United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 100

SEQ ID NO: 4232335 - DNA, 16 bp, Homo sapiens
ttaagtgacacagaca

SEQ ID NO: 4232336 - DNA, 17 bp, Homo sapiens
ttagaaaattttgtaaa

SEQ ID NO: 4232337 - DNA, 16 bp, Homo sapiens
ttagtactcaatgttt

SEQ ID NO: 4232338 - DNA, 15 bp, Homo sapiens
ttataaggttgtctg

SEQ ID NO: 4232339 - DNA, 15 bp, Homo sapiens
ttatgatctaataaa

SEQ ID NO: 4232340 - DNA, 17 bp, Homo sapiens
ttatgatctaataaact

SEQ ID NO: 4232341 - DNA, 19 bp, Homo sapiens
ttatgatctaataaacttt

SEQ ID NO: 4232342 - DNA, 20 bp, Homo sapiens
ttatgatctaataaacttta

SEQ ID NO: 4232343 - DNA, 16 bp, Homo sapiens
ttatgtggaagaactg

SEQ ID NO: 4232344 - DNA, 19 bp, Homo sapiens
ttcaattggtggaattcct

SEQ ID NO: 4232345 - DNA, 16 bp, Homo sapiens
aataaaatattcactc

SEQ ID NO: 4232346 - DNA, 20 bp, Homo sapiens
aataaaatattcactctcca

SEQ ID NO: 4232347 - DNA, 19 bp, Homo sapiens
aataataagtgatgtgctg

SEQ ID NO: 4232348 - DNA, 12 bp, Homo sapiens
aataatgtactc

SEQ ID NO: 4232349 - DNA, 13 bp, Homo sapiens
aataatgtactca

SEQ ID NO: 4232350 - DNA, 14 bp, Homo sapiens
aataatgtactcac

SEQ ID NO: 4232351 - DNA, 17 bp, Homo sapiens
aataatgtactcacata

SEQ ID NO: 4232352 - DNA, 11 bp, Homo sapiens
aatattcactc

SEQ ID NO: 4232353 - DNA, 13 bp, Homo sapiens
aatattcactctc

SEQ ID NO: 4232354 - DNA, 21 bp, Homo sapiens
aatgccatgaacaaattcttt

SEQ ID NO: 4232355 - DNA, 13 bp, Homo sapiens
aatgtttctggac

SEQ ID NO: 4232356 - DNA, 15 bp, Homo sapiens
aatgtttctggacat

SEQ ID NO: 4232357 - DNA, 16 bp, Homo sapiens
aatgtttctggacatt

SEQ ID NO: 4232358 - DNA, 19 bp, Homo sapiens
aatgtttctggacattctc

SEQ ID NO: 4232359 - DNA, 19 bp, Homo sapiens
aattcactccagtcaacag

SEQ ID NO: 4232360 - DNA, 24 bp, Homo sapiens
aattcactccagtcaacagattca

SEQ ID NO: 4232361 - DNA, 16 bp, Homo sapiens
aattctttagtactca

SEQ ID NO: 4232362 - DNA, 23 bp, Homo sapiens
aattgcatcagttcattgacctc

SEQ ID NO: 4232363 - DNA, 21 bp, Homo sapiens
aatttaagtgacacagacatt

SEQ ID NO: 4232364 - DNA, 20 bp, Homo sapiens
aattttatatcattggatga

SEQ ID NO: 4232365 - DNA, 15 bp, Homo sapiens
aattttgtaaaacaa

SEQ ID NO: 4232366 - DNA, 19 bp, Homo sapiens
aattttgtaaaacaatgcc

SEQ ID NO: 4232367 - DNA, 20 bp, Homo sapiens
aattttgtaaaacaatgcca

SEQ ID NO: 4232368 - DNA, 17 bp, Homo sapiens
acaaaggtggtaaattc

SEQ ID NO: 4232369 - DNA, 18 bp, Homo sapiens
acaaattctttagtactc

SEQ ID NO: 4232370 - DNA, 18 bp, Homo sapiens
acaacattatgatctaat

SEQ ID NO: 4232371 - DNA, 18 bp, Homo sapiens
acaagggctgcaatgccc

SEQ ID NO: 4232372 - DNA, 15 bp, Homo sapiens
acaataatgtactca

SEQ ID NO: 4232373 - DNA, 20 bp, Homo sapiens
acaatgccatgaacaaattc

SEQ ID NO: 4232374 - DNA, 22 bp, Homo sapiens
acaatgccatgaacaaattctt

SEQ ID NO: 4232375 - DNA, 12 bp, Homo sapiens
acacagacattt

SEQ ID NO: 4232376 - DNA, 16 bp, Homo sapiens
acacagacattttgtg

SEQ ID NO: 4232377 - DNA, 19 bp, Homo sapiens
acagacattttgtgtgaga

SEQ ID NO: 4232378 - DNA, 18 bp, Homo sapiens
acagattcagaatgagaa

SEQ ID NO: 4232379 - DNA, 12 bp, Homo sapiens
acagtacaataa

SEQ ID NO: 4232380 - DNA, 19 bp, Homo sapiens
acagtacaataatgtactc

SEQ ID NO: 4232381 - DNA, 21 bp, Homo sapiens
acataggcttcaattggtgga

SEQ ID NO: 4232382 - DNA, 14 bp, Homo sapiens
acatcagaaaataa

SEQ ID NO: 4232383 - DNA, 21 bp, Homo sapiens
acattatgatctaataaactt

SEQ ID NO: 4232384 - DNA, 14 bp, Homo sapiens
acattctctttgat

SEQ ID NO: 4232385 - DNA, 18 bp, Homo sapiens
acattctctttgataaca

SEQ ID NO: 4232386 - DNA, 13 bp, Homo sapiens
acgaccaaactca

SEQ ID NO: 4232387 - DNA, 13 bp, Homo sapiens
actattgagaaga

SEQ ID NO: 4232388 - DNA, 13 bp, Homo sapiens
actcaatgtttct

SEQ ID NO: 4232389 - DNA, 23 bp, Homo sapiens
actcaatgtttctggacattctc

SEQ ID NO: 4232390 - DNA, 17 bp, Homo sapiens
actcagttcaaaccatt

SEQ ID NO: 4232391 - DNA, 16 bp, Homo sapiens
actccagtcaacagat

SEQ ID NO: 4232392 - DNA, 14 bp, Homo sapiens
actctccattagaa

SEQ ID NO: 4232393 - DNA, 24 bp, Homo sapiens
acttaaaacatggtgcctatatct

SEQ ID NO: 4232394 - DNA, 15 bp, Homo sapiens
acttctgacaaaggt

SEQ ID NO: 4232395 - DNA, 23 bp, Homo sapiens
acttctgacaaaggtggtaaatt

SEQ ID NO: 4232396 - DNA, 20 bp, Homo sapiens
actttattttttaaaaatga

SEQ ID NO: 4232397 - DNA, 14 bp, Homo sapiens
agaaaataaaatat

SEQ ID NO: 4232398 - DNA, 16 bp, Homo sapiens
agaaaattttgtaaaa

SEQ ID NO: 4232399 - DNA, 16 bp, Homo sapiens
agaactgtgataaaaa

SEQ ID NO: 4232400 - DNA, 12 bp, Homo sapiens
agacaacattat

SEQ ID NO: 4232401 - DNA, 15 bp, Homo sapiens
agacaacattatgat

SEQ ID NO: 4232402 - DNA, 17 bp, Homo sapiens
agacattttgtgtgaga

SEQ ID NO: 4232403 - DNA, 20 bp, Homo sapiens
agacattttgtgtgagactt

SEQ ID NO: 4232404 - DNA, 15 bp, Homo sapiens
agacctgtgtgaact

SEQ ID NO: 4232405 - DNA, 16 bp, Homo sapiens
agacctgtgtgaacta

SEQ ID NO: 4232406 - DNA, 12 bp, Homo sapiens
agacttaaaaca

SEQ ID NO: 4232407 - DNA, 15 bp, Homo sapiens
agacttaaaacatgg

SEQ ID NO: 4232408 - DNA, 17 bp, Homo sapiens
agagacctgtgtgaact

SEQ ID NO: 4232409 - DNA, 19 bp, Homo sapiens
agagacctgtgtgaactat

SEQ ID NO: 4232410 - DNA, 21 bp, Homo sapiens
agagggctctgatctaacaaa

SEQ ID NO: 4232411 - DNA, 14 bp, Homo sapiens
agcagctgggaact

SEQ ID NO: 4232412 - DNA, 20 bp, Homo sapiens
agccaaactgtagatgaaga

SEQ ID NO: 4232413 - DNA, 19 bp, Homo sapiens
agctccttactctgaggaa

SEQ ID NO: 4232414 - DNA, 24 bp, Homo sapiens
aggagctttttagtttttcagctt

SEQ ID NO: 4232415 - DNA, 20 bp, Homo sapiens
agggctctgatctaacaaaa

SEQ ID NO: 4232416 - DNA, 22 bp, Homo sapiens
aggttatatgagtagatactct

SEQ ID NO: 4232417 - DNA, 14 bp, Homo sapiens
agtacaataatgta

SEQ ID NO: 4232418 - DNA, 20 bp, Homo sapiens
agtacaataatgtactcaca

SEQ ID NO: 4232419 - DNA, 21 bp, Homo sapiens
agtacaataatgtactcacat

SEQ ID NO: 4232420 - DNA, 13 bp, Homo sapiens
agtactcaatgtt

SEQ ID NO: 4232421 - DNA, 19 bp, Homo sapiens
agtactcaatgtttctgga

SEQ ID NO: 4232422 - DNA, 17 bp, Homo sapiens
agtagatactctcagca

SEQ ID NO: 4232423 - DNA, 13 bp, Homo sapiens
agtcaacagattc

SEQ ID NO: 4232424 - DNA, 14 bp, Homo sapiens
agtgaagaatacat

SEQ ID NO: 4232425 - DNA, 19 bp, Homo sapiens
agtgaagaatacatcagaa

SEQ ID NO: 4232426 - DNA, 14 bp, Homo sapiens
agtgacacagacat

SEQ ID NO: 4232427 - DNA, 23 bp, Homo sapiens
agtgacacagacattttgtgtga

SEQ ID NO: 4232428 - DNA, 13 bp, Homo sapiens
agtgatgtgctga

SEQ ID NO: 4232429 - DNA, 19 bp, Homo sapiens
agtttctagaattttatat

SEQ ID NO: 4232430 - DNA, 14 bp, Homo sapiens
ataaaatattcact

SEQ ID NO: 4232431 - DNA, 17 bp, Homo sapiens
ataaaatattcactctc

SEQ ID NO: 4232432 - DNA, 18 bp, Homo sapiens
ataaaatattcactctcc

SEQ ID NO: 4232433 - DNA, 20 bp, Homo sapiens
ccatgcacagtacaataatg

SEQ ID NO: 4232434 - DNA, 22 bp, Homo sapiens
ccatgcacagtacaataatgta

SEQ ID NO: 4232435 - DNA, 14 bp, Homo sapiens
ccattagaaaattt

SEQ ID NO: 4232436 - DNA, 19 bp, Homo sapiens
ccattagaaaattttgtaa

SEQ ID NO: 4232437 - DNA, 15 bp, Homo sapiens
cccatgcacagtaca

SEQ ID NO: 4232438 - DNA, 13 bp, Homo sapiens
cctatatctgaga

SEQ ID NO: 4232439 - DNA, 22 bp, Homo sapiens
cctcatacccatgcacagtaca

SEQ ID NO: 4232440 - DNA, 14 bp, Homo sapiens
ccttactctgagga

SEQ ID NO: 4232441 - DNA, 15 bp, Homo sapiens
ccttactctgaggaa

SEQ ID NO: 4232442 - DNA, 12 bp, Homo sapiens
ctaataaacttt

SEQ ID NO: 4232443 - DNA, 21 bp, Homo sapiens
ctactttgcccctttcagtat

SEQ ID NO: 4232444 - DNA, 22 bp, Homo sapiens
ctcacatataacatgcaaacag

SEQ ID NO: 4232445 - DNA, 16 bp, Homo sapiens
ctcagcaccaagagca

SEQ ID NO: 4232446 - DNA, 21 bp, Homo sapiens
ctcatacccatgcacagtaca

SEQ ID NO: 4232447 - DNA, 22 bp, Homo sapiens
ctcatcattaataagtgaagaa

SEQ ID NO: 4232448 - DNA, 13 bp, Homo sapiens
ctccagtcaacag

SEQ ID NO: 4232449 - DNA, 21 bp, Homo sapiens
ctccattagaaaattttgtaa

SEQ ID NO: 4232450 - DNA, 17 bp, Homo sapiens
ctctgatctaacaaaat

SEQ ID NO: 4232451 - DNA, 19 bp, Homo sapiens
ctctgatctaacaaaataa

SEQ ID NO: 4232452 - DNA, 13 bp, Homo sapiens
ctctttgataaca

SEQ ID NO: 4232453 - DNA, 12 bp, Homo sapiens
ctgaattcactc

SEQ ID NO: 4232454 - DNA, 16 bp, Homo sapiens
ctgacaaaggtggtaa

SEQ ID NO: 4232455 - DNA, 22 bp, Homo sapiens
ctgacaaaggtggtaaattcag

SEQ ID NO: 4232456 - DNA, 15 bp, Homo sapiens
ctgagagacctgtgt

SEQ ID NO: 4232457 - DNA, 13 bp, Homo sapiens
ctgatctaacaaa

SEQ ID NO: 4232458 - DNA, 14 bp, Homo sapiens
ctgatctaacaaaa

SEQ ID NO: 4232459 - DNA, 18 bp, Homo sapiens
ctgatctaacaaaataag

SEQ ID NO: 4232460 - DNA, 19 bp, Homo sapiens
ctgatctaacaaaataagg

SEQ ID NO: 4232461 - DNA, 14 bp, Homo sapiens
ctggacattctctt

SEQ ID NO: 4232462 - DNA, 15 bp, Homo sapiens
ctgtagatgaagagg

SEQ ID NO: 4232463 - DNA, 23 bp, Homo sapiens
ctgtttttttttttttaaataat

SEQ ID NO: 4232464 - DNA, 13 bp, Homo sapiens
cttctgacaaagg

SEQ ID NO: 4232465 - DNA, 20 bp, Homo sapiens
cttctgacaaaggtggtaaa

SEQ ID NO: 4232466 - DNA, 21 bp, Homo sapiens
cttctgacaaaggtggtaaat

SEQ ID NO: 4232467 - DNA, 19 bp, Homo sapiens
ctttattttttaaaaatga

SEQ ID NO: 4232468 - DNA, 14 bp, Homo sapiens
ctttgataacaaaa

SEQ ID NO: 4232469 - DNA, 18 bp, Homo sapiens
ctttgataacaaaaaata

SEQ ID NO: 4232470 - DNA, 23 bp, Homo sapiens
gaaaattttgtaaaacaatgcca

SEQ ID NO: 4232471 - DNA, 21 bp, Homo sapiens
gaacaaattctttagtactca

SEQ ID NO: 4232472 - DNA, 22 bp, Homo sapiens
gaacaaattctttagtactcaa

SEQ ID NO: 4232473 - DNA, 23 bp, Homo sapiens
acagtacaataatgtactcacat

SEQ ID NO: 4232474 - DNA, 20 bp, Homo sapiens
acataggcttcaattggtgg

SEQ ID NO: 4232475 - DNA, 14 bp, Homo sapiens
acatataacatgca

SEQ ID NO: 4232476 - DNA, 17 bp, Homo sapiens
acatcagaaaataaaat

SEQ ID NO: 4232477 - DNA, 23 bp, Homo sapiens
acatggtgcctatatctgagaga

SEQ ID NO: 4232478 - DNA, 13 bp, Homo sapiens
acattatgatcta

SEQ ID NO: 4232479 - DNA, 20 bp, Homo sapiens
acattatgatctaataaact

SEQ ID NO: 4232480 - DNA, 22 bp, Homo sapiens
acattatgatctaataaacttt

SEQ ID NO: 4232481 - DNA, 19 bp, Homo sapiens
acattctctttgataacaa

SEQ ID NO: 4232482 - DNA, 22 bp, Homo sapiens
acattctctttgataacaaaaa

SEQ ID NO: 4232483 - DNA, 15 bp, Homo sapiens
accactgaattcact

SEQ ID NO: 4232484 - DNA, 21 bp, Homo sapiens
accactgaattcactccagtc

SEQ ID NO: 4232485 - DNA, 16 bp, Homo sapiens
acccatgcacagtaca

SEQ ID NO: 4232486 - DNA, 14 bp, Homo sapiens
acctcatcattaat

SEQ ID NO: 4232487 - DNA, 13 bp, Homo sapiens
acctgtgtgaact

SEQ ID NO: 4232488 - DNA, 14 bp, Homo sapiens
actcaatgtttctg

SEQ ID NO: 4232489 - DNA, 16 bp, Homo sapiens
actcaatgtttctgga

SEQ ID NO: 4232490 - DNA, 21 bp, Homo sapiens
actcaatgtttctggacattc

SEQ ID NO: 4232491 - DNA, 22 bp, Homo sapiens
actcaatgtttctggacattct

SEQ ID NO: 4232492 - DNA, 17 bp, Homo sapiens
actcacatataacatgc

SEQ ID NO: 4232493 - DNA, 15 bp, Homo sapiens
actccagtcaacaga

SEQ ID NO: 4232494 - DNA, 17 bp, Homo sapiens
actccagtcaacagatt

SEQ ID NO: 4232495 - DNA, 13 bp, Homo sapiens
actgaattcactc

SEQ ID NO: 4232496 - DNA, 16 bp, Homo sapiens
actgacataggcttca

SEQ ID NO: 4232497 - DNA, 16 bp, Homo sapiens
actgccatattgtgta

SEQ ID NO: 4232498 - DNA, 17 bp, Homo sapiens
actgccatattgtgtaa

SEQ ID NO: 4232499 - DNA, 19 bp, Homo sapiens
actgccatattgtgtaatt

SEQ ID NO: 4232500 - DNA, 20 bp, Homo sapiens
actgtgataaaaagaggagc

SEQ ID NO: 4232501 - DNA, 11 bp, Homo sapiens
acttaaaacat

SEQ ID NO: 4232502 - DNA, 13 bp, Homo sapiens
acttaaaacatgg

SEQ ID NO: 4232503 - DNA, 15 bp, Homo sapiens
acttaaaacatggtg

SEQ ID NO: 4232504 - DNA, 22 bp, Homo sapiens
acttctgacaaaggtggtaaat

SEQ ID NO: 4232505 - DNA, 15 bp, Homo sapiens
actttattttttaaa

SEQ ID NO: 4232506 - DNA, 15 bp, Homo sapiens
actttgcccctttca

SEQ ID NO: 4232507 - DNA, 13 bp, Homo sapiens
agaaaattttgta

SEQ ID NO: 4232508 - DNA, 14 bp, Homo sapiens
agaatgagaatgga

SEQ ID NO: 4232509 - DNA, 20 bp, Homo sapiens
agaattttatatcattggat

SEQ ID NO: 4232510 - DNA, 20 bp, Homo sapiens
agacaacattatgatctaat

SEQ ID NO: 4232511 - DNA, 22 bp, Homo sapiens
agacaacattatgatctaataa

SEQ ID NO: 4232512 - DNA, 22 bp, Homo sapiens
agacattttgtgtgagacttaa

SEQ ID NO: 4232513 - DNA, 17 bp, Homo sapiens
agacctgtgtgaactat

SEQ ID NO: 4232514 - DNA, 16 bp, Homo sapiens
agacttaaaacatggt

SEQ ID NO: 4232515 - DNA, 22 bp, Homo sapiens
agacttaaaacatggtgcctat

SEQ ID NO: 4232516 - DNA, 14 bp, Homo sapiens
agagacctgtgtga

SEQ ID NO: 4232517 - DNA, 19 bp, Homo sapiens
agataaacgaccaaactca

SEQ ID NO: 4232518 - DNA, 17 bp, Homo sapiens
agatcggaacagctcct

SEQ ID NO: 4232519 - DNA, 19 bp, Homo sapiens
agatttttattttgaaaaa

SEQ ID NO: 4232520 - DNA, 14 bp, Homo sapiens
agccaaactgtaga

SEQ ID NO: 4232521 - DNA, 13 bp, Homo sapiens
agccttatgtgga

SEQ ID NO: 4232522 - DNA, 16 bp, Homo sapiens
agctgggaactgacat

SEQ ID NO: 4232523 - DNA, 17 bp, Homo sapiens
agggctctgatctaaca

SEQ ID NO: 4232524 - DNA, 18 bp, Homo sapiens
aggtggtaaattcagaca

SEQ ID NO: 4232525 - DNA, 16 bp, Homo sapiens
agtacaataatgtact

SEQ ID NO: 4232526 - DNA, 17 bp, Homo sapiens
agtacaataatgtactc

SEQ ID NO: 4232527 - DNA, 18 bp, Homo sapiens
agtacaataatgtactca

SEQ ID NO: 4232528 - DNA, 19 bp, Homo sapiens
agtacaataatgtactcac

SEQ ID NO: 4232529 - DNA, 16 bp, Homo sapiens
agtactcaatgtttct

SEQ ID NO: 4232530 - DNA, 22 bp, Homo sapiens
agtactcaatgtttctggacat

SEQ ID NO: 4232531 - DNA, 16 bp, Homo sapiens
agtcaacagattcaga

SEQ ID NO: 4232532 - DNA, 16 bp, Homo sapiens
agtgacacagacattt

SEQ ID NO: 4232533 - DNA, 10 bp, Homo sapiens
agtgcagtga

SEQ ID NO: 4232534 - DNA, 15 bp, Homo sapiens
agttgacttctgaca

SEQ ID NO: 4232535 - DNA, 15 bp, Homo sapiens
ataaaatattcactc

SEQ ID NO: 4232536 - DNA, 14 bp, Homo sapiens
ataacaaaaaataa

SEQ ID NO: 4232537 - DNA, 17 bp, Homo sapiens
ataacaaaaaataaatt

SEQ ID NO: 4232538 - DNA, 19 bp, Homo sapiens
ataatgtactcacatataa

SEQ ID NO: 4232539 - DNA, 17 bp, Homo sapiens
ataattgcatcagttca

SEQ ID NO: 4232540 - DNA, 22 bp, Homo sapiens
ataattgcatcagttcattgac

SEQ ID NO: 4232541 - DNA, 15 bp, Homo sapiens
atactctcagcacca

SEQ ID NO: 4232542 - DNA, 14 bp, Homo sapiens
atataacatgcaaa

SEQ ID NO: 4232543 - DNA, 15 bp, Homo sapiens
atatctgagagacct

SEQ ID NO: 4232544 - DNA, 23 bp, Homo sapiens
atatctgagagacctgtgtgaac

SEQ ID NO: 4232545 - DNA, 19 bp, Homo sapiens
atatgagtagatactctca

SEQ ID NO: 4232546 - DNA, 22 bp, Homo sapiens
atctaataaactttatttttta

SEQ ID NO: 4232547 - DNA, 19 bp, Homo sapiens
atgaacaaattctttagta

SEQ ID NO: 4232548 - DNA, 20 bp, Homo sapiens
atgaacaaattctttagtac

SEQ ID NO: 4232549 - DNA, 14 bp, Homo sapiens
atgatctaataaac

SEQ ID NO: 4232550 - DNA, 15 bp, Homo sapiens
atgatctaataaact

SEQ ID NO: 4232551 - DNA, 17 bp, Homo sapiens
atgatctaataaacttt

SEQ ID NO: 4232552 - DNA, 18 bp, Homo sapiens
atgatctaataaacttta

SEQ ID NO: 4232553 - DNA, 18 bp, Homo sapiens
atgcacagtacaataatg

SEQ ID NO: 4232554 - DNA, 20 bp, Homo sapiens
atgcacagtacaataatgta

SEQ ID NO: 4232555 - DNA, 20 bp, Homo sapiens
atggtgcctatatctgagag

SEQ ID NO: 4232556 - DNA, 22 bp, Homo sapiens
atggtggtattgtgaccactga

SEQ ID NO: 4232557 - DNA, 16 bp, Homo sapiens
atgtactcacatataa

SEQ ID NO: 4232558 - DNA, 19 bp, Homo sapiens
atgtactcacatataacat

SEQ ID NO: 4232559 - DNA, 22 bp, Homo sapiens
atgtactcacatataacatgca

SEQ ID NO: 4232560 - DNA, 22 bp, Homo sapiens
atgtttctggacattctctttg

SEQ ID NO: 4232561 - DNA, 16 bp, Homo sapiens
attagaaaattttgta

SEQ ID NO: 4232562 - DNA, 23 bp, Homo sapiens
attagaaaattttgtaaaacaat

SEQ ID NO: 4232563 - DNA, 13 bp, Homo sapiens
attatgatctaat

SEQ ID NO: 4232564 - DNA, 22 bp, Homo sapiens
attatgatctaataaactttat

SEQ ID NO: 4232565 - DNA, 16 bp, Homo sapiens
attcactccagtcaac

SEQ ID NO: 4232566 - DNA, 11 bp, Homo sapiens
attcactctcc

SEQ ID NO: 4232567 - DNA, 16 bp, Homo sapiens
attcagaatgagaatg

SEQ ID NO: 4232568 - DNA, 13 bp, Homo sapiens
attcagacaacat

SEQ ID NO: 4232569 - DNA, 15 bp, Homo sapiens
attcagacaacatta

SEQ ID NO: 4232570 - DNA, 17 bp, Homo sapiens
attcagacaacattatg

SEQ ID NO: 4232571 - DNA, 18 bp, Homo sapiens
attcagacaacattatga

SEQ ID NO: 4232572 - DNA, 13 bp, Homo sapiens
attcctctttaac

SEQ ID NO: 4232573 - DNA, 13 bp, Homo sapiens
attctctttgata

SEQ ID NO: 4232574 - DNA, 17 bp, Homo sapiens
attctctttgataacaa

SEQ ID NO: 4232575 - DNA, 18 bp, Homo sapiens
attctctttgataacaaa

SEQ ID NO: 4232576 - DNA, 19 bp, Homo sapiens
attctctttgataacaaaa

SEQ ID NO: 4232577 - DNA, 15 bp, Homo sapiens
attgacctcatcatt

SEQ ID NO: 4232578 - DNA, 20 bp, Homo sapiens
attgacctcatcattaataa

SEQ ID NO: 4232579 - DNA, 21 bp, Homo sapiens
attggaagctttgagttgact

SEQ ID NO: 4232580 - DNA, 19 bp, Homo sapiens
attgtgaccactgaattca

SEQ ID NO: 4232581 - DNA, 17 bp, Homo sapiens
attgtgtaatttaagtg

SEQ ID NO: 4232582 - DNA, 18 bp, Homo sapiens
atttaagtgacacagaca

SEQ ID NO: 4232583 - DNA, 23 bp, Homo sapiens
atttgatggtggtattgtgacca

SEQ ID NO: 4232584 - DNA, 15 bp, Homo sapiens
attttatatcattgg

SEQ ID NO: 4232585 - DNA, 19 bp, Homo sapiens
caaaaaataaattttaaaa

SEQ ID NO: 4232586 - DNA, 22 bp, Homo sapiens
caaacactgccatattgtgtaa

SEQ ID NO: 4232587 - DNA, 19 bp, Homo sapiens
caaacaggttgttttctac

SEQ ID NO: 4232588 - DNA, 14 bp, Homo sapiens
caaaccatttcagc

SEQ ID NO: 4232589 - DNA, 21 bp, Homo sapiens
caaaggtggtaaattcagaca

SEQ ID NO: 4232590 - DNA, 13 bp, Homo sapiens
caacagattcaga

SEQ ID NO: 4232591 - DNA, 18 bp, Homo sapiens
caacattatgatctaata

SEQ ID NO: 4232592 - DNA, 18 bp, Homo sapiens
caagagcagctgggaact

SEQ ID NO: 4232593 - DNA, 14 bp, Homo sapiens
gtgacacagacatt

SEQ ID NO: 4232594 - DNA, 15 bp, Homo sapiens
gtgacacagacattt

SEQ ID NO: 4232595 - DNA, 18 bp, Homo sapiens
gtgaccactgaattcact

SEQ ID NO: 4232596 - DNA, 21 bp, Homo sapiens
gtgaccactgaattcactcca

SEQ ID NO: 4232597 - DNA, 16 bp, Homo sapiens
gtgagacttaaaacat

SEQ ID NO: 4232598 - DNA, 18 bp, Homo sapiens
gtgcctatatctgagaga

SEQ ID NO: 4232599 - DNA, 23 bp, Homo sapiens
gtgcctatatctgagagacctgt

SEQ ID NO: 4232600 - DNA, 21 bp, Homo sapiens
gtggaattcctctttaacaag

SEQ ID NO: 4232601 - DNA, 18 bp, Homo sapiens
gtgtgagacttaaaacat

SEQ ID NO: 4232602 - DNA, 20 bp, Homo sapiens
gtgtgagacttaaaacatgg

SEQ ID NO: 4232603 - DNA, 17 bp, Homo sapiens
gtgtgcaagggcagtga

SEQ ID NO: 4232604 - DNA, 18 bp, Homo sapiens
gtttctagaattttatat

SEQ ID NO: 4232605 - DNA, 13 bp, Homo sapiens
gttttctactttg

SEQ ID NO: 4232606 - DNA, 21 bp, Homo sapiens
gtttttttttttttaaataat

SEQ ID NO: 4232607 - DNA, 19 bp, Homo sapiens
taaaaaggaattttgtaaa

SEQ ID NO: 4232608 - DNA, 13 bp, Homo sapiens
taaaacaatgcca

SEQ ID NO: 4232609 - DNA, 17 bp, Homo sapiens
taaaacatggtgcctat

SEQ ID NO: 4232610 - DNA, 23 bp, Homo sapiens
taaaacatggtgcctatatctga

SEQ ID NO: 4232611 - DNA, 16 bp, Homo sapiens
taaaatattcactctc

SEQ ID NO: 4232612 - DNA, 19 bp, Homo sapiens
taaaatattcactctccat

SEQ ID NO: 4232613 - DNA, 20 bp, Homo sapiens
taaagtttctagaattttat

SEQ ID NO: 4232614 - DNA, 12 bp, Homo sapiens
taaattcagaca

SEQ ID NO: 4232615 - DNA, 17 bp, Homo sapiens
taaattcagacaacatt

SEQ ID NO: 4232616 - DNA, 24 bp, Homo sapiens
taacaaaataaggttatatgagta

SEQ ID NO: 4232617 - DNA, 17 bp, Homo sapiens
taacttttctttttccc

SEQ ID NO: 4232618 - DNA, 14 bp, Homo sapiens
taagacaaacactg

SEQ ID NO: 4232619 - DNA, 16 bp, Homo sapiens
taagacaaacactgcc

SEQ ID NO: 4232620 - DNA, 17 bp, Homo sapiens
taagacaaacactgcca

SEQ ID NO: 4232621 - DNA, 21 bp, Homo sapiens
taagtgaagaatacatcagaa

SEQ ID NO: 4232622 - DNA, 13 bp, Homo sapiens
taataaactttat

SEQ ID NO: 4232623 - DNA, 21 bp, Homo sapiens
taataagtgaagaatacatca

SEQ ID NO: 4232624 - DNA, 13 bp, Homo sapiens
taattgcatcagt

SEQ ID NO: 4232625 - DNA, 13 bp, Homo sapiens
taatttaagtgac

SEQ ID NO: 4232626 - DNA, 17 bp, Homo sapiens
tacatcagaaaataaaa

SEQ ID NO: 4232627 - DNA, 22 bp, Homo sapiens
tactcaatgtttctggacattc

SEQ ID NO: 4232628 - DNA, 16 bp, Homo sapiens
tactttgcccctttca

SEQ ID NO: 4232629 - DNA, 14 bp, Homo sapiens
tagaaaattttgta

SEQ ID NO: 4232630 - DNA, 15 bp, Homo sapiens
tagaaaattttgtaa

SEQ ID NO: 4232631 - DNA, 21 bp, Homo sapiens
tataaataaaatcatgtagtt

SEQ ID NO: 4232632 - DNA, 14 bp, Homo sapiens
tataaggttgtctg

SEQ ID NO: 4232633 - DNA, 18 bp, Homo sapiens
tatgatctaataaacttt

SEQ ID NO: 4232634 - DNA, 19 bp, Homo sapiens
tatgatctaataaacttta

SEQ ID NO: 4232635 - DNA, 22 bp, Homo sapiens
tatgtccccataagacaaacac

SEQ ID NO: 4232636 - DNA, 23 bp, Homo sapiens
tatgtccccataagacaaacact

SEQ ID NO: 4232637 - DNA, 16 bp, Homo sapiens
tattgtgtaatttaag

SEQ ID NO: 4232638 - DNA, 20 bp, Homo sapiens
tattgtgtaatttaagtgac

SEQ ID NO: 4232639 - DNA, 21 bp, Homo sapiens
tcaacagattcagaatgagaa

SEQ ID NO: 4232640 - DNA, 13 bp, Homo sapiens
tcaatgtttctgg

SEQ ID NO: 4232641 - DNA, 17 bp, Homo sapiens
tcaatgtttctggacat

SEQ ID NO: 4232642 - DNA, 24 bp, Homo sapiens
tcaatgtttctggacattctcttt

SEQ ID NO: 4232643 - DNA, 16 bp, Homo sapiens
tcacatataacatgca

SEQ ID NO: 4232644 - DNA, 17 bp, Homo sapiens
tcactccagtcaacaga

SEQ ID NO: 4232645 - DNA, 12 bp, Homo sapiens
tcagacaacatt

SEQ ID NO: 4232646 - DNA, 23 bp, Homo sapiens
tcagacaacattatgatctaata

SEQ ID NO: 4232647 - DNA, 19 bp, Homo sapiens
tcagcaccaagagcagctg

SEQ ID NO: 4232648 - DNA, 22 bp, Homo sapiens
tcagccttatgtggaagaactg

SEQ ID NO: 4232649 - DNA, 20 bp, Homo sapiens
tcatacccatgcacagtaca

SEQ ID NO: 4232650 - DNA, 22 bp, Homo sapiens
tcatacccatgcacagtacaat

SEQ ID NO: 4232651 - DNA, 18 bp, Homo sapiens
tcatcattaataagtgaa

SEQ ID NO: 4232652 - DNA, 15 bp, Homo sapiens
tccagtcaacagatt

SEQ ID NO: 4232653 - DNA, 19 bp, Homo sapiens
tccccataagacaaacact

SEQ ID NO: 4232654 - DNA, 12 bp, Homo sapiens
tcggaacagctc

SEQ ID NO: 4232655 - DNA, 12 bp, Homo sapiens
tctaataaactt

SEQ ID NO: 4232656 - DNA, 15 bp, Homo sapiens
tctactttgcccctt

SEQ ID NO: 4232657 - DNA, 23 bp, Homo sapiens
tctccattagaaaattttgtaaa

SEQ ID NO: 4232658 - DNA, 19 bp, Homo sapiens
tctgagagacctgtgtgaa

SEQ ID NO: 4232659 - DNA, 18 bp, Homo sapiens
tctgatctaacaaaataa

SEQ ID NO: 4232660 - DNA, 19 bp, Homo sapiens
tctgatctaacaaaataag

SEQ ID NO: 4232661 - DNA, 21 bp, Homo sapiens
tctggacattctctttgataa

SEQ ID NO: 4232662 - DNA, 13 bp, Homo sapiens
tctttagtactca

SEQ ID NO: 4232663 - DNA, 16 bp, Homo sapiens
tctttgataacaaaaa

SEQ ID NO: 4232664 - DNA, 22 bp, Homo sapiens
tgaacaaattctttagtactca

SEQ ID NO: 4232665 - DNA, 20 bp, Homo sapiens
tgaagaatacatcagaaaat

SEQ ID NO: 4232666 - DNA, 13 bp, Homo sapiens
tgaattcactcca

SEQ ID NO: 4232667 - DNA, 17 bp, Homo sapiens
tgaattcactccagtca

SEQ ID NO: 4232668 - DNA, 19 bp, Homo sapiens
tgaattttataaataaaat

SEQ ID NO: 4232669 - DNA, 19 bp, Homo sapiens
tgacaaaggtggtaaattc

SEQ ID NO: 4232670 - DNA, 17 bp, Homo sapiens
tgacacagacattttgt

SEQ ID NO: 4232671 - DNA, 18 bp, Homo sapiens
tgacacagacattttgtg

SEQ ID NO: 4232672 - DNA, 21 bp, Homo sapiens
tgacacagacattttgtgtga

SEQ ID NO: 4232673 - DNA, 22 bp, Homo sapiens
tgacacagacattttgtgtgag

SEQ ID NO: 4232674 - DNA, 17 bp, Homo sapiens
tgaccactgaattcact

SEQ ID NO: 4232675 - DNA, 22 bp, Homo sapiens
tgacctcatcattaataagtga

SEQ ID NO: 4232676 - DNA, 14 bp, Homo sapiens
tgacttctgacaaa

SEQ ID NO: 4232677 - DNA, 18 bp, Homo sapiens
tgagaagatcggaacagc

SEQ ID NO: 4232678 - DNA, 20 bp, Homo sapiens
tgagaagatcggaacagctc

SEQ ID NO: 4232679 - DNA, 18 bp, Homo sapiens
tgagacttaaaacatggt

SEQ ID NO: 4232680 - DNA, 16 bp, Homo sapiens
tgagagacctgtgtga

SEQ ID NO: 4232681 - DNA, 17 bp, Homo sapiens
tgagttgacttctgaca

SEQ ID NO: 4232682 - DNA, 12 bp, Homo sapiens
tgatctaataaa

SEQ ID NO: 4232683 - DNA, 17 bp, Homo sapiens
tgatctaataaacttta

SEQ ID NO: 4232684 - DNA, 22 bp, Homo sapiens
tgcaaacaggttgttttctact

SEQ ID NO: 4232685 - DNA, 12 bp, Homo sapiens
tgcaatgccctc

SEQ ID NO: 4232686 - DNA, 19 bp, Homo sapiens
tgcacagtacaataatgta

SEQ ID NO: 4232687 - DNA, 13 bp, Homo sapiens
tgccatgaacaaa

SEQ ID NO: 4232688 - DNA, 18 bp, Homo sapiens
tgccatgaacaaattctt

SEQ ID NO: 4232689 - DNA, 18 bp, Homo sapiens
tggaagaactgtgataaa

SEQ ID NO: 4232690 - DNA, 20 bp, Homo sapiens
tggaattcctctttaacaag

SEQ ID NO: 4232691 - DNA, 17 bp, Homo sapiens
tggacattctctttgat

SEQ ID NO: 4232692 - DNA, 21 bp, Homo sapiens
tggtaaattcagacaacatta

SEQ ID NO: 4232693 - DNA, 22 bp, Homo sapiens
tggtaaattcagacaacattat

SEQ ID NO: 4232694 - DNA, 18 bp, Homo sapiens
tggtgcctatatctgaga

SEQ ID NO: 4232695 - DNA, 23 bp, Homo sapiens
tgtaaaacaatgccatgaacaaa

SEQ ID NO: 4232696 - DNA, 16 bp, Homo sapiens
tgtaaagtttctagaa

SEQ ID NO: 4232697 - DNA, 11 bp, Homo sapiens
tgtactcacat

SEQ ID NO: 4232698 - DNA, 17 bp, Homo sapiens
tgtactcacatataaca

SEQ ID NO: 4232699 - DNA, 20 bp, Homo sapiens
tgtactcacatataacatgc

SEQ ID NO: 4232700 - DNA, 13 bp, Homo sapiens
tgtgaccactgaa

SEQ ID NO: 4232701 - DNA, 22 bp, Homo sapiens
tgtgaccactgaattcactcca

SEQ ID NO: 4232702 - DNA, 19 bp, Homo sapiens
tgtgagacttaaaacatgg

SEQ ID NO: 4232703 - DNA, 16 bp, Homo sapiens
tgtgtaatttaagtga

SEQ ID NO: 4232704 - DNA, 22 bp, Homo sapiens
tgtgtaatttaagtgacacaga

SEQ ID NO: 4232705 - DNA, 21 bp, Homo sapiens
tgtgtgagacttaaaacatgg

SEQ ID NO: 4232706 - DNA, 19 bp, Homo sapiens
tgtttctggacattctctt

SEQ ID NO: 4232707 - DNA, 13 bp, Homo sapiens
tgttttttccttt

SEQ ID NO: 4232708 - DNA, 16 bp, Homo sapiens
ttaaaaaggaattttg

SEQ ID NO: 4232709 - DNA, 18 bp, Homo sapiens
ttaaaaaggaattttgta

SEQ ID NO: 4232710 - DNA, 18 bp, Homo sapiens
ttaaaacatggtgcctat

SEQ ID NO: 4232711 - DNA, 18 bp, Homo sapiens
ttaagtgacacagacatt

SEQ ID NO: 4232712 - DNA, 12 bp, Homo sapiens
aaattcagacaa

SEQ ID NO: 4232713 - DNA, 13 bp, Homo sapiens
aaattcagacaac

SEQ ID NO: 4232714 - DNA, 16 bp, Homo sapiens
aaattttgtaaaacaa

SEQ ID NO: 4232715 - DNA, 13 bp, Homo sapiens
aacaaaaaataaa

SEQ ID NO: 4232716 - DNA, 22 bp, Homo sapiens
aacaaaaaataaattttaaaaa

SEQ ID NO: 4232717 - DNA, 19 bp, Homo sapiens
aacaaattctttagtactc

SEQ ID NO: 4232718 - DNA, 17 bp, Homo sapiens
aacaagggctgcaatgc

SEQ ID NO: 4232719 - DNA, 23 bp, Homo sapiens
aacaatgccatgaacaaattctt

SEQ ID NO: 4232720 - DNA, 19 bp, Homo sapiens
aacaggttgttttctactt

SEQ ID NO: 4232721 - DNA, 14 bp, Homo sapiens
aacatggtgcctat

SEQ ID NO: 4232722 - DNA, 21 bp, Homo sapiens
aacatggtgcctatatctgag

SEQ ID NO: 4232723 - DNA, 17 bp, Homo sapiens
aacattatgatctaata

SEQ ID NO: 4232724 - DNA, 18 bp, Homo sapiens
aacattatgatctaataa

SEQ ID NO: 4232725 - DNA, 22 bp, Homo sapiens
aacattatgatctaataaactt

SEQ ID NO: 4232726 - DNA, 15 bp, Homo sapiens
aactcagttcaaacc

SEQ ID NO: 4232727 - DNA, 19 bp, Homo sapiens
aactcagttcaaaccattt

SEQ ID NO: 4232728 - DNA, 14 bp, Homo sapiens
aactgtagatgaag

SEQ ID NO: 4232729 - DNA, 13 bp, Homo sapiens
aactgtgataaaa

SEQ ID NO: 4232730 - DNA, 14 bp, Homo sapiens
aactgtgataaaaa

SEQ ID NO: 4232731 - DNA, 13 bp, Homo sapiens
aagaatacatcag

SEQ ID NO: 4232732 - DNA, 18 bp, Homo sapiens
aagaatacatcagaaaat

SEQ ID NO: 4232733 - DNA, 22 bp, Homo sapiens
aagacaaacactgccatattgt

SEQ ID NO: 4232734 - DNA, 17 bp, Homo sapiens
aagagataaacgaccaa

SEQ ID NO: 4232735 - DNA, 15 bp, Homo sapiens
aagatcggaacagct

SEQ ID NO: 4232736 - DNA, 15 bp, Homo sapiens
aagctattgtctgta

SEQ ID NO: 4232737 - DNA, 17 bp, Homo sapiens
aaggtggtaaattcaga

SEQ ID NO: 4232738 - DNA, 19 bp, Homo sapiens
aaggtggtaaattcagaca

SEQ ID NO: 4232739 - DNA, 14 bp, Homo sapiens
aagtgacacagaca

SEQ ID NO: 4232740 - DNA, 15 bp, Homo sapiens
aagtgacacagacat

SEQ ID NO: 4232741 - DNA, 22 bp, Homo sapiens
atgcacagtacaataatgtact

SEQ ID NO: 4232742 - DNA, 13 bp, Homo sapiens
atgccatgaacaa

SEQ ID NO: 4232743 - DNA, 15 bp, Homo sapiens
atgccatgaacaaat

SEQ ID NO: 4232744 - DNA, 19 bp, Homo sapiens
atggtgcctatatctgaga

SEQ ID NO: 4232745 - DNA, 21 bp, Homo sapiens
atgtttctggacattctcttt

SEQ ID NO: 4232746 - DNA, 17 bp, Homo sapiens
attaataagtgaagaat

SEQ ID NO: 4232747 - DNA, 22 bp, Homo sapiens
attagaaaattttgtaaaacaa

SEQ ID NO: 4232748 - DNA, 12 bp, Homo sapiens
attatgatctaa

SEQ ID NO: 4232749 - DNA, 19 bp, Homo sapiens
attcactccagtcaacaga

SEQ ID NO: 4232750 - DNA, 15 bp, Homo sapiens
attcactctccatta

SEQ ID NO: 4232751 - DNA, 12 bp, Homo sapiens
attcctctttaa

SEQ ID NO: 4232752 - DNA, 18 bp, Homo sapiens
attcttatttgatggtgg

SEQ ID NO: 4232753 - DNA, 15 bp, Homo sapiens
attctttagtactca

SEQ ID NO: 4232754 - DNA, 16 bp, Homo sapiens
attgtgaccactgaat

SEQ ID NO: 4232755 - DNA, 17 bp, Homo sapiens
attgtgaccactgaatt

SEQ ID NO: 4232756 - DNA, 21 bp, Homo sapiens
attgtgaccactgaattcact

SEQ ID NO: 4232757 - DNA, 22 bp, Homo sapiens
attgtgaccactgaattcactc

SEQ ID NO: 4232758 - DNA, 23 bp, Homo sapiens
attgtgaccactgaattcactcc

SEQ ID NO: 4232759 - DNA, 17 bp, Homo sapiens
atttaagtgacacagac

SEQ ID NO: 4232760 - DNA, 19 bp, Homo sapiens
atttaagtgacacagacat

SEQ ID NO: 4232761 - DNA, 23 bp, Homo sapiens
atttaagtgacacagacattttg

SEQ ID NO: 4232762 - DNA, 19 bp, Homo sapiens
attttgtaaaacaatgcca

SEQ ID NO: 4232763 - DNA, 13 bp, Homo sapiens
attttgtgtgaga

SEQ ID NO: 4232764 - DNA, 16 bp, Homo sapiens
attttgtgtgagactt

SEQ ID NO: 4232765 - DNA, 22 bp, Homo sapiens
attttgtgtgagacttaaaaca

SEQ ID NO: 4232766 - DNA, 11 bp, Homo sapiens
caaacactgcc

SEQ ID NO: 4232767 - DNA, 15 bp, Homo sapiens
caaacactgccatat

SEQ ID NO: 4232768 - DNA, 21 bp, Homo sapiens
caaacactgccatattgtgta

SEQ ID NO: 4232769 - DNA, 16 bp, Homo sapiens
caaaggtggtaaattc

SEQ ID NO: 4232770 - DNA, 22 bp, Homo sapiens
caaaggtggtaaattcagacaa

SEQ ID NO: 4232771 - DNA, 13 bp, Homo sapiens
caaattctttagt

SEQ ID NO: 4232772 - DNA, 19 bp, Homo sapiens
caacagattcagaatgaga

SEQ ID NO: 4232773 - DNA, 20 bp, Homo sapiens
caacagattcagaatgagaa

SEQ ID NO: 4232774 - DNA, 22 bp, Homo sapiens
caacattatgatctaataaact

SEQ ID NO: 4232775 - DNA, 14 bp, Homo sapiens
caataatgtactca

SEQ ID NO: 4232776 - DNA, 14 bp, Homo sapiens
caatgccatgaaca

SEQ ID NO: 4232777 - DNA, 21 bp, Homo sapiens
caatgccatgaacaaattctt

SEQ ID NO: 4232778 - DNA, 22 bp, Homo sapiens
caattggtggaattcctcttta

SEQ ID NO: 4232779 - DNA, 19 bp, Homo sapiens
cacagacattttgtgtgag

SEQ ID NO: 4232780 - DNA, 18 bp, Homo sapiens
cacagtacaataatgtac

SEQ ID NO: 4232781 - DNA, 21 bp, Homo sapiens
cacagtacaataatgtactca

SEQ ID NO: 4232782 - DNA, 12 bp, Homo sapiens
cacatataacat

SEQ ID NO: 4232783 - DNA, 14 bp, Homo sapiens
cacatataacatgc

SEQ ID NO: 4232784 - DNA, 17 bp, Homo sapiens
cactgaattcactccag

SEQ ID NO: 4232785 - DNA, 18 bp, Homo sapiens
cactgaattcactccagt

SEQ ID NO: 4232786 - DNA, 13 bp, Homo sapiens
cactgccatattg

SEQ ID NO: 4232787 - DNA, 17 bp, Homo sapiens
cagacattttgtgtgag

SEQ ID NO: 4232788 - DNA, 20 bp, Homo sapiens
cagacattttgtgtgagact

SEQ ID NO: 4232789 - DNA, 19 bp, Homo sapiens
cagatggaagagataaacg

SEQ ID NO: 4232790 - DNA, 17 bp, Homo sapiens
cagattcagaatgagaa

SEQ ID NO: 4232791 - DNA, 22 bp, Homo sapiens
cagcaccaagagcagctgggaa

SEQ ID NO: 4232792 - DNA, 21 bp, Homo sapiens
cagccaaactgtagatgaaga

SEQ ID NO: 4232793 - DNA, 12 bp, Homo sapiens
cagtacaataat

SEQ ID NO: 4232794 - DNA, 15 bp, Homo sapiens
cagtacaataatgta

SEQ ID NO: 4232795 - DNA, 22 bp, Homo sapiens
cagtacaataatgtactcacat

SEQ ID NO: 4232796 - DNA, 16 bp, Homo sapiens
cagtcaacagattcag

SEQ ID NO: 4232797 - DNA, 19 bp, Homo sapiens
cagttcattgacctcatca

SEQ ID NO: 4232798 - DNA, 13 bp, Homo sapiens
cataagacaaaca

SEQ ID NO: 4232799 - DNA, 19 bp, Homo sapiens
cataagacaaacactgcca

SEQ ID NO: 4232800 - DNA, 20 bp, Homo sapiens
cataagacaaacactgccat

SEQ ID NO: 4232801 - DNA, 21 bp, Homo sapiens
catataacatgcaaacaggtt

SEQ ID NO: 4232802 - DNA, 14 bp, Homo sapiens
catcagaaaataaa

SEQ ID NO: 4232803 - DNA, 17 bp, Homo sapiens
catcagaaaataaaata

SEQ ID NO: 4232804 - DNA, 16 bp, Homo sapiens
catcattaataagtga

SEQ ID NO: 4232805 - DNA, 21 bp, Homo sapiens
catgcacagtacaataatgta

SEQ ID NO: 4232806 - DNA, 12 bp, Homo sapiens
catggtgcctat

SEQ ID NO: 4232807 - DNA, 21 bp, Homo sapiens
catggtgcctatatctgagag

SEQ ID NO: 4232808 - DNA, 21 bp, Homo sapiens
cattaataagtgaagaataca

SEQ ID NO: 4232809 - DNA, 19 bp, Homo sapiens
cattagaaaattttgtaaa

SEQ ID NO: 4232810 - DNA, 11 bp, Homo sapiens
cattatgatct

SEQ ID NO: 4232811 - DNA, 13 bp, Homo sapiens
cattatgatctaa

SEQ ID NO: 4232812 - DNA, 18 bp, Homo sapiens
cattatgatctaataaac

SEQ ID NO: 4232813 - DNA, 19 bp, Homo sapiens
cattatgatctaataaact

SEQ ID NO: 4232814 - DNA, 15 bp, Homo sapiens
cattctctttgataa

SEQ ID NO: 4232815 - DNA, 20 bp, Homo sapiens
catttcagccaaactgtaga

SEQ ID NO: 4232816 - DNA, 14 bp, Homo sapiens
ccaaactcagttca

SEQ ID NO: 4232817 - DNA, 14 bp, Homo sapiens
ccactgaattcact

SEQ ID NO: 4232818 - DNA, 18 bp, Homo sapiens
ccactgaattcactccag

SEQ ID NO: 4232819 - DNA, 24 bp, Homo sapiens
ccactgaattcactccagtcaaca

SEQ ID NO: 4232820 - DNA, 16 bp, Homo sapiens
ccagtcaacagattca

SEQ ID NO: 4232821 - DNA, 12 bp, Homo sapiens
ccatattgtgta

SEQ ID NO: 4232822 - DNA, 18 bp, Homo sapiens
ccatgaacaaattcttta

SEQ ID NO: 4232823 - DNA, 13 bp, Homo sapiens
aaaaaaatgaata

SEQ ID NO: 4232824 - DNA, 13 bp, Homo sapiens
aaaataaaatatt

SEQ ID NO: 4232825 - DNA, 15 bp, Homo sapiens
aaaataaaatattca

SEQ ID NO: 4232826 - DNA, 23 bp, Homo sapiens
aaaatattcactctccattagaa

SEQ ID NO: 4232827 - DNA, 15 bp, Homo sapiens
aaaatgagagctgta

SEQ ID NO: 4232828 - DNA, 18 bp, Homo sapiens
aaaattttgtaaaacaat

SEQ ID NO: 4232829 - DNA, 23 bp, Homo sapiens
aaaattttgtaaaacaatgccat

SEQ ID NO: 4232830 - DNA, 20 bp, Homo sapiens
aaacaatgccatgaacaaat

SEQ ID NO: 4232831 - DNA, 13 bp, Homo sapiens
aaacactgccata

SEQ ID NO: 4232832 - DNA, 22 bp, Homo sapiens
aaacactgccatattgtgtaat

SEQ ID NO: 4232833 - DNA, 15 bp, Homo sapiens
aaacatggtgcctat

SEQ ID NO: 4232834 - DNA, 12 bp, Homo sapiens
aaactttatttt

SEQ ID NO: 4232835 - DNA, 16 bp, Homo sapiens
aaaggtggtaaattca

SEQ ID NO: 4232836 - DNA, 14 bp, Homo sapiens
aaataaattttaaa

SEQ ID NO: 4232837 - DNA, 9 bp, Homo sapiens
aaataattg

SEQ ID NO: 4232838 - DNA, 16 bp, Homo sapiens
aaattcagacaacatt

SEQ ID NO: 4232839 - DNA, 18 bp, Homo sapiens
aaattcagacaacattat

SEQ ID NO: 4232840 - DNA, 21 bp, Homo sapiens
aaattcagacaacattatgat

SEQ ID NO: 4232841 - DNA, 23 bp, Homo sapiens
aaattcagacaacattatgatct

SEQ ID NO: 4232842 - DNA, 16 bp, Homo sapiens
aaattctttagtactc

SEQ ID NO: 4232843 - DNA, 23 bp, Homo sapiens
aaattctttagtactcaatgttt

SEQ ID NO: 4232844 - DNA, 14 bp, Homo sapiens
aacaaattctttag

SEQ ID NO: 4232845 - DNA, 15 bp, Homo sapiens
aacaaattctttagt

SEQ ID NO: 4232846 - DNA, 17 bp, Homo sapiens
aacaaattctttagtac

SEQ ID NO: 4232847 - DNA, 18 bp, Homo sapiens
aacaaattctttagtact

SEQ ID NO: 4232848 - DNA, 20 bp, Homo sapiens
aacaaattctttagtactca

SEQ ID NO: 4232849 - DNA, 12 bp, Homo sapiens
aacagattcaga

SEQ ID NO: 4232850 - DNA, 20 bp, Homo sapiens
aacagattcagaatgagaat

SEQ ID NO: 4232851 - DNA, 14 bp, Homo sapiens
aacattatgatcta

SEQ ID NO: 4232852 - DNA, 13 bp, Homo sapiens
aacgaccaaactc

SEQ ID NO: 4232853 - DNA, 21 bp, Homo sapiens
aactttattttttaaaaatga

SEQ ID NO: 4232854 - DNA, 15 bp, Homo sapiens
aagaatacatcagaa

SEQ ID NO: 4232855 - DNA, 23 bp, Homo sapiens
aagaatacatcagaaaataaaat

SEQ ID NO: 4232856 - DNA, 16 bp, Homo sapiens
aagagcagctgggaac

SEQ ID NO: 4232857 - DNA, 16 bp, Homo sapiens
aagctttgagttgact

SEQ ID NO: 4232858 - DNA, 14 bp, Homo sapiens
aaggaattttgtaa

SEQ ID NO: 4232859 - DNA, 12 bp, Homo sapiens
aagggctgcaat

SEQ ID NO: 4232860 - DNA, 14 bp, Homo sapiens
aaggtggtaaattc

SEQ ID NO: 4232861 - DNA, 15 bp, Homo sapiens
aaggtggtaaattca

SEQ ID NO: 4232862 - DNA, 21 bp, Homo sapiens
aataaaatattcactctccat

SEQ ID NO: 4232863 - DNA, 20 bp, Homo sapiens
aataaaatcatgtagtttgt

SEQ ID NO: 4232864 - DNA, 15 bp, Homo sapiens
aataaattttaaaaa

SEQ ID NO: 4232865 - DNA, 15 bp, Homo sapiens
aataagtgaagaata

SEQ ID NO: 4232866 - DNA, 20 bp, Homo sapiens
aataagtgaagaatacatca

SEQ ID NO: 4232867 - DNA, 15 bp, Homo sapiens
aataatgtactcaca

SEQ ID NO: 4232868 - DNA, 16 bp, Homo sapiens
aataatgtactcacat

SEQ ID NO: 4232869 - DNA, 13 bp, Homo sapiens
aatacatcagaaa

SEQ ID NO: 4232870 - DNA, 18 bp, Homo sapiens
aatacatcagaaaataaa

SEQ ID NO: 4232871 - DNA, 15 bp, Homo sapiens
aatgccatgaacaaa

SEQ ID NO: 4232872 - DNA, 16 bp, Homo sapiens
aatgccatgaacaaat

SEQ ID NO: 4232873 - DNA, 14 bp, Homo sapiens
aatgtactcacata

SEQ ID NO: 4232874 - DNA, 21 bp, Homo sapiens
aattcactccagtcaacagat

SEQ ID NO: 4232875 - DNA, 11 bp, Homo sapiens
aattcagacaa

SEQ ID NO: 4232876 - DNA, 15 bp, Homo sapiens
aattcagacaacatt

SEQ ID NO: 4232877 - DNA, 17 bp, Homo sapiens
aattcagacaacattat

SEQ ID NO: 4232878 - DNA, 14 bp, Homo sapiens
aattcctctttaac

SEQ ID NO: 4232879 - DNA, 15 bp, Homo sapiens
aattctttagtactc

SEQ ID NO: 4232880 - DNA, 21 bp, Homo sapiens
aattgacataggcaataataa

SEQ ID NO: 4232881 - DNA, 16 bp, Homo sapiens
aatttaagtgacacag

SEQ ID NO: 4232882 - DNA, 17 bp, Homo sapiens
aatttaagtgacacaga

SEQ ID NO: 4232883 - DNA, 18 bp, Homo sapiens
aattttgtaaagtttcta

SEQ ID NO: 4232884 - DNA, 11 bp, Homo sapiens
acaaacactgc

SEQ ID NO: 4232885 - DNA, 12 bp, Homo sapiens
acaaacactgcc

SEQ ID NO: 4232886 - DNA, 20 bp, Homo sapiens
acaaacactgccatattgtg

SEQ ID NO: 4232887 - DNA, 11 bp, Homo sapiens
acaaaggtggt

SEQ ID NO: 4232888 - DNA, 13 bp, Homo sapiens
acaaattctttag

SEQ ID NO: 4232889 - DNA, 16 bp, Homo sapiens
acaaattctttagtac

SEQ ID NO: 4232890 - DNA, 23 bp, Homo sapiens
acaaattctttagtactcaatgt

SEQ ID NO: 4232891 - DNA, 15 bp, Homo sapiens
acaacattatgatct

SEQ ID NO: 4232892 - DNA, 16 bp, Homo sapiens
acaacattatgatcta

SEQ ID NO: 4232893 - DNA, 17 bp, Homo sapiens
acaatgccatgaacaaa

SEQ ID NO: 4232894 - DNA, 21 bp, Homo sapiens
acaatgccatgaacaaattct

SEQ ID NO: 4232895 - DNA, 23 bp, Homo sapiens
acaatgccatgaacaaattcttt

SEQ ID NO: 4232896 - DNA, 19 bp, Homo sapiens
acacagacattttgtgtga

SEQ ID NO: 4232897 - DNA, 21 bp, Homo sapiens
acacagacattttgtgtgaga

SEQ ID NO: 4232898 - DNA, 23 bp, Homo sapiens
acacagacattttgtgtgagact

SEQ ID NO: 4232899 - DNA, 17 bp, Homo sapiens
acagacattttgtgtga

SEQ ID NO: 4232900 - DNA, 17 bp, Homo sapiens
acagattcagaatgaga

SEQ ID NO: 4232901 - DNA, 19 bp, Homo sapiens
acagattcagaatgagaat

SEQ ID NO: 4232902 - DNA, 18 bp, Homo sapiens
acagctccttactctgag

SEQ ID NO: 4232903 - DNA, 21 bp, Homo sapiens
acagctccttactctgaggaa

SEQ ID NO: 4232904 - DNA, 18 bp, Homo sapiens
acagtacaataatgtact

SEQ ID NO: 4232905 - DNA, 15 bp, Homo sapiens
acatcagaaaataaa

SEQ ID NO: 4232906 - DNA, 23 bp, Homo sapiens
acattatgatctaataaacttta

SEQ ID NO: 4232907 - DNA, 13 bp, Homo sapiens
acattctctttga

SEQ ID NO: 4232908 - DNA, 20 bp, Homo sapiens
acattctctttgataacaaa

SEQ ID NO: 4232909 - DNA, 13 bp, Homo sapiens
acattttgtgtga

SEQ ID NO: 4232910 - DNA, 18 bp, Homo sapiens
accactgaattcactcca

SEQ ID NO: 4232911 - DNA, 19 bp, Homo sapiens
accactgaattcactccag

SEQ ID NO: 4232912 - DNA, 16 bp, Homo sapiens
acctcatcattaataa

SEQ ID NO: 4232913 - DNA, 14 bp, Homo sapiens
actattgagaagat

SEQ ID NO: 4232914 - DNA, 20 bp, Homo sapiens
actcaatgtttctggacatt

SEQ ID NO: 4232915 - DNA, 14 bp, Homo sapiens
actcacatataaca

SEQ ID NO: 4232916 - DNA, 16 bp, Homo sapiens
actcacatataacatg

SEQ ID NO: 4232917 - DNA, 22 bp, Homo sapiens
actcagttcaaaccatttcagc

SEQ ID NO: 4232918 - DNA, 18 bp, Homo sapiens
actccagtcaacagattc

SEQ ID NO: 4232919 - DNA, 19 bp, Homo sapiens
actccagtcaacagattca

SEQ ID NO: 4232920 - DNA, 13 bp, Homo sapiens
actctgaggaagt

SEQ ID NO: 4232921 - DNA, 14 bp, Homo sapiens
actgaattcactcc

SEQ ID NO: 4232922 - DNA, 16 bp, Homo sapiens
actgaattcactccag

SEQ ID NO: 4232923 - DNA, 20 bp, Homo sapiens
acttctgacaaaggtggtaa

SEQ ID NO: 4232924 - DNA, 19 bp, Homo sapiens
agaaaataaaatattcact

SEQ ID NO: 4232925 - DNA, 23 bp, Homo sapiens
agaaaataaaatattcactctcc

SEQ ID NO: 4232926 - DNA, 24 bp, Homo sapiens
agaaaataaaatattcactctcca

SEQ ID NO: 4232927 - DNA, 14 bp, Homo sapiens
agaactgtgataaa

SEQ ID NO: 4232928 - DNA, 12 bp, Homo sapiens
agaatacatcag

SEQ ID NO: 4232929 - DNA, 19 bp, Homo sapiens
agaattttatatcattgga

SEQ ID NO: 4232930 - DNA, 15 bp, Homo sapiens
agacaaacactgcca

SEQ ID NO: 4232931 - DNA, 16 bp, Homo sapiens
agacaaacactgccat

SEQ ID NO: 4232932 - DNA, 17 bp, Homo sapiens
agacaacattatgatct

SEQ ID NO: 4232933 - DNA, 19 bp, Homo sapiens
agacaacattatgatctaa

SEQ ID NO: 4232934 - DNA, 15 bp, Homo sapiens
agacattttgtgtga

SEQ ID NO: 4232935 - DNA, 19 bp, Homo sapiens
agacattttgtgtgagact

SEQ ID NO: 4232936 - DNA, 12 bp, Homo sapiens
agacctgtgtga

SEQ ID NO: 4232937 - DNA, 13 bp, Homo sapiens
agacttaaaacat

SEQ ID NO: 4232938 - DNA, 14 bp, Homo sapiens
agacttaaaacatg

SEQ ID NO: 4232939 - DNA, 17 bp, Homo sapiens
agattcagaatgagaat

SEQ ID NO: 4232940 - DNA, 15 bp, Homo sapiens
agccaaactgtagat

SEQ ID NO: 4232941 - DNA, 13 bp, Homo sapiens
aggaattttgtaa

SEQ ID NO: 4232942 - DNA, 18 bp, Homo sapiens
agggctgcaatgccctca

SEQ ID NO: 4232943 - DNA, 16 bp, Homo sapiens
aggtggtaaattcaga

SEQ ID NO: 4232944 - DNA, 21 bp, Homo sapiens
aggtggtaaattcagacaaca

SEQ ID NO: 4232945 - DNA, 20 bp, Homo sapiens
agtactcaatgtttctggac

SEQ ID NO: 4232946 - DNA, 19 bp, Homo sapiens
agtatgtccccataagaca

SEQ ID NO: 4232947 - DNA, 20 bp, Homo sapiens
agtatgtccccataagacaa

SEQ ID NO: 4232948 - DNA, 14 bp, Homo sapiens
agtcaacagattca

SEQ ID NO: 4232949 - DNA, 13 bp, Homo sapiens
agtgaagaataca

SEQ ID NO: 4232950 - DNA, 13 bp, Homo sapiens
agtgacacagaca

SEQ ID NO: 4232951 - DNA, 16 bp, Homo sapiens
agttcaaaccatttca

SEQ ID NO: 4232952 - DNA, 18 bp, Homo sapiens
agttcattgacctcatca

SEQ ID NO: 4232953 - DNA, 23 bp, Homo sapiens
ataaaatattcactctccattag

SEQ ID NO: 4232954 - DNA, 17 bp, Homo sapiens
ataaattttaaaaagga

SEQ ID NO: 4232955 - DNA, 19 bp, Homo sapiens
ataagacaaacactgccat

SEQ ID NO: 4232956 - DNA, 14 bp, Homo sapiens
ataaggttgtctgt

SEQ ID NO: 4232957 - DNA, 14 bp, Homo sapiens
ataatgtactcaca

SEQ ID NO: 4232958 - DNA, 15 bp, Homo sapiens
ataatgtactcacat

SEQ ID NO: 4232959 - DNA, 16 bp, Homo sapiens
atacatcagaaaataa

SEQ ID NO: 4232960 - DNA, 17 bp, Homo sapiens
atacatcagaaaataaa

SEQ ID NO: 4232961 - DNA, 19 bp, Homo sapiens
atacatcagaaaataaaat

SEQ ID NO: 4232962 - DNA, 11 bp, Homo sapiens
atattcactct

SEQ ID NO: 4232963 - DNA, 17 bp, Homo sapiens
atattcactctccatta

SEQ ID NO: 4232964 - DNA, 19 bp, Homo sapiens
atctgagagacctgtgtga

SEQ ID NO: 4232965 - DNA, 13 bp, Homo sapiens
atgaacaaattct

SEQ ID NO: 4232966 - DNA, 23 bp, Homo sapiens
atgaacaaattctttagtactca

SEQ ID NO: 4232967 - DNA, 16 bp, Homo sapiens
atgatctaataaactt

SEQ ID NO: 4232968 - DNA, 22 bp, Homo sapiens
atgcaaacaggttgttttctac

SEQ ID NO: 4232969 - DNA, 13 bp, Homo sapiens
atgcacagtacaa

SEQ ID NO: 4232970 - DNA, 15 bp, Homo sapiens
atgcacagtacaata

SEQ ID NO: 4232971 - DNA, 14 bp, Homo sapiens
atgccatgaacaaa

SEQ ID NO: 4232972 - DNA, 16 bp, Homo sapiens
atgccatgaacaaatt

SEQ ID NO: 4232973 - DNA, 17 bp, Homo sapiens
atgccatgaacaaattc

SEQ ID NO: 4232974 - DNA, 18 bp, Homo sapiens
atgtccccataagacaaa

SEQ ID NO: 4232975 - DNA, 18 bp, Homo sapiens
atgtttctggacattctc

SEQ ID NO: 4232976 - DNA, 20 bp, Homo sapiens
atgtttctggacattctctt

SEQ ID NO: 4232977 - DNA, 19 bp, Homo sapiens
attaataagtgaagaatac

SEQ ID NO: 4232978 - DNA, 15 bp, Homo sapiens
attatgatctaataa

SEQ ID NO: 4232979 - DNA, 18 bp, Homo sapiens
attatgatctaataaact

SEQ ID NO: 4232980 - DNA, 14 bp, Homo sapiens
attcactccagtca

SEQ ID NO: 4232981 - DNA, 21 bp, Homo sapiens
attcactccagtcaacagatt

SEQ ID NO: 4232982 - DNA, 14 bp, Homo sapiens
attcagacaacatt

SEQ ID NO: 4232983 - DNA, 20 bp, Homo sapiens
attctctttgataacaaaaa

SEQ ID NO: 4232984 - DNA, 16 bp, Homo sapiens
attctttagtactcaa

SEQ ID NO: 4232985 - DNA, 22 bp, Homo sapiens
attctttagtactcaatgtttc

SEQ ID NO: 4232986 - DNA, 14 bp, Homo sapiens
attgcatcagttca

SEQ ID NO: 4232987 - DNA, 13 bp, Homo sapiens
attggtggaattc

SEQ ID NO: 4232988 - DNA, 20 bp, Homo sapiens
atttaagtgacacagacatt

SEQ ID NO: 4232989 - DNA, 17 bp, Homo sapiens
attttaaaaaggaattt

SEQ ID NO: 4232990 - DNA, 17 bp, Homo sapiens
attttgtaaaacaatgc

SEQ ID NO: 4232991 - DNA, 12 bp, Homo sapiens
attttgtgtgag

SEQ ID NO: 4232992 - DNA, 15 bp, Homo sapiens
attttgtgtgagact

SEQ ID NO: 4232993 - DNA, 11 bp, Homo sapiens
caaaaaataaa

SEQ ID NO: 4232994 - DNA, 12 bp, Homo sapiens
caaaaaataaat

SEQ ID NO: 4232995 - DNA, 13 bp, Homo sapiens
caaaaaataaatt

SEQ ID NO: 4232996 - DNA, 18 bp, Homo sapiens
caaacaggttgttttcta

SEQ ID NO: 4232997 - DNA, 14 bp, Homo sapiens
caaactcagttcga

SEQ ID NO: 4232998 - DNA, 14 bp, Homo sapiens
caaaggtggtaaat

SEQ ID NO: 4232999 - DNA, 19 bp, Homo sapiens
caaaggtggtaaattcaga

SEQ ID NO: 4233000 - DNA, 20 bp, Homo sapiens
caaaggtggtaaattcagac

SEQ ID NO: 4233001 - DNA, 18 bp, Homo sapiens
caaattctttagtactca

SEQ ID NO: 4233002 - DNA, 19 bp, Homo sapiens
caaattctttagtactcaa

SEQ ID NO: 4233003 - DNA, 19 bp, Homo sapiens
caacattatgatctaataa

SEQ ID NO: 4233004 - DNA, 20 bp, Homo sapiens
caacattatgatctaataaa

SEQ ID NO: 4233005 - DNA, 21 bp, Homo sapiens
caagggctgcaatgccctcat

SEQ ID NO: 4233006 - DNA, 21 bp, Homo sapiens
caataataagtgatgtgctga

SEQ ID NO: 4233007 - DNA, 15 bp, Homo sapiens
caatgccatgaacaa

SEQ ID NO: 4233008 - DNA, 16 bp, Homo sapiens
caatgccatgaacaaa

SEQ ID NO: 4233009 - DNA, 20 bp, Homo sapiens
caatgtttctggacattctc

SEQ ID NO: 4233010 - DNA, 23 bp, Homo sapiens
caatgtttctggacattctcttt

SEQ ID NO: 4233011 - DNA, 17 bp, Homo sapiens
caattggtggaattcct

SEQ ID NO: 4233012 - DNA, 14 bp, Homo sapiens
cacagacattttgt

SEQ ID NO: 4233013 - DNA, 17 bp, Homo sapiens
cacagacattttgtgtg

SEQ ID NO: 4233014 - DNA, 20 bp, Homo sapiens
cacagacattttgtgtgaga

SEQ ID NO: 4233015 - DNA, 21 bp, Homo sapiens
cacagacattttgtgtgagac

SEQ ID NO: 4233016 - DNA, 20 bp, Homo sapiens
cacagtacaataatgtactc

SEQ ID NO: 4233017 - DNA, 15 bp, Homo sapiens
caccaagagcagctg

SEQ ID NO: 4233018 - DNA, 19 bp, Homo sapiens
caccaagagcagctgggaa

SEQ ID NO: 4233019 - DNA, 12 bp, Homo sapiens
cactgaattcac

SEQ ID NO: 4233020 - DNA, 14 bp, Homo sapiens
cactgaattcactc

SEQ ID NO: 4233021 - DNA, 15 bp, Homo sapiens
cactgaattcactcc

SEQ ID NO: 4233022 - DNA, 18 bp, Homo sapiens
cactgccatattgtgtaa

SEQ ID NO: 4233023 - DNA, 20 bp, Homo sapiens
cactgccatattgtgtaatt

SEQ ID NO: 4233024 - DNA, 11 bp, Homo sapiens
cagacaacatt

SEQ ID NO: 4233025 - DNA, 22 bp, Homo sapiens
cagacaacattatgatctaata

SEQ ID NO: 4233026 - DNA, 16 bp, Homo sapiens
cagacattttgtgtga

SEQ ID NO: 4233027 - DNA, 16 bp, Homo sapiens
cagccttatgtggaag

SEQ ID NO: 4233028 - DNA, 15 bp, Homo sapiens
caggttgttttctac

SEQ ID NO: 4233029 - DNA, 19 bp, Homo sapiens
cagtacaataatgtactca

SEQ ID NO: 4233030 - DNA, 21 bp, Homo sapiens
cagtatgtccccataagacaa

SEQ ID NO: 4233031 - DNA, 22 bp, Homo sapiens
cagttcgaccaaactcagttca

SEQ ID NO: 4233032 - DNA, 20 bp, Homo sapiens
catacccatgcacagtacaa

SEQ ID NO: 4233033 - DNA, 22 bp, Homo sapiens
cataggcttcaattggtggaat

SEQ ID NO: 4233034 - DNA, 18 bp, Homo sapiens
catattgtgtaatttaag

SEQ ID NO: 4233035 - DNA, 22 bp, Homo sapiens
catcagaaaataaaatattcac

SEQ ID NO: 4233036 - DNA, 14 bp, Homo sapiens
catcagttcattga

SEQ ID NO: 4233037 - DNA, 15 bp, Homo sapiens
catcattaataagtg

SEQ ID NO: 4233038 - DNA, 17 bp, Homo sapiens
catcattaataagtgaa

SEQ ID NO: 4233039 - DNA, 15 bp, Homo sapiens
catgcacagtacaat

SEQ ID NO: 4233040 - DNA, 14 bp, Homo sapiens
cattaataagtgaa

SEQ ID NO: 4233041 - DNA, 17 bp, Homo sapiens
cattaataagtgaagaa

SEQ ID NO: 4233042 - DNA, 17 bp, Homo sapiens
cattagaaaattttgta

SEQ ID NO: 4233043 - DNA, 14 bp, Homo sapiens
cattatgatctaat

SEQ ID NO: 4233044 - DNA, 15 bp, Homo sapiens
cattatgatctaata

SEQ ID NO: 4233045 - DNA, 16 bp, Homo sapiens
cattatgatctaataa

SEQ ID NO: 4233046 - DNA, 17 bp, Homo sapiens
cattatgatctaataaa

SEQ ID NO: 4233047 - DNA, 23 bp, Homo sapiens
cattatgatctaataaactttat

SEQ ID NO: 4233048 - DNA, 14 bp, Homo sapiens
cattctctttgata

SEQ ID NO: 4233049 - DNA, 19 bp, Homo sapiens
cattctctttgataacaaa

SEQ ID NO: 4233050 - DNA, 16 bp, Homo sapiens
cattgacctcatcatt

SEQ ID NO: 4233051 - DNA, 23 bp, Homo sapiens
cattttgtgtgagacttaaaaca

SEQ ID NO: 4233052 - DNA, 13 bp, Homo sapiens
ccactgaattcac

SEQ ID NO: 4233053 - DNA, 15 bp, Homo sapiens
ccactgaattcactc

SEQ ID NO: 4233054 - DNA, 21 bp, Homo sapiens
ccactgaattcactccagtca

SEQ ID NO: 4233055 - DNA, 14 bp, Homo sapiens
ccagtcaacagatt

SEQ ID NO: 4233056 - DNA, 20 bp, Homo sapiens
ccataagacaaacactgcca

SEQ ID NO: 4233057 - DNA, 16 bp, Homo sapiens
ccatattgtgtaattt

SEQ ID NO: 4233058 - DNA, 12 bp, Homo sapiens
ccatgaacaaat

SEQ ID NO: 4233059 - DNA, 22 bp, Homo sapiens
ccattagaaaattttgtaaaac

SEQ ID NO: 4233060 - DNA, 15 bp, Homo sapiens
cccataagacaaaca

SEQ ID NO: 4233061 - DNA, 18 bp, Homo sapiens
cccataagacaaacactg

SEQ ID NO: 4233062 - DNA, 20 bp, Homo sapiens
ccccataagacaaacactgc

SEQ ID NO: 4233063 - DNA, 22 bp, Homo sapiens
ccctcatacccatgcacagtac

SEQ ID NO: 4233064 - DNA, 15 bp, Homo sapiens
cctcatacccatgca

SEQ ID NO: 4233065 - DNA, 13 bp, Homo sapiens
cggaacagctcct

SEQ ID NO: 4233066 - DNA, 11 bp, Homo sapiens
ctaacaaaata

SEQ ID NO: 4233067 - DNA, 13 bp, Homo sapiens
ctaataaacttta

SEQ ID NO: 4233068 - DNA, 21 bp, Homo sapiens
ctacattggaagctttgagtt

SEQ ID NO: 4233069 - DNA, 13 bp, Homo sapiens
ctagaattttata

SEQ ID NO: 4233070 - DNA, 16 bp, Homo sapiens
ctatatctgagagacc

SEQ ID NO: 4233071 - DNA, 19 bp, Homo sapiens
ctcaatgtttctggacatt

SEQ ID NO: 4233072 - DNA, 16 bp, Homo sapiens
ctcagttcgaccaaac

SEQ ID NO: 4233073 - DNA, 22 bp, Homo sapiens
ctcagttcgaccaaactcagtt

SEQ ID NO: 4233074 - DNA, 15 bp, Homo sapiens
ctcatacccatgcac

SEQ ID NO: 4233075 - DNA, 22 bp, Homo sapiens
ctccattagaaaattttgtaaa

SEQ ID NO: 4233076 - DNA, 23 bp, Homo sapiens
ctctcagcaccaagagcagctgg

SEQ ID NO: 4233077 - DNA, 12 bp, Homo sapiens
ctctttaacaag

SEQ ID NO: 4233078 - DNA, 15 bp, Homo sapiens
ctgaattcactccag

SEQ ID NO: 4233079 - DNA, 18 bp, Homo sapiens
ctgaattcactccagtca

SEQ ID NO: 4233080 - DNA, 17 bp, Homo sapiens
ctgaattttataaataa

SEQ ID NO: 4233081 - DNA, 15 bp, Homo sapiens
ctgacaaaggtggta

SEQ ID NO: 4233082 - DNA, 20 bp, Homo sapiens
ctgagagacctgtgtgaact

SEQ ID NO: 4233083 - DNA, 15 bp, Homo sapiens
ctgccatattgtgta

SEQ ID NO: 4233084 - DNA, 17 bp, Homo sapiens
ctgccatattgtgtaat

SEQ ID NO: 4233085 - DNA, 21 bp, Homo sapiens
ctgccatattgtgtaatttaa

SEQ ID NO: 4233086 - DNA, 13 bp, Homo sapiens
ctggacattctct

SEQ ID NO: 4233087 - DNA, 17 bp, Homo sapiens
ctggacattctctttga

SEQ ID NO: 4233088 - DNA, 22 bp, Homo sapiens
ctggacattctctttgataaca

SEQ ID NO: 4233089 - DNA, 14 bp, Homo sapiens
ctgtagatgaagag

SEQ ID NO: 4233090 - DNA, 14 bp, Homo sapiens
ctgtgataaaaaga

SEQ ID NO: 4233091 - DNA, 13 bp, Homo sapiens
ctgtgtgaactat

SEQ ID NO: 4233092 - DNA, 22 bp, Homo sapiens
ctgtttttttttttttaaataa

SEQ ID NO: 4233093 - DNA, 18 bp, Homo sapiens
cttaataaagcttttcct

SEQ ID NO: 4233094 - DNA, 14 bp, Homo sapiens
cttactctgaggaa

SEQ ID NO: 4233095 - DNA, 16 bp, Homo sapiens
cttcaattggtggaat

SEQ ID NO: 4233096 - DNA, 15 bp, Homo sapiens
ctttagtactcaatg

SEQ ID NO: 4233097 - DNA, 22 bp, Homo sapiens
ctttcagtatgtccccataaga

SEQ ID NO: 4233098 - DNA, 15 bp, Homo sapiens
ctttgataacaaaaa

SEQ ID NO: 4233099 - DNA, 18 bp, Homo sapiens
gaaaataaaatattcact

SEQ ID NO: 4233100 - DNA, 13 bp, Homo sapiens
gaaaattttgtaa

SEQ ID NO: 4233101 - DNA, 22 bp, Homo sapiens
gaaaattttgtaaaacaatgcc

SEQ ID NO: 4233102 - DNA, 14 bp, Homo sapiens
gaagaatacatcag

SEQ ID NO: 4233103 - DNA, 22 bp, Homo sapiens
gaagttgattcttatttgatgg

SEQ ID NO: 4233104 - DNA, 16 bp, Homo sapiens
gaatacatcagaaaat

SEQ ID NO: 4233105 - DNA, 19 bp, Homo sapiens
gaatacatcagaaaataaa

SEQ ID NO: 4233106 - DNA, 16 bp, Homo sapiens
gaattcactccagtca

SEQ ID NO: 4233107 - DNA, 12 bp, Homo sapiens
gaattcctcttt

SEQ ID NO: 4233108 - DNA, 18 bp, Homo sapiens
gaattcctctttaacaag

SEQ ID NO: 4233109 - DNA, 21 bp, Homo sapiens
gacaaacactgccatattgtg

SEQ ID NO: 4233110 - DNA, 12 bp, Homo sapiens
gacaaaggtggt

SEQ ID NO: 4233111 - DNA, 21 bp, Homo sapiens
gacaaaggtggtaaattcaga

SEQ ID NO: 4233112 - DNA, 15 bp, Homo sapiens
gacacagacattttg

SEQ ID NO: 4233113 - DNA, 22 bp, Homo sapiens
gacacagacattttgtgtgaga

SEQ ID NO: 4233114 - DNA, 23 bp, Homo sapiens
gacataggcttcaattggtggaa

SEQ ID NO: 4233115 - DNA, 19 bp, Homo sapiens
gacattctctttgataaca

SEQ ID NO: 4233116 - DNA, 23 bp, Homo sapiens
gacattttgtgtgagacttaaaa

SEQ ID NO: 4233117 - DNA, 17 bp, Homo sapiens
gaccaaactcagttcaa

SEQ ID NO: 4233118 - DNA, 19 bp, Homo sapiens
gaccactgaattcactcca

SEQ ID NO: 4233119 - DNA, 20 bp, Homo sapiens
gacctcatcattaataagtg

SEQ ID NO: 4233120 - DNA, 21 bp, Homo sapiens
gagaagatcggaacagctcct

SEQ ID NO: 4233121 - DNA, 13 bp, Homo sapiens
gagacttaaaaca

SEQ ID NO: 4233122 - DNA, 15 bp, Homo sapiens
gagagacctgtgtga

SEQ ID NO: 4233123 - DNA, 16 bp, Homo sapiens
gaggaagttgattctt

SEQ ID NO: 4233124 - DNA, 23 bp, Homo sapiens
gagggctctgatctaacaaaata

SEQ ID NO: 4233125 - DNA, 16 bp, Homo sapiens
gataacaaaaaataaa

SEQ ID NO: 4233126 - DNA, 17 bp, Homo sapiens
gataacaaaaaataaat

SEQ ID NO: 4233127 - DNA, 16 bp, Homo sapiens
gatatgttgatcagcc

SEQ ID NO: 4233128 - DNA, 15 bp, Homo sapiens
gatctaataaacttt

SEQ ID NO: 4233129 - DNA, 22 bp, Homo sapiens
gcaaacaggttgttttctactt

SEQ ID NO: 4233130 - DNA, 16 bp, Homo sapiens
gcacagtacaataatg

SEQ ID NO: 4233131 - DNA, 13 bp, Homo sapiens
gcaccaagagcag

SEQ ID NO: 4233132 - DNA, 16 bp, Homo sapiens
gccatattgtgtaatt

SEQ ID NO: 4233133 - DNA, 15 bp, Homo sapiens
gcctatatctgagag

SEQ ID NO: 4233134 - DNA, 21 bp, Homo sapiens
gctctgatctaacaaaataag

SEQ ID NO: 4233135 - DNA, 15 bp, Homo sapiens
gctttgagttgactt

SEQ ID NO: 4233136 - DNA, 16 bp, Homo sapiens
ggaagaactgtgataa

SEQ ID NO: 4233137 - DNA, 19 bp, Homo sapiens
ggaattcctctttaacaag

SEQ ID NO: 4233138 - DNA, 13 bp, Homo sapiens
ggaattttgtaaa

SEQ ID NO: 4233139 - DNA, 20 bp, Homo sapiens
ggaattttgtaaagtttcta

SEQ ID NO: 4233140 - DNA, 21 bp, Homo sapiens
ggacattctctttgataacaa

SEQ ID NO: 4233141 - DNA, 17 bp, Homo sapiens
ggagttggtctgagtga

SEQ ID NO: 4233142 - DNA, 15 bp, Homo sapiens
ggctctgatctaaca

SEQ ID NO: 4233143 - DNA, 20 bp, Homo sapiens
ggctctgatctaacaaaata

SEQ ID NO: 4233144 - DNA, 13 bp, Homo sapiens
ggtgacagtgaga

SEQ ID NO: 4233145 - DNA, 15 bp, Homo sapiens
ggtggtaaattcaga

SEQ ID NO: 4233146 - DNA, 20 bp, Homo sapiens
gtaaaacaatgccatgaaca

SEQ ID NO: 4233147 - DNA, 21 bp, Homo sapiens
gtaaattcagacaacattatg

SEQ ID NO: 4233148 - DNA, 18 bp, Homo sapiens
gtaatattttactttgag

SEQ ID NO: 4233149 - DNA, 16 bp, Homo sapiens
gtaatttaagtgacac

SEQ ID NO: 4233150 - DNA, 21 bp, Homo sapiens
gtaatttaagtgacacagaca

SEQ ID NO: 4233151 - DNA, 20 bp, Homo sapiens
gtacaataatgtactcacat

SEQ ID NO: 4233152 - DNA, 22 bp, Homo sapiens
gtactcaatgtttctggacatt

SEQ ID NO: 4233153 - DNA, 18 bp, Homo sapiens
gtatgtccccataagaca

SEQ ID NO: 4233154 - DNA, 23 bp, Homo sapiens
gtatgtccccataagacaaacac

SEQ ID NO: 4233155 - DNA, 21 bp, Homo sapiens
gtcaacagattcagaatgaga

SEQ ID NO: 4233156 - DNA, 20 bp, Homo sapiens
gtccccataagacaaacact

SEQ ID NO: 4233157 - DNA, 13 bp, Homo sapiens
gtgacacagacat

SEQ ID NO: 4233158 - DNA, 14 bp, Homo sapiens
gtgagacttaaaac

SEQ ID NO: 4233159 - DNA, 13 bp, Homo sapiens
gtgcctatatctg

SEQ ID NO: 4233160 - DNA, 17 bp, Homo sapiens
gtgcctatatctgagag

SEQ ID NO: 4233161 - DNA, 19 bp, Homo sapiens
gtgtaatttaagtgacaca

SEQ ID NO: 4233162 - DNA, 20 bp, Homo sapiens
gtgtaatttaagtgacacag

SEQ ID NO: 4233163 - DNA, 16 bp, Homo sapiens
gttatatgagtagata

SEQ ID NO: 4233164 - DNA, 16 bp, Homo sapiens
gttttttcctttataa

SEQ ID NO: 4233165 - DNA, 18 bp, Homo sapiens
taaaacaatgccatgaac

SEQ ID NO: 4233166 - DNA, 21 bp, Homo sapiens
taaaacaatgccatgaacaaa

SEQ ID NO: 4233167 - DNA, 21 bp, Homo sapiens
taaaacatggtgcctatatct

SEQ ID NO: 4233168 - DNA, 13 bp, Homo sapiens
taaaatattcact

SEQ ID NO: 4233169 - DNA, 21 bp, Homo sapiens
taaataattgcatcagttcat

SEQ ID NO: 4233170 - DNA, 13 bp, Homo sapiens
taaattcagacaa

SEQ ID NO: 4233171 - DNA, 16 bp, Homo sapiens
taaattcagacaacat

SEQ ID NO: 4233172 - DNA, 19 bp, Homo sapiens
taaattcagacaacattat

SEQ ID NO: 4233173 - DNA, 22 bp, Homo sapiens
taaattcagacaacattatgat

SEQ ID NO: 4233174 - DNA, 13 bp, Homo sapiens
taacaaaaaataa

SEQ ID NO: 4233175 - DNA, 20 bp, Homo sapiens
taagacaaacactgccatat

SEQ ID NO: 4233176 - DNA, 15 bp, Homo sapiens
taagtgacacagaca

SEQ ID NO: 4233177 - DNA, 19 bp, Homo sapiens
taagtgacacagacatttt

SEQ ID NO: 4233178 - DNA, 19 bp, Homo sapiens
taagtgatgtgctgaattt

SEQ ID NO: 4233179 - DNA, 11 bp, Homo sapiens
taataaacttt

SEQ ID NO: 4233180 - DNA, 14 bp, Homo sapiens
taataaactttatt

SEQ ID NO: 4233181 - DNA, 17 bp, Homo sapiens
taataagtgatgtgctg

SEQ ID NO: 4233182 - DNA, 12 bp, Homo sapiens
taatgtactcac

SEQ ID NO: 4233183 - DNA, 14 bp, Homo sapiens
taatgtactcacat

SEQ ID NO: 4233184 - DNA, 15 bp, Homo sapiens
taatgtactcacata

SEQ ID NO: 4233185 - DNA, 12 bp, Homo sapiens
taattgcatcag

SEQ ID NO: 4233186 - DNA, 21 bp, Homo sapiens
taattgcatcagttcattgac

SEQ ID NO: 4233187 - DNA, 16 bp, Homo sapiens
taatttaagtgacaca

SEQ ID NO: 4233188 - DNA, 14 bp, Homo sapiens
tacaataatgtact

SEQ ID NO: 4233189 - DNA, 16 bp, Homo sapiens
tacaataatgtactca

SEQ ID NO: 4233190 - DNA, 19 bp, Homo sapiens
tacaataatgtactcacat

SEQ ID NO: 4233191 - DNA, 23 bp, Homo sapiens
tacatcagaaaataaaatattca

SEQ ID NO: 4233192 - DNA, 19 bp, Homo sapiens
tacattggaagctttgagt

SEQ ID NO: 4233193 - DNA, 13 bp, Homo sapiens
tacccatgcacag

SEQ ID NO: 4233194 - DNA, 21 bp, Homo sapiens
tactcaatgtttctggacatt

SEQ ID NO: 4233195 - DNA, 16 bp, Homo sapiens
tagaaaattttgtaaa

SEQ ID NO: 4233196 - DNA, 22 bp, Homo sapiens
tagaaaattttgtaaaacaatg

SEQ ID NO: 4233197 - DNA, 22 bp, Homo sapiens
tagaattttatatcattggatg

SEQ ID NO: 4233198 - DNA, 12 bp, Homo sapiens
tagtactcaatg

SEQ ID NO: 4233199 - DNA, 15 bp, Homo sapiens
tataacatgcaaaca

SEQ ID NO: 4233200 - DNA, 18 bp, Homo sapiens
tatgagtagatactctca

SEQ ID NO: 4233201 - DNA, 14 bp, Homo sapiens
tatgatctaataaa

SEQ ID NO: 4233202 - DNA, 15 bp, Homo sapiens
tatgatctaataaac

SEQ ID NO: 4233203 - DNA, 21 bp, Homo sapiens
tatgtccccataagacaaaca

SEQ ID NO: 4233204 - DNA, 10 bp, Homo sapiens
tattcactct

SEQ ID NO: 4233205 - DNA, 14 bp, Homo sapiens
tattcactctccat

SEQ ID NO: 4233206 - DNA, 16 bp, Homo sapiens
tattcactctccatta

SEQ ID NO: 4233207 - DNA, 23 bp, Homo sapiens
tattgagaagatcggaacagctc

SEQ ID NO: 4233208 - DNA, 16 bp, Homo sapiens
tattttttaaaaatga

SEQ ID NO: 4233209 - DNA, 14 bp, Homo sapiens
tcaaagatttttat

SEQ ID NO: 4233210 - DNA, 22 bp, Homo sapiens
tcaacagattcagaatgagaat

SEQ ID NO: 4233211 - DNA, 14 bp, Homo sapiens
tcaatgtttctgga

SEQ ID NO: 4233212 - DNA, 21 bp, Homo sapiens
tcaatgtttctggacattctc

SEQ ID NO: 4233213 - DNA, 22 bp, Homo sapiens
tcaatgtttctggacattctct

SEQ ID NO: 4233214 - DNA, 18 bp, Homo sapiens
tcaattggtggaattcct

SEQ ID NO: 4233215 - DNA, 14 bp, Homo sapiens
tcacatataacatg

SEQ ID NO: 4233216 - DNA, 13 bp, Homo sapiens
tcactccagtcaa

SEQ ID NO: 4233217 - DNA, 15 bp, Homo sapiens
tcactccagtcaaca

SEQ ID NO: 4233218 - DNA, 18 bp, Homo sapiens
tcagaatgagaatggacg

SEQ ID NO: 4233219 - DNA, 15 bp, Homo sapiens
tcagacaacattatg

SEQ ID NO: 4233220 - DNA, 22 bp, Homo sapiens
tcagacaacattatgatctaat

SEQ ID NO: 4233221 - DNA, 21 bp, Homo sapiens
tcagatggaagagataaacga

SEQ ID NO: 4233222 - DNA, 18 bp, Homo sapiens
tcatacccatgcacagta

SEQ ID NO: 4233223 - DNA, 19 bp, Homo sapiens
tcatacccatgcacagtac

SEQ ID NO: 4233224 - DNA, 21 bp, Homo sapiens
tccattagaaaattttgtaaa

SEQ ID NO: 4233225 - DNA, 23 bp, Homo sapiens
tccattagaaaattttgtaaaac

SEQ ID NO: 4233226 - DNA, 24 bp, Homo sapiens
tccattagaaaattttgtaaaaca

SEQ ID NO: 4233227 - DNA, 20 bp, Homo sapiens
tccccataagacaaacactg

SEQ ID NO: 4233228 - DNA, 21 bp, Homo sapiens
tccccataagacaaacactgc

SEQ ID NO: 4233229 - DNA, 22 bp, Homo sapiens
tccccataagacaaacactgcc

SEQ ID NO: 4233230 - DNA, 17 bp, Homo sapiens
tcctttataaggttgtc

SEQ ID NO: 4233231 - DNA, 14 bp, Homo sapiens
tcggaacagctcct

SEQ ID NO: 4233232 - DNA, 13 bp, Homo sapiens
tctaacaaaataa

SEQ ID NO: 4233233 - DNA, 15 bp, Homo sapiens
tctaacaaaataagg

SEQ ID NO: 4233234 - DNA, 13 bp, Homo sapiens
tctaataaacttt

SEQ ID NO: 4233235 - DNA, 14 bp, Homo sapiens
tctaataaacttta

SEQ ID NO: 4233236 - DNA, 18 bp, Homo sapiens
tctctttgataacaaaaa

SEQ ID NO: 4233237 - DNA, 22 bp, Homo sapiens
tctgagagacctgtgtgaacta

SEQ ID NO: 4233238 - DNA, 18 bp, Homo sapiens
tctggacattctctttga

SEQ ID NO: 4233239 - DNA, 14 bp, Homo sapiens
tctttagtactcaa

SEQ ID NO: 4233240 - DNA, 18 bp, Homo sapiens
tctttgataacaaaaaat

SEQ ID NO: 4233241 - DNA, 17 bp, Homo sapiens
tgaacaaattctttagt

SEQ ID NO: 4233242 - DNA, 23 bp, Homo sapiens
tgaacaaattctttagtactcaa

SEQ ID NO: 4233243 - DNA, 12 bp, Homo sapiens
tgaactattgag

SEQ ID NO: 4233244 - DNA, 15 bp, Homo sapiens
tgaactattgagaag

SEQ ID NO: 4233245 - DNA, 21 bp, Homo sapiens
tgaactattgagaagatcgga

SEQ ID NO: 4233246 - DNA, 11 bp, Homo sapiens
tgaattcactc

SEQ ID NO: 4233247 - DNA, 23 bp, Homo sapiens
tgaattcactccagtcaacagat

SEQ ID NO: 4233248 - DNA, 16 bp, Homo sapiens
tgacaaaggtggtaaa

SEQ ID NO: 4233249 - DNA, 17 bp, Homo sapiens
tgacaaaggtggtaaat

SEQ ID NO: 4233250 - DNA, 13 bp, Homo sapiens
tgacacagacatt

SEQ ID NO: 4233251 - DNA, 14 bp, Homo sapiens
tgacacagacattt

SEQ ID NO: 4233252 - DNA, 15 bp, Homo sapiens
tgacacagacatttt

SEQ ID NO: 4233253 - DNA, 19 bp, Homo sapiens
tgacttctgacaaaggtgg

SEQ ID NO: 4233254 - DNA, 15 bp, Homo sapiens
tgagacttaaaacat

SEQ ID NO: 4233255 - DNA, 16 bp, Homo sapiens
tgagacttaaaacatg

SEQ ID NO: 4233256 - DNA, 14 bp, Homo sapiens
tgagagacctgtgt

SEQ ID NO: 4233257 - DNA, 14 bp, Homo sapiens
tgataaaaagagga

SEQ ID NO: 4233258 - DNA, 12 bp, Homo sapiens
tgataacaaaaa

SEQ ID NO: 4233259 - DNA, 16 bp, Homo sapiens
tgataacaaaaaataa

SEQ ID NO: 4233260 - DNA, 17 bp, Homo sapiens
tgataacaaaaaataaa

SEQ ID NO: 4233261 - DNA, 19 bp, Homo sapiens
tgatcagccttatgtggaa

SEQ ID NO: 4233262 - DNA, 13 bp, Homo sapiens
tgatctaacaaaa

SEQ ID NO: 4233263 - DNA, 15 bp, Homo sapiens
tgatctaataaactt

SEQ ID NO: 4233264 - DNA, 18 bp, Homo sapiens
tgatctaataaactttat

SEQ ID NO: 4233265 - DNA, 20 bp, Homo sapiens
tgcaaacaggttgttttcta

SEQ ID NO: 4233266 - DNA, 17 bp, Homo sapiens
tgcacagtacaataatg

SEQ ID NO: 4233267 - DNA, 21 bp, Homo sapiens
tgcacagtacaataatgtact

SEQ ID NO: 4233268 - DNA, 14 bp, Homo sapiens
tgccatattgtgta

SEQ ID NO: 4233269 - DNA, 12 bp, Homo sapiens
tgccatgaacaa

SEQ ID NO: 4233270 - DNA, 22 bp, Homo sapiens
tgccatgaacaaattctttagt

SEQ ID NO: 4233271 - DNA, 22 bp, Homo sapiens
tgccctcatacccatgcacagt

SEQ ID NO: 4233272 - DNA, 20 bp, Homo sapiens
tgcctatatctgagagacct

SEQ ID NO: 4233273 - DNA, 19 bp, Homo sapiens
tggaattcctctttaacaa

SEQ ID NO: 4233274 - DNA, 14 bp, Homo sapiens
tggacattctcttt

SEQ ID NO: 4233275 - DNA, 18 bp, Homo sapiens
tggacattctctttgata

SEQ ID NO: 4233276 - DNA, 19 bp, Homo sapiens
tggacattctctttgataa

SEQ ID NO: 4233277 - DNA, 21 bp, Homo sapiens
tggacattctctttgataaca

SEQ ID NO: 4233278 - DNA, 19 bp, Homo sapiens
tggtaaattcagacaacat

SEQ ID NO: 4233279 - DNA, 23 bp, Homo sapiens
tggtaaattcagacaacattatg

SEQ ID NO: 4233280 - DNA, 13 bp, Homo sapiens
tgtaaaacaatgc

SEQ ID NO: 4233281 - DNA, 16 bp, Homo sapiens
tgtaaaacaatgccat

SEQ ID NO: 4233282 - DNA, 22 bp, Homo sapiens
tgtaaaacaatgccatgaacaa

SEQ ID NO: 4233283 - DNA, 18 bp, Homo sapiens
tgtaatttaagtgacaca

SEQ ID NO: 4233284 - DNA, 22 bp, Homo sapiens
tgtaatttaagtgacacagaca

SEQ ID NO: 4233285 - DNA, 23 bp, Homo sapiens
tgtaatttaagtgacacagacat

SEQ ID NO: 4233286 - DNA, 14 bp, Homo sapiens
tgtgaccactgaat

SEQ ID NO: 4233287 - DNA, 19 bp, Homo sapiens
tgtgaccactgaattcact

SEQ ID NO: 4233288 - DNA, 17 bp, Homo sapiens
tgtgagacttaaaacat

SEQ ID NO: 4233289 - DNA, 20 bp, Homo sapiens
tgttgatcagccttatgtgg

SEQ ID NO: 4233290 - DNA, 12 bp, Homo sapiens
tgttttttcctt

SEQ ID NO: 4233291 - DNA, 14 bp, Homo sapiens
tgttttttccttta

SEQ ID NO: 4233292 - DNA, 16 bp, Homo sapiens
tgttttttcctttata

SEQ ID NO: 4233293 - DNA, 23 bp, Homo sapiens
ttaaataattgcatcagttcatt

SEQ ID NO: 4233294 - DNA, 15 bp, Homo sapiens
ttaaccctttttcca

SEQ ID NO: 4233295 - DNA, 12 bp, Homo sapiens
ttaagtgacaca

SEQ ID NO: 4233296 - DNA, 22 bp, Homo sapiens
ttaagtgacacagacattttgt

SEQ ID NO: 4233297 - DNA, 16 bp, Homo sapiens
ttagaaaattttgtaa

SEQ ID NO: 4233298 - DNA, 21 bp, Homo sapiens
ttagaaaattttgtaaaacaa

SEQ ID NO: 4233299 - DNA, 15 bp, Homo sapiens
ttatatgagtagata

SEQ ID NO: 4233300 - DNA, 16 bp, Homo sapiens
ttatgatctaataaac

SEQ ID NO: 4233301 - DNA, 18 bp, Homo sapiens
ttatgatctaataaactt

SEQ ID NO: 4233302 - DNA, 13 bp, Homo sapiens
ttcactccagtca

SEQ ID NO: 4233303 - DNA, 14 bp, Homo sapiens
ttcactctccatta

SEQ ID NO: 4233304 - DNA, 13 bp, Homo sapiens
ttcagacaacatt

SEQ ID NO: 4233305 - DNA, 22 bp, Homo sapiens
ttcagacaacattatgatctaa

SEQ ID NO: 4233306 - DNA, 14 bp, Homo sapiens
ttcattgacctcat

SEQ ID NO: 4233307 - DNA, 11 bp, Homo sapiens
ttctctttgat

SEQ ID NO: 4233308 - DNA, 13 bp, Homo sapiens
ttctggacattct

SEQ ID NO: 4233309 - DNA, 21 bp, Homo sapiens
ttctggacattctctttgata

SEQ ID NO: 4233310 - DNA, 15 bp, Homo sapiens
ttgacctcatcatta

SEQ ID NO: 4233311 - DNA, 21 bp, Homo sapiens
ttgataacaaaaaataaattt

SEQ ID NO: 4233312 - DNA, 22 bp, Homo sapiens
ttgataagctattgtctgtaat

SEQ ID NO: 4233313 - DNA, 17 bp, Homo sapiens
ttgattcttatttgatg

SEQ ID NO: 4233314 - DNA, 19 bp, Homo sapiens
ttggaagctttgagttgac

SEQ ID NO: 4233315 - DNA, 20 bp, Homo sapiens
ttggtggaattcctctttaa

SEQ ID NO: 4233316 - DNA, 18 bp, Homo sapiens
ttgtgtaatttaagtgac

SEQ ID NO: 4233317 - DNA, 13 bp, Homo sapiens
ttgttttctactt

SEQ ID NO: 4233318 - DNA, 11 bp, Homo sapiens
tttaaataatt

SEQ ID NO: 4233319 - DNA, 12 bp, Homo sapiens
tttagtactcaa

SEQ ID NO: 4233320 - DNA, 21 bp, Homo sapiens
tttcagccaaactgtagatga

SEQ ID NO: 4233321 - DNA, 23 bp, Homo sapiens
tttcagccaaactgtagatgaag

SEQ ID NO: 4233322 - DNA, 23 bp, Homo sapiens
tttcagtatgtccccataagaca

SEQ ID NO: 4233323 - DNA, 14 bp, Homo sapiens
tttgataacaaaaa

SEQ ID NO: 4233324 - DNA, 12 bp, Homo sapiens
tttgtaaaacaa

SEQ ID NO: 4233325 - DNA, 15 bp, Homo sapiens
tttgtgtgagactta

SEQ ID NO: 4233326 - DNA, 12 bp, Homo sapiens
ttttgtaaaaca

SEQ ID NO: 4233327 - DNA, 13 bp, Homo sapiens
ttttgtaaagttt

SEQ ID NO: 4233328 - DNA, 21 bp, Homo sapiens
ttttgtgtgagacttaaaaca

SEQ ID NO: 4233329 - DNA, 17 bp, Homo sapiens
aaaataaaatattcact

SEQ ID NO: 4233330 - DNA, 12 bp, Homo sapiens
aaaattttgtaa

SEQ ID NO: 4233331 - DNA, 17 bp, Homo sapiens
aaaattttgtaaaacaa

SEQ ID NO: 4233332 - DNA, 21 bp, Homo sapiens
aaaattttgtaaaacaatgcc

SEQ ID NO: 4233333 - DNA, 17 bp, Homo sapiens
aaacaatgccatgaaca

SEQ ID NO: 4233334 - DNA, 21 bp, Homo sapiens
aaacactgccatattgtgtaa

SEQ ID NO: 4233335 - DNA, 23 bp, Homo sapiens
aaacactgccatattgtgtaatt

SEQ ID NO: 4233336 - DNA, 23 bp, Homo sapiens
aaacatggtgcctatatctgaga

SEQ ID NO: 4233337 - DNA, 19 bp, Homo sapiens
aaaccatttcagccaaact

SEQ ID NO: 4233338 - DNA, 14 bp, Homo sapiens
aaactgtagatgaa

SEQ ID NO: 4233339 - DNA, 17 bp, Homo sapiens
aaactgtagatgaagag

SEQ ID NO: 4233340 - DNA, 11 bp, Homo sapiens
aaactttattt

SEQ ID NO: 4233341 - DNA, 22 bp, Homo sapiens
aaactttattttttaaaaatga

SEQ ID NO: 4233342 - DNA, 17 bp, Homo sapiens
aaaggtggtaaattcag

SEQ ID NO: 4233343 - DNA, 19 bp, Homo sapiens
aaaggtggtaaattcagac

SEQ ID NO: 4233344 - DNA, 20 bp, Homo sapiens
aaaggtggtaaattcagaca

SEQ ID NO: 4233345 - DNA, 19 bp, Homo sapiens
aaatattcactctccatta

SEQ ID NO: 4233346 - DNA, 22 bp, Homo sapiens
aaatattcactctccattagaa

SEQ ID NO: 4233347 - DNA, 12 bp, Homo sapiens
ataaacgaccaa

SEQ ID NO: 4233348 - DNA, 15 bp, Homo sapiens
ataaacgaccaaact

SEQ ID NO: 4233349 - DNA, 17 bp, Homo sapiens
ataaacgaccaaactca

SEQ ID NO: 4233350 - DNA, 12 bp, Homo sapiens
ataaactttatt

SEQ ID NO: 4233351 - DNA, 16 bp, Homo sapiens
ataacaaaaaataaat

SEQ ID NO: 4233352 - DNA, 18 bp, Homo sapiens
ataacaaaaaataaattt

SEQ ID NO: 4233353 - DNA, 13 bp, Homo sapiens
ataagacaaacac

SEQ ID NO: 4233354 - DNA, 16 bp, Homo sapiens
ataagacaaacactgc

SEQ ID NO: 4233355 - DNA, 19 bp, Homo sapiens
atacccatgcacagtacaa

SEQ ID NO: 4233356 - DNA, 17 bp, Homo sapiens
atagtgttaactgtcag

SEQ ID NO: 4233357 - DNA, 20 bp, Homo sapiens
atataacatgcaaacaggtt

SEQ ID NO: 4233358 - DNA, 18 bp, Homo sapiens
atatcattggatgatatg

SEQ ID NO: 4233359 - DNA, 13 bp, Homo sapiens
atatgttgatcag

SEQ ID NO: 4233360 - DNA, 15 bp, Homo sapiens
atattcactctccat

SEQ ID NO: 4233361 - DNA, 22 bp, Homo sapiens
atattgataagctattgtctgt

SEQ ID NO: 4233362 - DNA, 11 bp, Homo sapiens
atattgtgtaa

SEQ ID NO: 4233363 - DNA, 14 bp, Homo sapiens
atattgtgtaattt

SEQ ID NO: 4233364 - DNA, 18 bp, Homo sapiens
atcagaaaataaaatatt

SEQ ID NO: 4233365 - DNA, 15 bp, Homo sapiens
atcattaataagtga

SEQ ID NO: 4233366 - DNA, 15 bp, Homo sapiens
atcggaacagctcct

SEQ ID NO: 4233367 - DNA, 12 bp, Homo sapiens
atctaacaaaat

SEQ ID NO: 4233368 - DNA, 15 bp, Homo sapiens
atctaacaaaataag

SEQ ID NO: 4233369 - DNA, 13 bp, Homo sapiens
atctaataaactt

SEQ ID NO: 4233370 - DNA, 15 bp, Homo sapiens
atctaataaacttta

SEQ ID NO: 4233371 - DNA, 22 bp, Homo sapiens
atctgagagacctgtgtgaact

SEQ ID NO: 4233372 - DNA, 14 bp, Homo sapiens
atgaacaaattctt

SEQ ID NO: 4233373 - DNA, 16 bp, Homo sapiens
atgaacaaattcttta

SEQ ID NO: 4233374 - DNA, 17 bp, Homo sapiens
atgaacaaattctttag

SEQ ID NO: 4233375 - DNA, 21 bp, Homo sapiens
atgaacaaattctttagtact

SEQ ID NO: 4233376 - DNA, 20 bp, Homo sapiens
atgaaggtaatattgataag

SEQ ID NO: 4233377 - DNA, 24 bp, Homo sapiens
atgagtagatactctcagcaccaa

SEQ ID NO: 4233378 - DNA, 19 bp, Homo sapiens
atgatctaataaactttat

SEQ ID NO: 4233379 - DNA, 21 bp, Homo sapiens
atgcaaacaggttgttttcta

SEQ ID NO: 4233380 - DNA, 12 bp, Homo sapiens
atgcacagtaca

SEQ ID NO: 4233381 - DNA, 14 bp, Homo sapiens
atgcacagtacaat

SEQ ID NO: 4233382 - DNA, 16 bp, Homo sapiens
gaactgtgataaaaag

SEQ ID NO: 4233383 - DNA, 15 bp, Homo sapiens
gaagaatacatcaga

SEQ ID NO: 4233384 - DNA, 18 bp, Homo sapiens
gaagatcggaacagctcc

SEQ ID NO: 4233385 - DNA, 15 bp, Homo sapiens
gaagctttgagttga

SEQ ID NO: 4233386 - DNA, 18 bp, Homo sapiens
gaattcactccagtcaac

SEQ ID NO: 4233387 - DNA, 20 bp, Homo sapiens
gaattcactccagtcaacag

SEQ ID NO: 4233388 - DNA, 22 bp, Homo sapiens
gaattcactccagtcaacagat

SEQ ID NO: 4233389 - DNA, 14 bp, Homo sapiens
gaattcctctttaa

SEQ ID NO: 4233390 - DNA, 17 bp, Homo sapiens
gaattcctctttaacaa

SEQ ID NO: 4233391 - DNA, 18 bp, Homo sapiens
gacaaaggtggtaaattc

SEQ ID NO: 4233392 - DNA, 23 bp, Homo sapiens
gacaaaggtggtaaattcagaca

SEQ ID NO: 4233393 - DNA, 17 bp, Homo sapiens
gacaacattatgatcta

SEQ ID NO: 4233394 - DNA, 19 bp, Homo sapiens
gacaacattatgatctaat

SEQ ID NO: 4233395 - DNA, 23 bp, Homo sapiens
gacacagacattttgtgtgagac

SEQ ID NO: 4233396 - DNA, 14 bp, Homo sapiens
gacattctctttga

SEQ ID NO: 4233397 - DNA, 16 bp, Homo sapiens
gacattctctttgata

SEQ ID NO: 4233398 - DNA, 14 bp, Homo sapiens
gacctgtgtgaact

SEQ ID NO: 4233399 - DNA, 16 bp, Homo sapiens
gagaagatcggaacag

SEQ ID NO: 4233400 - DNA, 20 bp, Homo sapiens
gagaagatcggaacagctcc

SEQ ID NO: 4233401 - DNA, 17 bp, Homo sapiens
gagagacctgtgtgaac

SEQ ID NO: 4233402 - DNA, 18 bp, Homo sapiens
gagcagctgggaactgac

SEQ ID NO: 4233403 - DNA, 19 bp, Homo sapiens
gaggtggaggttgcagtga

SEQ ID NO: 4233404 - DNA, 21 bp, Homo sapiens
gagtagatactctcagcacca

SEQ ID NO: 4233405 - DNA, 15 bp, Homo sapiens
gataacaaaaaataa

SEQ ID NO: 4233406 - DNA, 21 bp, Homo sapiens
gatcagccttatgtggaagaa

SEQ ID NO: 4233407 - DNA, 14 bp, Homo sapiens
gatctaataaactt

SEQ ID NO: 4233408 - DNA, 16 bp, Homo sapiens
gatctaataaacttta

SEQ ID NO: 4233409 - DNA, 18 bp, Homo sapiens
gatctaataaactttatt

SEQ ID NO: 4233410 - DNA, 14 bp, Homo sapiens
gattcagaatgaga

SEQ ID NO: 4233411 - DNA, 18 bp, Homo sapiens
gattcttatttgatggtg

SEQ ID NO: 4233412 - DNA, 22 bp, Homo sapiens
gccatgaacaaattctttagta

SEQ ID NO: 4233413 - DNA, 16 bp, Homo sapiens
gctctgatctaacaaa

SEQ ID NO: 4233414 - DNA, 16 bp, Homo sapiens
ggaagctttgagttga

SEQ ID NO: 4233415 - DNA, 14 bp, Homo sapiens
ggacattctctttg

SEQ ID NO: 4233416 - DNA, 22 bp, Homo sapiens
ggacattctctttgataacaaa

SEQ ID NO: 4233417 - DNA, 19 bp, Homo sapiens
ggaggtggaggttgcagtg

SEQ ID NO: 4233418 - DNA, 19 bp, Homo sapiens
ggctctgatctaacaaaat

SEQ ID NO: 4233419 - DNA, 22 bp, Homo sapiens
ggcttcaattggtggaattcct

SEQ ID NO: 4233420 - DNA, 13 bp, Homo sapiens
ggtaaattcagac

SEQ ID NO: 4233421 - DNA, 19 bp, Homo sapiens
ggtaaattcagacaacatt

SEQ ID NO: 4233422 - DNA, 23 bp, Homo sapiens
ggtaaattcagacaacattatga

SEQ ID NO: 4233423 - DNA, 14 bp, Homo sapiens
gtaaaacaatgcca

SEQ ID NO: 4233424 - DNA, 13 bp, Homo sapiens
gtaaattcagaca

SEQ ID NO: 4233425 - DNA, 14 bp, Homo sapiens
gtaaattcagacaa

SEQ ID NO: 4233426 - DNA, 18 bp, Homo sapiens
gtaatttaagtgacacag

SEQ ID NO: 4233427 - DNA, 15 bp, Homo sapiens
gtacaataatgtact

SEQ ID NO: 4233428 - DNA, 16 bp, Homo sapiens
gtacaataatgtactc

SEQ ID NO: 4233429 - DNA, 20 bp, Homo sapiens
gtactcacatataacatgca

SEQ ID NO: 4233430 - DNA, 19 bp, Homo sapiens
gtattgtgaccactgaatt

SEQ ID NO: 4233431 - DNA, 13 bp, Homo sapiens
gtcaacagattca

SEQ ID NO: 4233432 - DNA, 22 bp, Homo sapiens
gtgacacagacattttgtgtga

SEQ ID NO: 4233433 - DNA, 23 bp, Homo sapiens
gtgacacagacattttgtgtgag

SEQ ID NO: 4233434 - DNA, 13 bp, Homo sapiens
gtgaccactgaat

SEQ ID NO: 4233435 - DNA, 16 bp, Homo sapiens
gtgaccactgaattca

SEQ ID NO: 4233436 - DNA, 15 bp, Homo sapiens
gtgagacttaaaaca

SEQ ID NO: 4233437 - DNA, 19 bp, Homo sapiens
gtgcctatatctgagagac

SEQ ID NO: 4233438 - DNA, 16 bp, Homo sapiens
gtggtaaattcagaca

SEQ ID NO: 4233439 - DNA, 21 bp, Homo sapiens
gtgtaatttaagtgacacaga

SEQ ID NO: 4233440 - DNA, 18 bp, Homo sapiens
gttcattgacctcatcat

SEQ ID NO: 4233441 - DNA, 23 bp, Homo sapiens
gtttctagaattttatatcattg

SEQ ID NO: 4233442 - DNA, 13 bp, Homo sapiens
gtttctggacatt

SEQ ID NO: 4233443 - DNA, 20 bp, Homo sapiens
gtttctggacattctctttg

SEQ ID NO: 4233444 - DNA, 14 bp, Homo sapiens
gttttttcctttat

SEQ ID NO: 4233445 - DNA, 15 bp, Homo sapiens
gttttttcctttata

SEQ ID NO: 4233446 - DNA, 16 bp, Homo sapiens
taaaaaggaattttgt

SEQ ID NO: 4233447 - DNA, 17 bp, Homo sapiens
taaaacaatgccatgaa

SEQ ID NO: 4233448 - DNA, 20 bp, Homo sapiens
taaaacaatgccatgaacaa

SEQ ID NO: 4233449 - DNA, 23 bp, Homo sapiens
taaaacaatgccatgaacaaatt

SEQ ID NO: 4233450 - DNA, 14 bp, Homo sapiens
taaaatattcactc

SEQ ID NO: 4233451 - DNA, 17 bp, Homo sapiens
taaaatattcactctcc

SEQ ID NO: 4233452 - DNA, 23 bp, Homo sapiens
taaactttattttttaaaaatga

SEQ ID NO: 4233453 - DNA, 18 bp, Homo sapiens
taaataaaatcatgtagt

SEQ ID NO: 4233454 - DNA, 10 bp, Homo sapiens
taaattcaga

SEQ ID NO: 4233455 - DNA, 18 bp, Homo sapiens
taaattcagacaacatta

SEQ ID NO: 4233456 - DNA, 13 bp, Homo sapiens
taaattttaaaaa

SEQ ID NO: 4233457 - DNA, 16 bp, Homo sapiens
taacaaaaaataaatt

SEQ ID NO: 4233458 - DNA, 17 bp, Homo sapiens
taacaaaaaataaattt

SEQ ID NO: 4233459 - DNA, 14 bp, Homo sapiens
caagggctgcaatg

SEQ ID NO: 4233460 - DNA, 16 bp, Homo sapiens
caataatgtactcaca

SEQ ID NO: 4233461 - DNA, 18 bp, Homo sapiens
caatgccatgaacaaatt

SEQ ID NO: 4233462 - DNA, 21 bp, Homo sapiens
caatgtttctggacattctct

SEQ ID NO: 4233463 - DNA, 22 bp, Homo sapiens
caatgtttctggacattctctt

SEQ ID NO: 4233464 - DNA, 22 bp, Homo sapiens
caattgacataggcaataataa

SEQ ID NO: 4233465 - DNA, 16 bp, Homo sapiens
cacagtacaataatgt

SEQ ID NO: 4233466 - DNA, 16 bp, Homo sapiens
cactgaattcactcca

SEQ ID NO: 4233467 - DNA, 18 bp, Homo sapiens
cagacaacattatgatct

SEQ ID NO: 4233468 - DNA, 19 bp, Homo sapiens
cagacaacattatgatcta

SEQ ID NO: 4233469 - DNA, 18 bp, Homo sapiens
cagcaccaagagcagctg

SEQ ID NO: 4233470 - DNA, 22 bp, Homo sapiens
cagccaaactgtagatgaagag

SEQ ID NO: 4233471 - DNA, 20 bp, Homo sapiens
caggttgttttctactttgc

SEQ ID NO: 4233472 - DNA, 13 bp, Homo sapiens
cagtacaataatg

SEQ ID NO: 4233473 - DNA, 14 bp, Homo sapiens
cagtacaataatgt

SEQ ID NO: 4233474 - DNA, 23 bp, Homo sapiens
cagttcgaccaaactcagttcaa

SEQ ID NO: 4233475 - DNA, 15 bp, Homo sapiens
cataagacaaacact

SEQ ID NO: 4233476 - DNA, 21 bp, Homo sapiens
catattgtgtaatttaagtga

SEQ ID NO: 4233477 - DNA, 23 bp, Homo sapiens
catattgtgtaatttaagtgaca

SEQ ID NO: 4233478 - DNA, 16 bp, Homo sapiens
catcagaaaataaaat

SEQ ID NO: 4233479 - DNA, 18 bp, Homo sapiens
catcagaaaataaaatat

SEQ ID NO: 4233480 - DNA, 21 bp, Homo sapiens
catcattaataagtgaagaat

SEQ ID NO: 4233481 - DNA, 22 bp, Homo sapiens
catcattaataagtgaagaata

SEQ ID NO: 4233482 - DNA, 14 bp, Homo sapiens
catgaacaaattct

SEQ ID NO: 4233483 - DNA, 15 bp, Homo sapiens
catgaacaaattctt

SEQ ID NO: 4233484 - DNA, 21 bp, Homo sapiens
catgaacaaattctttagtac

SEQ ID NO: 4233485 - DNA, 14 bp, Homo sapiens
catgcaaacaggtt

SEQ ID NO: 4233486 - DNA, 22 bp, Homo sapiens
catgcacagtacaataatgtac

SEQ ID NO: 4233487 - DNA, 22 bp, Homo sapiens
catggtgcctatatctgagaga

SEQ ID NO: 4233488 - DNA, 23 bp, Homo sapiens
cattagaaaattttgtaaaacaa

SEQ ID NO: 4233489 - DNA, 20 bp, Homo sapiens
cattatgatctaataaactt

SEQ ID NO: 4233490 - DNA, 22 bp, Homo sapiens
cattatgatctaataaacttta

SEQ ID NO: 4233491 - DNA, 18 bp, Homo sapiens
cattctctttgataacaa

SEQ ID NO: 4233492 - DNA, 22 bp, Homo sapiens
cattctctttgataacaaaaaa

SEQ ID NO: 4233493 - DNA, 16 bp, Homo sapiens
ccactgaattcactcc

SEQ ID NO: 4233494 - DNA, 19 bp, Homo sapiens
cccataagacaaacactgc

SEQ ID NO: 4233495 - DNA, 22 bp, Homo sapiens
cccataagacaaacactgccat

SEQ ID NO: 4233496 - DNA, 22 bp, Homo sapiens
cccatgcacagtacaataatgt

SEQ ID NO: 4233497 - DNA, 17 bp, Homo sapiens
ccctttcagtatgtccc

SEQ ID NO: 4233498 - DNA, 22 bp, Homo sapiens
ccgggaggtggaggttgcagtg

SEQ ID NO: 4233499 - DNA, 11 bp, Homo sapiens
cggaacagctc

SEQ ID NO: 4233500 - DNA, 12 bp, Homo sapiens
ctaacaaaataa

SEQ ID NO: 4233501 - DNA, 11 bp, Homo sapiens
ctaataaactt

SEQ ID NO: 4233502 - DNA, 14 bp, Homo sapiens
ctaataaactttat

SEQ ID NO: 4233503 - DNA, 23 bp, Homo sapiens
ctacattggaagctttgagttga

SEQ ID NO: 4233504 - DNA, 14 bp, Homo sapiens
ctatatctgagaga

SEQ ID NO: 4233505 - DNA, 13 bp, Homo sapiens
ctcaatgtttctg

SEQ ID NO: 4233506 - DNA, 17 bp, Homo sapiens
ctcaatgtttctggaca

SEQ ID NO: 4233507 - DNA, 19 bp, Homo sapiens
ctcagttcaaaccatttca

SEQ ID NO: 4233508 - DNA, 14 bp, Homo sapiens
ctcatcattaataa

SEQ ID NO: 4233509 - DNA, 16 bp, Homo sapiens
ctccattagaaaattt

SEQ ID NO: 4233510 - DNA, 19 bp, Homo sapiens
ctccattagaaaattttgt

SEQ ID NO: 4233511 - DNA, 13 bp, Homo sapiens
ctctgatctaaca

SEQ ID NO: 4233512 - DNA, 18 bp, Homo sapiens
ctctgatctaacaaaata

SEQ ID NO: 4233513 - DNA, 18 bp, Homo sapiens
ctctttgataacaaaaaa

SEQ ID NO: 4233514 - DNA, 14 bp, Homo sapiens
ctgaattcactcca

SEQ ID NO: 4233515 - DNA, 23 bp, Homo sapiens
ctgacaaaggtggtaaattcaga

SEQ ID NO: 4233516 - DNA, 15 bp, Homo sapiens
ctgatctaacaaaat

SEQ ID NO: 4233517 - DNA, 14 bp, Homo sapiens
ctgcaatgccctca

SEQ ID NO: 4233518 - DNA, 16 bp, Homo sapiens
ctgccatattgtgtaa

SEQ ID NO: 4233519 - DNA, 15 bp, Homo sapiens
ctggacattctcttt

SEQ ID NO: 4233520 - DNA, 14 bp, Homo sapiens
ctgggtgacagtga

SEQ ID NO: 4233521 - DNA, 13 bp, Homo sapiens
cttaaaacatggt

SEQ ID NO: 4233522 - DNA, 22 bp, Homo sapiens
cttcaattggtggaattcctct

SEQ ID NO: 4233523 - DNA, 22 bp, Homo sapiens
cttctgacaaaggtggtaaatt

SEQ ID NO: 4233524 - DNA, 21 bp, Homo sapiens
ctttagtactcaatgtttctg

SEQ ID NO: 4233525 - DNA, 22 bp, Homo sapiens
ctttgataacaaaaaataaatt

SEQ ID NO: 4233526 - DNA, 20 bp, Homo sapiens
gaaaataaaatattcactct

SEQ ID NO: 4233527 - DNA, 21 bp, Homo sapiens
gaaaataaaatattcactctc

SEQ ID NO: 4233528 - DNA, 21 bp, Homo sapiens
gaaaattttgtaaaacaatgc

SEQ ID NO: 4233529 - DNA, 16 bp, Homo sapiens
gaacaaattctttagt

SEQ ID NO: 4233530 - DNA, 20 bp, Homo sapiens
gaacaaattctttagtactc

SEQ ID NO: 4233531 - DNA, 16 bp, Homo sapiens
gaagatcggaacagct

SEQ ID NO: 4233532 - DNA, 17 bp, Homo sapiens
gaagatcggaacagctc

SEQ ID NO: 4233533 - DNA, 21 bp, Homo sapiens
gaagctttgagttgacttctg

SEQ ID NO: 4233534 - DNA, 13 bp, Homo sapiens
gaatacatcagaa

SEQ ID NO: 4233535 - DNA, 20 bp, Homo sapiens
gaatacatcagaaaataaaa

SEQ ID NO: 4233536 - DNA, 15 bp, Homo sapiens
gacaacattatgatc

SEQ ID NO: 4233537 - DNA, 22 bp, Homo sapiens
gacaacattatgatctaataaa

SEQ ID NO: 4233538 - DNA, 15 bp, Homo sapiens
gacattctctttgat

SEQ ID NO: 4233539 - DNA, 22 bp, Homo sapiens
gacattctctttgataacaaaa

SEQ ID NO: 4233540 - DNA, 14 bp, Homo sapiens
gaccactgaattca

SEQ ID NO: 4233541 - DNA, 17 bp, Homo sapiens
gaccactgaattcactc

SEQ ID NO: 4233542 - DNA, 20 bp, Homo sapiens
gaccactgaattcactccag

SEQ ID NO: 4233543 - DNA, 23 bp, Homo sapiens
gacctcatcattaataagtgaag

SEQ ID NO: 4233544 - DNA, 15 bp, Homo sapiens
gagacctgtgtgaac

SEQ ID NO: 4233545 - DNA, 20 bp, Homo sapiens
gagataaacgaccaaactca

SEQ ID NO: 4233546 - DNA, 20 bp, Homo sapiens
gagggctctgatctaacaaa

SEQ ID NO: 4233547 - DNA, 22 bp, Homo sapiens
gagggctctgatctaacaaaat

SEQ ID NO: 4233548 - DNA, 18 bp, Homo sapiens
gataacaaaaaataaatt

SEQ ID NO: 4233549 - DNA, 14 bp, Homo sapiens
gatcggaacagctc

SEQ ID NO: 4233550 - DNA, 15 bp, Homo sapiens
gatctaacaaaataa

SEQ ID NO: 4233551 - DNA, 18 bp, Homo sapiens
gatctaacaaaataaggt

SEQ ID NO: 4233552 - DNA, 15 bp, Homo sapiens
gattcagaatgagaa

SEQ ID NO: 4233553 - DNA, 20 bp, Homo sapiens
gcaaacaggttgttttctac

SEQ ID NO: 4233554 - DNA, 14 bp, Homo sapiens
gccatattgtgtaa

SEQ ID NO: 4233555 - DNA, 18 bp, Homo sapiens
gccatattgtgtaattta

SEQ ID NO: 4233556 - DNA, 13 bp, Homo sapiens
gccatgaacaaat

SEQ ID NO: 4233557 - DNA, 12 bp, Homo sapiens
gccttatgtgga

SEQ ID NO: 4233558 - DNA, 18 bp, Homo sapiens
gctctgatctaacaaaat

SEQ ID NO: 4233559 - DNA, 17 bp, Homo sapiens
gctttgagttgacttct

SEQ ID NO: 4233560 - DNA, 22 bp, Homo sapiens
gctttgagttgacttctgacaa

SEQ ID NO: 4233561 - DNA, 20 bp, Homo sapiens
ggaggtggaggttgcagtga

SEQ ID NO: 4233562 - DNA, 22 bp, Homo sapiens
gggctatcaacttaataagata

SEQ ID NO: 4233563 - DNA, 18 bp, Homo sapiens
gggctctgatctaacaaa

SEQ ID NO: 4233564 - DNA, 14 bp, Homo sapiens
ggtaaattcagaca

SEQ ID NO: 4233565 - DNA, 18 bp, Homo sapiens
ggtaatattgataagcta

SEQ ID NO: 4233566 - DNA, 23 bp, Homo sapiens
ggttatatgagtagatactctca

SEQ ID NO: 4233567 - DNA, 17 bp, Homo sapiens
ggttgttttctactttg

SEQ ID NO: 4233568 - DNA, 22 bp, Homo sapiens
gtaaaacaatgccatgaacaaa

SEQ ID NO: 4233569 - DNA, 12 bp, Homo sapiens
gtaaattcagac

SEQ ID NO: 4233570 - DNA, 15 bp, Homo sapiens
gtaaattcagacaac

SEQ ID NO: 4233571 - DNA, 18 bp, Homo sapiens
gtaaattcagacaacatt

SEQ ID NO: 4233572 - DNA, 19 bp, Homo sapiens
gtaatttaagtgacacaga

SEQ ID NO: 4233573 - DNA, 17 bp, Homo sapiens
gtacaataatgtactca

SEQ ID NO: 4233574 - DNA, 18 bp, Homo sapiens
gtacaataatgtactcac

SEQ ID NO: 4233575 - DNA, 14 bp, Homo sapiens
gtactcacatataa

SEQ ID NO: 4233576 - DNA, 13 bp, Homo sapiens
gtattgtgaccac

SEQ ID NO: 4233577 - DNA, 14 bp, Homo sapiens
gtgaagaatacatc

SEQ ID NO: 4233578 - DNA, 14 bp, Homo sapiens
aaaaagaggagctt

SEQ ID NO: 4233579 - DNA, 12 bp, Homo sapiens
aaaacaatgcca

SEQ ID NO: 4233580 - DNA, 20 bp, Homo sapiens
aaaacaatgccatgaacaaa

SEQ ID NO: 4233581 - DNA, 23 bp, Homo sapiens
aaaacaatgccatgaacaaattc

SEQ ID NO: 4233582 - DNA, 14 bp, Homo sapiens
aaaataaaatattc

SEQ ID NO: 4233583 - DNA, 12 bp, Homo sapiens
aaaatattcact

SEQ ID NO: 4233584 - DNA, 13 bp, Homo sapiens
aaaatattcactc

SEQ ID NO: 4233585 - DNA, 22 bp, Homo sapiens
aaaatattcactctccattaga

SEQ ID NO: 4233586 - DNA, 12 bp, Homo sapiens
aaacaatgccat

SEQ ID NO: 4233587 - DNA, 18 bp, Homo sapiens
aaacaatgccatgaacaa

SEQ ID NO: 4233588 - DNA, 19 bp, Homo sapiens
aaacaatgccatgaacaaa

SEQ ID NO: 4233589 - DNA, 20 bp, Homo sapiens
aaactcagttcaaaccattt

SEQ ID NO: 4233590 - DNA, 23 bp, Homo sapiens
aaaggaattttgtaaagtttcta

SEQ ID NO: 4233591 - DNA, 18 bp, Homo sapiens
aaagtttctagaatttta

SEQ ID NO: 4233592 - DNA, 13 bp, Homo sapiens
aaatattcactct

SEQ ID NO: 4233593 - DNA, 17 bp, Homo sapiens
aaatattcactctccat

SEQ ID NO: 4233594 - DNA, 17 bp, Homo sapiens
aaattctttagtactca

SEQ ID NO: 4233595 - DNA, 18 bp, Homo sapiens
aaattctttagtactcaa

SEQ ID NO: 4233596 - DNA, 12 bp, Homo sapiens
aaattttaaaaa

SEQ ID NO: 4233597 - DNA, 11 bp, Homo sapiens
aaattttgtaa

SEQ ID NO: 4233598 - DNA, 21 bp, Homo sapiens
aacaaattctttagtactcaa

SEQ ID NO: 4233599 - DNA, 22 bp, Homo sapiens
aacaaattctttagtactcaat

SEQ ID NO: 4233600 - DNA, 19 bp, Homo sapiens
aacaagggctgcaatgccc

SEQ ID NO: 4233601 - DNA, 13 bp, Homo sapiens
aacaatgccatga

SEQ ID NO: 4233602 - DNA, 15 bp, Homo sapiens
aacaatgccatgaac

SEQ ID NO: 4233603 - DNA, 17 bp, Homo sapiens
aacaatgccatgaacaa

SEQ ID NO: 4233604 - DNA, 18 bp, Homo sapiens
aacaatgccatgaacaaa

SEQ ID NO: 4233605 - DNA, 19 bp, Homo sapiens
aacaatgccatgaacaaat

SEQ ID NO: 4233606 - DNA, 20 bp, Homo sapiens
aacaatgccatgaacaaatt

SEQ ID NO: 4233607 - DNA, 20 bp, Homo sapiens
aacactgccatattgtgtaa

SEQ ID NO: 4233608 - DNA, 13 bp, Homo sapiens
aacattatgatct

SEQ ID NO: 4233609 - DNA, 19 bp, Homo sapiens
aacgaccaaactcagttcg

SEQ ID NO: 4233610 - DNA, 16 bp, Homo sapiens
aactcagttcaaacca

SEQ ID NO: 4233611 - DNA, 15 bp, Homo sapiens
aagacaaacactgcc

SEQ ID NO: 4233612 - DNA, 18 bp, Homo sapiens
aagaggagctttttagtt

SEQ ID NO: 4233613 - DNA, 20 bp, Homo sapiens
aaggcctttagtaatgaatg

SEQ ID NO: 4233614 - DNA, 12 bp, Homo sapiens
aagtgacacaga

SEQ ID NO: 4233615 - DNA, 12 bp, Homo sapiens
aagtttctagaa

SEQ ID NO: 4233616 - DNA, 13 bp, Homo sapiens
aataaactttatt

SEQ ID NO: 4233617 - DNA, 17 bp, Homo sapiens
aataagtgaagaataca

SEQ ID NO: 4233618 - DNA, 22 bp, Homo sapiens
aataagtgaagaatacatcaga

SEQ ID NO: 4233619 - DNA, 20 bp, Homo sapiens
aataataagtgatgtgctga

SEQ ID NO: 4233620 - DNA, 19 bp, Homo sapiens
aataatgtactcacatata

SEQ ID NO: 4233621 - DNA, 22 bp, Homo sapiens
aataatgtactcacatataaca

SEQ ID NO: 4233622 - DNA, 17 bp, Homo sapiens
aatacatcagaaaataa

SEQ ID NO: 4233623 - DNA, 12 bp, Homo sapiens
aatattcactct

SEQ ID NO: 4233624 - DNA, 17 bp, Homo sapiens
aatgccatgaacaaatt

SEQ ID NO: 4233625 - DNA, 22 bp, Homo sapiens
aatgccatgaacaaattcttta

SEQ ID NO: 4233626 - DNA, 12 bp, Homo sapiens
aatgtactcaca

SEQ ID NO: 4233627 - DNA, 10 bp, Homo sapiens
aattcactcc

SEQ ID NO: 4233628 - DNA, 17 bp, Homo sapiens
aattcactccagtcaac

SEQ ID NO: 4233629 - DNA, 20 bp, Homo sapiens
aattcactccagtcaacaga

SEQ ID NO: 4233630 - DNA, 22 bp, Homo sapiens
aattcactccagtcaacagatt

SEQ ID NO: 4233631 - DNA, 18 bp, Homo sapiens
aattcagacaacattatg

SEQ ID NO: 4233632 - DNA, 12 bp, Homo sapiens
aattcctcttta

SEQ ID NO: 4233633 - DNA, 13 bp, Homo sapiens
aattcctctttaa

SEQ ID NO: 4233634 - DNA, 15 bp, Homo sapiens
aatttaagtgacaca

SEQ ID NO: 4233635 - DNA, 17 bp, Homo sapiens
aattttgtaaaacaatg

SEQ ID NO: 4233636 - DNA, 21 bp, Homo sapiens
aattttgtaaaacaatgccat

SEQ ID NO: 4233637 - DNA, 13 bp, Homo sapiens
acaaacactgcca

SEQ ID NO: 4233638 - DNA, 14 bp, Homo sapiens
acaaacactgccat

SEQ ID NO: 4233639 - DNA, 22 bp, Homo sapiens
acaaacactgccatattgtgta

SEQ ID NO: 4233640 - DNA, 23 bp, Homo sapiens
acaaacactgccatattgtgtaa

SEQ ID NO: 4233641 - DNA, 12 bp, Homo sapiens
acaaaggtggta

SEQ ID NO: 4233642 - DNA, 15 bp, Homo sapiens
acaaaggtggtaaat

SEQ ID NO: 4233643 - DNA, 20 bp, Homo sapiens
acaaaggtggtaaattcaga

SEQ ID NO: 4233644 - DNA, 21 bp, Homo sapiens
acaaattctttagtactcaat

SEQ ID NO: 4233645 - DNA, 19 bp, Homo sapiens
acaacattatgatctaata

SEQ ID NO: 4233646 - DNA, 23 bp, Homo sapiens
acaacattatgatctaataaact

SEQ ID NO: 4233647 - DNA, 19 bp, Homo sapiens
acaatgccatgaacaaatt

SEQ ID NO: 4233648 - DNA, 18 bp, Homo sapiens
acactgccatattgtgta

SEQ ID NO: 4233649 - DNA, 21 bp, Homo sapiens
acagacattttgtgtgagact

SEQ ID NO: 4233650 - DNA, 13 bp, Homo sapiens
acagtacaataat

SEQ ID NO: 4233651 - DNA, 14 bp, Homo sapiens
acagtacaataatg

SEQ ID NO: 4233652 - DNA, 16 bp, Homo sapiens
acagtacaataatgta

SEQ ID NO: 4233653 - DNA, 20 bp, Homo sapiens
acagtacaataatgtactca

SEQ ID NO: 4233654 - DNA, 20 bp, Homo sapiens
ttaagtgacacagacatttt

SEQ ID NO: 4233655 - DNA, 22 bp, Homo sapiens
ttagaaaattttgtaaaacaat

SEQ ID NO: 4233656 - DNA, 17 bp, Homo sapiens
ttcactccagtcaacag

SEQ ID NO: 4233657 - DNA, 18 bp, Homo sapiens
ttcactccagtcaacaga

SEQ ID NO: 4233658 - DNA, 17 bp, Homo sapiens
ttcattgacctcatcat

SEQ ID NO: 4233659 - DNA, 22 bp, Homo sapiens
ttcattgacctcatcattaata

SEQ ID NO: 4233660 - DNA, 21 bp, Homo sapiens
ttccatagtgttaactgtcag

SEQ ID NO: 4233661 - DNA, 15 bp, Homo sapiens
ttctactttgcccct

SEQ ID NO: 4233662 - DNA, 19 bp, Homo sapiens
ttctgacaaaggtggtaaa

SEQ ID NO: 4233663 - DNA, 22 bp, Homo sapiens
ttctttagtactcaatgtttct

SEQ ID NO: 4233664 - DNA, 23 bp, Homo sapiens
ttgagttgacttctgacaaaggt

SEQ ID NO: 4233665 - DNA, 13 bp, Homo sapiens
ttgataacaaaaa

SEQ ID NO: 4233666 - DNA, 16 bp, Homo sapiens
ttgcccctttcagtat

SEQ ID NO: 4233667 - DNA, 11 bp, Homo sapiens
ttgtaaaacaa

SEQ ID NO: 4233668 - DNA, 12 bp, Homo sapiens
ttgtaaaacaat

SEQ ID NO: 4233669 - DNA, 14 bp, Homo sapiens
ttgtaaaacaatgc

SEQ ID NO: 4233670 - DNA, 15 bp, Homo sapiens
ttgtaaaacaatgcc

SEQ ID NO: 4233671 - DNA, 22 bp, Homo sapiens
ttgtaaaacaatgccatgaaca

SEQ ID NO: 4233672 - DNA, 19 bp, Homo sapiens
ttgtgtgagacttaaaaca

SEQ ID NO: 4233673 - DNA, 18 bp, Homo sapiens
ttgttttttcctttataa

SEQ ID NO: 4233674 - DNA, 15 bp, Homo sapiens
tttaagtgacacaga

SEQ ID NO: 4233675 - DNA, 20 bp, Homo sapiens
tttaagtgacacagacattt

SEQ ID NO: 4233676 - DNA, 17 bp, Homo sapiens
tttagtactcaatgttt

SEQ ID NO: 4233677 - DNA, 19 bp, Homo sapiens
tttataaggttgtctgttt

SEQ ID NO: 4233678 - DNA, 17 bp, Homo sapiens
tttctagaattttatat

SEQ ID NO: 4233679 - DNA, 14 bp, Homo sapiens
tttctggacattct

SEQ ID NO: 4233680 - DNA, 13 bp, Homo sapiens
tttgataacaaaa

SEQ ID NO: 4233681 - DNA, 14 bp, Homo sapiens
tttgatggtggtat

SEQ ID NO: 4233682 - DNA, 16 bp, Homo sapiens
tttgcccctttcagta

SEQ ID NO: 4233683 - DNA, 17 bp, Homo sapiens
tttgtaaaacaatgcca

SEQ ID NO: 4233684 - DNA, 14 bp, Homo sapiens
tttgttttttcctt

SEQ ID NO: 4233685 - DNA, 12 bp, Homo sapiens
ttttaaaaatga

SEQ ID NO: 4233686 - DNA, 12 bp, Homo sapiens
tttttcctttat

SEQ ID NO: 4233687 - DNA, 12 bp, Homo sapiens
taagacaaacac

SEQ ID NO: 4233688 - DNA, 13 bp, Homo sapiens
taagacaaacact

SEQ ID NO: 4233689 - DNA, 18 bp, Homo sapiens
taagacaaacactgccat

SEQ ID NO: 4233690 - DNA, 12 bp, Homo sapiens
taagtgacacag

SEQ ID NO: 4233691 - DNA, 13 bp, Homo sapiens
taatgtactcaca

SEQ ID NO: 4233692 - DNA, 20 bp, Homo sapiens
taatgtactcacatataaca

SEQ ID NO: 4233693 - DNA, 22 bp, Homo sapiens
taatgtactcacatataacatg

SEQ ID NO: 4233694 - DNA, 20 bp, Homo sapiens
taattgcatcagttcattga

SEQ ID NO: 4233695 - DNA, 12 bp, Homo sapiens
tacaataatgta

SEQ ID NO: 4233696 - DNA, 15 bp, Homo sapiens
tacaataatgtactc

SEQ ID NO: 4233697 - DNA, 16 bp, Homo sapiens
tacatcagaaaataaa

SEQ ID NO: 4233698 - DNA, 19 bp, Homo sapiens
tacatcagaaaataaaata

SEQ ID NO: 4233699 - DNA, 20 bp, Homo sapiens
tacatcagaaaataaaatat

SEQ ID NO: 4233700 - DNA, 18 bp, Homo sapiens
tacccatgcacagtacaa

SEQ ID NO: 4233701 - DNA, 13 bp, Homo sapiens
tactcaatgtttc

SEQ ID NO: 4233702 - DNA, 16 bp, Homo sapiens
tactcacatataacat

SEQ ID NO: 4233703 - DNA, 23 bp, Homo sapiens
tagaaaattttgtaaaacaatgc

SEQ ID NO: 4233704 - DNA, 23 bp, Homo sapiens
tagtactcaatgtttctggacat

SEQ ID NO: 4233705 - DNA, 18 bp, Homo sapiens
tatatgagtagatactct

SEQ ID NO: 4233706 - DNA, 23 bp, Homo sapiens
tatctgagagacctgtgtgaact

SEQ ID NO: 4233707 - DNA, 13 bp, Homo sapiens
tatgatctaataa

SEQ ID NO: 4233708 - DNA, 16 bp, Homo sapiens
tatgatctaataaact

SEQ ID NO: 4233709 - DNA, 17 bp, Homo sapiens
tatgtccccataagaca

SEQ ID NO: 4233710 - DNA, 19 bp, Homo sapiens
tattgtgtaatttaagtga

SEQ ID NO: 4233711 - DNA, 15 bp, Homo sapiens
tcaacttaataagat

SEQ ID NO: 4233712 - DNA, 20 bp, Homo sapiens
tcaatgtttctggacattct

SEQ ID NO: 4233713 - DNA, 19 bp, Homo sapiens
tcactccagtcaacagatt

SEQ ID NO: 4233714 - DNA, 14 bp, Homo sapiens
tcactctccattag

SEQ ID NO: 4233715 - DNA, 19 bp, Homo sapiens
tcagaaaataaaatattca

SEQ ID NO: 4233716 - DNA, 14 bp, Homo sapiens
tcagacaacattat

SEQ ID NO: 4233717 - DNA, 20 bp, Homo sapiens
tcagacaacattatgatcta

SEQ ID NO: 4233718 - DNA, 18 bp, Homo sapiens
tcagatggaagagataaa

SEQ ID NO: 4233719 - DNA, 23 bp, Homo sapiens
tcagttcattgacctcatcatta

SEQ ID NO: 4233720 - DNA, 16 bp, Homo sapiens
tcatacccatgcacag

SEQ ID NO: 4233721 - DNA, 15 bp, Homo sapiens
tcattaataagtgaa

SEQ ID NO: 4233722 - DNA, 18 bp, Homo sapiens
tcattgacctcatcatta

SEQ ID NO: 4233723 - DNA, 22 bp, Homo sapiens
tccattagaaaattttgtaaaa

SEQ ID NO: 4233724 - DNA, 18 bp, Homo sapiens
tctgacaaaggtggtaaa

SEQ ID NO: 4233725 - DNA, 19 bp, Homo sapiens
tctgacaaaggtggtaaat

SEQ ID NO: 4233726 - DNA, 14 bp, Homo sapiens
tctgatctaacaaa

SEQ ID NO: 4233727 - DNA, 20 bp, Homo sapiens
tctttagtactcaatgtttc

SEQ ID NO: 4233728 - DNA, 12 bp, Homo sapiens
tctttgataaca

SEQ ID NO: 4233729 - DNA, 21 bp, Homo sapiens
tctttgataacaaaaaataaa

SEQ ID NO: 4233730 - DNA, 15 bp, Homo sapiens
tgaacaaattcttta

SEQ ID NO: 4233731 - DNA, 18 bp, Homo sapiens
tgaacaaattctttagta

SEQ ID NO: 4233732 - DNA, 14 bp, Homo sapiens
tgaagaatacatca

SEQ ID NO: 4233733 - DNA, 21 bp, Homo sapiens
tgaattcactccagtcaacag

SEQ ID NO: 4233734 - DNA, 20 bp, Homo sapiens
tgacaaaggtggtaaattca

SEQ ID NO: 4233735 - DNA, 21 bp, Homo sapiens
tgaccactgaattcactccag

SEQ ID NO: 4233736 - DNA, 21 bp, Homo sapiens
tgacctcatcattaataagtg

SEQ ID NO: 4233737 - DNA, 23 bp, Homo sapiens
tgacttctgacaaaggtggtaaa

SEQ ID NO: 4233738 - DNA, 15 bp, Homo sapiens
tgagagacctgtgtg

SEQ ID NO: 4233739 - DNA, 17 bp, Homo sapiens
tgagagacctgtgtgaa

SEQ ID NO: 4233740 - DNA, 21 bp, Homo sapiens
tgagagacctgtgtgaactat

SEQ ID NO: 4233741 - DNA, 16 bp, Homo sapiens
tgatcagccttatgtg

SEQ ID NO: 4233742 - DNA, 12 bp, Homo sapiens
tgatctaacaaa

SEQ ID NO: 4233743 - DNA, 15 bp, Homo sapiens
tgatctaacaaaata

SEQ ID NO: 4233744 - DNA, 17 bp, Homo sapiens
tgatctaacaaaataag

SEQ ID NO: 4233745 - DNA, 19 bp, Homo sapiens
tgatctaataaactttatt

SEQ ID NO: 4233746 - DNA, 13 bp, Homo sapiens
tgcaatgccctca

SEQ ID NO: 4233747 - DNA, 15 bp, Homo sapiens
tgcacagtacaataa

SEQ ID NO: 4233748 - DNA, 12 bp, Homo sapiens
tgcatcagttca

SEQ ID NO: 4233749 - DNA, 19 bp, Homo sapiens
tgccatgaacaaattcttt

SEQ ID NO: 4233750 - DNA, 20 bp, Homo sapiens
tgccatgaacaaattcttta

SEQ ID NO: 4233751 - DNA, 16 bp, Homo sapiens
tgcctatatctgagag

SEQ ID NO: 4233752 - DNA, 22 bp, Homo sapiens
tgcctatatctgagagacctgt

SEQ ID NO: 4233753 - DNA, 16 bp, Homo sapiens
tggaattcctctttaa

SEQ ID NO: 4233754 - DNA, 16 bp, Homo sapiens
tggacattctctttga

SEQ ID NO: 4233755 - DNA, 14 bp, Homo sapiens
tggtaaattcagac

SEQ ID NO: 4233756 - DNA, 20 bp, Homo sapiens
tggtaaattcagacaacatt

SEQ ID NO: 4233757 - DNA, 19 bp, Homo sapiens
tggtgcctatatctgagag

SEQ ID NO: 4233758 - DNA, 14 bp, Homo sapiens
tgtaaagtttctag

SEQ ID NO: 4233759 - DNA, 21 bp, Homo sapiens
tgtaactgaggactgtttgca

SEQ ID NO: 4233760 - DNA, 21 bp, Homo sapiens
tgtactcacatataacatgca

SEQ ID NO: 4233761 - DNA, 20 bp, Homo sapiens
tgtccccataagacaaacac

SEQ ID NO: 4233762 - DNA, 22 bp, Homo sapiens
tgtccccataagacaaacactg

SEQ ID NO: 4233763 - DNA, 19 bp, Homo sapiens
tgtgtgagacttaaaacat

SEQ ID NO: 4233764 - DNA, 20 bp, Homo sapiens
tgtgtgagacttaaaacatg

SEQ ID NO: 4233765 - DNA, 14 bp, Homo sapiens
tgtttctggacatt

SEQ ID NO: 4233766 - DNA, 21 bp, Homo sapiens
tgtttttttttttttaaataa

SEQ ID NO: 4233767 - DNA, 15 bp, Homo sapiens
ttaagtgacacagac

SEQ ID NO: 4233768 - DNA, 19 bp, Homo sapiens
ttaagtgacacagacattt

SEQ ID NO: 4233769 - DNA, 18 bp, Homo sapiens
ttaataagatatttagta

SEQ ID NO: 4233770 - DNA, 18 bp, Homo sapiens
ttataaataaaatcatgt

SEQ ID NO: 4233771 - DNA, 14 bp, Homo sapiens
ttatgatctaataa

SEQ ID NO: 4233772 - DNA, 19 bp, Homo sapiens
ttcactccagtcaacagat

SEQ ID NO: 4233773 - DNA, 10 bp, Homo sapiens
ttcactctcc

SEQ ID NO: 4233774 - DNA, 21 bp, Homo sapiens
ttcactctccattagaaaatt

SEQ ID NO: 4233775 - DNA, 17 bp, Homo sapiens
ttcagacaacattatga

SEQ ID NO: 4233776 - DNA, 20 bp, Homo sapiens
ttcagacaacattatgatct

SEQ ID NO: 4233777 - DNA, 21 bp, Homo sapiens
ttcagacaacattatgatcta

SEQ ID NO: 4233778 - DNA, 20 bp, Homo sapiens
ttctgacaaaggtggtaaat

SEQ ID NO: 4233779 - DNA, 15 bp, Homo sapiens
ttctttagtactcaa

SEQ ID NO: 4233780 - DNA, 16 bp, Homo sapiens
ttgacctcatcattaa

SEQ ID NO: 4233781 - DNA, 12 bp, Homo sapiens
tttaaataattg

SEQ ID NO: 4233782 - DNA, 21 bp, Homo sapiens
tttaagtgacacagacatttt

SEQ ID NO: 4233783 - DNA, 18 bp, Homo sapiens
tttagtaatattttactt

SEQ ID NO: 4233784 - DNA, 19 bp, Homo sapiens
tttcagccaaactgtagat

SEQ ID NO: 4233785 - DNA, 12 bp, Homo sapiens
tttctactttgc

SEQ ID NO: 4233786 - DNA, 22 bp, Homo sapiens
tttgatggtggtattgtgacca

SEQ ID NO: 4233787 - DNA, 13 bp, Homo sapiens
tttgtaaaacaat

SEQ ID NO: 4233788 - DNA, 21 bp, Homo sapiens
tttgtgtgagacttaaaacat

SEQ ID NO: 4233789 - DNA, 22 bp, Homo sapiens
ttttaaataattgcatcagttc

SEQ ID NO: 4233790 - DNA, 12 bp, Homo sapiens
ttttatatcatt

SEQ ID NO: 4233791 - DNA, 13 bp, Homo sapiens
ttttcctttataa

SEQ ID NO: 4233792 - DNA, 13 bp, Homo sapiens
ttttgtaaaacaa

SEQ ID NO: 4233793 - DNA, 14 bp, Homo sapiens
ttttgtaaaacaat

SEQ ID NO: 4233794 - DNA, 22 bp, Homo sapiens
ttttgtgtgagacttaaaacat

SEQ ID NO: 4233795 - DNA, 21 bp, Homo sapiens
aaaacatatgaaatataaatt

SEQ ID NO: 4233796 - DNA, 23 bp, Homo sapiens
aaaacatatgaaatataaattat

SEQ ID NO: 4233797 - DNA, 13 bp, Homo sapiens
aaaagattttatg

SEQ ID NO: 4233798 - DNA, 18 bp, Homo sapiens
aaaagttactaatatatc

SEQ ID NO: 4233799 - DNA, 13 bp, Homo sapiens
aaaataaacttct

SEQ ID NO: 4233800 - DNA, 14 bp, Homo sapiens
aaactgtttctcag

SEQ ID NO: 4233801 - DNA, 14 bp, Homo sapiens
aaacttggctggaa

SEQ ID NO: 4233802 - DNA, 20 bp, Homo sapiens
aaacttggctggaatttctg

SEQ ID NO: 4233803 - DNA, 19 bp, Homo sapiens
aaagagaaaatatatattt

SEQ ID NO: 4233804 - DNA, 20 bp, Homo sapiens
aaagagaaaatatatatttt

SEQ ID NO: 4233805 - DNA, 22 bp, Homo sapiens
aaagattttatggttttataac

SEQ ID NO: 4233806 - DNA, 13 bp, Homo sapiens
aaagccatatttt

SEQ ID NO: 4233807 - DNA, 13 bp, Homo sapiens
gccagggcccagg

SEQ ID NO: 4233808 - DNA, 11 bp, Homo sapiens
gccagtcccag

SEQ ID NO: 4233809 - DNA, 22 bp, Homo sapiens
gccagtgttgtgggcttcctgc

SEQ ID NO: 4233810 - DNA, 19 bp, Homo sapiens
gcccaggctagagtgcagt

SEQ ID NO: 4233811 - DNA, 20 bp, Homo sapiens
gcccaggctagagtgcagtg

SEQ ID NO: 4233812 - DNA, 23 bp, Homo sapiens
gcccatttagaggatgtggctgt

SEQ ID NO: 4233813 - DNA, 14 bp, Homo sapiens
gccccaggccctgc

SEQ ID NO: 4233814 - DNA, 16 bp, Homo sapiens
gcccgaggaagctgga

SEQ ID NO: 4233815 - DNA, 12 bp, Homo sapiens
gcctccaggacc

SEQ ID NO: 4233816 - DNA, 15 bp, Homo sapiens
gcctgctgaggcctt

SEQ ID NO: 4233817 - DNA, 21 bp, Homo sapiens
gcctgctgaggccttctcttg

SEQ ID NO: 4233818 - DNA, 18 bp, Homo sapiens
gcctggggtccctctgaa

SEQ ID NO: 4233819 - DNA, 19 bp, Homo sapiens
gccttgccccaggccctgc

SEQ ID NO: 4233820 - DNA, 15 bp, Homo sapiens
gccttggctgggcct

SEQ ID NO: 4233821 - DNA, 15 bp, Homo sapiens
gcgagacccaaggct

SEQ ID NO: 4233822 - DNA, 21 bp, Homo sapiens
gcgagacccaaggctcactgc

SEQ ID NO: 4233823 - DNA, 14 bp, Homo sapiens
gcggcagtgggcct

SEQ ID NO: 4233824 - DNA, 21 bp, Homo sapiens
gctaaacatgtgaggcctgga

SEQ ID NO: 4233825 - DNA, 20 bp, Homo sapiens
gctatgctagaggcttttat

SEQ ID NO: 4233826 - DNA, 16 bp, Homo sapiens
gctatttatattcatt

SEQ ID NO: 4233827 - DNA, 16 bp, Homo sapiens
gctcctgacccctccc

SEQ ID NO: 4233828 - DNA, 14 bp, Homo sapiens
gctccttgcagcag

SEQ ID NO: 4233829 - DNA, 18 bp, Homo sapiens
gctccttgcagcagggct

SEQ ID NO: 4233830 - DNA, 23 bp, Homo sapiens
gctccttgcagcagggctgggcc

SEQ ID NO: 4233831 - DNA, 14 bp, Homo sapiens
gctgatgtttcctg

SEQ ID NO: 4233832 - DNA, 12 bp, Homo sapiens
gctgctgccttg

SEQ ID NO: 4233833 - DNA, 13 bp, Homo sapiens
gctggaagctgtc

SEQ ID NO: 4233834 - DNA, 21 bp, Homo sapiens
gctggaatttctgctgtggtc

SEQ ID NO: 4233835 - DNA, 13 bp, Homo sapiens
gctggacagcggc

SEQ ID NO: 4233836 - DNA, 18 bp, Homo sapiens
gctggaccagctggcctg

SEQ ID NO: 4233837 - DNA, 20 bp, Homo sapiens
gctggaccagctggcctggg

SEQ ID NO: 4233838 - DNA, 21 bp, Homo sapiens
gctggcctggggtccctctga

SEQ ID NO: 4233839 - DNA, 22 bp, Homo sapiens
gctgggatcacagctgcaggcc

SEQ ID NO: 4233840 - DNA, 17 bp, Homo sapiens
gcttcctgctgggactg

SEQ ID NO: 4233841 - DNA, 20 bp, Homo sapiens
ggaaagtttgtagcattttt

SEQ ID NO: 4233842 - DNA, 13 bp, Homo sapiens
ggacagcggcagt

SEQ ID NO: 4233843 - DNA, 19 bp, Homo sapiens
ggacagcggcagtgggcct

SEQ ID NO: 4233844 - DNA, 17 bp, Homo sapiens
ggaccagctggcctggg

SEQ ID NO: 4233845 - DNA, 21 bp, Homo sapiens
ggaccgcctgccctgcctggg

SEQ ID NO: 4233846 - DNA, 17 bp, Homo sapiens
ggactccatagctcctt

SEQ ID NO: 4233847 - DNA, 22 bp, Homo sapiens
ggattctgtgcctccaggacca

SEQ ID NO: 4233848 - DNA, 18 bp, Homo sapiens
ggcaacctggctctggcc

SEQ ID NO: 4233849 - DNA, 17 bp, Homo sapiens
ggcactgcagtctgcag

SEQ ID NO: 4233850 - DNA, 16 bp, Homo sapiens
ggcagtgggcctgctg

SEQ ID NO: 4233851 - DNA, 16 bp, Homo sapiens
ggccagcctgtccctg

SEQ ID NO: 4233852 - DNA, 15 bp, Homo sapiens
ggccagtttctctgc

SEQ ID NO: 4233853 - DNA, 23 bp, Homo sapiens
ggcccaccctctgcccagggagt

SEQ ID NO: 4233854 - DNA, 15 bp, Homo sapiens
ggcctgcgagaccca

SEQ ID NO: 4233855 - DNA, 20 bp, Homo sapiens
ggccttgccccaggccctgc

SEQ ID NO: 4233856 - DNA, 15 bp, Homo sapiens
ggccttggctgggcc

SEQ ID NO: 4233857 - DNA, 18 bp, Homo sapiens
ggctacgttagcagccca

SEQ ID NO: 4233858 - DNA, 20 bp, Homo sapiens
ggctagagtgcagtggtgcg

SEQ ID NO: 4233859 - DNA, 15 bp, Homo sapiens
ggctcactgcagcgc

SEQ ID NO: 4233860 - DNA, 13 bp, Homo sapiens
ggctgggcctgcg

SEQ ID NO: 4233861 - DNA, 18 bp, Homo sapiens
ggcttcctgctgggactg

SEQ ID NO: 4233862 - DNA, 18 bp, Homo sapiens
gggactccatagctcctt

SEQ ID NO: 4233863 - DNA, 19 bp, Homo sapiens
gggccagtttctctgcctt

SEQ ID NO: 4233864 - DNA, 13 bp, Homo sapiens
ggggctgctgcct

SEQ ID NO: 4233865 - DNA, 13 bp, Homo sapiens
ggtactaaaagaa

SEQ ID NO: 4233866 - DNA, 16 bp, Homo sapiens
ggtctataaaataaac

SEQ ID NO: 4233867 - DNA, 16 bp, Homo sapiens
ggtgttgtcagcaggc

SEQ ID NO: 4233868 - DNA, 13 bp, Homo sapiens
gtaaactgtttct

SEQ ID NO: 4233869 - DNA, 18 bp, Homo sapiens
gtaattcaactggaaatt

SEQ ID NO: 4233870 - DNA, 22 bp, Homo sapiens
gtacatattatcatcctataaa

SEQ ID NO: 4233871 - DNA, 23 bp, Homo sapiens
gtagctgggatcacagctgcagg

SEQ ID NO: 4233872 - DNA, 23 bp, Homo sapiens
gtatgacttaattttagaaagaa

SEQ ID NO: 4233873 - DNA, 14 bp, Homo sapiens
gtcaattgtttaat

SEQ ID NO: 4233874 - DNA, 14 bp, Homo sapiens
gtcacatagtcgtg

SEQ ID NO: 4233875 - DNA, 14 bp, Homo sapiens
aatgtctaacttaa

SEQ ID NO: 4233876 - DNA, 17 bp, Homo sapiens
aatgttggaaaacatat

SEQ ID NO: 4233877 - DNA, 18 bp, Homo sapiens
aatgttggaaaacatatg

SEQ ID NO: 4233878 - DNA, 22 bp, Homo sapiens
aatgttggaaaacatatgaaat

SEQ ID NO: 4233879 - DNA, 20 bp, Homo sapiens
aattcaactggaaattaaaa

SEQ ID NO: 4233880 - DNA, 15 bp, Homo sapiens
aattgaatgtacctt

SEQ ID NO: 4233881 - DNA, 18 bp, Homo sapiens
aatttctgctgtggtcta

SEQ ID NO: 4233882 - DNA, 17 bp, Homo sapiens
aattttagaaagaaaat

SEQ ID NO: 4233883 - DNA, 13 bp, Homo sapiens
aattttatctgta

SEQ ID NO: 4233884 - DNA, 19 bp, Homo sapiens
aattttatctgtataagct

SEQ ID NO: 4233885 - DNA, 23 bp, Homo sapiens
aattttatctgtataagctgtaa

SEQ ID NO: 4233886 - DNA, 14 bp, Homo sapiens
acaaatgaaagaga

SEQ ID NO: 4233887 - DNA, 18 bp, Homo sapiens
acaatctaattaaatggc

SEQ ID NO: 4233888 - DNA, 15 bp, Homo sapiens
acaatgccagggccc

SEQ ID NO: 4233889 - DNA, 20 bp, Homo sapiens
acacccaggtgatttcctct

SEQ ID NO: 4233890 - DNA, 13 bp, Homo sapiens
acactctgatttt

SEQ ID NO: 4233891 - DNA, 15 bp, Homo sapiens
acagctgcaggccac

SEQ ID NO: 4233892 - DNA, 18 bp, Homo sapiens
acagggtactaaaagaaa

SEQ ID NO: 4233893 - DNA, 16 bp, Homo sapiens
acagtattgctattta

SEQ ID NO: 4233894 - DNA, 12 bp, Homo sapiens
acatattatcat

SEQ ID NO: 4233895 - DNA, 15 bp, Homo sapiens
acatattatcatcct

SEQ ID NO: 4233896 - DNA, 15 bp, Homo sapiens
acatctcctccaata

SEQ ID NO: 4233897 - DNA, 15 bp, Homo sapiens
acattattaaagttt

SEQ ID NO: 4233898 - DNA, 17 bp, Homo sapiens
acattattaaagttttc

SEQ ID NO: 4233899 - DNA, 14 bp, Homo sapiens
acccctcagctccc

SEQ ID NO: 4233900 - DNA, 16 bp, Homo sapiens
acccctccctgcaggg

SEQ ID NO: 4233901 - DNA, 11 bp, Homo sapiens
accgcctgccc

SEQ ID NO: 4233902 - DNA, 17 bp, Homo sapiens
accgcctgccctgcctg

SEQ ID NO: 4233903 - DNA, 19 bp, Homo sapiens
accgcctgccctgcctggg

SEQ ID NO: 4233904 - DNA, 23 bp, Homo sapiens
accgcctgccctgcctgggcctt

SEQ ID NO: 4233905 - DNA, 18 bp, Homo sapiens
acctgctggatgggactc

SEQ ID NO: 4233906 - DNA, 19 bp, Homo sapiens
accttccatgtcaggccag

SEQ ID NO: 4233907 - DNA, 16 bp, Homo sapiens
acggggtgtgtggccc

SEQ ID NO: 4233908 - DNA, 17 bp, Homo sapiens
acgtttgcatagagaga

SEQ ID NO: 4233909 - DNA, 12 bp, Homo sapiens
actaatatatct

SEQ ID NO: 4233910 - DNA, 18 bp, Homo sapiens
actatataaatgacatta

SEQ ID NO: 4233911 - DNA, 14 bp, Homo sapiens
actatattttccct

SEQ ID NO: 4233912 - DNA, 13 bp, Homo sapiens
actattacagtat

SEQ ID NO: 4233913 - DNA, 14 bp, Homo sapiens
actgagagctgcct

SEQ ID NO: 4233914 - DNA, 14 bp, Homo sapiens
acttaattttagaa

SEQ ID NO: 4233915 - DNA, 21 bp, Homo sapiens
acttcagggaaggtgaaacag

SEQ ID NO: 4233916 - DNA, 22 bp, Homo sapiens
agaaaatgcattatttagtcaa

SEQ ID NO: 4233917 - DNA, 16 bp, Homo sapiens
agaaaattatattctg

SEQ ID NO: 4233918 - DNA, 17 bp, Homo sapiens
agaaaattatattctgt

SEQ ID NO: 4233919 - DNA, 20 bp, Homo sapiens
agaaaattatattctgttta

SEQ ID NO: 4233920 - DNA, 20 bp, Homo sapiens
agaaactatgatgtggagaa

SEQ ID NO: 4233921 - DNA, 17 bp, Homo sapiens
agaaacttggctggaat

SEQ ID NO: 4233922 - DNA, 19 bp, Homo sapiens
agaaagaaaattatattct

SEQ ID NO: 4233923 - DNA, 17 bp, Homo sapiens
agaaagccatatttttt

SEQ ID NO: 4233924 - DNA, 13 bp, Homo sapiens
agaaattgaatgt

SEQ ID NO: 4233925 - DNA, 17 bp, Homo sapiens
agaaattgaatgtacct

SEQ ID NO: 4233926 - DNA, 13 bp, Homo sapiens
agaggatgtggct

SEQ ID NO: 4233927 - DNA, 17 bp, Homo sapiens
agatataagatttgtac

SEQ ID NO: 4233928 - DNA, 22 bp, Homo sapiens
agatataagatttgtacatatt

SEQ ID NO: 4233929 - DNA, 16 bp, Homo sapiens
agatctggatcgttat

SEQ ID NO: 4233930 - DNA, 20 bp, Homo sapiens
agatgctctgagaaattgaa

SEQ ID NO: 4233931 - DNA, 17 bp, Homo sapiens
agatttcagctatgcta

SEQ ID NO: 4233932 - DNA, 16 bp, Homo sapiens
agatttgtacatatta

SEQ ID NO: 4233933 - DNA, 20 bp, Homo sapiens
agattttatggttttataac

SEQ ID NO: 4233934 - DNA, 15 bp, Homo sapiens
agcacatagcttgcc

SEQ ID NO: 4233935 - DNA, 18 bp, Homo sapiens
agcaccgcagcctctgcc

SEQ ID NO: 4233936 - DNA, 13 bp, Homo sapiens
agcagggctgggc

SEQ ID NO: 4233937 - DNA, 16 bp, Homo sapiens
agcagggctgggcctg

SEQ ID NO: 4233938 - DNA, 20 bp, Homo sapiens
agcagggctgggcctgcgag

SEQ ID NO: 4233939 - DNA, 19 bp, Homo sapiens
agcatttttctaataggta

SEQ ID NO: 4233940 - DNA, 20 bp, Homo sapiens
agccatatttttttctgtaa

SEQ ID NO: 4233941 - DNA, 13 bp, Homo sapiens
agcccggtgcagc

SEQ ID NO: 4233942 - DNA, 14 bp, Homo sapiens
agcctaggtgttgt

SEQ ID NO: 4233943 - DNA, 22 bp, Homo sapiens
agcctaggtgttgtcagcaggc

SEQ ID NO: 4233944 - DNA, 19 bp, Homo sapiens
agcggcagtgggcctgctg

SEQ ID NO: 4233945 - DNA, 21 bp, Homo sapiens
agctatgctagaggcttttat

SEQ ID NO: 4233946 - DNA, 18 bp, Homo sapiens
agctgcctcctggtctct

SEQ ID NO: 4233947 - DNA, 14 bp, Homo sapiens
agctgcttttaaaa

SEQ ID NO: 4233948 - DNA, 20 bp, Homo sapiens
agctgtaatatcattttata

SEQ ID NO: 4233949 - DNA, 13 bp, Homo sapiens
aggaccaggggcc

SEQ ID NO: 4233950 - DNA, 17 bp, Homo sapiens
aggcaggggctgctgcc

SEQ ID NO: 4233951 - DNA, 19 bp, Homo sapiens
aggccagtgttgtgggctt

SEQ ID NO: 4233952 - DNA, 20 bp, Homo sapiens
aggccagtgttgtgggcttc

SEQ ID NO: 4233953 - DNA, 16 bp, Homo sapiens
aggctggggaggccag

SEQ ID NO: 4233954 - DNA, 13 bp, Homo sapiens
aggcttttattag

SEQ ID NO: 4233955 - DNA, 18 bp, Homo sapiens
aggcttttattagaaagc

SEQ ID NO: 4233956 - DNA, 19 bp, Homo sapiens
agggagtccttgcgtccca

SEQ ID NO: 4233957 - DNA, 16 bp, Homo sapiens
aggggctgctgccttg

SEQ ID NO: 4233958 - DNA, 19 bp, Homo sapiens
agggtactaaaagaaacta

SEQ ID NO: 4233959 - DNA, 16 bp, Homo sapiens
agtaattcaactggaa

SEQ ID NO: 4233960 - DNA, 17 bp, Homo sapiens
agtaattcaactggaaa

SEQ ID NO: 4233961 - DNA, 18 bp, Homo sapiens
agtaattcaactggaaat

SEQ ID NO: 4233962 - DNA, 15 bp, Homo sapiens
agtatttttataatt

SEQ ID NO: 4233963 - DNA, 17 bp, Homo sapiens
agtatttttataatttt

SEQ ID NO: 4233964 - DNA, 18 bp, Homo sapiens
agtatttttataatttta

SEQ ID NO: 4233965 - DNA, 20 bp, Homo sapiens
agtatttttataattttatc

SEQ ID NO: 4233966 - DNA, 17 bp, Homo sapiens
agtcaattgtttaatgt

SEQ ID NO: 4233967 - DNA, 18 bp, Homo sapiens
agtcctccagcctcggcc

SEQ ID NO: 4233968 - DNA, 17 bp, Homo sapiens
agtgatatctttctcat

SEQ ID NO: 4233969 - DNA, 18 bp, Homo sapiens
agtgatcctcccacctca

SEQ ID NO: 4233970 - DNA, 12 bp, Homo sapiens
agttactaatat

SEQ ID NO: 4233971 - DNA, 14 bp, Homo sapiens
agttactaatatat

SEQ ID NO: 4233972 - DNA, 20 bp, Homo sapiens
agttactaatatatctgtaa

SEQ ID NO: 4233973 - DNA, 14 bp, Homo sapiens
agtttctctgcctt

SEQ ID NO: 4233974 - DNA, 14 bp, Homo sapiens
ataaaataaacttc

SEQ ID NO: 4233975 - DNA, 13 bp, Homo sapiens
ataaacttcttaa

SEQ ID NO: 4233976 - DNA, 20 bp, Homo sapiens
ataaacttcttaacatgctt

SEQ ID NO: 4233977 - DNA, 20 bp, Homo sapiens
ataaagaaacggtatgactt

SEQ ID NO: 4233978 - DNA, 14 bp, Homo sapiens
ataaattatctgaa

SEQ ID NO: 4233979 - DNA, 23 bp, Homo sapiens
ataaattatctgaatattagatg

SEQ ID NO: 4233980 - DNA, 18 bp, Homo sapiens
ataacctgccagtcccag

SEQ ID NO: 4233981 - DNA, 11 bp, Homo sapiens
ataactatata

SEQ ID NO: 4233982 - DNA, 22 bp, Homo sapiens
ataagatttgtacatattatca

SEQ ID NO: 4233983 - DNA, 23 bp, Homo sapiens
ataagctgtaatatcattttata

SEQ ID NO: 4233984 - DNA, 11 bp, Homo sapiens
ataattttatc

SEQ ID NO: 4233985 - DNA, 15 bp, Homo sapiens
ataattttatctgta

SEQ ID NO: 4233986 - DNA, 17 bp, Homo sapiens
ataattttatctgtata

SEQ ID NO: 4233987 - DNA, 15 bp, Homo sapiens
atagcccggtgcagc

SEQ ID NO: 4233988 - DNA, 14 bp, Homo sapiens
atagctttgagatt

SEQ ID NO: 4233989 - DNA, 14 bp, Homo sapiens
atataaattatctg

SEQ ID NO: 4233990 - DNA, 15 bp, Homo sapiens
atataaattatctga

SEQ ID NO: 4233991 - DNA, 16 bp, Homo sapiens
atataagatttgtaca

SEQ ID NO: 4233992 - DNA, 19 bp, Homo sapiens
atataagatttgtacatat

SEQ ID NO: 4233993 - DNA, 11 bp, Homo sapiens
atatatctgta

SEQ ID NO: 4233994 - DNA, 17 bp, Homo sapiens
atatatctgtaacacta

SEQ ID NO: 4233995 - DNA, 16 bp, Homo sapiens
atatatttttaatgga

SEQ ID NO: 4233996 - DNA, 20 bp, Homo sapiens
atatatttttaatggaaagt

SEQ ID NO: 4233997 - DNA, 20 bp, Homo sapiens
atatctgtaacactattaca

SEQ ID NO: 4233998 - DNA, 14 bp, Homo sapiens
atatctttctcatt

SEQ ID NO: 4233999 - DNA, 20 bp, Homo sapiens
atatctttctcattaccagt

SEQ ID NO: 4234000 - DNA, 14 bp, Homo sapiens
atatgaaatataaa

SEQ ID NO: 4234001 - DNA, 21 bp, Homo sapiens
atatgaaatataaattatctg

SEQ ID NO: 4234002 - DNA, 23 bp, Homo sapiens
atattagatgctctgagaaattg

SEQ ID NO: 4234003 - DNA, 21 bp, Homo sapiens
atattatcatcctataaagaa

SEQ ID NO: 4234004 - DNA, 17 bp, Homo sapiens
atatttttaatggaaag

SEQ ID NO: 4234005 - DNA, 20 bp, Homo sapiens
atatttttaatggaaagttt

SEQ ID NO: 4234006 - DNA, 16 bp, Homo sapiens
atatttttttctgtaa

SEQ ID NO: 4234007 - DNA, 18 bp, Homo sapiens
atatttttttctgtaaaa

SEQ ID NO: 4234008 - DNA, 15 bp, Homo sapiens
atcatcctataaaga

SEQ ID NO: 4234009 - DNA, 16 bp, Homo sapiens
atcatcctataaagaa

SEQ ID NO: 4234010 - DNA, 17 bp, Homo sapiens
atcatcgaagtcttccc

SEQ ID NO: 4234011 - DNA, 16 bp, Homo sapiens
atctaattaaatggca

SEQ ID NO: 4234012 - DNA, 17 bp, Homo sapiens
atctactgactatattt

SEQ ID NO: 4234013 - DNA, 17 bp, Homo sapiens
atctgtataagctgtaa

SEQ ID NO: 4234014 - DNA, 13 bp, Homo sapiens
atctttctcatta

SEQ ID NO: 4234015 - DNA, 21 bp, Homo sapiens
atgaaagagaaaatatatatt

SEQ ID NO: 4234016 - DNA, 13 bp, Homo sapiens
atgaaatataaat

SEQ ID NO: 4234017 - DNA, 14 bp, Homo sapiens
atgaaatataaatt

SEQ ID NO: 4234018 - DNA, 22 bp, Homo sapiens
atgactcataggtccctgacat

SEQ ID NO: 4234019 - DNA, 15 bp, Homo sapiens
atgacttaattttag

SEQ ID NO: 4234020 - DNA, 22 bp, Homo sapiens
atgacttaattttagaaagaaa

SEQ ID NO: 4234021 - DNA, 15 bp, Homo sapiens
atgaggtcttcccgc

SEQ ID NO: 4234022 - DNA, 15 bp, Homo sapiens
atgccagggcccagg

SEQ ID NO: 4234023 - DNA, 15 bp, Homo sapiens
atgctagaggctttt

SEQ ID NO: 4234024 - DNA, 19 bp, Homo sapiens
atgctagaggcttttatta

SEQ ID NO: 4234025 - DNA, 14 bp, Homo sapiens
atgctctgagaaat

SEQ ID NO: 4234026 - DNA, 21 bp, Homo sapiens
atggatgagtaaactgtttct

SEQ ID NO: 4234027 - DNA, 19 bp, Homo sapiens
atggttttataactatata

SEQ ID NO: 4234028 - DNA, 14 bp, Homo sapiens
atgtctaacttaaa

SEQ ID NO: 4234029 - DNA, 15 bp, Homo sapiens
atgtctaacttaaat

SEQ ID NO: 4234030 - DNA, 18 bp, Homo sapiens
atgtctaacttaaatagc

SEQ ID NO: 4234031 - DNA, 15 bp, Homo sapiens
atgttacccagcctg

SEQ ID NO: 4234032 - DNA, 14 bp, Homo sapiens
atgttggaaaacat

SEQ ID NO: 4234033 - DNA, 14 bp, Homo sapiens
attacagtattgct

SEQ ID NO: 4234034 - DNA, 20 bp, Homo sapiens
attaccagtgactaattttg

SEQ ID NO: 4234035 - DNA, 16 bp, Homo sapiens
attactgcttgcagta

SEQ ID NO: 4234036 - DNA, 22 bp, Homo sapiens
attagatgctctgagaaattga

SEQ ID NO: 4234037 - DNA, 13 bp, Homo sapiens
attatctgaatat

SEQ ID NO: 4234038 - DNA, 15 bp, Homo sapiens
attattaaagttttc

SEQ ID NO: 4234039 - DNA, 15 bp, Homo sapiens
attatttagtcaatt

SEQ ID NO: 4234040 - DNA, 20 bp, Homo sapiens
attatttagtcaattgttta

SEQ ID NO: 4234041 - DNA, 13 bp, Homo sapiens
attcaactggaaa

SEQ ID NO: 4234042 - DNA, 16 bp, Homo sapiens
attcaactggaaatta

SEQ ID NO: 4234043 - DNA, 19 bp, Homo sapiens
attcaactggaaattaaaa

SEQ ID NO: 4234044 - DNA, 21 bp, Homo sapiens
attcaactggaaattaaaaaa

SEQ ID NO: 4234045 - DNA, 16 bp, Homo sapiens
attcagatataagatt

SEQ ID NO: 4234046 - DNA, 15 bp, Homo sapiens
attcattcagatata

SEQ ID NO: 4234047 - DNA, 22 bp, Homo sapiens
attcattcagatataagatttg

SEQ ID NO: 4234048 - DNA, 20 bp, Homo sapiens
attctgtgcctccaggacca

SEQ ID NO: 4234049 - DNA, 22 bp, Homo sapiens
attctgtgcctccaggaccagg

SEQ ID NO: 4234050 - DNA, 16 bp, Homo sapiens
attctgtttattatga

SEQ ID NO: 4234051 - DNA, 17 bp, Homo sapiens
attgaatgtaccttatt

SEQ ID NO: 4234052 - DNA, 19 bp, Homo sapiens
attgaatgtaccttattta

SEQ ID NO: 4234053 - DNA, 14 bp, Homo sapiens
attgagctgtttcc

SEQ ID NO: 4234054 - DNA, 15 bp, Homo sapiens
attgctatttatatt

SEQ ID NO: 4234055 - DNA, 17 bp, Homo sapiens
attgctatttatattca

SEQ ID NO: 4234056 - DNA, 14 bp, Homo sapiens
atttaaaagatttt

SEQ ID NO: 4234057 - DNA, 20 bp, Homo sapiens
atttagtcaattgtttaatg

SEQ ID NO: 4234058 - DNA, 16 bp, Homo sapiens
atttcctctaaagaaa

SEQ ID NO: 4234059 - DNA, 18 bp, Homo sapiens
atttcctctaaagaaact

SEQ ID NO: 4234060 - DNA, 19 bp, Homo sapiens
attttagaaagaaaattat

SEQ ID NO: 4234061 - DNA, 15 bp, Homo sapiens
attttatagaaaatg

SEQ ID NO: 4234062 - DNA, 18 bp, Homo sapiens
attttatagaaaatgcat

SEQ ID NO: 4234063 - DNA, 20 bp, Homo sapiens
atttttaatggaaagtttgt

SEQ ID NO: 4234064 - DNA, 15 bp, Homo sapiens
atttttttctgtaaa

SEQ ID NO: 4234065 - DNA, 23 bp, Homo sapiens
caaataaatgccttccacctcac

SEQ ID NO: 4234066 - DNA, 19 bp, Homo sapiens
caaccttcggagtagctgg

SEQ ID NO: 4234067 - DNA, 15 bp, Homo sapiens
caaggctcactgcag

SEQ ID NO: 4234068 - DNA, 13 bp, Homo sapiens
ccttgcagcaggg

SEQ ID NO: 4234069 - DNA, 17 bp, Homo sapiens
ccttgcttagcctgtgc

SEQ ID NO: 4234070 - DNA, 19 bp, Homo sapiens
ccttgcttagcctgtgctg

SEQ ID NO: 4234071 - DNA, 12 bp, Homo sapiens
ccttggctgggc

SEQ ID NO: 4234072 - DNA, 13 bp, Homo sapiens
cgcaaggcctctc

SEQ ID NO: 4234073 - DNA, 13 bp, Homo sapiens
cgcagcctctgcc

SEQ ID NO: 4234074 - DNA, 15 bp, Homo sapiens
cgcctgccctgcctg

SEQ ID NO: 4234075 - DNA, 20 bp, Homo sapiens
cggagtagctgggatcacag

SEQ ID NO: 4234076 - DNA, 19 bp, Homo sapiens
cgggccagtttctctgcct

SEQ ID NO: 4234077 - DNA, 16 bp, Homo sapiens
cggtatgacttaattt

SEQ ID NO: 4234078 - DNA, 19 bp, Homo sapiens
cgtcccatgaggtcttccc

SEQ ID NO: 4234079 - DNA, 14 bp, Homo sapiens
ctaatggctttcac

SEQ ID NO: 4234080 - DNA, 19 bp, Homo sapiens
ctatgatgtggagaaagga

SEQ ID NO: 4234081 - DNA, 16 bp, Homo sapiens
ctatgctagaggcttt

SEQ ID NO: 4234082 - DNA, 19 bp, Homo sapiens
ctcaggcacttgaggcttt

SEQ ID NO: 4234083 - DNA, 20 bp, Homo sapiens
ctcataggtccctgacattt

SEQ ID NO: 4234084 - DNA, 17 bp, Homo sapiens
ctccaagttgctgcagc

SEQ ID NO: 4234085 - DNA, 18 bp, Homo sapiens
ctccatagctccttccca

SEQ ID NO: 4234086 - DNA, 14 bp, Homo sapiens
ctccctgcaggggc

SEQ ID NO: 4234087 - DNA, 15 bp, Homo sapiens
ctccctgcaggggct

SEQ ID NO: 4234088 - DNA, 17 bp, Homo sapiens
ctccttcccaggacccc

SEQ ID NO: 4234089 - DNA, 15 bp, Homo sapiens
ctccttgcagcaggg

SEQ ID NO: 4234090 - DNA, 12 bp, Homo sapiens
ctctcagaccca

SEQ ID NO: 4234091 - DNA, 13 bp, Homo sapiens
ctctcagacccag

SEQ ID NO: 4234092 - DNA, 20 bp, Homo sapiens
ctctggccttgccccaggcc

SEQ ID NO: 4234093 - DNA, 13 bp, Homo sapiens
ctgaagagacctt

SEQ ID NO: 4234094 - DNA, 22 bp, Homo sapiens
ctgacccctccctgcaggggct

SEQ ID NO: 4234095 - DNA, 17 bp, Homo sapiens
ctgactatattttccct

SEQ ID NO: 4234096 - DNA, 20 bp, Homo sapiens
ctgaggccttctcttgaggc

SEQ ID NO: 4234097 - DNA, 12 bp, Homo sapiens
ctgcccagggag

SEQ ID NO: 4234098 - DNA, 17 bp, Homo sapiens
ctgcccagggagtcctt

SEQ ID NO: 4234099 - DNA, 17 bp, Homo sapiens
ctgcctgggccttggct

SEQ ID NO: 4234100 - DNA, 13 bp, Homo sapiens
ctgctgaggcctt

SEQ ID NO: 4234101 - DNA, 14 bp, Homo sapiens
ctgctgaggccttc

SEQ ID NO: 4234102 - DNA, 13 bp, Homo sapiens
ctgctgccttgtt

SEQ ID NO: 4234103 - DNA, 12 bp, Homo sapiens
ctgctgggactg

SEQ ID NO: 4234104 - DNA, 22 bp, Homo sapiens
ctgctgtggtctataaaataaa

SEQ ID NO: 4234105 - DNA, 14 bp, Homo sapiens
ctggaatttctgct

SEQ ID NO: 4234106 - DNA, 15 bp, Homo sapiens
ctggaccagctggcc

SEQ ID NO: 4234107 - DNA, 12 bp, Homo sapiens
ctggaggcaggg

SEQ ID NO: 4234108 - DNA, 15 bp, Homo sapiens
ctggaggcaggggct

SEQ ID NO: 4234109 - DNA, 17 bp, Homo sapiens
ctggatcgttatctact

SEQ ID NO: 4234110 - DNA, 15 bp, Homo sapiens
ctggcagaggcactc

SEQ ID NO: 4234111 - DNA, 17 bp, Homo sapiens
ctggctccttgcagcag

SEQ ID NO: 4234112 - DNA, 13 bp, Homo sapiens
ctgggacaggctt

SEQ ID NO: 4234113 - DNA, 19 bp, Homo sapiens
ctggggcagatgtctcccc

SEQ ID NO: 4234114 - DNA, 17 bp, Homo sapiens
ctggtctcttcaccact

SEQ ID NO: 4234115 - DNA, 21 bp, Homo sapiens
ctgtaaaagttactaatatat

SEQ ID NO: 4234116 - DNA, 14 bp, Homo sapiens
ctgtaacctgctgg

SEQ ID NO: 4234117 - DNA, 21 bp, Homo sapiens
ctgtataagctgtaatatcat

SEQ ID NO: 4234118 - DNA, 20 bp, Homo sapiens
ctgtccctcctaacaagtgt

SEQ ID NO: 4234119 - DNA, 22 bp, Homo sapiens
ctgtgcctccaggaccaggggc

SEQ ID NO: 4234120 - DNA, 19 bp, Homo sapiens
ctgtggtctataaaataaa

SEQ ID NO: 4234121 - DNA, 23 bp, Homo sapiens
ctgtggtctataaaataaacttc

SEQ ID NO: 4234122 - DNA, 14 bp, Homo sapiens
ctgtttgccacacc

SEQ ID NO: 4234123 - DNA, 23 bp, Homo sapiens
ctgtttgccacacccaggtgatt

SEQ ID NO: 4234124 - DNA, 23 bp, Homo sapiens
cttaagcagaactaagctcagta

SEQ ID NO: 4234125 - DNA, 20 bp, Homo sapiens
cttaggggaaccctgtccct

SEQ ID NO: 4234126 - DNA, 22 bp, Homo sapiens
cttattactgcttgcagtaatt

SEQ ID NO: 4234127 - DNA, 14 bp, Homo sapiens
cttatttaaaagat

SEQ ID NO: 4234128 - DNA, 16 bp, Homo sapiens
cttatttaaaagattt

SEQ ID NO: 4234129 - DNA, 23 bp, Homo sapiens
cttatttaaaagattttatggtt

SEQ ID NO: 4234130 - DNA, 17 bp, Homo sapiens
cttccatgtcaggccag

SEQ ID NO: 4234131 - DNA, 19 bp, Homo sapiens
taattttagaaagaaaatt

SEQ ID NO: 4234132 - DNA, 23 bp, Homo sapiens
taattttagaaagaaaattatat

SEQ ID NO: 4234133 - DNA, 13 bp, Homo sapiens
taattttatctgt

SEQ ID NO: 4234134 - DNA, 14 bp, Homo sapiens
taattttatctgta

SEQ ID NO: 4234135 - DNA, 15 bp, Homo sapiens
tactaaaagaaacta

SEQ ID NO: 4234136 - DNA, 21 bp, Homo sapiens
tactaaaagaaactatgatgt

SEQ ID NO: 4234137 - DNA, 16 bp, Homo sapiens
tactaaatatgggaat

SEQ ID NO: 4234138 - DNA, 13 bp, Homo sapiens
tactgccatattt

SEQ ID NO: 4234139 - DNA, 16 bp, Homo sapiens
tactgccatatttttc

SEQ ID NO: 4234140 - DNA, 18 bp, Homo sapiens
tactgcttgcagtaattc

SEQ ID NO: 4234141 - DNA, 18 bp, Homo sapiens
tagaaaatgcattattta

SEQ ID NO: 4234142 - DNA, 16 bp, Homo sapiens
tagaaagccatatttt

SEQ ID NO: 4234143 - DNA, 16 bp, Homo sapiens
tagaattgcaggtctc

SEQ ID NO: 4234144 - DNA, 14 bp, Homo sapiens
tagaggcttttatt

SEQ ID NO: 4234145 - DNA, 18 bp, Homo sapiens
tagaggcttttattagaa

SEQ ID NO: 4234146 - DNA, 16 bp, Homo sapiens
tagatgctctgagaaa

SEQ ID NO: 4234147 - DNA, 20 bp, Homo sapiens
tagcttgcctaatggctttc

SEQ ID NO: 4234148 - DNA, 18 bp, Homo sapiens
tataaatgacattattaa

SEQ ID NO: 4234149 - DNA, 20 bp, Homo sapiens
tataaattatctgaatatta

SEQ ID NO: 4234150 - DNA, 12 bp, Homo sapiens
tataattttatc

SEQ ID NO: 4234151 - DNA, 19 bp, Homo sapiens
tataattttatctgtataa

SEQ ID NO: 4234152 - DNA, 15 bp, Homo sapiens
tatatatttttaatg

SEQ ID NO: 4234153 - DNA, 13 bp, Homo sapiens
tatatctgtaaca

SEQ ID NO: 4234154 - DNA, 23 bp, Homo sapiens
tatatctgtaacactattacagt

SEQ ID NO: 4234155 - DNA, 23 bp, Homo sapiens
tatattcattcagatataagatt

SEQ ID NO: 4234156 - DNA, 18 bp, Homo sapiens
tatatttttaatggaaag

SEQ ID NO: 4234157 - DNA, 12 bp, Homo sapiens
tatcattttata

SEQ ID NO: 4234158 - DNA, 17 bp, Homo sapiens
tatcattttatagaaaa

SEQ ID NO: 4234159 - DNA, 14 bp, Homo sapiens
tatctgaatattag

SEQ ID NO: 4234160 - DNA, 12 bp, Homo sapiens
tatctttctcat

SEQ ID NO: 4234161 - DNA, 19 bp, Homo sapiens
tatgaaatataaattatct

SEQ ID NO: 4234162 - DNA, 23 bp, Homo sapiens
tatgctagaggcttttattagaa

SEQ ID NO: 4234163 - DNA, 24 bp, Homo sapiens
tatgctagaggcttttattagaaa

SEQ ID NO: 4234164 - DNA, 22 bp, Homo sapiens
tattaaagttttcaaattattt

SEQ ID NO: 4234165 - DNA, 14 bp, Homo sapiens
tattacagtattgc

SEQ ID NO: 4234166 - DNA, 15 bp, Homo sapiens
tattacagtattgct

SEQ ID NO: 4234167 - DNA, 14 bp, Homo sapiens
tattagatgctctg

SEQ ID NO: 4234168 - DNA, 23 bp, Homo sapiens
tattcattcagatataagatttg

SEQ ID NO: 4234169 - DNA, 12 bp, Homo sapiens
tattctgtttat

SEQ ID NO: 4234170 - DNA, 20 bp, Homo sapiens
tattctgtttattatgacaa

SEQ ID NO: 4234171 - DNA, 12 bp, Homo sapiens
tattgctattta

SEQ ID NO: 4234172 - DNA, 22 bp, Homo sapiens
tatttagtcaattgtttaatgt

SEQ ID NO: 4234173 - DNA, 15 bp, Homo sapiens
tatttttttctgtaa

SEQ ID NO: 4234174 - DNA, 16 bp, Homo sapiens
tatttttttctgtaaa

SEQ ID NO: 4234175 - DNA, 17 bp, Homo sapiens
tcaactggaaattaaaa

SEQ ID NO: 4234176 - DNA, 13 bp, Homo sapiens
tcacagctgcagg

SEQ ID NO: 4234177 - DNA, 15 bp, Homo sapiens
tcacagctgcaggcc

SEQ ID NO: 4234178 - DNA, 19 bp, Homo sapiens
tcaccttccatgtcaggcc

SEQ ID NO: 4234179 - DNA, 19 bp, Homo sapiens
tcactgcagcgcgctcctg

SEQ ID NO: 4234180 - DNA, 20 bp, Homo sapiens
tcagatataagatttgtaca

SEQ ID NO: 4234181 - DNA, 13 bp, Homo sapiens
tcagcaggcaggc

SEQ ID NO: 4234182 - DNA, 16 bp, Homo sapiens
tcagcaggcaggctgg

SEQ ID NO: 4234183 - DNA, 21 bp, Homo sapiens
tcagctccccggcactgcagt

SEQ ID NO: 4234184 - DNA, 14 bp, Homo sapiens
tcagctgcttttaa

SEQ ID NO: 4234185 - DNA, 18 bp, Homo sapiens
tcaggccagcctgtccct

SEQ ID NO: 4234186 - DNA, 11 bp, Homo sapiens
tcaggctggga

SEQ ID NO: 4234187 - DNA, 18 bp, Homo sapiens
tcaggctgggacaggctt

SEQ ID NO: 4234188 - DNA, 19 bp, Homo sapiens
tcagtgatatctttctcat

SEQ ID NO: 4234189 - DNA, 15 bp, Homo sapiens
tcattttatagaaaa

SEQ ID NO: 4234190 - DNA, 17 bp, Homo sapiens
tcattttatagaaaatg

SEQ ID NO: 4234191 - DNA, 15 bp, Homo sapiens
tccaggaccaggggc

SEQ ID NO: 4234192 - DNA, 16 bp, Homo sapiens
tccaggatcaggggtt

SEQ ID NO: 4234193 - DNA, 18 bp, Homo sapiens
tccatgtcaggccagcct

SEQ ID NO: 4234194 - DNA, 18 bp, Homo sapiens
tccattgtgccttactaa

SEQ ID NO: 4234195 - DNA, 18 bp, Homo sapiens
tcccaggacccctcagct

SEQ ID NO: 4234196 - DNA, 15 bp, Homo sapiens
tcccatgaggtcttc

SEQ ID NO: 4234197 - DNA, 15 bp, Homo sapiens
tcccttgcttagcct

SEQ ID NO: 4234198 - DNA, 18 bp, Homo sapiens
tcccttgcttagcctgtg

SEQ ID NO: 4234199 - DNA, 19 bp, Homo sapiens
tcccttgcttagcctgtgc

SEQ ID NO: 4234200 - DNA, 15 bp, Homo sapiens
tcctataaagaaacg

SEQ ID NO: 4234201 - DNA, 17 bp, Homo sapiens
tcctctaaagaaacttg

SEQ ID NO: 4234202 - DNA, 21 bp, Homo sapiens
tcctgacccctccctgcaggg

SEQ ID NO: 4234203 - DNA, 24 bp, Homo sapiens
tcctggaggcaggggctgctgcct

SEQ ID NO: 4234204 - DNA, 15 bp, Homo sapiens
tccttgcagcagggc

SEQ ID NO: 4234205 - DNA, 21 bp, Homo sapiens
tccttgcgtcccatgaggtct

SEQ ID NO: 4234206 - DNA, 20 bp, Homo sapiens
tctaaagaaacttggctgga

SEQ ID NO: 4234207 - DNA, 22 bp, Homo sapiens
tctaataggtactgccatattt

SEQ ID NO: 4234208 - DNA, 14 bp, Homo sapiens
tctactgactatat

SEQ ID NO: 4234209 - DNA, 16 bp, Homo sapiens
tctagaggtctctctg

SEQ ID NO: 4234210 - DNA, 15 bp, Homo sapiens
tctaggtggcaggac

SEQ ID NO: 4234211 - DNA, 16 bp, Homo sapiens
tctaggtggcaggaca

SEQ ID NO: 4234212 - DNA, 15 bp, Homo sapiens
tctataaaataaact

SEQ ID NO: 4234213 - DNA, 12 bp, Homo sapiens
tctcagacccag

SEQ ID NO: 4234214 - DNA, 13 bp, Homo sapiens
tctcagacccaga

SEQ ID NO: 4234215 - DNA, 17 bp, Homo sapiens
tctcagacccagatgtg

SEQ ID NO: 4234216 - DNA, 18 bp, Homo sapiens
tctcctggaggcaggggc

SEQ ID NO: 4234217 - DNA, 21 bp, Homo sapiens
tctctgtacgggccagtttct

SEQ ID NO: 4234218 - DNA, 14 bp, Homo sapiens
tctgaatattagat

SEQ ID NO: 4234219 - DNA, 17 bp, Homo sapiens
tctggatcgttatctac

SEQ ID NO: 4234220 - DNA, 17 bp, Homo sapiens
tctgtaaaagttactaa

SEQ ID NO: 4234221 - DNA, 23 bp, Homo sapiens
tctgtaaaagttactaatatatc

SEQ ID NO: 4234222 - DNA, 21 bp, Homo sapiens
tctgtaacactattacagtat

SEQ ID NO: 4234223 - DNA, 23 bp, Homo sapiens
tctgtataagctgtaatatcatt

SEQ ID NO: 4234224 - DNA, 16 bp, Homo sapiens
tctgtttattatgaca

SEQ ID NO: 4234225 - DNA, 19 bp, Homo sapiens
tcttgatatctttcctccc

SEQ ID NO: 4234226 - DNA, 17 bp, Homo sapiens
tctttaaaagtgcctta

SEQ ID NO: 4234227 - DNA, 14 bp, Homo sapiens
tctttcttttctct

SEQ ID NO: 4234228 - DNA, 12 bp, Homo sapiens
tgaaagagaaaa

SEQ ID NO: 4234229 - DNA, 13 bp, Homo sapiens
tgaaagagaaaat

SEQ ID NO: 4234230 - DNA, 21 bp, Homo sapiens
tgaaatataaattatctgaat

SEQ ID NO: 4234231 - DNA, 22 bp, Homo sapiens
tgaatattagatgctctgagaa

SEQ ID NO: 4234232 - DNA, 19 bp, Homo sapiens
tgacaaatgaaagagaaaa

SEQ ID NO: 4234233 - DNA, 17 bp, Homo sapiens
tgacattattaaagttt

SEQ ID NO: 4234234 - DNA, 16 bp, Homo sapiens
tgacccctccctgcag

SEQ ID NO: 4234235 - DNA, 20 bp, Homo sapiens
tgacttaattttagaaagaa

SEQ ID NO: 4234236 - DNA, 13 bp, Homo sapiens
tgagaaattgaat

SEQ ID NO: 4234237 - DNA, 15 bp, Homo sapiens
tgagaaattgaatgt

SEQ ID NO: 4234238 - DNA, 18 bp, Homo sapiens
tgagatttcagctatgct

SEQ ID NO: 4234239 - DNA, 12 bp, Homo sapiens
tgaggcctgtgc

SEQ ID NO: 4234240 - DNA, 15 bp, Homo sapiens
tgaggcctgtgctct

SEQ ID NO: 4234241 - DNA, 17 bp, Homo sapiens
tgatgaggactgtcccc

SEQ ID NO: 4234242 - DNA, 14 bp, Homo sapiens
tgcagcagggctgg

SEQ ID NO: 4234243 - DNA, 15 bp, Homo sapiens
tgcagcagggctggg

SEQ ID NO: 4234244 - DNA, 18 bp, Homo sapiens
tgcagcagggctgggcct

SEQ ID NO: 4234245 - DNA, 19 bp, Homo sapiens
tgcagcagggctgggcctg

SEQ ID NO: 4234246 - DNA, 20 bp, Homo sapiens
tgcagcttggcattcttctt

SEQ ID NO: 4234247 - DNA, 24 bp, Homo sapiens
tgcaggggctacgttagcagccca

SEQ ID NO: 4234248 - DNA, 16 bp, Homo sapiens
tgccactcctcaaact

SEQ ID NO: 4234249 - DNA, 14 bp, Homo sapiens
tgccagggcccagg

SEQ ID NO: 4234250 - DNA, 16 bp, Homo sapiens
tgccagggcccaggag

SEQ ID NO: 4234251 - DNA, 18 bp, Homo sapiens
tgccctggctccttgcag

SEQ ID NO: 4234252 - DNA, 19 bp, Homo sapiens
aaaagttactaatatatct

SEQ ID NO: 4234253 - DNA, 21 bp, Homo sapiens
aaaagttactaatatatctgt

SEQ ID NO: 4234254 - DNA, 22 bp, Homo sapiens
aaaagttactaatatatctgta

SEQ ID NO: 4234255 - DNA, 11 bp, Homo sapiens
aaaataaactt

SEQ ID NO: 4234256 - DNA, 15 bp, Homo sapiens
aaaataaacttctta

SEQ ID NO: 4234257 - DNA, 14 bp, Homo sapiens
aaaatatatatttt

SEQ ID NO: 4234258 - DNA, 16 bp, Homo sapiens
aaactagactccattg

SEQ ID NO: 4234259 - DNA, 14 bp, Homo sapiens
aaacttcttaacat

SEQ ID NO: 4234260 - DNA, 14 bp, Homo sapiens
aaagaaaattatat

SEQ ID NO: 4234261 - DNA, 13 bp, Homo sapiens
aaagagaaaatat

SEQ ID NO: 4234262 - DNA, 21 bp, Homo sapiens
aaagccatatttttttctgta

SEQ ID NO: 4234263 - DNA, 22 bp, Homo sapiens
aaagccatatttttttctgtaa

SEQ ID NO: 4234264 - DNA, 22 bp, Homo sapiens
aaagggctaaacatgtgaggcc

SEQ ID NO: 4234265 - DNA, 13 bp, Homo sapiens
aaataaacttctt

SEQ ID NO: 4234266 - DNA, 13 bp, Homo sapiens
aaatatatatttt

SEQ ID NO: 4234267 - DNA, 14 bp, Homo sapiens
aaatgaaagagaaa

SEQ ID NO: 4234268 - DNA, 16 bp, Homo sapiens
aaatgaaagagaaaat

SEQ ID NO: 4234269 - DNA, 22 bp, Homo sapiens
aaatggcatcagcactttaacc

SEQ ID NO: 4234270 - DNA, 22 bp, Homo sapiens
aaatggccattgagctgtttcc

SEQ ID NO: 4234271 - DNA, 16 bp, Homo sapiens
aaattatattctgttt

SEQ ID NO: 4234272 - DNA, 12 bp, Homo sapiens
aaattgaatgta

SEQ ID NO: 4234273 - DNA, 15 bp, Homo sapiens
aacatatgaaatata

SEQ ID NO: 4234274 - DNA, 16 bp, Homo sapiens
aacatatgaaatataa

SEQ ID NO: 4234275 - DNA, 17 bp, Homo sapiens
aacatatgaaatataaa

SEQ ID NO: 4234276 - DNA, 20 bp, Homo sapiens
aacatatgaaatataaatta

SEQ ID NO: 4234277 - DNA, 21 bp, Homo sapiens
aacatatgaaatataaattat

SEQ ID NO: 4234278 - DNA, 16 bp, Homo sapiens
aacatctcctccaata

SEQ ID NO: 4234279 - DNA, 14 bp, Homo sapiens
aactatataaatga

SEQ ID NO: 4234280 - DNA, 18 bp, Homo sapiens
aactatgatgtggagaaa

SEQ ID NO: 4234281 - DNA, 15 bp, Homo sapiens
aagaaaattatattc

SEQ ID NO: 4234282 - DNA, 13 bp, Homo sapiens
aagagaaaatata

SEQ ID NO: 4234283 - DNA, 14 bp, Homo sapiens
aagagaccttggct

SEQ ID NO: 4234284 - DNA, 21 bp, Homo sapiens
aagatttgtacatattatcat

SEQ ID NO: 4234285 - DNA, 17 bp, Homo sapiens
aagctgtaatatcattt

SEQ ID NO: 4234286 - DNA, 17 bp, Homo sapiens
aagttactaatatatct

SEQ ID NO: 4234287 - DNA, 20 bp, Homo sapiens
aagttactaatatatctgta

SEQ ID NO: 4234288 - DNA, 21 bp, Homo sapiens
aagttactaatatatctgtaa

SEQ ID NO: 4234289 - DNA, 22 bp, Homo sapiens
aagttactaatatatctgtaac

SEQ ID NO: 4234290 - DNA, 16 bp, Homo sapiens
aagttttcaaattatt

SEQ ID NO: 4234291 - DNA, 17 bp, Homo sapiens
aataaacttcttaacat

SEQ ID NO: 4234292 - DNA, 12 bp, Homo sapiens
aatatatctgta

SEQ ID NO: 4234293 - DNA, 21 bp, Homo sapiens
aatatatctgtaacactatta

SEQ ID NO: 4234294 - DNA, 20 bp, Homo sapiens
aatatcattttatagaaaat

SEQ ID NO: 4234295 - DNA, 17 bp, Homo sapiens
aatatgggaatgtctaa

SEQ ID NO: 4234296 - DNA, 12 bp, Homo sapiens
aatgaaagagaa

SEQ ID NO: 4234297 - DNA, 15 bp, Homo sapiens
aatgccagggcccag

SEQ ID NO: 4234298 - DNA, 20 bp, Homo sapiens
aatggaaagtttgtagcatt

SEQ ID NO: 4234299 - DNA, 20 bp, Homo sapiens
aatggccattgagctgtttc

SEQ ID NO: 4234300 - DNA, 21 bp, Homo sapiens
aatgttggaaaacatatgaaa

SEQ ID NO: 4234301 - DNA, 17 bp, Homo sapiens
aattatctgaatattag

SEQ ID NO: 4234302 - DNA, 14 bp, Homo sapiens
aattcaactggaaa

SEQ ID NO: 4234303 - DNA, 15 bp, Homo sapiens
aattttagaaagaaa

SEQ ID NO: 4234304 - DNA, 12 bp, Homo sapiens
acaaatgaaaga

SEQ ID NO: 4234305 - DNA, 18 bp, Homo sapiens
acaaatgaaagagaaaat

SEQ ID NO: 4234306 - DNA, 18 bp, Homo sapiens
acacccaggtgatttcct

SEQ ID NO: 4234307 - DNA, 20 bp, Homo sapiens
acactattacagtattgcta

SEQ ID NO: 4234308 - DNA, 21 bp, Homo sapiens
acactattacagtattgctat

SEQ ID NO: 4234309 - DNA, 17 bp, Homo sapiens
acagggtactaaaagaa

SEQ ID NO: 4234310 - DNA, 23 bp, Homo sapiens
acagtattgctatttatattcat

SEQ ID NO: 4234311 - DNA, 14 bp, Homo sapiens
acatatgaaatata

SEQ ID NO: 4234312 - DNA, 23 bp, Homo sapiens
acatatgaaatataaattatctg

SEQ ID NO: 4234313 - DNA, 13 bp, Homo sapiens
accagctggcctg

SEQ ID NO: 4234314 - DNA, 21 bp, Homo sapiens
accagctggcctggggtccct

SEQ ID NO: 4234315 - DNA, 17 bp, Homo sapiens
accagtgactaattttg

SEQ ID NO: 4234316 - DNA, 21 bp, Homo sapiens
acccaggtgatttcctctaaa

SEQ ID NO: 4234317 - DNA, 18 bp, Homo sapiens
acccctccctgcaggggc

SEQ ID NO: 4234318 - DNA, 15 bp, Homo sapiens
accctctgcccaggg

SEQ ID NO: 4234319 - DNA, 16 bp, Homo sapiens
accgcagcctctgccc

SEQ ID NO: 4234320 - DNA, 14 bp, Homo sapiens
acctgccagtccca

SEQ ID NO: 4234321 - DNA, 11 bp, Homo sapiens
accttatttaa

SEQ ID NO: 4234322 - DNA, 22 bp, Homo sapiens
acgggccagtttctctgccttc

SEQ ID NO: 4234323 - DNA, 14 bp, Homo sapiens
actaaaagaaacta

SEQ ID NO: 4234324 - DNA, 13 bp, Homo sapiens
actaatatatctg

SEQ ID NO: 4234325 - DNA, 13 bp, Homo sapiens
actatataaatga

SEQ ID NO: 4234326 - DNA, 19 bp, Homo sapiens
actatataaatgacattat

SEQ ID NO: 4234327 - DNA, 17 bp, Homo sapiens
actattacagtattgct

SEQ ID NO: 4234328 - DNA, 12 bp, Homo sapiens
actgactatatt

SEQ ID NO: 4234329 - DNA, 16 bp, Homo sapiens
actgtcagatctggat

SEQ ID NO: 4234330 - DNA, 11 bp, Homo sapiens
acttaatttta

SEQ ID NO: 4234331 - DNA, 15 bp, Homo sapiens
acttaattttagaaa

SEQ ID NO: 4234332 - DNA, 18 bp, Homo sapiens
acttaattttagaaagaa

SEQ ID NO: 4234333 - DNA, 21 bp, Homo sapiens
acttggctggaatttctgctg

SEQ ID NO: 4234334 - DNA, 14 bp, Homo sapiens
actttgccttccag

SEQ ID NO: 4234335 - DNA, 18 bp, Homo sapiens
agaaaattatattctgtt

SEQ ID NO: 4234336 - DNA, 18 bp, Homo sapiens
agaaacttggctggaatt

SEQ ID NO: 4234337 - DNA, 22 bp, Homo sapiens
agaaacttggctggaatttctg

SEQ ID NO: 4234338 - DNA, 13 bp, Homo sapiens
agaaagaaaatta

SEQ ID NO: 4234339 - DNA, 14 bp, Homo sapiens
agaaagaaaattat

SEQ ID NO: 4234340 - DNA, 19 bp, Homo sapiens
ctaggtgttgtcagcaggc

SEQ ID NO: 4234341 - DNA, 14 bp, Homo sapiens
ctataaaataaact

SEQ ID NO: 4234342 - DNA, 16 bp, Homo sapiens
ctataaaataaacttc

SEQ ID NO: 4234343 - DNA, 20 bp, Homo sapiens
ctataaaataaacttcttaa

SEQ ID NO: 4234344 - DNA, 19 bp, Homo sapiens
ctatataaatgacattatt

SEQ ID NO: 4234345 - DNA, 19 bp, Homo sapiens
ctatgctagaggcttttat

SEQ ID NO: 4234346 - DNA, 17 bp, Homo sapiens
ctattacagtattgcta

SEQ ID NO: 4234347 - DNA, 13 bp, Homo sapiens
ctatttatattca

SEQ ID NO: 4234348 - DNA, 13 bp, Homo sapiens
ctcactgcagcgc

SEQ ID NO: 4234349 - DNA, 21 bp, Homo sapiens
ctcagctccccggcactgcag

SEQ ID NO: 4234350 - DNA, 19 bp, Homo sapiens
ctcatttccaaaccatcag

SEQ ID NO: 4234351 - DNA, 14 bp, Homo sapiens
ctccatagctcctt

SEQ ID NO: 4234352 - DNA, 17 bp, Homo sapiens
ctcctggaggcaggggc

SEQ ID NO: 4234353 - DNA, 14 bp, Homo sapiens
ctccttgcagcagg

SEQ ID NO: 4234354 - DNA, 14 bp, Homo sapiens
ctctaaagaaactt

SEQ ID NO: 4234355 - DNA, 16 bp, Homo sapiens
ctctaaagaaacttgg

SEQ ID NO: 4234356 - DNA, 14 bp, Homo sapiens
ctctgagaaattga

SEQ ID NO: 4234357 - DNA, 12 bp, Homo sapiens
ctctttcttttc

SEQ ID NO: 4234358 - DNA, 17 bp, Homo sapiens
ctgacactttctgctgg

SEQ ID NO: 4234359 - DNA, 16 bp, Homo sapiens
ctgacccctccctgca

SEQ ID NO: 4234360 - DNA, 17 bp, Homo sapiens
ctgacccctccctgcag

SEQ ID NO: 4234361 - DNA, 19 bp, Homo sapiens
ctgacccctccctgcaggg

SEQ ID NO: 4234362 - DNA, 15 bp, Homo sapiens
ctgagaaattgaatg

SEQ ID NO: 4234363 - DNA, 15 bp, Homo sapiens
ctgcagagttctcct

SEQ ID NO: 4234364 - DNA, 20 bp, Homo sapiens
ctgcagagttctcctggagg

SEQ ID NO: 4234365 - DNA, 13 bp, Homo sapiens
ctgcccagggagt

SEQ ID NO: 4234366 - DNA, 16 bp, Homo sapiens
ctgccctgcctgggcc

SEQ ID NO: 4234367 - DNA, 18 bp, Homo sapiens
ctgccctgcctgggcctt

SEQ ID NO: 4234368 - DNA, 14 bp, Homo sapiens
ctgcctcctggtct

SEQ ID NO: 4234369 - DNA, 13 bp, Homo sapiens
ctgcctgggcctt

SEQ ID NO: 4234370 - DNA, 15 bp, Homo sapiens
ctgctacagacctgg

SEQ ID NO: 4234371 - DNA, 16 bp, Homo sapiens
ctgctgaggccttctc

SEQ ID NO: 4234372 - DNA, 14 bp, Homo sapiens
ctgctgccttgttt

SEQ ID NO: 4234373 - DNA, 23 bp, Homo sapiens
ctgctggaagctgtcaggctggg

SEQ ID NO: 4234374 - DNA, 16 bp, Homo sapiens
ctggaccagctggcct

SEQ ID NO: 4234375 - DNA, 18 bp, Homo sapiens
ctggaggcaggggctgct

SEQ ID NO: 4234376 - DNA, 23 bp, Homo sapiens
ctggaggcaggggctgctgcctt

SEQ ID NO: 4234377 - DNA, 20 bp, Homo sapiens
ctggcctggggtccctctga

SEQ ID NO: 4234378 - DNA, 21 bp, Homo sapiens
ctggcctggggtccctctgaa

SEQ ID NO: 4234379 - DNA, 20 bp, Homo sapiens
ctggctccttgcagcagggc

SEQ ID NO: 4234380 - DNA, 22 bp, Homo sapiens
ctggctccttgcagcagggctg

SEQ ID NO: 4234381 - DNA, 15 bp, Homo sapiens
ctgggacaggctttg

SEQ ID NO: 4234382 - DNA, 21 bp, Homo sapiens
ctgggattacaggcgtgagcc

SEQ ID NO: 4234383 - DNA, 17 bp, Homo sapiens
ctgggccttggctgggc

SEQ ID NO: 4234384 - DNA, 18 bp, Homo sapiens
ctgggccttggctgggcc

SEQ ID NO: 4234385 - DNA, 19 bp, Homo sapiens
ctggtctcttcaccactgt

SEQ ID NO: 4234386 - DNA, 18 bp, Homo sapiens
ctgtaaaagttactaata

SEQ ID NO: 4234387 - DNA, 19 bp, Homo sapiens
ctgtaaaagttactaatat

SEQ ID NO: 4234388 - DNA, 23 bp, Homo sapiens
ctgtaaaagttactaatatatct

SEQ ID NO: 4234389 - DNA, 15 bp, Homo sapiens
ctgtaacactattac

SEQ ID NO: 4234390 - DNA, 20 bp, Homo sapiens
ctgtaatatcattttataga

SEQ ID NO: 4234391 - DNA, 17 bp, Homo sapiens
ctgtataagctgtaata

SEQ ID NO: 4234392 - DNA, 15 bp, Homo sapiens
ctgtcaggctgggac

SEQ ID NO: 4234393 - DNA, 22 bp, Homo sapiens
ctgtgctctgggggtcccttgc

SEQ ID NO: 4234394 - DNA, 22 bp, Homo sapiens
ctgtgctggaccagctggcctg

SEQ ID NO: 4234395 - DNA, 17 bp, Homo sapiens
ctgtggtctataaaata

SEQ ID NO: 4234396 - DNA, 11 bp, Homo sapiens
ctgtttctcag

SEQ ID NO: 4234397 - DNA, 22 bp, Homo sapiens
ctgtttgccacacccaggtgat

SEQ ID NO: 4234398 - DNA, 17 bp, Homo sapiens
cttaaatagctttgaga

SEQ ID NO: 4234399 - DNA, 20 bp, Homo sapiens
cttaaatagctttgagattt

SEQ ID NO: 4234400 - DNA, 12 bp, Homo sapiens
cttactaaatat

SEQ ID NO: 4234401 - DNA, 19 bp, Homo sapiens
cttactaaatatgggaatg

SEQ ID NO: 4234402 - DNA, 14 bp, Homo sapiens
cttcccaggacccc

SEQ ID NO: 4234403 - DNA, 19 bp, Homo sapiens
cttcccgcaaggcctctca

SEQ ID NO: 4234404 - DNA, 14 bp, Homo sapiens
cttcctgctgggac

SEQ ID NO: 4234405 - DNA, 15 bp, Homo sapiens
cttcctgctgggact

SEQ ID NO: 4234406 - DNA, 15 bp, Homo sapiens
cttgcagcagggctg

SEQ ID NO: 4234407 - DNA, 16 bp, Homo sapiens
cttgcttagcctgtgc

SEQ ID NO: 4234408 - DNA, 18 bp, Homo sapiens
cttgcttagcctgtgctg

SEQ ID NO: 4234409 - DNA, 13 bp, Homo sapiens
cttggctggaatt

SEQ ID NO: 4234410 - DNA, 12 bp, Homo sapiens
cttggctgggcc

SEQ ID NO: 4234411 - DNA, 15 bp, Homo sapiens
cttggctgggcctct

SEQ ID NO: 4234412 - DNA, 19 bp, Homo sapiens
ctttctgctggaagctgtc

SEQ ID NO: 4234413 - DNA, 19 bp, Homo sapiens
cttttcttgatatctttcc

SEQ ID NO: 4234414 - DNA, 17 bp, Homo sapiens
gaaaacatatgaaatat

SEQ ID NO: 4234415 - DNA, 21 bp, Homo sapiens
gaaaacatatgaaatataaat

SEQ ID NO: 4234416 - DNA, 15 bp, Homo sapiens
gaaaattatattctg

SEQ ID NO: 4234417 - DNA, 17 bp, Homo sapiens
gaaacttggctggaatt

SEQ ID NO: 4234418 - DNA, 17 bp, Homo sapiens
gaaatataaattatctg

SEQ ID NO: 4234419 - DNA, 16 bp, Homo sapiens
gaaattgaatgtacct

SEQ ID NO: 4234420 - DNA, 15 bp, Homo sapiens
gaacaatgccagggc

SEQ ID NO: 4234421 - DNA, 16 bp, Homo sapiens
gaagccctgtctgttt

SEQ ID NO: 4234422 - DNA, 12 bp, Homo sapiens
gaaggtgaaaca

SEQ ID NO: 4234423 - DNA, 22 bp, Homo sapiens
gaatattagatgctctgagaaa

SEQ ID NO: 4234424 - DNA, 18 bp, Homo sapiens
gaatgtaccttatttaaa

SEQ ID NO: 4234425 - DNA, 21 bp, Homo sapiens
gaatgtaccttatttaaaaga

SEQ ID NO: 4234426 - DNA, 16 bp, Homo sapiens
gaatgtctaacttaaa

SEQ ID NO: 4234427 - DNA, 20 bp, Homo sapiens
gacagtaagtttattgttaa

SEQ ID NO: 4234428 - DNA, 13 bp, Homo sapiens
gacattattaaag

SEQ ID NO: 4234429 - DNA, 15 bp, Homo sapiens
gaccagctggcctgg

SEQ ID NO: 4234430 - DNA, 21 bp, Homo sapiens
gaccaggggcccaccctctgc

SEQ ID NO: 4234431 - DNA, 19 bp, Homo sapiens
gacccaaggctcactgcag

SEQ ID NO: 4234432 - DNA, 16 bp, Homo sapiens
gacccctcagctcccc

SEQ ID NO: 4234433 - DNA, 19 bp, Homo sapiens
gacccctccctgcaggggc

SEQ ID NO: 4234434 - DNA, 21 bp, Homo sapiens
gacgtttgcatagagagaaat

SEQ ID NO: 4234435 - DNA, 19 bp, Homo sapiens
gactgtccccatgcccacg

SEQ ID NO: 4234436 - DNA, 23 bp, Homo sapiens
gacttaattttagaaagaaaatt

SEQ ID NO: 4234437 - DNA, 22 bp, Homo sapiens
gacttcagggaaggtgaaacag

SEQ ID NO: 4234438 - DNA, 22 bp, Homo sapiens
gagacccaaggctcactgcagc

SEQ ID NO: 4234439 - DNA, 19 bp, Homo sapiens
gaggaagctggacagcggc

SEQ ID NO: 4234440 - DNA, 13 bp, Homo sapiens
gaggcaggggctg

SEQ ID NO: 4234441 - DNA, 19 bp, Homo sapiens
gaggccagtgttgtgggct

SEQ ID NO: 4234442 - DNA, 14 bp, Homo sapiens
gaggcctgtgctct

SEQ ID NO: 4234443 - DNA, 13 bp, Homo sapiens
gaggctttcagtg

SEQ ID NO: 4234444 - DNA, 13 bp, Homo sapiens
gatatctttctca

SEQ ID NO: 4234445 - DNA, 20 bp, Homo sapiens
gatgagtaaactgtttctca

SEQ ID NO: 4234446 - DNA, 16 bp, Homo sapiens
gatgctctgagaaatt

SEQ ID NO: 4234447 - DNA, 23 bp, Homo sapiens
gatgctctgagaaattgaatgta

SEQ ID NO: 4234448 - DNA, 20 bp, Homo sapiens
gatgtgacggggtgtgtggc

SEQ ID NO: 4234449 - DNA, 17 bp, Homo sapiens
gatttgtacatattatc

SEQ ID NO: 4234450 - DNA, 16 bp, Homo sapiens
gcaccgcagcctctgc

SEQ ID NO: 4234451 - DNA, 16 bp, Homo sapiens
gcagggctgggcctgc

SEQ ID NO: 4234452 - DNA, 19 bp, Homo sapiens
gcagggctgggcctgcgag

SEQ ID NO: 4234453 - DNA, 23 bp, Homo sapiens
gcaggggctacgttagcagccca

SEQ ID NO: 4234454 - DNA, 13 bp, Homo sapiens
gcagtgggcctgc

SEQ ID NO: 4234455 - DNA, 17 bp, Homo sapiens
gcagtgggcctgctgag

SEQ ID NO: 4234456 - DNA, 20 bp, Homo sapiens
gcagtgggcctgctgaggcc

SEQ ID NO: 4234457 - DNA, 16 bp, Homo sapiens
gccagtgttgtgggct

SEQ ID NO: 4234458 - DNA, 21 bp, Homo sapiens
gccagtgttgtgggcttcctg

SEQ ID NO: 4234459 - DNA, 14 bp, Homo sapiens
gccagtttctctgc

SEQ ID NO: 4234460 - DNA, 13 bp, Homo sapiens
tttatctgtataa

SEQ ID NO: 4234461 - DNA, 22 bp, Homo sapiens
tttcactgagagctgcctcctg

SEQ ID NO: 4234462 - DNA, 15 bp, Homo sapiens
tttcagctatgctag

SEQ ID NO: 4234463 - DNA, 15 bp, Homo sapiens
tttcctctaaagaaa

SEQ ID NO: 4234464 - DNA, 17 bp, Homo sapiens
tttgagatttcagctat

SEQ ID NO: 4234465 - DNA, 22 bp, Homo sapiens
ttttagaaagaaaattatattc

SEQ ID NO: 4234466 - DNA, 19 bp, Homo sapiens
ttttataactatataaatg

SEQ ID NO: 4234467 - DNA, 19 bp, Homo sapiens
ttttataattttatctgta

SEQ ID NO: 4234468 - DNA, 13 bp, Homo sapiens
ttttcaaattatt

SEQ ID NO: 4234469 - DNA, 22 bp, Homo sapiens
tttttatgactatcctgttctg

SEQ ID NO: 4234470 - DNA, 13 bp, Homo sapiens
tttttctgtaaaa

SEQ ID NO: 4234471 - DNA, 20 bp, Homo sapiens
tttttggcaacctggctctg

SEQ ID NO: 4234472 - DNA, 12 bp, Homo sapiens
aaaaaactagac

SEQ ID NO: 4234473 - DNA, 16 bp, Homo sapiens
aaaaactagactccat

SEQ ID NO: 4234474 - DNA, 13 bp, Homo sapiens
aaaacatatgaaa

SEQ ID NO: 4234475 - DNA, 19 bp, Homo sapiens
aaaacatatgaaatataaa

SEQ ID NO: 4234476 - DNA, 12 bp, Homo sapiens
aaaataaacttc

SEQ ID NO: 4234477 - DNA, 12 bp, Homo sapiens
aaaatatatatt

SEQ ID NO: 4234478 - DNA, 13 bp, Homo sapiens
aaaatatatattt

SEQ ID NO: 4234479 - DNA, 15 bp, Homo sapiens
aaaatcttctgatga

SEQ ID NO: 4234480 - DNA, 15 bp, Homo sapiens
aaaatgcattattta

SEQ ID NO: 4234481 - DNA, 14 bp, Homo sapiens
aaaattatattctg

SEQ ID NO: 4234482 - DNA, 13 bp, Homo sapiens
aaagaaaattata

SEQ ID NO: 4234483 - DNA, 18 bp, Homo sapiens
aaagaaaattatattctg

SEQ ID NO: 4234484 - DNA, 20 bp, Homo sapiens
aaagaaaattatattctgtt

SEQ ID NO: 4234485 - DNA, 19 bp, Homo sapiens
aaagaaacttggctggaat

SEQ ID NO: 4234486 - DNA, 20 bp, Homo sapiens
aaagaaacttggctggaatt

SEQ ID NO: 4234487 - DNA, 12 bp, Homo sapiens
aaagattttatg

SEQ ID NO: 4234488 - DNA, 13 bp, Homo sapiens
aaagattttatgg

SEQ ID NO: 4234489 - DNA, 18 bp, Homo sapiens
aaagttactaatatatct

SEQ ID NO: 4234490 - DNA, 15 bp, Homo sapiens
aaataaacttcttaa

SEQ ID NO: 4234491 - DNA, 18 bp, Homo sapiens
aaatagctttgagatttc

SEQ ID NO: 4234492 - DNA, 15 bp, Homo sapiens
aaatgaaagagaaaa

SEQ ID NO: 4234493 - DNA, 14 bp, Homo sapiens
aaattatattctgt

SEQ ID NO: 4234494 - DNA, 17 bp, Homo sapiens
aaattatctgaatatta

SEQ ID NO: 4234495 - DNA, 18 bp, Homo sapiens
aaattatctgaatattag

SEQ ID NO: 4234496 - DNA, 19 bp, Homo sapiens
aaattatctgaatattaga

SEQ ID NO: 4234497 - DNA, 22 bp, Homo sapiens
aacatatgaaatataaattatc

SEQ ID NO: 4234498 - DNA, 15 bp, Homo sapiens
aacctgctggatggg

SEQ ID NO: 4234499 - DNA, 19 bp, Homo sapiens
aacctgctggatgggactc

SEQ ID NO: 4234500 - DNA, 21 bp, Homo sapiens
aacctgctggatgggactcca

SEQ ID NO: 4234501 - DNA, 21 bp, Homo sapiens
aacggtatgacttaattttag

SEQ ID NO: 4234502 - DNA, 23 bp, Homo sapiens
aacggtatgacttaattttagaa

SEQ ID NO: 4234503 - DNA, 23 bp, Homo sapiens
aactccaagttgctgcagcttgg

SEQ ID NO: 4234504 - DNA, 16 bp, Homo sapiens
aacttaaatagctttg

SEQ ID NO: 4234505 - DNA, 12 bp, Homo sapiens
aagaaaattata

SEQ ID NO: 4234506 - DNA, 14 bp, Homo sapiens
aagaaaattatatt

SEQ ID NO: 4234507 - DNA, 16 bp, Homo sapiens
aagaaacttggctgga

SEQ ID NO: 4234508 - DNA, 18 bp, Homo sapiens
aagaaacttggctggaat

SEQ ID NO: 4234509 - DNA, 22 bp, Homo sapiens
aagaagccatttagggcagcaa

SEQ ID NO: 4234510 - DNA, 16 bp, Homo sapiens
aagatttgtacatatt

SEQ ID NO: 4234511 - DNA, 19 bp, Homo sapiens
aagatttgtacatattatc

SEQ ID NO: 4234512 - DNA, 21 bp, Homo sapiens
aagattttatggttttataac

SEQ ID NO: 4234513 - DNA, 24 bp, Homo sapiens
aagattttatggttttataactat

SEQ ID NO: 4234514 - DNA, 15 bp, Homo sapiens
aagctgtaatatcat

SEQ ID NO: 4234515 - DNA, 16 bp, Homo sapiens
aagctgtcaggctggg

SEQ ID NO: 4234516 - DNA, 18 bp, Homo sapiens
aaggcctctcagacccag

SEQ ID NO: 4234517 - DNA, 12 bp, Homo sapiens
aaggtgaaacag

SEQ ID NO: 4234518 - DNA, 11 bp, Homo sapiens
aataaacttct

SEQ ID NO: 4234519 - DNA, 12 bp, Homo sapiens
aataaacttctt

SEQ ID NO: 4234520 - DNA, 11 bp, Homo sapiens
aataacctgcc

SEQ ID NO: 4234521 - DNA, 22 bp, Homo sapiens
aatagctttgagatttcagcta

SEQ ID NO: 4234522 - DNA, 13 bp, Homo sapiens
aatataaattatc

SEQ ID NO: 4234523 - DNA, 20 bp, Homo sapiens
aatatatctgtaacactatt

SEQ ID NO: 4234524 - DNA, 12 bp, Homo sapiens
aatatcatttta

SEQ ID NO: 4234525 - DNA, 14 bp, Homo sapiens
aatatcattttata

SEQ ID NO: 4234526 - DNA, 20 bp, Homo sapiens
aatattagatgctctgagaa

SEQ ID NO: 4234527 - DNA, 13 bp, Homo sapiens
aatccaactgtca

SEQ ID NO: 4234528 - DNA, 19 bp, Homo sapiens
aatggccattgagctgttt

SEQ ID NO: 4234529 - DNA, 15 bp, Homo sapiens
aatgtaccttattta

SEQ ID NO: 4234530 - DNA, 17 bp, Homo sapiens
aatgtaccttatttaaa

SEQ ID NO: 4234531 - DNA, 15 bp, Homo sapiens
aatgtctaacttaaa

SEQ ID NO: 4234532 - DNA, 17 bp, Homo sapiens
aatgtctaacttaaata

SEQ ID NO: 4234533 - DNA, 16 bp, Homo sapiens
aattatattctgttta

SEQ ID NO: 4234534 - DNA, 16 bp, Homo sapiens
aattatctgaatatta

SEQ ID NO: 4234535 - DNA, 19 bp, Homo sapiens
aattatctgaatattagat

SEQ ID NO: 4234536 - DNA, 21 bp, Homo sapiens
aattatctgaatattagatgc

SEQ ID NO: 4234537 - DNA, 21 bp, Homo sapiens
aattcaactggaaattaaaaa

SEQ ID NO: 4234538 - DNA, 16 bp, Homo sapiens
aattttagaaagaaaa

SEQ ID NO: 4234539 - DNA, 14 bp, Homo sapiens
aattttatctgtat

SEQ ID NO: 4234540 - DNA, 17 bp, Homo sapiens
acaatgccagggcccag

SEQ ID NO: 4234541 - DNA, 12 bp, Homo sapiens
acactattacag

SEQ ID NO: 4234542 - DNA, 13 bp, Homo sapiens
acactattacagt

SEQ ID NO: 4234543 - DNA, 17 bp, Homo sapiens
acagcggcagtgggcct

SEQ ID NO: 4234544 - DNA, 19 bp, Homo sapiens
acagggtactaaaagaaac

SEQ ID NO: 4234545 - DNA, 19 bp, Homo sapiens
acatatgaaatataaatta

SEQ ID NO: 4234546 - DNA, 21 bp, Homo sapiens
acatatgaaatataaattatc

SEQ ID NO: 4234547 - DNA, 14 bp, Homo sapiens
acattattaaagtt

SEQ ID NO: 4234548 - DNA, 23 bp, Homo sapiens
accacccggcattctctgcccac

SEQ ID NO: 4234549 - DNA, 17 bp, Homo sapiens
accactgtagttctctc

SEQ ID NO: 4234550 - DNA, 16 bp, Homo sapiens
accatcagctgctttt

SEQ ID NO: 4234551 - DNA, 19 bp, Homo sapiens
acccctccctgcaggggct

SEQ ID NO: 4234552 - DNA, 18 bp, Homo sapiens
acccggcattctctgccc

SEQ ID NO: 4234553 - DNA, 14 bp, Homo sapiens
actaatatatctgt

SEQ ID NO: 4234554 - DNA, 15 bp, Homo sapiens
actaatatatctgta

SEQ ID NO: 4234555 - DNA, 16 bp, Homo sapiens
actaatatatctgtaa

SEQ ID NO: 4234556 - DNA, 12 bp, Homo sapiens
actatataaatg

SEQ ID NO: 4234557 - DNA, 15 bp, Homo sapiens
actatataaatgaca

SEQ ID NO: 4234558 - DNA, 21 bp, Homo sapiens
actatattttcccttattact

SEQ ID NO: 4234559 - DNA, 17 bp, Homo sapiens
actatgatgtggagaaa

SEQ ID NO: 4234560 - DNA, 15 bp, Homo sapiens
actattacagtattg

SEQ ID NO: 4234561 - DNA, 14 bp, Homo sapiens
actcataggtccct

SEQ ID NO: 4234562 - DNA, 17 bp, Homo sapiens
actcataggtccctgac

SEQ ID NO: 4234563 - DNA, 23 bp, Homo sapiens
actgagaaggctcacgaagggca

SEQ ID NO: 4234564 - DNA, 16 bp, Homo sapiens
actgcaggaaaaccct

SEQ ID NO: 4234565 - DNA, 18 bp, Homo sapiens
actgcaggaaaaccctta

SEQ ID NO: 4234566 - DNA, 12 bp, Homo sapiens
actgtttctcag

SEQ ID NO: 4234567 - DNA, 15 bp, Homo sapiens
acttaaatagctttg

SEQ ID NO: 4234568 - DNA, 19 bp, Homo sapiens
acttaattttagaaagaaa

SEQ ID NO: 4234569 - DNA, 17 bp, Homo sapiens
acttgaggctttcagtg

SEQ ID NO: 4234570 - DNA, 23 bp, Homo sapiens
acttgaggctttcagtgatatct

SEQ ID NO: 4234571 - DNA, 14 bp, Homo sapiens
acttggctggaatt

SEQ ID NO: 4234572 - DNA, 17 bp, Homo sapiens
acttggctggaatttct

SEQ ID NO: 4234573 - DNA, 17 bp, Homo sapiens
actttttctaggtggca

SEQ ID NO: 4234574 - DNA, 12 bp, Homo sapiens
agaaaattatat

SEQ ID NO: 4234575 - DNA, 16 bp, Homo sapiens
agaaacttggctggaa

SEQ ID NO: 4234576 - DNA, 15 bp, Homo sapiens
agaaagaaaattata

SEQ ID NO: 4234577 - DNA, 16 bp, Homo sapiens
agaaagaaaattatat

SEQ ID NO: 4234578 - DNA, 17 bp, Homo sapiens
agaaagaaaattatatt

SEQ ID NO: 4234579 - DNA, 21 bp, Homo sapiens
agaagccatttagggcagcaa

SEQ ID NO: 4234580 - DNA, 16 bp, Homo sapiens
agaccttggctgctca

SEQ ID NO: 4234581 - DNA, 14 bp, Homo sapiens
agagctgcctcctg

SEQ ID NO: 4234582 - DNA, 20 bp, Homo sapiens
agaggcttttattagaaagc

SEQ ID NO: 4234583 - DNA, 14 bp, Homo sapiens
agatataagatttg

SEQ ID NO: 4234584 - DNA, 21 bp, Homo sapiens
agatataagatttgtacatat

SEQ ID NO: 4234585 - DNA, 19 bp, Homo sapiens
agatgtctcccctgccact

SEQ ID NO: 4234586 - DNA, 13 bp, Homo sapiens
agatttgtacata

SEQ ID NO: 4234587 - DNA, 15 bp, Homo sapiens
agatttgtacatatt

SEQ ID NO: 4234588 - DNA, 17 bp, Homo sapiens
agatttgtacatattat

SEQ ID NO: 4234589 - DNA, 22 bp, Homo sapiens
agattttatggttttataacta

SEQ ID NO: 4234590 - DNA, 20 bp, Homo sapiens
agcaccgcagcctctgcccc

SEQ ID NO: 4234591 - DNA, 22 bp, Homo sapiens
agcagcatcctcctctctggcc

SEQ ID NO: 4234592 - DNA, 15 bp, Homo sapiens
agcagggctgggcct

SEQ ID NO: 4234593 - DNA, 12 bp, Homo sapiens
agcgcgctcctg

SEQ ID NO: 4234594 - DNA, 14 bp, Homo sapiens
agcgcgctcctgac

SEQ ID NO: 4234595 - DNA, 22 bp, Homo sapiens
agcgcgctcctgacccctccct

SEQ ID NO: 4234596 - DNA, 21 bp, Homo sapiens
agctgggatcacagctgcagg

SEQ ID NO: 4234597 - DNA, 23 bp, Homo sapiens
agctgggatcacagctgcaggcc

SEQ ID NO: 4234598 - DNA, 19 bp, Homo sapiens
agctgtaatatcattttat

SEQ ID NO: 4234599 - DNA, 15 bp, Homo sapiens
agcttgcctaatggc

SEQ ID NO: 4234600 - DNA, 15 bp, Homo sapiens
aggaccgcctgccct

SEQ ID NO: 4234601 - DNA, 20 bp, Homo sapiens
aggattctgtgcctccagga

SEQ ID NO: 4234602 - DNA, 17 bp, Homo sapiens
aggcacttgaggctttc

SEQ ID NO: 4234603 - DNA, 21 bp, Homo sapiens
aggcacttgaggctttcagtg

SEQ ID NO: 4234604 - DNA, 16 bp, Homo sapiens
aggccagcctgtccct

SEQ ID NO: 4234605 - DNA, 18 bp, Homo sapiens
aggccagtgttgtgggct

SEQ ID NO: 4234606 - DNA, 19 bp, Homo sapiens
aggccttctcttgaggcct

SEQ ID NO: 4234607 - DNA, 14 bp, Homo sapiens
agggaaggtgaaac

SEQ ID NO: 4234608 - DNA, 22 bp, Homo sapiens
aggtactgccatatttttctgt

SEQ ID NO: 4234609 - DNA, 17 bp, Homo sapiens
aggtgatttcctctaaa

SEQ ID NO: 4234610 - DNA, 17 bp, Homo sapiens
aggtgttgtcagcaggc

SEQ ID NO: 4234611 - DNA, 14 bp, Homo sapiens
agtaaactgtttct

SEQ ID NO: 4234612 - DNA, 16 bp, Homo sapiens
agtaaactgtttctca

SEQ ID NO: 4234613 - DNA, 15 bp, Homo sapiens
agtaattcaactgga

SEQ ID NO: 4234614 - DNA, 15 bp, Homo sapiens
agtattgctatttat

SEQ ID NO: 4234615 - DNA, 14 bp, Homo sapiens
agtgggcctgctga

SEQ ID NO: 4234616 - DNA, 18 bp, Homo sapiens
agtgttgtgggcttcctg

SEQ ID NO: 4234617 - DNA, 14 bp, Homo sapiens
agtttgtagcattt

SEQ ID NO: 4234618 - DNA, 18 bp, Homo sapiens
agtttgtagcatttttct

SEQ ID NO: 4234619 - DNA, 14 bp, Homo sapiens
agttttcaaattat

SEQ ID NO: 4234620 - DNA, 15 bp, Homo sapiens
ataaaataaacttct

SEQ ID NO: 4234621 - DNA, 19 bp, Homo sapiens
ataaagaaacggtatgact

SEQ ID NO: 4234622 - DNA, 13 bp, Homo sapiens
ataaattatctga

SEQ ID NO: 4234623 - DNA, 16 bp, Homo sapiens
ataaattatctgaata

SEQ ID NO: 4234624 - DNA, 18 bp, Homo sapiens
ataaattatctgaatatt

SEQ ID NO: 4234625 - DNA, 13 bp, Homo sapiens
ataactatataaa

SEQ ID NO: 4234626 - DNA, 14 bp, Homo sapiens
ataactatataaat

SEQ ID NO: 4234627 - DNA, 20 bp, Homo sapiens
ataagatttgtacatattat

SEQ ID NO: 4234628 - DNA, 14 bp, Homo sapiens
ataagctgtaatat

SEQ ID NO: 4234629 - DNA, 16 bp, Homo sapiens
ataattttatctgtat

SEQ ID NO: 4234630 - DNA, 16 bp, Homo sapiens
atagctttgagatttc

SEQ ID NO: 4234631 - DNA, 19 bp, Homo sapiens
ataggtactgccatatttt

SEQ ID NO: 4234632 - DNA, 20 bp, Homo sapiens
atataaatgacattattaaa

SEQ ID NO: 4234633 - DNA, 12 bp, Homo sapiens
atataaattatc

SEQ ID NO: 4234634 - DNA, 20 bp, Homo sapiens
atataaattatctgaatatt

SEQ ID NO: 4234635 - DNA, 20 bp, Homo sapiens
atataagatttgtacatatt

SEQ ID NO: 4234636 - DNA, 21 bp, Homo sapiens
atataagatttgtacatatta

SEQ ID NO: 4234637 - DNA, 12 bp, Homo sapiens
atatatctgtaa

SEQ ID NO: 4234638 - DNA, 16 bp, Homo sapiens
atatatctgtaacact

SEQ ID NO: 4234639 - DNA, 22 bp, Homo sapiens
atatatttttaatggaaagttt

SEQ ID NO: 4234640 - DNA, 15 bp, Homo sapiens
atatcattttataga

SEQ ID NO: 4234641 - DNA, 17 bp, Homo sapiens
atatctttctcattacc

SEQ ID NO: 4234642 - DNA, 13 bp, Homo sapiens
atatgaaatataa

SEQ ID NO: 4234643 - DNA, 16 bp, Homo sapiens
atatgaaatataaatt

SEQ ID NO: 4234644 - DNA, 17 bp, Homo sapiens
atattctcatttttcta

SEQ ID NO: 4234645 - DNA, 19 bp, Homo sapiens
atattctcatttttctaaa

SEQ ID NO: 4234646 - DNA, 14 bp, Homo sapiens
atatttttttctgt

SEQ ID NO: 4234647 - DNA, 17 bp, Homo sapiens
atatttttttctgtaaa

SEQ ID NO: 4234648 - DNA, 16 bp, Homo sapiens
atcagcactttaacca

SEQ ID NO: 4234649 - DNA, 17 bp, Homo sapiens
atcatcctataaagaaa

SEQ ID NO: 4234650 - DNA, 18 bp, Homo sapiens
atccaactgtcagatctg

SEQ ID NO: 4234651 - DNA, 21 bp, Homo sapiens
atcccatggatgagtaaactg

SEQ ID NO: 4234652 - DNA, 14 bp, Homo sapiens
atcctataaagaaa

SEQ ID NO: 4234653 - DNA, 14 bp, Homo sapiens
atctactgactata

SEQ ID NO: 4234654 - DNA, 16 bp, Homo sapiens
atctactgactatatt

SEQ ID NO: 4234655 - DNA, 20 bp, Homo sapiens
atctgtataagctgtaatat

SEQ ID NO: 4234656 - DNA, 21 bp, Homo sapiens
atctgtataagctgtaatatc

SEQ ID NO: 4234657 - DNA, 15 bp, Homo sapiens
atgaaagagaaaata

SEQ ID NO: 4234658 - DNA, 16 bp, Homo sapiens
atgaaagagaaaatat

SEQ ID NO: 4234659 - DNA, 22 bp, Homo sapiens
atgaaatataaattatctgaat

SEQ ID NO: 4234660 - DNA, 23 bp, Homo sapiens
atgaaatataaattatctgaata

SEQ ID NO: 4234661 - DNA, 17 bp, Homo sapiens
atgaagggagggtccct

SEQ ID NO: 4234662 - DNA, 19 bp, Homo sapiens
atgacaaatgaaagagaaa

SEQ ID NO: 4234663 - DNA, 17 bp, Homo sapiens
atgacattattaaagtt

SEQ ID NO: 4234664 - DNA, 17 bp, Homo sapiens
atgacttaattttagaa

SEQ ID NO: 4234665 - DNA, 19 bp, Homo sapiens
atgagtaaactgtttctca

SEQ ID NO: 4234666 - DNA, 17 bp, Homo sapiens
atgatgtggagaaagga

SEQ ID NO: 4234667 - DNA, 14 bp, Homo sapiens
atgccagggcccag

SEQ ID NO: 4234668 - DNA, 22 bp, Homo sapiens
atgctagaggcttttattagaa

SEQ ID NO: 4234669 - DNA, 15 bp, Homo sapiens
atgctctgagaaatt

SEQ ID NO: 4234670 - DNA, 16 bp, Homo sapiens
atgctctgagaaattg

SEQ ID NO: 4234671 - DNA, 16 bp, Homo sapiens
atggaaagtttgtagc

SEQ ID NO: 4234672 - DNA, 13 bp, Homo sapiens
atggcatcagcac

SEQ ID NO: 4234673 - DNA, 21 bp, Homo sapiens
atggccattgagctgtttcct

SEQ ID NO: 4234674 - DNA, 13 bp, Homo sapiens
atggttttataac

SEQ ID NO: 4234675 - DNA, 21 bp, Homo sapiens
atgtaccttatttaaaagatt

SEQ ID NO: 4234676 - DNA, 13 bp, Homo sapiens
atgtctaacttaa

SEQ ID NO: 4234677 - DNA, 16 bp, Homo sapiens
atgtctcccctgccac

SEQ ID NO: 4234678 - DNA, 22 bp, Homo sapiens
atgtgtaagaacaatgccaggg

SEQ ID NO: 4234679 - DNA, 22 bp, Homo sapiens
atgttggaaaacatatgaaata

SEQ ID NO: 4234680 - DNA, 15 bp, Homo sapiens
attaaagttttcaaa

SEQ ID NO: 4234681 - DNA, 20 bp, Homo sapiens
attaaagttttcaaattatt

SEQ ID NO: 4234682 - DNA, 14 bp, Homo sapiens
attaataacctgcc

SEQ ID NO: 4234683 - DNA, 18 bp, Homo sapiens
attacaggcgtgagcccc

SEQ ID NO: 4234684 - DNA, 17 bp, Homo sapiens
attagatgctctgagaa

SEQ ID NO: 4234685 - DNA, 21 bp, Homo sapiens
attagatgctctgagaaattg

SEQ ID NO: 4234686 - DNA, 14 bp, Homo sapiens
attatattctgttt

SEQ ID NO: 4234687 - DNA, 14 bp, Homo sapiens
attatcatcctata

SEQ ID NO: 4234688 - DNA, 20 bp, Homo sapiens
attatcatcctataaagaaa

SEQ ID NO: 4234689 - DNA, 18 bp, Homo sapiens
attatctgaatattagat

SEQ ID NO: 4234690 - DNA, 16 bp, Homo sapiens
attatgacaaatgaaa

SEQ ID NO: 4234691 - DNA, 17 bp, Homo sapiens
attatgacaaatgaaag

SEQ ID NO: 4234692 - DNA, 18 bp, Homo sapiens
attatgacaaatgaaaga

SEQ ID NO: 4234693 - DNA, 17 bp, Homo sapiens
attcaactggaaattaa

SEQ ID NO: 4234694 - DNA, 18 bp, Homo sapiens
attcattcagatataaga

SEQ ID NO: 4234695 - DNA, 22 bp, Homo sapiens
attccttttcataacttttctt

SEQ ID NO: 4234696 - DNA, 15 bp, Homo sapiens
attgagctgtttcct

SEQ ID NO: 4234697 - DNA, 13 bp, Homo sapiens
attgctatttata

SEQ ID NO: 4234698 - DNA, 16 bp, Homo sapiens
attgctatttatattc

SEQ ID NO: 4234699 - DNA, 18 bp, Homo sapiens
attgctatttatattcat

SEQ ID NO: 4234700 - DNA, 18 bp, Homo sapiens
atttagaggatgtggctg

SEQ ID NO: 4234701 - DNA, 15 bp, Homo sapiens
atttatattcattca

SEQ ID NO: 4234702 - DNA, 16 bp, Homo sapiens
atttctaaaactccaa

SEQ ID NO: 4234703 - DNA, 14 bp, Homo sapiens
atttgtacatatta

SEQ ID NO: 4234704 - DNA, 19 bp, Homo sapiens
atttgtacatattatcatc

SEQ ID NO: 4234705 - DNA, 14 bp, Homo sapiens
attttagaaagaaa

SEQ ID NO: 4234706 - DNA, 16 bp, Homo sapiens
attttagaaagaaaat

SEQ ID NO: 4234707 - DNA, 20 bp, Homo sapiens
attttagaaagaaaattata

SEQ ID NO: 4234708 - DNA, 22 bp, Homo sapiens
attttagaaagaaaattatatt

SEQ ID NO: 4234709 - DNA, 14 bp, Homo sapiens
attttatctgtata

SEQ ID NO: 4234710 - DNA, 18 bp, Homo sapiens
attttatctgtataagct

SEQ ID NO: 4234711 - DNA, 17 bp, Homo sapiens
attttcttttgtgcccc

SEQ ID NO: 4234712 - DNA, 21 bp, Homo sapiens
attttcttttgtgcccctgct

SEQ ID NO: 4234713 - DNA, 22 bp, Homo sapiens
attttgccacagggtactaaaa

SEQ ID NO: 4234714 - DNA, 18 bp, Homo sapiens
atttttataattttatct

SEQ ID NO: 4234715 - DNA, 19 bp, Homo sapiens
atttttctgtgtggagtat

SEQ ID NO: 4234716 - DNA, 18 bp, Homo sapiens
atttttttctgtaaaagt

SEQ ID NO: 4234717 - DNA, 13 bp, Homo sapiens
caaatgaaagaga

SEQ ID NO: 4234718 - DNA, 16 bp, Homo sapiens
caaatgaaagagaaaa

SEQ ID NO: 4234719 - DNA, 16 bp, Homo sapiens
caaggctcactgcagc

SEQ ID NO: 4234720 - DNA, 23 bp, Homo sapiens
cacacccaggtgatttcctctaa

SEQ ID NO: 4234721 - DNA, 23 bp, Homo sapiens
cacccaggtgatttcctctaaag

SEQ ID NO: 4234722 - DNA, 20 bp, Homo sapiens
cacccggcattctctgccca

SEQ ID NO: 4234723 - DNA, 16 bp, Homo sapiens
cacctcttctgcgtgc

SEQ ID NO: 4234724 - DNA, 14 bp, Homo sapiens
cacgaagggcatcc

SEQ ID NO: 4234725 - DNA, 15 bp, Homo sapiens
cactcaggtacttgg

SEQ ID NO: 4234726 - DNA, 15 bp, Homo sapiens
cactgagagctgcct

SEQ ID NO: 4234727 - DNA, 19 bp, Homo sapiens
cagatataagatttgtaca

SEQ ID NO: 4234728 - DNA, 11 bp, Homo sapiens
cagcagggctg

SEQ ID NO: 4234729 - DNA, 15 bp, Homo sapiens
cagcagggctgggcc

SEQ ID NO: 4234730 - DNA, 14 bp, Homo sapiens
cagcctctgcccca

SEQ ID NO: 4234731 - DNA, 18 bp, Homo sapiens
cagctccccggcactgca

SEQ ID NO: 4234732 - DNA, 13 bp, Homo sapiens
cagctggcctggg

SEQ ID NO: 4234733 - DNA, 13 bp, Homo sapiens
caggaccaggggc

SEQ ID NO: 4234734 - DNA, 19 bp, Homo sapiens
caggctggggaggccagtg

SEQ ID NO: 4234735 - DNA, 16 bp, Homo sapiens
cagggaaggtgaaaca

SEQ ID NO: 4234736 - DNA, 11 bp, Homo sapiens
cagggcccagg

SEQ ID NO: 4234737 - DNA, 16 bp, Homo sapiens
cagggctgggcctgcg

SEQ ID NO: 4234738 - DNA, 17 bp, Homo sapiens
cagtaattcaactggaa

SEQ ID NO: 4234739 - DNA, 15 bp, Homo sapiens
cagtattgctattta

SEQ ID NO: 4234740 - DNA, 16 bp, Homo sapiens
cagtcctccagcctcg

SEQ ID NO: 4234741 - DNA, 12 bp, Homo sapiens
cagtgggcctgc

SEQ ID NO: 4234742 - DNA, 18 bp, Homo sapiens
cagtgggcctgctgaggc

SEQ ID NO: 4234743 - DNA, 22 bp, Homo sapiens
cagtgggcctgctgaggccttc

SEQ ID NO: 4234744 - DNA, 23 bp, Homo sapiens
cagtgggcctgctgaggccttct

SEQ ID NO: 4234745 - DNA, 23 bp, Homo sapiens
cagtgttgtgggcttcctgctgg

SEQ ID NO: 4234746 - DNA, 18 bp, Homo sapiens
catatgaaatataaatta

SEQ ID NO: 4234747 - DNA, 23 bp, Homo sapiens
catatgaaatataaattatctga

SEQ ID NO: 4234748 - DNA, 14 bp, Homo sapiens
catatttttctgtg

SEQ ID NO: 4234749 - DNA, 20 bp, Homo sapiens
catggatgagtaaactgttt

SEQ ID NO: 4234750 - DNA, 13 bp, Homo sapiens
catgtcaggccag

SEQ ID NO: 4234751 - DNA, 15 bp, Homo sapiens
cattcagatataaga

SEQ ID NO: 4234752 - DNA, 21 bp, Homo sapiens
cattcagatataagatttgta

SEQ ID NO: 4234753 - DNA, 15 bp, Homo sapiens
cattgagctgtttcc

SEQ ID NO: 4234754 - DNA, 19 bp, Homo sapiens
catttccaaaccatcagct

SEQ ID NO: 4234755 - DNA, 19 bp, Homo sapiens
ccaaatggttaatccaact

SEQ ID NO: 4234756 - DNA, 21 bp, Homo sapiens
ccacccggcattctctgccca

SEQ ID NO: 4234757 - DNA, 18 bp, Homo sapiens
ccaccctctgcccaggga

SEQ ID NO: 4234758 - DNA, 18 bp, Homo sapiens
ccacgcccagcttcctcc

SEQ ID NO: 4234759 - DNA, 23 bp, Homo sapiens
ccagatgtgacggggtgtgtggc

SEQ ID NO: 4234760 - DNA, 12 bp, Homo sapiens
ccagcctcggcc

SEQ ID NO: 4234761 - DNA, 20 bp, Homo sapiens
ccagctaaagcagtcctcca

SEQ ID NO: 4234762 - DNA, 14 bp, Homo sapiens
ccagctggcctggg

SEQ ID NO: 4234763 - DNA, 15 bp, Homo sapiens
ccaggacccctcagc

SEQ ID NO: 4234764 - DNA, 20 bp, Homo sapiens
ccaggacccctcagctcccc

SEQ ID NO: 4234765 - DNA, 23 bp, Homo sapiens
ccagggcccaggaggaccgcctg

SEQ ID NO: 4234766 - DNA, 23 bp, Homo sapiens
ccaggggcccaccctctgcccag

SEQ ID NO: 4234767 - DNA, 21 bp, Homo sapiens
ccagtgttgtgggcttcctgc

SEQ ID NO: 4234768 - DNA, 14 bp, Homo sapiens
ccatatttttctgt

SEQ ID NO: 4234769 - DNA, 19 bp, Homo sapiens
ccatgtcaggccagcctgt

SEQ ID NO: 4234770 - DNA, 21 bp, Homo sapiens
ccatgtcaggccagcctgtcc

SEQ ID NO: 4234771 - DNA, 16 bp, Homo sapiens
ccattgagctgtttcc

SEQ ID NO: 4234772 - DNA, 17 bp, Homo sapiens
cccaaggctcactgcag

SEQ ID NO: 4234773 - DNA, 19 bp, Homo sapiens
cccaaggctcactgcagcg

SEQ ID NO: 4234774 - DNA, 16 bp, Homo sapiens
cccagcctggtctcaa

SEQ ID NO: 4234775 - DNA, 22 bp, Homo sapiens
cccaggaggaccgcctgccctg

SEQ ID NO: 4234776 - DNA, 14 bp, Homo sapiens
cccagggagtcctt

SEQ ID NO: 4234777 - DNA, 13 bp, Homo sapiens
cccatgaggtctt

SEQ ID NO: 4234778 - DNA, 22 bp, Homo sapiens
ccccagagacacggtcccacca

SEQ ID NO: 4234779 - DNA, 13 bp, Homo sapiens
ccccaggccctgc

SEQ ID NO: 4234780 - DNA, 23 bp, Homo sapiens
ccccaggccctgcagcggtggtt

SEQ ID NO: 4234781 - DNA, 21 bp, Homo sapiens
ccctctgaagagaccttggct

SEQ ID NO: 4234782 - DNA, 22 bp, Homo sapiens
ccctctgaagagaccttggctg

SEQ ID NO: 4234783 - DNA, 15 bp, Homo sapiens
ccgcaaggcctctca

SEQ ID NO: 4234784 - DNA, 14 bp, Homo sapiens
ccgcagcctctgcc

SEQ ID NO: 4234785 - DNA, 20 bp, Homo sapiens
cctcagctccccggcactgc

SEQ ID NO: 4234786 - DNA, 15 bp, Homo sapiens
cctctctggccttgc

SEQ ID NO: 4234787 - DNA, 13 bp, Homo sapiens
cctctgaagagac

SEQ ID NO: 4234788 - DNA, 20 bp, Homo sapiens
cctgacccctccctgcaggg

SEQ ID NO: 4234789 - DNA, 14 bp, Homo sapiens
cctgccagtcccag

SEQ ID NO: 4234790 - DNA, 13 bp, Homo sapiens
cctgcgagaccca

SEQ ID NO: 4234791 - DNA, 20 bp, Homo sapiens
cctgcgagacccaaggctca

SEQ ID NO: 4234792 - DNA, 14 bp, Homo sapiens
cctgctgaggcctt

SEQ ID NO: 4234793 - DNA, 15 bp, Homo sapiens
cctgctgaggccttc

SEQ ID NO: 4234794 - DNA, 14 bp, Homo sapiens
cctggaggcagggg

SEQ ID NO: 4234795 - DNA, 14 bp, Homo sapiens
cctggctccttgca

SEQ ID NO: 4234796 - DNA, 19 bp, Homo sapiens
cctggctccttgcagcagg

SEQ ID NO: 4234797 - DNA, 19 bp, Homo sapiens
cctgggccttggctgggcc

SEQ ID NO: 4234798 - DNA, 15 bp, Homo sapiens
cctggggtccctctg

SEQ ID NO: 4234799 - DNA, 19 bp, Homo sapiens
cctgggtgccctggctcct

SEQ ID NO: 4234800 - DNA, 22 bp, Homo sapiens
cctgtgctggaccagctggcct

SEQ ID NO: 4234801 - DNA, 21 bp, Homo sapiens
ccttccatgtcaggccagcct

SEQ ID NO: 4234802 - DNA, 15 bp, Homo sapiens
ccttcccaggacccc

SEQ ID NO: 4234803 - DNA, 17 bp, Homo sapiens
ccttgccccaggccctg

SEQ ID NO: 4234804 - DNA, 18 bp, Homo sapiens
ccttgccccaggccctgc

SEQ ID NO: 4234805 - DNA, 22 bp, Homo sapiens
ccttgcgtcccatgaggtcttc

SEQ ID NO: 4234806 - DNA, 23 bp, Homo sapiens
ccttggctgctcactgtccacat

SEQ ID NO: 4234807 - DNA, 19 bp, Homo sapiens
cgagacccaaggctcactg

SEQ ID NO: 4234808 - DNA, 14 bp, Homo sapiens
cgcagcctctgccc

SEQ ID NO: 4234809 - DNA, 21 bp, Homo sapiens
cgcgctcctgacccctccctg

SEQ ID NO: 4234810 - DNA, 14 bp, Homo sapiens
cggcattctctgcc

SEQ ID NO: 4234811 - DNA, 16 bp, Homo sapiens
cggcattctctgccca

SEQ ID NO: 4234812 - DNA, 18 bp, Homo sapiens
cgggccagtttctctgcc

SEQ ID NO: 4234813 - DNA, 18 bp, Homo sapiens
cggtatgacttaatttta

SEQ ID NO: 4234814 - DNA, 13 bp, Homo sapiens
cggtgcagcctct

SEQ ID NO: 4234815 - DNA, 15 bp, Homo sapiens
ctaaaagaaactatg

SEQ ID NO: 4234816 - DNA, 20 bp, Homo sapiens
ctaaagaaacttggctggaa

SEQ ID NO: 4234817 - DNA, 16 bp, Homo sapiens
ctaatatatctgtaac

SEQ ID NO: 4234818 - DNA, 21 bp, Homo sapiens
ctagaggcttttattagaaag

SEQ ID NO: 4234819 - DNA, 23 bp, Homo sapiens
ctatgctagaggcttttattaga

SEQ ID NO: 4234820 - DNA, 21 bp, Homo sapiens
ctcatttccaaaccatcagct

SEQ ID NO: 4234821 - DNA, 17 bp, Homo sapiens
ctccttgcagcagggct

SEQ ID NO: 4234822 - DNA, 19 bp, Homo sapiens
ctccttgcagcagggctgg

SEQ ID NO: 4234823 - DNA, 20 bp, Homo sapiens
ctctaaagaaacttggctgg

SEQ ID NO: 4234824 - DNA, 14 bp, Homo sapiens
ctctaactcctggg

SEQ ID NO: 4234825 - DNA, 15 bp, Homo sapiens
ctctgaagagacctt

SEQ ID NO: 4234826 - DNA, 15 bp, Homo sapiens
ctctgcccagggagt

SEQ ID NO: 4234827 - DNA, 14 bp, Homo sapiens
ctctgtacgggcca

SEQ ID NO: 4234828 - DNA, 15 bp, Homo sapiens
ctcttgaggcctgtg

SEQ ID NO: 4234829 - DNA, 20 bp, Homo sapiens
ctgaaagagaagatggccat

SEQ ID NO: 4234830 - DNA, 23 bp, Homo sapiens
ctgaatattagatgctctgagaa

SEQ ID NO: 4234831 - DNA, 18 bp, Homo sapiens
ctgacactttctgctgga

SEQ ID NO: 4234832 - DNA, 16 bp, Homo sapiens
ctgagagctgcctcct

SEQ ID NO: 4234833 - DNA, 23 bp, Homo sapiens
ctgatgtttcctgggtgccctgg

SEQ ID NO: 4234834 - DNA, 14 bp, Homo sapiens
ctgcagcgcgctcc

SEQ ID NO: 4234835 - DNA, 15 bp, Homo sapiens
ctgcagcgcgctcct

SEQ ID NO: 4234836 - DNA, 13 bp, Homo sapiens
ctgcaggccacgc

SEQ ID NO: 4234837 - DNA, 12 bp, Homo sapiens
ctgcaggggcta

SEQ ID NO: 4234838 - DNA, 19 bp, Homo sapiens
ctgcctgggccttggctgg

SEQ ID NO: 4234839 - DNA, 21 bp, Homo sapiens
ctgcctgggccttggctgggc

SEQ ID NO: 4234840 - DNA, 12 bp, Homo sapiens
ctgcgagaccca

SEQ ID NO: 4234841 - DNA, 14 bp, Homo sapiens
ctgctcactgtcca

SEQ ID NO: 4234842 - DNA, 12 bp, Homo sapiens
ctgctgaggcct

SEQ ID NO: 4234843 - DNA, 17 bp, Homo sapiens
ctgctgaggccttctct

SEQ ID NO: 4234844 - DNA, 22 bp, Homo sapiens
ctgctggaagctgtcaggctgg

SEQ ID NO: 4234845 - DNA, 16 bp, Homo sapiens
ctgctggatgggactc

SEQ ID NO: 4234846 - DNA, 15 bp, Homo sapiens
ctggaaattaaaaaa

SEQ ID NO: 4234847 - DNA, 17 bp, Homo sapiens
ctggacagcggcagtgg

SEQ ID NO: 4234848 - DNA, 13 bp, Homo sapiens
ctggatgggactc

SEQ ID NO: 4234849 - DNA, 23 bp, Homo sapiens
ctggatgggactccatagctcct

SEQ ID NO: 4234850 - DNA, 19 bp, Homo sapiens
ctggctccttgcagcaggg

SEQ ID NO: 4234851 - DNA, 21 bp, Homo sapiens
ctggctccttgcagcagggct

SEQ ID NO: 4234852 - DNA, 19 bp, Homo sapiens
ctgggatcacagctgcagg

SEQ ID NO: 4234853 - DNA, 14 bp, Homo sapiens
ctgggcagcagcat

SEQ ID NO: 4234854 - DNA, 16 bp, Homo sapiens
ctgggccttggctggg

SEQ ID NO: 4234855 - DNA, 19 bp, Homo sapiens
ctgggccttggctgggcct

SEQ ID NO: 4234856 - DNA, 18 bp, Homo sapiens
ctgggggtcccttgctta

SEQ ID NO: 4234857 - DNA, 15 bp, Homo sapiens
ctgggtgccctggct

SEQ ID NO: 4234858 - DNA, 16 bp, Homo sapiens
ctgtaacactattaca

SEQ ID NO: 4234859 - DNA, 23 bp, Homo sapiens
ctgtaacctgctggatgggactc

SEQ ID NO: 4234860 - DNA, 16 bp, Homo sapiens
ctgtcaggctgggaca

SEQ ID NO: 4234861 - DNA, 21 bp, Homo sapiens
ctgtcaggctgggacaggctt

SEQ ID NO: 4234862 - DNA, 14 bp, Homo sapiens
ctgtccctcctaac

SEQ ID NO: 4234863 - DNA, 18 bp, Homo sapiens
ctgtgctggaccagctgg

SEQ ID NO: 4234864 - DNA, 21 bp, Homo sapiens
ctgtgctggaccagctggcct

SEQ ID NO: 4234865 - DNA, 21 bp, Homo sapiens
ctgtggtctataaaataaact

SEQ ID NO: 4234866 - DNA, 22 bp, Homo sapiens
ctgtggtctataaaataaactt

SEQ ID NO: 4234867 - DNA, 22 bp, Homo sapiens
ctgtgtggagtatttttataat

SEQ ID NO: 4234868 - DNA, 17 bp, Homo sapiens
cttaattttagaaagaa

SEQ ID NO: 4234869 - DNA, 18 bp, Homo sapiens
cttaattttagaaagaaa

SEQ ID NO: 4234870 - DNA, 19 bp, Homo sapiens
cttcagggaaggtgaaaca

SEQ ID NO: 4234871 - DNA, 15 bp, Homo sapiens
agaacaatgccaggg

SEQ ID NO: 4234872 - DNA, 22 bp, Homo sapiens
agaccacccggcattctctgcc

SEQ ID NO: 4234873 - DNA, 16 bp, Homo sapiens
agacccaaggctcact

SEQ ID NO: 4234874 - DNA, 14 bp, Homo sapiens
agacccagatgtga

SEQ ID NO: 4234875 - DNA, 20 bp, Homo sapiens
agagaagatggccatgccct

SEQ ID NO: 4234876 - DNA, 16 bp, Homo sapiens
agcaaaacaagtgaca

SEQ ID NO: 4234877 - DNA, 16 bp, Homo sapiens
agcacatagcttgcct

SEQ ID NO: 4234878 - DNA, 11 bp, Homo sapiens
agcagcccagc

SEQ ID NO: 4234879 - DNA, 23 bp, Homo sapiens
agcagcccagcacatagcttgcc

SEQ ID NO: 4234880 - DNA, 13 bp, Homo sapiens
agcaggcaggctg

SEQ ID NO: 4234881 - DNA, 16 bp, Homo sapiens
agcaggcaggctgggg

SEQ ID NO: 4234882 - DNA, 22 bp, Homo sapiens
agccagggctcgcgagggcagc

SEQ ID NO: 4234883 - DNA, 18 bp, Homo sapiens
agccatatttttttctgt

SEQ ID NO: 4234884 - DNA, 12 bp, Homo sapiens
agcctctgcccc

SEQ ID NO: 4234885 - DNA, 22 bp, Homo sapiens
agcctgtgctggaccagctggc

SEQ ID NO: 4234886 - DNA, 18 bp, Homo sapiens
agctggacagcggcagtg

SEQ ID NO: 4234887 - DNA, 12 bp, Homo sapiens
agctggcctggg

SEQ ID NO: 4234888 - DNA, 22 bp, Homo sapiens
agctggcctggggtccctctga

SEQ ID NO: 4234889 - DNA, 16 bp, Homo sapiens
agctgtcaggctggga

SEQ ID NO: 4234890 - DNA, 19 bp, Homo sapiens
agctttgagatttcagcta

SEQ ID NO: 4234891 - DNA, 22 bp, Homo sapiens
aggaccgcctgccctgcctggg

SEQ ID NO: 4234892 - DNA, 18 bp, Homo sapiens
aggcaggggctgctgcct

SEQ ID NO: 4234893 - DNA, 21 bp, Homo sapiens
aggccagcctgtccctgaaag

SEQ ID NO: 4234894 - DNA, 15 bp, Homo sapiens
aggctcactgcagcg

SEQ ID NO: 4234895 - DNA, 18 bp, Homo sapiens
aggctggggaggccagtg

SEQ ID NO: 4234896 - DNA, 11 bp, Homo sapiens
agggctgggcc

SEQ ID NO: 4234897 - DNA, 17 bp, Homo sapiens
aggggaaccctgtccct

SEQ ID NO: 4234898 - DNA, 22 bp, Homo sapiens
aggggctacgttagcagcccag

SEQ ID NO: 4234899 - DNA, 15 bp, Homo sapiens
aggggctgctgcctt

SEQ ID NO: 4234900 - DNA, 16 bp, Homo sapiens
aggtactgccatattt

SEQ ID NO: 4234901 - DNA, 12 bp, Homo sapiens
aggtgatttcct

SEQ ID NO: 4234902 - DNA, 13 bp, Homo sapiens
aggtggcaggaca

SEQ ID NO: 4234903 - DNA, 20 bp, Homo sapiens
agtactgggattacaggcgt

SEQ ID NO: 4234904 - DNA, 14 bp, Homo sapiens
agtattgctattta

SEQ ID NO: 4234905 - DNA, 13 bp, Homo sapiens
agtatttttataa

SEQ ID NO: 4234906 - DNA, 16 bp, Homo sapiens
agtatttttataattt

SEQ ID NO: 4234907 - DNA, 22 bp, Homo sapiens
agtatttttataattttatctg

SEQ ID NO: 4234908 - DNA, 14 bp, Homo sapiens
agtcctccagcctc

SEQ ID NO: 4234909 - DNA, 19 bp, Homo sapiens
agtccttgcgtcccatgag

SEQ ID NO: 4234910 - DNA, 19 bp, Homo sapiens
agtgggcctgctgaggcct

SEQ ID NO: 4234911 - DNA, 15 bp, Homo sapiens
agttactaatatatc

SEQ ID NO: 4234912 - DNA, 19 bp, Homo sapiens
agttactaatatatctgta

SEQ ID NO: 4234913 - DNA, 22 bp, Homo sapiens
agttctcctggaggcaggggct

SEQ ID NO: 4234914 - DNA, 23 bp, Homo sapiens
agttctcctggaggcaggggctg

SEQ ID NO: 4234915 - DNA, 18 bp, Homo sapiens
agttgctgcagcttggca

SEQ ID NO: 4234916 - DNA, 22 bp, Homo sapiens
agtttgtagcatttttctaata

SEQ ID NO: 4234917 - DNA, 15 bp, Homo sapiens
agttttcaaattatt

SEQ ID NO: 4234918 - DNA, 12 bp, Homo sapiens
ataaaataaact

SEQ ID NO: 4234919 - DNA, 16 bp, Homo sapiens
ataaaataaacttctt

SEQ ID NO: 4234920 - DNA, 12 bp, Homo sapiens
ataaacttctta

SEQ ID NO: 4234921 - DNA, 15 bp, Homo sapiens
ataaacttcttaaca

SEQ ID NO: 4234922 - DNA, 17 bp, Homo sapiens
ataaattatctgaatat

SEQ ID NO: 4234923 - DNA, 22 bp, Homo sapiens
ataaattatctgaatattagat

SEQ ID NO: 4234924 - DNA, 15 bp, Homo sapiens
ataactatataaatg

SEQ ID NO: 4234925 - DNA, 18 bp, Homo sapiens
ataagatttgtacatatt

SEQ ID NO: 4234926 - DNA, 17 bp, Homo sapiens
ataagctgtaatatcat

SEQ ID NO: 4234927 - DNA, 19 bp, Homo sapiens
ataagctgtaatatcattt

SEQ ID NO: 4234928 - DNA, 21 bp, Homo sapiens
ataattttatctgtataagct

SEQ ID NO: 4234929 - DNA, 20 bp, Homo sapiens
atagctccttcccaggaccc

SEQ ID NO: 4234930 - DNA, 19 bp, Homo sapiens
atataaattatctgaatat

SEQ ID NO: 4234931 - DNA, 10 bp, Homo sapiens
atatatattt

SEQ ID NO: 4234932 - DNA, 14 bp, Homo sapiens
atatatctgtaaca

SEQ ID NO: 4234933 - DNA, 19 bp, Homo sapiens
atatatctgtaacactatt

SEQ ID NO: 4234934 - DNA, 14 bp, Homo sapiens
atatatttttaatg

SEQ ID NO: 4234935 - DNA, 18 bp, Homo sapiens
atatatttttaatggaaa

SEQ ID NO: 4234936 - DNA, 17 bp, Homo sapiens
atatcattttatagaaa

SEQ ID NO: 4234937 - DNA, 18 bp, Homo sapiens
atatcattttatagaaaa

SEQ ID NO: 4234938 - DNA, 13 bp, Homo sapiens
atatctttctcat

SEQ ID NO: 4234939 - DNA, 15 bp, Homo sapiens
atatgaaatataaat

SEQ ID NO: 4234940 - DNA, 22 bp, Homo sapiens
atatgaaatataaattatctga

SEQ ID NO: 4234941 - DNA, 23 bp, Homo sapiens
atatgaaatataaattatctgaa

SEQ ID NO: 4234942 - DNA, 21 bp, Homo sapiens
atatgggaatgtctaacttaa

SEQ ID NO: 4234943 - DNA, 21 bp, Homo sapiens
atattagatgctctgagaaat

SEQ ID NO: 4234944 - DNA, 22 bp, Homo sapiens
atattagatgctctgagaaatt

SEQ ID NO: 4234945 - DNA, 19 bp, Homo sapiens
atattatcatcctataaag

SEQ ID NO: 4234946 - DNA, 22 bp, Homo sapiens
atattctgtttattatgacaaa

SEQ ID NO: 4234947 - DNA, 21 bp, Homo sapiens
atatttttttctgtaaaagtt

SEQ ID NO: 4234948 - DNA, 14 bp, Homo sapiens
atcattttatagaa

SEQ ID NO: 4234949 - DNA, 21 bp, Homo sapiens
atccaactgtcagatctggat

SEQ ID NO: 4234950 - DNA, 16 bp, Homo sapiens
atcctataaagaaacg

SEQ ID NO: 4234951 - DNA, 12 bp, Homo sapiens
atcgttatctac

SEQ ID NO: 4234952 - DNA, 20 bp, Homo sapiens
atcgttatctactgactata

SEQ ID NO: 4234953 - DNA, 22 bp, Homo sapiens
atctcgattaataacctgccag

SEQ ID NO: 4234954 - DNA, 17 bp, Homo sapiens
atctggatcgttatcta

SEQ ID NO: 4234955 - DNA, 22 bp, Homo sapiens
atctgtaacactattacagtat

SEQ ID NO: 4234956 - DNA, 18 bp, Homo sapiens
atctttctcattaccagt

SEQ ID NO: 4234957 - DNA, 13 bp, Homo sapiens
atgaaagagaaaa

SEQ ID NO: 4234958 - DNA, 19 bp, Homo sapiens
atgaaagagaaaatatata

SEQ ID NO: 4234959 - DNA, 17 bp, Homo sapiens
atgaaatataaattatc

SEQ ID NO: 4234960 - DNA, 21 bp, Homo sapiens
atgaaatataaattatctgaa

SEQ ID NO: 4234961 - DNA, 17 bp, Homo sapiens
atgacaaatgaaagaga

SEQ ID NO: 4234962 - DNA, 20 bp, Homo sapiens
atgacaaatgaaagagaaaa

SEQ ID NO: 4234963 - DNA, 13 bp, Homo sapiens
atgacattattaa

SEQ ID NO: 4234964 - DNA, 15 bp, Homo sapiens
atgacattattaaag

SEQ ID NO: 4234965 - DNA, 20 bp, Homo sapiens
atgacttaattttagaaaga

SEQ ID NO: 4234966 - DNA, 21 bp, Homo sapiens
atgacttaattttagaaagaa

SEQ ID NO: 4234967 - DNA, 16 bp, Homo sapiens
atgagtaaactgtttc

SEQ ID NO: 4234968 - DNA, 17 bp, Homo sapiens
atgagtaaactgtttct

SEQ ID NO: 4234969 - DNA, 23 bp, Homo sapiens
atgctagaggcttttattagaaa

SEQ ID NO: 4234970 - DNA, 22 bp, Homo sapiens
atgctctgagaaattgaatgta

SEQ ID NO: 4234971 - DNA, 16 bp, Homo sapiens
atggatgagtaaactg

SEQ ID NO: 4234972 - DNA, 19 bp, Homo sapiens
atggccattgagctgtttc

SEQ ID NO: 4234973 - DNA, 23 bp, Homo sapiens
atggccattgagctgtttcctca

SEQ ID NO: 4234974 - DNA, 22 bp, Homo sapiens
atggttttataactatataaat

SEQ ID NO: 4234975 - DNA, 12 bp, Homo sapiens
atgtcaggccag

SEQ ID NO: 4234976 - DNA, 19 bp, Homo sapiens
atgtctaacttaaatagct

SEQ ID NO: 4234977 - DNA, 19 bp, Homo sapiens
atgtgacggggtgtgtggc

SEQ ID NO: 4234978 - DNA, 17 bp, Homo sapiens
attaaagttttcaaatt

SEQ ID NO: 4234979 - DNA, 22 bp, Homo sapiens
attaataacctgccagtcccag

SEQ ID NO: 4234980 - DNA, 22 bp, Homo sapiens
attacagtattgctatttatat

SEQ ID NO: 4234981 - DNA, 13 bp, Homo sapiens
attatattctgtt

SEQ ID NO: 4234982 - DNA, 15 bp, Homo sapiens
attatattctgttta

SEQ ID NO: 4234983 - DNA, 19 bp, Homo sapiens
attatattctgtttattat

SEQ ID NO: 4234984 - DNA, 18 bp, Homo sapiens
attatcatcctataaaga

SEQ ID NO: 4234985 - DNA, 21 bp, Homo sapiens
attatcatcctataaagaaac

SEQ ID NO: 4234986 - DNA, 15 bp, Homo sapiens
attatgacaaatgaa

SEQ ID NO: 4234987 - DNA, 21 bp, Homo sapiens
attcagatataagatttgtac

SEQ ID NO: 4234988 - DNA, 14 bp, Homo sapiens
attccttttcataa

SEQ ID NO: 4234989 - DNA, 16 bp, Homo sapiens
attctcatttttctaa

SEQ ID NO: 4234990 - DNA, 15 bp, Homo sapiens
tgacattattaaagt

SEQ ID NO: 4234991 - DNA, 21 bp, Homo sapiens
tgacattattaaagttttcaa

SEQ ID NO: 4234992 - DNA, 22 bp, Homo sapiens
tgactcataggtccctgacatt

SEQ ID NO: 4234993 - DNA, 14 bp, Homo sapiens
tgagaaattgaatg

SEQ ID NO: 4234994 - DNA, 23 bp, Homo sapiens
tgagaaattgaatgtaccttatt

SEQ ID NO: 4234995 - DNA, 14 bp, Homo sapiens
tgatatctttctca

SEQ ID NO: 4234996 - DNA, 15 bp, Homo sapiens
tgatatctttctcat

SEQ ID NO: 4234997 - DNA, 13 bp, Homo sapiens
tgatgtggagaaa

SEQ ID NO: 4234998 - DNA, 18 bp, Homo sapiens
tgatttcctctaaagaaa

SEQ ID NO: 4234999 - DNA, 22 bp, Homo sapiens
tgcaagaagccatttagggcag

SEQ ID NO: 4235000 - DNA, 16 bp, Homo sapiens
tgcagcagggctgggc

SEQ ID NO: 4235001 - DNA, 19 bp, Homo sapiens
tgcagtaattcaactggaa

SEQ ID NO: 4235002 - DNA, 17 bp, Homo sapiens
tgccacagggtactaaa

SEQ ID NO: 4235003 - DNA, 15 bp, Homo sapiens
tgcccacctcttctg

SEQ ID NO: 4235004 - DNA, 16 bp, Homo sapiens
tgcccacctcttctgc

SEQ ID NO: 4235005 - DNA, 23 bp, Homo sapiens
tgccctggctccttgcagcaggg

SEQ ID NO: 4235006 - DNA, 16 bp, Homo sapiens
tgcctgggccttggct

SEQ ID NO: 4235007 - DNA, 19 bp, Homo sapiens
tgcctgggccttggctggg

SEQ ID NO: 4235008 - DNA, 13 bp, Homo sapiens
tgccttcttccag

SEQ ID NO: 4235009 - DNA, 19 bp, Homo sapiens
tgcgtagaattgcaggtct

SEQ ID NO: 4235010 - DNA, 16 bp, Homo sapiens
tgctatttatattcat

SEQ ID NO: 4235011 - DNA, 21 bp, Homo sapiens
tgctatttatattcattcaga

SEQ ID NO: 4235012 - DNA, 16 bp, Homo sapiens
tgctctgagaaattga

SEQ ID NO: 4235013 - DNA, 18 bp, Homo sapiens
tgctctgggggtcccttg

SEQ ID NO: 4235014 - DNA, 13 bp, Homo sapiens
tgctgaggccttc

SEQ ID NO: 4235015 - DNA, 14 bp, Homo sapiens
tgctgatgtttcct

SEQ ID NO: 4235016 - DNA, 15 bp, Homo sapiens
tgctgcagcttggca

SEQ ID NO: 4235017 - DNA, 21 bp, Homo sapiens
tgctggaccagctggcctggg

SEQ ID NO: 4235018 - DNA, 13 bp, Homo sapiens
tgctggatgggac

SEQ ID NO: 4235019 - DNA, 13 bp, Homo sapiens
tgcttagcctgtg

SEQ ID NO: 4235020 - DNA, 15 bp, Homo sapiens
tgcttagcctgtgct

SEQ ID NO: 4235021 - DNA, 13 bp, Homo sapiens
tggaaagtttgta

SEQ ID NO: 4235022 - DNA, 22 bp, Homo sapiens
tggaaatggccattgagctgtt

SEQ ID NO: 4235023 - DNA, 19 bp, Homo sapiens
tggaagctgtcaggctggg

SEQ ID NO: 4235024 - DNA, 20 bp, Homo sapiens
tggaagctgtcaggctggga

SEQ ID NO: 4235025 - DNA, 23 bp, Homo sapiens
tggaagctgtcaggctgggacag

SEQ ID NO: 4235026 - DNA, 22 bp, Homo sapiens
tggagtatttttataattttat

SEQ ID NO: 4235027 - DNA, 17 bp, Homo sapiens
tggcaggacaaattgcg

SEQ ID NO: 4235028 - DNA, 21 bp, Homo sapiens
tggccttgccccaggccctgc

SEQ ID NO: 4235029 - DNA, 20 bp, Homo sapiens
tggctccttgcagcagggct

SEQ ID NO: 4235030 - DNA, 21 bp, Homo sapiens
tggctccttgcagcagggctg

SEQ ID NO: 4235031 - DNA, 20 bp, Homo sapiens
tgggaatgtctaacttaaat

SEQ ID NO: 4235032 - DNA, 14 bp, Homo sapiens
tgggcctgctgagg

SEQ ID NO: 4235033 - DNA, 15 bp, Homo sapiens
tgggcctgctgaggc

SEQ ID NO: 4235034 - DNA, 20 bp, Homo sapiens
tgggcctgctgaggccttct

SEQ ID NO: 4235035 - DNA, 18 bp, Homo sapiens
tgggccttggctgggcct

SEQ ID NO: 4235036 - DNA, 19 bp, Homo sapiens
tgggcttcctgctgggact

SEQ ID NO: 4235037 - DNA, 19 bp, Homo sapiens
tgggtgccctggctccttg

SEQ ID NO: 4235038 - DNA, 19 bp, Homo sapiens
tggtctataaaataaactt

SEQ ID NO: 4235039 - DNA, 23 bp, Homo sapiens
tggtctataaaataaacttctta

SEQ ID NO: 4235040 - DNA, 16 bp, Homo sapiens
tggttaatccaactgt

SEQ ID NO: 4235041 - DNA, 18 bp, Homo sapiens
tggttttataactatata

SEQ ID NO: 4235042 - DNA, 15 bp, Homo sapiens
tgtaaaagttactaa

SEQ ID NO: 4235043 - DNA, 16 bp, Homo sapiens
tgtaaaagttactaat

SEQ ID NO: 4235044 - DNA, 19 bp, Homo sapiens
tgtaacactattacagtat

SEQ ID NO: 4235045 - DNA, 13 bp, Homo sapiens
tgtaacctgctgg

SEQ ID NO: 4235046 - DNA, 22 bp, Homo sapiens
tgtaacctgctggatgggactc

SEQ ID NO: 4235047 - DNA, 19 bp, Homo sapiens
tgtaagaacaatgccaggg

SEQ ID NO: 4235048 - DNA, 15 bp, Homo sapiens
tgtaatatcatttta

SEQ ID NO: 4235049 - DNA, 21 bp, Homo sapiens
tgtaccttatttaaaagattt

SEQ ID NO: 4235050 - DNA, 18 bp, Homo sapiens
tgtagcatttttctaata

SEQ ID NO: 4235051 - DNA, 14 bp, Homo sapiens
tgtcagatctggat

SEQ ID NO: 4235052 - DNA, 12 bp, Homo sapiens
tgtcagcaggca

SEQ ID NO: 4235053 - DNA, 21 bp, Homo sapiens
tgtcagcaggcaggctgggga

SEQ ID NO: 4235054 - DNA, 13 bp, Homo sapiens
tgtctaacttaaa

SEQ ID NO: 4235055 - DNA, 17 bp, Homo sapiens
tgtgcctccaggaccag

SEQ ID NO: 4235056 - DNA, 14 bp, Homo sapiens
tgtgccttactaaa

SEQ ID NO: 4235057 - DNA, 18 bp, Homo sapiens
tgtgctgatgtttcctgg

SEQ ID NO: 4235058 - DNA, 17 bp, Homo sapiens
tgtggcccgaggaagct

SEQ ID NO: 4235059 - DNA, 21 bp, Homo sapiens
tgtgggcttcctgctgggact

SEQ ID NO: 4235060 - DNA, 20 bp, Homo sapiens
tgtgggtcgaggattctgtg

SEQ ID NO: 4235061 - DNA, 21 bp, Homo sapiens
tgtggtctataaaataaactt

SEQ ID NO: 4235062 - DNA, 23 bp, Homo sapiens
tgtggtctataaaataaacttct

SEQ ID NO: 4235063 - DNA, 13 bp, Homo sapiens
tgtgtgctgatgt

SEQ ID NO: 4235064 - DNA, 14 bp, Homo sapiens
tgttgtcagcaggc

SEQ ID NO: 4235065 - DNA, 21 bp, Homo sapiens
tgttgtcagcaggcaggctgg

SEQ ID NO: 4235066 - DNA, 15 bp, Homo sapiens
tgttgtgggcttcct

SEQ ID NO: 4235067 - DNA, 14 bp, Homo sapiens
tgtttattatgaca

SEQ ID NO: 4235068 - DNA, 19 bp, Homo sapiens
ttaaaaaaaaaaaactaga

SEQ ID NO: 4235069 - DNA, 19 bp, Homo sapiens
ttaaagttttcaaattatt

SEQ ID NO: 4235070 - DNA, 21 bp, Homo sapiens
ttaataacctgccagtcccag

SEQ ID NO: 4235071 - DNA, 17 bp, Homo sapiens
ttaattttagaaagaaa

SEQ ID NO: 4235072 - DNA, 18 bp, Homo sapiens
ttaattttagaaagaaaa

SEQ ID NO: 4235073 - DNA, 21 bp, Homo sapiens
ttaattttagaaagaaaatta

SEQ ID NO: 4235074 - DNA, 19 bp, Homo sapiens
ttacagtattgctatttat

SEQ ID NO: 4235075 - DNA, 12 bp, Homo sapiens
ttactaaatatg

SEQ ID NO: 4235076 - DNA, 14 bp, Homo sapiens
ttactaatatatct

SEQ ID NO: 4235077 - DNA, 16 bp, Homo sapiens
ttactgcttgcagtaa

SEQ ID NO: 4235078 - DNA, 21 bp, Homo sapiens
ttagaaagaaaattatattct

SEQ ID NO: 4235079 - DNA, 22 bp, Homo sapiens
ttagataaagtaagcctaggtg

SEQ ID NO: 4235080 - DNA, 18 bp, Homo sapiens
ttagatgctctgagaaat

SEQ ID NO: 4235081 - DNA, 18 bp, Homo sapiens
ttataactatataaatga

SEQ ID NO: 4235082 - DNA, 12 bp, Homo sapiens
ttataattttat

SEQ ID NO: 4235083 - DNA, 19 bp, Homo sapiens
ttataattttatctgtata

SEQ ID NO: 4235084 - DNA, 22 bp, Homo sapiens
ttatattcattcagatataaga

SEQ ID NO: 4235085 - DNA, 18 bp, Homo sapiens
ttatctgaatattagatg

SEQ ID NO: 4235086 - DNA, 13 bp, Homo sapiens
ttatctgtataag

SEQ ID NO: 4235087 - DNA, 15 bp, Homo sapiens
ttatggttttataac

SEQ ID NO: 4235088 - DNA, 16 bp, Homo sapiens
ttatttaaaagatttt

SEQ ID NO: 4235089 - DNA, 21 bp, Homo sapiens
ttatttagtcaattgtttaat

SEQ ID NO: 4235090 - DNA, 13 bp, Homo sapiens
ttcaactggaaat

SEQ ID NO: 4235091 - DNA, 17 bp, Homo sapiens
ttcactgagagctgcct

SEQ ID NO: 4235092 - DNA, 21 bp, Homo sapiens
ttcactgagagctgcctcctg

SEQ ID NO: 4235093 - DNA, 19 bp, Homo sapiens
ttcagggaaggtgaaacag

SEQ ID NO: 4235094 - DNA, 13 bp, Homo sapiens
ttcagtgatatct

SEQ ID NO: 4235095 - DNA, 15 bp, Homo sapiens
ttcattcagatataa

SEQ ID NO: 4235096 - DNA, 21 bp, Homo sapiens
ttctcaggcacttgaggcttt

SEQ ID NO: 4235097 - DNA, 12 bp, Homo sapiens
ttctctgccttc

SEQ ID NO: 4235098 - DNA, 19 bp, Homo sapiens
ttctgctgtggtctataaa

SEQ ID NO: 4235099 - DNA, 18 bp, Homo sapiens
ttctgtgtggagtatttt

SEQ ID NO: 4235100 - DNA, 17 bp, Homo sapiens
ttcttttgtgcccctgc

SEQ ID NO: 4235101 - DNA, 13 bp, Homo sapiens
ttgagctgtttcc

SEQ ID NO: 4235102 - DNA, 12 bp, Homo sapiens
ttgcagcagggc

SEQ ID NO: 4235103 - DNA, 20 bp, Homo sapiens
ttggaaaacatatgaaatat

SEQ ID NO: 4235104 - DNA, 22 bp, Homo sapiens
tttagaaagaaaattatattct

SEQ ID NO: 4235105 - DNA, 16 bp, Homo sapiens
tttagaggatgtggct

SEQ ID NO: 4235106 - DNA, 16 bp, Homo sapiens
tttataattttatctg

SEQ ID NO: 4235107 - DNA, 15 bp, Homo sapiens
tttatagaaaatgca

SEQ ID NO: 4235108 - DNA, 21 bp, Homo sapiens
tttatattcattcagatataa

SEQ ID NO: 4235109 - DNA, 11 bp, Homo sapiens
tttatctgtat

SEQ ID NO: 4235110 - DNA, 18 bp, Homo sapiens
caaggctcactgcagcgc

SEQ ID NO: 4235111 - DNA, 15 bp, Homo sapiens
caatgccagggccca

SEQ ID NO: 4235112 - DNA, 21 bp, Homo sapiens
caatgccagggcccaggagga

SEQ ID NO: 4235113 - DNA, 16 bp, Homo sapiens
cacagctgcaggccac

SEQ ID NO: 4235114 - DNA, 23 bp, Homo sapiens
cacagggtactaaaagaaactat

SEQ ID NO: 4235115 - DNA, 17 bp, Homo sapiens
caccacccctgggcagc

SEQ ID NO: 4235116 - DNA, 18 bp, Homo sapiens
cacccaggtgatttcctc

SEQ ID NO: 4235117 - DNA, 20 bp, Homo sapiens
cacccaggtgatttcctcta

SEQ ID NO: 4235118 - DNA, 17 bp, Homo sapiens
cactcaggtacttggta

SEQ ID NO: 4235119 - DNA, 19 bp, Homo sapiens
cactgagagctgcctcctg

SEQ ID NO: 4235120 - DNA, 17 bp, Homo sapiens
cactgcagtctgcagag

SEQ ID NO: 4235121 - DNA, 18 bp, Homo sapiens
cactgcagtctgcagagt

SEQ ID NO: 4235122 - DNA, 21 bp, Homo sapiens
cactggggcagatgtctcccc

SEQ ID NO: 4235123 - DNA, 13 bp, Homo sapiens
cactttctgctgg

SEQ ID NO: 4235124 - DNA, 14 bp, Homo sapiens
cactttgccttcca

SEQ ID NO: 4235125 - DNA, 12 bp, Homo sapiens
cagaggcactca

SEQ ID NO: 4235126 - DNA, 13 bp, Homo sapiens
cagatataagatt

SEQ ID NO: 4235127 - DNA, 14 bp, Homo sapiens
cagatataagattt

SEQ ID NO: 4235128 - DNA, 20 bp, Homo sapiens
cagatctggatcgttatcta

SEQ ID NO: 4235129 - DNA, 19 bp, Homo sapiens
cagatgtctcccctgccac

SEQ ID NO: 4235130 - DNA, 12 bp, Homo sapiens
cagcaggcaggc

SEQ ID NO: 4235131 - DNA, 14 bp, Homo sapiens
cagcaggcaggctg

SEQ ID NO: 4235132 - DNA, 16 bp, Homo sapiens
cagcaggcaggctggg

SEQ ID NO: 4235133 - DNA, 14 bp, Homo sapiens
cagcagggctgggc

SEQ ID NO: 4235134 - DNA, 18 bp, Homo sapiens
cagccccggccacccagg

SEQ ID NO: 4235135 - DNA, 16 bp, Homo sapiens
cagctccccggcactg

SEQ ID NO: 4235136 - DNA, 23 bp, Homo sapiens
cagcttcctccccccgactcccc

SEQ ID NO: 4235137 - DNA, 20 bp, Homo sapiens
caggacatggggctcctgga

SEQ ID NO: 4235138 - DNA, 18 bp, Homo sapiens
caggacccctcagctccc

SEQ ID NO: 4235139 - DNA, 19 bp, Homo sapiens
caggacccctcagctcccc

SEQ ID NO: 4235140 - DNA, 14 bp, Homo sapiens
caggatcaggggtt

SEQ ID NO: 4235141 - DNA, 14 bp, Homo sapiens
caggccagcctgtc

SEQ ID NO: 4235142 - DNA, 17 bp, Homo sapiens
caggccagcctgtccct

SEQ ID NO: 4235143 - DNA, 16 bp, Homo sapiens
caggctagagtgcagt

SEQ ID NO: 4235144 - DNA, 13 bp, Homo sapiens
caggctgggacag

SEQ ID NO: 4235145 - DNA, 22 bp, Homo sapiens
caggctggggaggccagtgttg

SEQ ID NO: 4235146 - DNA, 17 bp, Homo sapiens
cagggaaggtgaaacag

SEQ ID NO: 4235147 - DNA, 21 bp, Homo sapiens
cagggcttgtccctccaactg

SEQ ID NO: 4235148 - DNA, 24 bp, Homo sapiens
caggggcccaccctctgcccaggg

SEQ ID NO: 4235149 - DNA, 23 bp, Homo sapiens
caggggctacgttagcagcccag

SEQ ID NO: 4235150 - DNA, 19 bp, Homo sapiens
cagtaagtttattgttaat

SEQ ID NO: 4235151 - DNA, 14 bp, Homo sapiens
cagtaattcaactg

SEQ ID NO: 4235152 - DNA, 22 bp, Homo sapiens
cagtcgaggaagaccacccggc

SEQ ID NO: 4235153 - DNA, 21 bp, Homo sapiens
cagtctgcagagttctcctgg

SEQ ID NO: 4235154 - DNA, 19 bp, Homo sapiens
cagtgatatctttctcatt

SEQ ID NO: 4235155 - DNA, 16 bp, Homo sapiens
cagtgggcctgctgag

SEQ ID NO: 4235156 - DNA, 20 bp, Homo sapiens
cagtgggcctgctgaggcct

SEQ ID NO: 4235157 - DNA, 16 bp, Homo sapiens
cataggtccctgacat

SEQ ID NO: 4235158 - DNA, 15 bp, Homo sapiens
catatgaaatataaa

SEQ ID NO: 4235159 - DNA, 20 bp, Homo sapiens
catatgaaatataaattatc

SEQ ID NO: 4235160 - DNA, 21 bp, Homo sapiens
catattatcatcctataaaga

SEQ ID NO: 4235161 - DNA, 15 bp, Homo sapiens
catcgaagtcttccc

SEQ ID NO: 4235162 - DNA, 22 bp, Homo sapiens
catggatgagtaaactgtttct

SEQ ID NO: 4235163 - DNA, 16 bp, Homo sapiens
gtcagcaggcaggctg

SEQ ID NO: 4235164 - DNA, 19 bp, Homo sapiens
gtcagcaggcaggctgggg

SEQ ID NO: 4235165 - DNA, 19 bp, Homo sapiens
gtcaggccagcctgtccct

SEQ ID NO: 4235166 - DNA, 14 bp, Homo sapiens
gtcccatgaggtct

SEQ ID NO: 4235167 - DNA, 16 bp, Homo sapiens
gtccctgaaagagaag

SEQ ID NO: 4235168 - DNA, 18 bp, Homo sapiens
gtcctccagcctcggcct

SEQ ID NO: 4235169 - DNA, 22 bp, Homo sapiens
gtcgaggattctgtgcctccag

SEQ ID NO: 4235170 - DNA, 15 bp, Homo sapiens
gtctataaaataaac

SEQ ID NO: 4235171 - DNA, 20 bp, Homo sapiens
gtctataaaataaacttctt

SEQ ID NO: 4235172 - DNA, 22 bp, Homo sapiens
gtctataaaataaacttcttaa

SEQ ID NO: 4235173 - DNA, 15 bp, Homo sapiens
gtgatatctttctca

SEQ ID NO: 4235174 - DNA, 16 bp, Homo sapiens
gtgatatctttctcat

SEQ ID NO: 4235175 - DNA, 15 bp, Homo sapiens
gtgcccctgctcaca

SEQ ID NO: 4235176 - DNA, 18 bp, Homo sapiens
gtggagtatttttataat

SEQ ID NO: 4235177 - DNA, 21 bp, Homo sapiens
gtgtaagaacaatgccagggc

SEQ ID NO: 4235178 - DNA, 18 bp, Homo sapiens
gtgtgctgatgtttcctg

SEQ ID NO: 4235179 - DNA, 18 bp, Homo sapiens
gttctcctggaggcaggg

SEQ ID NO: 4235180 - DNA, 20 bp, Homo sapiens
gttggtttcactgagagctg

SEQ ID NO: 4235181 - DNA, 17 bp, Homo sapiens
gttgtcacaccctgact

SEQ ID NO: 4235182 - DNA, 21 bp, Homo sapiens
gttgtcagcaggcaggctggg

SEQ ID NO: 4235183 - DNA, 19 bp, Homo sapiens
gtttaatgttggaaaacat

SEQ ID NO: 4235184 - DNA, 16 bp, Homo sapiens
gtttattatgacaaat

SEQ ID NO: 4235185 - DNA, 14 bp, Homo sapiens
gtttctctgccttc

SEQ ID NO: 4235186 - DNA, 19 bp, Homo sapiens
gtttgtagcatttttctaa

SEQ ID NO: 4235187 - DNA, 14 bp, Homo sapiens
taaaagattttatg

SEQ ID NO: 4235188 - DNA, 16 bp, Homo sapiens
taaaagttactaatat

SEQ ID NO: 4235189 - DNA, 17 bp, Homo sapiens
taaaagttactaatata

SEQ ID NO: 4235190 - DNA, 20 bp, Homo sapiens
taaaagttactaatatatct

SEQ ID NO: 4235191 - DNA, 14 bp, Homo sapiens
taaaataaacttct

SEQ ID NO: 4235192 - DNA, 15 bp, Homo sapiens
taaactgtttctcag

SEQ ID NO: 4235193 - DNA, 12 bp, Homo sapiens
taaacttcttaa

SEQ ID NO: 4235194 - DNA, 16 bp, Homo sapiens
taaacttcttaacatg

SEQ ID NO: 4235195 - DNA, 22 bp, Homo sapiens
taaagaaacggtatgacttaat

SEQ ID NO: 4235196 - DNA, 16 bp, Homo sapiens
taaagaaacttggctg

SEQ ID NO: 4235197 - DNA, 22 bp, Homo sapiens
taaatggcatcagcactttaac

SEQ ID NO: 4235198 - DNA, 14 bp, Homo sapiens
taaattatctgaat

SEQ ID NO: 4235199 - DNA, 17 bp, Homo sapiens
taacactattacagtat

SEQ ID NO: 4235200 - DNA, 12 bp, Homo sapiens
taactatataaa

SEQ ID NO: 4235201 - DNA, 14 bp, Homo sapiens
taactatataaatg

SEQ ID NO: 4235202 - DNA, 20 bp, Homo sapiens
taagaacaatgccagggccc

SEQ ID NO: 4235203 - DNA, 20 bp, Homo sapiens
taataacctgccagtcccag

SEQ ID NO: 4235204 - DNA, 21 bp, Homo sapiens
taataggtactgccatatttt

SEQ ID NO: 4235205 - DNA, 15 bp, Homo sapiens
taatatcattttata

SEQ ID NO: 4235206 - DNA, 17 bp, Homo sapiens
taatatcattttataga

SEQ ID NO: 4235207 - DNA, 19 bp, Homo sapiens
taatatcattttatagaaa

SEQ ID NO: 4235208 - DNA, 18 bp, Homo sapiens
taatggaaagtttgtagc

SEQ ID NO: 4235209 - DNA, 21 bp, Homo sapiens
taatgttggaaaacatatgaa

SEQ ID NO: 4235210 - DNA, 23 bp, Homo sapiens
taatgttggaaaacatatgaaat

SEQ ID NO: 4235211 - DNA, 16 bp, Homo sapiens
taattcaactggaaat

SEQ ID NO: 4235212 - DNA, 15 bp, Homo sapiens
taattttagaaagaa

SEQ ID NO: 4235213 - DNA, 17 bp, Homo sapiens
tgcctgggccttggctg

SEQ ID NO: 4235214 - DNA, 21 bp, Homo sapiens
tgcctgggccttggctgggcc

SEQ ID NO: 4235215 - DNA, 12 bp, Homo sapiens
tgcgagacccaa

SEQ ID NO: 4235216 - DNA, 20 bp, Homo sapiens
tgctagaggcttttattaga

SEQ ID NO: 4235217 - DNA, 22 bp, Homo sapiens
tgctagaggcttttattagaaa

SEQ ID NO: 4235218 - DNA, 14 bp, Homo sapiens
tgctctgagaaatt

SEQ ID NO: 4235219 - DNA, 14 bp, Homo sapiens
tgctgaggccttct

SEQ ID NO: 4235220 - DNA, 15 bp, Homo sapiens
tgctggaccagctgg

SEQ ID NO: 4235221 - DNA, 16 bp, Homo sapiens
tgctgtggtctataaa

SEQ ID NO: 4235222 - DNA, 13 bp, Homo sapiens
tggaaaacatatg

SEQ ID NO: 4235223 - DNA, 13 bp, Homo sapiens
tggaccagctggc

SEQ ID NO: 4235224 - DNA, 18 bp, Homo sapiens
tggaccagctggcctggg

SEQ ID NO: 4235225 - DNA, 23 bp, Homo sapiens
tggaggcaggggctgctgccttg

SEQ ID NO: 4235226 - DNA, 17 bp, Homo sapiens
tggagtatttttataat

SEQ ID NO: 4235227 - DNA, 14 bp, Homo sapiens
tggatcgttatcta

SEQ ID NO: 4235228 - DNA, 23 bp, Homo sapiens
tggatgagtaaactgtttctcag

SEQ ID NO: 4235229 - DNA, 12 bp, Homo sapiens
tggatgggactc

SEQ ID NO: 4235230 - DNA, 20 bp, Homo sapiens
tggcaggacaaattgcgccc

SEQ ID NO: 4235231 - DNA, 19 bp, Homo sapiens
tggccattgagctgtttcc

SEQ ID NO: 4235232 - DNA, 18 bp, Homo sapiens
tggctccttgcagcaggg

SEQ ID NO: 4235233 - DNA, 19 bp, Homo sapiens
tggctccttgcagcagggc

SEQ ID NO: 4235234 - DNA, 15 bp, Homo sapiens
tggctggaatttctg

SEQ ID NO: 4235235 - DNA, 18 bp, Homo sapiens
tggctggaatttctgctg

SEQ ID NO: 4235236 - DNA, 15 bp, Homo sapiens
tggctgtaacctgct

SEQ ID NO: 4235237 - DNA, 17 bp, Homo sapiens
tgggcctgcgagaccca

SEQ ID NO: 4235238 - DNA, 17 bp, Homo sapiens
tgggccttggctgggcc

SEQ ID NO: 4235239 - DNA, 16 bp, Homo sapiens
tggtctataaaataaa

SEQ ID NO: 4235240 - DNA, 20 bp, Homo sapiens
tgtaacactattacagtatt

SEQ ID NO: 4235241 - DNA, 17 bp, Homo sapiens
tgtaatatcattttata

SEQ ID NO: 4235242 - DNA, 19 bp, Homo sapiens
tgtaatatcattttataga

SEQ ID NO: 4235243 - DNA, 21 bp, Homo sapiens
tgtaatatcattttatagaaa

SEQ ID NO: 4235244 - DNA, 15 bp, Homo sapiens
tgtacatattatcat

SEQ ID NO: 4235245 - DNA, 15 bp, Homo sapiens
tgtaccttatttaaa

SEQ ID NO: 4235246 - DNA, 20 bp, Homo sapiens
tgtataagctgtaatatcat

SEQ ID NO: 4235247 - DNA, 17 bp, Homo sapiens
tgtcaggccagcctgtc

SEQ ID NO: 4235248 - DNA, 20 bp, Homo sapiens
tgtcaggccagcctgtccct

SEQ ID NO: 4235249 - DNA, 20 bp, Homo sapiens
tgtctaacttaaatagcttt

SEQ ID NO: 4235250 - DNA, 17 bp, Homo sapiens
tgtggagtatttttata

SEQ ID NO: 4235251 - DNA, 23 bp, Homo sapiens
tgtggagtatttttataatttta

SEQ ID NO: 4235252 - DNA, 24 bp, Homo sapiens
tgtggcccgaggaagctggacagc

SEQ ID NO: 4235253 - DNA, 13 bp, Homo sapiens
tgtgggcttcctg

SEQ ID NO: 4235254 - DNA, 12 bp, Homo sapiens
tgtgtgtgctga

SEQ ID NO: 4235255 - DNA, 23 bp, Homo sapiens
tgttaagcttgcgtagaattgca

SEQ ID NO: 4235256 - DNA, 19 bp, Homo sapiens
tgttggtttcactgagagc

SEQ ID NO: 4235257 - DNA, 14 bp, Homo sapiens
tgttgtgggcttcc

SEQ ID NO: 4235258 - DNA, 23 bp, Homo sapiens
tgttgtgggcttcctgctgggac

SEQ ID NO: 4235259 - DNA, 17 bp, Homo sapiens
ttaaaagattttatggt

SEQ ID NO: 4235260 - DNA, 19 bp, Homo sapiens
ttaatggaaagtttgtagc

SEQ ID NO: 4235261 - DNA, 16 bp, Homo sapiens
ttaattttagaaagaa

SEQ ID NO: 4235262 - DNA, 18 bp, Homo sapiens
ttactaaatatgggaatg

SEQ ID NO: 4235263 - DNA, 23 bp, Homo sapiens
ttactaaatatgggaatgtctaa

SEQ ID NO: 4235264 - DNA, 15 bp, Homo sapiens
ttactaatatatctg

SEQ ID NO: 4235265 - DNA, 19 bp, Homo sapiens
ttactaatatatctgtaac

SEQ ID NO: 4235266 - DNA, 23 bp, Homo sapiens
ttagaaagaaaattatattctgt

SEQ ID NO: 4235267 - DNA, 16 bp, Homo sapiens
ttagatgctctgagaa

SEQ ID NO: 4235268 - DNA, 17 bp, Homo sapiens
ttagatgctctgagaaa

SEQ ID NO: 4235269 - DNA, 17 bp, Homo sapiens
ttataactatataaatg

SEQ ID NO: 4235270 - DNA, 16 bp, Homo sapiens
ttataattttatctgt

SEQ ID NO: 4235271 - DNA, 20 bp, Homo sapiens
ttatattctgtttattatga

SEQ ID NO: 4235272 - DNA, 20 bp, Homo sapiens
ttatgacaaatgaaagagaa

SEQ ID NO: 4235273 - DNA, 21 bp, Homo sapiens
ttatgacaaatgaaagagaaa

SEQ ID NO: 4235274 - DNA, 21 bp, Homo sapiens
ttatggttttataactatata

SEQ ID NO: 4235275 - DNA, 19 bp, Homo sapiens
ttattagaaagccatattt

SEQ ID NO: 4235276 - DNA, 19 bp, Homo sapiens
ttatttaaaagattttatg

SEQ ID NO: 4235277 - DNA, 16 bp, Homo sapiens
ttatttagtcaattgt

SEQ ID NO: 4235278 - DNA, 11 bp, Homo sapiens
ttcaaattatt

SEQ ID NO: 4235279 - DNA, 21 bp, Homo sapiens
ttcagatataagatttgtaca

SEQ ID NO: 4235280 - DNA, 20 bp, Homo sapiens
ttcagtgatatctttctcat

SEQ ID NO: 4235281 - DNA, 17 bp, Homo sapiens
ttcctgggtgccctggc

SEQ ID NO: 4235282 - DNA, 19 bp, Homo sapiens
ttctcaaaaattctcctaa

SEQ ID NO: 4235283 - DNA, 23 bp, Homo sapiens
ttctgctgtggtctataaaataa

SEQ ID NO: 4235284 - DNA, 22 bp, Homo sapiens
ttctgtaaaagttactaatata

SEQ ID NO: 4235285 - DNA, 15 bp, Homo sapiens
ttctgtgcctccagg

SEQ ID NO: 4235286 - DNA, 18 bp, Homo sapiens
ttcttttgtgcccctgct

SEQ ID NO: 4235287 - DNA, 14 bp, Homo sapiens
cttgcagcagggct

SEQ ID NO: 4235288 - DNA, 18 bp, Homo sapiens
cttgcagtaattcaactg

SEQ ID NO: 4235289 - DNA, 17 bp, Homo sapiens
cttgcttagcctgtgct

SEQ ID NO: 4235290 - DNA, 15 bp, Homo sapiens
cttggcattcttctt

SEQ ID NO: 4235291 - DNA, 13 bp, Homo sapiens
cttggctgggcct

SEQ ID NO: 4235292 - DNA, 14 bp, Homo sapiens
cttgtccctccaac

SEQ ID NO: 4235293 - DNA, 22 bp, Homo sapiens
ctttcagtgatatctttctcat

SEQ ID NO: 4235294 - DNA, 22 bp, Homo sapiens
ctttgtagccatcctgttaaat

SEQ ID NO: 4235295 - DNA, 15 bp, Homo sapiens
cttttattagaaagc

SEQ ID NO: 4235296 - DNA, 19 bp, Homo sapiens
gaaaacatatgaaatataa

SEQ ID NO: 4235297 - DNA, 16 bp, Homo sapiens
gaaaattatattctgt

SEQ ID NO: 4235298 - DNA, 15 bp, Homo sapiens
gaaacttggctggaa

SEQ ID NO: 4235299 - DNA, 14 bp, Homo sapiens
gaaagaaaattata

SEQ ID NO: 4235300 - DNA, 19 bp, Homo sapiens
gaaagaaaattatattctg

SEQ ID NO: 4235301 - DNA, 12 bp, Homo sapiens
gaaagagaaaat

SEQ ID NO: 4235302 - DNA, 22 bp, Homo sapiens
gaaagagaaaatatatattttt

SEQ ID NO: 4235303 - DNA, 21 bp, Homo sapiens
gaaattaaaaaaaaaaaacta

SEQ ID NO: 4235304 - DNA, 17 bp, Homo sapiens
gaacaatgccagggccc

SEQ ID NO: 4235305 - DNA, 14 bp, Homo sapiens
gaagctgtcaggct

SEQ ID NO: 4235306 - DNA, 17 bp, Homo sapiens
gaagctgtcaggctggg

SEQ ID NO: 4235307 - DNA, 18 bp, Homo sapiens
gaatattagatgctctga

SEQ ID NO: 4235308 - DNA, 20 bp, Homo sapiens
gaatattagatgctctgaga

SEQ ID NO: 4235309 - DNA, 23 bp, Homo sapiens
gaccaggggcccaccctctgccc

SEQ ID NO: 4235310 - DNA, 14 bp, Homo sapiens
gacccctccctgca

SEQ ID NO: 4235311 - DNA, 13 bp, Homo sapiens
gagaaaatatata

SEQ ID NO: 4235312 - DNA, 12 bp, Homo sapiens
gagaagatggcc

SEQ ID NO: 4235313 - DNA, 11 bp, Homo sapiens
gagagctgcct

SEQ ID NO: 4235314 - DNA, 19 bp, Homo sapiens
gaggctttcagtgatatct

SEQ ID NO: 4235315 - DNA, 15 bp, Homo sapiens
gagtatttttataat

SEQ ID NO: 4235316 - DNA, 17 bp, Homo sapiens
gagtatttttataattt

SEQ ID NO: 4235317 - DNA, 21 bp, Homo sapiens
gagtatttttataattttatc

SEQ ID NO: 4235318 - DNA, 17 bp, Homo sapiens
gatataagatttgtaca

SEQ ID NO: 4235319 - DNA, 18 bp, Homo sapiens
gatataagatttgtacat

SEQ ID NO: 4235320 - DNA, 22 bp, Homo sapiens
gatataagatttgtacatatta

SEQ ID NO: 4235321 - DNA, 20 bp, Homo sapiens
gatatctttctcattaccag

SEQ ID NO: 4235322 - DNA, 21 bp, Homo sapiens
gatctggatcgttatctactg

SEQ ID NO: 4235323 - DNA, 21 bp, Homo sapiens
gatgagtaaactgtttctcag

SEQ ID NO: 4235324 - DNA, 21 bp, Homo sapiens
gatgctctgagaaattgaatg

SEQ ID NO: 4235325 - DNA, 20 bp, Homo sapiens
gatgggactccatagctcct

SEQ ID NO: 4235326 - DNA, 17 bp, Homo sapiens
gatgtctcccctgccac

SEQ ID NO: 4235327 - DNA, 15 bp, Homo sapiens
gatttgtacatatta

SEQ ID NO: 4235328 - DNA, 19 bp, Homo sapiens
gcaaggcctctcagaccca

SEQ ID NO: 4235329 - DNA, 14 bp, Homo sapiens
gcaccgcagcctct

SEQ ID NO: 4235330 - DNA, 23 bp, Homo sapiens
gcagagttctcctggaggcaggg

SEQ ID NO: 4235331 - DNA, 15 bp, Homo sapiens
gcagcagggctgggc

SEQ ID NO: 4235332 - DNA, 17 bp, Homo sapiens
gcagcagggctgggcct

SEQ ID NO: 4235333 - DNA, 19 bp, Homo sapiens
gcagcagtaatttgtggca

SEQ ID NO: 4235334 - DNA, 19 bp, Homo sapiens
gcaggctggggaggccagt

SEQ ID NO: 4235335 - DNA, 13 bp, Homo sapiens
gcagggctgggcc

SEQ ID NO: 4235336 - DNA, 14 bp, Homo sapiens
gcagggctgggcct

SEQ ID NO: 4235337 - DNA, 10 bp, Homo sapiens
gcaggggcta

SEQ ID NO: 4235338 - DNA, 20 bp, Homo sapiens
gcaggggctgctgccttgtt

SEQ ID NO: 4235339 - DNA, 22 bp, Homo sapiens
gcaggtctctgtacgggccagt

SEQ ID NO: 4235340 - DNA, 19 bp, Homo sapiens
gcagtgggcctgctgaggc

SEQ ID NO: 4235341 - DNA, 21 bp, Homo sapiens
gcatcctcctctctggccttg

SEQ ID NO: 4235342 - DNA, 21 bp, Homo sapiens
ttgatatctttcctccctctt

SEQ ID NO: 4235343 - DNA, 20 bp, Homo sapiens
ttgcagtaattcaactggaa

SEQ ID NO: 4235344 - DNA, 23 bp, Homo sapiens
ttgcagtaattcaactggaaatt

SEQ ID NO: 4235345 - DNA, 22 bp, Homo sapiens
ttgccacagggtactaaaagaa

SEQ ID NO: 4235346 - DNA, 14 bp, Homo sapiens
ttggcattcttctt

SEQ ID NO: 4235347 - DNA, 11 bp, Homo sapiens
ttggctgggcc

SEQ ID NO: 4235348 - DNA, 14 bp, Homo sapiens
ttgtacatattatc

SEQ ID NO: 4235349 - DNA, 17 bp, Homo sapiens
ttgtacatattatcatc

SEQ ID NO: 4235350 - DNA, 12 bp, Homo sapiens
ttgtcagcaggc

SEQ ID NO: 4235351 - DNA, 21 bp, Homo sapiens
ttgtcagcaggcaggctgggg

SEQ ID NO: 4235352 - DNA, 16 bp, Homo sapiens
ttgtgccttactaaat

SEQ ID NO: 4235353 - DNA, 22 bp, Homo sapiens
tttaatgttggaaaacatatga

SEQ ID NO: 4235354 - DNA, 15 bp, Homo sapiens
tttagaaagaaaatt

SEQ ID NO: 4235355 - DNA, 19 bp, Homo sapiens
tttagtcaattgtttaatg

SEQ ID NO: 4235356 - DNA, 14 bp, Homo sapiens
tttataactatata

SEQ ID NO: 4235357 - DNA, 23 bp, Homo sapiens
tttataactatataaatgacatt

SEQ ID NO: 4235358 - DNA, 18 bp, Homo sapiens
tttatattcattcagata

SEQ ID NO: 4235359 - DNA, 23 bp, Homo sapiens
tttatctgtataagctgtaatat

SEQ ID NO: 4235360 - DNA, 12 bp, Homo sapiens
tttcaaattatt

SEQ ID NO: 4235361 - DNA, 22 bp, Homo sapiens
tttcagctatgctagaggcttt

SEQ ID NO: 4235362 - DNA, 15 bp, Homo sapiens
tttcagtgatatctt

SEQ ID NO: 4235363 - DNA, 17 bp, Homo sapiens
tttcctctaaagaaact

SEQ ID NO: 4235364 - DNA, 14 bp, Homo sapiens
tttctgtaaaagtt

SEQ ID NO: 4235365 - DNA, 16 bp, Homo sapiens
tttgagatttcagcta

SEQ ID NO: 4235366 - DNA, 21 bp, Homo sapiens
tttgtagcatttttctaatag

SEQ ID NO: 4235367 - DNA, 19 bp, Homo sapiens
ttttcttgatatctttcct

SEQ ID NO: 4235368 - DNA, 21 bp, Homo sapiens
ttttgccacagggtactaaaa

SEQ ID NO: 4235369 - DNA, 19 bp, Homo sapiens
tttttataattttatctgt

SEQ ID NO: 4235370 - DNA, 18 bp, Homo sapiens
tttttctgtaaaagttac

SEQ ID NO: 4235371 - DNA, 15 bp, Homo sapiens
aaaggttttctcaaa

SEQ ID NO: 4235372 - DNA, 19 bp, Homo sapiens
aaagttactaatatatctg

SEQ ID NO: 4235373 - DNA, 21 bp, Homo sapiens
aaagttactaatatatctgta

SEQ ID NO: 4235374 - DNA, 22 bp, Homo sapiens
aaagttactaatatatctgtaa

SEQ ID NO: 4235375 - DNA, 18 bp, Homo sapiens
aaagtttgtagcattttt

SEQ ID NO: 4235376 - DNA, 22 bp, Homo sapiens
aaagtttgtagcatttttctaa

SEQ ID NO: 4235377 - DNA, 19 bp, Homo sapiens
aaagttttcaaattatttt

SEQ ID NO: 4235378 - DNA, 11 bp, Homo sapiens
aaataaacttc

SEQ ID NO: 4235379 - DNA, 12 bp, Homo sapiens
aaataaacttct

SEQ ID NO: 4235380 - DNA, 20 bp, Homo sapiens
aaatgaaagagaaaatatat

SEQ ID NO: 4235381 - DNA, 22 bp, Homo sapiens
aaatgacattattaaagttttc

SEQ ID NO: 4235382 - DNA, 18 bp, Homo sapiens
aaatgactcataggtccc

SEQ ID NO: 4235383 - DNA, 13 bp, Homo sapiens
aaattatctgaat

SEQ ID NO: 4235384 - DNA, 14 bp, Homo sapiens
aaattatctgaata

SEQ ID NO: 4235385 - DNA, 19 bp, Homo sapiens
aaattgaatgtaccttatt

SEQ ID NO: 4235386 - DNA, 23 bp, Homo sapiens
aaccccaaatggttaatccaact

SEQ ID NO: 4235387 - DNA, 16 bp, Homo sapiens
aacctgccagtcccag

SEQ ID NO: 4235388 - DNA, 13 bp, Homo sapiens
aactatataaatg

SEQ ID NO: 4235389 - DNA, 18 bp, Homo sapiens
aactatataaatgacatt

SEQ ID NO: 4235390 - DNA, 20 bp, Homo sapiens
aactatataaatgacattat

SEQ ID NO: 4235391 - DNA, 21 bp, Homo sapiens
aactatataaatgacattatt

SEQ ID NO: 4235392 - DNA, 15 bp, Homo sapiens
aacttggctggaatt

SEQ ID NO: 4235393 - DNA, 13 bp, Homo sapiens
aagaaacggtatg

SEQ ID NO: 4235394 - DNA, 17 bp, Homo sapiens
aagaaacttggctggaa

SEQ ID NO: 4235395 - DNA, 12 bp, Homo sapiens
aagagaaaatat

SEQ ID NO: 4235396 - DNA, 18 bp, Homo sapiens
aagagaaaatatatattt

SEQ ID NO: 4235397 - DNA, 23 bp, Homo sapiens
aagatggccatgccctccatgtg

SEQ ID NO: 4235398 - DNA, 14 bp, Homo sapiens
aagatttgtacata

SEQ ID NO: 4235399 - DNA, 18 bp, Homo sapiens
aagatttgtacatattat

SEQ ID NO: 4235400 - DNA, 23 bp, Homo sapiens
aagcctaggtgttgtcagcaggc

SEQ ID NO: 4235401 - DNA, 22 bp, Homo sapiens
aagctgtaatatcattttatag

SEQ ID NO: 4235402 - DNA, 16 bp, Homo sapiens
aagttactaatatatc

SEQ ID NO: 4235403 - DNA, 19 bp, Homo sapiens
aagttactaatatatctgt

SEQ ID NO: 4235404 - DNA, 13 bp, Homo sapiens
aataaacttctta

SEQ ID NO: 4235405 - DNA, 17 bp, Homo sapiens
aatagctttgagatttc

SEQ ID NO: 4235406 - DNA, 15 bp, Homo sapiens
aataggtactgccat

SEQ ID NO: 4235407 - DNA, 14 bp, Homo sapiens
aatatatctgtaac

SEQ ID NO: 4235408 - DNA, 19 bp, Homo sapiens
aatatcattttatagaaaa

SEQ ID NO: 4235409 - DNA, 16 bp, Homo sapiens
aatattagatgctctg

SEQ ID NO: 4235410 - DNA, 17 bp, Homo sapiens
aatattagatgctctga

SEQ ID NO: 4235411 - DNA, 22 bp, Homo sapiens
aatattagatgctctgagaaat

SEQ ID NO: 4235412 - DNA, 23 bp, Homo sapiens
aatattagatgctctgagaaatt

SEQ ID NO: 4235413 - DNA, 14 bp, Homo sapiens
aatgaaagagaaaa

SEQ ID NO: 4235414 - DNA, 17 bp, Homo sapiens
aatgaaagagaaaatat

SEQ ID NO: 4235415 - DNA, 13 bp, Homo sapiens
aatgacattatta

SEQ ID NO: 4235416 - DNA, 17 bp, Homo sapiens
aatgacattattaaagt

SEQ ID NO: 4235417 - DNA, 21 bp, Homo sapiens
aatgtaccttatttaaaagat

SEQ ID NO: 4235418 - DNA, 12 bp, Homo sapiens
cattctctgccc

SEQ ID NO: 4235419 - DNA, 21 bp, Homo sapiens
catttccaaaccatcagctgc

SEQ ID NO: 4235420 - DNA, 15 bp, Homo sapiens
cattttatagaaaat

SEQ ID NO: 4235421 - DNA, 21 bp, Homo sapiens
ccacacccaggtgatttcctc

SEQ ID NO: 4235422 - DNA, 16 bp, Homo sapiens
ccactttgccttccag

SEQ ID NO: 4235423 - DNA, 18 bp, Homo sapiens
ccagcacatagcttgcct

SEQ ID NO: 4235424 - DNA, 21 bp, Homo sapiens
ccagctaaagcagtcctccag

SEQ ID NO: 4235425 - DNA, 12 bp, Homo sapiens
ccagctggcctg

SEQ ID NO: 4235426 - DNA, 13 bp, Homo sapiens
ccagcttcctccc

SEQ ID NO: 4235427 - DNA, 19 bp, Homo sapiens
ccaggccctgcagcggtgg

SEQ ID NO: 4235428 - DNA, 21 bp, Homo sapiens
ccaggggcccaccctctgccc

SEQ ID NO: 4235429 - DNA, 14 bp, Homo sapiens
ccaggtgatttcct

SEQ ID NO: 4235430 - DNA, 18 bp, Homo sapiens
ccagtgttgtgggcttcc

SEQ ID NO: 4235431 - DNA, 19 bp, Homo sapiens
ccagtgttgtgggcttcct

SEQ ID NO: 4235432 - DNA, 20 bp, Homo sapiens
ccagttataaagaggtcaca

SEQ ID NO: 4235433 - DNA, 23 bp, Homo sapiens
ccatggatgagtaaactgtttct

SEQ ID NO: 4235434 - DNA, 19 bp, Homo sapiens
cccagcacatagcttgcct

SEQ ID NO: 4235435 - DNA, 22 bp, Homo sapiens
cccagctaaagcagtcctccag

SEQ ID NO: 4235436 - DNA, 20 bp, Homo sapiens
cccatttagaggatgtggct

SEQ ID NO: 4235437 - DNA, 13 bp, Homo sapiens
cccctcagctccc

SEQ ID NO: 4235438 - DNA, 14 bp, Homo sapiens
cccgcaaggcctct

SEQ ID NO: 4235439 - DNA, 15 bp, Homo sapiens
cccgcaaggcctctc

SEQ ID NO: 4235440 - DNA, 16 bp, Homo sapiens
cccggcattctctgcc

SEQ ID NO: 4235441 - DNA, 18 bp, Homo sapiens
cccggcattctctgccca

SEQ ID NO: 4235442 - DNA, 14 bp, Homo sapiens
ccctgccactcctc

SEQ ID NO: 4235443 - DNA, 17 bp, Homo sapiens
ccctgcctgggccttgg

SEQ ID NO: 4235444 - DNA, 14 bp, Homo sapiens
ccctggctccttgc

SEQ ID NO: 4235445 - DNA, 15 bp, Homo sapiens
ccctggctccttgca

SEQ ID NO: 4235446 - DNA, 19 bp, Homo sapiens
ccctggctccttgcagcag

SEQ ID NO: 4235447 - DNA, 20 bp, Homo sapiens
ccctggctccttgcagcagg

SEQ ID NO: 4235448 - DNA, 23 bp, Homo sapiens
ccgaggaagctggacagcggcag

SEQ ID NO: 4235449 - DNA, 14 bp, Homo sapiens
ccgcaaggcctctc

SEQ ID NO: 4235450 - DNA, 11 bp, Homo sapiens
ccgcagcctct

SEQ ID NO: 4235451 - DNA, 15 bp, Homo sapiens
ccgcagcctctgccc

SEQ ID NO: 4235452 - DNA, 16 bp, Homo sapiens
ccgcctgccctgcctg

SEQ ID NO: 4235453 - DNA, 17 bp, Homo sapiens
ccggcattctctgccca

SEQ ID NO: 4235454 - DNA, 16 bp, Homo sapiens
cctccaggaccagggg

SEQ ID NO: 4235455 - DNA, 16 bp, Homo sapiens
cctccctgcaggggct

SEQ ID NO: 4235456 - DNA, 19 bp, Homo sapiens
cctgacccctccctgcagg

SEQ ID NO: 4235457 - DNA, 21 bp, Homo sapiens
cctgacccctccctgcagggg

SEQ ID NO: 4235458 - DNA, 22 bp, Homo sapiens
cctgacccctccctgcaggggc

SEQ ID NO: 4235459 - DNA, 13 bp, Homo sapiens
cctgccctgcctg

SEQ ID NO: 4235460 - DNA, 15 bp, Homo sapiens
cctgccctgcctggg

SEQ ID NO: 4235461 - DNA, 13 bp, Homo sapiens
cctgcctgggcct

SEQ ID NO: 4235462 - DNA, 17 bp, Homo sapiens
cctgctggatgggactc

SEQ ID NO: 4235463 - DNA, 14 bp, Homo sapiens
cctgctgggactga

SEQ ID NO: 4235464 - DNA, 16 bp, Homo sapiens
cctggaggcaggggct

SEQ ID NO: 4235465 - DNA, 18 bp, Homo sapiens
cctggaggcaggggctgc

SEQ ID NO: 4235466 - DNA, 20 bp, Homo sapiens
cctggctccttgcagcaggg

SEQ ID NO: 4235467 - DNA, 22 bp, Homo sapiens
cctggctccttgcagcagggct

SEQ ID NO: 4235468 - DNA, 14 bp, Homo sapiens
cctggctctggccc

SEQ ID NO: 4235469 - DNA, 13 bp, Homo sapiens
cctgggccttggc

SEQ ID NO: 4235470 - DNA, 13 bp, Homo sapiens
cctgggtgccctg

SEQ ID NO: 4235471 - DNA, 17 bp, Homo sapiens
cctgggtgccctggctc

SEQ ID NO: 4235472 - DNA, 19 bp, Homo sapiens
cctgtgctggaccagctgg

SEQ ID NO: 4235473 - DNA, 19 bp, Homo sapiens
cctgtgtgtgtgtgtgctg

SEQ ID NO: 4235474 - DNA, 14 bp, Homo sapiens
ccttactaaatatg

SEQ ID NO: 4235475 - DNA, 13 bp, Homo sapiens
ccttatttaaaag

SEQ ID NO: 4235476 - DNA, 12 bp, Homo sapiens
ccttccacctca

SEQ ID NO: 4235477 - DNA, 22 bp, Homo sapiens
ccttccatgtcaggccagcctg

SEQ ID NO: 4235478 - DNA, 16 bp, Homo sapiens
ccttctcttgaggcct

SEQ ID NO: 4235479 - DNA, 13 bp, Homo sapiens
gccatcctgttaa

SEQ ID NO: 4235480 - DNA, 22 bp, Homo sapiens
gcccaccctctgcccagggagt

SEQ ID NO: 4235481 - DNA, 13 bp, Homo sapiens
gccccaggccctg

SEQ ID NO: 4235482 - DNA, 19 bp, Homo sapiens
gcccccacgctggcctgct

SEQ ID NO: 4235483 - DNA, 15 bp, Homo sapiens
gccctgcctgggcct

SEQ ID NO: 4235484 - DNA, 20 bp, Homo sapiens
gccctgcctgggccttggct

SEQ ID NO: 4235485 - DNA, 22 bp, Homo sapiens
gccctggctccttgcagcaggg

SEQ ID NO: 4235486 - DNA, 23 bp, Homo sapiens
gcctaggtgttgtcagcaggcag

SEQ ID NO: 4235487 - DNA, 18 bp, Homo sapiens
gcctccaggaccaggggc

SEQ ID NO: 4235488 - DNA, 16 bp, Homo sapiens
gcctctaactcctggg

SEQ ID NO: 4235489 - DNA, 14 bp, Homo sapiens
gcctctgccccagc

SEQ ID NO: 4235490 - DNA, 16 bp, Homo sapiens
gcctgcgagacccaag

SEQ ID NO: 4235491 - DNA, 20 bp, Homo sapiens
gcctgctgaggccttctctt

SEQ ID NO: 4235492 - DNA, 14 bp, Homo sapiens
gccttccacctcac

SEQ ID NO: 4235493 - DNA, 22 bp, Homo sapiens
gcgagacccaaggctcactgca

SEQ ID NO: 4235494 - DNA, 16 bp, Homo sapiens
gctacgttagcagccc

SEQ ID NO: 4235495 - DNA, 13 bp, Homo sapiens
gctcactgtccac

SEQ ID NO: 4235496 - DNA, 22 bp, Homo sapiens
gctcctgacccctccctgcagg

SEQ ID NO: 4235497 - DNA, 19 bp, Homo sapiens
gctccttgcagcagggctg

SEQ ID NO: 4235498 - DNA, 17 bp, Homo sapiens
gctcgcgagggcagcac

SEQ ID NO: 4235499 - DNA, 14 bp, Homo sapiens
gctgaggccttctc

SEQ ID NO: 4235500 - DNA, 20 bp, Homo sapiens
gctgccttgtttcaccttcc

SEQ ID NO: 4235501 - DNA, 23 bp, Homo sapiens
gctggacagcggcagtgggcctg

SEQ ID NO: 4235502 - DNA, 19 bp, Homo sapiens
gctgggcctgcgagaccca

SEQ ID NO: 4235503 - DNA, 12 bp, Homo sapiens
gctgtcaggctg

SEQ ID NO: 4235504 - DNA, 12 bp, Homo sapiens
gcttcctgctgg

SEQ ID NO: 4235505 - DNA, 22 bp, Homo sapiens
gcttgcgtagaattgcaggtct

SEQ ID NO: 4235506 - DNA, 19 bp, Homo sapiens
gctttgagatttcagctat

SEQ ID NO: 4235507 - DNA, 14 bp, Homo sapiens
gcttttattagaaa

SEQ ID NO: 4235508 - DNA, 16 bp, Homo sapiens
gcttttattagaaagc

SEQ ID NO: 4235509 - DNA, 14 bp, Homo sapiens
ggaaccctgtccct

SEQ ID NO: 4235510 - DNA, 19 bp, Homo sapiens
ggaatttctgctgtggtct

SEQ ID NO: 4235511 - DNA, 17 bp, Homo sapiens
ggacccctcagctcccc

SEQ ID NO: 4235512 - DNA, 23 bp, Homo sapiens
ggatcaggggttagggtgcaaga

SEQ ID NO: 4235513 - DNA, 20 bp, Homo sapiens
ggatcgttatctactgacta

SEQ ID NO: 4235514 - DNA, 18 bp, Homo sapiens
ggatgagtaaactgtttc

SEQ ID NO: 4235515 - DNA, 19 bp, Homo sapiens
ggatgagtaaactgtttct

SEQ ID NO: 4235516 - DNA, 20 bp, Homo sapiens
ggatgagtaaactgtttctc

SEQ ID NO: 4235517 - DNA, 19 bp, Homo sapiens
ggcactgcagtctgcagag

SEQ ID NO: 4235518 - DNA, 21 bp, Homo sapiens
ggcagcaccgcagcctctgcc

SEQ ID NO: 4235519 - DNA, 21 bp, Homo sapiens
ggccagtttctctgccttctt

SEQ ID NO: 4235520 - DNA, 20 bp, Homo sapiens
ggcccaccctctgcccaggg

SEQ ID NO: 4235521 - DNA, 14 bp, Homo sapiens
ggcccaggaggacc

SEQ ID NO: 4235522 - DNA, 17 bp, Homo sapiens
ggcctgctgaggccttc

SEQ ID NO: 4235523 - DNA, 17 bp, Homo sapiens
ggcctggggtccctctg

SEQ ID NO: 4235524 - DNA, 13 bp, Homo sapiens
ggcctgtgctctg

SEQ ID NO: 4235525 - DNA, 18 bp, Homo sapiens
ggccttctcttgaggcct

SEQ ID NO: 4235526 - DNA, 19 bp, Homo sapiens
ggccttgccccaggccctg

SEQ ID NO: 4235527 - DNA, 19 bp, Homo sapiens
ggccttggctgggcctctg

SEQ ID NO: 4235528 - DNA, 14 bp, Homo sapiens
ggctagagtgcagt

SEQ ID NO: 4235529 - DNA, 17 bp, Homo sapiens
ggctccttgcagcaggg

SEQ ID NO: 4235530 - DNA, 15 bp, Homo sapiens
ggctgtaacctgctg

SEQ ID NO: 4235531 - DNA, 17 bp, Homo sapiens
ggggcccaccctctgcc

SEQ ID NO: 4235532 - DNA, 17 bp, Homo sapiens
ggtcgaggattctgtgc

SEQ ID NO: 4235533 - DNA, 19 bp, Homo sapiens
ggtctataaaataaacttc

SEQ ID NO: 4235534 - DNA, 22 bp, Homo sapiens
ggtctataaaataaacttctta

SEQ ID NO: 4235535 - DNA, 19 bp, Homo sapiens
ggtctctgtacgggccagt

SEQ ID NO: 4235536 - DNA, 21 bp, Homo sapiens
ggtgttgtcagcaggcaggct

SEQ ID NO: 4235537 - DNA, 21 bp, Homo sapiens
ggttctgacactttctgctgg

SEQ ID NO: 4235538 - DNA, 21 bp, Homo sapiens
ggtttcactgagagctgcctc

SEQ ID NO: 4235539 - DNA, 21 bp, Homo sapiens
ggttttataactatataaatg

SEQ ID NO: 4235540 - DNA, 18 bp, Homo sapiens
gtaagaacaatgccaggg

SEQ ID NO: 4235541 - DNA, 15 bp, Homo sapiens
gtaatatcattttat

SEQ ID NO: 4235542 - DNA, 16 bp, Homo sapiens
gtaatatcattttata

SEQ ID NO: 4235543 - DNA, 18 bp, Homo sapiens
gtaatatcattttataga

SEQ ID NO: 4235544 - DNA, 19 bp, Homo sapiens
gtaatatcattttatagaa

SEQ ID NO: 4235545 - DNA, 21 bp, Homo sapiens
gtaatatcattttatagaaaa

SEQ ID NO: 4235546 - DNA, 15 bp, Homo sapiens
gtaccttatttaaaa

SEQ ID NO: 4235547 - DNA, 16 bp, Homo sapiens
gtagcatttttctaat

SEQ ID NO: 4235548 - DNA, 16 bp, Homo sapiens
gtataagctgtaatat

SEQ ID NO: 4235549 - DNA, 18 bp, Homo sapiens
gtatgacttaattttaga

SEQ ID NO: 4235550 - DNA, 19 bp, Homo sapiens
gtattttcttttgtgcccc

SEQ ID NO: 4235551 - DNA, 18 bp, Homo sapiens
gtatttttataattttat

SEQ ID NO: 4235552 - DNA, 16 bp, Homo sapiens
gtcaattgtttaatgt

SEQ ID NO: 4235553 - DNA, 14 bp, Homo sapiens
gtcagcaggcaggc

SEQ ID NO: 4235554 - DNA, 16 bp, Homo sapiens
gtcaggccagcctgtc

SEQ ID NO: 4235555 - DNA, 12 bp, Homo sapiens
gtcaggctggga

SEQ ID NO: 4235556 - DNA, 19 bp, Homo sapiens
gtcccttgcttagcctgtg

SEQ ID NO: 4235557 - DNA, 21 bp, Homo sapiens
gtcccttgcttagcctgtgct

SEQ ID NO: 4235558 - DNA, 19 bp, Homo sapiens
gtctataaaataaacttct

SEQ ID NO: 4235559 - DNA, 14 bp, Homo sapiens
gtctcatagttgtg

SEQ ID NO: 4235560 - DNA, 21 bp, Homo sapiens
gtgaaacagggcttgtccctc

SEQ ID NO: 4235561 - DNA, 21 bp, Homo sapiens
gtgaactttttctaggtggca

SEQ ID NO: 4235562 - DNA, 23 bp, Homo sapiens
gtgacggggtgtgtggcccgagg

SEQ ID NO: 4235563 - DNA, 14 bp, Homo sapiens
gtgagggtctcttt

SEQ ID NO: 4235564 - DNA, 14 bp, Homo sapiens
gtgatttcctctaa

SEQ ID NO: 4235565 - DNA, 17 bp, Homo sapiens
gtgccctggctccttgc

SEQ ID NO: 4235566 - DNA, 16 bp, Homo sapiens
gtgcctccaggaccag

SEQ ID NO: 4235567 - DNA, 16 bp, Homo sapiens
gtgccttaggggaacc

SEQ ID NO: 4235568 - DNA, 22 bp, Homo sapiens
gtgcgattatagcccggtgcag

SEQ ID NO: 4235569 - DNA, 20 bp, Homo sapiens
gtgggcctgctgaggccttc

SEQ ID NO: 4235570 - DNA, 20 bp, Homo sapiens
gtgggcttcctgctgggact

SEQ ID NO: 4235571 - DNA, 21 bp, Homo sapiens
gtgggcttcctgctgggactg

SEQ ID NO: 4235572 - DNA, 22 bp, Homo sapiens
gtggtctataaaataaacttct

SEQ ID NO: 4235573 - DNA, 23 bp, Homo sapiens
gtggtctataaaataaacttctt

SEQ ID NO: 4235574 - DNA, 20 bp, Homo sapiens
gtgtaagaacaatgccaggg

SEQ ID NO: 4235575 - DNA, 15 bp, Homo sapiens
gttacccagcctggt

SEQ ID NO: 4235576 - DNA, 18 bp, Homo sapiens
gttactaatatatctgta

SEQ ID NO: 4235577 - DNA, 23 bp, Homo sapiens
gttggtttcactgagagctgcct

SEQ ID NO: 4235578 - DNA, 17 bp, Homo sapiens
gttgtcagcaggcaggc

SEQ ID NO: 4235579 - DNA, 23 bp, Homo sapiens
gtttaatgttggaaaacatatga

SEQ ID NO: 4235580 - DNA, 21 bp, Homo sapiens
gtttctctgccttcttccagg

SEQ ID NO: 4235581 - DNA, 20 bp, Homo sapiens
gtttgtagcatttttctaat

SEQ ID NO: 4235582 - DNA, 21 bp, Homo sapiens
gtttgtagcatttttctaata

SEQ ID NO: 4235583 - DNA, 20 bp, Homo sapiens
gttttataactatataaatg

SEQ ID NO: 4235584 - DNA, 15 bp, Homo sapiens
taaaagaaactatga

SEQ ID NO: 4235585 - DNA, 22 bp, Homo sapiens
taaaagaaactatgatgtggag

SEQ ID NO: 4235586 - DNA, 12 bp, Homo sapiens
taaaagatttta

SEQ ID NO: 4235587 - DNA, 13 bp, Homo sapiens
taaaagttactaa

SEQ ID NO: 4235588 - DNA, 21 bp, Homo sapiens
taaaagttactaatatatctg

SEQ ID NO: 4235589 - DNA, 14 bp, Homo sapiens
taaactgtttctca

SEQ ID NO: 4235590 - DNA, 24 bp, Homo sapiens
taaagaaacggtatgacttaattt

SEQ ID NO: 4235591 - DNA, 17 bp, Homo sapiens
taaagttttcaaattat

SEQ ID NO: 4235592 - DNA, 19 bp, Homo sapiens
taaagttttcaaattattt

SEQ ID NO: 4235593 - DNA, 16 bp, Homo sapiens
taaatagctttgagat

SEQ ID NO: 4235594 - DNA, 17 bp, Homo sapiens
taaatagctttgagatt

SEQ ID NO: 4235595 - DNA, 17 bp, Homo sapiens
taaatatgggaatgtct

SEQ ID NO: 4235596 - DNA, 19 bp, Homo sapiens
taaatatgggaatgtctaa

SEQ ID NO: 4235597 - DNA, 13 bp, Homo sapiens
taacaagtgtatc

SEQ ID NO: 4235598 - DNA, 21 bp, Homo sapiens
attctgtgcctccaggaccag

SEQ ID NO: 4235599 - DNA, 23 bp, Homo sapiens
attgaatgtaccttatttaaaag

SEQ ID NO: 4235600 - DNA, 15 bp, Homo sapiens
atttcctctaaagaa

SEQ ID NO: 4235601 - DNA, 17 bp, Homo sapiens
attttagaaagaaaatt

SEQ ID NO: 4235602 - DNA, 18 bp, Homo sapiens
attttagaaagaaaatta

SEQ ID NO: 4235603 - DNA, 23 bp, Homo sapiens
attttagaaagaaaattatattc

SEQ ID NO: 4235604 - DNA, 22 bp, Homo sapiens
attttatagaaaatgcattatt

SEQ ID NO: 4235605 - DNA, 19 bp, Homo sapiens
atttttaatggaaagtttg

SEQ ID NO: 4235606 - DNA, 11 bp, Homo sapiens
atttttataat

SEQ ID NO: 4235607 - DNA, 15 bp, Homo sapiens
atttttctaataggt

SEQ ID NO: 4235608 - DNA, 23 bp, Homo sapiens
caaaacaagtgacatgaagggag

SEQ ID NO: 4235609 - DNA, 19 bp, Homo sapiens
caaagtactgggattacag

SEQ ID NO: 4235610 - DNA, 21 bp, Homo sapiens
caaatgaaagagaaaatatat

SEQ ID NO: 4235611 - DNA, 14 bp, Homo sapiens
cacatagcttgcct

SEQ ID NO: 4235612 - DNA, 15 bp, Homo sapiens
caccctctgcccagg

SEQ ID NO: 4235613 - DNA, 23 bp, Homo sapiens
caccctctgcccagggagtcctt

SEQ ID NO: 4235614 - DNA, 18 bp, Homo sapiens
cactgcagcgcgctcctg

SEQ ID NO: 4235615 - DNA, 24 bp, Homo sapiens
cactgcagtctgcagagttctcct

SEQ ID NO: 4235616 - DNA, 16 bp, Homo sapiens
cagagacacggtccca

SEQ ID NO: 4235617 - DNA, 23 bp, Homo sapiens
cagagttctcctggaggcagggg

SEQ ID NO: 4235618 - DNA, 23 bp, Homo sapiens
cagatataagatttgtacatatt

SEQ ID NO: 4235619 - DNA, 23 bp, Homo sapiens
cagcccagcacatagcttgccta

SEQ ID NO: 4235620 - DNA, 14 bp, Homo sapiens
cagccccggccacc

SEQ ID NO: 4235621 - DNA, 15 bp, Homo sapiens
cagcctctaactcct

SEQ ID NO: 4235622 - DNA, 23 bp, Homo sapiens
cagcctctaactcctgggctcaa

SEQ ID NO: 4235623 - DNA, 12 bp, Homo sapiens
cagcctctgccc

SEQ ID NO: 4235624 - DNA, 13 bp, Homo sapiens
cagcctctgcccc

SEQ ID NO: 4235625 - DNA, 15 bp, Homo sapiens
cagctaaagcagtcc

SEQ ID NO: 4235626 - DNA, 12 bp, Homo sapiens
cagctggcctgg

SEQ ID NO: 4235627 - DNA, 23 bp, Homo sapiens
cagctggcctggggtccctctga

SEQ ID NO: 4235628 - DNA, 14 bp, Homo sapiens
caggaccaggggcc

SEQ ID NO: 4235629 - DNA, 20 bp, Homo sapiens
caggctggggaggccagtgt

SEQ ID NO: 4235630 - DNA, 13 bp, Homo sapiens
cagggctgggcct

SEQ ID NO: 4235631 - DNA, 13 bp, Homo sapiens
caggggctgctgc

SEQ ID NO: 4235632 - DNA, 16 bp, Homo sapiens
cagggtactaaaagaa

SEQ ID NO: 4235633 - DNA, 17 bp, Homo sapiens
caggtgatttcctctaa

SEQ ID NO: 4235634 - DNA, 13 bp, Homo sapiens
cagtaattcaact

SEQ ID NO: 4235635 - DNA, 17 bp, Homo sapiens
cagtattgctatttata

SEQ ID NO: 4235636 - DNA, 12 bp, Homo sapiens
cagtgactaatt

SEQ ID NO: 4235637 - DNA, 15 bp, Homo sapiens
cagtgactaattttg

SEQ ID NO: 4235638 - DNA, 15 bp, Homo sapiens
cagtgggcctgctga

SEQ ID NO: 4235639 - DNA, 17 bp, Homo sapiens
cagtgttgtgggcttcc

SEQ ID NO: 4235640 - DNA, 17 bp, Homo sapiens
cagtttctctgccttct

SEQ ID NO: 4235641 - DNA, 19 bp, Homo sapiens
cagtttctctgccttcttc

SEQ ID NO: 4235642 - DNA, 22 bp, Homo sapiens
catagcttgcctaatggctttc

SEQ ID NO: 4235643 - DNA, 16 bp, Homo sapiens
catagttgtgttaagc

SEQ ID NO: 4235644 - DNA, 17 bp, Homo sapiens
catatgaaatataaatt

SEQ ID NO: 4235645 - DNA, 18 bp, Homo sapiens
catatttttttctgtaaa

SEQ ID NO: 4235646 - DNA, 15 bp, Homo sapiens
catggggctcctgga

SEQ ID NO: 4235647 - DNA, 19 bp, Homo sapiens
catgtcaggccagcctgtc

SEQ ID NO: 4235648 - DNA, 18 bp, Homo sapiens
ccacttttgcccacctct

SEQ ID NO: 4235649 - DNA, 21 bp, Homo sapiens
ccacttttgcccacctcttct

SEQ ID NO: 4235650 - DNA, 17 bp, Homo sapiens
ccagcacatagcttgcc

SEQ ID NO: 4235651 - DNA, 19 bp, Homo sapiens
ccaggacccctcagctccc

SEQ ID NO: 4235652 - DNA, 19 bp, Homo sapiens
ccaggaggaccgcctgccc

SEQ ID NO: 4235653 - DNA, 20 bp, Homo sapiens
ccaggaggaccgcctgccct

SEQ ID NO: 4235654 - DNA, 13 bp, Homo sapiens
ccagggcccagga

SEQ ID NO: 4235655 - DNA, 15 bp, Homo sapiens
ccaggtgatttcctc

SEQ ID NO: 4235656 - DNA, 12 bp, Homo sapiens
ccatatttttct

SEQ ID NO: 4235657 - DNA, 16 bp, Homo sapiens
ccatatttttttctgt

SEQ ID NO: 4235658 - DNA, 20 bp, Homo sapiens
ccatatttttttctgtaaaa

SEQ ID NO: 4235659 - DNA, 17 bp, Homo sapiens
ccattgagctgtttcct

SEQ ID NO: 4235660 - DNA, 23 bp, Homo sapiens
cccagagacacggtcccaccatg

SEQ ID NO: 4235661 - DNA, 14 bp, Homo sapiens
cccagcttcctccc

SEQ ID NO: 4235662 - DNA, 15 bp, Homo sapiens
cccaggtgatttcct

SEQ ID NO: 4235663 - DNA, 16 bp, Homo sapiens
cccgcaaggcctctca

SEQ ID NO: 4235664 - DNA, 20 bp, Homo sapiens
cccggcactgcagtctgcag

SEQ ID NO: 4235665 - DNA, 17 bp, Homo sapiens
cccggcattctctgccc

SEQ ID NO: 4235666 - DNA, 16 bp, Homo sapiens
ccctcagctccccggc

SEQ ID NO: 4235667 - DNA, 15 bp, Homo sapiens
ccctctgcccaggga

SEQ ID NO: 4235668 - DNA, 21 bp, Homo sapiens
ccctgcagcggtggttgtcac

SEQ ID NO: 4235669 - DNA, 14 bp, Homo sapiens
ccctgcctgggcct

SEQ ID NO: 4235670 - DNA, 16 bp, Homo sapiens
ccctgcctgggccttg

SEQ ID NO: 4235671 - DNA, 22 bp, Homo sapiens
ccctgcctgggccttggctggg

SEQ ID NO: 4235672 - DNA, 11 bp, Homo sapiens
ccgactccccc

SEQ ID NO: 4235673 - DNA, 21 bp, Homo sapiens
ccgcaaggcctctcagaccca

SEQ ID NO: 4235674 - DNA, 17 bp, Homo sapiens
ccgcagcctctgcccca

SEQ ID NO: 4235675 - DNA, 14 bp, Homo sapiens
ccggtgcagcctct

SEQ ID NO: 4235676 - DNA, 12 bp, Homo sapiens
cctaatggcttt

SEQ ID NO: 4235677 - DNA, 21 bp, Homo sapiens
cctaggtgttgtcagcaggca

SEQ ID NO: 4235678 - DNA, 22 bp, Homo sapiens
cctcagctccccggcactgcag

SEQ ID NO: 4235679 - DNA, 12 bp, Homo sapiens
cctccaggacca

SEQ ID NO: 4235680 - DNA, 21 bp, Homo sapiens
cctcctggtctcttcaccact

SEQ ID NO: 4235681 - DNA, 16 bp, Homo sapiens
cctctaaagaaacttg

SEQ ID NO: 4235682 - DNA, 14 bp, Homo sapiens
cctctcagacccag

SEQ ID NO: 4235683 - DNA, 14 bp, Homo sapiens
cctctctggccttg

SEQ ID NO: 4235684 - DNA, 21 bp, Homo sapiens
cctctgaagagaccttggctg

SEQ ID NO: 4235685 - DNA, 13 bp, Homo sapiens
cctgacccctccc

SEQ ID NO: 4235686 - DNA, 14 bp, Homo sapiens
cctgccactcctca

SEQ ID NO: 4235687 - DNA, 15 bp, Homo sapiens
cctgccactcctcaa

SEQ ID NO: 4235688 - DNA, 16 bp, Homo sapiens
cctgccctgcctgggc

SEQ ID NO: 4235689 - DNA, 14 bp, Homo sapiens
cctgcctgggcctt

SEQ ID NO: 4235690 - DNA, 23 bp, Homo sapiens
cctgcgagacccaaggctcactg

SEQ ID NO: 4235691 - DNA, 21 bp, Homo sapiens
cctgctgaggccttctcttga

SEQ ID NO: 4235692 - DNA, 13 bp, Homo sapiens
cctgctgggactg

SEQ ID NO: 4235693 - DNA, 23 bp, Homo sapiens
cctgctgggactgagaaggctca

SEQ ID NO: 4235694 - DNA, 21 bp, Homo sapiens
cctggagatagttgctaagtt

SEQ ID NO: 4235695 - DNA, 15 bp, Homo sapiens
cctggaggcaggggc

SEQ ID NO: 4235696 - DNA, 15 bp, Homo sapiens
cctgggccttggctg

SEQ ID NO: 4235697 - DNA, 21 bp, Homo sapiens
cctgggccttggctgggcctc

SEQ ID NO: 4235698 - DNA, 18 bp, Homo sapiens
cctggggtccctctgaag

SEQ ID NO: 4235699 - DNA, 13 bp, Homo sapiens
cctggtctcttca

SEQ ID NO: 4235700 - DNA, 20 bp, Homo sapiens
cctgtgctctgggggtccct

SEQ ID NO: 4235701 - DNA, 14 bp, Homo sapiens
ccttattactgctt

SEQ ID NO: 4235702 - DNA, 15 bp, Homo sapiens
ccttatttaaaagat

SEQ ID NO: 4235703 - DNA, 24 bp, Homo sapiens
ccttccatgtcaggccagcctgtc

SEQ ID NO: 4235704 - DNA, 20 bp, Homo sapiens
ccttctcttgaggcctgtgc

SEQ ID NO: 4235705 - DNA, 16 bp, Homo sapiens
ccttgcttagcctgtg

SEQ ID NO: 4235706 - DNA, 17 bp, Homo sapiens
ccttggctgggcctctg

SEQ ID NO: 4235707 - DNA, 16 bp, Homo sapiens
cgcctgccctgcctgg

SEQ ID NO: 4235708 - DNA, 22 bp, Homo sapiens
cgctcctgacccctccctgcag

SEQ ID NO: 4235709 - DNA, 18 bp, Homo sapiens
cggcactgcagtctgcag

SEQ ID NO: 4235710 - DNA, 13 bp, Homo sapiens
cggcagtgggcct

SEQ ID NO: 4235711 - DNA, 22 bp, Homo sapiens
cggcagtgggcctgctgaggcc

SEQ ID NO: 4235712 - DNA, 23 bp, Homo sapiens
cgggccagtttctctgccttctt

SEQ ID NO: 4235713 - DNA, 19 bp, Homo sapiens
ctaaatatgggaatgtcta

SEQ ID NO: 4235714 - DNA, 21 bp, Homo sapiens
ctaataggtactgccatattt

SEQ ID NO: 4235715 - DNA, 14 bp, Homo sapiens
ctaatatatctgta

SEQ ID NO: 4235716 - DNA, 18 bp, Homo sapiens
ctacagacctggtacact

SEQ ID NO: 4235717 - DNA, 14 bp, Homo sapiens
ctactgactatatt

SEQ ID NO: 4235718 - DNA, 22 bp, Homo sapiens
taaccaatgacgtttgcataga

SEQ ID NO: 4235719 - DNA, 17 bp, Homo sapiens
taacctgccagtcccag

SEQ ID NO: 4235720 - DNA, 20 bp, Homo sapiens
taagatttgtacatattatc

SEQ ID NO: 4235721 - DNA, 23 bp, Homo sapiens
taagcctaggtgttgtcagcagg

SEQ ID NO: 4235722 - DNA, 15 bp, Homo sapiens
taagctgtaatatca

SEQ ID NO: 4235723 - DNA, 16 bp, Homo sapiens
taagctgtaatatcat

SEQ ID NO: 4235724 - DNA, 20 bp, Homo sapiens
taataaaatcttctgatgag

SEQ ID NO: 4235725 - DNA, 13 bp, Homo sapiens
taatatatctgta

SEQ ID NO: 4235726 - DNA, 16 bp, Homo sapiens
taatatatctgtaaca

SEQ ID NO: 4235727 - DNA, 21 bp, Homo sapiens
taatatatctgtaacactatt

SEQ ID NO: 4235728 - DNA, 16 bp, Homo sapiens
taatatcattttatag

SEQ ID NO: 4235729 - DNA, 20 bp, Homo sapiens
taatatcattttatagaaaa

SEQ ID NO: 4235730 - DNA, 12 bp, Homo sapiens
tacagtattgct

SEQ ID NO: 4235731 - DNA, 13 bp, Homo sapiens
tacagtattgcta

SEQ ID NO: 4235732 - DNA, 15 bp, Homo sapiens
tacagtattgctatt

SEQ ID NO: 4235733 - DNA, 12 bp, Homo sapiens
taccttatttaa

SEQ ID NO: 4235734 - DNA, 21 bp, Homo sapiens
tacgggccagtttctctgcct

SEQ ID NO: 4235735 - DNA, 14 bp, Homo sapiens
tactaaaagaaact

SEQ ID NO: 4235736 - DNA, 12 bp, Homo sapiens
tactaatatatc

SEQ ID NO: 4235737 - DNA, 13 bp, Homo sapiens
tactaatatatct

SEQ ID NO: 4235738 - DNA, 14 bp, Homo sapiens
tactaatatatctg

SEQ ID NO: 4235739 - DNA, 23 bp, Homo sapiens
tactgcttgcagtaattcaactg

SEQ ID NO: 4235740 - DNA, 16 bp, Homo sapiens
tagaaagaaaattata

SEQ ID NO: 4235741 - DNA, 16 bp, Homo sapiens
tagaggatgtggctgt

SEQ ID NO: 4235742 - DNA, 14 bp, Homo sapiens
tagatgctctgaga

SEQ ID NO: 4235743 - DNA, 14 bp, Homo sapiens
tagcccggtgcagc

SEQ ID NO: 4235744 - DNA, 14 bp, Homo sapiens
tagcctgtgctgga

SEQ ID NO: 4235745 - DNA, 22 bp, Homo sapiens
tagctgggatcacagctgcagg

SEQ ID NO: 4235746 - DNA, 18 bp, Homo sapiens
taggggaaccctgtccct

SEQ ID NO: 4235747 - DNA, 20 bp, Homo sapiens
tataaagaaacggtatgact

SEQ ID NO: 4235748 - DNA, 20 bp, Homo sapiens
tataaatgacattattaaag

SEQ ID NO: 4235749 - DNA, 13 bp, Homo sapiens
tataaattatctg

SEQ ID NO: 4235750 - DNA, 15 bp, Homo sapiens
tataaattatctgaa

SEQ ID NO: 4235751 - DNA, 17 bp, Homo sapiens
tataaattatctgaata

SEQ ID NO: 4235752 - DNA, 15 bp, Homo sapiens
tataactatataaat

SEQ ID NO: 4235753 - DNA, 17 bp, Homo sapiens
tataactatataaatga

SEQ ID NO: 4235754 - DNA, 15 bp, Homo sapiens
tataagatttgtaca

SEQ ID NO: 4235755 - DNA, 22 bp, Homo sapiens
tataagatttgtacatattatc

SEQ ID NO: 4235756 - DNA, 18 bp, Homo sapiens
tataagctgtaatatcat

SEQ ID NO: 4235757 - DNA, 19 bp, Homo sapiens
tataagctgtaatatcatt

SEQ ID NO: 4235758 - DNA, 16 bp, Homo sapiens
tatataaatgacatta

SEQ ID NO: 4235759 - DNA, 19 bp, Homo sapiens
tatataaatgacattatta

SEQ ID NO: 4235760 - DNA, 22 bp, Homo sapiens
tatattcattcagatataagat

SEQ ID NO: 4235761 - DNA, 14 bp, Homo sapiens
tatattctgtttat

SEQ ID NO: 4235762 - DNA, 15 bp, Homo sapiens
tatcattttatagaa

SEQ ID NO: 4235763 - DNA, 19 bp, Homo sapiens
tatctgaatattagatgct

SEQ ID NO: 4235764 - DNA, 14 bp, Homo sapiens
tatctgtataagct

SEQ ID NO: 4235765 - DNA, 18 bp, Homo sapiens
tatctgtataagctgtaa

SEQ ID NO: 4235766 - DNA, 15 bp, Homo sapiens
tatgaaatataaatt

SEQ ID NO: 4235767 - DNA, 18 bp, Homo sapiens
tatgaaatataaattatc

SEQ ID NO: 4235768 - DNA, 22 bp, Homo sapiens
tatgaaatataaattatctgaa

SEQ ID NO: 4235769 - DNA, 17 bp, Homo sapiens
tatgacaaatgaaagag

SEQ ID NO: 4235770 - DNA, 17 bp, Homo sapiens
tatgacttaattttaga

SEQ ID NO: 4235771 - DNA, 15 bp, Homo sapiens
tatgatgtggagaaa

SEQ ID NO: 4235772 - DNA, 20 bp, Homo sapiens
tatggttttataactatata

SEQ ID NO: 4235773 - DNA, 17 bp, Homo sapiens
tattagaaagccatatt

SEQ ID NO: 4235774 - DNA, 20 bp, Homo sapiens
tattatcatcctataaagaa

SEQ ID NO: 4235775 - DNA, 19 bp, Homo sapiens
tattatgacaaatgaaaga

SEQ ID NO: 4235776 - DNA, 13 bp, Homo sapiens
tattcattcagat

SEQ ID NO: 4235777 - DNA, 19 bp, Homo sapiens
tattcattcagatataaga

SEQ ID NO: 4235778 - DNA, 14 bp, Homo sapiens
tattccttttcata

SEQ ID NO: 4235779 - DNA, 17 bp, Homo sapiens
tattgctatttatattc

SEQ ID NO: 4235780 - DNA, 18 bp, Homo sapiens
tattgttaatggttctta

SEQ ID NO: 4235781 - DNA, 18 bp, Homo sapiens
tatttaaaagattttatg

SEQ ID NO: 4235782 - DNA, 14 bp, Homo sapiens
tatttatattcatt

SEQ ID NO: 4235783 - DNA, 20 bp, Homo sapiens
tatttatattcattcagata

SEQ ID NO: 4235784 - DNA, 18 bp, Homo sapiens
tatttttaatggaaagtt

SEQ ID NO: 4235785 - DNA, 14 bp, Homo sapiens
tatttttataattt

SEQ ID NO: 4235786 - DNA, 17 bp, Homo sapiens
tatttttttctgtaaaa

SEQ ID NO: 4235787 - DNA, 16 bp, Homo sapiens
tcacaccctgacttca

SEQ ID NO: 4235788 - DNA, 14 bp, Homo sapiens
tcaccttccatgtc

SEQ ID NO: 4235789 - DNA, 21 bp, Homo sapiens
tcaccttccatgtcaggccag

SEQ ID NO: 4235790 - DNA, 12 bp, Homo sapiens
tcactgagagct

SEQ ID NO: 4235791 - DNA, 13 bp, Homo sapiens
tcagacccagatg

SEQ ID NO: 4235792 - DNA, 16 bp, Homo sapiens
tcagatataagatttg

SEQ ID NO: 4235793 - DNA, 17 bp, Homo sapiens
tcagcaggcaggctggg

SEQ ID NO: 4235794 - DNA, 20 bp, Homo sapiens
tcagctccccggcactgcag

SEQ ID NO: 4235795 - DNA, 17 bp, Homo sapiens
tcattaccagtgactaa

SEQ ID NO: 4235796 - DNA, 14 bp, Homo sapiens
tcattttatagaaa

SEQ ID NO: 4235797 - DNA, 16 bp, Homo sapiens
tccaactgcaggaaaa

SEQ ID NO: 4235798 - DNA, 14 bp, Homo sapiens
tccagcctcggcct

SEQ ID NO: 4235799 - DNA, 12 bp, Homo sapiens
tccatagctcct

SEQ ID NO: 4235800 - DNA, 17 bp, Homo sapiens
tccatagctccttccca

SEQ ID NO: 4235801 - DNA, 23 bp, Homo sapiens
tccattgtgccttactaaatatg

SEQ ID NO: 4235802 - DNA, 16 bp, Homo sapiens
tcccatggatgagtaa

SEQ ID NO: 4235803 - DNA, 22 bp, Homo sapiens
tccctctgaagagaccttggct

SEQ ID NO: 4235804 - DNA, 14 bp, Homo sapiens
tccctgcaggggct

SEQ ID NO: 4235805 - DNA, 23 bp, Homo sapiens
tcctgacccctccctgcaggggc

SEQ ID NO: 4235806 - DNA, 14 bp, Homo sapiens
tcctgctgggactg

SEQ ID NO: 4235807 - DNA, 19 bp, Homo sapiens
tccttgcagcagggctggg

SEQ ID NO: 4235808 - DNA, 14 bp, Homo sapiens
tctaaagaaacttg

SEQ ID NO: 4235809 - DNA, 16 bp, Homo sapiens
tctaactcctgggctc

SEQ ID NO: 4235810 - DNA, 12 bp, Homo sapiens
tctaacttaaat

SEQ ID NO: 4235811 - DNA, 18 bp, Homo sapiens
tctaacttaaatagcttt

SEQ ID NO: 4235812 - DNA, 15 bp, Homo sapiens
tctaattaaatggca

SEQ ID NO: 4235813 - DNA, 13 bp, Homo sapiens
tctataaaataaa

SEQ ID NO: 4235814 - DNA, 17 bp, Homo sapiens
tctataaaataaacttc

SEQ ID NO: 4235815 - DNA, 16 bp, Homo sapiens
tctcctaaaggtgagg

SEQ ID NO: 4235816 - DNA, 17 bp, Homo sapiens
tctcttgaggcctgtgc

SEQ ID NO: 4235817 - DNA, 24 bp, Homo sapiens
tctgaatattagatgctctgagaa

SEQ ID NO: 4235818 - DNA, 18 bp, Homo sapiens
tctgacactttctgctgg

SEQ ID NO: 4235819 - DNA, 13 bp, Homo sapiens
tctgagaaattga

SEQ ID NO: 4235820 - DNA, 13 bp, Homo sapiens
tctgcccagggag

SEQ ID NO: 4235821 - DNA, 15 bp, Homo sapiens
tctgctgtggtctat

SEQ ID NO: 4235822 - DNA, 18 bp, Homo sapiens
tctgctgtggtctataaa

SEQ ID NO: 4235823 - DNA, 22 bp, Homo sapiens
tctgctgtggtctataaaataa

SEQ ID NO: 4235824 - DNA, 23 bp, Homo sapiens
tctggcccaggctagagtgcagt

SEQ ID NO: 4235825 - DNA, 13 bp, Homo sapiens
tctgtaaaagtta

SEQ ID NO: 4235826 - DNA, 21 bp, Homo sapiens
tctgtaaaagttactaatata

SEQ ID NO: 4235827 - DNA, 18 bp, Homo sapiens
tctgtataagctgtaata

SEQ ID NO: 4235828 - DNA, 13 bp, Homo sapiens
tcttcaccactgt

SEQ ID NO: 4235829 - DNA, 16 bp, Homo sapiens
tcttgaggcctgtgct

SEQ ID NO: 4235830 - DNA, 22 bp, Homo sapiens
tctttttttggcaacctggctc

SEQ ID NO: 4235831 - DNA, 15 bp, Homo sapiens
tgaaagagaaaatat

SEQ ID NO: 4235832 - DNA, 16 bp, Homo sapiens
tgaaatataaattatc

SEQ ID NO: 4235833 - DNA, 17 bp, Homo sapiens
tgaaatataaattatct

SEQ ID NO: 4235834 - DNA, 18 bp, Homo sapiens
tgaaatataaattatctg

SEQ ID NO: 4235835 - DNA, 22 bp, Homo sapiens
tgaaatataaattatctgaata

SEQ ID NO: 4235836 - DNA, 13 bp, Homo sapiens
tgaatattagatg

SEQ ID NO: 4235837 - DNA, 21 bp, Homo sapiens
tgacaaatgaaagagaaaata

SEQ ID NO: 4235838 - DNA, 23 bp, Homo sapiens
tgacactttctgctggaagctgt

SEQ ID NO: 4235839 - DNA, 11 bp, Homo sapiens
aaaagaaacta

SEQ ID NO: 4235840 - DNA, 23 bp, Homo sapiens
aaaagttactaatatatctgtaa

SEQ ID NO: 4235841 - DNA, 13 bp, Homo sapiens
aaaatgcattatt

SEQ ID NO: 4235842 - DNA, 13 bp, Homo sapiens
aaaattatattct

SEQ ID NO: 4235843 - DNA, 22 bp, Homo sapiens
aaacggtatgacttaattttag

SEQ ID NO: 4235844 - DNA, 11 bp, Homo sapiens
aaactgtttct

SEQ ID NO: 4235845 - DNA, 22 bp, Homo sapiens
aaactgtttctcaggcacttga

SEQ ID NO: 4235846 - DNA, 16 bp, Homo sapiens
aaacttggctggaatt

SEQ ID NO: 4235847 - DNA, 15 bp, Homo sapiens
aaagaaaattatatt

SEQ ID NO: 4235848 - DNA, 17 bp, Homo sapiens
aaagaaaattatattct

SEQ ID NO: 4235849 - DNA, 22 bp, Homo sapiens
aaagaaactatgatgtggagaa

SEQ ID NO: 4235850 - DNA, 18 bp, Homo sapiens
aaagagaaaatatatatt

SEQ ID NO: 4235851 - DNA, 21 bp, Homo sapiens
aaagattttatggttttataa

SEQ ID NO: 4235852 - DNA, 14 bp, Homo sapiens
aaagtttgtagcat

SEQ ID NO: 4235853 - DNA, 17 bp, Homo sapiens
aaagtttgtagcatttt

SEQ ID NO: 4235854 - DNA, 19 bp, Homo sapiens
aaagtttgtagcatttttc

SEQ ID NO: 4235855 - DNA, 17 bp, Homo sapiens
aaagttttcaaattatt

SEQ ID NO: 4235856 - DNA, 14 bp, Homo sapiens
aaataaacttctta

SEQ ID NO: 4235857 - DNA, 21 bp, Homo sapiens
aaataaacttcttaacatgct

SEQ ID NO: 4235858 - DNA, 23 bp, Homo sapiens
aaatagctttgagatttcagcta

SEQ ID NO: 4235859 - DNA, 12 bp, Homo sapiens
aaatgacattat

SEQ ID NO: 4235860 - DNA, 13 bp, Homo sapiens
aaatgacattatt

SEQ ID NO: 4235861 - DNA, 21 bp, Homo sapiens
aaatggttaatccaactgtca

SEQ ID NO: 4235862 - DNA, 13 bp, Homo sapiens
aaattatattctg

SEQ ID NO: 4235863 - DNA, 23 bp, Homo sapiens
aaattatattctgtttattatga

SEQ ID NO: 4235864 - DNA, 20 bp, Homo sapiens
aaattatctgaatattagat

SEQ ID NO: 4235865 - DNA, 18 bp, Homo sapiens
aacaatgccagggcccag

SEQ ID NO: 4235866 - DNA, 14 bp, Homo sapiens
aacactattacagt

SEQ ID NO: 4235867 - DNA, 19 bp, Homo sapiens
aacatatgaaatataaatt

SEQ ID NO: 4235868 - DNA, 19 bp, Homo sapiens
aacatctcctccaataaac

SEQ ID NO: 4235869 - DNA, 15 bp, Homo sapiens
aacctggctctggcc

SEQ ID NO: 4235870 - DNA, 19 bp, Homo sapiens
aactatataaatgacatta

SEQ ID NO: 4235871 - DNA, 13 bp, Homo sapiens
aactgtttctcag

SEQ ID NO: 4235872 - DNA, 19 bp, Homo sapiens
aagaaacttggctggaatt

SEQ ID NO: 4235873 - DNA, 14 bp, Homo sapiens
aagagaaaatatat

SEQ ID NO: 4235874 - DNA, 22 bp, Homo sapiens
aagccatatttttttctgtaaa

SEQ ID NO: 4235875 - DNA, 17 bp, Homo sapiens
aagctgtcaggctggga

SEQ ID NO: 4235876 - DNA, 20 bp, Homo sapiens
aagctgtcaggctgggacag

SEQ ID NO: 4235877 - DNA, 20 bp, Homo sapiens
aaggctcacgaagggcatcc

SEQ ID NO: 4235878 - DNA, 14 bp, Homo sapiens
aataaacttcttaa

SEQ ID NO: 4235879 - DNA, 20 bp, Homo sapiens
aataggtactgccatatttt

SEQ ID NO: 4235880 - DNA, 14 bp, Homo sapiens
aatataaattatct

SEQ ID NO: 4235881 - DNA, 16 bp, Homo sapiens
aatataaattatctga

SEQ ID NO: 4235882 - DNA, 23 bp, Homo sapiens
aatatatatttttaatggaaagt

SEQ ID NO: 4235883 - DNA, 13 bp, Homo sapiens
aatatatctgtaa

SEQ ID NO: 4235884 - DNA, 18 bp, Homo sapiens
aatatcattttatagaaa

SEQ ID NO: 4235885 - DNA, 21 bp, Homo sapiens
aatatcattttatagaaaatg

SEQ ID NO: 4235886 - DNA, 23 bp, Homo sapiens
aatatcattttatagaaaatgca

SEQ ID NO: 4235887 - DNA, 13 bp, Homo sapiens
aatattagatgct

SEQ ID NO: 4235888 - DNA, 21 bp, Homo sapiens
aatattagatgctctgagaaa

SEQ ID NO: 4235889 - DNA, 15 bp, Homo sapiens
aatgaaagagaaaat

SEQ ID NO: 4235890 - DNA, 15 bp, Homo sapiens
aatgacattattaaa

SEQ ID NO: 4235891 - DNA, 18 bp, Homo sapiens
aatgacattattaaagtt

SEQ ID NO: 4235892 - DNA, 14 bp, Homo sapiens
aatgcattatttag

SEQ ID NO: 4235893 - DNA, 13 bp, Homo sapiens
aatgccagggccc

SEQ ID NO: 4235894 - DNA, 20 bp, Homo sapiens
aatggttaatccaactgtca

SEQ ID NO: 4235895 - DNA, 23 bp, Homo sapiens
aatgtaccttatttaaaagattt

SEQ ID NO: 4235896 - DNA, 13 bp, Homo sapiens
aattatctgaata

SEQ ID NO: 4235897 - DNA, 13 bp, Homo sapiens
aattcaactggaa

SEQ ID NO: 4235898 - DNA, 16 bp, Homo sapiens
aattcaactggaaatt

SEQ ID NO: 4235899 - DNA, 21 bp, Homo sapiens
aattgaatgtaccttatttaa

SEQ ID NO: 4235900 - DNA, 22 bp, Homo sapiens
aattgaatgtaccttatttaaa

SEQ ID NO: 4235901 - DNA, 20 bp, Homo sapiens
aattgtttaatgttggaaaa

SEQ ID NO: 4235902 - DNA, 19 bp, Homo sapiens
aatttctgctgtggtctat

SEQ ID NO: 4235903 - DNA, 22 bp, Homo sapiens
aatttctgctgtggtctataaa

SEQ ID NO: 4235904 - DNA, 14 bp, Homo sapiens
aattttagaaagaa

SEQ ID NO: 4235905 - DNA, 18 bp, Homo sapiens
aattttagaaagaaaatt

SEQ ID NO: 4235906 - DNA, 21 bp, Homo sapiens
aattttagaaagaaaattata

SEQ ID NO: 4235907 - DNA, 23 bp, Homo sapiens
aattttagaaagaaaattatatt

SEQ ID NO: 4235908 - DNA, 15 bp, Homo sapiens
aattttatctgtata

SEQ ID NO: 4235909 - DNA, 19 bp, Homo sapiens
acaaatgaaagagaaaata

SEQ ID NO: 4235910 - DNA, 20 bp, Homo sapiens
acaaatgaaagagaaaatat

SEQ ID NO: 4235911 - DNA, 21 bp, Homo sapiens
acaaatgaaagagaaaatata

SEQ ID NO: 4235912 - DNA, 12 bp, Homo sapiens
acaatgccaggg

SEQ ID NO: 4235913 - DNA, 24 bp, Homo sapiens
acacatcatcatcgaagtcttccc

SEQ ID NO: 4235914 - DNA, 19 bp, Homo sapiens
acacccaggtgatttcctc

SEQ ID NO: 4235915 - DNA, 14 bp, Homo sapiens
acactattacagta

SEQ ID NO: 4235916 - DNA, 16 bp, Homo sapiens
acactattacagtatt

SEQ ID NO: 4235917 - DNA, 14 bp, Homo sapiens
acactttctgctgg

SEQ ID NO: 4235918 - DNA, 23 bp, Homo sapiens
acagcggcagtgggcctgctgag

SEQ ID NO: 4235919 - DNA, 13 bp, Homo sapiens
acagggcttgtcc

SEQ ID NO: 4235920 - DNA, 14 bp, Homo sapiens
acagtattgctatt

SEQ ID NO: 4235921 - DNA, 18 bp, Homo sapiens
acatatgaaatataaatt

SEQ ID NO: 4235922 - DNA, 18 bp, Homo sapiens
acattattaaagttttca

SEQ ID NO: 4235923 - DNA, 15 bp, Homo sapiens
accagctggcctggg

SEQ ID NO: 4235924 - DNA, 21 bp, Homo sapiens
accaggggcccaccctctgcc

SEQ ID NO: 4235925 - DNA, 17 bp, Homo sapiens
acccaggtgatttcctc

SEQ ID NO: 4235926 - DNA, 18 bp, Homo sapiens
accctctgcccagggagt

SEQ ID NO: 4235927 - DNA, 18 bp, Homo sapiens
accgcctgccctgcctgg

SEQ ID NO: 4235928 - DNA, 15 bp, Homo sapiens
acctgccagtcccag

SEQ ID NO: 4235929 - DNA, 17 bp, Homo sapiens
accttatttaaaagatt

SEQ ID NO: 4235930 - DNA, 22 bp, Homo sapiens
attactgcttgcagtaattcaa

SEQ ID NO: 4235931 - DNA, 18 bp, Homo sapiens
attagatgctctgagaaa

SEQ ID NO: 4235932 - DNA, 20 bp, Homo sapiens
attagatgctctgagaaatt

SEQ ID NO: 4235933 - DNA, 12 bp, Homo sapiens
attatattctgt

SEQ ID NO: 4235934 - DNA, 16 bp, Homo sapiens
attatattctgtttat

SEQ ID NO: 4235935 - DNA, 16 bp, Homo sapiens
attatcatcctataaa

SEQ ID NO: 4235936 - DNA, 22 bp, Homo sapiens
attatcatcctataaagaaacg

SEQ ID NO: 4235937 - DNA, 20 bp, Homo sapiens
attatgacaaatgaaagaga

SEQ ID NO: 4235938 - DNA, 21 bp, Homo sapiens
attatgacaaatgaaagagaa

SEQ ID NO: 4235939 - DNA, 14 bp, Homo sapiens
attattaaagtttt

SEQ ID NO: 4235940 - DNA, 14 bp, Homo sapiens
attcaactggaaat

SEQ ID NO: 4235941 - DNA, 18 bp, Homo sapiens
attcaactggaaattaaa

SEQ ID NO: 4235942 - DNA, 23 bp, Homo sapiens
attcattcagatataagatttgt

SEQ ID NO: 4235943 - DNA, 12 bp, Homo sapiens
attctctgccca

SEQ ID NO: 4235944 - DNA, 13 bp, Homo sapiens
attctgtttatta

SEQ ID NO: 4235945 - DNA, 20 bp, Homo sapiens
attgaatgtaccttatttaa

SEQ ID NO: 4235946 - DNA, 14 bp, Homo sapiens
attgctatttatat

SEQ ID NO: 4235947 - DNA, 19 bp, Homo sapiens
attgtgccttactaaatat

SEQ ID NO: 4235948 - DNA, 22 bp, Homo sapiens
atttagggcagcaaaacaagtg

SEQ ID NO: 4235949 - DNA, 17 bp, Homo sapiens
atttcctctaaagaaac

SEQ ID NO: 4235950 - DNA, 21 bp, Homo sapiens
atttctgctgtggtctataaa

SEQ ID NO: 4235951 - DNA, 21 bp, Homo sapiens
atttgtggcactatgacagct

SEQ ID NO: 4235952 - DNA, 13 bp, Homo sapiens
attttagaaagaa

SEQ ID NO: 4235953 - DNA, 15 bp, Homo sapiens
attttatctgtataa

SEQ ID NO: 4235954 - DNA, 18 bp, Homo sapiens
attttatggttttataac

SEQ ID NO: 4235955 - DNA, 19 bp, Homo sapiens
attttatggttttataact

SEQ ID NO: 4235956 - DNA, 16 bp, Homo sapiens
atttttataattttat

SEQ ID NO: 4235957 - DNA, 20 bp, Homo sapiens
atttttataattttatctgt

SEQ ID NO: 4235958 - DNA, 21 bp, Homo sapiens
atttttataattttatctgta

SEQ ID NO: 4235959 - DNA, 18 bp, Homo sapiens
caaaccatcagctgcttt

SEQ ID NO: 4235960 - DNA, 20 bp, Homo sapiens
caaagcaaataaatgccttc

SEQ ID NO: 4235961 - DNA, 14 bp, Homo sapiens
caaatgaaagagaa

SEQ ID NO: 4235962 - DNA, 15 bp, Homo sapiens
caacctggctctggc

SEQ ID NO: 4235963 - DNA, 13 bp, Homo sapiens
caaggcctctcag

SEQ ID NO: 4235964 - DNA, 14 bp, Homo sapiens
caaggcctctcaga

SEQ ID NO: 4235965 - DNA, 19 bp, Homo sapiens
caaggcctctcagacccag

SEQ ID NO: 4235966 - DNA, 16 bp, Homo sapiens
caatgccagggcccag

SEQ ID NO: 4235967 - DNA, 18 bp, Homo sapiens
caatgccagggcccagga

SEQ ID NO: 4235968 - DNA, 19 bp, Homo sapiens
cacccaggtgatttcctct

SEQ ID NO: 4235969 - DNA, 21 bp, Homo sapiens
cacccggcattctctgcccac

SEQ ID NO: 4235970 - DNA, 16 bp, Homo sapiens
caccctctgcccaggg

SEQ ID NO: 4235971 - DNA, 13 bp, Homo sapiens
caccgcagcctct

SEQ ID NO: 4235972 - DNA, 15 bp, Homo sapiens
cactattacagtatt

SEQ ID NO: 4235973 - DNA, 15 bp, Homo sapiens
cagatataagatttg

SEQ ID NO: 4235974 - DNA, 18 bp, Homo sapiens
cagcagggctgggcctgc

SEQ ID NO: 4235975 - DNA, 21 bp, Homo sapiens
cagcagtaatttgtggcacta

SEQ ID NO: 4235976 - DNA, 17 bp, Homo sapiens
cagcctgtccctgaaag

SEQ ID NO: 4235977 - DNA, 19 bp, Homo sapiens
cagcctgtccctgaaagag

SEQ ID NO: 4235978 - DNA, 17 bp, Homo sapiens
cagcggcagtgggcctg

SEQ ID NO: 4235979 - DNA, 20 bp, Homo sapiens
cagcggcagtgggcctgctg

SEQ ID NO: 4235980 - DNA, 20 bp, Homo sapiens
cagctccccggcactgcagt

SEQ ID NO: 4235981 - DNA, 12 bp, Homo sapiens
cagctgcaggcc

SEQ ID NO: 4235982 - DNA, 14 bp, Homo sapiens
cagctggcctgggg

SEQ ID NO: 4235983 - DNA, 15 bp, Homo sapiens
cagctggcctggggt

SEQ ID NO: 4235984 - DNA, 14 bp, Homo sapiens
caggcaggctgggg

SEQ ID NO: 4235985 - DNA, 16 bp, Homo sapiens
caggctggggaggcca

SEQ ID NO: 4235986 - DNA, 13 bp, Homo sapiens
cagggagtccttg

SEQ ID NO: 4235987 - DNA, 14 bp, Homo sapiens
cagggctgggcctg

SEQ ID NO: 4235988 - DNA, 22 bp, Homo sapiens
caggggcccaccctctgcccag

SEQ ID NO: 4235989 - DNA, 15 bp, Homo sapiens
caggggctgctgcct

SEQ ID NO: 4235990 - DNA, 22 bp, Homo sapiens
caggtgatttcctctaaagaaa

SEQ ID NO: 4235991 - DNA, 23 bp, Homo sapiens
cagtaattcaactggaaattaaa

SEQ ID NO: 4235992 - DNA, 18 bp, Homo sapiens
cagtgatatctttctcat

SEQ ID NO: 4235993 - DNA, 19 bp, Homo sapiens
cagtgttgtgggcttcctg

SEQ ID NO: 4235994 - DNA, 18 bp, Homo sapiens
catagctccttcccagga

SEQ ID NO: 4235995 - DNA, 14 bp, Homo sapiens
catatgaaatataa

SEQ ID NO: 4235996 - DNA, 22 bp, Homo sapiens
catattatcatcctataaagaa

SEQ ID NO: 4235997 - DNA, 23 bp, Homo sapiens
catattatcatcctataaagaaa

SEQ ID NO: 4235998 - DNA, 17 bp, Homo sapiens
catatttttttctgtaa

SEQ ID NO: 4235999 - DNA, 14 bp, Homo sapiens
cattattaaagttt

SEQ ID NO: 4236000 - DNA, 20 bp, Homo sapiens
cattatttagtcaattgttt

SEQ ID NO: 4236001 - DNA, 23 bp, Homo sapiens
cattcagatataagatttgtaca

SEQ ID NO: 4236002 - DNA, 13 bp, Homo sapiens
cattctctgccca

SEQ ID NO: 4236003 - DNA, 15 bp, Homo sapiens
cattgtgccttacta

SEQ ID NO: 4236004 - DNA, 17 bp, Homo sapiens
ccaaaccatcagctgct

SEQ ID NO: 4236005 - DNA, 16 bp, Homo sapiens
ccaaggctcactgcag

SEQ ID NO: 4236006 - DNA, 18 bp, Homo sapiens
ccaaggctcactgcagcg

SEQ ID NO: 4236007 - DNA, 19 bp, Homo sapiens
ccaaggctcactgcagcgc

SEQ ID NO: 4236008 - DNA, 12 bp, Homo sapiens
ccaccctctgcc

SEQ ID NO: 4236009 - DNA, 22 bp, Homo sapiens
ccacttttgcccacctcttctg

SEQ ID NO: 4236010 - DNA, 15 bp, Homo sapiens
ccagcctcggcctcc

SEQ ID NO: 4236011 - DNA, 18 bp, Homo sapiens
ccaggggcccaccctctg

SEQ ID NO: 4236012 - DNA, 22 bp, Homo sapiens
ccaggtgatttcctctaaagaa

SEQ ID NO: 4236013 - DNA, 14 bp, Homo sapiens
ccatatttttttct

SEQ ID NO: 4236014 - DNA, 15 bp, Homo sapiens
ccatgaggtcttccc

SEQ ID NO: 4236015 - DNA, 20 bp, Homo sapiens
ccatttagaggatgtggctg

SEQ ID NO: 4236016 - DNA, 13 bp, Homo sapiens
cccaccctctgcc

SEQ ID NO: 4236017 - DNA, 19 bp, Homo sapiens
cccagctaaagcagtcctc

SEQ ID NO: 4236018 - DNA, 17 bp, Homo sapiens
cccaggacccctcagct

SEQ ID NO: 4236019 - DNA, 19 bp, Homo sapiens
cccaggaggaccgcctgcc

SEQ ID NO: 4236020 - DNA, 20 bp, Homo sapiens
cccaggaggaccgcctgccc

SEQ ID NO: 4236021 - DNA, 23 bp, Homo sapiens
cccaggaggaccgcctgccctgc

SEQ ID NO: 4236022 - DNA, 19 bp, Homo sapiens
cccaggctagagtgcagtg

SEQ ID NO: 4236023 - DNA, 22 bp, Homo sapiens
cccagggagtccttgcgtccca

SEQ ID NO: 4236024 - DNA, 22 bp, Homo sapiens
cccagggatcgatcggtacagt

SEQ ID NO: 4236025 - DNA, 22 bp, Homo sapiens
cccgcaaggcctctcagaccca

SEQ ID NO: 4236026 - DNA, 20 bp, Homo sapiens
ccctcagctccccggcactg

SEQ ID NO: 4236027 - DNA, 16 bp, Homo sapiens
ccctccctgcaggggc

SEQ ID NO: 4236028 - DNA, 17 bp, Homo sapiens
ccctctgcccagggagt

SEQ ID NO: 4236029 - DNA, 23 bp, Homo sapiens
ccctgaaagagaagatggccatg

SEQ ID NO: 4236030 - DNA, 18 bp, Homo sapiens
ccctgcagcggtggttgt

SEQ ID NO: 4236031 - DNA, 15 bp, Homo sapiens
ccctgccactcctca

SEQ ID NO: 4236032 - DNA, 20 bp, Homo sapiens
ccctgcctgggccttggctg

SEQ ID NO: 4236033 - DNA, 14 bp, Homo sapiens
cccttgcttagcct

SEQ ID NO: 4236034 - DNA, 14 bp, Homo sapiens
ccgcctgccctgcc

SEQ ID NO: 4236035 - DNA, 13 bp, Homo sapiens
ccggcattctctg

SEQ ID NO: 4236036 - DNA, 16 bp, Homo sapiens
ccggcattctctgccc

SEQ ID NO: 4236037 - DNA, 20 bp, Homo sapiens
cctaggtgttgtcagcaggc

SEQ ID NO: 4236038 - DNA, 12 bp, Homo sapiens
cctccagcctcg

SEQ ID NO: 4236039 - DNA, 13 bp, Homo sapiens
cctccaggaccag

SEQ ID NO: 4236040 - DNA, 15 bp, Homo sapiens
cctctaaagaaactt

SEQ ID NO: 4236041 - DNA, 15 bp, Homo sapiens
cctctaactcctggg

SEQ ID NO: 4236042 - DNA, 13 bp, Homo sapiens
cctctgcccaggg

SEQ ID NO: 4236043 - DNA, 15 bp, Homo sapiens
cctctgcccagggag

SEQ ID NO: 4236044 - DNA, 20 bp, Homo sapiens
cctgaaagagaagatggcca

SEQ ID NO: 4236045 - DNA, 16 bp, Homo sapiens
cctgacccctccctgc

SEQ ID NO: 4236046 - DNA, 23 bp, Homo sapiens
cctgacccctccctgcaggggct

SEQ ID NO: 4236047 - DNA, 13 bp, Homo sapiens
cctgccagtccca

SEQ ID NO: 4236048 - DNA, 17 bp, Homo sapiens
cctgcctgggccttggc

SEQ ID NO: 4236049 - DNA, 16 bp, Homo sapiens
cctgctgaggccttct

SEQ ID NO: 4236050 - DNA, 17 bp, Homo sapiens
cctgctgaggccttctc

SEQ ID NO: 4236051 - DNA, 18 bp, Homo sapiens
cctgctgaggccttctct

SEQ ID NO: 4236052 - DNA, 19 bp, Homo sapiens
accttatttaaaagatttt

SEQ ID NO: 4236053 - DNA, 20 bp, Homo sapiens
acggtatgacttaattttag

SEQ ID NO: 4236054 - DNA, 15 bp, Homo sapiens
acgttagcagcccag

SEQ ID NO: 4236055 - DNA, 13 bp, Homo sapiens
actaaaagaaact

SEQ ID NO: 4236056 - DNA, 17 bp, Homo sapiens
actaatatatctgtaac

SEQ ID NO: 4236057 - DNA, 23 bp, Homo sapiens
actccattgtgccttactaaata

SEQ ID NO: 4236058 - DNA, 15 bp, Homo sapiens
actgagaaggctcac

SEQ ID NO: 4236059 - DNA, 18 bp, Homo sapiens
actgagagctgcctcctg

SEQ ID NO: 4236060 - DNA, 18 bp, Homo sapiens
actgcagcgcgctcctga

SEQ ID NO: 4236061 - DNA, 17 bp, Homo sapiens
acttaattttagaaaga

SEQ ID NO: 4236062 - DNA, 22 bp, Homo sapiens
acttaattttagaaagaaaatt

SEQ ID NO: 4236063 - DNA, 20 bp, Homo sapiens
acttcagggaaggtgaaaca

SEQ ID NO: 4236064 - DNA, 16 bp, Homo sapiens
acttttcttgatatct

SEQ ID NO: 4236065 - DNA, 18 bp, Homo sapiens
agaaaatgcattatttag

SEQ ID NO: 4236066 - DNA, 13 bp, Homo sapiens
agaaaattatatt

SEQ ID NO: 4236067 - DNA, 21 bp, Homo sapiens
agaaacggtatgacttaattt

SEQ ID NO: 4236068 - DNA, 22 bp, Homo sapiens
agaaactatgatgtggagaaag

SEQ ID NO: 4236069 - DNA, 14 bp, Homo sapiens
agaaagccatattt

SEQ ID NO: 4236070 - DNA, 18 bp, Homo sapiens
agaaaggactaacatctc

SEQ ID NO: 4236071 - DNA, 18 bp, Homo sapiens
agaaattgaatgtacctt

SEQ ID NO: 4236072 - DNA, 15 bp, Homo sapiens
agacccaaggctcac

SEQ ID NO: 4236073 - DNA, 18 bp, Homo sapiens
agaccttggctgctcact

SEQ ID NO: 4236074 - DNA, 16 bp, Homo sapiens
agagaaaatatatatt

SEQ ID NO: 4236075 - DNA, 21 bp, Homo sapiens
agagtatctttaaaagtgcct

SEQ ID NO: 4236076 - DNA, 21 bp, Homo sapiens
agagttctcctggaggcaggg

SEQ ID NO: 4236077 - DNA, 18 bp, Homo sapiens
agataaagtaagcctagg

SEQ ID NO: 4236078 - DNA, 16 bp, Homo sapiens
agatgctctgagaaat

SEQ ID NO: 4236079 - DNA, 16 bp, Homo sapiens
agatgtctcccctgcc

SEQ ID NO: 4236080 - DNA, 23 bp, Homo sapiens
agatgtgacggggtgtgtggccc

SEQ ID NO: 4236081 - DNA, 14 bp, Homo sapiens
agatttgtacatat

SEQ ID NO: 4236082 - DNA, 22 bp, Homo sapiens
agcaaataaatgccttccacct

SEQ ID NO: 4236083 - DNA, 14 bp, Homo sapiens
agcagggctgggcc

SEQ ID NO: 4236084 - DNA, 19 bp, Homo sapiens
agcagtaatttgtggcact

SEQ ID NO: 4236085 - DNA, 21 bp, Homo sapiens
agccatatttttttctgtaaa

SEQ ID NO: 4236086 - DNA, 16 bp, Homo sapiens
agcctggtctcaaact

SEQ ID NO: 4236087 - DNA, 21 bp, Homo sapiens
agcctggtctcaaactcccca

SEQ ID NO: 4236088 - DNA, 20 bp, Homo sapiens
agcggcagtgggcctgctga

SEQ ID NO: 4236089 - DNA, 21 bp, Homo sapiens
agcggcagtgggcctgctgag

SEQ ID NO: 4236090 - DNA, 23 bp, Homo sapiens
agctaaagcagtcctccagcctc

SEQ ID NO: 4236091 - DNA, 14 bp, Homo sapiens
agctgtaatatcat

SEQ ID NO: 4236092 - DNA, 17 bp, Homo sapiens
agctttgagatttcagc

SEQ ID NO: 4236093 - DNA, 17 bp, Homo sapiens
aggacccctcagctccc

SEQ ID NO: 4236094 - DNA, 20 bp, Homo sapiens
aggcaggctggggaggccag

SEQ ID NO: 4236095 - DNA, 15 bp, Homo sapiens
aggcaggggctgctg

SEQ ID NO: 4236096 - DNA, 22 bp, Homo sapiens
aggccagtgttgtgggcttcct

SEQ ID NO: 4236097 - DNA, 17 bp, Homo sapiens
aggcctctcagacccag

SEQ ID NO: 4236098 - DNA, 22 bp, Homo sapiens
aggccttctcttgaggcctgtg

SEQ ID NO: 4236099 - DNA, 16 bp, Homo sapiens
aggctcacgaagggca

SEQ ID NO: 4236100 - DNA, 14 bp, Homo sapiens
aggctcactgcagc

SEQ ID NO: 4236101 - DNA, 15 bp, Homo sapiens
aggcttttattagaa

SEQ ID NO: 4236102 - DNA, 17 bp, Homo sapiens
aggcttttattagaaag

SEQ ID NO: 4236103 - DNA, 13 bp, Homo sapiens
agggctgggcctg

SEQ ID NO: 4236104 - DNA, 18 bp, Homo sapiens
agggtactaaaagaaact

SEQ ID NO: 4236105 - DNA, 20 bp, Homo sapiens
aggtactgccatatttttct

SEQ ID NO: 4236106 - DNA, 21 bp, Homo sapiens
aggtcttcccgcaaggcctct

SEQ ID NO: 4236107 - DNA, 22 bp, Homo sapiens
aggtcttcccgcaaggcctctc

SEQ ID NO: 4236108 - DNA, 18 bp, Homo sapiens
aggtgttgtcagcaggca

SEQ ID NO: 4236109 - DNA, 20 bp, Homo sapiens
agtattgctatttatattca

SEQ ID NO: 4236110 - DNA, 14 bp, Homo sapiens
agtatttttataat

SEQ ID NO: 4236111 - DNA, 19 bp, Homo sapiens
agtatttttataattttat

SEQ ID NO: 4236112 - DNA, 19 bp, Homo sapiens
agtcaattgtttaatgttg

SEQ ID NO: 4236113 - DNA, 16 bp, Homo sapiens
agtgatatctttctca

SEQ ID NO: 4236114 - DNA, 18 bp, Homo sapiens
agtgatatctttctcatt

SEQ ID NO: 4236115 - DNA, 21 bp, Homo sapiens
agtgatatctttctcattacc

SEQ ID NO: 4236116 - DNA, 14 bp, Homo sapiens
agtgccttagggga

SEQ ID NO: 4236117 - DNA, 18 bp, Homo sapiens
agtgggcctgctgaggcc

SEQ ID NO: 4236118 - DNA, 17 bp, Homo sapiens
agtgttgtgggcttcct

SEQ ID NO: 4236119 - DNA, 21 bp, Homo sapiens
agttctcctggaggcaggggc

SEQ ID NO: 4236120 - DNA, 15 bp, Homo sapiens
agtttctctgccttc

SEQ ID NO: 4236121 - DNA, 16 bp, Homo sapiens
agtttgtagcattttt

SEQ ID NO: 4236122 - DNA, 13 bp, Homo sapiens
ataaaataaactt

SEQ ID NO: 4236123 - DNA, 17 bp, Homo sapiens
ataaaataaacttctta

SEQ ID NO: 4236124 - DNA, 11 bp, Homo sapiens
ataaacttctt

SEQ ID NO: 4236125 - DNA, 15 bp, Homo sapiens
ataaattatctgaat

SEQ ID NO: 4236126 - DNA, 19 bp, Homo sapiens
ataaattatctgaatatta

SEQ ID NO: 4236127 - DNA, 20 bp, Homo sapiens
ataagctgtaatatcatttt

SEQ ID NO: 4236128 - DNA, 14 bp, Homo sapiens
ataattttatctgt

SEQ ID NO: 4236129 - DNA, 19 bp, Homo sapiens
ataattttatctgtataag

SEQ ID NO: 4236130 - DNA, 19 bp, Homo sapiens
atagaaaatgcattattta

SEQ ID NO: 4236131 - DNA, 20 bp, Homo sapiens
atagttgtgttaagcttgcg

SEQ ID NO: 4236132 - DNA, 16 bp, Homo sapiens
atataaattatctgaa

SEQ ID NO: 4236133 - DNA, 15 bp, Homo sapiens
atatatatttttaat

SEQ ID NO: 4236134 - DNA, 20 bp, Homo sapiens
atatatctgtaacactatta

SEQ ID NO: 4236135 - DNA, 22 bp, Homo sapiens
atatatctgtaacactattaca

SEQ ID NO: 4236136 - DNA, 13 bp, Homo sapiens
atatcattttata

SEQ ID NO: 4236137 - DNA, 20 bp, Homo sapiens
atatcattttatagaaaatg

SEQ ID NO: 4236138 - DNA, 11 bp, Homo sapiens
atatctgtaac

SEQ ID NO: 4236139 - DNA, 17 bp, Homo sapiens
atatctgtaacactatt

SEQ ID NO: 4236140 - DNA, 18 bp, Homo sapiens
atatctgtaacactatta

SEQ ID NO: 4236141 - DNA, 23 bp, Homo sapiens
atatctgtaacactattacagta

SEQ ID NO: 4236142 - DNA, 15 bp, Homo sapiens
atatctttctcatta

SEQ ID NO: 4236143 - DNA, 17 bp, Homo sapiens
atatgaaatataaatta

SEQ ID NO: 4236144 - DNA, 19 bp, Homo sapiens
atatgaaatataaattatc

SEQ ID NO: 4236145 - DNA, 22 bp, Homo sapiens
atatgggaatgtctaacttaaa

SEQ ID NO: 4236146 - DNA, 20 bp, Homo sapiens
atattagatgctctgagaaa

SEQ ID NO: 4236147 - DNA, 13 bp, Homo sapiens
atattcattcaga

SEQ ID NO: 4236148 - DNA, 14 bp, Homo sapiens
atatttttctgtgt

SEQ ID NO: 4236149 - DNA, 21 bp, Homo sapiens
atatttttctgtgtggagtat

SEQ ID NO: 4236150 - DNA, 15 bp, Homo sapiens
atatttttttctgta

SEQ ID NO: 4236151 - DNA, 16 bp, Homo sapiens
atcattttatagaaaa

SEQ ID NO: 4236152 - DNA, 17 bp, Homo sapiens
atcattttatagaaaat

SEQ ID NO: 4236153 - DNA, 15 bp, Homo sapiens
atcctataaagaaac

SEQ ID NO: 4236154 - DNA, 15 bp, Homo sapiens
atctgaatattagat

SEQ ID NO: 4236155 - DNA, 15 bp, Homo sapiens
atctgtaacactatt

SEQ ID NO: 4236156 - DNA, 18 bp, Homo sapiens
atctgtaacactattaca

SEQ ID NO: 4236157 - DNA, 11 bp, Homo sapiens
atctttctcat

SEQ ID NO: 4236158 - DNA, 20 bp, Homo sapiens
atgaaatataaattatctga

SEQ ID NO: 4236159 - DNA, 15 bp, Homo sapiens
atgacaaatgaaaga

SEQ ID NO: 4236160 - DNA, 19 bp, Homo sapiens
atgacttaattttagaaag

SEQ ID NO: 4236161 - DNA, 23 bp, Homo sapiens
atgacttaattttagaaagaaaa

SEQ ID NO: 4236162 - DNA, 20 bp, Homo sapiens
atgagtaaactgtttctcag

SEQ ID NO: 4236163 - DNA, 12 bp, Homo sapiens
atgctctgagaa

SEQ ID NO: 4236164 - DNA, 20 bp, Homo sapiens
atggccattgagctgtttcc

SEQ ID NO: 4236165 - DNA, 21 bp, Homo sapiens
atggctttcactttctctttt

SEQ ID NO: 4236166 - DNA, 23 bp, Homo sapiens
atgggaatgtctaacttaaatag

SEQ ID NO: 4236167 - DNA, 16 bp, Homo sapiens
atgtaaaggttttctc

SEQ ID NO: 4236168 - DNA, 23 bp, Homo sapiens
atgtctaacttaaatagctttga

SEQ ID NO: 4236169 - DNA, 18 bp, Homo sapiens
atgtggctgtaacctgct

SEQ ID NO: 4236170 - DNA, 20 bp, Homo sapiens
atgttggaaaacatatgaaa

SEQ ID NO: 4236171 - DNA, 19 bp, Homo sapiens
attaaagttttcaaattat

SEQ ID NO: 4236172 - DNA, 15 bp, Homo sapiens
attaataacctgcca

SEQ ID NO: 4236173 - DNA, 12 bp, Homo sapiens
attacagtattg

SEQ ID NO: 4236174 - DNA, 16 bp, Homo sapiens
tgccctggctccttgc

SEQ ID NO: 4236175 - DNA, 14 bp, Homo sapiens
tgcctccaggacca

SEQ ID NO: 4236176 - DNA, 15 bp, Homo sapiens
tgcctccaggaccag

SEQ ID NO: 4236177 - DNA, 19 bp, Homo sapiens
tgcctcctggtctcttcac

SEQ ID NO: 4236178 - DNA, 19 bp, Homo sapiens
tgccttcttccaggatcag

SEQ ID NO: 4236179 - DNA, 15 bp, Homo sapiens
tgctgaggccttctc

SEQ ID NO: 4236180 - DNA, 14 bp, Homo sapiens
tgctggaagctgtc

SEQ ID NO: 4236181 - DNA, 17 bp, Homo sapiens
tgctggaagctgtcagg

SEQ ID NO: 4236182 - DNA, 18 bp, Homo sapiens
tgctggaccagctggcct

SEQ ID NO: 4236183 - DNA, 19 bp, Homo sapiens
tgctggaccagctggcctg

SEQ ID NO: 4236184 - DNA, 15 bp, Homo sapiens
tgctgtggtctataa

SEQ ID NO: 4236185 - DNA, 23 bp, Homo sapiens
tgctgtggtctataaaataaact

SEQ ID NO: 4236186 - DNA, 14 bp, Homo sapiens
tgcttagcctgtgc

SEQ ID NO: 4236187 - DNA, 19 bp, Homo sapiens
tgcttagcctgtgctggac

SEQ ID NO: 4236188 - DNA, 20 bp, Homo sapiens
tgcttgcagtaattcaactg

SEQ ID NO: 4236189 - DNA, 21 bp, Homo sapiens
tggacagcggcagtgggcctg

SEQ ID NO: 4236190 - DNA, 15 bp, Homo sapiens
tggaccagctggcct

SEQ ID NO: 4236191 - DNA, 11 bp, Homo sapiens
tggaggcaggg

SEQ ID NO: 4236192 - DNA, 19 bp, Homo sapiens
tggaggcaggggctgctgc

SEQ ID NO: 4236193 - DNA, 16 bp, Homo sapiens
tggagtatttttataa

SEQ ID NO: 4236194 - DNA, 18 bp, Homo sapiens
tggatgagtaaactgttt

SEQ ID NO: 4236195 - DNA, 18 bp, Homo sapiens
tggccattgagctgtttc

SEQ ID NO: 4236196 - DNA, 16 bp, Homo sapiens
tggctctggcccaggc

SEQ ID NO: 4236197 - DNA, 15 bp, Homo sapiens
tggctgctcactgtc

SEQ ID NO: 4236198 - DNA, 11 bp, Homo sapiens
tggctggaatt

SEQ ID NO: 4236199 - DNA, 16 bp, Homo sapiens
tggctgtaacctgctg

SEQ ID NO: 4236200 - DNA, 18 bp, Homo sapiens
tgggactccatagctcct

SEQ ID NO: 4236201 - DNA, 16 bp, Homo sapiens
tgggccttggctgggc

SEQ ID NO: 4236202 - DNA, 20 bp, Homo sapiens
tgggccttggctgggcctct

SEQ ID NO: 4236203 - DNA, 15 bp, Homo sapiens
tgggcttcctgctgg

SEQ ID NO: 4236204 - DNA, 18 bp, Homo sapiens
tgggcttcctgctgggac

SEQ ID NO: 4236205 - DNA, 20 bp, Homo sapiens
tgggcttcctgctgggactg

SEQ ID NO: 4236206 - DNA, 18 bp, Homo sapiens
tggtctataaaataaact

SEQ ID NO: 4236207 - DNA, 21 bp, Homo sapiens
tggtctataaaataaacttct

SEQ ID NO: 4236208 - DNA, 12 bp, Homo sapiens
tgtacatattat

SEQ ID NO: 4236209 - DNA, 19 bp, Homo sapiens
tgtagcatttttctaatag

SEQ ID NO: 4236210 - DNA, 14 bp, Homo sapiens
tgtataagctgtaa

SEQ ID NO: 4236211 - DNA, 16 bp, Homo sapiens
tgtcaggccagcctgt

SEQ ID NO: 4236212 - DNA, 13 bp, Homo sapiens
tgtcaggctggga

SEQ ID NO: 4236213 - DNA, 18 bp, Homo sapiens
tgtgccttactaaatatg

SEQ ID NO: 4236214 - DNA, 17 bp, Homo sapiens
tgtgctggaccagctgg

SEQ ID NO: 4236215 - DNA, 20 bp, Homo sapiens
tgtggagtatttttataatt

SEQ ID NO: 4236216 - DNA, 14 bp, Homo sapiens
tgttggaaaacata

SEQ ID NO: 4236217 - DNA, 16 bp, Homo sapiens
ttaaaagattttatgg

SEQ ID NO: 4236218 - DNA, 15 bp, Homo sapiens
ttaaagttttcaaat

SEQ ID NO: 4236219 - DNA, 23 bp, Homo sapiens
ttaattttagaaagaaaattata

SEQ ID NO: 4236220 - DNA, 16 bp, Homo sapiens
ttactaatatatctgt

SEQ ID NO: 4236221 - DNA, 13 bp, Homo sapiens
ttactgcttgcag

SEQ ID NO: 4236222 - DNA, 21 bp, Homo sapiens
ttactgcttgcagtaattcaa

SEQ ID NO: 4236223 - DNA, 20 bp, Homo sapiens
ttagaaagaaaattatattc

SEQ ID NO: 4236224 - DNA, 15 bp, Homo sapiens
ttagatgctctgaga

SEQ ID NO: 4236225 - DNA, 14 bp, Homo sapiens
ttagcctgtgctgg

SEQ ID NO: 4236226 - DNA, 18 bp, Homo sapiens
ttataattttatctgtat

SEQ ID NO: 4236227 - DNA, 21 bp, Homo sapiens
ttatagaaaatgcattattta

SEQ ID NO: 4236228 - DNA, 17 bp, Homo sapiens
ttatagcccggtgcagc

SEQ ID NO: 4236229 - DNA, 18 bp, Homo sapiens
ttatattcattcagatat

SEQ ID NO: 4236230 - DNA, 19 bp, Homo sapiens
ttatattcattcagatata

SEQ ID NO: 4236231 - DNA, 14 bp, Homo sapiens
ttatattctgttta

SEQ ID NO: 4236232 - DNA, 15 bp, Homo sapiens
ttatattctgtttat

SEQ ID NO: 4236233 - DNA, 16 bp, Homo sapiens
ttatcatcctataaag

SEQ ID NO: 4236234 - DNA, 13 bp, Homo sapiens
ttatctgaatatt

SEQ ID NO: 4236235 - DNA, 17 bp, Homo sapiens
ttatctgaatattagat

SEQ ID NO: 4236236 - DNA, 12 bp, Homo sapiens
ttattagaaagc

SEQ ID NO: 4236237 - DNA, 20 bp, Homo sapiens
ttatttagtcaattgtttaa

SEQ ID NO: 4236238 - DNA, 18 bp, Homo sapiens
ttcaactggaaattaaaa

SEQ ID NO: 4236239 - DNA, 21 bp, Homo sapiens
ttcattcagatataagatttg

SEQ ID NO: 4236240 - DNA, 14 bp, Homo sapiens
ttcctgctgggact

SEQ ID NO: 4236241 - DNA, 15 bp, Homo sapiens
ttctaggtggcagga

SEQ ID NO: 4236242 - DNA, 14 bp, Homo sapiens
ttctcctggaggca

SEQ ID NO: 4236243 - DNA, 19 bp, Homo sapiens
ttctcttgaggcctgtgct

SEQ ID NO: 4236244 - DNA, 12 bp, Homo sapiens
ttctgctggaag

SEQ ID NO: 4236245 - DNA, 14 bp, Homo sapiens
ttcttaacatgctt

SEQ ID NO: 4236246 - DNA, 16 bp, Homo sapiens
ttgaatgtaccttatt

SEQ ID NO: 4236247 - DNA, 23 bp, Homo sapiens
ttgaatgtaccttatttaaaaga

SEQ ID NO: 4236248 - DNA, 14 bp, Homo sapiens
ttgaggctttcagt

SEQ ID NO: 4236249 - DNA, 11 bp, Homo sapiens
ttgcagcaggg

SEQ ID NO: 4236250 - DNA, 13 bp, Homo sapiens
ttgcagcagggct

SEQ ID NO: 4236251 - DNA, 15 bp, Homo sapiens
ttgccccaggccctg

SEQ ID NO: 4236252 - DNA, 16 bp, Homo sapiens
ttgcttagcctgtgct

SEQ ID NO: 4236253 - DNA, 17 bp, Homo sapiens
ttgtgccttactaaata

SEQ ID NO: 4236254 - DNA, 14 bp, Homo sapiens
ttgtgggcttcctg

SEQ ID NO: 4236255 - DNA, 22 bp, Homo sapiens
ttgtgggcttcctgctgggact

SEQ ID NO: 4236256 - DNA, 23 bp, Homo sapiens
ttgtgggcttcctgctgggactg

SEQ ID NO: 4236257 - DNA, 19 bp, Homo sapiens
tttaatggaaagtttgtag

SEQ ID NO: 4236258 - DNA, 16 bp, Homo sapiens
tttataactatataaa

SEQ ID NO: 4236259 - DNA, 17 bp, Homo sapiens
tttataattttatctgt

SEQ ID NO: 4236260 - DNA, 17 bp, Homo sapiens
tttatagaaaatgcatt

SEQ ID NO: 4236261 - DNA, 11 bp, Homo sapiens
tttattagaaa

SEQ ID NO: 4236262 - DNA, 13 bp, Homo sapiens
tttctcttttcct

SEQ ID NO: 4236263 - DNA, 14 bp, Homo sapiens
tttctcttttcctt

SEQ ID NO: 4236264 - DNA, 20 bp, Homo sapiens
tttctgctgtggtctataaa

SEQ ID NO: 4236265 - DNA, 18 bp, Homo sapiens
tttcttgatatctttcct

SEQ ID NO: 4236266 - DNA, 17 bp, Homo sapiens
tttgtacatattatcat

SEQ ID NO: 4236267 - DNA, 20 bp, Homo sapiens
tttgtagccatcctgttaaa

SEQ ID NO: 4236268 - DNA, 16 bp, Homo sapiens
ttttaatggaaagttt

SEQ ID NO: 4236269 - DNA, 22 bp, Homo sapiens
ttttaatgtaaaggttttctca

SEQ ID NO: 4236270 - DNA, 13 bp, Homo sapiens
ttttagaaagaaa

SEQ ID NO: 4236271 - DNA, 15 bp, Homo sapiens
ttttagaaagaaaat

SEQ ID NO: 4236272 - DNA, 15 bp, Homo sapiens
ttttataactatata

SEQ ID NO: 4236273 - DNA, 13 bp, Homo sapiens
ttttatagaaaat

SEQ ID NO: 4236274 - DNA, 19 bp, Homo sapiens
ttttatagaaaatgcatta

SEQ ID NO: 4236275 - DNA, 13 bp, Homo sapiens
ttttatctgtata

SEQ ID NO: 4236276 - DNA, 14 bp, Homo sapiens
ttttctcttttcct

SEQ ID NO: 4236277 - DNA, 18 bp, Homo sapiens
tttttataattttatctg

SEQ ID NO: 4236278 - DNA, 21 bp, Homo sapiens
tttttctgtaaaagttactaa

SEQ ID NO: 4236279 - DNA, 23 bp, Homo sapiens
taaaagttactaatatatctgta

SEQ ID NO: 4236280 - DNA, 13 bp, Homo sapiens
taaaataaacttc

SEQ ID NO: 4236281 - DNA, 16 bp, Homo sapiens
taaaataaacttctta

SEQ ID NO: 4236282 - DNA, 21 bp, Homo sapiens
taaaatcttctgatgagttct

SEQ ID NO: 4236283 - DNA, 13 bp, Homo sapiens
taaactgtttctc

SEQ ID NO: 4236284 - DNA, 14 bp, Homo sapiens
taaacttcttaaca

SEQ ID NO: 4236285 - DNA, 20 bp, Homo sapiens
taaagaaacttggctggaat

SEQ ID NO: 4236286 - DNA, 21 bp, Homo sapiens
taaagaaacttggctggaatt

SEQ ID NO: 4236287 - DNA, 18 bp, Homo sapiens
taaagttttcaaattatt

SEQ ID NO: 4236288 - DNA, 14 bp, Homo sapiens
taaatagctttgag

SEQ ID NO: 4236289 - DNA, 13 bp, Homo sapiens
taaatgacattat

SEQ ID NO: 4236290 - DNA, 17 bp, Homo sapiens
taaatgacattattaaa

SEQ ID NO: 4236291 - DNA, 20 bp, Homo sapiens
taaatgacattattaaagtt

SEQ ID NO: 4236292 - DNA, 15 bp, Homo sapiens
taaattatctgaata

SEQ ID NO: 4236293 - DNA, 17 bp, Homo sapiens
taaattatctgaatatt

SEQ ID NO: 4236294 - DNA, 10 bp, Homo sapiens
taacctgctg

SEQ ID NO: 4236295 - DNA, 15 bp, Homo sapiens
taactatataaatga

SEQ ID NO: 4236296 - DNA, 22 bp, Homo sapiens
taactatataaatgacattatt

SEQ ID NO: 4236297 - DNA, 12 bp, Homo sapiens
taagatttgtac

SEQ ID NO: 4236298 - DNA, 16 bp, Homo sapiens
taagcaaatttctaaa

SEQ ID NO: 4236299 - DNA, 22 bp, Homo sapiens
taagcttgcgtagaattgcagg

SEQ ID NO: 4236300 - DNA, 22 bp, Homo sapiens
taattttgccacagggtactaa

SEQ ID NO: 4236301 - DNA, 22 bp, Homo sapiens
taccttatttaaaagattttat

SEQ ID NO: 4236302 - DNA, 23 bp, Homo sapiens
taccttatttaaaagattttatg

SEQ ID NO: 4236303 - DNA, 22 bp, Homo sapiens
tacgggccagtttctctgcctt

SEQ ID NO: 4236304 - DNA, 16 bp, Homo sapiens
tactaatatatctgta

SEQ ID NO: 4236305 - DNA, 16 bp, Homo sapiens
tactgactatattttc

SEQ ID NO: 4236306 - DNA, 18 bp, Homo sapiens
tactgccatatttttctg

SEQ ID NO: 4236307 - DNA, 13 bp, Homo sapiens
tagaggatgtggc

SEQ ID NO: 4236308 - DNA, 19 bp, Homo sapiens
tagaggcttttattagaaa

SEQ ID NO: 4236309 - DNA, 20 bp, Homo sapiens
tagaggcttttattagaaag

SEQ ID NO: 4236310 - DNA, 21 bp, Homo sapiens
tagaggcttttattagaaagc

SEQ ID NO: 4236311 - DNA, 19 bp, Homo sapiens
tagatgctctgagaaattg

SEQ ID NO: 4236312 - DNA, 14 bp, Homo sapiens
tagcatttttctaa

SEQ ID NO: 4236313 - DNA, 14 bp, Homo sapiens
tataaaataaactt

SEQ ID NO: 4236314 - DNA, 17 bp, Homo sapiens
tataaaataaacttctt

SEQ ID NO: 4236315 - DNA, 14 bp, Homo sapiens
tataaattatctga

SEQ ID NO: 4236316 - DNA, 22 bp, Homo sapiens
tataaattatctgaatattaga

SEQ ID NO: 4236317 - DNA, 18 bp, Homo sapiens
tataagatttgtacatat

SEQ ID NO: 4236318 - DNA, 19 bp, Homo sapiens
tataagatttgtacatatt

SEQ ID NO: 4236319 - DNA, 15 bp, Homo sapiens
tataagctgtaatat

SEQ ID NO: 4236320 - DNA, 15 bp, Homo sapiens
tataattttatctgt

SEQ ID NO: 4236321 - DNA, 18 bp, Homo sapiens
tataattttatctgtata

SEQ ID NO: 4236322 - DNA, 22 bp, Homo sapiens
tatagaaaatgcattatttagt

SEQ ID NO: 4236323 - DNA, 15 bp, Homo sapiens
tatataaatgacatt

SEQ ID NO: 4236324 - DNA, 18 bp, Homo sapiens
tatataaatgacattatt

SEQ ID NO: 4236325 - DNA, 21 bp, Homo sapiens
tatataaatgacattattaaa

SEQ ID NO: 4236326 - DNA, 20 bp, Homo sapiens
tatattttcccttattactg

SEQ ID NO: 4236327 - DNA, 22 bp, Homo sapiens
tatctactgactatattttccc

SEQ ID NO: 4236328 - DNA, 16 bp, Homo sapiens
tatctgtaacactatt

SEQ ID NO: 4236329 - DNA, 19 bp, Homo sapiens
tatctgtaacactattaca

SEQ ID NO: 4236330 - DNA, 23 bp, Homo sapiens
tatctgtaacactattacagtat

SEQ ID NO: 4236331 - DNA, 20 bp, Homo sapiens
tatctgtataagctgtaata

SEQ ID NO: 4236332 - DNA, 23 bp, Homo sapiens
tatctgtataagctgtaatatca

SEQ ID NO: 4236333 - DNA, 23 bp, Homo sapiens
tatctttctcattaccagtgact

SEQ ID NO: 4236334 - DNA, 21 bp, Homo sapiens
tatgacttaattttagaaaga

SEQ ID NO: 4236335 - DNA, 18 bp, Homo sapiens
tatgatgtggagaaagga

SEQ ID NO: 4236336 - DNA, 18 bp, Homo sapiens
tatggttttataactata

SEQ ID NO: 4236337 - DNA, 13 bp, Homo sapiens
tattaaagttttc

SEQ ID NO: 4236338 - DNA, 19 bp, Homo sapiens
tattacagtattgctattt

SEQ ID NO: 4236339 - DNA, 23 bp, Homo sapiens
tattacagtattgctatttatat

SEQ ID NO: 4236340 - DNA, 18 bp, Homo sapiens
tattactgcttgcagtaa

SEQ ID NO: 4236341 - DNA, 12 bp, Homo sapiens
tattagaaagcc

SEQ ID NO: 4236342 - DNA, 21 bp, Homo sapiens
tattatcatcctataaagaaa

SEQ ID NO: 4236343 - DNA, 23 bp, Homo sapiens
tattatgacaaatgaaagagaaa

SEQ ID NO: 4236344 - DNA, 19 bp, Homo sapiens
tattctgtttattatgaca

SEQ ID NO: 4236345 - DNA, 19 bp, Homo sapiens
tattgctatttatattcat

SEQ ID NO: 4236346 - DNA, 14 bp, Homo sapiens
tatttagtcaattg

SEQ ID NO: 4236347 - DNA, 23 bp, Homo sapiens
tatttagtcaattgtttaatgtt

SEQ ID NO: 4236348 - DNA, 16 bp, Homo sapiens
tatttttaatggaaag

SEQ ID NO: 4236349 - DNA, 17 bp, Homo sapiens
tatttttataattttat

SEQ ID NO: 4236350 - DNA, 14 bp, Homo sapiens
tatttttctgtgtg

SEQ ID NO: 4236351 - DNA, 16 bp, Homo sapiens
tcaattgtttaatgtt

SEQ ID NO: 4236352 - DNA, 16 bp, Homo sapiens
tcactgagagctgcct

SEQ ID NO: 4236353 - DNA, 21 bp, Homo sapiens
tcactttctcttttgttttaa

SEQ ID NO: 4236354 - DNA, 18 bp, Homo sapiens
tcagatataagatttgta

SEQ ID NO: 4236355 - DNA, 14 bp, Homo sapiens
tcagcaggcaggct

SEQ ID NO: 4236356 - DNA, 15 bp, Homo sapiens
tcaggccagcctgtc

SEQ ID NO: 4236357 - DNA, 17 bp, Homo sapiens
tcagggaaggtgaaaca

SEQ ID NO: 4236358 - DNA, 22 bp, Homo sapiens
tccaagttgctgcagcttggca

SEQ ID NO: 4236359 - DNA, 20 bp, Homo sapiens
tccacatgtgaactttttct

SEQ ID NO: 4236360 - DNA, 15 bp, Homo sapiens
tccatgtcaggccag

SEQ ID NO: 4236361 - DNA, 23 bp, Homo sapiens
tccctctgaagagaccttggctg

SEQ ID NO: 4236362 - DNA, 13 bp, Homo sapiens
tccctgcaggggc

SEQ ID NO: 4236363 - DNA, 22 bp, Homo sapiens
tcctaaaggtgagggtctcttt

SEQ ID NO: 4236364 - DNA, 12 bp, Homo sapiens
tcctccagcctc

SEQ ID NO: 4236365 - DNA, 24 bp, Homo sapiens
tcctgacccctccctgcaggggct

SEQ ID NO: 4236366 - DNA, 19 bp, Homo sapiens
tcctgctgggactgagaag

SEQ ID NO: 4236367 - DNA, 16 bp, Homo sapiens
tccttgcagcagggct

SEQ ID NO: 4236368 - DNA, 22 bp, Homo sapiens
tccttgcagcagggctgggcct

SEQ ID NO: 4236369 - DNA, 22 bp, Homo sapiens
tcgttatctactgactatattt

SEQ ID NO: 4236370 - DNA, 13 bp, Homo sapiens
tctaactcctggg

SEQ ID NO: 4236371 - DNA, 16 bp, Homo sapiens
tctataaaataaactt

SEQ ID NO: 4236372 - DNA, 18 bp, Homo sapiens
tctataaaataaacttct

SEQ ID NO: 4236373 - DNA, 19 bp, Homo sapiens
tctataaaataaacttctt

SEQ ID NO: 4236374 - DNA, 16 bp, Homo sapiens
tctcaaaaattctcct

SEQ ID NO: 4236375 - DNA, 17 bp, Homo sapiens
tctcctggaggcagggg

SEQ ID NO: 4236376 - DNA, 14 bp, Homo sapiens
tctcttgaggcctg

SEQ ID NO: 4236377 - DNA, 18 bp, Homo sapiens
tctgaagagaccttggct

SEQ ID NO: 4236378 - DNA, 21 bp, Homo sapiens
tctgctgtggtctataaaata

SEQ ID NO: 4236379 - DNA, 23 bp, Homo sapiens
tctggccttgccccaggccctgc

SEQ ID NO: 4236380 - DNA, 18 bp, Homo sapiens
tctgtaacactattacag

SEQ ID NO: 4236381 - DNA, 15 bp, Homo sapiens
tctgtacgggccagt

SEQ ID NO: 4236382 - DNA, 19 bp, Homo sapiens
tctgtgcctccaggaccag

SEQ ID NO: 4236383 - DNA, 18 bp, Homo sapiens
tctgtttgccacacccag

SEQ ID NO: 4236384 - DNA, 19 bp, Homo sapiens
tgaaagagaaaatatatat

SEQ ID NO: 4236385 - DNA, 16 bp, Homo sapiens
tgacagtaagtttatt

SEQ ID NO: 4236386 - DNA, 14 bp, Homo sapiens
tgacccctccctgc

SEQ ID NO: 4236387 - DNA, 23 bp, Homo sapiens
tgacttcagggaaggtgaaacag

SEQ ID NO: 4236388 - DNA, 16 bp, Homo sapiens
tgagagctgcctcctg

SEQ ID NO: 4236389 - DNA, 19 bp, Homo sapiens
tgagcccccacgctggcct

SEQ ID NO: 4236390 - DNA, 13 bp, Homo sapiens
tgagctgtttcct

SEQ ID NO: 4236391 - DNA, 21 bp, Homo sapiens
tgaggccttctcttgaggcct

SEQ ID NO: 4236392 - DNA, 18 bp, Homo sapiens
tgagtaaactgtttctca

SEQ ID NO: 4236393 - DNA, 20 bp, Homo sapiens
tgatatctttcctccctctt

SEQ ID NO: 4236394 - DNA, 17 bp, Homo sapiens
tgatgtggagaaaggac

SEQ ID NO: 4236395 - DNA, 22 bp, Homo sapiens
tgcagcagggctgggcctgcga

SEQ ID NO: 4236396 - DNA, 15 bp, Homo sapiens
tgcagtaattcaact

SEQ ID NO: 4236397 - DNA, 21 bp, Homo sapiens
tgcagtaattcaactggaaat

SEQ ID NO: 4236398 - DNA, 12 bp, Homo sapiens
tgcattatttag

SEQ ID NO: 4236399 - DNA, 15 bp, Homo sapiens
tgccatatttttctg

SEQ ID NO: 4236400 - DNA, 20 bp, Homo sapiens
gcaaggcctctcagacccag

SEQ ID NO: 4236401 - DNA, 16 bp, Homo sapiens
gcaccacccctgggca

SEQ ID NO: 4236402 - DNA, 14 bp, Homo sapiens
gcagcagggctggg

SEQ ID NO: 4236403 - DNA, 13 bp, Homo sapiens
gcagcctctgccc

SEQ ID NO: 4236404 - DNA, 15 bp, Homo sapiens
gcaggcaggctgggg

SEQ ID NO: 4236405 - DNA, 12 bp, Homo sapiens
gcagggctgggc

SEQ ID NO: 4236406 - DNA, 16 bp, Homo sapiens
gcagtgggcctgctga

SEQ ID NO: 4236407 - DNA, 21 bp, Homo sapiens
gcattatttagtcaattgttt

SEQ ID NO: 4236408 - DNA, 20 bp, Homo sapiens
gcattctctgcccactttgc

SEQ ID NO: 4236409 - DNA, 17 bp, Homo sapiens
gccacgcccagcttcct

SEQ ID NO: 4236410 - DNA, 15 bp, Homo sapiens
gccagcctgtccctg

SEQ ID NO: 4236411 - DNA, 12 bp, Homo sapiens
gccagggcccag

SEQ ID NO: 4236412 - DNA, 14 bp, Homo sapiens
gccagggcccagga

SEQ ID NO: 4236413 - DNA, 20 bp, Homo sapiens
gccagtttctctgccttctt

SEQ ID NO: 4236414 - DNA, 22 bp, Homo sapiens
gccatatttttctgtgtggagt

SEQ ID NO: 4236415 - DNA, 17 bp, Homo sapiens
gccattgagctgtttcc

SEQ ID NO: 4236416 - DNA, 20 bp, Homo sapiens
gcccaccctctgcccaggga

SEQ ID NO: 4236417 - DNA, 20 bp, Homo sapiens
gcccaggaggaccgcctgcc

SEQ ID NO: 4236418 - DNA, 16 bp, Homo sapiens
gcccagggagtccttg

SEQ ID NO: 4236419 - DNA, 12 bp, Homo sapiens
gcccctgctcac

SEQ ID NO: 4236420 - DNA, 12 bp, Homo sapiens
gcccggtgcagc

SEQ ID NO: 4236421 - DNA, 16 bp, Homo sapiens
gcccggtgcagcctct

SEQ ID NO: 4236422 - DNA, 14 bp, Homo sapiens
gccctggctccttg

SEQ ID NO: 4236423 - DNA, 16 bp, Homo sapiens
gccctggctccttgca

SEQ ID NO: 4236424 - DNA, 23 bp, Homo sapiens
gccctggctccttgcagcagggc

SEQ ID NO: 4236425 - DNA, 19 bp, Homo sapiens
gcctaatggctttcacttt

SEQ ID NO: 4236426 - DNA, 19 bp, Homo sapiens
gcctcccaaagtactggga

SEQ ID NO: 4236427 - DNA, 14 bp, Homo sapiens
gcctgctgaggcct

SEQ ID NO: 4236428 - DNA, 20 bp, Homo sapiens
gcctgggccttggctgggcc

SEQ ID NO: 4236429 - DNA, 14 bp, Homo sapiens
gccttctcttgagg

SEQ ID NO: 4236430 - DNA, 22 bp, Homo sapiens
gccttctcttgaggcctgtgct

SEQ ID NO: 4236431 - DNA, 13 bp, Homo sapiens
gccttcttccagg

SEQ ID NO: 4236432 - DNA, 18 bp, Homo sapiens
gccttggctgggcctctg

SEQ ID NO: 4236433 - DNA, 23 bp, Homo sapiens
gcgagacccaaggctcactgcag

SEQ ID NO: 4236434 - DNA, 13 bp, Homo sapiens
gcgcgctcctgac

SEQ ID NO: 4236435 - DNA, 23 bp, Homo sapiens
gcgcgctcctgacccctccctgc

SEQ ID NO: 4236436 - DNA, 16 bp, Homo sapiens
gcgtcccatgaggtct

SEQ ID NO: 4236437 - DNA, 18 bp, Homo sapiens
gctagaggcttttattag

SEQ ID NO: 4236438 - DNA, 12 bp, Homo sapiens
gctatttatatt

SEQ ID NO: 4236439 - DNA, 15 bp, Homo sapiens
gctatttatattcat

SEQ ID NO: 4236440 - DNA, 21 bp, Homo sapiens
gctcactgcagcgcgctcctg

SEQ ID NO: 4236441 - DNA, 16 bp, Homo sapiens
gctcagtatgtgacct

SEQ ID NO: 4236442 - DNA, 14 bp, Homo sapiens
gctccttcccagga

SEQ ID NO: 4236443 - DNA, 16 bp, Homo sapiens
gctccttcccaggacc

SEQ ID NO: 4236444 - DNA, 17 bp, Homo sapiens
gctccttcccaggaccc

SEQ ID NO: 4236445 - DNA, 19 bp, Homo sapiens
gctgaggccttctcttgag

SEQ ID NO: 4236446 - DNA, 18 bp, Homo sapiens
gctgcctcctggtctctt

SEQ ID NO: 4236447 - DNA, 15 bp, Homo sapiens
gctggaccagctggc

SEQ ID NO: 4236448 - DNA, 17 bp, Homo sapiens
gctggaccagctggcct

SEQ ID NO: 4236449 - DNA, 14 bp, Homo sapiens
gctggatgggactc

SEQ ID NO: 4236450 - DNA, 15 bp, Homo sapiens
gctgtaacctgctgg

SEQ ID NO: 4236451 - DNA, 20 bp, Homo sapiens
gctgtggtctataaaataaa

SEQ ID NO: 4236452 - DNA, 21 bp, Homo sapiens
gctgtggtctataaaataaac

SEQ ID NO: 4236453 - DNA, 15 bp, Homo sapiens
gcttgcctaatggct

SEQ ID NO: 4236454 - DNA, 19 bp, Homo sapiens
gcttgcgtagaattgcagg

SEQ ID NO: 4236455 - DNA, 22 bp, Homo sapiens
gctttcagtgatatctttctca

SEQ ID NO: 4236456 - DNA, 23 bp, Homo sapiens
gctttcagtgatatctttctcat

SEQ ID NO: 4236457 - DNA, 18 bp, Homo sapiens
gctttgagatttcagcta

SEQ ID NO: 4236458 - DNA, 21 bp, Homo sapiens
ggacagcggcagtgggcctgc

SEQ ID NO: 4236459 - DNA, 15 bp, Homo sapiens
ggaccagctggcctg

SEQ ID NO: 4236460 - DNA, 22 bp, Homo sapiens
ggaggccagtgttgtgggcttc

SEQ ID NO: 4236461 - DNA, 22 bp, Homo sapiens
ggagtatttttataattttatc

SEQ ID NO: 4236462 - DNA, 11 bp, Homo sapiens
ggatgggactc

SEQ ID NO: 4236463 - DNA, 19 bp, Homo sapiens
ggcaacctggctctggccc

SEQ ID NO: 4236464 - DNA, 19 bp, Homo sapiens
ggcagtgggcctgctgagg

SEQ ID NO: 4236465 - DNA, 14 bp, Homo sapiens
ggcatcagcacttt

SEQ ID NO: 4236466 - DNA, 15 bp, Homo sapiens
ggccagcctgtccct

SEQ ID NO: 4236467 - DNA, 18 bp, Homo sapiens
ggccagtgttgtgggctt

SEQ ID NO: 4236468 - DNA, 22 bp, Homo sapiens
ggccagtgttgtgggcttcctg

SEQ ID NO: 4236469 - DNA, 20 bp, Homo sapiens
ggccttctcttgaggcctgt

SEQ ID NO: 4236470 - DNA, 12 bp, Homo sapiens
ggctccttgcag

SEQ ID NO: 4236471 - DNA, 17 bp, Homo sapiens
ggctgtaacctgctgga

SEQ ID NO: 4236472 - DNA, 22 bp, Homo sapiens
ggctttcagtgatatctttctc

SEQ ID NO: 4236473 - DNA, 14 bp, Homo sapiens
gggcccaggaggac

SEQ ID NO: 4236474 - DNA, 15 bp, Homo sapiens
gggccttggctgggc

SEQ ID NO: 4236475 - DNA, 16 bp, Homo sapiens
gggccttggctgggcc

SEQ ID NO: 4236476 - DNA, 20 bp, Homo sapiens
gggctacgttagcagcccag

SEQ ID NO: 4236477 - DNA, 19 bp, Homo sapiens
gggcttcctgctgggactg

SEQ ID NO: 4236478 - DNA, 14 bp, Homo sapiens
ggggaggccagtgt

SEQ ID NO: 4236479 - DNA, 23 bp, Homo sapiens
ggggcccaccctctgcccaggga

SEQ ID NO: 4236480 - DNA, 17 bp, Homo sapiens
gggtgccctggctcctt

SEQ ID NO: 4236481 - DNA, 17 bp, Homo sapiens
ggtctataaaataaact

SEQ ID NO: 4236482 - DNA, 12 bp, Homo sapiens
ggtgatttcctc

SEQ ID NO: 4236483 - DNA, 22 bp, Homo sapiens
ggtgatttcctctaaagaaact

SEQ ID NO: 4236484 - DNA, 20 bp, Homo sapiens
ggttctgacactttctgctg

SEQ ID NO: 4236485 - DNA, 22 bp, Homo sapiens
gtaatatcattttatagaaaat

SEQ ID NO: 4236486 - DNA, 15 bp, Homo sapiens
gtagttctctcattt

SEQ ID NO: 4236487 - DNA, 14 bp, Homo sapiens
gtattgctatttat

SEQ ID NO: 4236488 - DNA, 15 bp, Homo sapiens
gtattgctatttata

SEQ ID NO: 4236489 - DNA, 23 bp, Homo sapiens
gtatttttataattttatctgta

SEQ ID NO: 4236490 - DNA, 17 bp, Homo sapiens
gtcaggccagcctgtcc

SEQ ID NO: 4236491 - DNA, 17 bp, Homo sapiens
gtccctcctaacaagtg

SEQ ID NO: 4236492 - DNA, 22 bp, Homo sapiens
gtccttgcgtcccatgaggtct

SEQ ID NO: 4236493 - DNA, 16 bp, Homo sapiens
gtcgaggaagaccacc

SEQ ID NO: 4236494 - DNA, 12 bp, Homo sapiens
gtctataaaata

SEQ ID NO: 4236495 - DNA, 16 bp, Homo sapiens
gtctataaaataaact

SEQ ID NO: 4236496 - DNA, 18 bp, Homo sapiens
gtctataaaataaacttc

SEQ ID NO: 4236497 - DNA, 22 bp, Homo sapiens
gtgatttcctctaaagaaactt

SEQ ID NO: 4236498 - DNA, 14 bp, Homo sapiens
gtgcccctgctcac

SEQ ID NO: 4236499 - DNA, 20 bp, Homo sapiens
gtgcctccaggaccaggggc

SEQ ID NO: 4236500 - DNA, 18 bp, Homo sapiens
gtgctctgggggtccctt

SEQ ID NO: 4236501 - DNA, 19 bp, Homo sapiens
gtgctggaccagctggcct

SEQ ID NO: 4236502 - DNA, 15 bp, Homo sapiens
gtgggcctgctgagg

SEQ ID NO: 4236503 - DNA, 17 bp, Homo sapiens
gtgggcttcctgctggg

SEQ ID NO: 4236504 - DNA, 15 bp, Homo sapiens
gtgggtcgaggattc

SEQ ID NO: 4236505 - DNA, 20 bp, Homo sapiens
gtggtctataaaataaactt

SEQ ID NO: 4236506 - DNA, 15 bp, Homo sapiens
gtgttgtcagcaggc

SEQ ID NO: 4236507 - DNA, 16 bp, Homo sapiens
gtgttgtcagcaggca

SEQ ID NO: 4236508 - DNA, 21 bp, Homo sapiens
gttaatttatccatgctggca

SEQ ID NO: 4236509 - DNA, 14 bp, Homo sapiens
gttactaatatatc

SEQ ID NO: 4236510 - DNA, 21 bp, Homo sapiens
gttactaatatatctgtaaca

SEQ ID NO: 4236511 - DNA, 22 bp, Homo sapiens
gttactaatatatctgtaacac

SEQ ID NO: 4236512 - DNA, 21 bp, Homo sapiens
gttctcctggaggcaggggct

SEQ ID NO: 4236513 - DNA, 19 bp, Homo sapiens
gttctgacactttctgctg

SEQ ID NO: 4236514 - DNA, 16 bp, Homo sapiens
gttggaaaacatatga

SEQ ID NO: 4236515 - DNA, 20 bp, Homo sapiens
gttggaaaacatatgaaata

SEQ ID NO: 4236516 - DNA, 20 bp, Homo sapiens
gtttattatgacaaatgaaa

SEQ ID NO: 4236517 - DNA, 14 bp, Homo sapiens
gtttcactgagagc

SEQ ID NO: 4236518 - DNA, 21 bp, Homo sapiens
gtttcctgggtgccctggctc

SEQ ID NO: 4236519 - DNA, 15 bp, Homo sapiens
gttttataactatat

SEQ ID NO: 4236520 - DNA, 19 bp, Homo sapiens
gttttataactatataaat

SEQ ID NO: 4236521 - DNA, 19 bp, Homo sapiens
taaaagttactaatatatc

SEQ ID NO: 4236522 - DNA, 16 bp, Homo sapiens
cctggctccttgcagc

SEQ ID NO: 4236523 - DNA, 17 bp, Homo sapiens
ccttatttaaaagattt

SEQ ID NO: 4236524 - DNA, 18 bp, Homo sapiens
ccttccatgtcaggccag

SEQ ID NO: 4236525 - DNA, 14 bp, Homo sapiens
ccttcccaggaccc

SEQ ID NO: 4236526 - DNA, 21 bp, Homo sapiens
ccttgcagcagggctgggcct

SEQ ID NO: 4236527 - DNA, 14 bp, Homo sapiens
ccttgccccaggcc

SEQ ID NO: 4236528 - DNA, 20 bp, Homo sapiens
ccttgcgtcccatgaggtct

SEQ ID NO: 4236529 - DNA, 18 bp, Homo sapiens
ccttggctgctcactgtc

SEQ ID NO: 4236530 - DNA, 17 bp, Homo sapiens
cgaggattctgtgcctc

SEQ ID NO: 4236531 - DNA, 18 bp, Homo sapiens
cgattaataacctgccag

SEQ ID NO: 4236532 - DNA, 21 bp, Homo sapiens
cgcaaggcctctcagacccag

SEQ ID NO: 4236533 - DNA, 15 bp, Homo sapiens
cgcagcctctgcccc

SEQ ID NO: 4236534 - DNA, 17 bp, Homo sapiens
cggcagtgggcctgctg

SEQ ID NO: 4236535 - DNA, 23 bp, Homo sapiens
cggtgcagcctctaactcctggg

SEQ ID NO: 4236536 - DNA, 21 bp, Homo sapiens
ctaaagaaacttggctggaat

SEQ ID NO: 4236537 - DNA, 18 bp, Homo sapiens
ctaacaagtgtatctcga

SEQ ID NO: 4236538 - DNA, 15 bp, Homo sapiens
ctaatatatctgtaa

SEQ ID NO: 4236539 - DNA, 15 bp, Homo sapiens
ctactgactatattt

SEQ ID NO: 4236540 - DNA, 15 bp, Homo sapiens
ctagaggtctctctg

SEQ ID NO: 4236541 - DNA, 15 bp, Homo sapiens
ctataaaataaactt

SEQ ID NO: 4236542 - DNA, 17 bp, Homo sapiens
ctataaaataaacttct

SEQ ID NO: 4236543 - DNA, 18 bp, Homo sapiens
ctataaaataaacttctt

SEQ ID NO: 4236544 - DNA, 11 bp, Homo sapiens
ctatataaatg

SEQ ID NO: 4236545 - DNA, 22 bp, Homo sapiens
ctatataaatgacattattaaa

SEQ ID NO: 4236546 - DNA, 18 bp, Homo sapiens
ctatattttcccttatta

SEQ ID NO: 4236547 - DNA, 14 bp, Homo sapiens
ctatttatattcat

SEQ ID NO: 4236548 - DNA, 14 bp, Homo sapiens
ctcaaactccccag

SEQ ID NO: 4236549 - DNA, 11 bp, Homo sapiens
ctcactgcagc

SEQ ID NO: 4236550 - DNA, 13 bp, Homo sapiens
ctcataggtccct

SEQ ID NO: 4236551 - DNA, 15 bp, Homo sapiens
ctccaggaccagggg

SEQ ID NO: 4236552 - DNA, 17 bp, Homo sapiens
ctccatagctccttccc

SEQ ID NO: 4236553 - DNA, 18 bp, Homo sapiens
ctcctgacccctccctgc

SEQ ID NO: 4236554 - DNA, 19 bp, Homo sapiens
ctcctgacccctccctgca

SEQ ID NO: 4236555 - DNA, 20 bp, Homo sapiens
ctcctgacccctccctgcag

SEQ ID NO: 4236556 - DNA, 18 bp, Homo sapiens
ctcctggaggcaggggct

SEQ ID NO: 4236557 - DNA, 21 bp, Homo sapiens
ctccttgcagcagggctgggc

SEQ ID NO: 4236558 - DNA, 15 bp, Homo sapiens
ctctaaagaaacttg

SEQ ID NO: 4236559 - DNA, 23 bp, Homo sapiens
ctctgaagagaccttggctgctc

SEQ ID NO: 4236560 - DNA, 12 bp, Homo sapiens
ctctgccttctt

SEQ ID NO: 4236561 - DNA, 15 bp, Homo sapiens
ctctggttctgacac

SEQ ID NO: 4236562 - DNA, 16 bp, Homo sapiens
ctcttgaggcctgtgc

SEQ ID NO: 4236563 - DNA, 20 bp, Homo sapiens
ctcttgaggcctgtgctctg

SEQ ID NO: 4236564 - DNA, 20 bp, Homo sapiens
ctgaagagaccttggctgct

SEQ ID NO: 4236565 - DNA, 12 bp, Homo sapiens
ctgaatattaga

SEQ ID NO: 4236566 - DNA, 20 bp, Homo sapiens
ctgaatattagatgctctga

SEQ ID NO: 4236567 - DNA, 18 bp, Homo sapiens
ctgacccctccctgcagg

SEQ ID NO: 4236568 - DNA, 21 bp, Homo sapiens
ctgacccctccctgcaggggc

SEQ ID NO: 4236569 - DNA, 23 bp, Homo sapiens
ctgacttcagggaaggtgaaaca

SEQ ID NO: 4236570 - DNA, 14 bp, Homo sapiens
ctgagaaattgaat

SEQ ID NO: 4236571 - DNA, 13 bp, Homo sapiens
ctgagagctgcct

SEQ ID NO: 4236572 - DNA, 13 bp, Homo sapiens
ctgaggccttctc

SEQ ID NO: 4236573 - DNA, 21 bp, Homo sapiens
ctgcagagttctcctggaggc

SEQ ID NO: 4236574 - DNA, 22 bp, Homo sapiens
ctgcagagttctcctggaggca

SEQ ID NO: 4236575 - DNA, 13 bp, Homo sapiens
ctgcagtctgcag

SEQ ID NO: 4236576 - DNA, 14 bp, Homo sapiens
ctgcagtctgcaga

SEQ ID NO: 4236577 - DNA, 15 bp, Homo sapiens
ctgccatatttttct

SEQ ID NO: 4236578 - DNA, 17 bp, Homo sapiens
ctgccatatttttctgt

SEQ ID NO: 4236579 - DNA, 13 bp, Homo sapiens
ctgcgagacccaa

SEQ ID NO: 4236580 - DNA, 21 bp, Homo sapiens
ctgctggaagctgtcaggctg

SEQ ID NO: 4236581 - DNA, 17 bp, Homo sapiens
ctgctgggactgagaag

SEQ ID NO: 4236582 - DNA, 15 bp, Homo sapiens
ctggaagctgtcagg

SEQ ID NO: 4236583 - DNA, 16 bp, Homo sapiens
ctggaagctgtcaggc

SEQ ID NO: 4236584 - DNA, 13 bp, Homo sapiens
ctggctccttgca

SEQ ID NO: 4236585 - DNA, 18 bp, Homo sapiens
ctggctccttgcagcagg

SEQ ID NO: 4236586 - DNA, 13 bp, Homo sapiens
ctggctctggccc

SEQ ID NO: 4236587 - DNA, 19 bp, Homo sapiens
ctgggactgagaaggctca

SEQ ID NO: 4236588 - DNA, 18 bp, Homo sapiens
ctgggcctgcgagaccca

SEQ ID NO: 4236589 - DNA, 13 bp, Homo sapiens
ctgggccttggct

SEQ ID NO: 4236590 - DNA, 16 bp, Homo sapiens
ctgggggtcccttgct

SEQ ID NO: 4236591 - DNA, 15 bp, Homo sapiens
ctggggtccctctga

SEQ ID NO: 4236592 - DNA, 20 bp, Homo sapiens
ctgtaaaagttactaatata

SEQ ID NO: 4236593 - DNA, 18 bp, Homo sapiens
ctgtaatatcattttata

SEQ ID NO: 4236594 - DNA, 14 bp, Homo sapiens
ctgtcaggctggga

SEQ ID NO: 4236595 - DNA, 17 bp, Homo sapiens
ctgtgcctccaggacca

SEQ ID NO: 4236596 - DNA, 11 bp, Homo sapiens
ctgtttattat

SEQ ID NO: 4236597 - DNA, 18 bp, Homo sapiens
cttaaatagctttgagat

SEQ ID NO: 4236598 - DNA, 19 bp, Homo sapiens
cttaaatagctttgagatt

SEQ ID NO: 4236599 - DNA, 12 bp, Homo sapiens
cttaattttaga

SEQ ID NO: 4236600 - DNA, 16 bp, Homo sapiens
cttaattttagaaaga

SEQ ID NO: 4236601 - DNA, 20 bp, Homo sapiens
cttattactgcttgcagtaa

SEQ ID NO: 4236602 - DNA, 15 bp, Homo sapiens
cttatttaaaagatt

SEQ ID NO: 4236603 - DNA, 17 bp, Homo sapiens
cttatttaaaagatttt

SEQ ID NO: 4236604 - DNA, 20 bp, Homo sapiens
cttatttaaaagattttatg

SEQ ID NO: 4236605 - DNA, 20 bp, Homo sapiens
cttcagggaaggtgaaacag

SEQ ID NO: 4236606 - DNA, 22 bp, Homo sapiens
cttgatatctttcctccctctt

SEQ ID NO: 4236607 - DNA, 19 bp, Homo sapiens
cttgcagcagggctgggcc

SEQ ID NO: 4236608 - DNA, 15 bp, Homo sapiens
cttgcagtaattcaa

SEQ ID NO: 4236609 - DNA, 12 bp, Homo sapiens
cttggctgctca

SEQ ID NO: 4236610 - DNA, 13 bp, Homo sapiens
cttggctgctcac

SEQ ID NO: 4236611 - DNA, 20 bp, Homo sapiens
cttggctgctcactgtccac

SEQ ID NO: 4236612 - DNA, 16 bp, Homo sapiens
gaaaacatatgaaata

SEQ ID NO: 4236613 - DNA, 18 bp, Homo sapiens
gaaactatgatgtggaga

SEQ ID NO: 4236614 - DNA, 16 bp, Homo sapiens
gaaacttggctggaat

SEQ ID NO: 4236615 - DNA, 20 bp, Homo sapiens
gaaagaaaattatattctgt

SEQ ID NO: 4236616 - DNA, 15 bp, Homo sapiens
gaaagccatattttt

SEQ ID NO: 4236617 - DNA, 20 bp, Homo sapiens
gaaagtttgtagcatttttc

SEQ ID NO: 4236618 - DNA, 15 bp, Homo sapiens
gaaatataaattatc

SEQ ID NO: 4236619 - DNA, 20 bp, Homo sapiens
gaaatataaattatctgaat

SEQ ID NO: 4236620 - DNA, 14 bp, Homo sapiens
gaatgtaccttatt

SEQ ID NO: 4236621 - DNA, 22 bp, Homo sapiens
gaatgtaccttatttaaaagat

SEQ ID NO: 4236622 - DNA, 20 bp, Homo sapiens
gacaaatgaaagagaaaata

SEQ ID NO: 4236623 - DNA, 16 bp, Homo sapiens
gacattattaaagttt

SEQ ID NO: 4236624 - DNA, 20 bp, Homo sapiens
gacattattaaagttttcaa

SEQ ID NO: 4236625 - DNA, 21 bp, Homo sapiens
gacattattaaagttttcaaa

SEQ ID NO: 4236626 - DNA, 21 bp, Homo sapiens
gaccacccggcattctctgcc

SEQ ID NO: 4236627 - DNA, 20 bp, Homo sapiens
gacccctccctgcaggggct

SEQ ID NO: 4236628 - DNA, 20 bp, Homo sapiens
gacctggtacactctgattt

SEQ ID NO: 4236629 - DNA, 23 bp, Homo sapiens
gactatattttcccttattactg

SEQ ID NO: 4236630 - DNA, 18 bp, Homo sapiens
gacttaattttagaaaga

SEQ ID NO: 4236631 - DNA, 19 bp, Homo sapiens
gacttaattttagaaagaa

SEQ ID NO: 4236632 - DNA, 15 bp, Homo sapiens
gagaaatgattgaca

SEQ ID NO: 4236633 - DNA, 15 bp, Homo sapiens
gagaaattgaatgta

SEQ ID NO: 4236634 - DNA, 18 bp, Homo sapiens
gagaagatggccatgccc

SEQ ID NO: 4236635 - DNA, 23 bp, Homo sapiens
gagaaggctcacgaagggcatcc

SEQ ID NO: 4236636 - DNA, 17 bp, Homo sapiens
gagaccttggctgctca

SEQ ID NO: 4236637 - DNA, 14 bp, Homo sapiens
gaggccagtgttgt

SEQ ID NO: 4236638 - DNA, 17 bp, Homo sapiens
gagtaaactgtttctca

SEQ ID NO: 4236639 - DNA, 18 bp, Homo sapiens
gagtaaactgtttctcag

SEQ ID NO: 4236640 - DNA, 20 bp, Homo sapiens
gagtatttttataattttat

SEQ ID NO: 4236641 - DNA, 14 bp, Homo sapiens
gatatctttctcat

SEQ ID NO: 4236642 - DNA, 16 bp, Homo sapiens
gatcgttatctactga

SEQ ID NO: 4236643 - DNA, 15 bp, Homo sapiens
gattaataacctgcc

SEQ ID NO: 4236644 - DNA, 18 bp, Homo sapiens
gcaacctggctctggccc

SEQ ID NO: 4236645 - DNA, 18 bp, Homo sapiens
cttccaggatcaggggtt

SEQ ID NO: 4236646 - DNA, 16 bp, Homo sapiens
cttccatgtcaggcca

SEQ ID NO: 4236647 - DNA, 18 bp, Homo sapiens
cttccatgtcaggccagc

SEQ ID NO: 4236648 - DNA, 16 bp, Homo sapiens
cttcctgctgggactg

SEQ ID NO: 4236649 - DNA, 21 bp, Homo sapiens
cttcttccaggatcaggggtt

SEQ ID NO: 4236650 - DNA, 12 bp, Homo sapiens
cttgcagcaggg

SEQ ID NO: 4236651 - DNA, 18 bp, Homo sapiens
cttgcagcagggctgggc

SEQ ID NO: 4236652 - DNA, 20 bp, Homo sapiens
cttgcagcagggctgggcct

SEQ ID NO: 4236653 - DNA, 22 bp, Homo sapiens
cttgcagcagggctgggcctgc

SEQ ID NO: 4236654 - DNA, 15 bp, Homo sapiens
cttgcttagcctgtg

SEQ ID NO: 4236655 - DNA, 11 bp, Homo sapiens
cttggctgggc

SEQ ID NO: 4236656 - DNA, 16 bp, Homo sapiens
cttgtccctccaactg

SEQ ID NO: 4236657 - DNA, 17 bp, Homo sapiens
cttttgcccacctcttc

SEQ ID NO: 4236658 - DNA, 20 bp, Homo sapiens
gaaaacatatgaaatataaa

SEQ ID NO: 4236659 - DNA, 22 bp, Homo sapiens
gaaaacatatgaaatataaatt

SEQ ID NO: 4236660 - DNA, 14 bp, Homo sapiens
gaaacttggctgga

SEQ ID NO: 4236661 - DNA, 23 bp, Homo sapiens
gaaacttggctggaatttctgct

SEQ ID NO: 4236662 - DNA, 15 bp, Homo sapiens
gaaagaaaattatat

SEQ ID NO: 4236663 - DNA, 16 bp, Homo sapiens
gaaagagaaaatatat

SEQ ID NO: 4236664 - DNA, 22 bp, Homo sapiens
gaaagccatatttttttctgta

SEQ ID NO: 4236665 - DNA, 16 bp, Homo sapiens
gaaatataaattatct

SEQ ID NO: 4236666 - DNA, 18 bp, Homo sapiens
gaaatataaattatctga

SEQ ID NO: 4236667 - DNA, 22 bp, Homo sapiens
gaaatggccattgagctgtttc

SEQ ID NO: 4236668 - DNA, 18 bp, Homo sapiens
gaagctgtcaggctggga

SEQ ID NO: 4236669 - DNA, 23 bp, Homo sapiens
gaatattagatgctctgagaaat

SEQ ID NO: 4236670 - DNA, 23 bp, Homo sapiens
gacaaatgaaagagaaaatatat

SEQ ID NO: 4236671 - DNA, 16 bp, Homo sapiens
gaccagctggcctggg

SEQ ID NO: 4236672 - DNA, 15 bp, Homo sapiens
gacccagatgtgacg

SEQ ID NO: 4236673 - DNA, 15 bp, Homo sapiens
gacccctcagctccc

SEQ ID NO: 4236674 - DNA, 20 bp, Homo sapiens
gaccgcctgccctgcctggg

SEQ ID NO: 4236675 - DNA, 16 bp, Homo sapiens
gactccatagctcctt

SEQ ID NO: 4236676 - DNA, 17 bp, Homo sapiens
gagcccccacgctggcc

SEQ ID NO: 4236677 - DNA, 14 bp, Homo sapiens
gagctgcctcctgg

SEQ ID NO: 4236678 - DNA, 14 bp, Homo sapiens
gagctgtttcctca

SEQ ID NO: 4236679 - DNA, 22 bp, Homo sapiens
gaggaagctggacagcggcagt

SEQ ID NO: 4236680 - DNA, 15 bp, Homo sapiens
gagtaaactgtttct

SEQ ID NO: 4236681 - DNA, 20 bp, Homo sapiens
gagttctcctggaggcaggg

SEQ ID NO: 4236682 - DNA, 13 bp, Homo sapiens
gatataagatttg

SEQ ID NO: 4236683 - DNA, 15 bp, Homo sapiens
gatataagatttgta

SEQ ID NO: 4236684 - DNA, 23 bp, Homo sapiens
gattaataacctgccagtcccag

SEQ ID NO: 4236685 - DNA, 18 bp, Homo sapiens
gattctgtgcctccagga

SEQ ID NO: 4236686 - DNA, 14 bp, Homo sapiens
gattttagataaag

SEQ ID NO: 4236687 - DNA, 16 bp, Homo sapiens
gcactgcagtctgcag

SEQ ID NO: 4236688 - DNA, 18 bp, Homo sapiens
gcagagttctcctggagg

SEQ ID NO: 4236689 - DNA, 21 bp, Homo sapiens
gcagagttctcctggaggcag

SEQ ID NO: 4236690 - DNA, 20 bp, Homo sapiens
gcagcctctaactcctgggc

SEQ ID NO: 4236691 - DNA, 14 bp, Homo sapiens
gcaggcaggctggg

SEQ ID NO: 4236692 - DNA, 16 bp, Homo sapiens
gcagtaattcaactgg

SEQ ID NO: 4236693 - DNA, 13 bp, Homo sapiens
gcattctctgccc

SEQ ID NO: 4236694 - DNA, 19 bp, Homo sapiens
gccagtgttgtgggcttcc

SEQ ID NO: 4236695 - DNA, 21 bp, Homo sapiens
gccagtttctctgccttcttc

SEQ ID NO: 4236696 - DNA, 20 bp, Homo sapiens
gccatatttttttctgtaaa

SEQ ID NO: 4236697 - DNA, 17 bp, Homo sapiens
gcccaccctctgcccag

SEQ ID NO: 4236698 - DNA, 18 bp, Homo sapiens
gcccaccctctgcccagg

SEQ ID NO: 4236699 - DNA, 16 bp, Homo sapiens
gccctgcctgggcctt

SEQ ID NO: 4236700 - DNA, 19 bp, Homo sapiens
gccctggctccttgcagca

SEQ ID NO: 4236701 - DNA, 19 bp, Homo sapiens
gcctccaggaccaggggcc

SEQ ID NO: 4236702 - DNA, 15 bp, Homo sapiens
gcctctcagacccag

SEQ ID NO: 4236703 - DNA, 14 bp, Homo sapiens
gcctgcgagaccca

SEQ ID NO: 4236704 - DNA, 15 bp, Homo sapiens
gcctgcgagacccaa

SEQ ID NO: 4236705 - DNA, 17 bp, Homo sapiens
gcctgctgaggccttct

SEQ ID NO: 4236706 - DNA, 18 bp, Homo sapiens
gcctgctgaggccttctc

SEQ ID NO: 4236707 - DNA, 13 bp, Homo sapiens
gccttggctgggc

SEQ ID NO: 4236708 - DNA, 14 bp, Homo sapiens
gccttggctgggcc

SEQ ID NO: 4236709 - DNA, 14 bp, Homo sapiens
gcgagggcagcacc

SEQ ID NO: 4236710 - DNA, 21 bp, Homo sapiens
gcgattatagcccggtgcagc

SEQ ID NO: 4236711 - DNA, 15 bp, Homo sapiens
gcggcagtgggcctg

SEQ ID NO: 4236712 - DNA, 18 bp, Homo sapiens
gctacgttagcagcccag

SEQ ID NO: 4236713 - DNA, 12 bp, Homo sapiens
gctagaggcttt

SEQ ID NO: 4236714 - DNA, 20 bp, Homo sapiens
gctagagtgcagtggtgcga

SEQ ID NO: 4236715 - DNA, 19 bp, Homo sapiens
gctatgctagaggctttta

SEQ ID NO: 4236716 - DNA, 21 bp, Homo sapiens
gctatttatattcattcagat

SEQ ID NO: 4236717 - DNA, 17 bp, Homo sapiens
gctccccggcactgcag

SEQ ID NO: 4236718 - DNA, 20 bp, Homo sapiens
gctcctgacccctccctgca

SEQ ID NO: 4236719 - DNA, 21 bp, Homo sapiens
gctcctgacccctccctgcag

SEQ ID NO: 4236720 - DNA, 17 bp, Homo sapiens
gctctgagaaattgaat

SEQ ID NO: 4236721 - DNA, 17 bp, Homo sapiens
gctctgggggtcccttg

SEQ ID NO: 4236722 - DNA, 20 bp, Homo sapiens
gctgaggccttctcttgagg

SEQ ID NO: 4236723 - DNA, 22 bp, Homo sapiens
gctggacagcggcagtgggcct

SEQ ID NO: 4236724 - DNA, 12 bp, Homo sapiens
gctgggcctctg

SEQ ID NO: 4236725 - DNA, 13 bp, Homo sapiens
gctgggcctctgg

SEQ ID NO: 4236726 - DNA, 14 bp, Homo sapiens
gctgtaatatcatt

SEQ ID NO: 4236727 - DNA, 16 bp, Homo sapiens
gctgtcaggctgggac

SEQ ID NO: 4236728 - DNA, 22 bp, Homo sapiens
gctgtggtctataaaataaact

SEQ ID NO: 4236729 - DNA, 15 bp, Homo sapiens
gcttagcctgtgctg

SEQ ID NO: 4236730 - DNA, 14 bp, Homo sapiens
gctttgagatttca

SEQ ID NO: 4236731 - DNA, 23 bp, Homo sapiens
ggaaaacatatgaaatataaatt

SEQ ID NO: 4236732 - DNA, 23 bp, Homo sapiens
ggaaatggccattgagctgtttc

SEQ ID NO: 4236733 - DNA, 14 bp, Homo sapiens
ggaaggtgaaacag

SEQ ID NO: 4236734 - DNA, 14 bp, Homo sapiens
ggaggcaggggctg

SEQ ID NO: 4236735 - DNA, 21 bp, Homo sapiens
ggatgagtaaactgtttctca

SEQ ID NO: 4236736 - DNA, 22 bp, Homo sapiens
ggatgagtaaactgtttctcag

SEQ ID NO: 4236737 - DNA, 23 bp, Homo sapiens
ggattctgtgcctccaggaccag

SEQ ID NO: 4236738 - DNA, 21 bp, Homo sapiens
ggcagatgtctcccctgccac

SEQ ID NO: 4236739 - DNA, 22 bp, Homo sapiens
ggcagcaaaacaagtgacatga

SEQ ID NO: 4236740 - DNA, 17 bp, Homo sapiens
ggcaggggctgctgcct

SEQ ID NO: 4236741 - DNA, 18 bp, Homo sapiens
ggccattgagctgtttcc

SEQ ID NO: 4236742 - DNA, 14 bp, Homo sapiens
ggcccaccctctgc

SEQ ID NO: 4236743 - DNA, 15 bp, Homo sapiens
ggcccaccctctgcc

SEQ ID NO: 4236744 - DNA, 19 bp, Homo sapiens
ggcccaccctctgcccagg

SEQ ID NO: 4236745 - DNA, 15 bp, Homo sapiens
ggcctctcagaccca

SEQ ID NO: 4236746 - DNA, 21 bp, Homo sapiens
ggcctctggttctgacacttt

SEQ ID NO: 4236747 - DNA, 15 bp, Homo sapiens
ggcctgctgaggcct

SEQ ID NO: 4236748 - DNA, 19 bp, Homo sapiens
ggcctggggtccctctgaa

SEQ ID NO: 4236749 - DNA, 16 bp, Homo sapiens
ggctccttgcagcagg

SEQ ID NO: 4236750 - DNA, 19 bp, Homo sapiens
ggctccttgcagcagggct

SEQ ID NO: 4236751 - DNA, 16 bp, Homo sapiens
ggctggaatttctgct

SEQ ID NO: 4236752 - DNA, 22 bp, Homo sapiens
ggctgggcctctggttctgaca

SEQ ID NO: 4236753 - DNA, 16 bp, Homo sapiens
ggctggggaggccagt

SEQ ID NO: 4236754 - DNA, 23 bp, Homo sapiens
ggctttcagtgatatctttctca

SEQ ID NO: 4236755 - DNA, 16 bp, Homo sapiens
gggcccaccctctgcc

SEQ ID NO: 4236756 - DNA, 12 bp, Homo sapiens
gggctgctgcct

SEQ ID NO: 4236757 - DNA, 13 bp, Homo sapiens
gggctgctgcctt

SEQ ID NO: 4236758 - DNA, 22 bp, Homo sapiens
gggctgggcctgcgagacccaa

SEQ ID NO: 4236759 - DNA, 13 bp, Homo sapiens
gggtgtgtggccc

SEQ ID NO: 4236760 - DNA, 13 bp, Homo sapiens
ggtctataaaata

SEQ ID NO: 4236761 - DNA, 21 bp, Homo sapiens
ggtctataaaataaacttctt

SEQ ID NO: 4236762 - DNA, 22 bp, Homo sapiens
ggtgtgtggcccgaggaagctg

SEQ ID NO: 4236763 - DNA, 22 bp, Homo sapiens
ggttaatttatccatgctggca

SEQ ID NO: 4236764 - DNA, 16 bp, Homo sapiens
gtaaaagttactaata

SEQ ID NO: 4236765 - DNA, 20 bp, Homo sapiens
gtaaaagttactaatatatc

SEQ ID NO: 4236766 - DNA, 16 bp, Homo sapiens
gtaaactgtttctcag

SEQ ID NO: 4236767 - DNA, 15 bp, Homo sapiens
gtaacactattacag

SEQ ID NO: 4236768 - DNA, 17 bp, Homo sapiens
gtaacactattacagta

SEQ ID NO: 4236769 - DNA, 21 bp, Homo sapiens
gtaacctgctggatgggactc

SEQ ID NO: 4236770 - DNA, 21 bp, Homo sapiens
gtaccttatttaaaagatttt

SEQ ID NO: 4236771 - DNA, 15 bp, Homo sapiens
gtactaaaagaaact

SEQ ID NO: 4236772 - DNA, 21 bp, Homo sapiens
gtactaaaagaaactatgatg

SEQ ID NO: 4236773 - DNA, 13 bp, Homo sapiens
gtataagctgtaa

SEQ ID NO: 4236774 - DNA, 22 bp, Homo sapiens
gtatgacttaattttagaaaga

SEQ ID NO: 4236775 - DNA, 22 bp, Homo sapiens
gtatttttataattttatctgt

SEQ ID NO: 4236776 - DNA, 13 bp, Homo sapiens
gtcagcaggcagg

SEQ ID NO: 4236777 - DNA, 15 bp, Homo sapiens
gtcaggctgggacag

SEQ ID NO: 4236778 - DNA, 16 bp, Homo sapiens
gtcctccagcctcggc

SEQ ID NO: 4236779 - DNA, 17 bp, Homo sapiens
gtctataaaataaactt

SEQ ID NO: 4236780 - DNA, 21 bp, Homo sapiens
gtctataaaataaacttctta

SEQ ID NO: 4236781 - DNA, 24 bp, Homo sapiens
gtctataaaataaacttcttaaca

SEQ ID NO: 4236782 - DNA, 18 bp, Homo sapiens
gtcttcccgcaaggcctc

SEQ ID NO: 4236783 - DNA, 19 bp, Homo sapiens
gtcttcccgcaaggcctct

SEQ ID NO: 4236784 - DNA, 16 bp, Homo sapiens
gtgactaattttgcca

SEQ ID NO: 4236785 - DNA, 19 bp, Homo sapiens
gtgagcccccacgctggcc

SEQ ID NO: 4236786 - DNA, 13 bp, Homo sapiens
gtgatatctttct

SEQ ID NO: 4236787 - DNA, 22 bp, Homo sapiens
gtgatatctttctcattaccag

SEQ ID NO: 4236788 - DNA, 18 bp, Homo sapiens
gtgccctggctccttgca

SEQ ID NO: 4236789 - DNA, 23 bp, Homo sapiens
gtgccctggctccttgcagcagg

SEQ ID NO: 4236790 - DNA, 15 bp, Homo sapiens
gtgcctccaggacca

SEQ ID NO: 4236791 - DNA, 15 bp, Homo sapiens
gtgctctgggggtcc

SEQ ID NO: 4236792 - DNA, 17 bp, Homo sapiens
gtggcccgaggaagctg

SEQ ID NO: 4236793 - DNA, 22 bp, Homo sapiens
gtgggtcgaggattctgtgcct

SEQ ID NO: 4236794 - DNA, 21 bp, Homo sapiens
gtggtctataaaataaacttc

SEQ ID NO: 4236795 - DNA, 13 bp, Homo sapiens
gtgtggagtattt

SEQ ID NO: 4236796 - DNA, 17 bp, Homo sapiens
gtgttgtgggcttcctg

SEQ ID NO: 4236797 - DNA, 20 bp, Homo sapiens
gtgttgtgggcttcctgctg

SEQ ID NO: 4236798 - DNA, 19 bp, Homo sapiens
gttactaatatatctgtaa

SEQ ID NO: 4236799 - DNA, 15 bp, Homo sapiens
gttgtgggcttcctg

SEQ ID NO: 4236800 - DNA, 18 bp, Homo sapiens
gttgtgggcttcctgctg

SEQ ID NO: 4236801 - DNA, 22 bp, Homo sapiens
gtttcaccttccatgtcaggcc

SEQ ID NO: 4236802 - DNA, 20 bp, Homo sapiens
gtttcactgagagctgcctc

SEQ ID NO: 4236803 - DNA, 23 bp, Homo sapiens
gtttcactgagagctgcctcctg

SEQ ID NO: 4236804 - DNA, 11 bp, Homo sapiens
taaaagatttt

SEQ ID NO: 4236805 - DNA, 15 bp, Homo sapiens
taaaagttactaata

SEQ ID NO: 4236806 - DNA, 22 bp, Homo sapiens
taaaagttactaatatatctgt

SEQ ID NO: 4236807 - DNA, 12 bp, Homo sapiens
taaaataaactt

SEQ ID NO: 4236808 - DNA, 15 bp, Homo sapiens
taaaataaacttctt

SEQ ID NO: 4236809 - DNA, 17 bp, Homo sapiens
taaaataaacttcttaa

SEQ ID NO: 4236810 - DNA, 12 bp, Homo sapiens
taaactgtttct

SEQ ID NO: 4236811 - DNA, 20 bp, Homo sapiens
taaactgtttctcaggcact

SEQ ID NO: 4236812 - DNA, 14 bp, Homo sapiens
taaatgacattatt

SEQ ID NO: 4236813 - DNA, 18 bp, Homo sapiens
taaatgacattattaaag

SEQ ID NO: 4236814 - DNA, 12 bp, Homo sapiens
taaattatctga

SEQ ID NO: 4236815 - DNA, 13 bp, Homo sapiens
taaattatctgaa

SEQ ID NO: 4236816 - DNA, 16 bp, Homo sapiens
taaattatctgaatat

SEQ ID NO: 4236817 - DNA, 16 bp, Homo sapiens
taacactattacagta

SEQ ID NO: 4236818 - DNA, 16 bp, Homo sapiens
taacctgccagtccca

SEQ ID NO: 4236819 - DNA, 16 bp, Homo sapiens
taacttaaatagcttt

SEQ ID NO: 4236820 - DNA, 17 bp, Homo sapiens
taacttttcttgatatc

SEQ ID NO: 4236821 - DNA, 16 bp, Homo sapiens
taagatttgtacatat

SEQ ID NO: 4236822 - DNA, 17 bp, Homo sapiens
taagatttgtacatatt

SEQ ID NO: 4236823 - DNA, 21 bp, Homo sapiens
taagatttgtacatattatca

SEQ ID NO: 4236824 - DNA, 14 bp, Homo sapiens
taatatatctgtaa

SEQ ID NO: 4236825 - DNA, 15 bp, Homo sapiens
taatatatctgtaac

SEQ ID NO: 4236826 - DNA, 18 bp, Homo sapiens
taatatcattttatagaa

SEQ ID NO: 4236827 - DNA, 22 bp, Homo sapiens
taatgttggaaaacatatgaaa

SEQ ID NO: 4236828 - DNA, 13 bp, Homo sapiens
taattttagaaag

SEQ ID NO: 4236829 - DNA, 16 bp, Homo sapiens
taattttagaaagaaa

SEQ ID NO: 4236830 - DNA, 15 bp, Homo sapiens
taattttatctgtat

SEQ ID NO: 4236831 - DNA, 16 bp, Homo sapiens
taattttatctgtata

SEQ ID NO: 4236832 - DNA, 17 bp, Homo sapiens
taattttatctgtataa

SEQ ID NO: 4236833 - DNA, 21 bp, Homo sapiens
taattttatctgtataagctg

SEQ ID NO: 4236834 - DNA, 20 bp, Homo sapiens
tacagtattgctatttatat

SEQ ID NO: 4236835 - DNA, 16 bp, Homo sapiens
taccagtgactaattt

SEQ ID NO: 4236836 - DNA, 17 bp, Homo sapiens
tactaatatatctgtaa

SEQ ID NO: 4236837 - DNA, 17 bp, Homo sapiens
tactgcttgcagtaatt

SEQ ID NO: 4236838 - DNA, 12 bp, Homo sapiens
tagaaagaaaat

SEQ ID NO: 4236839 - DNA, 15 bp, Homo sapiens
tagaaagaaaattat

SEQ ID NO: 4236840 - DNA, 21 bp, Homo sapiens
tagaaagaaaattatattctg

SEQ ID NO: 4236841 - DNA, 22 bp, Homo sapiens
tagaaagccatatttttttctg

SEQ ID NO: 4236842 - DNA, 15 bp, Homo sapiens
tagaggcttttatta

SEQ ID NO: 4236843 - DNA, 16 bp, Homo sapiens
tagcatttttctaata

SEQ ID NO: 4236844 - DNA, 14 bp, Homo sapiens
taggtccctgacat

SEQ ID NO: 4236845 - DNA, 13 bp, Homo sapiens
tataaaataaact

SEQ ID NO: 4236846 - DNA, 15 bp, Homo sapiens
tataaaataaacttc

SEQ ID NO: 4236847 - DNA, 16 bp, Homo sapiens
tataaaataaacttct

SEQ ID NO: 4236848 - DNA, 18 bp, Homo sapiens
tataaaataaacttctta

SEQ ID NO: 4236849 - DNA, 16 bp, Homo sapiens
tataaatgacattatt

SEQ ID NO: 4236850 - DNA, 16 bp, Homo sapiens
tataaattatctgaat

SEQ ID NO: 4236851 - DNA, 14 bp, Homo sapiens
tataactatataaa

SEQ ID NO: 4236852 - DNA, 23 bp, Homo sapiens
tataactatataaatgacattat

SEQ ID NO: 4236853 - DNA, 21 bp, Homo sapiens
tataagatttgtacatattat

SEQ ID NO: 4236854 - DNA, 13 bp, Homo sapiens
tataagctgtaat

SEQ ID NO: 4236855 - DNA, 16 bp, Homo sapiens
tataagctgtaatatc

SEQ ID NO: 4236856 - DNA, 14 bp, Homo sapiens
tataattttatctg

SEQ ID NO: 4236857 - DNA, 16 bp, Homo sapiens
tataattttatctgta

SEQ ID NO: 4236858 - DNA, 17 bp, Homo sapiens
tataattttatctgtat

SEQ ID NO: 4236859 - DNA, 16 bp, Homo sapiens
tatagcccggtgcagc

SEQ ID NO: 4236860 - DNA, 17 bp, Homo sapiens
tatatctgtaacactat

SEQ ID NO: 4236861 - DNA, 19 bp, Homo sapiens
tatattctgtttattatga

SEQ ID NO: 4236862 - DNA, 22 bp, Homo sapiens
tatattttcccttattactgct

SEQ ID NO: 4236863 - DNA, 17 bp, Homo sapiens
tatctactgactatatt

SEQ ID NO: 4236864 - DNA, 17 bp, Homo sapiens
tatctgtaacactatta

SEQ ID NO: 4236865 - DNA, 20 bp, Homo sapiens
tatgaaatataaattatctg

SEQ ID NO: 4236866 - DNA, 21 bp, Homo sapiens
tatgaaatataaattatctga

SEQ ID NO: 4236867 - DNA, 14 bp, Homo sapiens
tatgacaaatgaaa

SEQ ID NO: 4236868 - DNA, 18 bp, Homo sapiens
tatgacaaatgaaagaga

SEQ ID NO: 4236869 - DNA, 21 bp, Homo sapiens
tatgacaaatgaaagagaaaa

SEQ ID NO: 4236870 - DNA, 23 bp, Homo sapiens
tatgacaaatgaaagagaaaata

SEQ ID NO: 4236871 - DNA, 19 bp, Homo sapiens
tatgacttaattttagaaa

SEQ ID NO: 4236872 - DNA, 22 bp, Homo sapiens
tatgacttaattttagaaagaa

SEQ ID NO: 4236873 - DNA, 12 bp, Homo sapiens
tattacagtatt

SEQ ID NO: 4236874 - DNA, 21 bp, Homo sapiens
tattactgcttgcagtaattc

SEQ ID NO: 4236875 - DNA, 18 bp, Homo sapiens
tattagaaagccatattt

SEQ ID NO: 4236876 - DNA, 19 bp, Homo sapiens
tattagatgctctgagaaa

SEQ ID NO: 4236877 - DNA, 22 bp, Homo sapiens
tattagatgctctgagaaattg

SEQ ID NO: 4236878 - DNA, 23 bp, Homo sapiens
tattagatgctctgagaaattga

SEQ ID NO: 4236879 - DNA, 19 bp, Homo sapiens
tattctagaggtctctctg

SEQ ID NO: 4236880 - DNA, 13 bp, Homo sapiens
tattgctatttat

SEQ ID NO: 4236881 - DNA, 14 bp, Homo sapiens
tatttaaaagattt

SEQ ID NO: 4236882 - DNA, 12 bp, Homo sapiens
tatttatattca

SEQ ID NO: 4236883 - DNA, 19 bp, Homo sapiens
tatttatattcattcagat

SEQ ID NO: 4236884 - DNA, 12 bp, Homo sapiens
tatttttataat

SEQ ID NO: 4236885 - DNA, 10 bp, Homo sapiens
tcaaattatt

SEQ ID NO: 4236886 - DNA, 22 bp, Homo sapiens
tcaattgtttaatgttggaaaa

SEQ ID NO: 4236887 - DNA, 22 bp, Homo sapiens
tcacagctgcaggccacgccca

SEQ ID NO: 4236888 - DNA, 18 bp, Homo sapiens
tcagcaggcaggctgggg

SEQ ID NO: 4236889 - DNA, 18 bp, Homo sapiens
tcattcagatataagatt

SEQ ID NO: 4236890 - DNA, 21 bp, Homo sapiens
tccaagtgatcctcccacctc

SEQ ID NO: 4236891 - DNA, 16 bp, Homo sapiens
tccaagttgctgcagc

SEQ ID NO: 4236892 - DNA, 14 bp, Homo sapiens
tcccgcaaggcctc

SEQ ID NO: 4236893 - DNA, 16 bp, Homo sapiens
tcccgcaaggcctctc

SEQ ID NO: 4236894 - DNA, 18 bp, Homo sapiens
tcccgcaaggcctctcag

SEQ ID NO: 4236895 - DNA, 11 bp, Homo sapiens
tccctccaact

SEQ ID NO: 4236896 - DNA, 11 bp, Homo sapiens
tcctcccacct

SEQ ID NO: 4236897 - DNA, 14 bp, Homo sapiens
tcctctctggcctt

SEQ ID NO: 4236898 - DNA, 15 bp, Homo sapiens
tcctgctgggactga

SEQ ID NO: 4236899 - DNA, 14 bp, Homo sapiens
tcctggaggcaggg

SEQ ID NO: 4236900 - DNA, 16 bp, Homo sapiens
tcctggaggcaggggc

SEQ ID NO: 4236901 - DNA, 22 bp, Homo sapiens
tcctggaggcaggggctgctgc

SEQ ID NO: 4236902 - DNA, 16 bp, Homo sapiens
tccttcccaggacccc

SEQ ID NO: 4236903 - DNA, 14 bp, Homo sapiens
tccttgcagcaggg

SEQ ID NO: 4236904 - DNA, 19 bp, Homo sapiens
tcgaagtcttccccagtta

SEQ ID NO: 4236905 - DNA, 23 bp, Homo sapiens
tcgaggattctgtgcctccagga

SEQ ID NO: 4236906 - DNA, 14 bp, Homo sapiens
tcgttatctactga

SEQ ID NO: 4236907 - DNA, 16 bp, Homo sapiens
tctaacttaaatagct

SEQ ID NO: 4236908 - DNA, 17 bp, Homo sapiens
tctaggtggcaggacaa

SEQ ID NO: 4236909 - DNA, 21 bp, Homo sapiens
tctataaaataaacttcttaa

SEQ ID NO: 4236910 - DNA, 16 bp, Homo sapiens
tctcagacccagatgt

SEQ ID NO: 4236911 - DNA, 11 bp, Homo sapiens
tctcccctgcc

SEQ ID NO: 4236912 - DNA, 15 bp, Homo sapiens
tctgaatattagatg

SEQ ID NO: 4236913 - DNA, 23 bp, Homo sapiens
tctgctggaagctgtcaggctgg

SEQ ID NO: 4236914 - DNA, 15 bp, Homo sapiens
tctggttctgacact

SEQ ID NO: 4236915 - DNA, 16 bp, Homo sapiens
tctgtaaaagttacta

SEQ ID NO: 4236916 - DNA, 18 bp, Homo sapiens
tctgtaaaagttactaat

SEQ ID NO: 4236917 - DNA, 19 bp, Homo sapiens
tctgtaaaagttactaata

SEQ ID NO: 4236918 - DNA, 14 bp, Homo sapiens
tctgtaacactatt

SEQ ID NO: 4236919 - DNA, 14 bp, Homo sapiens
tctgtgcctccagg

SEQ ID NO: 4236920 - DNA, 20 bp, Homo sapiens
tctgtgcctccaggaccagg

SEQ ID NO: 4236921 - DNA, 18 bp, Homo sapiens
tcttgaggcctgtgctct

SEQ ID NO: 4236922 - DNA, 18 bp, Homo sapiens
tgaaagagaaaatatata

SEQ ID NO: 4236923 - DNA, 18 bp, Homo sapiens
tgaaagagaagatggcca

SEQ ID NO: 4236924 - DNA, 13 bp, Homo sapiens
tgaaatataaatt

SEQ ID NO: 4236925 - DNA, 14 bp, Homo sapiens
tgaaatataaatta

SEQ ID NO: 4236926 - DNA, 22 bp, Homo sapiens
tgaactttttctaggtggcagg

SEQ ID NO: 4236927 - DNA, 15 bp, Homo sapiens
tgaatattagatgct

SEQ ID NO: 4236928 - DNA, 17 bp, Homo sapiens
tgaatgtaccttattta

SEQ ID NO: 4236929 - DNA, 20 bp, Homo sapiens
tgaatgtaccttatttaaaa

SEQ ID NO: 4236930 - DNA, 16 bp, Homo sapiens
tgacaaatgaaagaga

SEQ ID NO: 4236931 - DNA, 16 bp, Homo sapiens
tgacggggtgtgtggc

SEQ ID NO: 4236932 - DNA, 16 bp, Homo sapiens
tgactcataggtccct

SEQ ID NO: 4236933 - DNA, 14 bp, Homo sapiens
tgacttaattttag

SEQ ID NO: 4236934 - DNA, 19 bp, Homo sapiens
tgacttaattttagaaaga

SEQ ID NO: 4236935 - DNA, 22 bp, Homo sapiens
tgacttcagggaaggtgaaaca

SEQ ID NO: 4236936 - DNA, 12 bp, Homo sapiens
tgagctgtttcc

SEQ ID NO: 4236937 - DNA, 13 bp, Homo sapiens
tgaggcctgtgct

SEQ ID NO: 4236938 - DNA, 16 bp, Homo sapiens
tgagtaaactgtttct

SEQ ID NO: 4236939 - DNA, 19 bp, Homo sapiens
tgagtaaactgtttctcag

SEQ ID NO: 4236940 - DNA, 23 bp, Homo sapiens
tgatgtggagaaaggactaacat

SEQ ID NO: 4236941 - DNA, 14 bp, Homo sapiens
tgatttcctctaaa

SEQ ID NO: 4236942 - DNA, 15 bp, Homo sapiens
tgatttcctctaaag

SEQ ID NO: 4236943 - DNA, 12 bp, Homo sapiens
tgcagcagggct

SEQ ID NO: 4236944 - DNA, 17 bp, Homo sapiens
tgcagcagggctgggcc

SEQ ID NO: 4236945 - DNA, 13 bp, Homo sapiens
tgcagtctgcaga

SEQ ID NO: 4236946 - DNA, 15 bp, Homo sapiens
tgcattatttagtca

SEQ ID NO: 4236947 - DNA, 18 bp, Homo sapiens
tgccacagggtactaaaa

SEQ ID NO: 4236948 - DNA, 16 bp, Homo sapiens
tgccatatttttctgt

SEQ ID NO: 4236949 - DNA, 18 bp, Homo sapiens
tgcccagggagtccttgc

SEQ ID NO: 4236950 - DNA, 15 bp, Homo sapiens
tgccccaggccctgc

SEQ ID NO: 4236951 - DNA, 14 bp, Homo sapiens
tgccctgcctgggc

SEQ ID NO: 4236952 - DNA, 17 bp, Homo sapiens
tgccctgcctgggcctt

SEQ ID NO: 4236953 - DNA, 20 bp, Homo sapiens
tgcctgggccttggctgggc

SEQ ID NO: 4236954 - DNA, 22 bp, Homo sapiens
tgcctgggccttggctgggcct

SEQ ID NO: 4236955 - DNA, 16 bp, Homo sapiens
tgccttactaaatatg

SEQ ID NO: 4236956 - DNA, 21 bp, Homo sapiens
tgccttactaaatatgggaat

SEQ ID NO: 4236957 - DNA, 22 bp, Homo sapiens
tgccttccaggaaatgggcttt

SEQ ID NO: 4236958 - DNA, 22 bp, Homo sapiens
tgcgattatagcccggtgcagc

SEQ ID NO: 4236959 - DNA, 13 bp, Homo sapiens
tgctctgagaaat

SEQ ID NO: 4236960 - DNA, 20 bp, Homo sapiens
tgctctgagaaattgaatgt

SEQ ID NO: 4236961 - DNA, 12 bp, Homo sapiens
tgctgaggcctt

SEQ ID NO: 4236962 - DNA, 15 bp, Homo sapiens
tgctgatgtttcctg

SEQ ID NO: 4236963 - DNA, 19 bp, Homo sapiens
tgctggaagctgtcaggct

SEQ ID NO: 4236964 - DNA, 16 bp, Homo sapiens
tgctggaccagctggc

SEQ ID NO: 4236965 - DNA, 15 bp, Homo sapiens
tgctggatgggactc

SEQ ID NO: 4236966 - DNA, 15 bp, Homo sapiens
tgctggcagaggcac

SEQ ID NO: 4236967 - DNA, 22 bp, Homo sapiens
tggaaaacatatgaaatataaa

SEQ ID NO: 4236968 - DNA, 17 bp, Homo sapiens
tggaagccctgtctgtt

SEQ ID NO: 4236969 - DNA, 14 bp, Homo sapiens
tggaatttctgctg

SEQ ID NO: 4236970 - DNA, 17 bp, Homo sapiens
tggacagcggcagtggg

SEQ ID NO: 4236971 - DNA, 16 bp, Homo sapiens
tggatcgttatctact

SEQ ID NO: 4236972 - DNA, 19 bp, Homo sapiens
tggatgagtaaactgtttc

SEQ ID NO: 4236973 - DNA, 20 bp, Homo sapiens
tggatgagtaaactgtttct

SEQ ID NO: 4236974 - DNA, 22 bp, Homo sapiens
tggatgagtaaactgtttctca

SEQ ID NO: 4236975 - DNA, 22 bp, Homo sapiens
tggatgggactccatagctcct

SEQ ID NO: 4236976 - DNA, 17 bp, Homo sapiens
tggcccgaggaagctgg

SEQ ID NO: 4236977 - DNA, 14 bp, Homo sapiens
tggctgggcctctg

SEQ ID NO: 4236978 - DNA, 16 bp, Homo sapiens
tgggactgagaaggct

SEQ ID NO: 4236979 - DNA, 21 bp, Homo sapiens
tgggcctgctgaggccttctc

SEQ ID NO: 4236980 - DNA, 15 bp, Homo sapiens
tgggccttggctggg

SEQ ID NO: 4236981 - DNA, 14 bp, Homo sapiens
tgggcttcctgctg

SEQ ID NO: 4236982 - DNA, 16 bp, Homo sapiens
tggggcagatgtctcc

SEQ ID NO: 4236983 - DNA, 17 bp, Homo sapiens
tggggcagatgtctccc

SEQ ID NO: 4236984 - DNA, 13 bp, Homo sapiens
tggggctcctgga

SEQ ID NO: 4236985 - DNA, 22 bp, Homo sapiens
tggtctataaaataaacttctt

SEQ ID NO: 4236986 - DNA, 18 bp, Homo sapiens
tgtaaaagttactaatat

SEQ ID NO: 4236987 - DNA, 21 bp, Homo sapiens
tgtaaaagttactaatatatc

SEQ ID NO: 4236988 - DNA, 22 bp, Homo sapiens
tgtaaaagttactaatatatct

SEQ ID NO: 4236989 - DNA, 15 bp, Homo sapiens
tgtaacactattaca

SEQ ID NO: 4236990 - DNA, 23 bp, Homo sapiens
tgtaacactattacagtattgct

SEQ ID NO: 4236991 - DNA, 16 bp, Homo sapiens
tgtaagaacaatgcca

SEQ ID NO: 4236992 - DNA, 20 bp, Homo sapiens
tgtaagaacaatgccagggc

SEQ ID NO: 4236993 - DNA, 16 bp, Homo sapiens
tgtcacaccctgactt

SEQ ID NO: 4236994 - DNA, 20 bp, Homo sapiens
tgtgctggaccagctggcct

SEQ ID NO: 4236995 - DNA, 16 bp, Homo sapiens
tgtgggcttcctgctg

SEQ ID NO: 4236996 - DNA, 22 bp, Homo sapiens
tgtgggcttcctgctgggactg

SEQ ID NO: 4236997 - DNA, 20 bp, Homo sapiens
tgtggtctataaaataaact

SEQ ID NO: 4236998 - DNA, 14 bp, Homo sapiens
tgttacccagcctg

SEQ ID NO: 4236999 - DNA, 15 bp, Homo sapiens
tgttgtcagcaggca

SEQ ID NO: 4237000 - DNA, 14 bp, Homo sapiens
ttaaaagattttat

SEQ ID NO: 4237001 - DNA, 15 bp, Homo sapiens
ttaaaagattttatg

SEQ ID NO: 4237002 - DNA, 14 bp, Homo sapiens
ttaaatagctttga

SEQ ID NO: 4237003 - DNA, 15 bp, Homo sapiens
ttaatggaaagtttg

SEQ ID NO: 4237004 - DNA, 17 bp, Homo sapiens
ttactaaatatgggaat

SEQ ID NO: 4237005 - DNA, 18 bp, Homo sapiens
ttactaatatatctgtaa

SEQ ID NO: 4237006 - DNA, 17 bp, Homo sapiens
ttagaaagaaaattata

SEQ ID NO: 4237007 - DNA, 18 bp, Homo sapiens
ttagaaagaaaattatat

SEQ ID NO: 4237008 - DNA, 23 bp, Homo sapiens
ttagatgctctgagaaattgaat

SEQ ID NO: 4237009 - DNA, 15 bp, Homo sapiens
ttataattttatctg

SEQ ID NO: 4237010 - DNA, 17 bp, Homo sapiens
ttataattttatctgta

SEQ ID NO: 4237011 - DNA, 15 bp, Homo sapiens
ttatagaaaatgcat

SEQ ID NO: 4237012 - DNA, 19 bp, Homo sapiens
ttatagaaaatgcattatt

SEQ ID NO: 4237013 - DNA, 14 bp, Homo sapiens
ttatattcattcag

SEQ ID NO: 4237014 - DNA, 12 bp, Homo sapiens
ttatattctgtt

SEQ ID NO: 4237015 - DNA, 19 bp, Homo sapiens
ttatattctgtttattatg

SEQ ID NO: 4237016 - DNA, 19 bp, Homo sapiens
ttatcatcctataaagaaa

SEQ ID NO: 4237017 - DNA, 16 bp, Homo sapiens
ttatctgaatattaga

SEQ ID NO: 4237018 - DNA, 21 bp, Homo sapiens
ttatctgtataagctgtaata

SEQ ID NO: 4237019 - DNA, 13 bp, Homo sapiens
ttattaaagtttt

SEQ ID NO: 4237020 - DNA, 14 bp, Homo sapiens
ttattaaagttttc

SEQ ID NO: 4237021 - DNA, 22 bp, Homo sapiens
ttattaaagttttcaaattatt

SEQ ID NO: 4237022 - DNA, 11 bp, Homo sapiens
ttattagaaag

SEQ ID NO: 4237023 - DNA, 23 bp, Homo sapiens
ttatttagtcaattgtttaatgt

SEQ ID NO: 4237024 - DNA, 13 bp, Homo sapiens
ttcaaattatttt

SEQ ID NO: 4237025 - DNA, 16 bp, Homo sapiens
ttcaactggaaattaa

SEQ ID NO: 4237026 - DNA, 17 bp, Homo sapiens
ttcagatataagatttg

SEQ ID NO: 4237027 - DNA, 15 bp, Homo sapiens
ttcccttattactgc

SEQ ID NO: 4237028 - DNA, 22 bp, Homo sapiens
ttctaataggtactgccatatt

SEQ ID NO: 4237029 - DNA, 14 bp, Homo sapiens
ttctaggtggcagg

SEQ ID NO: 4237030 - DNA, 14 bp, Homo sapiens
ttctctgccttctt

SEQ ID NO: 4237031 - DNA, 14 bp, Homo sapiens
ttctgtttattatg

SEQ ID NO: 4237032 - DNA, 20 bp, Homo sapiens
ttctgtttattatgacaaat

SEQ ID NO: 4237033 - DNA, 20 bp, Homo sapiens
ttcttccaggatcaggggtt

SEQ ID NO: 4237034 - DNA, 16 bp, Homo sapiens
ttcttttgtgcccctg

SEQ ID NO: 4237035 - DNA, 17 bp, Homo sapiens
ttgcagcagggctgggc

SEQ ID NO: 4237036 - DNA, 18 bp, Homo sapiens
ttgcagtaattcaactgg

SEQ ID NO: 4237037 - DNA, 23 bp, Homo sapiens
ttgccacagggtactaaaagaaa

SEQ ID NO: 4237038 - DNA, 15 bp, Homo sapiens
ttgctatttatattc

SEQ ID NO: 4237039 - DNA, 17 bp, Homo sapiens
ttgtcagcaggcaggct

SEQ ID NO: 4237040 - DNA, 16 bp, Homo sapiens
ttgtgttaagcttgcg

SEQ ID NO: 4237041 - DNA, 22 bp, Homo sapiens
tttaatggaaagtttgtagcat

SEQ ID NO: 4237042 - DNA, 18 bp, Homo sapiens
tttagaaagaaaattata

SEQ ID NO: 4237043 - DNA, 15 bp, Homo sapiens
tttataactatataa

SEQ ID NO: 4237044 - DNA, 21 bp, Homo sapiens
tttcagtgatatctttctcat

SEQ ID NO: 4237045 - DNA, 20 bp, Homo sapiens
tttctgtaaaagttactaat

SEQ ID NO: 4237046 - DNA, 21 bp, Homo sapiens
tttctgtaaaagttactaata

SEQ ID NO: 4237047 - DNA, 21 bp, Homo sapiens
tttgtaaacaatctaattaaa

SEQ ID NO: 4237048 - DNA, 13 bp, Homo sapiens
tttgtacatatta

SEQ ID NO: 4237049 - DNA, 18 bp, Homo sapiens
tttgtagcatttttctaa

SEQ ID NO: 4237050 - DNA, 20 bp, Homo sapiens
ttttataactatataaatga

SEQ ID NO: 4237051 - DNA, 17 bp, Homo sapiens
ttttataattttatctg

SEQ ID NO: 4237052 - DNA, 13 bp, Homo sapiens
tttttaatggaaa

SEQ ID NO: 4237053 - DNA, 18 bp, Homo sapiens
tttttaatggaaagtttg

SEQ ID NO: 4237054 - DNA, 14 bp, Homo sapiens
gccaccatggccag

SEQ ID NO: 4237055 - DNA, 17 bp, Homo sapiens
gccaggagccctggccc

SEQ ID NO: 4237056 - DNA, 14 bp, Homo sapiens
gccaggccctcagt

SEQ ID NO: 4237057 - DNA, 20 bp, Homo sapiens
gccagtgctaagctgccctg

SEQ ID NO: 4237058 - DNA, 23 bp, Homo sapiens
gccatgcccttacacgtgcgtgt

SEQ ID NO: 4237059 - DNA, 18 bp, Homo sapiens
gccatgggaaatgagcca

SEQ ID NO: 4237060 - DNA, 21 bp, Homo sapiens
gccattaaatgaatattttga

SEQ ID NO: 4237061 - DNA, 12 bp, Homo sapiens
gcccaatatatt

SEQ ID NO: 4237062 - DNA, 23 bp, Homo sapiens
gcccactccccagttggcccttc

SEQ ID NO: 4237063 - DNA, 21 bp, Homo sapiens
gcccagaagaaaattctcctg

SEQ ID NO: 4237064 - DNA, 21 bp, Homo sapiens
gcccagccctctgtggccagg

SEQ ID NO: 4237065 - DNA, 22 bp, Homo sapiens
gcccagccctctgtggccagga

SEQ ID NO: 4237066 - DNA, 19 bp, Homo sapiens
gcccctctcacaggcagct

SEQ ID NO: 4237067 - DNA, 14 bp, Homo sapiens
gcccgcgccaggcc

SEQ ID NO: 4237068 - DNA, 14 bp, Homo sapiens
gcccggccggaggg

SEQ ID NO: 4237069 - DNA, 19 bp, Homo sapiens
gcccggccggagggcagga

SEQ ID NO: 4237070 - DNA, 16 bp, Homo sapiens
gcccgtgtccaggagc

SEQ ID NO: 4237071 - DNA, 14 bp, Homo sapiens
gccctctgtggcca

SEQ ID NO: 4237072 - DNA, 21 bp, Homo sapiens
gccctctgtggccaggagccc

SEQ ID NO: 4237073 - DNA, 17 bp, Homo sapiens
gccctgcagcagaacct

SEQ ID NO: 4237074 - DNA, 13 bp, Homo sapiens
gccctgtccctgc

SEQ ID NO: 4237075 - DNA, 16 bp, Homo sapiens
gccctttcttgcactg

SEQ ID NO: 4237076 - DNA, 22 bp, Homo sapiens
gccctttcttgcactgtccagc

SEQ ID NO: 4237077 - DNA, 14 bp, Homo sapiens
gccgcccggcagtg

SEQ ID NO: 4237078 - DNA, 17 bp, Homo sapiens
gccgctttgtctgtcca

SEQ ID NO: 4237079 - DNA, 18 bp, Homo sapiens
gccgctttgtctgtccag

SEQ ID NO: 4237080 - DNA, 13 bp, Homo sapiens
gccggaggaaccg

SEQ ID NO: 4237081 - DNA, 13 bp, Homo sapiens
gccggagggcagg

SEQ ID NO: 4237082 - DNA, 13 bp, Homo sapiens
gccgggcaggggg

SEQ ID NO: 4237083 - DNA, 14 bp, Homo sapiens
gccgtgcgggcgag

SEQ ID NO: 4237084 - DNA, 15 bp, Homo sapiens
gccgtgtgtgcatgt

SEQ ID NO: 4237085 - DNA, 22 bp, Homo sapiens
gcctacctctcgtttctgccca

SEQ ID NO: 4237086 - DNA, 21 bp, Homo sapiens
gcctctccctaggagaagagt

SEQ ID NO: 4237087 - DNA, 19 bp, Homo sapiens
gcctctgggatctgccaac

SEQ ID NO: 4237088 - DNA, 16 bp, Homo sapiens
gcctgcctggcaggct

SEQ ID NO: 4237089 - DNA, 18 bp, Homo sapiens
gcctgctgggtgccaggt

SEQ ID NO: 4237090 - DNA, 19 bp, Homo sapiens
gcctggttaatattaatat

SEQ ID NO: 4237091 - DNA, 15 bp, Homo sapiens
gcctggttcgtgcca

SEQ ID NO: 4237092 - DNA, 18 bp, Homo sapiens
gcctggttcgtgccatgc

SEQ ID NO: 4237093 - DNA, 21 bp, Homo sapiens
gcctgttttgagaccagaagg

SEQ ID NO: 4237094 - DNA, 19 bp, Homo sapiens
gccttagagcatctctgcc

SEQ ID NO: 4237095 - DNA, 20 bp, Homo sapiens
gccttagagcatctctgcct

SEQ ID NO: 4237096 - DNA, 23 bp, Homo sapiens
gccttgctcctagcagacagaaa

SEQ ID NO: 4237097 - DNA, 15 bp, Homo sapiens
gcctttgcctccccg

SEQ ID NO: 4237098 - DNA, 16 bp, Homo sapiens
gcgatccacctgtctc

SEQ ID NO: 4237099 - DNA, 17 bp, Homo sapiens
gcgatccacctgtctca

SEQ ID NO: 4237100 - DNA, 21 bp, Homo sapiens
gcgatccacctgtctcagcct

SEQ ID NO: 4237101 - DNA, 20 bp, Homo sapiens
gcgcacttacctgcttgagc

SEQ ID NO: 4237102 - DNA, 12 bp, Homo sapiens
gcgccctgcagg

SEQ ID NO: 4237103 - DNA, 20 bp, Homo sapiens
gcgctcttgggaccccagag

SEQ ID NO: 4237104 - DNA, 16 bp, Homo sapiens
gcgctttcccctcctc

SEQ ID NO: 4237105 - DNA, 15 bp, Homo sapiens
gcgggatggtgcaga

SEQ ID NO: 4237106 - DNA, 16 bp, Homo sapiens
gcggggtttcaccatg

SEQ ID NO: 4237107 - DNA, 16 bp, Homo sapiens
gcgggtgatgagacct

SEQ ID NO: 4237108 - DNA, 20 bp, Homo sapiens
gcgtcccccgttgtgcctgg

SEQ ID NO: 4237109 - DNA, 12 bp, Homo sapiens
gctaaataaatg

SEQ ID NO: 4237110 - DNA, 13 bp, Homo sapiens
gctacacactgca

SEQ ID NO: 4237111 - DNA, 19 bp, Homo sapiens
gctacccttttcctttgtg

SEQ ID NO: 4237112 - DNA, 20 bp, Homo sapiens
gctacccttttcctttgtgg

SEQ ID NO: 4237113 - DNA, 18 bp, Homo sapiens
gctagaggttcaaagata

SEQ ID NO: 4237114 - DNA, 13 bp, Homo sapiens
gctattgcataag

SEQ ID NO: 4237115 - DNA, 19 bp, Homo sapiens
gctcaggcgatccacctgt

SEQ ID NO: 4237116 - DNA, 21 bp, Homo sapiens
gctcattttcctgacatttgt

SEQ ID NO: 4237117 - DNA, 14 bp, Homo sapiens
gctcatttttgctg

SEQ ID NO: 4237118 - DNA, 20 bp, Homo sapiens
gctcccacacccacctctgc

SEQ ID NO: 4237119 - DNA, 21 bp, Homo sapiens
gctcccacacccacctctgcc

SEQ ID NO: 4237120 - DNA, 17 bp, Homo sapiens
gctccccagtgctcctg

SEQ ID NO: 4237121 - DNA, 17 bp, Homo sapiens
gctcctagcagacagaa

SEQ ID NO: 4237122 - DNA, 21 bp, Homo sapiens
gctcgagcagtcctgcctcag

SEQ ID NO: 4237123 - DNA, 20 bp, Homo sapiens
gctcgatccaaattgtgctt

SEQ ID NO: 4237124 - DNA, 21 bp, Homo sapiens
gctcgatccaaattgtgcttc

SEQ ID NO: 4237125 - DNA, 18 bp, Homo sapiens
gctctcttttctgtactt

SEQ ID NO: 4237126 - DNA, 14 bp, Homo sapiens
gctctgtccccctg

SEQ ID NO: 4237127 - DNA, 17 bp, Homo sapiens
gctcttatgtgtgcctt

SEQ ID NO: 4237128 - DNA, 18 bp, Homo sapiens
ggaccgggcgcagccctc

SEQ ID NO: 4237129 - DNA, 22 bp, Homo sapiens
ggaccgtctttacccctgctga

SEQ ID NO: 4237130 - DNA, 20 bp, Homo sapiens
ggacctccggagcgccctgc

SEQ ID NO: 4237131 - DNA, 22 bp, Homo sapiens
ggacctccggagcgccctgcag

SEQ ID NO: 4237132 - DNA, 16 bp, Homo sapiens
ggacgctgccgggaga

SEQ ID NO: 4237133 - DNA, 19 bp, Homo sapiens
ggacgctgccgggagactg

SEQ ID NO: 4237134 - DNA, 14 bp, Homo sapiens
ggactcggagggtg

SEQ ID NO: 4237135 - DNA, 20 bp, Homo sapiens
ggagaagagttgaggaactg

SEQ ID NO: 4237136 - DNA, 13 bp, Homo sapiens
ggagactgccagt

SEQ ID NO: 4237137 - DNA, 11 bp, Homo sapiens
ggagagccctg

SEQ ID NO: 4237138 - DNA, 20 bp, Homo sapiens
ggagatttacaactggggga

SEQ ID NO: 4237139 - DNA, 21 bp, Homo sapiens
ggagccccgccaggtgcccgc

SEQ ID NO: 4237140 - DNA, 19 bp, Homo sapiens
ggagccttcccgggcgggc

SEQ ID NO: 4237141 - DNA, 18 bp, Homo sapiens
ggagcgccctgcagggcc

SEQ ID NO: 4237142 - DNA, 12 bp, Homo sapiens
ggagctcctggc

SEQ ID NO: 4237143 - DNA, 15 bp, Homo sapiens
ggagctttcctgatg

SEQ ID NO: 4237144 - DNA, 14 bp, Homo sapiens
ggaggcggcctcca

SEQ ID NO: 4237145 - DNA, 15 bp, Homo sapiens
ggagggagagccctg

SEQ ID NO: 4237146 - DNA, 16 bp, Homo sapiens
ggagggaggcggcctc

SEQ ID NO: 4237147 - DNA, 18 bp, Homo sapiens
ggatagtatttttatcca

SEQ ID NO: 4237148 - DNA, 15 bp, Homo sapiens
ggatgaggagacaga

SEQ ID NO: 4237149 - DNA, 23 bp, Homo sapiens
ggatgcacagagttgttacattt

SEQ ID NO: 4237150 - DNA, 17 bp, Homo sapiens
ggcaagactgcaaactt

SEQ ID NO: 4237151 - DNA, 18 bp, Homo sapiens
ggcaatgcttaaactaaa

SEQ ID NO: 4237152 - DNA, 12 bp, Homo sapiens
ggcaattggaac

SEQ ID NO: 4237153 - DNA, 18 bp, Homo sapiens
ggcacatcagcacgattt

SEQ ID NO: 4237154 - DNA, 15 bp, Homo sapiens
ggcacatgctggccg

SEQ ID NO: 4237155 - DNA, 15 bp, Homo sapiens
ggcacgtggccagga

SEQ ID NO: 4237156 - DNA, 14 bp, Homo sapiens
ggcagctagtgcct

SEQ ID NO: 4237157 - DNA, 17 bp, Homo sapiens
ggcagctagtgccttta

SEQ ID NO: 4237158 - DNA, 15 bp, Homo sapiens
ggcagctctgagccg

SEQ ID NO: 4237159 - DNA, 19 bp, Homo sapiens
ggcagggggacagcaggga

SEQ ID NO: 4237160 - DNA, 17 bp, Homo sapiens
ggcaggggggctgtggg

SEQ ID NO: 4237161 - DNA, 17 bp, Homo sapiens
ggcagtgcacgcggctt

SEQ ID NO: 4237162 - DNA, 20 bp, Homo sapiens
ggcagtggtggttttctgtt

SEQ ID NO: 4237163 - DNA, 21 bp, Homo sapiens
ggcagtggtggttttctgttc

SEQ ID NO: 4237164 - DNA, 16 bp, Homo sapiens
ggcatcatcctcagca

SEQ ID NO: 4237165 - DNA, 13 bp, Homo sapiens
ggcatctgcatgg

SEQ ID NO: 4237166 - DNA, 17 bp, Homo sapiens
ggcatggctcagagctt

SEQ ID NO: 4237167 - DNA, 19 bp, Homo sapiens
ggccagctgccccagccag

SEQ ID NO: 4237168 - DNA, 16 bp, Homo sapiens
ggccaggagccctggc

SEQ ID NO: 4237169 - DNA, 14 bp, Homo sapiens
ggccgcccggcagt

SEQ ID NO: 4237170 - DNA, 16 bp, Homo sapiens
ggccgcccggcagtgc

SEQ ID NO: 4237171 - DNA, 14 bp, Homo sapiens
ggccggagggcagg

SEQ ID NO: 4237172 - DNA, 15 bp, Homo sapiens
ggccggagggcagga

SEQ ID NO: 4237173 - DNA, 19 bp, Homo sapiens
ggccggagggcaggaccct

SEQ ID NO: 4237174 - DNA, 12 bp, Homo sapiens
ggccgggcaggg

SEQ ID NO: 4237175 - DNA, 20 bp, Homo sapiens
ggcctcgtgctccgcagggc

SEQ ID NO: 4237176 - DNA, 14 bp, Homo sapiens
ggcgaggccgccca

SEQ ID NO: 4237177 - DNA, 13 bp, Homo sapiens
ggcgcccagcgcc

SEQ ID NO: 4237178 - DNA, 16 bp, Homo sapiens
ggcggccccgccgcag

SEQ ID NO: 4237179 - DNA, 22 bp, Homo sapiens
ggcgggtgtggagaccaggctc

SEQ ID NO: 4237180 - DNA, 14 bp, Homo sapiens
ggctactctgccca

SEQ ID NO: 4237181 - DNA, 17 bp, Homo sapiens
ggctcagagcttgaaga

SEQ ID NO: 4237182 - DNA, 10 bp, Homo sapiens
ggctcctgac

SEQ ID NO: 4237183 - DNA, 23 bp, Homo sapiens
ggctcctgaccccgccatgcatg

SEQ ID NO: 4237184 - DNA, 15 bp, Homo sapiens
ggctctgtccccctg

SEQ ID NO: 4237185 - DNA, 19 bp, Homo sapiens
ggctcttatgtgtgccttt

SEQ ID NO: 4237186 - DNA, 14 bp, Homo sapiens
ggctgaggcagaag

SEQ ID NO: 4237187 - DNA, 17 bp, Homo sapiens
ggctgtttcaaaaaaat

SEQ ID NO: 4237188 - DNA, 19 bp, Homo sapiens
ggcttcgttagaccgctct

SEQ ID NO: 4237189 - DNA, 12 bp, Homo sapiens
gggaaggccagc

SEQ ID NO: 4237190 - DNA, 13 bp, Homo sapiens
gggaccccagaga

SEQ ID NO: 4237191 - DNA, 21 bp, Homo sapiens
gggagcatttaatggcagcta

SEQ ID NO: 4237192 - DNA, 21 bp, Homo sapiens
gggagctgctgggtggcaggg

SEQ ID NO: 4237193 - DNA, 15 bp, Homo sapiens
gggagggagtctggg

SEQ ID NO: 4237194 - DNA, 20 bp, Homo sapiens
gggatggacgctgccgggag

SEQ ID NO: 4237195 - DNA, 13 bp, Homo sapiens
gggcagggaagga

SEQ ID NO: 4237196 - DNA, 18 bp, Homo sapiens
gggcagggggacagcagg

SEQ ID NO: 4237197 - DNA, 21 bp, Homo sapiens
gggcatttcttgcgagcctcg

SEQ ID NO: 4237198 - DNA, 13 bp, Homo sapiens
gggcggagccttc

SEQ ID NO: 4237199 - DNA, 15 bp, Homo sapiens
gggcgtgggaggagg

SEQ ID NO: 4237200 - DNA, 17 bp, Homo sapiens
gtaaattaacttttata

SEQ ID NO: 4237201 - DNA, 18 bp, Homo sapiens
gtaagaacacattttaaa

SEQ ID NO: 4237202 - DNA, 14 bp, Homo sapiens
gtaatataatgtat

SEQ ID NO: 4237203 - DNA, 17 bp, Homo sapiens
gtaatataatgtatttt

SEQ ID NO: 4237204 - DNA, 15 bp, Homo sapiens
gtaatgcagttttta

SEQ ID NO: 4237205 - DNA, 22 bp, Homo sapiens
gtaatgcagtttttaaaaacct

SEQ ID NO: 4237206 - DNA, 14 bp, Homo sapiens
gtaatttcatttaa

SEQ ID NO: 4237207 - DNA, 17 bp, Homo sapiens
gtaatttgtgatacaat

SEQ ID NO: 4237208 - DNA, 13 bp, Homo sapiens
gtaatttttgctc

SEQ ID NO: 4237209 - DNA, 15 bp, Homo sapiens
gtacaaacagtattt

SEQ ID NO: 4237210 - DNA, 20 bp, Homo sapiens
gtacaaacagtatttctggt

SEQ ID NO: 4237211 - DNA, 13 bp, Homo sapiens
gtacaactgtatt

SEQ ID NO: 4237212 - DNA, 17 bp, Homo sapiens
gtacaatgtgtttttct

SEQ ID NO: 4237213 - DNA, 18 bp, Homo sapiens
gtacactgtttcaaactt

SEQ ID NO: 4237214 - DNA, 21 bp, Homo sapiens
gtacactgtttcaaactttac

SEQ ID NO: 4237215 - DNA, 20 bp, Homo sapiens
gtacataatgcgtgcatacc

SEQ ID NO: 4237216 - DNA, 16 bp, Homo sapiens
gtacatgaaaacacat

SEQ ID NO: 4237217 - DNA, 19 bp, Homo sapiens
gtacatgaaaacacatttt

SEQ ID NO: 4237218 - DNA, 21 bp, Homo sapiens
gtacgatggaggcctacctct

SEQ ID NO: 4237219 - DNA, 14 bp, Homo sapiens
gtacgttgtgcatt

SEQ ID NO: 4237220 - DNA, 17 bp, Homo sapiens
gtacgttgtgcatttgg

SEQ ID NO: 4237221 - DNA, 17 bp, Homo sapiens
gtactctgtgtctggca

SEQ ID NO: 4237222 - DNA, 19 bp, Homo sapiens
gtagatgcatgacttgtgt

SEQ ID NO: 4237223 - DNA, 14 bp, Homo sapiens
gtagccagctgtgc

SEQ ID NO: 4237224 - DNA, 14 bp, Homo sapiens
gtaggtaaaatgta

SEQ ID NO: 4237225 - DNA, 19 bp, Homo sapiens
gtagtttggatatttttgt

SEQ ID NO: 4237226 - DNA, 13 bp, Homo sapiens
gtataatgtttaa

SEQ ID NO: 4237227 - DNA, 13 bp, Homo sapiens
gtatataatttta

SEQ ID NO: 4237228 - DNA, 16 bp, Homo sapiens
gtatatcattctacag

SEQ ID NO: 4237229 - DNA, 20 bp, Homo sapiens
gtatatcattctacagaata

SEQ ID NO: 4237230 - DNA, 21 bp, Homo sapiens
gtatatcattctacagaataa

SEQ ID NO: 4237231 - DNA, 14 bp, Homo sapiens
gtatcagatgtgaa

SEQ ID NO: 4237232 - DNA, 18 bp, Homo sapiens
gtatcttggggcaagact

SEQ ID NO: 4237233 - DNA, 21 bp, Homo sapiens
gtatcttggggcaagactgca

SEQ ID NO: 4237234 - DNA, 22 bp, Homo sapiens
gtatgttatgatattgtttaaa

SEQ ID NO: 4237235 - DNA, 14 bp, Homo sapiens
gtattatacctttt

SEQ ID NO: 4237236 - DNA, 15 bp, Homo sapiens
gtattcttctgtatt

SEQ ID NO: 4237237 - DNA, 18 bp, Homo sapiens
gtattcttctgtatttct

SEQ ID NO: 4237238 - DNA, 21 bp, Homo sapiens
gtattgactgtaccacagaca

SEQ ID NO: 4237239 - DNA, 22 bp, Homo sapiens
gtattgcatgcaatttgaagta

SEQ ID NO: 4237240 - DNA, 19 bp, Homo sapiens
gtatttatgtaatgaagta

SEQ ID NO: 4237241 - DNA, 20 bp, Homo sapiens
gtatttttcatctttaagaa

SEQ ID NO: 4237242 - DNA, 17 bp, Homo sapiens
gtattttttaaaacact

SEQ ID NO: 4237243 - DNA, 18 bp, Homo sapiens
gtattttttaaaacacta

SEQ ID NO: 4237244 - DNA, 14 bp, Homo sapiens
gtatttttttacta

SEQ ID NO: 4237245 - DNA, 15 bp, Homo sapiens
gtcaaaagttggtgt

SEQ ID NO: 4237246 - DNA, 17 bp, Homo sapiens
gtcaagtctctgctggc

SEQ ID NO: 4237247 - DNA, 19 bp, Homo sapiens
gtcaataacactgtatttt

SEQ ID NO: 4237248 - DNA, 17 bp, Homo sapiens
gtcacaagtagcctctg

SEQ ID NO: 4237249 - DNA, 15 bp, Homo sapiens
gtcactgcttaactt

SEQ ID NO: 4237250 - DNA, 18 bp, Homo sapiens
gtcagatttttatttatg

SEQ ID NO: 4237251 - DNA, 15 bp, Homo sapiens
gtcatatacatattg

SEQ ID NO: 4237252 - DNA, 23 bp, Homo sapiens
gtccaactcttccacctctgggg

SEQ ID NO: 4237253 - DNA, 14 bp, Homo sapiens
gtccaatttctgct

SEQ ID NO: 4237254 - DNA, 16 bp, Homo sapiens
gtccaatttctgctgt

SEQ ID NO: 4237255 - DNA, 19 bp, Homo sapiens
gtccagccgtgtgtgcatg

SEQ ID NO: 4237256 - DNA, 14 bp, Homo sapiens
gtccatgcttctca

SEQ ID NO: 4237257 - DNA, 14 bp, Homo sapiens
gtcctactcctgga

SEQ ID NO: 4237258 - DNA, 17 bp, Homo sapiens
gtcctgcctcagcctcc

SEQ ID NO: 4237259 - DNA, 22 bp, Homo sapiens
gtcctgtccacacccagctcag

SEQ ID NO: 4237260 - DNA, 19 bp, Homo sapiens
gtccttgcacctgagcctg

SEQ ID NO: 4237261 - DNA, 17 bp, Homo sapiens
gtcgttttccaaactga

SEQ ID NO: 4237262 - DNA, 16 bp, Homo sapiens
gtctcactgttctgca

SEQ ID NO: 4237263 - DNA, 16 bp, Homo sapiens
gtctcgctttgttgcc

SEQ ID NO: 4237264 - DNA, 19 bp, Homo sapiens
gtctcgctttgttgcccag

SEQ ID NO: 4237265 - DNA, 21 bp, Homo sapiens
gtctctccctcccccagagcc

SEQ ID NO: 4237266 - DNA, 20 bp, Homo sapiens
gtctctgctggcccagccaa

SEQ ID NO: 4237267 - DNA, 12 bp, Homo sapiens
gtctgaatattt

SEQ ID NO: 4237268 - DNA, 13 bp, Homo sapiens
gtctgaatatttt

SEQ ID NO: 4237269 - DNA, 17 bp, Homo sapiens
gtctgttctttccaaag

SEQ ID NO: 4237270 - DNA, 21 bp, Homo sapiens
gtcttaagatggaaatacagt

SEQ ID NO: 4237271 - DNA, 15 bp, Homo sapiens
gtcttagagcctttt

SEQ ID NO: 4237272 - DNA, 20 bp, Homo sapiens
gtcttagagccttttatctg

SEQ ID NO: 4237273 - DNA, 16 bp, Homo sapiens
gtgaaatggccaggat

SEQ ID NO: 4237274 - DNA, 20 bp, Homo sapiens
gtgaagcctggagctttcct

SEQ ID NO: 4237275 - DNA, 16 bp, Homo sapiens
gtgactttttttggta

SEQ ID NO: 4237276 - DNA, 14 bp, Homo sapiens
gtgatgagacctgg

SEQ ID NO: 4237277 - DNA, 18 bp, Homo sapiens
gtgcagaaaatatttaat

SEQ ID NO: 4237278 - DNA, 12 bp, Homo sapiens
gtgcagaataat

SEQ ID NO: 4237279 - DNA, 18 bp, Homo sapiens
gtgcagaataatggaaac

SEQ ID NO: 4237280 - DNA, 21 bp, Homo sapiens
gtgcagaataatggaaacatt

SEQ ID NO: 4237281 - DNA, 14 bp, Homo sapiens
gtgcataccacttt

SEQ ID NO: 4237282 - DNA, 12 bp, Homo sapiens
gtgcatgtgccg

SEQ ID NO: 4237283 - DNA, 20 bp, Homo sapiens
gtgcatttgaggtctgttct

SEQ ID NO: 4237284 - DNA, 15 bp, Homo sapiens
gtgcccgcgccaggc

SEQ ID NO: 4237285 - DNA, 18 bp, Homo sapiens
gtgcccgcgccaggccct

SEQ ID NO: 4237286 - DNA, 15 bp, Homo sapiens
gtgcccttccctgga

SEQ ID NO: 4237287 - DNA, 17 bp, Homo sapiens
gtgccgtgcgggcgagg

SEQ ID NO: 4237288 - DNA, 20 bp, Homo sapiens
gtgcctgctgggtgccaggt

SEQ ID NO: 4237289 - DNA, 22 bp, Homo sapiens
gtgcctgctgggtgccaggtgc

SEQ ID NO: 4237290 - DNA, 23 bp, Homo sapiens
gtgcctgctgggtgccaggtgct

SEQ ID NO: 4237291 - DNA, 19 bp, Homo sapiens
gtgcctggttaatattaat

SEQ ID NO: 4237292 - DNA, 22 bp, Homo sapiens
gtgcgtcccccgttgtgcctgg

SEQ ID NO: 4237293 - DNA, 17 bp, Homo sapiens
gtgcgtgtgagtgtgtg

SEQ ID NO: 4237294 - DNA, 20 bp, Homo sapiens
gtgctctgctaaccatttat

SEQ ID NO: 4237295 - DNA, 17 bp, Homo sapiens
gtgctgagtaaacataa

SEQ ID NO: 4237296 - DNA, 16 bp, Homo sapiens
gtgcttctccccagaa

SEQ ID NO: 4237297 - DNA, 20 bp, Homo sapiens
gtgcttgttccctctccctg

SEQ ID NO: 4237298 - DNA, 19 bp, Homo sapiens
gtgctttttaagaatattt

SEQ ID NO: 4237299 - DNA, 20 bp, Homo sapiens
gtggaccaattattgatata

SEQ ID NO: 4237300 - DNA, 13 bp, Homo sapiens
gtggatgactgtt

SEQ ID NO: 4237301 - DNA, 15 bp, Homo sapiens
gtggatgactgttga

SEQ ID NO: 4237302 - DNA, 20 bp, Homo sapiens
gtggatttaacagaaatgta

SEQ ID NO: 4237303 - DNA, 18 bp, Homo sapiens
gtggccaggagccctggc

SEQ ID NO: 4237304 - DNA, 23 bp, Homo sapiens
gtggcctcgtgctccgcagggcg

SEQ ID NO: 4237305 - DNA, 13 bp, Homo sapiens
gtgggaaggccag

SEQ ID NO: 4237306 - DNA, 20 bp, Homo sapiens
gtgggcatttcttgcgagcc

SEQ ID NO: 4237307 - DNA, 11 bp, Homo sapiens
gtgggctcctg

SEQ ID NO: 4237308 - DNA, 15 bp, Homo sapiens
gtggtactctgtgtc

SEQ ID NO: 4237309 - DNA, 14 bp, Homo sapiens
gtggtggttttctg

SEQ ID NO: 4237310 - DNA, 20 bp, Homo sapiens
gtggtggttttctgttcttt

SEQ ID NO: 4237311 - DNA, 17 bp, Homo sapiens
gtgtcattggggggacc

SEQ ID NO: 4237312 - DNA, 18 bp, Homo sapiens
gtgtctgacttttgttaa

SEQ ID NO: 4237313 - DNA, 13 bp, Homo sapiens
gtgtgtgcatgtg

SEQ ID NO: 4237314 - DNA, 14 bp, Homo sapiens
gtgtgtgcatgtgc

SEQ ID NO: 4237315 - DNA, 17 bp, Homo sapiens
gtgtgtgcatgtgccga

SEQ ID NO: 4237316 - DNA, 14 bp, Homo sapiens
gtgttactaagttt

SEQ ID NO: 4237317 - DNA, 18 bp, Homo sapiens
tgtttataatctgaagat

SEQ ID NO: 4237318 - DNA, 19 bp, Homo sapiens
tgtttataatctgaagata

SEQ ID NO: 4237319 - DNA, 14 bp, Homo sapiens
tgtttatgttttta

SEQ ID NO: 4237320 - DNA, 14 bp, Homo sapiens
tgtttcaaaaaaat

SEQ ID NO: 4237321 - DNA, 15 bp, Homo sapiens
tgtttcaaactttac

SEQ ID NO: 4237322 - DNA, 13 bp, Homo sapiens
tgtttgtgattga

SEQ ID NO: 4237323 - DNA, 19 bp, Homo sapiens
tgttttaaggatgcttgta

SEQ ID NO: 4237324 - DNA, 22 bp, Homo sapiens
tgttttaaggatgcttgtacat

SEQ ID NO: 4237325 - DNA, 13 bp, Homo sapiens
tgttttcttcaac

SEQ ID NO: 4237326 - DNA, 21 bp, Homo sapiens
tgttttgaatattactcctat

SEQ ID NO: 4237327 - DNA, 16 bp, Homo sapiens
ttaaaaacctgtatct

SEQ ID NO: 4237328 - DNA, 15 bp, Homo sapiens
ttaaaaatctcaaat

SEQ ID NO: 4237329 - DNA, 17 bp, Homo sapiens
ttaaaaatctcaaattt

SEQ ID NO: 4237330 - DNA, 20 bp, Homo sapiens
ttaaaaatctcaaatttcta

SEQ ID NO: 4237331 - DNA, 23 bp, Homo sapiens
ttaaaaattaatatggtgtattt

SEQ ID NO: 4237332 - DNA, 18 bp, Homo sapiens
tttataaactttaccttt

SEQ ID NO: 4237333 - DNA, 12 bp, Homo sapiens
tttataatctga

SEQ ID NO: 4237334 - DNA, 16 bp, Homo sapiens
tttataatctgaagat

SEQ ID NO: 4237335 - DNA, 12 bp, Homo sapiens
tttatacataaa

SEQ ID NO: 4237336 - DNA, 21 bp, Homo sapiens
tttatcgtcactgcttaactt

SEQ ID NO: 4237337 - DNA, 12 bp, Homo sapiens
tttatctgcaga

SEQ ID NO: 4237338 - DNA, 16 bp, Homo sapiens
tttatctgcagaacat

SEQ ID NO: 4237339 - DNA, 17 bp, Homo sapiens
tttatgcagcaaatata

SEQ ID NO: 4237340 - DNA, 24 bp, Homo sapiens
tttatggcttttgtgcattatcta

SEQ ID NO: 4237341 - DNA, 13 bp, Homo sapiens
tttatgtaatgaa

SEQ ID NO: 4237342 - DNA, 20 bp, Homo sapiens
tttatgtaatgaagtaaagc

SEQ ID NO: 4237343 - DNA, 13 bp, Homo sapiens
tttattaaagatg

SEQ ID NO: 4237344 - DNA, 18 bp, Homo sapiens
tttattcaaggaagtttt

SEQ ID NO: 4237345 - DNA, 23 bp, Homo sapiens
tttatttcatttacaaaagattt

SEQ ID NO: 4237346 - DNA, 14 bp, Homo sapiens
tttatttttgacag

SEQ ID NO: 4237347 - DNA, 15 bp, Homo sapiens
tttcaaactttacta

SEQ ID NO: 4237348 - DNA, 22 bp, Homo sapiens
tttcaccccacccttcccctcc

SEQ ID NO: 4237349 - DNA, 12 bp, Homo sapiens
tttcagaaatgt

SEQ ID NO: 4237350 - DNA, 24 bp, Homo sapiens
tttcagtagtgagcagcatctagt

SEQ ID NO: 4237351 - DNA, 16 bp, Homo sapiens
tttccaaatgaaaaat

SEQ ID NO: 4237352 - DNA, 15 bp, Homo sapiens
tttcccctgttaaac

SEQ ID NO: 4237353 - DNA, 13 bp, Homo sapiens
tttcctatttaat

SEQ ID NO: 4237354 - DNA, 21 bp, Homo sapiens
tttctaaaggctacctttgta

SEQ ID NO: 4237355 - DNA, 13 bp, Homo sapiens
aaaaaagttttta

SEQ ID NO: 4237356 - DNA, 21 bp, Homo sapiens
aaaaaatttaaaattacgttt

SEQ ID NO: 4237357 - DNA, 15 bp, Homo sapiens
aaaaactgatttgct

SEQ ID NO: 4237358 - DNA, 19 bp, Homo sapiens
aaaaagtaagttaataatg

SEQ ID NO: 4237359 - DNA, 13 bp, Homo sapiens
aaaaataatacaa

SEQ ID NO: 4237360 - DNA, 14 bp, Homo sapiens
aaaaatctcaaatt

SEQ ID NO: 4237361 - DNA, 20 bp, Homo sapiens
aaaaatctcaaatttctaaa

SEQ ID NO: 4237362 - DNA, 19 bp, Homo sapiens
aaaaatctcaattgaaagc

SEQ ID NO: 4237363 - DNA, 17 bp, Homo sapiens
aaaaattgaaataaata

SEQ ID NO: 4237364 - DNA, 22 bp, Homo sapiens
aaaacaagtcatttttgtattt

SEQ ID NO: 4237365 - DNA, 13 bp, Homo sapiens
aaaacacattttt

SEQ ID NO: 4237366 - DNA, 10 bp, Homo sapiens
aaaacactaa

SEQ ID NO: 4237367 - DNA, 22 bp, Homo sapiens
aaaactagggctcattttcctg

SEQ ID NO: 4237368 - DNA, 18 bp, Homo sapiens
aaaacttaaaaattaata

SEQ ID NO: 4237369 - DNA, 17 bp, Homo sapiens
aaaaggatagtattttt

SEQ ID NO: 4237370 - DNA, 22 bp, Homo sapiens
aaaaggatgcacagagttgtta

SEQ ID NO: 4237371 - DNA, 19 bp, Homo sapiens
aaaagtcgttttccaaact

SEQ ID NO: 4237372 - DNA, 12 bp, Homo sapiens
aaaataaataat

SEQ ID NO: 4237373 - DNA, 17 bp, Homo sapiens
tggtgcccttccctgga

SEQ ID NO: 4237374 - DNA, 21 bp, Homo sapiens
tggttgtaccctctccaggca

SEQ ID NO: 4237375 - DNA, 13 bp, Homo sapiens
tggtttgagattg

SEQ ID NO: 4237376 - DNA, 21 bp, Homo sapiens
tggtttgtaaattaactttta

SEQ ID NO: 4237377 - DNA, 17 bp, Homo sapiens
tgtaaaatgaattgaaa

SEQ ID NO: 4237378 - DNA, 21 bp, Homo sapiens
tgtaaaatgaattgaaaaaca

SEQ ID NO: 4237379 - DNA, 22 bp, Homo sapiens
tgtaaaatgaattgaaaaacaa

SEQ ID NO: 4237380 - DNA, 23 bp, Homo sapiens
tgtaaaatgaattgaaaaacaat

SEQ ID NO: 4237381 - DNA, 20 bp, Homo sapiens
tgtaaactggaattaaaagg

SEQ ID NO: 4237382 - DNA, 17 bp, Homo sapiens
tgtaaatgcatattaaa

SEQ ID NO: 4237383 - DNA, 23 bp, Homo sapiens
tgtaaatgcatattaaataataa

SEQ ID NO: 4237384 - DNA, 20 bp, Homo sapiens
tgtaagaacacattttaaat

SEQ ID NO: 4237385 - DNA, 18 bp, Homo sapiens
tgtaatataatgtatttt

SEQ ID NO: 4237386 - DNA, 20 bp, Homo sapiens
tgtaatctttcatccaaaat

SEQ ID NO: 4237387 - DNA, 21 bp, Homo sapiens
tgtaatctttcatccaaaata

SEQ ID NO: 4237388 - DNA, 15 bp, Homo sapiens
tgtaatgaagtaaag

SEQ ID NO: 4237389 - DNA, 16 bp, Homo sapiens
tgtaatttgtgataca

SEQ ID NO: 4237390 - DNA, 15 bp, Homo sapiens
tgtacaaacagtatt

SEQ ID NO: 4237391 - DNA, 23 bp, Homo sapiens
tgtacaagttgttattgttgaac

SEQ ID NO: 4237392 - DNA, 21 bp, Homo sapiens
tgtacagaaaagggcggcttc

SEQ ID NO: 4237393 - DNA, 19 bp, Homo sapiens
tgtacataaacaatgatgc

SEQ ID NO: 4237394 - DNA, 19 bp, Homo sapiens
tgtacataatgcgtgcata

SEQ ID NO: 4237395 - DNA, 20 bp, Homo sapiens
tgtacatgaaaacacatttt

SEQ ID NO: 4237396 - DNA, 15 bp, Homo sapiens
tgtaccacagacaca

SEQ ID NO: 4237397 - DNA, 21 bp, Homo sapiens
tgtactctaggacttcaaagt

SEQ ID NO: 4237398 - DNA, 21 bp, Homo sapiens
tgtacttgaaaaatgttttta

SEQ ID NO: 4237399 - DNA, 15 bp, Homo sapiens
tgtacttgatttgat

SEQ ID NO: 4237400 - DNA, 18 bp, Homo sapiens
tgtagccagctgtgcact

SEQ ID NO: 4237401 - DNA, 19 bp, Homo sapiens
tgtaggtaaaatgtatttt

SEQ ID NO: 4237402 - DNA, 17 bp, Homo sapiens
tgtatatcattctacag

SEQ ID NO: 4237403 - DNA, 15 bp, Homo sapiens
tgtatgttatgatat

SEQ ID NO: 4237404 - DNA, 19 bp, Homo sapiens
tgtattctctcctgtacct

SEQ ID NO: 4237405 - DNA, 16 bp, Homo sapiens
tgtattgactgtacca

SEQ ID NO: 4237406 - DNA, 13 bp, Homo sapiens
tgtatttatgtaa

SEQ ID NO: 4237407 - DNA, 22 bp, Homo sapiens
tgtatttatgtaatgaagtaaa

SEQ ID NO: 4237408 - DNA, 14 bp, Homo sapiens
tgtatttttctaca

SEQ ID NO: 4237409 - DNA, 14 bp, Homo sapiens
tgtattttttaaaa

SEQ ID NO: 4237410 - DNA, 18 bp, Homo sapiens
tgtattttttaaaacact

SEQ ID NO: 4237411 - DNA, 22 bp, Homo sapiens
tgtattttttaaaacactaaaa

SEQ ID NO: 4237412 - DNA, 17 bp, Homo sapiens
tgtcaagtctctgctgg

SEQ ID NO: 4237413 - DNA, 19 bp, Homo sapiens
tgtcaagtctctgctggcc

SEQ ID NO: 4237414 - DNA, 18 bp, Homo sapiens
tgtcaattcataaaaaca

SEQ ID NO: 4237415 - DNA, 22 bp, Homo sapiens
tgtcagccatgggaaatgagcc

SEQ ID NO: 4237416 - DNA, 14 bp, Homo sapiens
tgtccagccgtgtg

SEQ ID NO: 4237417 - DNA, 21 bp, Homo sapiens
tgtccaggagccccgccaggt

SEQ ID NO: 4237418 - DNA, 17 bp, Homo sapiens
tgtccatgcttctcatc

SEQ ID NO: 4237419 - DNA, 20 bp, Homo sapiens
tgtccttgcacctgagcctg

SEQ ID NO: 4237420 - DNA, 15 bp, Homo sapiens
tgtctcagcctccca

SEQ ID NO: 4237421 - DNA, 21 bp, Homo sapiens
tgtctctcttcagactctcag

SEQ ID NO: 4237422 - DNA, 15 bp, Homo sapiens
tgtctggccaggcct

SEQ ID NO: 4237423 - DNA, 21 bp, Homo sapiens
tgtctgtccagccgtgtgtgc

SEQ ID NO: 4237424 - DNA, 15 bp, Homo sapiens
tgtcttgaaagtggc

SEQ ID NO: 4237425 - DNA, 19 bp, Homo sapiens
tgtcttgcaacttcagttt

SEQ ID NO: 4237426 - DNA, 17 bp, Homo sapiens
tgtctttcatctcccag

SEQ ID NO: 4237427 - DNA, 16 bp, Homo sapiens
tgtgaagccagatctc

SEQ ID NO: 4237428 - DNA, 20 bp, Homo sapiens
tgtgaagcctggagctttcc

SEQ ID NO: 4237429 - DNA, 12 bp, Homo sapiens
tgtgactttttt

SEQ ID NO: 4237430 - DNA, 17 bp, Homo sapiens
tgtgactttttttggta

SEQ ID NO: 4237431 - DNA, 21 bp, Homo sapiens
tgtgatacaatgctgtgccct

SEQ ID NO: 4237432 - DNA, 15 bp, Homo sapiens
tgtgcagaataatgg

SEQ ID NO: 4237433 - DNA, 14 bp, Homo sapiens
tgtgcattatctag

SEQ ID NO: 4237434 - DNA, 16 bp, Homo sapiens
tgtgcattatctagat

SEQ ID NO: 4237435 - DNA, 19 bp, Homo sapiens
tgtgcattatctagatact

SEQ ID NO: 4237436 - DNA, 20 bp, Homo sapiens
tgtgcattatctagatactg

SEQ ID NO: 4237437 - DNA, 20 bp, Homo sapiens
tgtgccctaaagtgtatttt

SEQ ID NO: 4237438 - DNA, 20 bp, Homo sapiens
tgtgcctggttaatattaat

SEQ ID NO: 4237439 - DNA, 17 bp, Homo sapiens
tgtgctttttaagaata

SEQ ID NO: 4237440 - DNA, 22 bp, Homo sapiens
tgtgctttttaagaatattttt

SEQ ID NO: 4237441 - DNA, 17 bp, Homo sapiens
tgtggaccaattattga

SEQ ID NO: 4237442 - DNA, 21 bp, Homo sapiens
tgtggaggagggagagccctg

SEQ ID NO: 4237443 - DNA, 20 bp, Homo sapiens
tgtggatttaacagaaatgt

SEQ ID NO: 4237444 - DNA, 18 bp, Homo sapiens
tgtggccaggagccctgg

SEQ ID NO: 4237445 - DNA, 17 bp, Homo sapiens
tgtggctgtgaggggtg

SEQ ID NO: 4237446 - DNA, 15 bp, Homo sapiens
tgtgggaaggccagc

SEQ ID NO: 4237447 - DNA, 14 bp, Homo sapiens
tgtggttttatgga

SEQ ID NO: 4237448 - DNA, 17 bp, Homo sapiens
tgtggttttatggagac

SEQ ID NO: 4237449 - DNA, 22 bp, Homo sapiens
tgtgtagttgtctctcttcaga

SEQ ID NO: 4237450 - DNA, 22 bp, Homo sapiens
tgtgtatacagccctgacgcaa

SEQ ID NO: 4237451 - DNA, 21 bp, Homo sapiens
tgtgtatattgagaatccctt

SEQ ID NO: 4237452 - DNA, 14 bp, Homo sapiens
tgtgtctggacctc

SEQ ID NO: 4237453 - DNA, 20 bp, Homo sapiens
tgtgtggagaactcagtgcc

SEQ ID NO: 4237454 - DNA, 16 bp, Homo sapiens
tgtgtttttctccagt

SEQ ID NO: 4237455 - DNA, 12 bp, Homo sapiens
tgttaaacagta

SEQ ID NO: 4237456 - DNA, 20 bp, Homo sapiens
tgttaaatactgtgcagaat

SEQ ID NO: 4237457 - DNA, 14 bp, Homo sapiens
tgttacatctgtct

SEQ ID NO: 4237458 - DNA, 23 bp, Homo sapiens
tgttagcaaatgacagatttctg

SEQ ID NO: 4237459 - DNA, 15 bp, Homo sapiens
tgttatgatattgtt

SEQ ID NO: 4237460 - DNA, 21 bp, Homo sapiens
tgttatgatttccttcaatgt

SEQ ID NO: 4237461 - DNA, 17 bp, Homo sapiens
tgttattttgtgtacaa

SEQ ID NO: 4237462 - DNA, 14 bp, Homo sapiens
tgttcctcaaatca

SEQ ID NO: 4237463 - DNA, 14 bp, Homo sapiens
tgttctatccaaac

SEQ ID NO: 4237464 - DNA, 19 bp, Homo sapiens
tgttctatccaaacatgta

SEQ ID NO: 4237465 - DNA, 16 bp, Homo sapiens
tgttcttaattcttag

SEQ ID NO: 4237466 - DNA, 12 bp, Homo sapiens
tgttgccagtgc

SEQ ID NO: 4237467 - DNA, 13 bp, Homo sapiens
tgttgccagtgct

SEQ ID NO: 4237468 - DNA, 17 bp, Homo sapiens
tgtttaaaaagtaagtt

SEQ ID NO: 4237469 - DNA, 21 bp, Homo sapiens
tgtttaaaaagtaagttaata

SEQ ID NO: 4237470 - DNA, 13 bp, Homo sapiens
tgtttaaatcatg

SEQ ID NO: 4237471 - DNA, 18 bp, Homo sapiens
tgtttaaatcatgtatgt

SEQ ID NO: 4237472 - DNA, 21 bp, Homo sapiens
tgtttaaatcatgtatgttat

SEQ ID NO: 4237473 - DNA, 14 bp, Homo sapiens
tgtttacgtttgat

SEQ ID NO: 4237474 - DNA, 17 bp, Homo sapiens
tctttccaaagtacact

SEQ ID NO: 4237475 - DNA, 23 bp, Homo sapiens
tctttctacaaagcactagagaa

SEQ ID NO: 4237476 - DNA, 20 bp, Homo sapiens
tctttctggctatgcatttg

SEQ ID NO: 4237477 - DNA, 21 bp, Homo sapiens
tcttttcataaagggttgaaa

SEQ ID NO: 4237478 - DNA, 12 bp, Homo sapiens
tcttttggttat

SEQ ID NO: 4237479 - DNA, 13 bp, Homo sapiens
tcttttgtttcca

SEQ ID NO: 4237480 - DNA, 15 bp, Homo sapiens
tgaaaaaaaagtttt

SEQ ID NO: 4237481 - DNA, 21 bp, Homo sapiens
tgaaaaaaattgaaataaata

SEQ ID NO: 4237482 - DNA, 12 bp, Homo sapiens
tgaaaacacatt

SEQ ID NO: 4237483 - DNA, 20 bp, Homo sapiens
tgaaaactagggctcatttt

SEQ ID NO: 4237484 - DNA, 20 bp, Homo sapiens
tgaaaattcgcccgagctgt

SEQ ID NO: 4237485 - DNA, 12 bp, Homo sapiens
tgaaaattttga

SEQ ID NO: 4237486 - DNA, 17 bp, Homo sapiens
tgaaactggattaaact

SEQ ID NO: 4237487 - DNA, 18 bp, Homo sapiens
tgaaagcttcaaagttta

SEQ ID NO: 4237488 - DNA, 19 bp, Homo sapiens
tgaaagcttcaaagtttat

SEQ ID NO: 4237489 - DNA, 23 bp, Homo sapiens
tgaacatacttcaaaaataatgt

SEQ ID NO: 4237490 - DNA, 13 bp, Homo sapiens
tgaacccttgctt

SEQ ID NO: 4237491 - DNA, 15 bp, Homo sapiens
tgaacccttgcttgc

SEQ ID NO: 4237492 - DNA, 13 bp, Homo sapiens
tgaaccctttgtt

SEQ ID NO: 4237493 - DNA, 16 bp, Homo sapiens
tgaactttgacctctg

SEQ ID NO: 4237494 - DNA, 21 bp, Homo sapiens
tgaaggaatcattccagtgct

SEQ ID NO: 4237495 - DNA, 17 bp, Homo sapiens
tgaagggcattctttcc

SEQ ID NO: 4237496 - DNA, 16 bp, Homo sapiens
tgaagtaatatgcaca

SEQ ID NO: 4237497 - DNA, 14 bp, Homo sapiens
tgaagtatactttt

SEQ ID NO: 4237498 - DNA, 21 bp, Homo sapiens
tgaagtatacttttcccctgt

SEQ ID NO: 4237499 - DNA, 18 bp, Homo sapiens
tgaagtcaaaatatgtaa

SEQ ID NO: 4237500 - DNA, 17 bp, Homo sapiens
tgaataggttatatgca

SEQ ID NO: 4237501 - DNA, 16 bp, Homo sapiens
tgaatattttgataat

SEQ ID NO: 4237502 - DNA, 14 bp, Homo sapiens
tgaatattttggaa

SEQ ID NO: 4237503 - DNA, 19 bp, Homo sapiens
tgaatattttggaaactgc

SEQ ID NO: 4237504 - DNA, 18 bp, Homo sapiens
tgaatgtgtctggacctc

SEQ ID NO: 4237505 - DNA, 16 bp, Homo sapiens
tgaattgtatcaattt

SEQ ID NO: 4237506 - DNA, 23 bp, Homo sapiens
tgaatttcttttgccgttattaa

SEQ ID NO: 4237507 - DNA, 12 bp, Homo sapiens
tgacagcctccc

SEQ ID NO: 4237508 - DNA, 13 bp, Homo sapiens
tgacatacatatt

SEQ ID NO: 4237509 - DNA, 21 bp, Homo sapiens
tgacctctgcagcaataaagc

SEQ ID NO: 4237510 - DNA, 14 bp, Homo sapiens
tgacgcaatgaaaa

SEQ ID NO: 4237511 - DNA, 24 bp, Homo sapiens
tgactacgtcttaagtcagatttt

SEQ ID NO: 4237512 - DNA, 19 bp, Homo sapiens
tgactgtaccacagacaca

SEQ ID NO: 4237513 - DNA, 17 bp, Homo sapiens
tgactgttgatgaagta

SEQ ID NO: 4237514 - DNA, 20 bp, Homo sapiens
tgacttactgtacatgaaaa

SEQ ID NO: 4237515 - DNA, 22 bp, Homo sapiens
tgactttttttggtataatgtt

SEQ ID NO: 4237516 - DNA, 12 bp, Homo sapiens
tgagacaatgtt

SEQ ID NO: 4237517 - DNA, 19 bp, Homo sapiens
tgagacaatgttttcttca

SEQ ID NO: 4237518 - DNA, 20 bp, Homo sapiens
tgagacaatgttttcttcaa

SEQ ID NO: 4237519 - DNA, 13 bp, Homo sapiens
tgagacagacacc

SEQ ID NO: 4237520 - DNA, 18 bp, Homo sapiens
tgagactgggtctcgctt

SEQ ID NO: 4237521 - DNA, 22 bp, Homo sapiens
tgagagcgaattgtgtggagaa

SEQ ID NO: 4237522 - DNA, 20 bp, Homo sapiens
tgagagttggggagaaactg

SEQ ID NO: 4237523 - DNA, 19 bp, Homo sapiens
tgagcagcatctagtttcc

SEQ ID NO: 4237524 - DNA, 17 bp, Homo sapiens
tgagccagcccaagggc

SEQ ID NO: 4237525 - DNA, 13 bp, Homo sapiens
tgagcctgtccaa

SEQ ID NO: 4237526 - DNA, 23 bp, Homo sapiens
tgagcctgtccaatttctgctgt

SEQ ID NO: 4237527 - DNA, 19 bp, Homo sapiens
tgagccttgaactttgacc

SEQ ID NO: 4237528 - DNA, 10 bp, Homo sapiens
tgagctttct

SEQ ID NO: 4237529 - DNA, 15 bp, Homo sapiens
tgagctttctgtgca

SEQ ID NO: 4237530 - DNA, 18 bp, Homo sapiens
tgagctttctgtgcatgt

SEQ ID NO: 4237531 - DNA, 19 bp, Homo sapiens
tgagctttctgtgcatgtg

SEQ ID NO: 4237532 - DNA, 21 bp, Homo sapiens
tgaggcatttgtttgaactga

SEQ ID NO: 4237533 - DNA, 12 bp, Homo sapiens
tgagggcaaatc

SEQ ID NO: 4237534 - DNA, 23 bp, Homo sapiens
tgagggtttccttcggggaccag

SEQ ID NO: 4237535 - DNA, 14 bp, Homo sapiens
tgaggtctgttctt

SEQ ID NO: 4237536 - DNA, 19 bp, Homo sapiens
tgagtacgttgtgcatttg

SEQ ID NO: 4237537 - DNA, 14 bp, Homo sapiens
tgagtgagcatgcc

SEQ ID NO: 4237538 - DNA, 15 bp, Homo sapiens
tgagtggccagggaa

SEQ ID NO: 4237539 - DNA, 13 bp, Homo sapiens
tgagtgtggactt

SEQ ID NO: 4237540 - DNA, 18 bp, Homo sapiens
tgagtttgtaggtaaaat

SEQ ID NO: 4237541 - DNA, 17 bp, Homo sapiens
tgataaaataaataatt

SEQ ID NO: 4237542 - DNA, 14 bp, Homo sapiens
tgatacaatgctgt

SEQ ID NO: 4237543 - DNA, 15 bp, Homo sapiens
tgatacaatgctgtg

SEQ ID NO: 4237544 - DNA, 18 bp, Homo sapiens
tgatacaatgctgtgccc

SEQ ID NO: 4237545 - DNA, 21 bp, Homo sapiens
tgatacaatgctgtgccctaa

SEQ ID NO: 4237546 - DNA, 14 bp, Homo sapiens
tgatactacagttt

SEQ ID NO: 4237547 - DNA, 21 bp, Homo sapiens
tgataggaagcgtctggcaga

SEQ ID NO: 4237548 - DNA, 16 bp, Homo sapiens
tgatattatattaaac

SEQ ID NO: 4237549 - DNA, 15 bp, Homo sapiens
tgatattgtttaaaa

SEQ ID NO: 4237550 - DNA, 17 bp, Homo sapiens
tgatatttttatacaag

SEQ ID NO: 4237551 - DNA, 21 bp, Homo sapiens
tgatatttttatacaagtaat

SEQ ID NO: 4237552 - DNA, 12 bp, Homo sapiens
tgatgagacctg

SEQ ID NO: 4237553 - DNA, 13 bp, Homo sapiens
tgatgatgctggc

SEQ ID NO: 4237554 - DNA, 16 bp, Homo sapiens
tgatgattttcatttc

SEQ ID NO: 4237555 - DNA, 20 bp, Homo sapiens
tgatgccctgctccagggag

SEQ ID NO: 4237556 - DNA, 14 bp, Homo sapiens
tgatgtgacttttt

SEQ ID NO: 4237557 - DNA, 18 bp, Homo sapiens
tgatgttttaaggatgct

SEQ ID NO: 4237558 - DNA, 14 bp, Homo sapiens
tgattcccgggctt

SEQ ID NO: 4237559 - DNA, 18 bp, Homo sapiens
tgatttccgttaaaatac

SEQ ID NO: 4237560 - DNA, 16 bp, Homo sapiens
tgattttcatttcatg

SEQ ID NO: 4237561 - DNA, 17 bp, Homo sapiens
tgattttcatttcatga

SEQ ID NO: 4237562 - DNA, 18 bp, Homo sapiens
tgcaaacttttttatatc

SEQ ID NO: 4237563 - DNA, 23 bp, Homo sapiens
tgcaaagtacaatgtgtttttct

SEQ ID NO: 4237564 - DNA, 20 bp, Homo sapiens
tgcaaagtatccctactgta

SEQ ID NO: 4237565 - DNA, 19 bp, Homo sapiens
tgcaacctcacctcccggg

SEQ ID NO: 4237566 - DNA, 11 bp, Homo sapiens
tgcaataattt

SEQ ID NO: 4237567 - DNA, 14 bp, Homo sapiens
tgcaataattttac

SEQ ID NO: 4237568 - DNA, 16 bp, Homo sapiens
tgcaatccatttattt

SEQ ID NO: 4237569 - DNA, 22 bp, Homo sapiens
tgcaatccatttatttcattta

SEQ ID NO: 4237570 - DNA, 15 bp, Homo sapiens
tgcacaaggattgaa

SEQ ID NO: 4237571 - DNA, 17 bp, Homo sapiens
tgcacaaggattgaaaa

SEQ ID NO: 4237572 - DNA, 11 bp, Homo sapiens
tgcacacattt

SEQ ID NO: 4237573 - DNA, 19 bp, Homo sapiens
tgcacagagttgttacatt

SEQ ID NO: 4237574 - DNA, 20 bp, Homo sapiens
tgcacagagttgttacattt

SEQ ID NO: 4237575 - DNA, 21 bp, Homo sapiens
tgcacagagttgttacatttt

SEQ ID NO: 4237576 - DNA, 22 bp, Homo sapiens
tgcacagagttgttacattttt

SEQ ID NO: 4237577 - DNA, 17 bp, Homo sapiens
tgcacagcgtcctgtcc

SEQ ID NO: 4237578 - DNA, 22 bp, Homo sapiens
tgcacctggaatatataaccag

SEQ ID NO: 4237579 - DNA, 13 bp, Homo sapiens
tgcactgtccagc

SEQ ID NO: 4237580 - DNA, 22 bp, Homo sapiens
tgcactttttaagtttgaagag

SEQ ID NO: 4237581 - DNA, 24 bp, Homo sapiens
tgcagaacatcgatatgtatatca

SEQ ID NO: 4237582 - DNA, 13 bp, Homo sapiens
tgcagaataatgg

SEQ ID NO: 4237583 - DNA, 16 bp, Homo sapiens
tgcagcaataaagcag

SEQ ID NO: 4237584 - DNA, 23 bp, Homo sapiens
tgcagcaataaagcagcgtttct

SEQ ID NO: 4237585 - DNA, 17 bp, Homo sapiens
tgcagcccgtgtccagg

SEQ ID NO: 4237586 - DNA, 14 bp, Homo sapiens
tgcagcgccacctg

SEQ ID NO: 4237587 - DNA, 17 bp, Homo sapiens
tgcagtttttaaaaacc

SEQ ID NO: 4237588 - DNA, 16 bp, Homo sapiens
tgcataaatgcataat

SEQ ID NO: 4237589 - DNA, 17 bp, Homo sapiens
tgcataaatgcataatt

SEQ ID NO: 4237590 - DNA, 12 bp, Homo sapiens
tgcataccactt

SEQ ID NO: 4237591 - DNA, 22 bp, Homo sapiens
tcctcagcttcttcacaggcac

SEQ ID NO: 4237592 - DNA, 14 bp, Homo sapiens
tcctccgaggccag

SEQ ID NO: 4237593 - DNA, 15 bp, Homo sapiens
tcctctcaggctctt

SEQ ID NO: 4237594 - DNA, 13 bp, Homo sapiens
tcctcttcagaac

SEQ ID NO: 4237595 - DNA, 12 bp, Homo sapiens
tcctcttcccag

SEQ ID NO: 4237596 - DNA, 14 bp, Homo sapiens
tcctctttgccctg

SEQ ID NO: 4237597 - DNA, 15 bp, Homo sapiens
tcctctttgccctga

SEQ ID NO: 4237598 - DNA, 12 bp, Homo sapiens
tcctgaatattt

SEQ ID NO: 4237599 - DNA, 13 bp, Homo sapiens
tcctgaatatttt

SEQ ID NO: 4237600 - DNA, 16 bp, Homo sapiens
tcctgaatattttttg

SEQ ID NO: 4237601 - DNA, 14 bp, Homo sapiens
tcctgatgatgctg

SEQ ID NO: 4237602 - DNA, 14 bp, Homo sapiens
tcctgcctcagcct

SEQ ID NO: 4237603 - DNA, 17 bp, Homo sapiens
tcctgcctcagcctccg

SEQ ID NO: 4237604 - DNA, 13 bp, Homo sapiens
tcctggagcactg

SEQ ID NO: 4237605 - DNA, 22 bp, Homo sapiens
tcctgtacctcttgagccttga

SEQ ID NO: 4237606 - DNA, 15 bp, Homo sapiens
tcctgtccccagggg

SEQ ID NO: 4237607 - DNA, 19 bp, Homo sapiens
tcctgtttataatctgaag

SEQ ID NO: 4237608 - DNA, 18 bp, Homo sapiens
tccttcatcgaatgctaa

SEQ ID NO: 4237609 - DNA, 13 bp, Homo sapiens
tccttcctaccct

SEQ ID NO: 4237610 - DNA, 17 bp, Homo sapiens
tccttgcacctgagcct

SEQ ID NO: 4237611 - DNA, 14 bp, Homo sapiens
tcggagggtgccgt

SEQ ID NO: 4237612 - DNA, 12 bp, Homo sapiens
tcggccgcccgg

SEQ ID NO: 4237613 - DNA, 15 bp, Homo sapiens
tcgggctcacgtcgc

SEQ ID NO: 4237614 - DNA, 19 bp, Homo sapiens
tcggggaccagcccacagc

SEQ ID NO: 4237615 - DNA, 23 bp, Homo sapiens
tcgtcactgcttaacttcacata

SEQ ID NO: 4237616 - DNA, 15 bp, Homo sapiens
tcgtgctccgcaggg

SEQ ID NO: 4237617 - DNA, 17 bp, Homo sapiens
tcgtgctccgcagggcg

SEQ ID NO: 4237618 - DNA, 19 bp, Homo sapiens
tctaaacagttatttctgt

SEQ ID NO: 4237619 - DNA, 16 bp, Homo sapiens
tctaaaggctaccttt

SEQ ID NO: 4237620 - DNA, 18 bp, Homo sapiens
tctaaaggctacctttgt

SEQ ID NO: 4237621 - DNA, 19 bp, Homo sapiens
tctaaaggctacctttgta

SEQ ID NO: 4237622 - DNA, 20 bp, Homo sapiens
tctaaaggctacctttgtat

SEQ ID NO: 4237623 - DNA, 23 bp, Homo sapiens
tctaactcccccattttacagat

SEQ ID NO: 4237624 - DNA, 19 bp, Homo sapiens
tctaatatccccaaattag

SEQ ID NO: 4237625 - DNA, 22 bp, Homo sapiens
tctaatttgaactggtattgtt

SEQ ID NO: 4237626 - DNA, 13 bp, Homo sapiens
tctacaaagcact

SEQ ID NO: 4237627 - DNA, 23 bp, Homo sapiens
tctacaaagcactagagaatgca

SEQ ID NO: 4237628 - DNA, 17 bp, Homo sapiens
tctacagaataatccag

SEQ ID NO: 4237629 - DNA, 21 bp, Homo sapiens
tctacctaatgtctcactgtt

SEQ ID NO: 4237630 - DNA, 23 bp, Homo sapiens
tctacctaatgtctcactgttct

SEQ ID NO: 4237631 - DNA, 22 bp, Homo sapiens
tctacgacccttttgagcctag

SEQ ID NO: 4237632 - DNA, 14 bp, Homo sapiens
tctacttacagttg

SEQ ID NO: 4237633 - DNA, 24 bp, Homo sapiens
tctagatactgtatcatgacaaag

SEQ ID NO: 4237634 - DNA, 16 bp, Homo sapiens
tctaggacttcaaagt

SEQ ID NO: 4237635 - DNA, 22 bp, Homo sapiens
tctagtttgattaaattcttgc

SEQ ID NO: 4237636 - DNA, 23 bp, Homo sapiens
tctagtttgattaaattcttgca

SEQ ID NO: 4237637 - DNA, 22 bp, Homo sapiens
tctatcaagtattatacctttt

SEQ ID NO: 4237638 - DNA, 17 bp, Homo sapiens
tctatgacacatgcaag

SEQ ID NO: 4237639 - DNA, 17 bp, Homo sapiens
tctatgttaaatactgt

SEQ ID NO: 4237640 - DNA, 21 bp, Homo sapiens
tctattgacttttcaataaat

SEQ ID NO: 4237641 - DNA, 14 bp, Homo sapiens
tctatttacctcct

SEQ ID NO: 4237642 - DNA, 22 bp, Homo sapiens
tctatttacctcctaatggcat

SEQ ID NO: 4237643 - DNA, 11 bp, Homo sapiens
tctcaaagtta

SEQ ID NO: 4237644 - DNA, 17 bp, Homo sapiens
tctcaaagttaattcac

SEQ ID NO: 4237645 - DNA, 15 bp, Homo sapiens
tctcaagctagtgtt

SEQ ID NO: 4237646 - DNA, 19 bp, Homo sapiens
tctcaatcttggtttgtca

SEQ ID NO: 4237647 - DNA, 18 bp, Homo sapiens
tctcacaggcagctctga

SEQ ID NO: 4237648 - DNA, 22 bp, Homo sapiens
tctcacaggcagctctgagccg

SEQ ID NO: 4237649 - DNA, 13 bp, Homo sapiens
tctcactgttctg

SEQ ID NO: 4237650 - DNA, 16 bp, Homo sapiens
tctcactgttctgcaa

SEQ ID NO: 4237651 - DNA, 14 bp, Homo sapiens
tctcagcccagaag

SEQ ID NO: 4237652 - DNA, 11 bp, Homo sapiens
tctcagcctcc

SEQ ID NO: 4237653 - DNA, 15 bp, Homo sapiens
tctcagctataattc

SEQ ID NO: 4237654 - DNA, 22 bp, Homo sapiens
tctccacacggagctcctggca

SEQ ID NO: 4237655 - DNA, 23 bp, Homo sapiens
tctccacacggagctcctggcag

SEQ ID NO: 4237656 - DNA, 21 bp, Homo sapiens
tctccagtgctgtccatgctt

SEQ ID NO: 4237657 - DNA, 23 bp, Homo sapiens
tctcccagatcctggaaacagca

SEQ ID NO: 4237658 - DNA, 12 bp, Homo sapiens
tctccccagaat

SEQ ID NO: 4237659 - DNA, 20 bp, Homo sapiens
tctccctcccccagagcccc

SEQ ID NO: 4237660 - DNA, 19 bp, Homo sapiens
tctcctgtacctcttgagc

SEQ ID NO: 4237661 - DNA, 12 bp, Homo sapiens
tctcctttgaaa

SEQ ID NO: 4237662 - DNA, 14 bp, Homo sapiens
tctcgtttctgccc

SEQ ID NO: 4237663 - DNA, 16 bp, Homo sapiens
tctcgtttctgcccag

SEQ ID NO: 4237664 - DNA, 22 bp, Homo sapiens
tctctaacttcaaggcccatat

SEQ ID NO: 4237665 - DNA, 19 bp, Homo sapiens
tctctaacttcaccatatt

SEQ ID NO: 4237666 - DNA, 15 bp, Homo sapiens
tctctccacacggag

SEQ ID NO: 4237667 - DNA, 17 bp, Homo sapiens
tctctccacacggagct

SEQ ID NO: 4237668 - DNA, 20 bp, Homo sapiens
tctctccctcccccagagcc

SEQ ID NO: 4237669 - DNA, 22 bp, Homo sapiens
tctctccctcccccagagcccc

SEQ ID NO: 4237670 - DNA, 14 bp, Homo sapiens
tctctcctgtacct

SEQ ID NO: 4237671 - DNA, 20 bp, Homo sapiens
tctctcctgtacctcttgag

SEQ ID NO: 4237672 - DNA, 20 bp, Homo sapiens
tctctggggcaggctgcttc

SEQ ID NO: 4237673 - DNA, 10 bp, Homo sapiens
tctgaatatt

SEQ ID NO: 4237674 - DNA, 19 bp, Homo sapiens
tctgcaaaggtggcaatgc

SEQ ID NO: 4237675 - DNA, 23 bp, Homo sapiens
tctgcccagccctctgtggccag

SEQ ID NO: 4237676 - DNA, 21 bp, Homo sapiens
tctgccgctttgtctgtccag

SEQ ID NO: 4237677 - DNA, 19 bp, Homo sapiens
tctgcctccaacccagcag

SEQ ID NO: 4237678 - DNA, 20 bp, Homo sapiens
tctgcctccaacccagcagt

SEQ ID NO: 4237679 - DNA, 14 bp, Homo sapiens
tctgctggcccagc

SEQ ID NO: 4237680 - DNA, 15 bp, Homo sapiens
tctgctttatctttt

SEQ ID NO: 4237681 - DNA, 17 bp, Homo sapiens
tctgctttatcttttca

SEQ ID NO: 4237682 - DNA, 18 bp, Homo sapiens
tctgctttatcttttcat

SEQ ID NO: 4237683 - DNA, 22 bp, Homo sapiens
tctgctttctttgattctcctt

SEQ ID NO: 4237684 - DNA, 16 bp, Homo sapiens
tctggcacgtggccag

SEQ ID NO: 4237685 - DNA, 17 bp, Homo sapiens
tctggcacgtggccagg

SEQ ID NO: 4237686 - DNA, 20 bp, Homo sapiens
tctggcacgtggccaggagc

SEQ ID NO: 4237687 - DNA, 11 bp, Homo sapiens
tctggccaggc

SEQ ID NO: 4237688 - DNA, 14 bp, Homo sapiens
tctggctatgcatt

SEQ ID NO: 4237689 - DNA, 14 bp, Homo sapiens
tctgggatctgcca

SEQ ID NO: 4237690 - DNA, 18 bp, Homo sapiens
tctgtagacttttgaaaa

SEQ ID NO: 4237691 - DNA, 15 bp, Homo sapiens
tctgtccagccgtgt

SEQ ID NO: 4237692 - DNA, 16 bp, Homo sapiens
tctgtccagccgtgtg

SEQ ID NO: 4237693 - DNA, 14 bp, Homo sapiens
tctgtggccaggag

SEQ ID NO: 4237694 - DNA, 15 bp, Homo sapiens
tctgtggccaggagc

SEQ ID NO: 4237695 - DNA, 14 bp, Homo sapiens
tctgttgcacctga

SEQ ID NO: 4237696 - DNA, 18 bp, Homo sapiens
tctgtttcctatttaata

SEQ ID NO: 4237697 - DNA, 11 bp, Homo sapiens
tcttaatctgt

SEQ ID NO: 4237698 - DNA, 14 bp, Homo sapiens
tcttaatctgtgtg

SEQ ID NO: 4237699 - DNA, 22 bp, Homo sapiens
tcttcaacatgctccaaatata

SEQ ID NO: 4237700 - DNA, 12 bp, Homo sapiens
tcttcagaactt

SEQ ID NO: 4237701 - DNA, 18 bp, Homo sapiens
tcttcagatctctaactt

SEQ ID NO: 4237702 - DNA, 16 bp, Homo sapiens
tcttgagccttgaact

SEQ ID NO: 4237703 - DNA, 19 bp, Homo sapiens
tcttgagccttgaactttg

SEQ ID NO: 4237704 - DNA, 16 bp, Homo sapiens
tcttgcactgtccagc

SEQ ID NO: 4237705 - DNA, 16 bp, Homo sapiens
tcttggggcaagactg

SEQ ID NO: 4237706 - DNA, 15 bp, Homo sapiens
tctttcatctcccag

SEQ ID NO: 4237707 - DNA, 13 bp, Homo sapiens
tctttccaaagta

SEQ ID NO: 4237708 - DNA, 17 bp, Homo sapiens
tattgtaaattttagaa

SEQ ID NO: 4237709 - DNA, 23 bp, Homo sapiens
tatttaagtagtgggcatttcat

SEQ ID NO: 4237710 - DNA, 18 bp, Homo sapiens
tatttaatatcaaaagaa

SEQ ID NO: 4237711 - DNA, 15 bp, Homo sapiens
tatttctttttatag

SEQ ID NO: 4237712 - DNA, 19 bp, Homo sapiens
tatttgctaatgtataatg

SEQ ID NO: 4237713 - DNA, 13 bp, Homo sapiens
tattttaaaatat

SEQ ID NO: 4237714 - DNA, 15 bp, Homo sapiens
tattttaaaatatat

SEQ ID NO: 4237715 - DNA, 15 bp, Homo sapiens
tattttgataataat

SEQ ID NO: 4237716 - DNA, 20 bp, Homo sapiens
tattttgcactctgtaattg

SEQ ID NO: 4237717 - DNA, 21 bp, Homo sapiens
tattttgcactctgtaattgc

SEQ ID NO: 4237718 - DNA, 13 bp, Homo sapiens
tattttgctttgt

SEQ ID NO: 4237719 - DNA, 15 bp, Homo sapiens
tattttgctttgtga

SEQ ID NO: 4237720 - DNA, 23 bp, Homo sapiens
tattttggaaactgctaaattct

SEQ ID NO: 4237721 - DNA, 20 bp, Homo sapiens
tatttttctacattattgct

SEQ ID NO: 4237722 - DNA, 13 bp, Homo sapiens
tatttttgacaga

SEQ ID NO: 4237723 - DNA, 12 bp, Homo sapiens
tatttttgtact

SEQ ID NO: 4237724 - DNA, 20 bp, Homo sapiens
tattttttgctctaatctct

SEQ ID NO: 4237725 - DNA, 16 bp, Homo sapiens
tcaaactttactatgg

SEQ ID NO: 4237726 - DNA, 13 bp, Homo sapiens
tcaaagatatttt

SEQ ID NO: 4237727 - DNA, 20 bp, Homo sapiens
tcaaagatattttgctttgt

SEQ ID NO: 4237728 - DNA, 18 bp, Homo sapiens
tcaaagttaattcaccta

SEQ ID NO: 4237729 - DNA, 19 bp, Homo sapiens
tcaaagttaattcacctat

SEQ ID NO: 4237730 - DNA, 22 bp, Homo sapiens
tcaaagttaattcacctatgtt

SEQ ID NO: 4237731 - DNA, 17 bp, Homo sapiens
tcaaatcagtgataatt

SEQ ID NO: 4237732 - DNA, 15 bp, Homo sapiens
tcaaatttctaaatc

SEQ ID NO: 4237733 - DNA, 18 bp, Homo sapiens
tcaactgggctctgtccc

SEQ ID NO: 4237734 - DNA, 17 bp, Homo sapiens
tcaagctagtgtttcta

SEQ ID NO: 4237735 - DNA, 22 bp, Homo sapiens
tcaaggtttaaccttaaaatta

SEQ ID NO: 4237736 - DNA, 15 bp, Homo sapiens
tcaagtattatacct

SEQ ID NO: 4237737 - DNA, 14 bp, Homo sapiens
tcaagtctctgctg

SEQ ID NO: 4237738 - DNA, 20 bp, Homo sapiens
tcaatctctgttgcacctga

SEQ ID NO: 4237739 - DNA, 16 bp, Homo sapiens
tcaattcataaaaaca

SEQ ID NO: 4237740 - DNA, 17 bp, Homo sapiens
tcaattggcagtgactt

SEQ ID NO: 4237741 - DNA, 18 bp, Homo sapiens
tcaattggcagtgacttt

SEQ ID NO: 4237742 - DNA, 18 bp, Homo sapiens
tcacaggcagctctgagc

SEQ ID NO: 4237743 - DNA, 20 bp, Homo sapiens
tcacaggcagctctgagccg

SEQ ID NO: 4237744 - DNA, 14 bp, Homo sapiens
tcacagtcctgagt

SEQ ID NO: 4237745 - DNA, 17 bp, Homo sapiens
tcacagtgttgcccagg

SEQ ID NO: 4237746 - DNA, 16 bp, Homo sapiens
tcacatattgatttcc

SEQ ID NO: 4237747 - DNA, 20 bp, Homo sapiens
tcacatattgatttccgtta

SEQ ID NO: 4237748 - DNA, 21 bp, Homo sapiens
tcactgcattcattctgagcc

SEQ ID NO: 4237749 - DNA, 22 bp, Homo sapiens
tcactgcattcattctgagccc

SEQ ID NO: 4237750 - DNA, 20 bp, Homo sapiens
tcactgcttaacttcacata

SEQ ID NO: 4237751 - DNA, 17 bp, Homo sapiens
tcacttttgttctgctt

SEQ ID NO: 4237752 - DNA, 20 bp, Homo sapiens
tcagactctcagcccagaag

SEQ ID NO: 4237753 - DNA, 15 bp, Homo sapiens
tcagatctctaactt

SEQ ID NO: 4237754 - DNA, 18 bp, Homo sapiens
tcagattgtcttgcaact

SEQ ID NO: 4237755 - DNA, 19 bp, Homo sapiens
tcagattgtcttgcaactt

SEQ ID NO: 4237756 - DNA, 18 bp, Homo sapiens
tcagatttttatttatga

SEQ ID NO: 4237757 - DNA, 15 bp, Homo sapiens
tcagcacgatttctg

SEQ ID NO: 4237758 - DNA, 15 bp, Homo sapiens
tcagcccagaagaaa

SEQ ID NO: 4237759 - DNA, 16 bp, Homo sapiens
tcagcccagaagaaaa

SEQ ID NO: 4237760 - DNA, 21 bp, Homo sapiens
tcagcttcttcacaggcactc

SEQ ID NO: 4237761 - DNA, 21 bp, Homo sapiens
tcaggcgatccacctgtctca

SEQ ID NO: 4237762 - DNA, 23 bp, Homo sapiens
tcagtgataattggtttgactgt

SEQ ID NO: 4237763 - DNA, 12 bp, Homo sapiens
tcagtttttgta

SEQ ID NO: 4237764 - DNA, 16 bp, Homo sapiens
tcagtttttgtatctt

SEQ ID NO: 4237765 - DNA, 20 bp, Homo sapiens
tcataaaaacaagtcatttt

SEQ ID NO: 4237766 - DNA, 20 bp, Homo sapiens
tcataaagggttgaaaatgt

SEQ ID NO: 4237767 - DNA, 21 bp, Homo sapiens
tcataaagggttgaaaatgtg

SEQ ID NO: 4237768 - DNA, 15 bp, Homo sapiens
tcataataggtagtt

SEQ ID NO: 4237769 - DNA, 21 bp, Homo sapiens
tcataataggtagtttggata

SEQ ID NO: 4237770 - DNA, 21 bp, Homo sapiens
tcatagggaaaggttttgtat

SEQ ID NO: 4237771 - DNA, 15 bp, Homo sapiens
tcatatacaaacatg

SEQ ID NO: 4237772 - DNA, 15 bp, Homo sapiens
tcatatattaaaaca

SEQ ID NO: 4237773 - DNA, 13 bp, Homo sapiens
tcatccaaaatat

SEQ ID NO: 4237774 - DNA, 22 bp, Homo sapiens
tcatccaaaatattttttgcaa

SEQ ID NO: 4237775 - DNA, 13 bp, Homo sapiens
tcatcttgtgaaa

SEQ ID NO: 4237776 - DNA, 19 bp, Homo sapiens
tcatgacaaagactgagta

SEQ ID NO: 4237777 - DNA, 21 bp, Homo sapiens
tcattaggtgtgactgaattt

SEQ ID NO: 4237778 - DNA, 16 bp, Homo sapiens
tcattcacttctctta

SEQ ID NO: 4237779 - DNA, 13 bp, Homo sapiens
tcattctgagccc

SEQ ID NO: 4237780 - DNA, 17 bp, Homo sapiens
tcattgttttgaatatt

SEQ ID NO: 4237781 - DNA, 14 bp, Homo sapiens
tcatttaaatatct

SEQ ID NO: 4237782 - DNA, 15 bp, Homo sapiens
tcatttcatgaaaat

SEQ ID NO: 4237783 - DNA, 17 bp, Homo sapiens
tcattttcctgacattt

SEQ ID NO: 4237784 - DNA, 12 bp, Homo sapiens
tcatttttgctg

SEQ ID NO: 4237785 - DNA, 18 bp, Homo sapiens
tcattttttttaagaaaa

SEQ ID NO: 4237786 - DNA, 17 bp, Homo sapiens
tccaaatataagacatt

SEQ ID NO: 4237787 - DNA, 15 bp, Homo sapiens
tccaaattgtgcttc

SEQ ID NO: 4237788 - DNA, 22 bp, Homo sapiens
tccaaattgtgcttctccccag

SEQ ID NO: 4237789 - DNA, 23 bp, Homo sapiens
tccaaattgtgcttctccccaga

SEQ ID NO: 4237790 - DNA, 20 bp, Homo sapiens
tccaacccagcagttctctg

SEQ ID NO: 4237791 - DNA, 22 bp, Homo sapiens
tccacacggagctcctggcagc

SEQ ID NO: 4237792 - DNA, 13 bp, Homo sapiens
tccacctgtctca

SEQ ID NO: 4237793 - DNA, 20 bp, Homo sapiens
tccacctgtctcagcctccc

SEQ ID NO: 4237794 - DNA, 15 bp, Homo sapiens
tccactcccaagcca

SEQ ID NO: 4237795 - DNA, 18 bp, Homo sapiens
tccactcccaagccacta

SEQ ID NO: 4237796 - DNA, 23 bp, Homo sapiens
tccactgttctcctgaatatttt

SEQ ID NO: 4237797 - DNA, 18 bp, Homo sapiens
tccacttcaggagcccta

SEQ ID NO: 4237798 - DNA, 19 bp, Homo sapiens
tccagccgtgtgtgcatgt

SEQ ID NO: 4237799 - DNA, 16 bp, Homo sapiens
tccagcctgcctggca

SEQ ID NO: 4237800 - DNA, 19 bp, Homo sapiens
tccagcctgcctggcaggc

SEQ ID NO: 4237801 - DNA, 13 bp, Homo sapiens
tccagtattgctg

SEQ ID NO: 4237802 - DNA, 15 bp, Homo sapiens
tccatgacaggcctg

SEQ ID NO: 4237803 - DNA, 17 bp, Homo sapiens
tcccacacccacctctg

SEQ ID NO: 4237804 - DNA, 20 bp, Homo sapiens
tcccacccccatctctccct

SEQ ID NO: 4237805 - DNA, 15 bp, Homo sapiens
tcccagatcctggaa

SEQ ID NO: 4237806 - DNA, 19 bp, Homo sapiens
tcccagtgagtctctgggg

SEQ ID NO: 4237807 - DNA, 18 bp, Homo sapiens
tccccagtgctcctggcc

SEQ ID NO: 4237808 - DNA, 13 bp, Homo sapiens
tcccccagagccc

SEQ ID NO: 4237809 - DNA, 17 bp, Homo sapiens
tcccccgttgtgcctgg

SEQ ID NO: 4237810 - DNA, 16 bp, Homo sapiens
tccccctggttgggtg

SEQ ID NO: 4237811 - DNA, 15 bp, Homo sapiens
tccctactgtaattt

SEQ ID NO: 4237812 - DNA, 16 bp, Homo sapiens
tccctcccctgccatt

SEQ ID NO: 4237813 - DNA, 21 bp, Homo sapiens
tccctgggatggacgctgccg

SEQ ID NO: 4237814 - DNA, 22 bp, Homo sapiens
tccctgggatggacgctgccgg

SEQ ID NO: 4237815 - DNA, 12 bp, Homo sapiens
tcccttaaaatt

SEQ ID NO: 4237816 - DNA, 22 bp, Homo sapiens
tcccttaaaattaccagacaaa

SEQ ID NO: 4237817 - DNA, 12 bp, Homo sapiens
tcccttttgcta

SEQ ID NO: 4237818 - DNA, 13 bp, Homo sapiens
tccggagcgccct

SEQ ID NO: 4237819 - DNA, 16 bp, Homo sapiens
tccggagcgccctgca

SEQ ID NO: 4237820 - DNA, 19 bp, Homo sapiens
tccgtgcttgctggtgcct

SEQ ID NO: 4237821 - DNA, 15 bp, Homo sapiens
tccgttaaaatacca

SEQ ID NO: 4237822 - DNA, 16 bp, Homo sapiens
tcctactcctggagca

SEQ ID NO: 4237823 - DNA, 22 bp, Homo sapiens
tcctagcagacagaaactggat

SEQ ID NO: 4237824 - DNA, 18 bp, Homo sapiens
tactgtaatttgtgatac

SEQ ID NO: 4237825 - DNA, 19 bp, Homo sapiens
tactgtaatttgtgataca

SEQ ID NO: 4237826 - DNA, 22 bp, Homo sapiens
tactgtacatgaaaacacattt

SEQ ID NO: 4237827 - DNA, 18 bp, Homo sapiens
tactgtctgttatgattt

SEQ ID NO: 4237828 - DNA, 23 bp, Homo sapiens
tacttttcccctgttaaacagta

SEQ ID NO: 4237829 - DNA, 15 bp, Homo sapiens
tagaaacttaaacac

SEQ ID NO: 4237830 - DNA, 17 bp, Homo sapiens
tagaagcacggctgtgg

SEQ ID NO: 4237831 - DNA, 20 bp, Homo sapiens
tagacaatcattgttttgaa

SEQ ID NO: 4237832 - DNA, 23 bp, Homo sapiens
tagaccgctctcttttctgtact

SEQ ID NO: 4237833 - DNA, 13 bp, Homo sapiens
tagactatttctt

SEQ ID NO: 4237834 - DNA, 13 bp, Homo sapiens
tagagaatgcaca

SEQ ID NO: 4237835 - DNA, 14 bp, Homo sapiens
tagagaatgcacag

SEQ ID NO: 4237836 - DNA, 14 bp, Homo sapiens
tagaggttcaaaga

SEQ ID NO: 4237837 - DNA, 19 bp, Homo sapiens
tagaggttcaaagatattt

SEQ ID NO: 4237838 - DNA, 21 bp, Homo sapiens
tagaggttcaaagatattttg

SEQ ID NO: 4237839 - DNA, 13 bp, Homo sapiens
tagataaattgta

SEQ ID NO: 4237840 - DNA, 21 bp, Homo sapiens
tagataaattgtagggcttta

SEQ ID NO: 4237841 - DNA, 20 bp, Homo sapiens
tagcagacagaaactggatt

SEQ ID NO: 4237842 - DNA, 18 bp, Homo sapiens
tagcataaataaaactga

SEQ ID NO: 4237843 - DNA, 16 bp, Homo sapiens
tagcatacgtacacat

SEQ ID NO: 4237844 - DNA, 22 bp, Homo sapiens
tagccactagtaagtaattatg

SEQ ID NO: 4237845 - DNA, 13 bp, Homo sapiens
tagccctttaaaa

SEQ ID NO: 4237846 - DNA, 19 bp, Homo sapiens
tagctcaatcacactggaa

SEQ ID NO: 4237847 - DNA, 22 bp, Homo sapiens
tagctcattctccttgtgttac

SEQ ID NO: 4237848 - DNA, 21 bp, Homo sapiens
taggaacttaaataatgtgaa

SEQ ID NO: 4237849 - DNA, 11 bp, Homo sapiens
taggacttcaa

SEQ ID NO: 4237850 - DNA, 21 bp, Homo sapiens
tagggaaggatacaaaagcat

SEQ ID NO: 4237851 - DNA, 15 bp, Homo sapiens
taggtaaaatgtatt

SEQ ID NO: 4237852 - DNA, 16 bp, Homo sapiens
taggtaaaatgtattt

SEQ ID NO: 4237853 - DNA, 16 bp, Homo sapiens
taggtagtttggatat

SEQ ID NO: 4237854 - DNA, 19 bp, Homo sapiens
taggtagtttggatatttt

SEQ ID NO: 4237855 - DNA, 19 bp, Homo sapiens
taggtgtgactgaatttct

SEQ ID NO: 4237856 - DNA, 15 bp, Homo sapiens
tagtaaaatttattt

SEQ ID NO: 4237857 - DNA, 16 bp, Homo sapiens
tagtaagtaattatgc

SEQ ID NO: 4237858 - DNA, 16 bp, Homo sapiens
tagtgaagatggtttc

SEQ ID NO: 4237859 - DNA, 23 bp, Homo sapiens
tagtggatgactgttgatgaagt

SEQ ID NO: 4237860 - DNA, 17 bp, Homo sapiens
tagttgtctctcttcag

SEQ ID NO: 4237861 - DNA, 12 bp, Homo sapiens
tagtttggatat

SEQ ID NO: 4237862 - DNA, 18 bp, Homo sapiens
tataaaacttaaaaacaa

SEQ ID NO: 4237863 - DNA, 15 bp, Homo sapiens
tataaactttacctt

SEQ ID NO: 4237864 - DNA, 15 bp, Homo sapiens
tataaagaatatata

SEQ ID NO: 4237865 - DNA, 18 bp, Homo sapiens
tataaagtatagagagaa

SEQ ID NO: 4237866 - DNA, 19 bp, Homo sapiens
tataaagtatagagagaag

SEQ ID NO: 4237867 - DNA, 14 bp, Homo sapiens
tataacaactattt

SEQ ID NO: 4237868 - DNA, 15 bp, Homo sapiens
tataagacatttgtt

SEQ ID NO: 4237869 - DNA, 22 bp, Homo sapiens
tataagatcactgaagaaagag

SEQ ID NO: 4237870 - DNA, 15 bp, Homo sapiens
tataatctgaagata

SEQ ID NO: 4237871 - DNA, 13 bp, Homo sapiens
tataatgtatttt

SEQ ID NO: 4237872 - DNA, 15 bp, Homo sapiens
tatacaagtaatttc

SEQ ID NO: 4237873 - DNA, 19 bp, Homo sapiens
tatacaagtaatttcctga

SEQ ID NO: 4237874 - DNA, 16 bp, Homo sapiens
tatacatattgtatat

SEQ ID NO: 4237875 - DNA, 20 bp, Homo sapiens
tatacttttcccctgttaaa

SEQ ID NO: 4237876 - DNA, 21 bp, Homo sapiens
tatataaaacttaaaaacaag

SEQ ID NO: 4237877 - DNA, 18 bp, Homo sapiens
tatataaagaatatatat

SEQ ID NO: 4237878 - DNA, 14 bp, Homo sapiens
tatatatataaagt

SEQ ID NO: 4237879 - DNA, 14 bp, Homo sapiens
tatatatatatata

SEQ ID NO: 4237880 - DNA, 19 bp, Homo sapiens
tatatatggtcatatacat

SEQ ID NO: 4237881 - DNA, 15 bp, Homo sapiens
tatatcattctacag

SEQ ID NO: 4237882 - DNA, 20 bp, Homo sapiens
tatatcttttggttattcta

SEQ ID NO: 4237883 - DNA, 22 bp, Homo sapiens
tatattaaacatacataataca

SEQ ID NO: 4237884 - DNA, 17 bp, Homo sapiens
tatattcatatacaaac

SEQ ID NO: 4237885 - DNA, 22 bp, Homo sapiens
tatattcatatacaaacatgta

SEQ ID NO: 4237886 - DNA, 20 bp, Homo sapiens
tatattctgaccgttaaaaa

SEQ ID NO: 4237887 - DNA, 20 bp, Homo sapiens
tatattgagaatcccttaaa

SEQ ID NO: 4237888 - DNA, 21 bp, Homo sapiens
tatcaagtattataccttttt

SEQ ID NO: 4237889 - DNA, 21 bp, Homo sapiens
tatcaattggcagtgactttg

SEQ ID NO: 4237890 - DNA, 18 bp, Homo sapiens
tatcacccagaagaaaat

SEQ ID NO: 4237891 - DNA, 12 bp, Homo sapiens
tatcagatgtga

SEQ ID NO: 4237892 - DNA, 19 bp, Homo sapiens
tatcagctttgataattgt

SEQ ID NO: 4237893 - DNA, 21 bp, Homo sapiens
tatcagctttgataattgtgt

SEQ ID NO: 4237894 - DNA, 12 bp, Homo sapiens
tatcagtacctc

SEQ ID NO: 4237895 - DNA, 21 bp, Homo sapiens
tatcatatattaaaacaataa

SEQ ID NO: 4237896 - DNA, 14 bp, Homo sapiens
tatcattctacaga

SEQ ID NO: 4237897 - DNA, 19 bp, Homo sapiens
tatcattctacagaataat

SEQ ID NO: 4237898 - DNA, 14 bp, Homo sapiens
tatccaaacatgta

SEQ ID NO: 4237899 - DNA, 16 bp, Homo sapiens
tatcgatctcttattt

SEQ ID NO: 4237900 - DNA, 19 bp, Homo sapiens
tatcggattactgaattgt

SEQ ID NO: 4237901 - DNA, 15 bp, Homo sapiens
tatctagatactgta

SEQ ID NO: 4237902 - DNA, 18 bp, Homo sapiens
tatctgacccactttgta

SEQ ID NO: 4237903 - DNA, 11 bp, Homo sapiens
tatctgcagaa

SEQ ID NO: 4237904 - DNA, 17 bp, Homo sapiens
tatcttaagcatgtcaa

SEQ ID NO: 4237905 - DNA, 18 bp, Homo sapiens
tatgaaccctttgtttct

SEQ ID NO: 4237906 - DNA, 20 bp, Homo sapiens
tatgaaccctttgtttcttg

SEQ ID NO: 4237907 - DNA, 20 bp, Homo sapiens
tatgaaggaatcattccagt

SEQ ID NO: 4237908 - DNA, 20 bp, Homo sapiens
tatgaggggcagtggacagt

SEQ ID NO: 4237909 - DNA, 14 bp, Homo sapiens
tatgcacacatttt

SEQ ID NO: 4237910 - DNA, 16 bp, Homo sapiens
tatgcagcaaatatat

SEQ ID NO: 4237911 - DNA, 20 bp, Homo sapiens
tatggaacataaagttgtat

SEQ ID NO: 4237912 - DNA, 16 bp, Homo sapiens
tatggagaattgctga

SEQ ID NO: 4237913 - DNA, 21 bp, Homo sapiens
tatggatttaagagtatttta

SEQ ID NO: 4237914 - DNA, 21 bp, Homo sapiens
tatggccctggcctagcatac

SEQ ID NO: 4237915 - DNA, 16 bp, Homo sapiens
tatggcttttgtgcat

SEQ ID NO: 4237916 - DNA, 17 bp, Homo sapiens
tatggcttttgtgcatt

SEQ ID NO: 4237917 - DNA, 14 bp, Homo sapiens
tatgggtgaaaata

SEQ ID NO: 4237918 - DNA, 14 bp, Homo sapiens
tatggtatgtagcc

SEQ ID NO: 4237919 - DNA, 22 bp, Homo sapiens
tatggtatgtagccagctgtgc

SEQ ID NO: 4237920 - DNA, 13 bp, Homo sapiens
tatggtgtatttt

SEQ ID NO: 4237921 - DNA, 16 bp, Homo sapiens
tatgtaagaacacatt

SEQ ID NO: 4237922 - DNA, 23 bp, Homo sapiens
tatgtaatgaagtaaagccatta

SEQ ID NO: 4237923 - DNA, 21 bp, Homo sapiens
tatgtatatcattctacagaa

SEQ ID NO: 4237924 - DNA, 16 bp, Homo sapiens
tatgttaaatactgtg

SEQ ID NO: 4237925 - DNA, 19 bp, Homo sapiens
tatgttaaatactgtgcag

SEQ ID NO: 4237926 - DNA, 22 bp, Homo sapiens
tatgttaaatactgtgcagaat

SEQ ID NO: 4237927 - DNA, 20 bp, Homo sapiens
tatgttatgatattgtttaa

SEQ ID NO: 4237928 - DNA, 18 bp, Homo sapiens
tattaaaaatctcaaatt

SEQ ID NO: 4237929 - DNA, 23 bp, Homo sapiens
tattaaaaatctcaaatttctaa

SEQ ID NO: 4237930 - DNA, 16 bp, Homo sapiens
tattacaagtaatgta

SEQ ID NO: 4237931 - DNA, 17 bp, Homo sapiens
tattacaagtaatgtaa

SEQ ID NO: 4237932 - DNA, 19 bp, Homo sapiens
tattaggaaaataaacaga

SEQ ID NO: 4237933 - DNA, 21 bp, Homo sapiens
tattaggaaaataaacagaca

SEQ ID NO: 4237934 - DNA, 12 bp, Homo sapiens
tattataccttt

SEQ ID NO: 4237935 - DNA, 15 bp, Homo sapiens
tattcaaatttgatg

SEQ ID NO: 4237936 - DNA, 21 bp, Homo sapiens
tattcctagtggatgactgtt

SEQ ID NO: 4237937 - DNA, 19 bp, Homo sapiens
tattgagtttgtaggtaaa

SEQ ID NO: 4237938 - DNA, 18 bp, Homo sapiens
tattgatatatattataa

SEQ ID NO: 4237939 - DNA, 18 bp, Homo sapiens
tattgcttagtaaaattt

SEQ ID NO: 4237940 - DNA, 18 bp, Homo sapiens
taaattaacttttataaa

SEQ ID NO: 4237941 - DNA, 18 bp, Homo sapiens
taaattctatgttaaata

SEQ ID NO: 4237942 - DNA, 20 bp, Homo sapiens
taaattctatgttaaatact

SEQ ID NO: 4237943 - DNA, 22 bp, Homo sapiens
taaattctatgttaaatactgt

SEQ ID NO: 4237944 - DNA, 14 bp, Homo sapiens
taacagaaatgtac

SEQ ID NO: 4237945 - DNA, 14 bp, Homo sapiens
taaccagcagaaat

SEQ ID NO: 4237946 - DNA, 17 bp, Homo sapiens
taacccagttaacttac

SEQ ID NO: 4237947 - DNA, 17 bp, Homo sapiens
taaccttaaaattgata

SEQ ID NO: 4237948 - DNA, 14 bp, Homo sapiens
taacttcaccatat

SEQ ID NO: 4237949 - DNA, 20 bp, Homo sapiens
taacttttataaactttacc

SEQ ID NO: 4237950 - DNA, 18 bp, Homo sapiens
taagaaaaaggatgcaca

SEQ ID NO: 4237951 - DNA, 23 bp, Homo sapiens
taagaatatttttagactatttc

SEQ ID NO: 4237952 - DNA, 15 bp, Homo sapiens
taagaatgagcctgt

SEQ ID NO: 4237953 - DNA, 16 bp, Homo sapiens
taagaatgcttaaaaa

SEQ ID NO: 4237954 - DNA, 23 bp, Homo sapiens
taagagtattttaagaagacata

SEQ ID NO: 4237955 - DNA, 21 bp, Homo sapiens
taaggaatttgatgattttca

SEQ ID NO: 4237956 - DNA, 20 bp, Homo sapiens
taaggatgcttgtacataat

SEQ ID NO: 4237957 - DNA, 21 bp, Homo sapiens
taaggatgcttgtacataatg

SEQ ID NO: 4237958 - DNA, 14 bp, Homo sapiens
taagtgctgcattt

SEQ ID NO: 4237959 - DNA, 15 bp, Homo sapiens
taagtgggctcctga

SEQ ID NO: 4237960 - DNA, 17 bp, Homo sapiens
taagttaataatgtatt

SEQ ID NO: 4237961 - DNA, 19 bp, Homo sapiens
taagttaataatgtattgt

SEQ ID NO: 4237962 - DNA, 14 bp, Homo sapiens
taataatattgttt

SEQ ID NO: 4237963 - DNA, 20 bp, Homo sapiens
taataatgtattgtaatctt

SEQ ID NO: 4237964 - DNA, 14 bp, Homo sapiens
taatacaccactac

SEQ ID NO: 4237965 - DNA, 23 bp, Homo sapiens
taatacaccactacattctgtta

SEQ ID NO: 4237966 - DNA, 18 bp, Homo sapiens
taatagacaatttattat

SEQ ID NO: 4237967 - DNA, 17 bp, Homo sapiens
taataggtagtttggat

SEQ ID NO: 4237968 - DNA, 19 bp, Homo sapiens
taataggtagtttggatat

SEQ ID NO: 4237969 - DNA, 19 bp, Homo sapiens
taatatgcacacatttttt

SEQ ID NO: 4237970 - DNA, 16 bp, Homo sapiens
taatatggtgtatttt

SEQ ID NO: 4237971 - DNA, 19 bp, Homo sapiens
taatattcttttgtttcca

SEQ ID NO: 4237972 - DNA, 11 bp, Homo sapiens
taatctaaatg

SEQ ID NO: 4237973 - DNA, 13 bp, Homo sapiens
taatctgaagata

SEQ ID NO: 4237974 - DNA, 20 bp, Homo sapiens
taatctgaagatatatttca

SEQ ID NO: 4237975 - DNA, 17 bp, Homo sapiens
taatgaataaactgaat

SEQ ID NO: 4237976 - DNA, 17 bp, Homo sapiens
taatgataaaataaata

SEQ ID NO: 4237977 - DNA, 21 bp, Homo sapiens
taatgataaaataaataattt

SEQ ID NO: 4237978 - DNA, 15 bp, Homo sapiens
taatgcgtgcatacc

SEQ ID NO: 4237979 - DNA, 19 bp, Homo sapiens
taatgcgtgcataccactt

SEQ ID NO: 4237980 - DNA, 23 bp, Homo sapiens
taatgcgtgcataccacttttgt

SEQ ID NO: 4237981 - DNA, 18 bp, Homo sapiens
taatggatcatagaattg

SEQ ID NO: 4237982 - DNA, 17 bp, Homo sapiens
taatggcagctagtgcc

SEQ ID NO: 4237983 - DNA, 15 bp, Homo sapiens
taatggcatggagac

SEQ ID NO: 4237984 - DNA, 15 bp, Homo sapiens
taatgtacatctggc

SEQ ID NO: 4237985 - DNA, 15 bp, Homo sapiens
taatgtacttgaaaa

SEQ ID NO: 4237986 - DNA, 16 bp, Homo sapiens
taatgtctcactgttc

SEQ ID NO: 4237987 - DNA, 20 bp, Homo sapiens
taatgtgaaactggattaaa

SEQ ID NO: 4237988 - DNA, 23 bp, Homo sapiens
taatgtgaaactggattaaactt

SEQ ID NO: 4237989 - DNA, 15 bp, Homo sapiens
taatgtttttaaaaa

SEQ ID NO: 4237990 - DNA, 19 bp, Homo sapiens
taattcacagaatagcaca

SEQ ID NO: 4237991 - DNA, 15 bp, Homo sapiens
taattcacctatgtt

SEQ ID NO: 4237992 - DNA, 16 bp, Homo sapiens
taattcacctatgtta

SEQ ID NO: 4237993 - DNA, 23 bp, Homo sapiens
taattcacctatgttattttgtg

SEQ ID NO: 4237994 - DNA, 18 bp, Homo sapiens
taattcttagctcattct

SEQ ID NO: 4237995 - DNA, 22 bp, Homo sapiens
taattgcactttttaagtttga

SEQ ID NO: 4237996 - DNA, 22 bp, Homo sapiens
taatttgtgatacaatgctgtg

SEQ ID NO: 4237997 - DNA, 23 bp, Homo sapiens
taattttatggtggaaaagaact

SEQ ID NO: 4237998 - DNA, 13 bp, Homo sapiens
taatttttattta

SEQ ID NO: 4237999 - DNA, 15 bp, Homo sapiens
tacaaaagcatgtga

SEQ ID NO: 4238000 - DNA, 16 bp, Homo sapiens
tacaaacagtatttct

SEQ ID NO: 4238001 - DNA, 16 bp, Homo sapiens
tacaaagcgtgcacaa

SEQ ID NO: 4238002 - DNA, 14 bp, Homo sapiens
tacaacatttatgt

SEQ ID NO: 4238003 - DNA, 17 bp, Homo sapiens
tacaactgtatttatta

SEQ ID NO: 4238004 - DNA, 20 bp, Homo sapiens
tacaagatattattaatttt

SEQ ID NO: 4238005 - DNA, 12 bp, Homo sapiens
tacaagtaatgt

SEQ ID NO: 4238006 - DNA, 19 bp, Homo sapiens
tacaagtaatgtaaagatg

SEQ ID NO: 4238007 - DNA, 14 bp, Homo sapiens
tacaatcctgttta

SEQ ID NO: 4238008 - DNA, 15 bp, Homo sapiens
tacaatcctgtttat

SEQ ID NO: 4238009 - DNA, 14 bp, Homo sapiens
tacaatgctgtgcc

SEQ ID NO: 4238010 - DNA, 21 bp, Homo sapiens
tacaatgctgtgccctaaagt

SEQ ID NO: 4238011 - DNA, 21 bp, Homo sapiens
tacaatgtgtttttctccagt

SEQ ID NO: 4238012 - DNA, 15 bp, Homo sapiens
tacacactgcatgtt

SEQ ID NO: 4238013 - DNA, 19 bp, Homo sapiens
tacacattttattttatta

SEQ ID NO: 4238014 - DNA, 23 bp, Homo sapiens
tacacattttattttattatgca

SEQ ID NO: 4238015 - DNA, 20 bp, Homo sapiens
tacaccactacattctgtta

SEQ ID NO: 4238016 - DNA, 23 bp, Homo sapiens
tacacgtgcgtgtgagtgtgtgt

SEQ ID NO: 4238017 - DNA, 19 bp, Homo sapiens
tacactgtttcaaacttta

SEQ ID NO: 4238018 - DNA, 13 bp, Homo sapiens
tacagctcagtaa

SEQ ID NO: 4238019 - DNA, 18 bp, Homo sapiens
tacagtttgttagtatga

SEQ ID NO: 4238020 - DNA, 21 bp, Homo sapiens
tacagtttgttagtatgaggc

SEQ ID NO: 4238021 - DNA, 14 bp, Homo sapiens
tacataaacaatga

SEQ ID NO: 4238022 - DNA, 15 bp, Homo sapiens
tacataatgcgtgca

SEQ ID NO: 4238023 - DNA, 17 bp, Homo sapiens
tacataatgcgtgcata

SEQ ID NO: 4238024 - DNA, 23 bp, Homo sapiens
tacataatgcgtgcataccactt

SEQ ID NO: 4238025 - DNA, 23 bp, Homo sapiens
tacatctgtctttcatctcccag

SEQ ID NO: 4238026 - DNA, 23 bp, Homo sapiens
tacatgaaaacacatttttctta

SEQ ID NO: 4238027 - DNA, 12 bp, Homo sapiens
tacattctgtta

SEQ ID NO: 4238028 - DNA, 23 bp, Homo sapiens
taccaagagtaactttactctgt

SEQ ID NO: 4238029 - DNA, 17 bp, Homo sapiens
taccagctaccctgtgt

SEQ ID NO: 4238030 - DNA, 16 bp, Homo sapiens
taccatggtttgatat

SEQ ID NO: 4238031 - DNA, 21 bp, Homo sapiens
taccatttgctactgtacata

SEQ ID NO: 4238032 - DNA, 14 bp, Homo sapiens
taccctctccaggc

SEQ ID NO: 4238033 - DNA, 19 bp, Homo sapiens
tacctaaaaggaaatctca

SEQ ID NO: 4238034 - DNA, 22 bp, Homo sapiens
tacctaatgtctcactgttctg

SEQ ID NO: 4238035 - DNA, 21 bp, Homo sapiens
tacctctcaagctagtgtttc

SEQ ID NO: 4238036 - DNA, 23 bp, Homo sapiens
tacctctcaagctagtgtttcta

SEQ ID NO: 4238037 - DNA, 20 bp, Homo sapiens
tacctctcgtttctgcccag

SEQ ID NO: 4238038 - DNA, 13 bp, Homo sapiens
tacctgacctaaa

SEQ ID NO: 4238039 - DNA, 23 bp, Homo sapiens
tacctgcttgagctttctgtgca

SEQ ID NO: 4238040 - DNA, 17 bp, Homo sapiens
taccttttttatacata

SEQ ID NO: 4238041 - DNA, 14 bp, Homo sapiens
tacgttgtgcattt

SEQ ID NO: 4238042 - DNA, 16 bp, Homo sapiens
tacgttgtgcatttgg

SEQ ID NO: 4238043 - DNA, 18 bp, Homo sapiens
tactaaccagcagaaatg

SEQ ID NO: 4238044 - DNA, 15 bp, Homo sapiens
tactaatagacaatt

SEQ ID NO: 4238045 - DNA, 21 bp, Homo sapiens
tactaatagacaatttattat

SEQ ID NO: 4238046 - DNA, 14 bp, Homo sapiens
tactcctatttttg

SEQ ID NO: 4238047 - DNA, 16 bp, Homo sapiens
tactctacttacagtt

SEQ ID NO: 4238048 - DNA, 13 bp, Homo sapiens
tactctaggactt

SEQ ID NO: 4238049 - DNA, 13 bp, Homo sapiens
tactctccatatc

SEQ ID NO: 4238050 - DNA, 20 bp, Homo sapiens
tactctgtgtttaaaaagta

SEQ ID NO: 4238051 - DNA, 20 bp, Homo sapiens
tactgaagggaacagcctga

SEQ ID NO: 4238052 - DNA, 22 bp, Homo sapiens
tactgaagggaacagcctgagc

SEQ ID NO: 4238053 - DNA, 22 bp, Homo sapiens
tactgcagcctttgcctccccg

SEQ ID NO: 4238054 - DNA, 14 bp, Homo sapiens
tactgcttgatttt

SEQ ID NO: 4238055 - DNA, 16 bp, Homo sapiens
tactgtaatttgtgat

SEQ ID NO: 4238056 - DNA, 21 bp, Homo sapiens
ggtgcatttgaggtctgttct

SEQ ID NO: 4238057 - DNA, 17 bp, Homo sapiens
ggtgcccgcgccaggcc

SEQ ID NO: 4238058 - DNA, 19 bp, Homo sapiens
ggtgcccttccctggaggt

SEQ ID NO: 4238059 - DNA, 19 bp, Homo sapiens
ggtgccgtgcgggcgaggc

SEQ ID NO: 4238060 - DNA, 19 bp, Homo sapiens
ggtggcaatgcttaaacta

SEQ ID NO: 4238061 - DNA, 17 bp, Homo sapiens
ggtggtttcagaaatgt

SEQ ID NO: 4238062 - DNA, 15 bp, Homo sapiens
ggtggttttctgttc

SEQ ID NO: 4238063 - DNA, 19 bp, Homo sapiens
ggtgtggagaccaggctcc

SEQ ID NO: 4238064 - DNA, 17 bp, Homo sapiens
ggtgttagtgtcagcca

SEQ ID NO: 4238065 - DNA, 13 bp, Homo sapiens
ggttcaaagatat

SEQ ID NO: 4238066 - DNA, 14 bp, Homo sapiens
ggtttcagaaatgt

SEQ ID NO: 4238067 - DNA, 13 bp, Homo sapiens
ggttttgtatttt

SEQ ID NO: 4238068 - DNA, 15 bp, Homo sapiens
gtaaaatgaattgaa

SEQ ID NO: 4238069 - DNA, 13 bp, Homo sapiens
gtaaaatttattt

SEQ ID NO: 4238070 - DNA, 15 bp, Homo sapiens
gtaaacataaaaact

SEQ ID NO: 4238071 - DNA, 20 bp, Homo sapiens
gtaaacataaaaactgattt

SEQ ID NO: 4238072 - DNA, 16 bp, Homo sapiens
gtaaagttatgtattt

SEQ ID NO: 4238073 - DNA, 19 bp, Homo sapiens
gtaaatgcatattaaataa

SEQ ID NO: 4238074 - DNA, 22 bp, Homo sapiens
gtaaattaacttttataaactt

SEQ ID NO: 4238075 - DNA, 23 bp, Homo sapiens
gtaaattaacttttataaacttt

SEQ ID NO: 4238076 - DNA, 13 bp, Homo sapiens
gtaacttatttga

SEQ ID NO: 4238077 - DNA, 22 bp, Homo sapiens
gtaatataatgtattttctttt

SEQ ID NO: 4238078 - DNA, 14 bp, Homo sapiens
gtaatgatggaact

SEQ ID NO: 4238079 - DNA, 22 bp, Homo sapiens
gtaatttcctgagctaaatgct

SEQ ID NO: 4238080 - DNA, 15 bp, Homo sapiens
gtaatttgtgataca

SEQ ID NO: 4238081 - DNA, 23 bp, Homo sapiens
gtaatttttgctccaatatccat

SEQ ID NO: 4238082 - DNA, 16 bp, Homo sapiens
gtacaaacagtatttc

SEQ ID NO: 4238083 - DNA, 17 bp, Homo sapiens
gtacaactgtatttatt

SEQ ID NO: 4238084 - DNA, 18 bp, Homo sapiens
gtacaactgtatttatta

SEQ ID NO: 4238085 - DNA, 20 bp, Homo sapiens
gtacactgtttcaaacttta

SEQ ID NO: 4238086 - DNA, 20 bp, Homo sapiens
gtacagcaaggagatttaca

SEQ ID NO: 4238087 - DNA, 14 bp, Homo sapiens
gtacatctggcctt

SEQ ID NO: 4238088 - DNA, 21 bp, Homo sapiens
gtaccacagacacaatatgta

SEQ ID NO: 4238089 - DNA, 20 bp, Homo sapiens
gtaccatggtttgatatgta

SEQ ID NO: 4238090 - DNA, 15 bp, Homo sapiens
gtaccctctccaggc

SEQ ID NO: 4238091 - DNA, 22 bp, Homo sapiens
gtacctctcaagctagtgtttc

SEQ ID NO: 4238092 - DNA, 21 bp, Homo sapiens
gtacctcttgagccttgaact

SEQ ID NO: 4238093 - DNA, 15 bp, Homo sapiens
gtaccttaagatatt

SEQ ID NO: 4238094 - DNA, 15 bp, Homo sapiens
gtacgttgtgcattt

SEQ ID NO: 4238095 - DNA, 19 bp, Homo sapiens
gtactctgtgtctggcagg

SEQ ID NO: 4238096 - DNA, 15 bp, Homo sapiens
gtactgtctgttatg

SEQ ID NO: 4238097 - DNA, 13 bp, Homo sapiens
gtactgtttacca

SEQ ID NO: 4238098 - DNA, 17 bp, Homo sapiens
gtagaaaagttgcagat

SEQ ID NO: 4238099 - DNA, 19 bp, Homo sapiens
gtagcataaataaaactga

SEQ ID NO: 4238100 - DNA, 21 bp, Homo sapiens
gtagcataaataaaactgaat

SEQ ID NO: 4238101 - DNA, 18 bp, Homo sapiens
gtagtttggatatttttg

SEQ ID NO: 4238102 - DNA, 19 bp, Homo sapiens
gtataatgtttaaatcatg

SEQ ID NO: 4238103 - DNA, 22 bp, Homo sapiens
gtatataataactttgaagcca

SEQ ID NO: 4238104 - DNA, 13 bp, Homo sapiens
gtatgaggcattt

SEQ ID NO: 4238105 - DNA, 15 bp, Homo sapiens
gtatgttttttatgt

SEQ ID NO: 4238106 - DNA, 18 bp, Homo sapiens
gtattctctcctgtacct

SEQ ID NO: 4238107 - DNA, 17 bp, Homo sapiens
gtattttaagaagacat

SEQ ID NO: 4238108 - DNA, 13 bp, Homo sapiens
gtatttttatcca

SEQ ID NO: 4238109 - DNA, 21 bp, Homo sapiens
gtatttttgggctattgcata

SEQ ID NO: 4238110 - DNA, 15 bp, Homo sapiens
gtatttttttactaa

SEQ ID NO: 4238111 - DNA, 21 bp, Homo sapiens
gtatttttttactaatagaca

SEQ ID NO: 4238112 - DNA, 14 bp, Homo sapiens
gtcaagtctctgct

SEQ ID NO: 4238113 - DNA, 21 bp, Homo sapiens
gtcaataacactgtattttaa

SEQ ID NO: 4238114 - DNA, 19 bp, Homo sapiens
gtcacaagtagcctctggg

SEQ ID NO: 4238115 - DNA, 21 bp, Homo sapiens
gtcaccctgctttggcggccc

SEQ ID NO: 4238116 - DNA, 10 bp, Homo sapiens
gtcactgctt

SEQ ID NO: 4238117 - DNA, 14 bp, Homo sapiens
gtcagccatgggaa

SEQ ID NO: 4238118 - DNA, 23 bp, Homo sapiens
gtcatcgctcgtgtgttctatcc

SEQ ID NO: 4238119 - DNA, 21 bp, Homo sapiens
gtcatgctgtccgtgcttgct

SEQ ID NO: 4238120 - DNA, 12 bp, Homo sapiens
gtcatttttgta

SEQ ID NO: 4238121 - DNA, 21 bp, Homo sapiens
gtccaactcttccacctctgg

SEQ ID NO: 4238122 - DNA, 22 bp, Homo sapiens
gtccaactcttccacctctggg

SEQ ID NO: 4238123 - DNA, 16 bp, Homo sapiens
gtccagccgtgtgtgc

SEQ ID NO: 4238124 - DNA, 22 bp, Homo sapiens
gtccagccgtgtgtgcatgtgc

SEQ ID NO: 4238125 - DNA, 23 bp, Homo sapiens
gtccagccgtgtgtgcatgtgcc

SEQ ID NO: 4238126 - DNA, 19 bp, Homo sapiens
gtcccccgttgtgcctggt

SEQ ID NO: 4238127 - DNA, 19 bp, Homo sapiens
gtccgtgcttgctggtgcc

SEQ ID NO: 4238128 - DNA, 23 bp, Homo sapiens
gtccgtgcttgctggtgcctctt

SEQ ID NO: 4238129 - DNA, 15 bp, Homo sapiens
gtcctgcctcagcct

SEQ ID NO: 4238130 - DNA, 18 bp, Homo sapiens
gtccttgcacctgagcct

SEQ ID NO: 4238131 - DNA, 16 bp, Homo sapiens
gtctcaaactcctggg

SEQ ID NO: 4238132 - DNA, 20 bp, Homo sapiens
gtctcaaactcctgggctca

SEQ ID NO: 4238133 - DNA, 23 bp, Homo sapiens
gtctcacagtgttgcccaggctg

SEQ ID NO: 4238134 - DNA, 22 bp, Homo sapiens
gtctcactgtgggaaggccagc

SEQ ID NO: 4238135 - DNA, 15 bp, Homo sapiens
gtctcactgttctgc

SEQ ID NO: 4238136 - DNA, 13 bp, Homo sapiens
gtctcagcctccc

SEQ ID NO: 4238137 - DNA, 17 bp, Homo sapiens
gtctcgctttgttgccc

SEQ ID NO: 4238138 - DNA, 21 bp, Homo sapiens
gtctctcttcagactctcagc

SEQ ID NO: 4238139 - DNA, 13 bp, Homo sapiens
gtctctgctggcc

SEQ ID NO: 4238140 - DNA, 19 bp, Homo sapiens
gtctctggggcaggctgct

SEQ ID NO: 4238141 - DNA, 13 bp, Homo sapiens
gtcttagagcctt

SEQ ID NO: 4238142 - DNA, 23 bp, Homo sapiens
gtgaagacaatgacttactgtac

SEQ ID NO: 4238143 - DNA, 14 bp, Homo sapiens
gtgaagtgaagaca

SEQ ID NO: 4238144 - DNA, 23 bp, Homo sapiens
gtgaagtgcctgctgggtgccag

SEQ ID NO: 4238145 - DNA, 14 bp, Homo sapiens
gtgaatgcttctca

SEQ ID NO: 4238146 - DNA, 16 bp, Homo sapiens
gtgactgaatttcttt

SEQ ID NO: 4238147 - DNA, 21 bp, Homo sapiens
gtgagccgcggggcacatgct

SEQ ID NO: 4238148 - DNA, 17 bp, Homo sapiens
gtgatacaatgctgtgc

SEQ ID NO: 4238149 - DNA, 13 bp, Homo sapiens
gtgattacctctc

SEQ ID NO: 4238150 - DNA, 18 bp, Homo sapiens
gtgatttttgtaattttt

SEQ ID NO: 4238151 - DNA, 15 bp, Homo sapiens
gtgcagaaaatattt

SEQ ID NO: 4238152 - DNA, 16 bp, Homo sapiens
gtgcagaataatggaa

SEQ ID NO: 4238153 - DNA, 19 bp, Homo sapiens
gtgcagaataatggaaaca

SEQ ID NO: 4238154 - DNA, 14 bp, Homo sapiens
gtgcataatgataa

SEQ ID NO: 4238155 - DNA, 19 bp, Homo sapiens
gtgcataatgataaaataa

SEQ ID NO: 4238156 - DNA, 22 bp, Homo sapiens
gtgcatctggcacgtggccagg

SEQ ID NO: 4238157 - DNA, 14 bp, Homo sapiens
gtgcatgtgcaggt

SEQ ID NO: 4238158 - DNA, 16 bp, Homo sapiens
gtgcatgtgccgaggt

SEQ ID NO: 4238159 - DNA, 19 bp, Homo sapiens
gtgcatttgaggtctgttc

SEQ ID NO: 4238160 - DNA, 15 bp, Homo sapiens
gtgcatttggtggtt

SEQ ID NO: 4238161 - DNA, 21 bp, Homo sapiens
gtgcatttggtggtttcagaa

SEQ ID NO: 4238162 - DNA, 21 bp, Homo sapiens
gtgcccgcgccaggccctcag

SEQ ID NO: 4238163 - DNA, 23 bp, Homo sapiens
gtgccgaccacgccccaggacct

SEQ ID NO: 4238164 - DNA, 24 bp, Homo sapiens
gtgccgaccacgccccaggacctc

SEQ ID NO: 4238165 - DNA, 19 bp, Homo sapiens
gtgcctgctgggtgccagg

SEQ ID NO: 4238166 - DNA, 15 bp, Homo sapiens
gtgctccgcagggcg

SEQ ID NO: 4238167 - DNA, 19 bp, Homo sapiens
gtgctgcatttaaaagata

SEQ ID NO: 4238168 - DNA, 20 bp, Homo sapiens
gtgctgcatttaaaagatac

SEQ ID NO: 4238169 - DNA, 22 bp, Homo sapiens
gtgctgggaatacatctgtgga

SEQ ID NO: 4238170 - DNA, 18 bp, Homo sapiens
gtgctgtccatgcttctc

SEQ ID NO: 4238171 - DNA, 21 bp, Homo sapiens
gtgcttctccccagaattcac

SEQ ID NO: 4238172 - DNA, 16 bp, Homo sapiens
gtggaaccaaagctgg

SEQ ID NO: 4238173 - DNA, 20 bp, Homo sapiens
gtggacaagacatgcttggg

SEQ ID NO: 4238174 - DNA, 21 bp, Homo sapiens
gtggatttaacagaaatgtac

SEQ ID NO: 4238175 - DNA, 11 bp, Homo sapiens
gtggccaggag

SEQ ID NO: 4238176 - DNA, 12 bp, Homo sapiens
gtggccaggagc

SEQ ID NO: 4238177 - DNA, 15 bp, Homo sapiens
gtggccaggagccct

SEQ ID NO: 4238178 - DNA, 17 bp, Homo sapiens
gtggccaggagccctgg

SEQ ID NO: 4238179 - DNA, 15 bp, Homo sapiens
gtgggaggagggagg

SEQ ID NO: 4238180 - DNA, 14 bp, Homo sapiens
gtgggatgggcagg

SEQ ID NO: 4238181 - DNA, 16 bp, Homo sapiens
gtggtttcagaaatgt

SEQ ID NO: 4238182 - DNA, 14 bp, Homo sapiens
gtgtactctaggac

SEQ ID NO: 4238183 - DNA, 14 bp, Homo sapiens
gtgtatataatttt

SEQ ID NO: 4238184 - DNA, 14 bp, Homo sapiens
gtgtgagtgtgtgt

SEQ ID NO: 4238185 - DNA, 11 bp, Homo sapiens
gtgtgcatgtg

SEQ ID NO: 4238186 - DNA, 11 bp, Homo sapiens
gtgttaaacac

SEQ ID NO: 4238187 - DNA, 20 bp, Homo sapiens
gtgttaaacactacacattt

SEQ ID NO: 4238188 - DNA, 23 bp, Homo sapiens
gtgttctatccaaacatgtattt

SEQ ID NO: 4238189 - DNA, 12 bp, Homo sapiens
gttaaacagtag

SEQ ID NO: 4238190 - DNA, 23 bp, Homo sapiens
gttaaacagtagttgtattcttc

SEQ ID NO: 4238191 - DNA, 13 bp, Homo sapiens
gttaaatactgtg

SEQ ID NO: 4238192 - DNA, 23 bp, Homo sapiens
gttaaatgtaatataatgtattt

SEQ ID NO: 4238193 - DNA, 19 bp, Homo sapiens
gttaaattcagtaatgcag

SEQ ID NO: 4238194 - DNA, 18 bp, Homo sapiens
gttaatcattaggtgtga

SEQ ID NO: 4238195 - DNA, 12 bp, Homo sapiens
gttaattttacc

SEQ ID NO: 4238196 - DNA, 21 bp, Homo sapiens
gttacatttttaagtgctgca

SEQ ID NO: 4238197 - DNA, 19 bp, Homo sapiens
gttacctgacctaaattag

SEQ ID NO: 4238198 - DNA, 18 bp, Homo sapiens
gttaggtagagggagttg

SEQ ID NO: 4238199 - DNA, 20 bp, Homo sapiens
gttagtatgaggcatttgtt

SEQ ID NO: 4238200 - DNA, 18 bp, Homo sapiens
gttatattagtgaagatg

SEQ ID NO: 4238201 - DNA, 22 bp, Homo sapiens
gttatgatattgtttaaaattc

SEQ ID NO: 4238202 - DNA, 15 bp, Homo sapiens
gttccctctccctgt

SEQ ID NO: 4238203 - DNA, 23 bp, Homo sapiens
gttccgcccgccctcccggagag

SEQ ID NO: 4238204 - DNA, 19 bp, Homo sapiens
gttccttttttgtatatta

SEQ ID NO: 4238205 - DNA, 12 bp, Homo sapiens
gttctatccaaa

SEQ ID NO: 4238206 - DNA, 22 bp, Homo sapiens
gttctatccaaacatgtattta

SEQ ID NO: 4238207 - DNA, 16 bp, Homo sapiens
gttctcctgaatattt

SEQ ID NO: 4238208 - DNA, 13 bp, Homo sapiens
gttcttaattctt

SEQ ID NO: 4238209 - DNA, 14 bp, Homo sapiens
gttcttaattctta

SEQ ID NO: 4238210 - DNA, 12 bp, Homo sapiens
gttgcacctgag

SEQ ID NO: 4238211 - DNA, 20 bp, Homo sapiens
gttggggagaaactgaagcc

SEQ ID NO: 4238212 - DNA, 15 bp, Homo sapiens
gttggggcccttaac

SEQ ID NO: 4238213 - DNA, 21 bp, Homo sapiens
gttgtattgcatgcaatttga

SEQ ID NO: 4238214 - DNA, 17 bp, Homo sapiens
gttgtcaagtctctgct

SEQ ID NO: 4238215 - DNA, 12 bp, Homo sapiens
gttgtgcctggt

SEQ ID NO: 4238216 - DNA, 22 bp, Homo sapiens
gttgtggatttaacagaaatgt

SEQ ID NO: 4238217 - DNA, 15 bp, Homo sapiens
gttgttacattttta

SEQ ID NO: 4238218 - DNA, 13 bp, Homo sapiens
gtttaaaaagtaa

SEQ ID NO: 4238219 - DNA, 10 bp, Homo sapiens
gtttaaaatt

SEQ ID NO: 4238220 - DNA, 14 bp, Homo sapiens
gtttaaatcatgta

SEQ ID NO: 4238221 - DNA, 14 bp, Homo sapiens
gtttagataataca

SEQ ID NO: 4238222 - DNA, 18 bp, Homo sapiens
gtttataatctgaagata

SEQ ID NO: 4238223 - DNA, 13 bp, Homo sapiens
gtttcaaacttta

SEQ ID NO: 4238224 - DNA, 11 bp, Homo sapiens
gtttcagaaat

SEQ ID NO: 4238225 - DNA, 12 bp, Homo sapiens
gtttctgcccag

SEQ ID NO: 4238226 - DNA, 22 bp, Homo sapiens
gtttctgcccagccctctgtgg

SEQ ID NO: 4238227 - DNA, 17 bp, Homo sapiens
gtttgattaaattcttg

SEQ ID NO: 4238228 - DNA, 19 bp, Homo sapiens
gtttgattaaattcttgca

SEQ ID NO: 4238229 - DNA, 14 bp, Homo sapiens
gtttgtaggtaaaa

SEQ ID NO: 4238230 - DNA, 20 bp, Homo sapiens
gtttgtccttgcacctgagc

SEQ ID NO: 4238231 - DNA, 20 bp, Homo sapiens
gttttgtattttttaaaaca

SEQ ID NO: 4238232 - DNA, 22 bp, Homo sapiens
gttttgtattttttaaaacact

SEQ ID NO: 4238233 - DNA, 14 bp, Homo sapiens
gtttttaatttgat

SEQ ID NO: 4238234 - DNA, 22 bp, Homo sapiens
gtttttatggcttttgtgcatt

SEQ ID NO: 4238235 - DNA, 23 bp, Homo sapiens
gtttttatggcttttgtgcatta

SEQ ID NO: 4238236 - DNA, 16 bp, Homo sapiens
gtttttctccagtgct

SEQ ID NO: 4238237 - DNA, 15 bp, Homo sapiens
taaaaaataatacaa

SEQ ID NO: 4238238 - DNA, 21 bp, Homo sapiens
taaaaataaatagaaaagtag

SEQ ID NO: 4238239 - DNA, 22 bp, Homo sapiens
taaaacaacagctcgatccaaa

SEQ ID NO: 4238240 - DNA, 21 bp, Homo sapiens
taaaacaattctgtgacatac

SEQ ID NO: 4238241 - DNA, 14 bp, Homo sapiens
taaaactaagcaca

SEQ ID NO: 4238242 - DNA, 15 bp, Homo sapiens
taaaacttaaaaaca

SEQ ID NO: 4238243 - DNA, 15 bp, Homo sapiens
taaaactttgctgcc

SEQ ID NO: 4238244 - DNA, 12 bp, Homo sapiens
taaaacttttta

SEQ ID NO: 4238245 - DNA, 21 bp, Homo sapiens
taaaagatacagttactcaga

SEQ ID NO: 4238246 - DNA, 13 bp, Homo sapiens
taaaatgtatttt

SEQ ID NO: 4238247 - DNA, 15 bp, Homo sapiens
taaaattaagatttc

SEQ ID NO: 4238248 - DNA, 19 bp, Homo sapiens
taaaattcagtttttgtat

SEQ ID NO: 4238249 - DNA, 20 bp, Homo sapiens
taaaattcagtttttgtatc

SEQ ID NO: 4238250 - DNA, 22 bp, Homo sapiens
taaaattcagtttttgtatctt

SEQ ID NO: 4238251 - DNA, 16 bp, Homo sapiens
taaaattgatattata

SEQ ID NO: 4238252 - DNA, 18 bp, Homo sapiens
taaacaagaccacgtttc

SEQ ID NO: 4238253 - DNA, 22 bp, Homo sapiens
taaacaagaccacgtttctaaa

SEQ ID NO: 4238254 - DNA, 23 bp, Homo sapiens
taaacaatgatgccctgctccag

SEQ ID NO: 4238255 - DNA, 19 bp, Homo sapiens
taaacagtagttgtattct

SEQ ID NO: 4238256 - DNA, 22 bp, Homo sapiens
taaacataaaaactgatttgct

SEQ ID NO: 4238257 - DNA, 16 bp, Homo sapiens
taaacggtttttatta

SEQ ID NO: 4238258 - DNA, 22 bp, Homo sapiens
taaacggtttttattaaagatg

SEQ ID NO: 4238259 - DNA, 14 bp, Homo sapiens
taaactaaataatg

SEQ ID NO: 4238260 - DNA, 16 bp, Homo sapiens
taaactaaataatgaa

SEQ ID NO: 4238261 - DNA, 13 bp, Homo sapiens
taaacttaatcta

SEQ ID NO: 4238262 - DNA, 18 bp, Homo sapiens
taaacttaatctaaatgg

SEQ ID NO: 4238263 - DNA, 16 bp, Homo sapiens
taaagatatggagaat

SEQ ID NO: 4238264 - DNA, 19 bp, Homo sapiens
taaagcagcgtttctatga

SEQ ID NO: 4238265 - DNA, 17 bp, Homo sapiens
taaaggctacctttgta

SEQ ID NO: 4238266 - DNA, 19 bp, Homo sapiens
taaaggctacctttgtatt

SEQ ID NO: 4238267 - DNA, 21 bp, Homo sapiens
taaaggctacctttgtattct

SEQ ID NO: 4238268 - DNA, 21 bp, Homo sapiens
taaagtgtatttttttactaa

SEQ ID NO: 4238269 - DNA, 23 bp, Homo sapiens
taaagtgtatttttttactaata

SEQ ID NO: 4238270 - DNA, 15 bp, Homo sapiens
taaagttgtattgca

SEQ ID NO: 4238271 - DNA, 19 bp, Homo sapiens
taaataatgaataaactga

SEQ ID NO: 4238272 - DNA, 13 bp, Homo sapiens
taaataattttaa

SEQ ID NO: 4238273 - DNA, 13 bp, Homo sapiens
taaatactgtgca

SEQ ID NO: 4238274 - DNA, 21 bp, Homo sapiens
taaatactgtgcagaataatg

SEQ ID NO: 4238275 - DNA, 23 bp, Homo sapiens
taaatcagctgcaatccatttat

SEQ ID NO: 4238276 - DNA, 15 bp, Homo sapiens
taaatcatgtatgtt

SEQ ID NO: 4238277 - DNA, 19 bp, Homo sapiens
taaatcatgtatgttatga

SEQ ID NO: 4238278 - DNA, 23 bp, Homo sapiens
taaatcatgtatgttatgatatt

SEQ ID NO: 4238279 - DNA, 19 bp, Homo sapiens
taaatctccaaaataaaac

SEQ ID NO: 4238280 - DNA, 15 bp, Homo sapiens
taaatgaatattttg

SEQ ID NO: 4238281 - DNA, 16 bp, Homo sapiens
taaatgaatattttga

SEQ ID NO: 4238282 - DNA, 23 bp, Homo sapiens
taaatgcacctggaatatataac

SEQ ID NO: 4238283 - DNA, 15 bp, Homo sapiens
taaatgcataattta

SEQ ID NO: 4238284 - DNA, 20 bp, Homo sapiens
taaatgcataatttatggtc

SEQ ID NO: 4238285 - DNA, 16 bp, Homo sapiens
taaatgcatattaaat

SEQ ID NO: 4238286 - DNA, 14 bp, Homo sapiens
taaatgggggtgca

SEQ ID NO: 4238287 - DNA, 14 bp, Homo sapiens
taaattaactttta

SEQ ID NO: 4238288 - DNA, 17 bp, Homo sapiens
taaattaacttttataa

SEQ ID NO: 4238289 - DNA, 17 bp, Homo sapiens
gctgtctggccaggcct

SEQ ID NO: 4238290 - DNA, 17 bp, Homo sapiens
gctgtttatgtttttat

SEQ ID NO: 4238291 - DNA, 23 bp, Homo sapiens
gctgtttcaaaaaaatctattga

SEQ ID NO: 4238292 - DNA, 13 bp, Homo sapiens
gcttaaaaaataa

SEQ ID NO: 4238293 - DNA, 15 bp, Homo sapiens
gcttagtaaaattta

SEQ ID NO: 4238294 - DNA, 16 bp, Homo sapiens
gcttctcatcttgtga

SEQ ID NO: 4238295 - DNA, 14 bp, Homo sapiens
gcttctccccagaa

SEQ ID NO: 4238296 - DNA, 15 bp, Homo sapiens
gcttctccccagaat

SEQ ID NO: 4238297 - DNA, 18 bp, Homo sapiens
gcttgagctttctgtgca

SEQ ID NO: 4238298 - DNA, 20 bp, Homo sapiens
gcttgagctttctgtgcatg

SEQ ID NO: 4238299 - DNA, 22 bp, Homo sapiens
gcttgagctttctgtgcatgtg

SEQ ID NO: 4238300 - DNA, 20 bp, Homo sapiens
gcttgggaggggccggagga

SEQ ID NO: 4238301 - DNA, 20 bp, Homo sapiens
gcttgggtcctactcctgga

SEQ ID NO: 4238302 - DNA, 22 bp, Homo sapiens
gcttgtggaggagggagagccc

SEQ ID NO: 4238303 - DNA, 22 bp, Homo sapiens
gctttcccctcctccctgggat

SEQ ID NO: 4238304 - DNA, 19 bp, Homo sapiens
gctttcttattttgtttga

SEQ ID NO: 4238305 - DNA, 14 bp, Homo sapiens
gctttgtctgtcca

SEQ ID NO: 4238306 - DNA, 15 bp, Homo sapiens
gctttgtctgtccag

SEQ ID NO: 4238307 - DNA, 19 bp, Homo sapiens
gcttttgtgcattatctag

SEQ ID NO: 4238308 - DNA, 18 bp, Homo sapiens
gctttttaagaatatttt

SEQ ID NO: 4238309 - DNA, 18 bp, Homo sapiens
ggaaaacatgctacacac

SEQ ID NO: 4238310 - DNA, 19 bp, Homo sapiens
ggaaaggttttgtattttt

SEQ ID NO: 4238311 - DNA, 13 bp, Homo sapiens
ggaaatgagccag

SEQ ID NO: 4238312 - DNA, 22 bp, Homo sapiens
ggaaatgagccagcccaagggc

SEQ ID NO: 4238313 - DNA, 16 bp, Homo sapiens
ggaaatgggaaaaaac

SEQ ID NO: 4238314 - DNA, 23 bp, Homo sapiens
ggaactaggctcttatgtgtgcc

SEQ ID NO: 4238315 - DNA, 16 bp, Homo sapiens
ggaatatataaccagt

SEQ ID NO: 4238316 - DNA, 22 bp, Homo sapiens
ggaatatatcagtacctctcaa

SEQ ID NO: 4238317 - DNA, 17 bp, Homo sapiens
ggacagagcccgggaga

SEQ ID NO: 4238318 - DNA, 22 bp, Homo sapiens
ggacagagcccgggagagactc

SEQ ID NO: 4238319 - DNA, 12 bp, Homo sapiens
ggaccccagaga

SEQ ID NO: 4238320 - DNA, 21 bp, Homo sapiens
ggacctccggagcgccctgca

SEQ ID NO: 4238321 - DNA, 14 bp, Homo sapiens
ggagaaactgaagc

SEQ ID NO: 4238322 - DNA, 19 bp, Homo sapiens
ggagaactcagtgccacac

SEQ ID NO: 4238323 - DNA, 13 bp, Homo sapiens
ggagactctgaga

SEQ ID NO: 4238324 - DNA, 16 bp, Homo sapiens
ggagaggtggccgcca

SEQ ID NO: 4238325 - DNA, 16 bp, Homo sapiens
ggagcaagcaggagtg

SEQ ID NO: 4238326 - DNA, 14 bp, Homo sapiens
ggagcgccctgcag

SEQ ID NO: 4238327 - DNA, 17 bp, Homo sapiens
ggagcgccctgcagggc

SEQ ID NO: 4238328 - DNA, 20 bp, Homo sapiens
ggaggaggaccctggaaatg

SEQ ID NO: 4238329 - DNA, 15 bp, Homo sapiens
ggaggcatctgcatg

SEQ ID NO: 4238330 - DNA, 17 bp, Homo sapiens
ggaggcatctgcatggg

SEQ ID NO: 4238331 - DNA, 18 bp, Homo sapiens
ggatacaaaagcatgtga

SEQ ID NO: 4238332 - DNA, 16 bp, Homo sapiens
ggatggacgctgccgg

SEQ ID NO: 4238333 - DNA, 20 bp, Homo sapiens
ggatggacgctgccgggaga

SEQ ID NO: 4238334 - DNA, 22 bp, Homo sapiens
ggatggacgctgccgggagact

SEQ ID NO: 4238335 - DNA, 22 bp, Homo sapiens
ggatggtggactacaaaataca

SEQ ID NO: 4238336 - DNA, 23 bp, Homo sapiens
ggattaaacttaatctaaatgga

SEQ ID NO: 4238337 - DNA, 22 bp, Homo sapiens
ggatttaacagaaatgtacagc

SEQ ID NO: 4238338 - DNA, 20 bp, Homo sapiens
ggcaagactgcaaacttttt

SEQ ID NO: 4238339 - DNA, 20 bp, Homo sapiens
ggcaataaataaagcttggg

SEQ ID NO: 4238340 - DNA, 13 bp, Homo sapiens
ggcacgtggccag

SEQ ID NO: 4238341 - DNA, 17 bp, Homo sapiens
ggcacgtggccaggagc

SEQ ID NO: 4238342 - DNA, 18 bp, Homo sapiens
ggcacgtggccaggagcc

SEQ ID NO: 4238343 - DNA, 15 bp, Homo sapiens
ggcagagaagttctc

SEQ ID NO: 4238344 - DNA, 22 bp, Homo sapiens
ggcaggctgtctggccaggcct

SEQ ID NO: 4238345 - DNA, 18 bp, Homo sapiens
ggcagggggacagcaggg

SEQ ID NO: 4238346 - DNA, 17 bp, Homo sapiens
ggcatttgtttgaactg

SEQ ID NO: 4238347 - DNA, 24 bp, Homo sapiens
ggcccatatctgtgaaatgctggc

SEQ ID NO: 4238348 - DNA, 19 bp, Homo sapiens
ggcccgcaagagggacaga

SEQ ID NO: 4238349 - DNA, 23 bp, Homo sapiens
ggcccgcaagagggacagagccc

SEQ ID NO: 4238350 - DNA, 21 bp, Homo sapiens
ggccctttcttgcactgtcca

SEQ ID NO: 4238351 - DNA, 12 bp, Homo sapiens
ggcctacctctc

SEQ ID NO: 4238352 - DNA, 22 bp, Homo sapiens
ggcctacctctcgtttctgccc

SEQ ID NO: 4238353 - DNA, 22 bp, Homo sapiens
ggcctagcatacgtacacattt

SEQ ID NO: 4238354 - DNA, 21 bp, Homo sapiens
ggcctcgtgctccgcagggcg

SEQ ID NO: 4238355 - DNA, 22 bp, Homo sapiens
ggcgatccacctgtctcagcct

SEQ ID NO: 4238356 - DNA, 20 bp, Homo sapiens
ggcgctgggtattggaaatg

SEQ ID NO: 4238357 - DNA, 22 bp, Homo sapiens
ggcggagccttcccgggcgggc

SEQ ID NO: 4238358 - DNA, 14 bp, Homo sapiens
ggcggccccgccgc

SEQ ID NO: 4238359 - DNA, 19 bp, Homo sapiens
ggcggcccggccggagggc

SEQ ID NO: 4238360 - DNA, 24 bp, Homo sapiens
ggcgggtgtggagaccaggctcct

SEQ ID NO: 4238361 - DNA, 14 bp, Homo sapiens
ggctacctttgtat

SEQ ID NO: 4238362 - DNA, 16 bp, Homo sapiens
ggctagaggttcaaag

SEQ ID NO: 4238363 - DNA, 17 bp, Homo sapiens
ggctagaggttcaaaga

SEQ ID NO: 4238364 - DNA, 14 bp, Homo sapiens
ggctatgcatttga

SEQ ID NO: 4238365 - DNA, 19 bp, Homo sapiens
ggctccccagtgctcctgg

SEQ ID NO: 4238366 - DNA, 21 bp, Homo sapiens
ggctcctgaccccgccatgca

SEQ ID NO: 4238367 - DNA, 15 bp, Homo sapiens
ggctcttgactactt

SEQ ID NO: 4238368 - DNA, 14 bp, Homo sapiens
ggcttttgtgcatt

SEQ ID NO: 4238369 - DNA, 15 bp, Homo sapiens
gggaaatgagccagc

SEQ ID NO: 4238370 - DNA, 15 bp, Homo sapiens
gggaacagcctgagc

SEQ ID NO: 4238371 - DNA, 18 bp, Homo sapiens
gggacagagcccgggaga

SEQ ID NO: 4238372 - DNA, 14 bp, Homo sapiens
gggacagcagggac

SEQ ID NO: 4238373 - DNA, 19 bp, Homo sapiens
gggaccgtctttacccctg

SEQ ID NO: 4238374 - DNA, 12 bp, Homo sapiens
gggagagactcg

SEQ ID NO: 4238375 - DNA, 12 bp, Homo sapiens
gggagagccctg

SEQ ID NO: 4238376 - DNA, 20 bp, Homo sapiens
gggagctgctgggtggcagg

SEQ ID NO: 4238377 - DNA, 18 bp, Homo sapiens
gggaggcatctgcatggg

SEQ ID NO: 4238378 - DNA, 19 bp, Homo sapiens
gggaggcatctgcatgggt

SEQ ID NO: 4238379 - DNA, 13 bp, Homo sapiens
gggaggcggcctc

SEQ ID NO: 4238380 - DNA, 18 bp, Homo sapiens
gggaggctgaggcagaag

SEQ ID NO: 4238381 - DNA, 22 bp, Homo sapiens
gggagttgtcaagtctctgctg

SEQ ID NO: 4238382 - DNA, 21 bp, Homo sapiens
gggatggacgctgccgggaga

SEQ ID NO: 4238383 - DNA, 13 bp, Homo sapiens
gggcgcagccctc

SEQ ID NO: 4238384 - DNA, 15 bp, Homo sapiens
gggcgggcgtgggag

SEQ ID NO: 4238385 - DNA, 20 bp, Homo sapiens
gggcgggtgatgagacctgg

SEQ ID NO: 4238386 - DNA, 10 bp, Homo sapiens
gggctcctga

SEQ ID NO: 4238387 - DNA, 14 bp, Homo sapiens
gggctgctgcaggc

SEQ ID NO: 4238388 - DNA, 16 bp, Homo sapiens
ggggagaaactgaagc

SEQ ID NO: 4238389 - DNA, 18 bp, Homo sapiens
gggtcctactcctggagc

SEQ ID NO: 4238390 - DNA, 20 bp, Homo sapiens
gggtgctgctggtaacagtg

SEQ ID NO: 4238391 - DNA, 20 bp, Homo sapiens
gggtttcaccatgttggcca

SEQ ID NO: 4238392 - DNA, 13 bp, Homo sapiens
ggtaaaatgtatt

SEQ ID NO: 4238393 - DNA, 12 bp, Homo sapiens
ggtaacagtggc

SEQ ID NO: 4238394 - DNA, 14 bp, Homo sapiens
ggtacaactgtatt

SEQ ID NO: 4238395 - DNA, 15 bp, Homo sapiens
ggtacaactgtattt

SEQ ID NO: 4238396 - DNA, 15 bp, Homo sapiens
ggtactctgtgtctg

SEQ ID NO: 4238397 - DNA, 15 bp, Homo sapiens
ggtataatgtttaaa

SEQ ID NO: 4238398 - DNA, 16 bp, Homo sapiens
ggtatgtagccagctg

SEQ ID NO: 4238399 - DNA, 14 bp, Homo sapiens
ggtcggaaaacatg

SEQ ID NO: 4238400 - DNA, 23 bp, Homo sapiens
ggtctcaaactcctgggctcagg

SEQ ID NO: 4238401 - DNA, 18 bp, Homo sapiens
ggtctcacagtgttgccc

SEQ ID NO: 4238402 - DNA, 14 bp, Homo sapiens
ggtctctccctccc

SEQ ID NO: 4238403 - DNA, 19 bp, Homo sapiens
ggtctgttctttccaaagt

SEQ ID NO: 4238404 - DNA, 19 bp, Homo sapiens
ggtgcagacgcggcgggga

SEQ ID NO: 4238405 - DNA, 21 bp, Homo sapiens
gccaggcctcttggcagtcac

SEQ ID NO: 4238406 - DNA, 20 bp, Homo sapiens
gccaggtgcccgcgccaggc

SEQ ID NO: 4238407 - DNA, 23 bp, Homo sapiens
gccagtaaatgggggtgcatttg

SEQ ID NO: 4238408 - DNA, 20 bp, Homo sapiens
gccatgggaaatgagccagc

SEQ ID NO: 4238409 - DNA, 23 bp, Homo sapiens
gccattaaatgaatattttgata

SEQ ID NO: 4238410 - DNA, 14 bp, Homo sapiens
gcccaaaatttgat

SEQ ID NO: 4238411 - DNA, 18 bp, Homo sapiens
gcccagaagaaaattctc

SEQ ID NO: 4238412 - DNA, 21 bp, Homo sapiens
gcccagccaaaccctgtctga

SEQ ID NO: 4238413 - DNA, 18 bp, Homo sapiens
gcccagccctctgtggcc

SEQ ID NO: 4238414 - DNA, 22 bp, Homo sapiens
gcccagctaatttttgtatttt

SEQ ID NO: 4238415 - DNA, 19 bp, Homo sapiens
gcccaggttggagtgcagt

SEQ ID NO: 4238416 - DNA, 20 bp, Homo sapiens
gcccaggttggagtgcagtg

SEQ ID NO: 4238417 - DNA, 16 bp, Homo sapiens
gccccgggcggagcct

SEQ ID NO: 4238418 - DNA, 18 bp, Homo sapiens
gcccgagctgtttatgtt

SEQ ID NO: 4238419 - DNA, 16 bp, Homo sapiens
gcccgcaagagggaca

SEQ ID NO: 4238420 - DNA, 19 bp, Homo sapiens
gcccgcaagagggacagag

SEQ ID NO: 4238421 - DNA, 22 bp, Homo sapiens
gcccgcaagagggacagagccc

SEQ ID NO: 4238422 - DNA, 23 bp, Homo sapiens
gcccgcaagagggacagagcccg

SEQ ID NO: 4238423 - DNA, 23 bp, Homo sapiens
gcccggaagaaccagaagtgcag

SEQ ID NO: 4238424 - DNA, 21 bp, Homo sapiens
gcccggcagtgcacgcggctt

SEQ ID NO: 4238425 - DNA, 18 bp, Homo sapiens
gcccgtggcctcgtgctc

SEQ ID NO: 4238426 - DNA, 18 bp, Homo sapiens
gccctactgaagggaaca

SEQ ID NO: 4238427 - DNA, 23 bp, Homo sapiens
gccctactgaagggaacagcctg

SEQ ID NO: 4238428 - DNA, 15 bp, Homo sapiens
gccctctgtggccag

SEQ ID NO: 4238429 - DNA, 18 bp, Homo sapiens
gccctctgtggccaggag

SEQ ID NO: 4238430 - DNA, 21 bp, Homo sapiens
gccctgcagggccgggcaggg

SEQ ID NO: 4238431 - DNA, 18 bp, Homo sapiens
gccctggcccgcaagagg

SEQ ID NO: 4238432 - DNA, 15 bp, Homo sapiens
gcccttccctggagg

SEQ ID NO: 4238433 - DNA, 12 bp, Homo sapiens
gcccttctgccc

SEQ ID NO: 4238434 - DNA, 11 bp, Homo sapiens
gccctttaaaa

SEQ ID NO: 4238435 - DNA, 17 bp, Homo sapiens
gccctttcttgcactgt

SEQ ID NO: 4238436 - DNA, 18 bp, Homo sapiens
gccgcagaccagctggcg

SEQ ID NO: 4238437 - DNA, 16 bp, Homo sapiens
gccgcccggcagtgca

SEQ ID NO: 4238438 - DNA, 19 bp, Homo sapiens
gccgcctgcagcccgtgtc

SEQ ID NO: 4238439 - DNA, 22 bp, Homo sapiens
gccgcgctttcccctcctccct

SEQ ID NO: 4238440 - DNA, 14 bp, Homo sapiens
gccggagggcagga

SEQ ID NO: 4238441 - DNA, 21 bp, Homo sapiens
gccgggagactgccagtggag

SEQ ID NO: 4238442 - DNA, 21 bp, Homo sapiens
gccgtgtgtctgtcagcccaa

SEQ ID NO: 4238443 - DNA, 14 bp, Homo sapiens
gccgtgtgtgcatg

SEQ ID NO: 4238444 - DNA, 22 bp, Homo sapiens
gccgtgtgtgcatgtgccgagg

SEQ ID NO: 4238445 - DNA, 23 bp, Homo sapiens
gccgtgtgtgcatgtgccgaggt

SEQ ID NO: 4238446 - DNA, 15 bp, Homo sapiens
gcctaaatttgtgct

SEQ ID NO: 4238447 - DNA, 11 bp, Homo sapiens
gcctacctctc

SEQ ID NO: 4238448 - DNA, 19 bp, Homo sapiens
gcctagcatacgtacacat

SEQ ID NO: 4238449 - DNA, 21 bp, Homo sapiens
gcctagcatacgtacacattt

SEQ ID NO: 4238450 - DNA, 22 bp, Homo sapiens
gcctagcatacgtacacatttt

SEQ ID NO: 4238451 - DNA, 12 bp, Homo sapiens
gcctcccacccc

SEQ ID NO: 4238452 - DNA, 14 bp, Homo sapiens
gcctccggaagctg

SEQ ID NO: 4238453 - DNA, 17 bp, Homo sapiens
gcctctgggatctgcca

SEQ ID NO: 4238454 - DNA, 22 bp, Homo sapiens
gcctcttttcagtagtgagcag

SEQ ID NO: 4238455 - DNA, 24 bp, Homo sapiens
gcctgcagcccgtgtccaggagcc

SEQ ID NO: 4238456 - DNA, 17 bp, Homo sapiens
gcctgcctggcaggctg

SEQ ID NO: 4238457 - DNA, 12 bp, Homo sapiens
gcctgctgggtg

SEQ ID NO: 4238458 - DNA, 14 bp, Homo sapiens
gcctggcaggctgt

SEQ ID NO: 4238459 - DNA, 19 bp, Homo sapiens
gcctggtcccagagtggct

SEQ ID NO: 4238460 - DNA, 17 bp, Homo sapiens
gcctggttcgtgccatg

SEQ ID NO: 4238461 - DNA, 20 bp, Homo sapiens
gcctggttcgtgccatgccc

SEQ ID NO: 4238462 - DNA, 22 bp, Homo sapiens
gcctgttcccactcagcagtga

SEQ ID NO: 4238463 - DNA, 15 bp, Homo sapiens
gcctgttttgagacc

SEQ ID NO: 4238464 - DNA, 16 bp, Homo sapiens
gcctgttttgagacca

SEQ ID NO: 4238465 - DNA, 14 bp, Homo sapiens
gccttgaactttga

SEQ ID NO: 4238466 - DNA, 23 bp, Homo sapiens
gccttgaactttgacctctgcag

SEQ ID NO: 4238467 - DNA, 19 bp, Homo sapiens
gccttgctcctagcagaca

SEQ ID NO: 4238468 - DNA, 21 bp, Homo sapiens
gccttgctcctagcagacaga

SEQ ID NO: 4238469 - DNA, 15 bp, Homo sapiens
gcctttttgtaattt

SEQ ID NO: 4238470 - DNA, 15 bp, Homo sapiens
gcgccaggccctcag

SEQ ID NO: 4238471 - DNA, 15 bp, Homo sapiens
gcgccctgcagggcc

SEQ ID NO: 4238472 - DNA, 23 bp, Homo sapiens
gcggagccttcccgggcgggcgt

SEQ ID NO: 4238473 - DNA, 11 bp, Homo sapiens
gcggccgcctt

SEQ ID NO: 4238474 - DNA, 16 bp, Homo sapiens
gcgggcgaggccgccc

SEQ ID NO: 4238475 - DNA, 14 bp, Homo sapiens
gcgggcgtgggagg

SEQ ID NO: 4238476 - DNA, 21 bp, Homo sapiens
gcgtcccccgttgtgcctggt

SEQ ID NO: 4238477 - DNA, 13 bp, Homo sapiens
gcgtcctgtccac

SEQ ID NO: 4238478 - DNA, 24 bp, Homo sapiens
gcgtcctgtccacacccagctcag

SEQ ID NO: 4238479 - DNA, 19 bp, Homo sapiens
gctaaattctatgttaaat

SEQ ID NO: 4238480 - DNA, 23 bp, Homo sapiens
gctaaattctatgttaaatactg

SEQ ID NO: 4238481 - DNA, 15 bp, Homo sapiens
gctaaccatttatat

SEQ ID NO: 4238482 - DNA, 14 bp, Homo sapiens
gctacccttttcct

SEQ ID NO: 4238483 - DNA, 16 bp, Homo sapiens
gctacctttgtattct

SEQ ID NO: 4238484 - DNA, 13 bp, Homo sapiens
gctactctgccca

SEQ ID NO: 4238485 - DNA, 21 bp, Homo sapiens
gctagaggttcaaagatattt

SEQ ID NO: 4238486 - DNA, 22 bp, Homo sapiens
gctagtgtttctagctaaataa

SEQ ID NO: 4238487 - DNA, 17 bp, Homo sapiens
gctatgcatattcaatg

SEQ ID NO: 4238488 - DNA, 12 bp, Homo sapiens
gctatgcatttg

SEQ ID NO: 4238489 - DNA, 14 bp, Homo sapiens
gctcaaataaaaat

SEQ ID NO: 4238490 - DNA, 23 bp, Homo sapiens
gctcaatctctgttgcacctgag

SEQ ID NO: 4238491 - DNA, 18 bp, Homo sapiens
gctcacgtcgcggccgcc

SEQ ID NO: 4238492 - DNA, 18 bp, Homo sapiens
gctcagagcttgaagatt

SEQ ID NO: 4238493 - DNA, 22 bp, Homo sapiens
gctcaggcgatccacctgtctc

SEQ ID NO: 4238494 - DNA, 22 bp, Homo sapiens
gctcccacacccacctctgcca

SEQ ID NO: 4238495 - DNA, 23 bp, Homo sapiens
gctcccacacccacctctgccac

SEQ ID NO: 4238496 - DNA, 20 bp, Homo sapiens
gctccccagtgctcctggcc

SEQ ID NO: 4238497 - DNA, 23 bp, Homo sapiens
gctccctctctccacacggagct

SEQ ID NO: 4238498 - DNA, 19 bp, Homo sapiens
gctcctagcagacagaaac

SEQ ID NO: 4238499 - DNA, 20 bp, Homo sapiens
gctcgagcagtcctgcctca

SEQ ID NO: 4238500 - DNA, 14 bp, Homo sapiens
gctctcctcctcca

SEQ ID NO: 4238501 - DNA, 13 bp, Homo sapiens
gctgaggcagaag

SEQ ID NO: 4238502 - DNA, 18 bp, Homo sapiens
gctgcaatccatttattt

SEQ ID NO: 4238503 - DNA, 17 bp, Homo sapiens
gctgcatttaaaagata

SEQ ID NO: 4238504 - DNA, 18 bp, Homo sapiens
gctgcatttaaaagatac

SEQ ID NO: 4238505 - DNA, 12 bp, Homo sapiens
gctgctgcaggc

SEQ ID NO: 4238506 - DNA, 16 bp, Homo sapiens
gctgctgggtggcagg

SEQ ID NO: 4238507 - DNA, 19 bp, Homo sapiens
gctgctggtaacagtggct

SEQ ID NO: 4238508 - DNA, 14 bp, Homo sapiens
gctggcccagccaa

SEQ ID NO: 4238509 - DNA, 15 bp, Homo sapiens
gctgggtattggaaa

SEQ ID NO: 4238510 - DNA, 16 bp, Homo sapiens
gctgggtgccaggtgc

SEQ ID NO: 4238511 - DNA, 15 bp, Homo sapiens
gctggtgtactctag

SEQ ID NO: 4238512 - DNA, 20 bp, Homo sapiens
gctggtgtactctaggactt

SEQ ID NO: 4238513 - DNA, 21 bp, Homo sapiens
gctggtgtactctaggacttc

SEQ ID NO: 4238514 - DNA, 23 bp, Homo sapiens
gctggtgtactctaggacttcaa

SEQ ID NO: 4238515 - DNA, 20 bp, Homo sapiens
gctggttgtaccctctccag

SEQ ID NO: 4238516 - DNA, 21 bp, Homo sapiens
gctggttgtaccctctccagg

SEQ ID NO: 4238517 - DNA, 22 bp, Homo sapiens
gctggttgtaccctctccaggc

SEQ ID NO: 4238518 - DNA, 16 bp, Homo sapiens
gctgtccatgcttctc

SEQ ID NO: 4238519 - DNA, 17 bp, Homo sapiens
gctgtccgtgcttgctg

SEQ ID NO: 4238520 - DNA, 19 bp, Homo sapiens
gagtggtttttgctctagg

SEQ ID NO: 4238521 - DNA, 17 bp, Homo sapiens
gagtgtgtgtgtgtgtc

SEQ ID NO: 4238522 - DNA, 19 bp, Homo sapiens
gagtgtgtgtgtgtgtctg

SEQ ID NO: 4238523 - DNA, 16 bp, Homo sapiens
gagttcctctttgccc

SEQ ID NO: 4238524 - DNA, 15 bp, Homo sapiens
gagttgaggaactgt

SEQ ID NO: 4238525 - DNA, 22 bp, Homo sapiens
gagttgatactacagtttgtta

SEQ ID NO: 4238526 - DNA, 20 bp, Homo sapiens
gagttgttacatttttaagt

SEQ ID NO: 4238527 - DNA, 23 bp, Homo sapiens
gagtttgtaggtaaaatgtattt

SEQ ID NO: 4238528 - DNA, 18 bp, Homo sapiens
gataataatattgttttt

SEQ ID NO: 4238529 - DNA, 12 bp, Homo sapiens
gataatacacca

SEQ ID NO: 4238530 - DNA, 14 bp, Homo sapiens
gataatacaccact

SEQ ID NO: 4238531 - DNA, 21 bp, Homo sapiens
gataatacaccactacattct

SEQ ID NO: 4238532 - DNA, 22 bp, Homo sapiens
gataatacaccactacattctg

SEQ ID NO: 4238533 - DNA, 24 bp, Homo sapiens
gataatacaccactacattctgtt

SEQ ID NO: 4238534 - DNA, 17 bp, Homo sapiens
gatacaaaagcatgtga

SEQ ID NO: 4238535 - DNA, 13 bp, Homo sapiens
gatacaatgctgt

SEQ ID NO: 4238536 - DNA, 11 bp, Homo sapiens
gatactacagt

SEQ ID NO: 4238537 - DNA, 16 bp, Homo sapiens
gatactacagtttgtt

SEQ ID NO: 4238538 - DNA, 14 bp, Homo sapiens
gatatactttgtgg

SEQ ID NO: 4238539 - DNA, 18 bp, Homo sapiens
gatattgtttaaaattca

SEQ ID NO: 4238540 - DNA, 15 bp, Homo sapiens
gatattttgctttgt

SEQ ID NO: 4238541 - DNA, 11 bp, Homo sapiens
gatatttttat

SEQ ID NO: 4238542 - DNA, 18 bp, Homo sapiens
gatccacctgtctcagcc

SEQ ID NO: 4238543 - DNA, 24 bp, Homo sapiens
gatccatagtgctacctgcacctc

SEQ ID NO: 4238544 - DNA, 18 bp, Homo sapiens
gatctaaacagttatttc

SEQ ID NO: 4238545 - DNA, 23 bp, Homo sapiens
gatctaaacagttatttctgttt

SEQ ID NO: 4238546 - DNA, 19 bp, Homo sapiens
gatcttggcttactgcagc

SEQ ID NO: 4238547 - DNA, 16 bp, Homo sapiens
gatgagtgagcatgcc

SEQ ID NO: 4238548 - DNA, 17 bp, Homo sapiens
gatgatttaagtataca

SEQ ID NO: 4238549 - DNA, 21 bp, Homo sapiens
gatgattttcatttcatgaaa

SEQ ID NO: 4238550 - DNA, 23 bp, Homo sapiens
gatgattttcatttcatgaaaat

SEQ ID NO: 4238551 - DNA, 18 bp, Homo sapiens
gatgcaaagtacaatgtg

SEQ ID NO: 4238552 - DNA, 21 bp, Homo sapiens
gatgcaggcacttattgtaaa

SEQ ID NO: 4238553 - DNA, 14 bp, Homo sapiens
gatgcttgtacata

SEQ ID NO: 4238554 - DNA, 14 bp, Homo sapiens
gatggacgctgccg

SEQ ID NO: 4238555 - DNA, 14 bp, Homo sapiens
gattaaaacaattt

SEQ ID NO: 4238556 - DNA, 19 bp, Homo sapiens
gattaaattcttgcaaagt

SEQ ID NO: 4238557 - DNA, 19 bp, Homo sapiens
gattcaaccaaccaaggac

SEQ ID NO: 4238558 - DNA, 16 bp, Homo sapiens
gatttaacagaaatgt

SEQ ID NO: 4238559 - DNA, 18 bp, Homo sapiens
gatttaacagaaatgtac

SEQ ID NO: 4238560 - DNA, 14 bp, Homo sapiens
gatttgatgtgact

SEQ ID NO: 4238561 - DNA, 14 bp, Homo sapiens
gattttaaaggcag

SEQ ID NO: 4238562 - DNA, 16 bp, Homo sapiens
gattttaatacattga

SEQ ID NO: 4238563 - DNA, 22 bp, Homo sapiens
gcaaaaaactcttaatctgtgt

SEQ ID NO: 4238564 - DNA, 12 bp, Homo sapiens
gcaaactttttt

SEQ ID NO: 4238565 - DNA, 12 bp, Homo sapiens
gcaaagtacaat

SEQ ID NO: 4238566 - DNA, 16 bp, Homo sapiens
gcaaagtatccctact

SEQ ID NO: 4238567 - DNA, 13 bp, Homo sapiens
gcaaatatatgat

SEQ ID NO: 4238568 - DNA, 19 bp, Homo sapiens
gcaacagcaaatcacgacc

SEQ ID NO: 4238569 - DNA, 22 bp, Homo sapiens
gcaacatttgtatggatttaag

SEQ ID NO: 4238570 - DNA, 21 bp, Homo sapiens
gcaagactgcaaactttttta

SEQ ID NO: 4238571 - DNA, 18 bp, Homo sapiens
gcaagagggacagagccc

SEQ ID NO: 4238572 - DNA, 18 bp, Homo sapiens
gcaaggagatttacaact

SEQ ID NO: 4238573 - DNA, 16 bp, Homo sapiens
gcaaggagtggggagg

SEQ ID NO: 4238574 - DNA, 21 bp, Homo sapiens
gcaataaagcagcgtttctat

SEQ ID NO: 4238575 - DNA, 20 bp, Homo sapiens
gcaataaataaagcttggga

SEQ ID NO: 4238576 - DNA, 13 bp, Homo sapiens
gcaatccatttat

SEQ ID NO: 4238577 - DNA, 23 bp, Homo sapiens
gcaatgaaaagtcgttttccaaa

SEQ ID NO: 4238578 - DNA, 22 bp, Homo sapiens
gcaatgcttaaactaaataatg

SEQ ID NO: 4238579 - DNA, 18 bp, Homo sapiens
gcacaaggattgaaaatt

SEQ ID NO: 4238580 - DNA, 18 bp, Homo sapiens
gcacagagttgttacatt

SEQ ID NO: 4238581 - DNA, 19 bp, Homo sapiens
gcacagagttgttacattt

SEQ ID NO: 4238582 - DNA, 21 bp, Homo sapiens
gcacagagttgttacattttt

SEQ ID NO: 4238583 - DNA, 22 bp, Homo sapiens
gcacagagttgttacattttta

SEQ ID NO: 4238584 - DNA, 14 bp, Homo sapiens
gcacagctctcctc

SEQ ID NO: 4238585 - DNA, 21 bp, Homo sapiens
gcacatcagcacgatttctgt

SEQ ID NO: 4238586 - DNA, 23 bp, Homo sapiens
gcacatcagcacgatttctgttt

SEQ ID NO: 4238587 - DNA, 13 bp, Homo sapiens
gcacatctgcatt

SEQ ID NO: 4238588 - DNA, 21 bp, Homo sapiens
gcacatctgcattttcacccc

SEQ ID NO: 4238589 - DNA, 13 bp, Homo sapiens
gcacctgagcctg

SEQ ID NO: 4238590 - DNA, 20 bp, Homo sapiens
gcactagagaatgcacagat

SEQ ID NO: 4238591 - DNA, 23 bp, Homo sapiens
gcactatgcccttttatataagt

SEQ ID NO: 4238592 - DNA, 14 bp, Homo sapiens
gcacttacctgctt

SEQ ID NO: 4238593 - DNA, 14 bp, Homo sapiens
gcagaaaatattta

SEQ ID NO: 4238594 - DNA, 17 bp, Homo sapiens
gcagacagaaactggat

SEQ ID NO: 4238595 - DNA, 19 bp, Homo sapiens
gcagaccagctggcgggtg

SEQ ID NO: 4238596 - DNA, 15 bp, Homo sapiens
gcagagaagttctca

SEQ ID NO: 4238597 - DNA, 18 bp, Homo sapiens
gcagatgtattgactgta

SEQ ID NO: 4238598 - DNA, 12 bp, Homo sapiens
gcagcaataaag

SEQ ID NO: 4238599 - DNA, 16 bp, Homo sapiens
gcagcaataaagcagc

SEQ ID NO: 4238600 - DNA, 19 bp, Homo sapiens
gcagccccgggcggagcct

SEQ ID NO: 4238601 - DNA, 18 bp, Homo sapiens
gcagcctttgcctccccg

SEQ ID NO: 4238602 - DNA, 13 bp, Homo sapiens
gcagctagtgcct

SEQ ID NO: 4238603 - DNA, 14 bp, Homo sapiens
gcagctcccgcagg

SEQ ID NO: 4238604 - DNA, 13 bp, Homo sapiens
gcagctctgagcc

SEQ ID NO: 4238605 - DNA, 18 bp, Homo sapiens
gcagggctgaagtctggc

SEQ ID NO: 4238606 - DNA, 15 bp, Homo sapiens
gcagtgactttgtat

SEQ ID NO: 4238607 - DNA, 12 bp, Homo sapiens
gcagtgagagtt

SEQ ID NO: 4238608 - DNA, 21 bp, Homo sapiens
gcagtggtggttttctgttct

SEQ ID NO: 4238609 - DNA, 22 bp, Homo sapiens
gcagtggtggttttctgttctt

SEQ ID NO: 4238610 - DNA, 18 bp, Homo sapiens
gcagtgtcccttttgcta

SEQ ID NO: 4238611 - DNA, 15 bp, Homo sapiens
gcataatgataaaat

SEQ ID NO: 4238612 - DNA, 16 bp, Homo sapiens
gcatacgtacacattt

SEQ ID NO: 4238613 - DNA, 21 bp, Homo sapiens
gcatcgaggaagggccgagga

SEQ ID NO: 4238614 - DNA, 23 bp, Homo sapiens
gcatctggcacgtggccaggagc

SEQ ID NO: 4238615 - DNA, 20 bp, Homo sapiens
gcatgaagtaatatgcacac

SEQ ID NO: 4238616 - DNA, 16 bp, Homo sapiens
gcatgcagcgccacct

SEQ ID NO: 4238617 - DNA, 13 bp, Homo sapiens
gcatggagactct

SEQ ID NO: 4238618 - DNA, 15 bp, Homo sapiens
gcatggctcagagct

SEQ ID NO: 4238619 - DNA, 16 bp, Homo sapiens
gcatggtggctcatgc

SEQ ID NO: 4238620 - DNA, 18 bp, Homo sapiens
gcatggtggctcatgcct

SEQ ID NO: 4238621 - DNA, 12 bp, Homo sapiens
gcatgtgcaggt

SEQ ID NO: 4238622 - DNA, 19 bp, Homo sapiens
gcattatctagatactgta

SEQ ID NO: 4238623 - DNA, 22 bp, Homo sapiens
gcattatctagatactgtatca

SEQ ID NO: 4238624 - DNA, 24 bp, Homo sapiens
gcattatctagatactgtatcatg

SEQ ID NO: 4238625 - DNA, 17 bp, Homo sapiens
gcattcattctgagccc

SEQ ID NO: 4238626 - DNA, 12 bp, Homo sapiens
gcatttaaaaga

SEQ ID NO: 4238627 - DNA, 15 bp, Homo sapiens
gcatttaaaagatac

SEQ ID NO: 4238628 - DNA, 16 bp, Homo sapiens
gcatttaaaagataca

SEQ ID NO: 4238629 - DNA, 18 bp, Homo sapiens
gcatttaaaagatacagt

SEQ ID NO: 4238630 - DNA, 18 bp, Homo sapiens
gcatttaatggcagctag

SEQ ID NO: 4238631 - DNA, 23 bp, Homo sapiens
gccacagtggtactctgtgtctg

SEQ ID NO: 4238632 - DNA, 14 bp, Homo sapiens
gccaccacgtccag

SEQ ID NO: 4238633 - DNA, 16 bp, Homo sapiens
gccaccatggccagcc

SEQ ID NO: 4238634 - DNA, 17 bp, Homo sapiens
gccagctgccccagcca

SEQ ID NO: 4238635 - DNA, 15 bp, Homo sapiens
gccaggagccctggc

SEQ ID NO: 4238636 - DNA, 20 bp, Homo sapiens
gaaaatttagccctttaaaa

SEQ ID NO: 4238637 - DNA, 18 bp, Homo sapiens
gaaaattttgatgtttta

SEQ ID NO: 4238638 - DNA, 17 bp, Homo sapiens
gaaacattacagttcat

SEQ ID NO: 4238639 - DNA, 16 bp, Homo sapiens
gaaacccggtgcatct

SEQ ID NO: 4238640 - DNA, 13 bp, Homo sapiens
gaaactggattaa

SEQ ID NO: 4238641 - DNA, 17 bp, Homo sapiens
gaaactggattaaactt

SEQ ID NO: 4238642 - DNA, 13 bp, Homo sapiens
gaaagaggaaccc

SEQ ID NO: 4238643 - DNA, 20 bp, Homo sapiens
gaaagcttcaaagtttatat

SEQ ID NO: 4238644 - DNA, 15 bp, Homo sapiens
gaaagcttttaaaat

SEQ ID NO: 4238645 - DNA, 14 bp, Homo sapiens
gaaaggttttgtat

SEQ ID NO: 4238646 - DNA, 18 bp, Homo sapiens
gaaatacagttatttcat

SEQ ID NO: 4238647 - DNA, 17 bp, Homo sapiens
gaacaaagtgaaggaca

SEQ ID NO: 4238648 - DNA, 13 bp, Homo sapiens
gaacagcctgagc

SEQ ID NO: 4238649 - DNA, 19 bp, Homo sapiens
gaacatacttcaaaaataa

SEQ ID NO: 4238650 - DNA, 23 bp, Homo sapiens
gaaccctttgtttcttgtttatt

SEQ ID NO: 4238651 - DNA, 17 bp, Homo sapiens
gaactggttgtagtggg

SEQ ID NO: 4238652 - DNA, 20 bp, Homo sapiens
gaactggttgtagtgggaag

SEQ ID NO: 4238653 - DNA, 17 bp, Homo sapiens
gaacttaaataatgtga

SEQ ID NO: 4238654 - DNA, 16 bp, Homo sapiens
gaactttgacctctgc

SEQ ID NO: 4238655 - DNA, 23 bp, Homo sapiens
gaactttgacctctgcagcaata

SEQ ID NO: 4238656 - DNA, 12 bp, Homo sapiens
gaagaaggcagt

SEQ ID NO: 4238657 - DNA, 13 bp, Homo sapiens
gaagaaggcagtg

SEQ ID NO: 4238658 - DNA, 20 bp, Homo sapiens
gaagattaggagaaacacat

SEQ ID NO: 4238659 - DNA, 14 bp, Homo sapiens
gaagctcccacacc

SEQ ID NO: 4238660 - DNA, 17 bp, Homo sapiens
gaagctgagggcaaatc

SEQ ID NO: 4238661 - DNA, 19 bp, Homo sapiens
gaaggatacaaaagcatgt

SEQ ID NO: 4238662 - DNA, 17 bp, Homo sapiens
gaagggaacagcctgag

SEQ ID NO: 4238663 - DNA, 18 bp, Homo sapiens
gaagggaacagcctgagc

SEQ ID NO: 4238664 - DNA, 19 bp, Homo sapiens
gaagtaaagccattaaatg

SEQ ID NO: 4238665 - DNA, 13 bp, Homo sapiens
gaagtaacttatt

SEQ ID NO: 4238666 - DNA, 22 bp, Homo sapiens
gaagtaatatgcacacattttt

SEQ ID NO: 4238667 - DNA, 17 bp, Homo sapiens
gaagtcaaaatatgtaa

SEQ ID NO: 4238668 - DNA, 22 bp, Homo sapiens
gaagtgcctgctgggtgccagg

SEQ ID NO: 4238669 - DNA, 22 bp, Homo sapiens
gaagttttaactttaatacagc

SEQ ID NO: 4238670 - DNA, 12 bp, Homo sapiens
gaataaactgaa

SEQ ID NO: 4238671 - DNA, 13 bp, Homo sapiens
gaataaactgaat

SEQ ID NO: 4238672 - DNA, 14 bp, Homo sapiens
gaataatggaaaca

SEQ ID NO: 4238673 - DNA, 15 bp, Homo sapiens
gaatacatctgtgga

SEQ ID NO: 4238674 - DNA, 15 bp, Homo sapiens
gaatattttggaaac

SEQ ID NO: 4238675 - DNA, 16 bp, Homo sapiens
gaatcccttaaaatta

SEQ ID NO: 4238676 - DNA, 12 bp, Homo sapiens
gaatgagcctgt

SEQ ID NO: 4238677 - DNA, 13 bp, Homo sapiens
gaatggagacaga

SEQ ID NO: 4238678 - DNA, 23 bp, Homo sapiens
gaatgttatcggattactgaatt

SEQ ID NO: 4238679 - DNA, 19 bp, Homo sapiens
gaattaaaaggatagtatt

SEQ ID NO: 4238680 - DNA, 20 bp, Homo sapiens
gaattaaaaggatagtattt

SEQ ID NO: 4238681 - DNA, 19 bp, Homo sapiens
gaattctctagtttgatta

SEQ ID NO: 4238682 - DNA, 11 bp, Homo sapiens
gaattgaaaaa

SEQ ID NO: 4238683 - DNA, 20 bp, Homo sapiens
gaattgttagcaaatgacag

SEQ ID NO: 4238684 - DNA, 22 bp, Homo sapiens
gaatttcttttccttcattcat

SEQ ID NO: 4238685 - DNA, 20 bp, Homo sapiens
gacaaaaaaatttaaaatta

SEQ ID NO: 4238686 - DNA, 16 bp, Homo sapiens
gacaaagatttcttct

SEQ ID NO: 4238687 - DNA, 21 bp, Homo sapiens
gacaatgacttactgtacatg

SEQ ID NO: 4238688 - DNA, 16 bp, Homo sapiens
gacacaatatgtatgc

SEQ ID NO: 4238689 - DNA, 14 bp, Homo sapiens
gacacatgcaaggt

SEQ ID NO: 4238690 - DNA, 22 bp, Homo sapiens
gacaccttttctatttacctcc

SEQ ID NO: 4238691 - DNA, 21 bp, Homo sapiens
gacagaaactggattaaaaca

SEQ ID NO: 4238692 - DNA, 14 bp, Homo sapiens
gacagactatttgc

SEQ ID NO: 4238693 - DNA, 11 bp, Homo sapiens
gacagagcccg

SEQ ID NO: 4238694 - DNA, 15 bp, Homo sapiens
gacatagaggtatat

SEQ ID NO: 4238695 - DNA, 15 bp, Homo sapiens
gaccaagtccaagcc

SEQ ID NO: 4238696 - DNA, 18 bp, Homo sapiens
gaccaagtccaagcccgt

SEQ ID NO: 4238697 - DNA, 18 bp, Homo sapiens
gaccaattattgatatat

SEQ ID NO: 4238698 - DNA, 15 bp, Homo sapiens
gaccacgccccagga

SEQ ID NO: 4238699 - DNA, 16 bp, Homo sapiens
gaccacgccccaggac

SEQ ID NO: 4238700 - DNA, 14 bp, Homo sapiens
gaccagcccacagc

SEQ ID NO: 4238701 - DNA, 15 bp, Homo sapiens
gaccagcccacagca

SEQ ID NO: 4238702 - DNA, 21 bp, Homo sapiens
gacccactttgtaatttttgc

SEQ ID NO: 4238703 - DNA, 20 bp, Homo sapiens
gacccattctacacagagca

SEQ ID NO: 4238704 - DNA, 12 bp, Homo sapiens
gaccccagagaa

SEQ ID NO: 4238705 - DNA, 16 bp, Homo sapiens
gacctctgcagcaata

SEQ ID NO: 4238706 - DNA, 14 bp, Homo sapiens
gacggaatctgccg

SEQ ID NO: 4238707 - DNA, 14 bp, Homo sapiens
gactatttgctaat

SEQ ID NO: 4238708 - DNA, 20 bp, Homo sapiens
gactccagcctgcctggcag

SEQ ID NO: 4238709 - DNA, 19 bp, Homo sapiens
gactcctcttcccagagtc

SEQ ID NO: 4238710 - DNA, 17 bp, Homo sapiens
gactcgctcactcccat

SEQ ID NO: 4238711 - DNA, 15 bp, Homo sapiens
gactctcagcccaga

SEQ ID NO: 4238712 - DNA, 16 bp, Homo sapiens
gactctcagcccagaa

SEQ ID NO: 4238713 - DNA, 17 bp, Homo sapiens
gactctcagcccagaag

SEQ ID NO: 4238714 - DNA, 16 bp, Homo sapiens
gactgaatttcttttg

SEQ ID NO: 4238715 - DNA, 23 bp, Homo sapiens
gactgagtacgttgtgcatttgg

SEQ ID NO: 4238716 - DNA, 15 bp, Homo sapiens
gactgcaaacttttt

SEQ ID NO: 4238717 - DNA, 17 bp, Homo sapiens
gactgccagtggagacg

SEQ ID NO: 4238718 - DNA, 23 bp, Homo sapiens
gactgggtctcgctttgttgccc

SEQ ID NO: 4238719 - DNA, 18 bp, Homo sapiens
gacttactgtacatgaaa

SEQ ID NO: 4238720 - DNA, 19 bp, Homo sapiens
gacttgtacaaacagtatt

SEQ ID NO: 4238721 - DNA, 22 bp, Homo sapiens
gacttttgttaaattcagtaat

SEQ ID NO: 4238722 - DNA, 23 bp, Homo sapiens
gactttttttggtataatgttta

SEQ ID NO: 4238723 - DNA, 14 bp, Homo sapiens
gagaaccaaagcaa

SEQ ID NO: 4238724 - DNA, 14 bp, Homo sapiens
gagaatcccttaaa

SEQ ID NO: 4238725 - DNA, 17 bp, Homo sapiens
gagaatgcacagatata

SEQ ID NO: 4238726 - DNA, 21 bp, Homo sapiens
gagaattgctgaagggcattc

SEQ ID NO: 4238727 - DNA, 21 bp, Homo sapiens
gagaatttaagtagaaaagtt

SEQ ID NO: 4238728 - DNA, 10 bp, Homo sapiens
gagacagaca

SEQ ID NO: 4238729 - DNA, 12 bp, Homo sapiens
gagaccaggggc

SEQ ID NO: 4238730 - DNA, 11 bp, Homo sapiens
gagagccctgt

SEQ ID NO: 4238731 - DNA, 21 bp, Homo sapiens
gagagttaataggagtatttt

SEQ ID NO: 4238732 - DNA, 16 bp, Homo sapiens
gagcagtcctgcctca

SEQ ID NO: 4238733 - DNA, 20 bp, Homo sapiens
gagcagtcctgcctcagcct

SEQ ID NO: 4238734 - DNA, 22 bp, Homo sapiens
gagcatttaatggcagctagtg

SEQ ID NO: 4238735 - DNA, 12 bp, Homo sapiens
gagccagcccaa

SEQ ID NO: 4238736 - DNA, 21 bp, Homo sapiens
gagccctactgaagggaacag

SEQ ID NO: 4238737 - DNA, 12 bp, Homo sapiens
gagcctgtccaa

SEQ ID NO: 4238738 - DNA, 22 bp, Homo sapiens
gagcctgtccaatttctgctgt

SEQ ID NO: 4238739 - DNA, 20 bp, Homo sapiens
gagccttttatctgcagaac

SEQ ID NO: 4238740 - DNA, 21 bp, Homo sapiens
gagctgctgggtggcaggggg

SEQ ID NO: 4238741 - DNA, 17 bp, Homo sapiens
gagctttctgtgcatgt

SEQ ID NO: 4238742 - DNA, 17 bp, Homo sapiens
gaggaatgtgaagccag

SEQ ID NO: 4238743 - DNA, 17 bp, Homo sapiens
gaggccagtacctttcc

SEQ ID NO: 4238744 - DNA, 14 bp, Homo sapiens
gaggcctacctctc

SEQ ID NO: 4238745 - DNA, 13 bp, Homo sapiens
gagggacagagcc

SEQ ID NO: 4238746 - DNA, 15 bp, Homo sapiens
gagggaggcggcctc

SEQ ID NO: 4238747 - DNA, 13 bp, Homo sapiens
gaggggccggagg

SEQ ID NO: 4238748 - DNA, 16 bp, Homo sapiens
gaggtctctccctccc

SEQ ID NO: 4238749 - DNA, 23 bp, Homo sapiens
gaggtctctccctcccccagagc

SEQ ID NO: 4238750 - DNA, 13 bp, Homo sapiens
gaggtctgttctt

SEQ ID NO: 4238751 - DNA, 16 bp, Homo sapiens
gaggtgttgccagtgc

SEQ ID NO: 4238752 - DNA, 13 bp, Homo sapiens
gagtaatttcatt

SEQ ID NO: 4238753 - DNA, 11 bp, Homo sapiens
ctgtggccagg

SEQ ID NO: 4238754 - DNA, 13 bp, Homo sapiens
ctgtggccaggag

SEQ ID NO: 4238755 - DNA, 17 bp, Homo sapiens
ctgtggccaggagccct

SEQ ID NO: 4238756 - DNA, 20 bp, Homo sapiens
ctgtgggaaggccagctgcc

SEQ ID NO: 4238757 - DNA, 16 bp, Homo sapiens
ctgtggggtcgggctc

SEQ ID NO: 4238758 - DNA, 18 bp, Homo sapiens
ctgtggggtcgggctcac

SEQ ID NO: 4238759 - DNA, 12 bp, Homo sapiens
ctgtgtctggca

SEQ ID NO: 4238760 - DNA, 14 bp, Homo sapiens
ctgtgtgtatattg

SEQ ID NO: 4238761 - DNA, 22 bp, Homo sapiens
ctgtgttaaacactacacattt

SEQ ID NO: 4238762 - DNA, 13 bp, Homo sapiens
ctgttctttctgg

SEQ ID NO: 4238763 - DNA, 17 bp, Homo sapiens
ctgtttaccatttttca

SEQ ID NO: 4238764 - DNA, 18 bp, Homo sapiens
ctgtttagataatacacc

SEQ ID NO: 4238765 - DNA, 19 bp, Homo sapiens
ctgtttataatctgaagat

SEQ ID NO: 4238766 - DNA, 19 bp, Homo sapiens
ctgtttcaaaaaaatctat

SEQ ID NO: 4238767 - DNA, 16 bp, Homo sapiens
cttaaactaaataatg

SEQ ID NO: 4238768 - DNA, 20 bp, Homo sapiens
cttaaactaaataatgaata

SEQ ID NO: 4238769 - DNA, 14 bp, Homo sapiens
cttaaacttgtgaa

SEQ ID NO: 4238770 - DNA, 14 bp, Homo sapiens
cttaaataatgtga

SEQ ID NO: 4238771 - DNA, 16 bp, Homo sapiens
cttaaataatgtgaaa

SEQ ID NO: 4238772 - DNA, 12 bp, Homo sapiens
cttaactatgag

SEQ ID NO: 4238773 - DNA, 12 bp, Homo sapiens
cttaacttcaca

SEQ ID NO: 4238774 - DNA, 22 bp, Homo sapiens
cttaacttcacatattgatttc

SEQ ID NO: 4238775 - DNA, 22 bp, Homo sapiens
cttaagtcagatttttatttat

SEQ ID NO: 4238776 - DNA, 16 bp, Homo sapiens
cttaatctaaatggaa

SEQ ID NO: 4238777 - DNA, 19 bp, Homo sapiens
cttagacactttacctctt

SEQ ID NO: 4238778 - DNA, 22 bp, Homo sapiens
cttagactcctcttcccagagt

SEQ ID NO: 4238779 - DNA, 15 bp, Homo sapiens
cttaggaaaggagat

SEQ ID NO: 4238780 - DNA, 21 bp, Homo sapiens
cttagggaaggatacaaaagc

SEQ ID NO: 4238781 - DNA, 19 bp, Homo sapiens
cttagtaaaatttatttca

SEQ ID NO: 4238782 - DNA, 23 bp, Homo sapiens
cttattaattcttcacctgttat

SEQ ID NO: 4238783 - DNA, 18 bp, Homo sapiens
cttattgtaaattttaga

SEQ ID NO: 4238784 - DNA, 14 bp, Homo sapiens
cttcaaaaataatg

SEQ ID NO: 4238785 - DNA, 15 bp, Homo sapiens
cttcaaaaataatgt

SEQ ID NO: 4238786 - DNA, 13 bp, Homo sapiens
cttcaaagtgtgt

SEQ ID NO: 4238787 - DNA, 18 bp, Homo sapiens
cttcaaagtgtgtctggg

SEQ ID NO: 4238788 - DNA, 17 bp, Homo sapiens
cttcaaagtttatatgc

SEQ ID NO: 4238789 - DNA, 18 bp, Homo sapiens
cttcaatgtgcataatga

SEQ ID NO: 4238790 - DNA, 19 bp, Homo sapiens
cttcacctgttatgtatga

SEQ ID NO: 4238791 - DNA, 21 bp, Homo sapiens
cttcctccgaggccagtacct

SEQ ID NO: 4238792 - DNA, 22 bp, Homo sapiens
cttcctctacgtttatcctggc

SEQ ID NO: 4238793 - DNA, 19 bp, Homo sapiens
cttcctgccggttccgccc

SEQ ID NO: 4238794 - DNA, 16 bp, Homo sapiens
cttcggggaccagccc

SEQ ID NO: 4238795 - DNA, 19 bp, Homo sapiens
cttctagaatgtaaagtta

SEQ ID NO: 4238796 - DNA, 13 bp, Homo sapiens
cttctgccttttc

SEQ ID NO: 4238797 - DNA, 15 bp, Homo sapiens
cttctgtatttctag

SEQ ID NO: 4238798 - DNA, 14 bp, Homo sapiens
cttctgttgctggt

SEQ ID NO: 4238799 - DNA, 21 bp, Homo sapiens
cttgaactttgacctctgcag

SEQ ID NO: 4238800 - DNA, 21 bp, Homo sapiens
cttgacacaggaaatgggaaa

SEQ ID NO: 4238801 - DNA, 12 bp, Homo sapiens
cttgagacaatg

SEQ ID NO: 4238802 - DNA, 18 bp, Homo sapiens
cttgagccttgaactttg

SEQ ID NO: 4238803 - DNA, 17 bp, Homo sapiens
cttgagtggtttttgct

SEQ ID NO: 4238804 - DNA, 18 bp, Homo sapiens
cttgattttaatacattg

SEQ ID NO: 4238805 - DNA, 13 bp, Homo sapiens
cttgcacctgagc

SEQ ID NO: 4238806 - DNA, 14 bp, Homo sapiens
cttgcactgtccag

SEQ ID NO: 4238807 - DNA, 18 bp, Homo sapiens
cttgcattaaaggagatc

SEQ ID NO: 4238808 - DNA, 16 bp, Homo sapiens
cttggcaggtgcctgt

SEQ ID NO: 4238809 - DNA, 18 bp, Homo sapiens
cttgggaccccagagaaa

SEQ ID NO: 4238810 - DNA, 19 bp, Homo sapiens
cttgggtcctactcctgga

SEQ ID NO: 4238811 - DNA, 15 bp, Homo sapiens
cttggtttgtaaatt

SEQ ID NO: 4238812 - DNA, 20 bp, Homo sapiens
cttggtttgtaaattaactt

SEQ ID NO: 4238813 - DNA, 15 bp, Homo sapiens
cttgtacataatgcg

SEQ ID NO: 4238814 - DNA, 16 bp, Homo sapiens
cttgtgaatgcttctc

SEQ ID NO: 4238815 - DNA, 19 bp, Homo sapiens
cttgtgaatgcttctcact

SEQ ID NO: 4238816 - DNA, 21 bp, Homo sapiens
cttgttccccactgacagcct

SEQ ID NO: 4238817 - DNA, 12 bp, Homo sapiens
cttgtttattga

SEQ ID NO: 4238818 - DNA, 23 bp, Homo sapiens
cttgtttattgagtttgtaggta

SEQ ID NO: 4238819 - DNA, 19 bp, Homo sapiens
ctttaaccaggaatattaa

SEQ ID NO: 4238820 - DNA, 11 bp, Homo sapiens
ctttacctctt

SEQ ID NO: 4238821 - DNA, 17 bp, Homo sapiens
ctttaccttttttatac

SEQ ID NO: 4238822 - DNA, 13 bp, Homo sapiens
ctttactatggcc

SEQ ID NO: 4238823 - DNA, 18 bp, Homo sapiens
ctttactctgtgtttaaa

SEQ ID NO: 4238824 - DNA, 19 bp, Homo sapiens
ctttactctgtgtttaaaa

SEQ ID NO: 4238825 - DNA, 18 bp, Homo sapiens
ctttcatctcccagatcc

SEQ ID NO: 4238826 - DNA, 19 bp, Homo sapiens
ctttcatctcccagatcct

SEQ ID NO: 4238827 - DNA, 20 bp, Homo sapiens
ctttcccagtgagtctctgg

SEQ ID NO: 4238828 - DNA, 18 bp, Homo sapiens
ctttcccctcctccctgg

SEQ ID NO: 4238829 - DNA, 17 bp, Homo sapiens
ctttcctgatgatgctg

SEQ ID NO: 4238830 - DNA, 20 bp, Homo sapiens
ctttctgtgcatgtgcaggt

SEQ ID NO: 4238831 - DNA, 11 bp, Homo sapiens
ctttgaagcca

SEQ ID NO: 4238832 - DNA, 13 bp, Homo sapiens
ctttgacctctgc

SEQ ID NO: 4238833 - DNA, 23 bp, Homo sapiens
ctttgattctccttttatgtgta

SEQ ID NO: 4238834 - DNA, 14 bp, Homo sapiens
ctttgccctgaggc

SEQ ID NO: 4238835 - DNA, 15 bp, Homo sapiens
ctttgccctgaggct

SEQ ID NO: 4238836 - DNA, 23 bp, Homo sapiens
ctttgtaaatgcatattaaataa

SEQ ID NO: 4238837 - DNA, 15 bp, Homo sapiens
ctttgtatagagaat

SEQ ID NO: 4238838 - DNA, 14 bp, Homo sapiens
ctttgtctgtccag

SEQ ID NO: 4238839 - DNA, 16 bp, Homo sapiens
ctttgtggttttatgg

SEQ ID NO: 4238840 - DNA, 13 bp, Homo sapiens
ctttgtttcttgt

SEQ ID NO: 4238841 - DNA, 17 bp, Homo sapiens
ctttgtttcttgtttat

SEQ ID NO: 4238842 - DNA, 20 bp, Homo sapiens
cttttaaaatgtagaaactt

SEQ ID NO: 4238843 - DNA, 19 bp, Homo sapiens
cttttactggactgtctga

SEQ ID NO: 4238844 - DNA, 13 bp, Homo sapiens
cttttataaactt

SEQ ID NO: 4238845 - DNA, 16 bp, Homo sapiens
cttttataaactttac

SEQ ID NO: 4238846 - DNA, 20 bp, Homo sapiens
cttttataaactttaccttt

SEQ ID NO: 4238847 - DNA, 15 bp, Homo sapiens
cttttatctgcagaa

SEQ ID NO: 4238848 - DNA, 16 bp, Homo sapiens
cttttatctgcagaac

SEQ ID NO: 4238849 - DNA, 22 bp, Homo sapiens
cttttcataaagggttgaaaat

SEQ ID NO: 4238850 - DNA, 18 bp, Homo sapiens
cttttcccctgttaaaca

SEQ ID NO: 4238851 - DNA, 19 bp, Homo sapiens
cttttcccctgttaaacag

SEQ ID NO: 4238852 - DNA, 21 bp, Homo sapiens
cttttcccctgttaaacagta

SEQ ID NO: 4238853 - DNA, 13 bp, Homo sapiens
cttttctgtactt

SEQ ID NO: 4238854 - DNA, 22 bp, Homo sapiens
cttttgttctgctttatctttt

SEQ ID NO: 4238855 - DNA, 22 bp, Homo sapiens
cttttgttcttggtttgtaaat

SEQ ID NO: 4238856 - DNA, 16 bp, Homo sapiens
cttttttagagttgat

SEQ ID NO: 4238857 - DNA, 23 bp, Homo sapiens
ctttttttttttgtttgatgcag

SEQ ID NO: 4238858 - DNA, 16 bp, Homo sapiens
gaaaaaaaagttttta

SEQ ID NO: 4238859 - DNA, 23 bp, Homo sapiens
gaaaaacaccgcttctgcctttt

SEQ ID NO: 4238860 - DNA, 17 bp, Homo sapiens
gaaaaaggatgcacaga

SEQ ID NO: 4238861 - DNA, 18 bp, Homo sapiens
gaaaaatctcaattgaaa

SEQ ID NO: 4238862 - DNA, 20 bp, Homo sapiens
gaaaaatctcaattgaaagc

SEQ ID NO: 4238863 - DNA, 18 bp, Homo sapiens
gaaaacacatttttctta

SEQ ID NO: 4238864 - DNA, 19 bp, Homo sapiens
gaaaacacatttttcttag

SEQ ID NO: 4238865 - DNA, 12 bp, Homo sapiens
gaaaacatgcta

SEQ ID NO: 4238866 - DNA, 16 bp, Homo sapiens
gaaaacatgctacaca

SEQ ID NO: 4238867 - DNA, 19 bp, Homo sapiens
gaaaacatgctacacactg

SEQ ID NO: 4238868 - DNA, 20 bp, Homo sapiens
gaaaagttgcagatgtattg

SEQ ID NO: 4238869 - DNA, 17 bp, Homo sapiens
gaaaataaacagacaaa

SEQ ID NO: 4238870 - DNA, 19 bp, Homo sapiens
ctcccccaaggccactgcg

SEQ ID NO: 4238871 - DNA, 15 bp, Homo sapiens
ctcccccagagcccc

SEQ ID NO: 4238872 - DNA, 14 bp, Homo sapiens
ctccccggctcgag

SEQ ID NO: 4238873 - DNA, 15 bp, Homo sapiens
ctccctcccctgcca

SEQ ID NO: 4238874 - DNA, 18 bp, Homo sapiens
ctccctcccctgccattt

SEQ ID NO: 4238875 - DNA, 12 bp, Homo sapiens
ctccgcagggcg

SEQ ID NO: 4238876 - DNA, 20 bp, Homo sapiens
ctccgcagggcgcccagcgc

SEQ ID NO: 4238877 - DNA, 14 bp, Homo sapiens
ctcctaatggcatg

SEQ ID NO: 4238878 - DNA, 20 bp, Homo sapiens
ctcctaatggcatggagact

SEQ ID NO: 4238879 - DNA, 23 bp, Homo sapiens
ctcctaatggcatggagactctg

SEQ ID NO: 4238880 - DNA, 18 bp, Homo sapiens
ctcctagcagacagaaac

SEQ ID NO: 4238881 - DNA, 21 bp, Homo sapiens
ctcctagcagacagaaactgg

SEQ ID NO: 4238882 - DNA, 23 bp, Homo sapiens
ctcctagcagacagaaactggat

SEQ ID NO: 4238883 - DNA, 14 bp, Homo sapiens
ctcctggcccttct

SEQ ID NO: 4238884 - DNA, 16 bp, Homo sapiens
ctcctgtacctcttga

SEQ ID NO: 4238885 - DNA, 12 bp, Homo sapiens
ctccttttatgt

SEQ ID NO: 4238886 - DNA, 15 bp, Homo sapiens
ctccttttatgtgta

SEQ ID NO: 4238887 - DNA, 15 bp, Homo sapiens
ctcgatccaaattgt

SEQ ID NO: 4238888 - DNA, 21 bp, Homo sapiens
ctcgatccaaattgtgcttct

SEQ ID NO: 4238889 - DNA, 17 bp, Homo sapiens
ctcgctttgttgcccag

SEQ ID NO: 4238890 - DNA, 16 bp, Homo sapiens
ctcggagggtgccgtg

SEQ ID NO: 4238891 - DNA, 22 bp, Homo sapiens
ctctacctaatgtctcactgtt

SEQ ID NO: 4238892 - DNA, 19 bp, Homo sapiens
ctctagtttgattaaattc

SEQ ID NO: 4238893 - DNA, 21 bp, Homo sapiens
ctctagtttgattaaattctt

SEQ ID NO: 4238894 - DNA, 20 bp, Homo sapiens
ctctcacaggcagctctgag

SEQ ID NO: 4238895 - DNA, 15 bp, Homo sapiens
ctctccacacggagc

SEQ ID NO: 4238896 - DNA, 20 bp, Homo sapiens
ctctccatatcccttcctct

SEQ ID NO: 4238897 - DNA, 21 bp, Homo sapiens
ctctccctcccccagagcccc

SEQ ID NO: 4238898 - DNA, 17 bp, Homo sapiens
ctctccctcccctgcca

SEQ ID NO: 4238899 - DNA, 14 bp, Homo sapiens
ctctcctcctccat

SEQ ID NO: 4238900 - DNA, 13 bp, Homo sapiens
ctctcctgtacct

SEQ ID NO: 4238901 - DNA, 14 bp, Homo sapiens
ctctcctgtacctc

SEQ ID NO: 4238902 - DNA, 17 bp, Homo sapiens
ctctcctgtacctcttg

SEQ ID NO: 4238903 - DNA, 13 bp, Homo sapiens
ctctcctttgaaa

SEQ ID NO: 4238904 - DNA, 22 bp, Homo sapiens
ctctcttcagactctcagccca

SEQ ID NO: 4238905 - DNA, 23 bp, Homo sapiens
ctctcttcagactctcagcccag

SEQ ID NO: 4238906 - DNA, 19 bp, Homo sapiens
ctctgcagcaataaagcag

SEQ ID NO: 4238907 - DNA, 23 bp, Homo sapiens
ctctgcagcaataaagcagcgtt

SEQ ID NO: 4238908 - DNA, 12 bp, Homo sapiens
ctctgccaaagc

SEQ ID NO: 4238909 - DNA, 11 bp, Homo sapiens
ctctgccactc

SEQ ID NO: 4238910 - DNA, 21 bp, Homo sapiens
ctctgcctccaacccagcagt

SEQ ID NO: 4238911 - DNA, 13 bp, Homo sapiens
ctctgggatctgc

SEQ ID NO: 4238912 - DNA, 14 bp, Homo sapiens
ctctgtgtctggca

SEQ ID NO: 4238913 - DNA, 17 bp, Homo sapiens
ctctgtgtctggcaggc

SEQ ID NO: 4238914 - DNA, 14 bp, Homo sapiens
ctctgtgtttaaaa

SEQ ID NO: 4238915 - DNA, 13 bp, Homo sapiens
ctcttaatctgtg

SEQ ID NO: 4238916 - DNA, 15 bp, Homo sapiens
ctcttaatctgtgtg

SEQ ID NO: 4238917 - DNA, 17 bp, Homo sapiens
ctcttcagactctcagc

SEQ ID NO: 4238918 - DNA, 13 bp, Homo sapiens
ctcttcccagagt

SEQ ID NO: 4238919 - DNA, 23 bp, Homo sapiens
ctcttgagccttgaactttgacc

SEQ ID NO: 4238920 - DNA, 17 bp, Homo sapiens
ctctttgccctgaggct

SEQ ID NO: 4238921 - DNA, 15 bp, Homo sapiens
ctgaagggaacagcc

SEQ ID NO: 4238922 - DNA, 14 bp, Homo sapiens
ctgaatattttttg

SEQ ID NO: 4238923 - DNA, 12 bp, Homo sapiens
ctgaatttcttt

SEQ ID NO: 4238924 - DNA, 13 bp, Homo sapiens
ctgacagcctccc

SEQ ID NO: 4238925 - DNA, 16 bp, Homo sapiens
ctgaccccgccatgca

SEQ ID NO: 4238926 - DNA, 21 bp, Homo sapiens
ctgaccgttaaaaaattcttg

SEQ ID NO: 4238927 - DNA, 23 bp, Homo sapiens
ctgagccgaacatgttatttaac

SEQ ID NO: 4238928 - DNA, 22 bp, Homo sapiens
ctgagcctgttcccactcagca

SEQ ID NO: 4238929 - DNA, 19 bp, Homo sapiens
ctgagggcaaatccagtcc

SEQ ID NO: 4238930 - DNA, 18 bp, Homo sapiens
ctgagtacgttgtgcatt

SEQ ID NO: 4238931 - DNA, 19 bp, Homo sapiens
ctgataaaacaacagctcg

SEQ ID NO: 4238932 - DNA, 12 bp, Homo sapiens
ctgatgatgctg

SEQ ID NO: 4238933 - DNA, 24 bp, Homo sapiens
ctgattcaagtaagtagatgcctg

SEQ ID NO: 4238934 - DNA, 21 bp, Homo sapiens
ctgcagcccgtgtccaggagc

SEQ ID NO: 4238935 - DNA, 18 bp, Homo sapiens
ctgcagcctttgcctccc

SEQ ID NO: 4238936 - DNA, 20 bp, Homo sapiens
ctgcagcctttgcctccccg

SEQ ID NO: 4238937 - DNA, 19 bp, Homo sapiens
ctgcagggccgggcagggg

SEQ ID NO: 4238938 - DNA, 14 bp, Homo sapiens
ctgcatttaaaaga

SEQ ID NO: 4238939 - DNA, 18 bp, Homo sapiens
ctgcatttaaaagataca

SEQ ID NO: 4238940 - DNA, 17 bp, Homo sapiens
ctgcattttcaccccac

SEQ ID NO: 4238941 - DNA, 22 bp, Homo sapiens
ctgccaacacacgtccactccc

SEQ ID NO: 4238942 - DNA, 21 bp, Homo sapiens
ctgcccagccctctgtggcca

SEQ ID NO: 4238943 - DNA, 19 bp, Homo sapiens
ctgcccttaccccacacac

SEQ ID NO: 4238944 - DNA, 20 bp, Homo sapiens
ctgccgctttgtctgtccag

SEQ ID NO: 4238945 - DNA, 17 bp, Homo sapiens
ctgcctcagcctcctga

SEQ ID NO: 4238946 - DNA, 13 bp, Homo sapiens
ctgcctccaaccc

SEQ ID NO: 4238947 - DNA, 22 bp, Homo sapiens
ctgctaaattctatgttaaata

SEQ ID NO: 4238948 - DNA, 16 bp, Homo sapiens
ctgctggcccagccaa

SEQ ID NO: 4238949 - DNA, 22 bp, Homo sapiens
ctgctggcccagccaaaccctg

SEQ ID NO: 4238950 - DNA, 16 bp, Homo sapiens
ctgctggtaacagtgg

SEQ ID NO: 4238951 - DNA, 15 bp, Homo sapiens
ctgcttgagctttct

SEQ ID NO: 4238952 - DNA, 14 bp, Homo sapiens
ctgctttctttgat

SEQ ID NO: 4238953 - DNA, 18 bp, Homo sapiens
ctggaatatataaccagt

SEQ ID NO: 4238954 - DNA, 13 bp, Homo sapiens
ctggagatatgaa

SEQ ID NO: 4238955 - DNA, 23 bp, Homo sapiens
ctggaggtctctccctcccccag

SEQ ID NO: 4238956 - DNA, 13 bp, Homo sapiens
ctggattaaactt

SEQ ID NO: 4238957 - DNA, 22 bp, Homo sapiens
ctggcacgtggccaggagccat

SEQ ID NO: 4238958 - DNA, 24 bp, Homo sapiens
ctggccccgcccgtggcctcgtgc

SEQ ID NO: 4238959 - DNA, 20 bp, Homo sapiens
ctggcccgcaagagggacag

SEQ ID NO: 4238960 - DNA, 23 bp, Homo sapiens
ctggcccgcaagagggacagagc

SEQ ID NO: 4238961 - DNA, 15 bp, Homo sapiens
ctggccgcctgcagc

SEQ ID NO: 4238962 - DNA, 14 bp, Homo sapiens
ctggcctagcatac

SEQ ID NO: 4238963 - DNA, 14 bp, Homo sapiens
ctggctatgcattt

SEQ ID NO: 4238964 - DNA, 15 bp, Homo sapiens
ctggctatgcatttg

SEQ ID NO: 4238965 - DNA, 16 bp, Homo sapiens
ctggctatgcatttga

SEQ ID NO: 4238966 - DNA, 18 bp, Homo sapiens
ctgggatttttttattaa

SEQ ID NO: 4238967 - DNA, 12 bp, Homo sapiens
ctgggctctgtc

SEQ ID NO: 4238968 - DNA, 17 bp, Homo sapiens
ctggggaagatggagca

SEQ ID NO: 4238969 - DNA, 23 bp, Homo sapiens
ctggtagcataaataaaactgaa

SEQ ID NO: 4238970 - DNA, 21 bp, Homo sapiens
ctggtctcaaactcctgggct

SEQ ID NO: 4238971 - DNA, 19 bp, Homo sapiens
ctggtgcccttccctggag

SEQ ID NO: 4238972 - DNA, 20 bp, Homo sapiens
ctggtgcccttccctggagg

SEQ ID NO: 4238973 - DNA, 21 bp, Homo sapiens
ctggttgtaccctctccaggc

SEQ ID NO: 4238974 - DNA, 22 bp, Homo sapiens
ctgtaatttgtgatacaatgct

SEQ ID NO: 4238975 - DNA, 17 bp, Homo sapiens
ctgtacatgaaaacaca

SEQ ID NO: 4238976 - DNA, 21 bp, Homo sapiens
ctgtacatgaaaacacatttt

SEQ ID NO: 4238977 - DNA, 23 bp, Homo sapiens
ctgtacatgaaaacacatttttc

SEQ ID NO: 4238978 - DNA, 14 bp, Homo sapiens
ctgtattttaatgt

SEQ ID NO: 4238979 - DNA, 14 bp, Homo sapiens
ctgtcatctaaagt

SEQ ID NO: 4238980 - DNA, 14 bp, Homo sapiens
ctgtccccagggga

SEQ ID NO: 4238981 - DNA, 20 bp, Homo sapiens
ctgtctgatcagggtggagg

SEQ ID NO: 4238982 - DNA, 16 bp, Homo sapiens
ctgtgaaatgctggca

SEQ ID NO: 4238983 - DNA, 14 bp, Homo sapiens
ctgtgattacctct

SEQ ID NO: 4238984 - DNA, 15 bp, Homo sapiens
ctgtgcagaataatg

SEQ ID NO: 4238985 - DNA, 19 bp, Homo sapiens
ctgtgcagaataatggaaa

SEQ ID NO: 4238986 - DNA, 14 bp, Homo sapiens
cggagctcctggca

SEQ ID NO: 4238987 - DNA, 15 bp, Homo sapiens
cggagctcctggcag

SEQ ID NO: 4238988 - DNA, 12 bp, Homo sapiens
cggagggcagga

SEQ ID NO: 4238989 - DNA, 23 bp, Homo sapiens
cggagggtgccgtgcgggcgagg

SEQ ID NO: 4238990 - DNA, 19 bp, Homo sapiens
cggattactgaattgtatc

SEQ ID NO: 4238991 - DNA, 14 bp, Homo sapiens
cggccccgccgcag

SEQ ID NO: 4238992 - DNA, 21 bp, Homo sapiens
cggcccggccggagggcagga

SEQ ID NO: 4238993 - DNA, 15 bp, Homo sapiens
cggccgcccggcagt

SEQ ID NO: 4238994 - DNA, 16 bp, Homo sapiens
cggccgcccggcagtg

SEQ ID NO: 4238995 - DNA, 17 bp, Homo sapiens
cggccgcccggcagtgc

SEQ ID NO: 4238996 - DNA, 15 bp, Homo sapiens
cggccggagggcagg

SEQ ID NO: 4238997 - DNA, 16 bp, Homo sapiens
cggccggagggcagga

SEQ ID NO: 4238998 - DNA, 17 bp, Homo sapiens
cggccggagggcaggac

SEQ ID NO: 4238999 - DNA, 20 bp, Homo sapiens
cggctcgagcagtcctgcct

SEQ ID NO: 4239000 - DNA, 13 bp, Homo sapiens
cggctgtgggtgg

SEQ ID NO: 4239001 - DNA, 22 bp, Homo sapiens
cgggagactgccagtggagacg

SEQ ID NO: 4239002 - DNA, 21 bp, Homo sapiens
cgggcagggggacagcaggga

SEQ ID NO: 4239003 - DNA, 10 bp, Homo sapiens
cggggaccag

SEQ ID NO: 4239004 - DNA, 23 bp, Homo sapiens
cggggactcggagggtgccgtgc

SEQ ID NO: 4239005 - DNA, 19 bp, Homo sapiens
cgggtgatgagacctgggg

SEQ ID NO: 4239006 - DNA, 20 bp, Homo sapiens
cggtgcatctggcacgtggc

SEQ ID NO: 4239007 - DNA, 13 bp, Homo sapiens
cggtttttattaa

SEQ ID NO: 4239008 - DNA, 16 bp, Homo sapiens
cgtacacattttattt

SEQ ID NO: 4239009 - DNA, 22 bp, Homo sapiens
cgtacacattttattttattat

SEQ ID NO: 4239010 - DNA, 16 bp, Homo sapiens
cgtccactcccaagcc

SEQ ID NO: 4239011 - DNA, 22 bp, Homo sapiens
cgtccggcggccccgccgcaga

SEQ ID NO: 4239012 - DNA, 17 bp, Homo sapiens
cgtcttctccctattcc

SEQ ID NO: 4239013 - DNA, 16 bp, Homo sapiens
cgtgcttgctggtgcc

SEQ ID NO: 4239014 - DNA, 17 bp, Homo sapiens
cgtggcctcgtgctccg

SEQ ID NO: 4239015 - DNA, 13 bp, Homo sapiens
cgtgtgtgcatgt

SEQ ID NO: 4239016 - DNA, 15 bp, Homo sapiens
cgtgtgtgcatgtgc

SEQ ID NO: 4239017 - DNA, 15 bp, Homo sapiens
cgtgtgttctatcca

SEQ ID NO: 4239018 - DNA, 22 bp, Homo sapiens
cgttgagcgtacgatggaggcc

SEQ ID NO: 4239019 - DNA, 13 bp, Homo sapiens
cgttgtgcctggt

SEQ ID NO: 4239020 - DNA, 20 bp, Homo sapiens
cgtttctatgacacatgcaa

SEQ ID NO: 4239021 - DNA, 13 bp, Homo sapiens
cgtttctgcccag

SEQ ID NO: 4239022 - DNA, 18 bp, Homo sapiens
cgtttctgcccagccctc

SEQ ID NO: 4239023 - DNA, 20 bp, Homo sapiens
cgtttctgcccagccctctg

SEQ ID NO: 4239024 - DNA, 19 bp, Homo sapiens
ctaaagtgtatttttttac

SEQ ID NO: 4239025 - DNA, 12 bp, Homo sapiens
ctaaataatgaa

SEQ ID NO: 4239026 - DNA, 21 bp, Homo sapiens
ctaaataatgaataaactgaa

SEQ ID NO: 4239027 - DNA, 22 bp, Homo sapiens
ctaaataatgaataaactgaat

SEQ ID NO: 4239028 - DNA, 23 bp, Homo sapiens
ctaaatatgaaccctttgtttct

SEQ ID NO: 4239029 - DNA, 21 bp, Homo sapiens
ctaaatctccaaaataaaact

SEQ ID NO: 4239030 - DNA, 15 bp, Homo sapiens
ctaaatggaaccact

SEQ ID NO: 4239031 - DNA, 15 bp, Homo sapiens
ctaaattagataaat

SEQ ID NO: 4239032 - DNA, 20 bp, Homo sapiens
ctaaatttgtgctttttaag

SEQ ID NO: 4239033 - DNA, 15 bp, Homo sapiens
ctaacttcaccatat

SEQ ID NO: 4239034 - DNA, 15 bp, Homo sapiens
ctaagctgccctgag

SEQ ID NO: 4239035 - DNA, 13 bp, Homo sapiens
ctaagtgagagtt

SEQ ID NO: 4239036 - DNA, 14 bp, Homo sapiens
ctaagtttttatgg

SEQ ID NO: 4239037 - DNA, 23 bp, Homo sapiens
ctaatagacaatttattatggca

SEQ ID NO: 4239038 - DNA, 17 bp, Homo sapiens
ctaatatccccaaatta

SEQ ID NO: 4239039 - DNA, 18 bp, Homo sapiens
ctaatggcatggagactc

SEQ ID NO: 4239040 - DNA, 21 bp, Homo sapiens
ctaatgtctcactgttctgca

SEQ ID NO: 4239041 - DNA, 13 bp, Homo sapiens
ctacacactgcat

SEQ ID NO: 4239042 - DNA, 23 bp, Homo sapiens
ctacattattgcttattgcttag

SEQ ID NO: 4239043 - DNA, 14 bp, Homo sapiens
ctaccctgtgtata

SEQ ID NO: 4239044 - DNA, 18 bp, Homo sapiens
ctacctctcgtttctgcc

SEQ ID NO: 4239045 - DNA, 20 bp, Homo sapiens
ctacctctcgtttctgccca

SEQ ID NO: 4239046 - DNA, 15 bp, Homo sapiens
ctacctgcacctctg

SEQ ID NO: 4239047 - DNA, 16 bp, Homo sapiens
ctacctgcacctctgg

SEQ ID NO: 4239048 - DNA, 14 bp, Homo sapiens
ctactcctggagca

SEQ ID NO: 4239049 - DNA, 12 bp, Homo sapiens
ctactctgccca

SEQ ID NO: 4239050 - DNA, 16 bp, Homo sapiens
ctactgtaatttgtga

SEQ ID NO: 4239051 - DNA, 13 bp, Homo sapiens
ctactgtacataa

SEQ ID NO: 4239052 - DNA, 19 bp, Homo sapiens
ctagaatgtaaagttatgt

SEQ ID NO: 4239053 - DNA, 22 bp, Homo sapiens
ctagaatgtaaagttatgtatt

SEQ ID NO: 4239054 - DNA, 16 bp, Homo sapiens
ctagagaatgcacaga

SEQ ID NO: 4239055 - DNA, 21 bp, Homo sapiens
ctagagaatgcacagatatac

SEQ ID NO: 4239056 - DNA, 21 bp, Homo sapiens
ctagaggttcaaagatatttt

SEQ ID NO: 4239057 - DNA, 13 bp, Homo sapiens
ctagatactgtat

SEQ ID NO: 4239058 - DNA, 16 bp, Homo sapiens
ctagatactgtatcat

SEQ ID NO: 4239059 - DNA, 17 bp, Homo sapiens
ctagcagacagaaactg

SEQ ID NO: 4239060 - DNA, 21 bp, Homo sapiens
ctagcagacagaaactggatt

SEQ ID NO: 4239061 - DNA, 21 bp, Homo sapiens
ctagcatacgtacacatttta

SEQ ID NO: 4239062 - DNA, 13 bp, Homo sapiens
ctagcccactccc

SEQ ID NO: 4239063 - DNA, 13 bp, Homo sapiens
ctagctaaataaa

SEQ ID NO: 4239064 - DNA, 15 bp, Homo sapiens
ctagctaaataaatg

SEQ ID NO: 4239065 - DNA, 21 bp, Homo sapiens
ctagtaagtaattatgcacta

SEQ ID NO: 4239066 - DNA, 16 bp, Homo sapiens
ctagtggatgactgtt

SEQ ID NO: 4239067 - DNA, 20 bp, Homo sapiens
ctagtttgattaaattcttg

SEQ ID NO: 4239068 - DNA, 19 bp, Homo sapiens
ctatccaaacatgtattta

SEQ ID NO: 4239069 - DNA, 14 bp, Homo sapiens
ctatgacacatgca

SEQ ID NO: 4239070 - DNA, 22 bp, Homo sapiens
ctatgcatattcaatgtattga

SEQ ID NO: 4239071 - DNA, 11 bp, Homo sapiens
ctatgcatttg

SEQ ID NO: 4239072 - DNA, 12 bp, Homo sapiens
ctatgcatttga

SEQ ID NO: 4239073 - DNA, 19 bp, Homo sapiens
ctatgttaaatactgtgca

SEQ ID NO: 4239074 - DNA, 18 bp, Homo sapiens
ctattgacttttcaataa

SEQ ID NO: 4239075 - DNA, 13 bp, Homo sapiens
ctatttacctcct

SEQ ID NO: 4239076 - DNA, 14 bp, Homo sapiens
ctcaaatttctaaa

SEQ ID NO: 4239077 - DNA, 14 bp, Homo sapiens
ctcaatcacactgg

SEQ ID NO: 4239078 - DNA, 21 bp, Homo sapiens
ctcaatctctgttgcacctga

SEQ ID NO: 4239079 - DNA, 20 bp, Homo sapiens
ctcacaggcagctctgagcc

SEQ ID NO: 4239080 - DNA, 13 bp, Homo sapiens
ctcactatatata

SEQ ID NO: 4239081 - DNA, 14 bp, Homo sapiens
ctcactgttctgca

SEQ ID NO: 4239082 - DNA, 16 bp, Homo sapiens
ctcactgttctgcaaa

SEQ ID NO: 4239083 - DNA, 21 bp, Homo sapiens
ctcactgttgaattttctcta

SEQ ID NO: 4239084 - DNA, 15 bp, Homo sapiens
ctcagagcttgaaga

SEQ ID NO: 4239085 - DNA, 13 bp, Homo sapiens
ctcagcctcccag

SEQ ID NO: 4239086 - DNA, 20 bp, Homo sapiens
ctcagcctcccagagtgctg

SEQ ID NO: 4239087 - DNA, 17 bp, Homo sapiens
ctcagctataattctgt

SEQ ID NO: 4239088 - DNA, 18 bp, Homo sapiens
ctcagctataattctgtt

SEQ ID NO: 4239089 - DNA, 20 bp, Homo sapiens
ctcagcttcttcacaggcac

SEQ ID NO: 4239090 - DNA, 15 bp, Homo sapiens
ctcaggctccccagt

SEQ ID NO: 4239091 - DNA, 12 bp, Homo sapiens
ctcaggctcttg

SEQ ID NO: 4239092 - DNA, 14 bp, Homo sapiens
ctcatcttgtgaaa

SEQ ID NO: 4239093 - DNA, 12 bp, Homo sapiens
ctcatgttctta

SEQ ID NO: 4239094 - DNA, 14 bp, Homo sapiens
ctcatgttcttaat

SEQ ID NO: 4239095 - DNA, 19 bp, Homo sapiens
ctcatgttcttaattctta

SEQ ID NO: 4239096 - DNA, 18 bp, Homo sapiens
ctccaaaataaaactttt

SEQ ID NO: 4239097 - DNA, 15 bp, Homo sapiens
ctccaacccagcagt

SEQ ID NO: 4239098 - DNA, 16 bp, Homo sapiens
ctccacaacccaagca

SEQ ID NO: 4239099 - DNA, 15 bp, Homo sapiens
ctcccaagccactag

SEQ ID NO: 4239100 - DNA, 22 bp, Homo sapiens
ctcccacccccatctctccctc

SEQ ID NO: 4239101 - DNA, 13 bp, Homo sapiens
ctcccagatcctg

SEQ ID NO: 4239102 - DNA, 14 bp, Homo sapiens
ctcccagatcctgg

SEQ ID NO: 4239103 - DNA, 13 bp, Homo sapiens
cccgcgccaggcc

SEQ ID NO: 4239104 - DNA, 21 bp, Homo sapiens
cccggagaggtggccgccatg

SEQ ID NO: 4239105 - DNA, 19 bp, Homo sapiens
ccctcagtcttcctgccgg

SEQ ID NO: 4239106 - DNA, 18 bp, Homo sapiens
ccctccacaaagagacca

SEQ ID NO: 4239107 - DNA, 21 bp, Homo sapiens
ccctctgtggccaggagccct

SEQ ID NO: 4239108 - DNA, 20 bp, Homo sapiens
ccctgcagggccgggcaggg

SEQ ID NO: 4239109 - DNA, 21 bp, Homo sapiens
ccctgcagggccgggcagggg

SEQ ID NO: 4239110 - DNA, 23 bp, Homo sapiens
ccctgggatggacgctgccggga

SEQ ID NO: 4239111 - DNA, 18 bp, Homo sapiens
ccgaggaatgtgaagcca

SEQ ID NO: 4239112 - DNA, 11 bp, Homo sapiens
ccgaggccagt

SEQ ID NO: 4239113 - DNA, 14 bp, Homo sapiens
ccgaggtgttgcca

SEQ ID NO: 4239114 - DNA, 20 bp, Homo sapiens
ccgcaagagggacagagccc

SEQ ID NO: 4239115 - DNA, 21 bp, Homo sapiens
ccgcaagagggacagagcccg

SEQ ID NO: 4239116 - DNA, 23 bp, Homo sapiens
ccgccaggtgcccgcgccaggcc

SEQ ID NO: 4239117 - DNA, 17 bp, Homo sapiens
ccgcccggcagtgcacg

SEQ ID NO: 4239118 - DNA, 13 bp, Homo sapiens
ccgccctgcagca

SEQ ID NO: 4239119 - DNA, 23 bp, Homo sapiens
ccgcctttgcgctctcgggtcac

SEQ ID NO: 4239120 - DNA, 16 bp, Homo sapiens
ccgcgcggccgctttg

SEQ ID NO: 4239121 - DNA, 18 bp, Homo sapiens
ccgctttgtctgtccagc

SEQ ID NO: 4239122 - DNA, 13 bp, Homo sapiens
ccggagcaagcag

SEQ ID NO: 4239123 - DNA, 18 bp, Homo sapiens
ccggagcaagcaggagtg

SEQ ID NO: 4239124 - DNA, 22 bp, Homo sapiens
ccggagcgccctgcagggccgg

SEQ ID NO: 4239125 - DNA, 13 bp, Homo sapiens
ccggagggcagga

SEQ ID NO: 4239126 - DNA, 18 bp, Homo sapiens
ccggcggccccgccgcag

SEQ ID NO: 4239127 - DNA, 15 bp, Homo sapiens
ccgggagactgccag

SEQ ID NO: 4239128 - DNA, 12 bp, Homo sapiens
ccgggcgcagcc

SEQ ID NO: 4239129 - DNA, 16 bp, Homo sapiens
ccggtgcatctggcac

SEQ ID NO: 4239130 - DNA, 19 bp, Homo sapiens
ccggtgcatctggcacgtg

SEQ ID NO: 4239131 - DNA, 15 bp, Homo sapiens
ccgtgtccaggagcc

SEQ ID NO: 4239132 - DNA, 23 bp, Homo sapiens
ccgtgtccaggagccccgccagg

SEQ ID NO: 4239133 - DNA, 20 bp, Homo sapiens
cctaatggcatggagactct

SEQ ID NO: 4239134 - DNA, 12 bp, Homo sapiens
cctactcctgga

SEQ ID NO: 4239135 - DNA, 23 bp, Homo sapiens
cctactgaagggaacagcctgag

SEQ ID NO: 4239136 - DNA, 19 bp, Homo sapiens
cctactgtaatttgtgata

SEQ ID NO: 4239137 - DNA, 18 bp, Homo sapiens
cctagtggatgactgttg

SEQ ID NO: 4239138 - DNA, 20 bp, Homo sapiens
cctagtggatgactgttgat

SEQ ID NO: 4239139 - DNA, 14 bp, Homo sapiens
cctataagaggaat

SEQ ID NO: 4239140 - DNA, 14 bp, Homo sapiens
cctatttttgtaaa

SEQ ID NO: 4239141 - DNA, 19 bp, Homo sapiens
cctcacctctcccccaagg

SEQ ID NO: 4239142 - DNA, 13 bp, Homo sapiens
cctcatgccacag

SEQ ID NO: 4239143 - DNA, 13 bp, Homo sapiens
cctcatgttctta

SEQ ID NO: 4239144 - DNA, 13 bp, Homo sapiens
cctcccaccccca

SEQ ID NO: 4239145 - DNA, 22 bp, Homo sapiens
cctccggagcgccctgcagggc

SEQ ID NO: 4239146 - DNA, 19 bp, Homo sapiens
cctcgtgctccgcagggcg

SEQ ID NO: 4239147 - DNA, 20 bp, Homo sapiens
cctcgtgctccgcagggcgc

SEQ ID NO: 4239148 - DNA, 21 bp, Homo sapiens
cctctcaagctagtgtttcta

SEQ ID NO: 4239149 - DNA, 19 bp, Homo sapiens
cctctcacaggcagctctg

SEQ ID NO: 4239150 - DNA, 10 bp, Homo sapiens
cctctccctg

SEQ ID NO: 4239151 - DNA, 13 bp, Homo sapiens
cctctccttccta

SEQ ID NO: 4239152 - DNA, 16 bp, Homo sapiens
cctctcgtttctgccc

SEQ ID NO: 4239153 - DNA, 16 bp, Homo sapiens
cctctgggatctgcca

SEQ ID NO: 4239154 - DNA, 17 bp, Homo sapiens
cctctgggatctgccaa

SEQ ID NO: 4239155 - DNA, 18 bp, Homo sapiens
cctctgggatctgccaac

SEQ ID NO: 4239156 - DNA, 20 bp, Homo sapiens
cctctggggaagatggagca

SEQ ID NO: 4239157 - DNA, 15 bp, Homo sapiens
cctctgtggccagga

SEQ ID NO: 4239158 - DNA, 16 bp, Homo sapiens
cctctgtggccaggag

SEQ ID NO: 4239159 - DNA, 17 bp, Homo sapiens
cctctgtggccaggagc

SEQ ID NO: 4239160 - DNA, 19 bp, Homo sapiens
cctctgtggccaggagccc

SEQ ID NO: 4239161 - DNA, 20 bp, Homo sapiens
cctctgtggccaggagccct

SEQ ID NO: 4239162 - DNA, 16 bp, Homo sapiens
cctcttcccagagtca

SEQ ID NO: 4239163 - DNA, 19 bp, Homo sapiens
cctcttgagccttgaactt

SEQ ID NO: 4239164 - DNA, 22 bp, Homo sapiens
cctgaccccgccatgcatgcag

SEQ ID NO: 4239165 - DNA, 23 bp, Homo sapiens
cctgacctaaattagataaattg

SEQ ID NO: 4239166 - DNA, 13 bp, Homo sapiens
cctgatgatgctg

SEQ ID NO: 4239167 - DNA, 13 bp, Homo sapiens
cctgcctcagcct

SEQ ID NO: 4239168 - DNA, 14 bp, Homo sapiens
cctgcctggcaggc

SEQ ID NO: 4239169 - DNA, 11 bp, Homo sapiens
cctgcctttta

SEQ ID NO: 4239170 - DNA, 15 bp, Homo sapiens
cctggagctttcctg

SEQ ID NO: 4239171 - DNA, 14 bp, Homo sapiens
cctgggatggacgc

SEQ ID NO: 4239172 - DNA, 16 bp, Homo sapiens
cctgtccacacccagc

SEQ ID NO: 4239173 - DNA, 22 bp, Homo sapiens
cctgtccacacccagctcagca

SEQ ID NO: 4239174 - DNA, 14 bp, Homo sapiens
cctgtccccagggg

SEQ ID NO: 4239175 - DNA, 13 bp, Homo sapiens
cctgtctcagcct

SEQ ID NO: 4239176 - DNA, 14 bp, Homo sapiens
cctgtctcagcctc

SEQ ID NO: 4239177 - DNA, 19 bp, Homo sapiens
cctgtggcactcagggagc

SEQ ID NO: 4239178 - DNA, 17 bp, Homo sapiens
cctgttttgagaccaga

SEQ ID NO: 4239179 - DNA, 15 bp, Homo sapiens
ccttcctgtccccag

SEQ ID NO: 4239180 - DNA, 11 bp, Homo sapiens
ccttctgccct

SEQ ID NO: 4239181 - DNA, 16 bp, Homo sapiens
ccttgctcctagcaga

SEQ ID NO: 4239182 - DNA, 16 bp, Homo sapiens
cctttcttgcactgtc

SEQ ID NO: 4239183 - DNA, 20 bp, Homo sapiens
cctttcttgcactgtccagc

SEQ ID NO: 4239184 - DNA, 23 bp, Homo sapiens
cctttgggccaatttactggcca

SEQ ID NO: 4239185 - DNA, 18 bp, Homo sapiens
cctttgtattctctcctg

SEQ ID NO: 4239186 - DNA, 20 bp, Homo sapiens
cctttgtattctctcctgta

SEQ ID NO: 4239187 - DNA, 24 bp, Homo sapiens
cctttgtattctctcctgtacctc

SEQ ID NO: 4239188 - DNA, 14 bp, Homo sapiens
ccttttgagcctag

SEQ ID NO: 4239189 - DNA, 19 bp, Homo sapiens
ccttttttatacataaaca

SEQ ID NO: 4239190 - DNA, 24 bp, Homo sapiens
cgaaacccggtgcatctggcacgt

SEQ ID NO: 4239191 - DNA, 17 bp, Homo sapiens
cgagaactacgcacagc

SEQ ID NO: 4239192 - DNA, 21 bp, Homo sapiens
cgagcagtcctgcctcagcct

SEQ ID NO: 4239193 - DNA, 17 bp, Homo sapiens
cgaggaatgtgaagcca

SEQ ID NO: 4239194 - DNA, 22 bp, Homo sapiens
cgatccacctgtctcagcctcc

SEQ ID NO: 4239195 - DNA, 12 bp, Homo sapiens
cgatttctgttt

SEQ ID NO: 4239196 - DNA, 20 bp, Homo sapiens
cgcaagagggacagagcccg

SEQ ID NO: 4239197 - DNA, 15 bp, Homo sapiens
cgcacttacctgctt

SEQ ID NO: 4239198 - DNA, 19 bp, Homo sapiens
cgcagaccagctggcgggt

SEQ ID NO: 4239199 - DNA, 17 bp, Homo sapiens
cgcagccccgggcggag

SEQ ID NO: 4239200 - DNA, 12 bp, Homo sapiens
cgcagggcgccc

SEQ ID NO: 4239201 - DNA, 13 bp, Homo sapiens
cgccatcgcggga

SEQ ID NO: 4239202 - DNA, 15 bp, Homo sapiens
cgcccgagctgttta

SEQ ID NO: 4239203 - DNA, 12 bp, Homo sapiens
cgccctgcagca

SEQ ID NO: 4239204 - DNA, 22 bp, Homo sapiens
cgccctgcagggccgggcaggg

SEQ ID NO: 4239205 - DNA, 22 bp, Homo sapiens
cgcgaaacccggtgcatctggc

SEQ ID NO: 4239206 - DNA, 15 bp, Homo sapiens
cgcggccgcctttgc

SEQ ID NO: 4239207 - DNA, 17 bp, Homo sapiens
cgcgggatggtgcagac

SEQ ID NO: 4239208 - DNA, 23 bp, Homo sapiens
cgctcgtgtgttctatccaaaca

SEQ ID NO: 4239209 - DNA, 17 bp, Homo sapiens
cgctctcgggtcaccct

SEQ ID NO: 4239210 - DNA, 19 bp, Homo sapiens
cgctctcttttctgtactt

SEQ ID NO: 4239211 - DNA, 16 bp, Homo sapiens
cgctgccgggagactg

SEQ ID NO: 4239212 - DNA, 16 bp, Homo sapiens
cgctttcccctcctcc

SEQ ID NO: 4239213 - DNA, 20 bp, Homo sapiens
cggaaaacatgctacacact

SEQ ID NO: 4239214 - DNA, 22 bp, Homo sapiens
cggaagaaccagaagtgcagcc

SEQ ID NO: 4239215 - DNA, 14 bp, Homo sapiens
cggagaggtggccg

SEQ ID NO: 4239216 - DNA, 18 bp, Homo sapiens
cggagaggtggccgccat

SEQ ID NO: 4239217 - DNA, 21 bp, Homo sapiens
cggagaggtggccgccatgct

SEQ ID NO: 4239218 - DNA, 20 bp, Homo sapiens
cggagcgccctgcagggccg

SEQ ID NO: 4239219 - DNA, 14 bp, Homo sapiens
catgtatgttatga

SEQ ID NO: 4239220 - DNA, 18 bp, Homo sapiens
catgttatttaacctgag

SEQ ID NO: 4239221 - DNA, 16 bp, Homo sapiens
catgttcttaattctt

SEQ ID NO: 4239222 - DNA, 18 bp, Homo sapiens
cattaaatgcaataattt

SEQ ID NO: 4239223 - DNA, 12 bp, Homo sapiens
cattacttttta

SEQ ID NO: 4239224 - DNA, 20 bp, Homo sapiens
cattataacaactatttact

SEQ ID NO: 4239225 - DNA, 19 bp, Homo sapiens
cattatctcacttagtcct

SEQ ID NO: 4239226 - DNA, 18 bp, Homo sapiens
cattcatagggaaaggtt

SEQ ID NO: 4239227 - DNA, 16 bp, Homo sapiens
cattcattctgagccc

SEQ ID NO: 4239228 - DNA, 13 bp, Homo sapiens
cattccagtgcta

SEQ ID NO: 4239229 - DNA, 20 bp, Homo sapiens
cattccagtgctagaaaatt

SEQ ID NO: 4239230 - DNA, 18 bp, Homo sapiens
cattctcggtacttctgt

SEQ ID NO: 4239231 - DNA, 21 bp, Homo sapiens
cattctgagcccccttcctgt

SEQ ID NO: 4239232 - DNA, 22 bp, Homo sapiens
cattgaaagcttcaaagtttat

SEQ ID NO: 4239233 - DNA, 19 bp, Homo sapiens
cattgttttgaatattact

SEQ ID NO: 4239234 - DNA, 16 bp, Homo sapiens
catttaaaagatacag

SEQ ID NO: 4239235 - DNA, 21 bp, Homo sapiens
catttaatggcagctagtgcc

SEQ ID NO: 4239236 - DNA, 16 bp, Homo sapiens
catttatataaaactt

SEQ ID NO: 4239237 - DNA, 17 bp, Homo sapiens
catttcatgaaaatgac

SEQ ID NO: 4239238 - DNA, 22 bp, Homo sapiens
catttgaaaattttgatgtttt

SEQ ID NO: 4239239 - DNA, 12 bp, Homo sapiens
catttgtttgct

SEQ ID NO: 4239240 - DNA, 16 bp, Homo sapiens
cattttacagatttct

SEQ ID NO: 4239241 - DNA, 19 bp, Homo sapiens
cattttattttattatgca

SEQ ID NO: 4239242 - DNA, 21 bp, Homo sapiens
cattttattttattatgcatg

SEQ ID NO: 4239243 - DNA, 23 bp, Homo sapiens
cattttattttattatgcatgaa

SEQ ID NO: 4239244 - DNA, 16 bp, Homo sapiens
cattttttaaatgcac

SEQ ID NO: 4239245 - DNA, 18 bp, Homo sapiens
ccaaaataaaacttttta

SEQ ID NO: 4239246 - DNA, 14 bp, Homo sapiens
ccaaacatgtattt

SEQ ID NO: 4239247 - DNA, 14 bp, Homo sapiens
ccaaaccctgtctg

SEQ ID NO: 4239248 - DNA, 16 bp, Homo sapiens
ccaaagctggcccagt

SEQ ID NO: 4239249 - DNA, 18 bp, Homo sapiens
ccaaagtacactgtttca

SEQ ID NO: 4239250 - DNA, 22 bp, Homo sapiens
ccaaagtacactgtttcaaact

SEQ ID NO: 4239251 - DNA, 20 bp, Homo sapiens
ccaaatataagacatttgtt

SEQ ID NO: 4239252 - DNA, 17 bp, Homo sapiens
ccaaattgtgcttctcc

SEQ ID NO: 4239253 - DNA, 23 bp, Homo sapiens
ccaaattgtgcttctccccagaa

SEQ ID NO: 4239254 - DNA, 19 bp, Homo sapiens
ccaactcttccacctctgg

SEQ ID NO: 4239255 - DNA, 15 bp, Homo sapiens
ccaagagtaacttta

SEQ ID NO: 4239256 - DNA, 15 bp, Homo sapiens
ccaaggcaaaaaact

SEQ ID NO: 4239257 - DNA, 19 bp, Homo sapiens
ccaatatttctgctttctt

SEQ ID NO: 4239258 - DNA, 15 bp, Homo sapiens
ccaattattgatata

SEQ ID NO: 4239259 - DNA, 14 bp, Homo sapiens
ccacaaagagacca

SEQ ID NO: 4239260 - DNA, 16 bp, Homo sapiens
ccacaaagagaccagg

SEQ ID NO: 4239261 - DNA, 18 bp, Homo sapiens
ccacaaagagaccagggg

SEQ ID NO: 4239262 - DNA, 15 bp, Homo sapiens
ccacacccacctctg

SEQ ID NO: 4239263 - DNA, 17 bp, Homo sapiens
ccacacccacctctgcc

SEQ ID NO: 4239264 - DNA, 22 bp, Homo sapiens
ccacaggttcatgccaccatgg

SEQ ID NO: 4239265 - DNA, 21 bp, Homo sapiens
ccacctggaagccgcgcggcc

SEQ ID NO: 4239266 - DNA, 11 bp, Homo sapiens
ccacctgtctc

SEQ ID NO: 4239267 - DNA, 12 bp, Homo sapiens
ccacctgtctca

SEQ ID NO: 4239268 - DNA, 15 bp, Homo sapiens
ccacctgtctcagcc

SEQ ID NO: 4239269 - DNA, 18 bp, Homo sapiens
ccacctgtctcagcctcc

SEQ ID NO: 4239270 - DNA, 11 bp, Homo sapiens
ccactacattc

SEQ ID NO: 4239271 - DNA, 14 bp, Homo sapiens
ccactacattctgt

SEQ ID NO: 4239272 - DNA, 13 bp, Homo sapiens
ccactcccaagcc

SEQ ID NO: 4239273 - DNA, 16 bp, Homo sapiens
ccactgacagcctccc

SEQ ID NO: 4239274 - DNA, 22 bp, Homo sapiens
ccactgatagatgtctattctt

SEQ ID NO: 4239275 - DNA, 14 bp, Homo sapiens
ccacttcaggagcc

SEQ ID NO: 4239276 - DNA, 19 bp, Homo sapiens
ccacttcttgttccccact

SEQ ID NO: 4239277 - DNA, 14 bp, Homo sapiens
ccacttttgttctt

SEQ ID NO: 4239278 - DNA, 21 bp, Homo sapiens
ccacttttgttcttggtttgt

SEQ ID NO: 4239279 - DNA, 20 bp, Homo sapiens
ccagacaaaaaaatttaaaa

SEQ ID NO: 4239280 - DNA, 17 bp, Homo sapiens
ccagacaattccattca

SEQ ID NO: 4239281 - DNA, 17 bp, Homo sapiens
ccagcagaaatgcctta

SEQ ID NO: 4239282 - DNA, 16 bp, Homo sapiens
ccagcagttctctgcc

SEQ ID NO: 4239283 - DNA, 17 bp, Homo sapiens
ccagcagttctctgcca

SEQ ID NO: 4239284 - DNA, 16 bp, Homo sapiens
ccagcatcagcacagc

SEQ ID NO: 4239285 - DNA, 19 bp, Homo sapiens
ccagccaaaccctgtctga

SEQ ID NO: 4239286 - DNA, 14 bp, Homo sapiens
ccagccgtgtgtgc

SEQ ID NO: 4239287 - DNA, 16 bp, Homo sapiens
ccagcctgcctggcag

SEQ ID NO: 4239288 - DNA, 19 bp, Homo sapiens
ccagcctgcctggcaggct

SEQ ID NO: 4239289 - DNA, 15 bp, Homo sapiens
ccagctaatttttgt

SEQ ID NO: 4239290 - DNA, 18 bp, Homo sapiens
ccagctgccccagccaga

SEQ ID NO: 4239291 - DNA, 21 bp, Homo sapiens
ccagctggttgtaccctctcc

SEQ ID NO: 4239292 - DNA, 13 bp, Homo sapiens
ccaggaatattaa

SEQ ID NO: 4239293 - DNA, 14 bp, Homo sapiens
ccaggacctccgga

SEQ ID NO: 4239294 - DNA, 12 bp, Homo sapiens
ccaggagccctg

SEQ ID NO: 4239295 - DNA, 13 bp, Homo sapiens
ccaggagccctgg

SEQ ID NO: 4239296 - DNA, 16 bp, Homo sapiens
ccaggcctcttggcag

SEQ ID NO: 4239297 - DNA, 18 bp, Homo sapiens
ccaggcctcttggcagtc

SEQ ID NO: 4239298 - DNA, 22 bp, Homo sapiens
ccaggctcctgaccccgccatg

SEQ ID NO: 4239299 - DNA, 17 bp, Homo sapiens
ccagggaagctgtccct

SEQ ID NO: 4239300 - DNA, 17 bp, Homo sapiens
ccaggggaggtgtattg

SEQ ID NO: 4239301 - DNA, 22 bp, Homo sapiens
ccagtaaatgggggtgcatttg

SEQ ID NO: 4239302 - DNA, 13 bp, Homo sapiens
ccagtattgctga

SEQ ID NO: 4239303 - DNA, 14 bp, Homo sapiens
ccatcccacaccct

SEQ ID NO: 4239304 - DNA, 23 bp, Homo sapiens
ccatctctccctcccctgccatt

SEQ ID NO: 4239305 - DNA, 12 bp, Homo sapiens
ccatctctgtga

SEQ ID NO: 4239306 - DNA, 20 bp, Homo sapiens
ccatgacaggcctgaagata

SEQ ID NO: 4239307 - DNA, 21 bp, Homo sapiens
ccatgcccttacacgtgcgtg

SEQ ID NO: 4239308 - DNA, 22 bp, Homo sapiens
ccatgcttctcatcttgtgaaa

SEQ ID NO: 4239309 - DNA, 20 bp, Homo sapiens
ccatggtcggaaaacatgct

SEQ ID NO: 4239310 - DNA, 20 bp, Homo sapiens
ccatgttggccaggatggtc

SEQ ID NO: 4239311 - DNA, 15 bp, Homo sapiens
ccattaaatgaatat

SEQ ID NO: 4239312 - DNA, 18 bp, Homo sapiens
ccatttgctactgtacat

SEQ ID NO: 4239313 - DNA, 12 bp, Homo sapiens
cccacaccctgg

SEQ ID NO: 4239314 - DNA, 13 bp, Homo sapiens
cccacctctgcca

SEQ ID NO: 4239315 - DNA, 16 bp, Homo sapiens
cccactgacagcctcc

SEQ ID NO: 4239316 - DNA, 10 bp, Homo sapiens
cccagagccc

SEQ ID NO: 4239317 - DNA, 14 bp, Homo sapiens
cccagatcctggaa

SEQ ID NO: 4239318 - DNA, 17 bp, Homo sapiens
cccagatcctggaaaca

SEQ ID NO: 4239319 - DNA, 22 bp, Homo sapiens
cccagccagatggactccagcc

SEQ ID NO: 4239320 - DNA, 22 bp, Homo sapiens
cccagctaatttttgtattttt

SEQ ID NO: 4239321 - DNA, 14 bp, Homo sapiens
cccaggtgagacct

SEQ ID NO: 4239322 - DNA, 19 bp, Homo sapiens
cccaggttggagtgcagtg

SEQ ID NO: 4239323 - DNA, 15 bp, Homo sapiens
cccagtgctcctggc

SEQ ID NO: 4239324 - DNA, 22 bp, Homo sapiens
cccagtgctcctggcccttcta

SEQ ID NO: 4239325 - DNA, 13 bp, Homo sapiens
cccatcccacacc

SEQ ID NO: 4239326 - DNA, 18 bp, Homo sapiens
cccatctctccctcccct

SEQ ID NO: 4239327 - DNA, 23 bp, Homo sapiens
cccatctctccctcccctgccat

SEQ ID NO: 4239328 - DNA, 19 bp, Homo sapiens
cccattctacacagagcag

SEQ ID NO: 4239329 - DNA, 22 bp, Homo sapiens
cccattttattaataatattta

SEQ ID NO: 4239330 - DNA, 13 bp, Homo sapiens
ccccagtgctcct

SEQ ID NO: 4239331 - DNA, 18 bp, Homo sapiens
ccccagtgctcctggccc

SEQ ID NO: 4239332 - DNA, 12 bp, Homo sapiens
cccccattttac

SEQ ID NO: 4239333 - DNA, 21 bp, Homo sapiens
ccccgccatgcatgcagcgcc

SEQ ID NO: 4239334 - DNA, 20 bp, Homo sapiens
cccgcaagagggacagagcc

SEQ ID NO: 4239335 - DNA, 21 bp, Homo sapiens
cccgcaagagggacagagccc

SEQ ID NO: 4239336 - DNA, 14 bp, Homo sapiens
cagacaattagaaa

SEQ ID NO: 4239337 - DNA, 16 bp, Homo sapiens
cagacacaatatgtat

SEQ ID NO: 4239338 - DNA, 17 bp, Homo sapiens
cagactctcagcccaga

SEQ ID NO: 4239339 - DNA, 18 bp, Homo sapiens
cagactctcagcccagaa

SEQ ID NO: 4239340 - DNA, 21 bp, Homo sapiens
cagactctcagcccagaagaa

SEQ ID NO: 4239341 - DNA, 20 bp, Homo sapiens
cagagaagttctcaaagtta

SEQ ID NO: 4239342 - DNA, 22 bp, Homo sapiens
cagagaagttctcaaagttaat

SEQ ID NO: 4239343 - DNA, 17 bp, Homo sapiens
cagagcccctcatgcca

SEQ ID NO: 4239344 - DNA, 17 bp, Homo sapiens
cagagcccgggagagac

SEQ ID NO: 4239345 - DNA, 18 bp, Homo sapiens
cagagcccgggagagact

SEQ ID NO: 4239346 - DNA, 23 bp, Homo sapiens
cagagtcacaagtagcctctggg

SEQ ID NO: 4239347 - DNA, 14 bp, Homo sapiens
cagagttgttacat

SEQ ID NO: 4239348 - DNA, 19 bp, Homo sapiens
cagatggactccagcctgc

SEQ ID NO: 4239349 - DNA, 17 bp, Homo sapiens
cagatgtattgactgta

SEQ ID NO: 4239350 - DNA, 18 bp, Homo sapiens
cagattgtcttgcaactt

SEQ ID NO: 4239351 - DNA, 16 bp, Homo sapiens
cagatttctcactata

SEQ ID NO: 4239352 - DNA, 11 bp, Homo sapiens
cagatttttat

SEQ ID NO: 4239353 - DNA, 13 bp, Homo sapiens
cagcaaatatatg

SEQ ID NO: 4239354 - DNA, 22 bp, Homo sapiens
cagcacaccaaggtggcccgga

SEQ ID NO: 4239355 - DNA, 15 bp, Homo sapiens
cagcagaaatgcctt

SEQ ID NO: 4239356 - DNA, 15 bp, Homo sapiens
cagcagaaccttggc

SEQ ID NO: 4239357 - DNA, 23 bp, Homo sapiens
cagcagggaccgggcgcagccct

SEQ ID NO: 4239358 - DNA, 23 bp, Homo sapiens
cagcatttccacaccaagcagca

SEQ ID NO: 4239359 - DNA, 17 bp, Homo sapiens
cagcccgtgtccaggag

SEQ ID NO: 4239360 - DNA, 22 bp, Homo sapiens
cagccctctgtggccaggagcc

SEQ ID NO: 4239361 - DNA, 17 bp, Homo sapiens
cagccgtgtgtgcatgt

SEQ ID NO: 4239362 - DNA, 19 bp, Homo sapiens
cagccgtgtgtgcatgtgc

SEQ ID NO: 4239363 - DNA, 14 bp, Homo sapiens
cagcctcccacccc

SEQ ID NO: 4239364 - DNA, 17 bp, Homo sapiens
cagcctttgcctccccg

SEQ ID NO: 4239365 - DNA, 14 bp, Homo sapiens
cagcgtttctatga

SEQ ID NO: 4239366 - DNA, 16 bp, Homo sapiens
cagctaatttttgtat

SEQ ID NO: 4239367 - DNA, 17 bp, Homo sapiens
cagctaatttttgtatt

SEQ ID NO: 4239368 - DNA, 19 bp, Homo sapiens
cagctaatttttgtatttt

SEQ ID NO: 4239369 - DNA, 22 bp, Homo sapiens
cagctaatttttgtatttttag

SEQ ID NO: 4239370 - DNA, 15 bp, Homo sapiens
cagctctcctcctcc

SEQ ID NO: 4239371 - DNA, 13 bp, Homo sapiens
cagctctgagccg

SEQ ID NO: 4239372 - DNA, 15 bp, Homo sapiens
cagctgccccagcca

SEQ ID NO: 4239373 - DNA, 13 bp, Homo sapiens
cagctgtgcactt

SEQ ID NO: 4239374 - DNA, 17 bp, Homo sapiens
caggaccctcacctctc

SEQ ID NO: 4239375 - DNA, 13 bp, Homo sapiens
caggacctccgga

SEQ ID NO: 4239376 - DNA, 12 bp, Homo sapiens
caggagccctgg

SEQ ID NO: 4239377 - DNA, 15 bp, Homo sapiens
caggagccctggccc

SEQ ID NO: 4239378 - DNA, 16 bp, Homo sapiens
caggagccctggcccg

SEQ ID NO: 4239379 - DNA, 13 bp, Homo sapiens
caggagtgtgcgg

SEQ ID NO: 4239380 - DNA, 16 bp, Homo sapiens
caggcagctctgagcc

SEQ ID NO: 4239381 - DNA, 12 bp, Homo sapiens
caggcctcttgg

SEQ ID NO: 4239382 - DNA, 19 bp, Homo sapiens
caggcctcttggcagtcac

SEQ ID NO: 4239383 - DNA, 16 bp, Homo sapiens
caggcgatccacctgt

SEQ ID NO: 4239384 - DNA, 20 bp, Homo sapiens
caggcgatccacctgtctca

SEQ ID NO: 4239385 - DNA, 13 bp, Homo sapiens
caggctggtctca

SEQ ID NO: 4239386 - DNA, 20 bp, Homo sapiens
cagggaccgggcgcagccct

SEQ ID NO: 4239387 - DNA, 23 bp, Homo sapiens
cagggagcatttaatggcagcta

SEQ ID NO: 4239388 - DNA, 20 bp, Homo sapiens
cagggcgcccagcgccgtcc

SEQ ID NO: 4239389 - DNA, 21 bp, Homo sapiens
caggggcgcttgggaggggcc

SEQ ID NO: 4239390 - DNA, 23 bp, Homo sapiens
cagggtggagggaaggtgagagg

SEQ ID NO: 4239391 - DNA, 20 bp, Homo sapiens
caggtcccagccccttttcc

SEQ ID NO: 4239392 - DNA, 19 bp, Homo sapiens
caggtgagaagtgagggag

SEQ ID NO: 4239393 - DNA, 19 bp, Homo sapiens
cagtaaatgggggtgcatt

SEQ ID NO: 4239394 - DNA, 16 bp, Homo sapiens
cagtagttgtattctt

SEQ ID NO: 4239395 - DNA, 16 bp, Homo sapiens
cagtccaactcttcca

SEQ ID NO: 4239396 - DNA, 14 bp, Homo sapiens
cagtgactttgtat

SEQ ID NO: 4239397 - DNA, 16 bp, Homo sapiens
cagtgactttgtatag

SEQ ID NO: 4239398 - DNA, 18 bp, Homo sapiens
cagtgagtctctggggca

SEQ ID NO: 4239399 - DNA, 15 bp, Homo sapiens
cagtgctcctggccc

SEQ ID NO: 4239400 - DNA, 16 bp, Homo sapiens
cagtgctcctggccct

SEQ ID NO: 4239401 - DNA, 19 bp, Homo sapiens
cagtgctgtccatgcttct

SEQ ID NO: 4239402 - DNA, 22 bp, Homo sapiens
cagtgctgtccatgcttctcat

SEQ ID NO: 4239403 - DNA, 18 bp, Homo sapiens
cagtggtggttttctgtt

SEQ ID NO: 4239404 - DNA, 21 bp, Homo sapiens
cagtggtggttttctgttctt

SEQ ID NO: 4239405 - DNA, 22 bp, Homo sapiens
cagtggtggttttctgttcttt

SEQ ID NO: 4239406 - DNA, 22 bp, Homo sapiens
cagtgtatatttttggtggtgg

SEQ ID NO: 4239407 - DNA, 22 bp, Homo sapiens
cagtgtgcctggttaatattaa

SEQ ID NO: 4239408 - DNA, 18 bp, Homo sapiens
cagttaacttactcttta

SEQ ID NO: 4239409 - DNA, 15 bp, Homo sapiens
cagttatttctgttt

SEQ ID NO: 4239410 - DNA, 14 bp, Homo sapiens
cagttctctgccaa

SEQ ID NO: 4239411 - DNA, 14 bp, Homo sapiens
cagtttttgtatct

SEQ ID NO: 4239412 - DNA, 15 bp, Homo sapiens
cataaagggttgaaa

SEQ ID NO: 4239413 - DNA, 17 bp, Homo sapiens
cataaataaaactgaat

SEQ ID NO: 4239414 - DNA, 18 bp, Homo sapiens
cataaataaaactgaatc

SEQ ID NO: 4239415 - DNA, 19 bp, Homo sapiens
cataacttttaactggagt

SEQ ID NO: 4239416 - DNA, 15 bp, Homo sapiens
cataatgataaaata

SEQ ID NO: 4239417 - DNA, 17 bp, Homo sapiens
cataatgataaaataaa

SEQ ID NO: 4239418 - DNA, 14 bp, Homo sapiens
cataatgcgtgcat

SEQ ID NO: 4239419 - DNA, 15 bp, Homo sapiens
cataccacttttgtt

SEQ ID NO: 4239420 - DNA, 18 bp, Homo sapiens
cataccacttttgttctt

SEQ ID NO: 4239421 - DNA, 16 bp, Homo sapiens
catacgtacacatttt

SEQ ID NO: 4239422 - DNA, 21 bp, Homo sapiens
catatacatattgtatatata

SEQ ID NO: 4239423 - DNA, 21 bp, Homo sapiens
catatcaattggcagtgactt

SEQ ID NO: 4239424 - DNA, 16 bp, Homo sapiens
catattaccacagaca

SEQ ID NO: 4239425 - DNA, 22 bp, Homo sapiens
catattaccacagacatactaa

SEQ ID NO: 4239426 - DNA, 12 bp, Homo sapiens
catattcaatgt

SEQ ID NO: 4239427 - DNA, 18 bp, Homo sapiens
catcagcacgatttctgt

SEQ ID NO: 4239428 - DNA, 17 bp, Homo sapiens
catccaaaatatttttt

SEQ ID NO: 4239429 - DNA, 20 bp, Homo sapiens
catccacttcaggagcccta

SEQ ID NO: 4239430 - DNA, 14 bp, Homo sapiens
catcgatatgtata

SEQ ID NO: 4239431 - DNA, 21 bp, Homo sapiens
catctagtttccctggtgccc

SEQ ID NO: 4239432 - DNA, 23 bp, Homo sapiens
catctagtttccctggtgccctt

SEQ ID NO: 4239433 - DNA, 19 bp, Homo sapiens
catctcccagatcctggaa

SEQ ID NO: 4239434 - DNA, 20 bp, Homo sapiens
catctggcacgtggccagga

SEQ ID NO: 4239435 - DNA, 24 bp, Homo sapiens
catctggcacgtggccaggagcca

SEQ ID NO: 4239436 - DNA, 15 bp, Homo sapiens
catctgtggacaaga

SEQ ID NO: 4239437 - DNA, 12 bp, Homo sapiens
catcttgtgaaa

SEQ ID NO: 4239438 - DNA, 13 bp, Homo sapiens
catcttttacatt

SEQ ID NO: 4239439 - DNA, 13 bp, Homo sapiens
catgaaaacacat

SEQ ID NO: 4239440 - DNA, 14 bp, Homo sapiens
catgaaaacacatt

SEQ ID NO: 4239441 - DNA, 22 bp, Homo sapiens
catgaagtaatatgcacacatt

SEQ ID NO: 4239442 - DNA, 23 bp, Homo sapiens
catgaagtaatatgcacacattt

SEQ ID NO: 4239443 - DNA, 13 bp, Homo sapiens
catgacaaagact

SEQ ID NO: 4239444 - DNA, 14 bp, Homo sapiens
catgacttgtgtgt

SEQ ID NO: 4239445 - DNA, 14 bp, Homo sapiens
catgcaatttgaag

SEQ ID NO: 4239446 - DNA, 16 bp, Homo sapiens
catgcaatttgaagta

SEQ ID NO: 4239447 - DNA, 21 bp, Homo sapiens
catgccaccatggccagccaa

SEQ ID NO: 4239448 - DNA, 15 bp, Homo sapiens
catgctccaaatata

SEQ ID NO: 4239449 - DNA, 14 bp, Homo sapiens
catggctcagagct

SEQ ID NO: 4239450 - DNA, 18 bp, Homo sapiens
catgggaaatgagccagc

SEQ ID NO: 4239451 - DNA, 14 bp, Homo sapiens
catggtatcatata

SEQ ID NO: 4239452 - DNA, 14 bp, Homo sapiens
catgtatgtataca

SEQ ID NO: 4239453 - DNA, 16 bp, Homo sapiens
caaatgacagatttct

SEQ ID NO: 4239454 - DNA, 17 bp, Homo sapiens
caaatgcataaatgcat

SEQ ID NO: 4239455 - DNA, 21 bp, Homo sapiens
caaatgtgggtgaagtgcctg

SEQ ID NO: 4239456 - DNA, 21 bp, Homo sapiens
caaattagggcaattggaaca

SEQ ID NO: 4239457 - DNA, 23 bp, Homo sapiens
caaattgtgcttctccccagaat

SEQ ID NO: 4239458 - DNA, 11 bp, Homo sapiens
caaatttctaa

SEQ ID NO: 4239459 - DNA, 13 bp, Homo sapiens
caacaaaaaatac

SEQ ID NO: 4239460 - DNA, 15 bp, Homo sapiens
caacaacaaaaaata

SEQ ID NO: 4239461 - DNA, 17 bp, Homo sapiens
caacagcaaatcacgac

SEQ ID NO: 4239462 - DNA, 19 bp, Homo sapiens
caacatgctccaaatataa

SEQ ID NO: 4239463 - DNA, 13 bp, Homo sapiens
caacatttatgtg

SEQ ID NO: 4239464 - DNA, 19 bp, Homo sapiens
caactcttccacctctggg

SEQ ID NO: 4239465 - DNA, 13 bp, Homo sapiens
caactgtatttat

SEQ ID NO: 4239466 - DNA, 20 bp, Homo sapiens
caacttcagttttatttttg

SEQ ID NO: 4239467 - DNA, 23 bp, Homo sapiens
caacttttatgcagcaaatatat

SEQ ID NO: 4239468 - DNA, 17 bp, Homo sapiens
caagaccacgtttctaa

SEQ ID NO: 4239469 - DNA, 16 bp, Homo sapiens
caagactgcaaacttt

SEQ ID NO: 4239470 - DNA, 22 bp, Homo sapiens
caagagggacagagcccgggag

SEQ ID NO: 4239471 - DNA, 20 bp, Homo sapiens
caagagtaactttactctgt

SEQ ID NO: 4239472 - DNA, 22 bp, Homo sapiens
caagcactatgcccttttatat

SEQ ID NO: 4239473 - DNA, 23 bp, Homo sapiens
caagccactagcccactccccag

SEQ ID NO: 4239474 - DNA, 15 bp, Homo sapiens
caagctagtgtttct

SEQ ID NO: 4239475 - DNA, 18 bp, Homo sapiens
caaggacggaaaatgctt

SEQ ID NO: 4239476 - DNA, 14 bp, Homo sapiens
caaggattgaaaat

SEQ ID NO: 4239477 - DNA, 22 bp, Homo sapiens
caagggcatcatcctcagcagc

SEQ ID NO: 4239478 - DNA, 18 bp, Homo sapiens
caaggtacaactgtattt

SEQ ID NO: 4239479 - DNA, 14 bp, Homo sapiens
caaggtcatttttt

SEQ ID NO: 4239480 - DNA, 13 bp, Homo sapiens
caagtattatacc

SEQ ID NO: 4239481 - DNA, 23 bp, Homo sapiens
caagtctctgctggcccagccaa

SEQ ID NO: 4239482 - DNA, 18 bp, Homo sapiens
caagtgttaggtcaataa

SEQ ID NO: 4239483 - DNA, 20 bp, Homo sapiens
caagttatattagtgaagat

SEQ ID NO: 4239484 - DNA, 15 bp, Homo sapiens
caataacactgtatt

SEQ ID NO: 4239485 - DNA, 17 bp, Homo sapiens
caataacactgtatttt

SEQ ID NO: 4239486 - DNA, 16 bp, Homo sapiens
caataattctacatgt

SEQ ID NO: 4239487 - DNA, 17 bp, Homo sapiens
caatatgtatgcttttt

SEQ ID NO: 4239488 - DNA, 21 bp, Homo sapiens
caatatttctgctttctttga

SEQ ID NO: 4239489 - DNA, 16 bp, Homo sapiens
caatcaccaccaggta

SEQ ID NO: 4239490 - DNA, 20 bp, Homo sapiens
caatcattgttttgaatatt

SEQ ID NO: 4239491 - DNA, 13 bp, Homo sapiens
caatgtgcataat

SEQ ID NO: 4239492 - DNA, 17 bp, Homo sapiens
caatgtgtttttctcca

SEQ ID NO: 4239493 - DNA, 15 bp, Homo sapiens
caattattgatatat

SEQ ID NO: 4239494 - DNA, 16 bp, Homo sapiens
caattccaatatttct

SEQ ID NO: 4239495 - DNA, 17 bp, Homo sapiens
caattccaatatttctg

SEQ ID NO: 4239496 - DNA, 13 bp, Homo sapiens
caattgaaagctt

SEQ ID NO: 4239497 - DNA, 15 bp, Homo sapiens
caatttactggccac

SEQ ID NO: 4239498 - DNA, 13 bp, Homo sapiens
caatttattatgg

SEQ ID NO: 4239499 - DNA, 13 bp, Homo sapiens
cacaaagagacca

SEQ ID NO: 4239500 - DNA, 18 bp, Homo sapiens
cacaaggattgaaaattc

SEQ ID NO: 4239501 - DNA, 15 bp, Homo sapiens
cacaagtagcctctg

SEQ ID NO: 4239502 - DNA, 22 bp, Homo sapiens
cacaatgttccttttttgtata

SEQ ID NO: 4239503 - DNA, 10 bp, Homo sapiens
cacacatttt

SEQ ID NO: 4239504 - DNA, 11 bp, Homo sapiens
cacacattttt

SEQ ID NO: 4239505 - DNA, 18 bp, Homo sapiens
cacaccaagcagcaacag

SEQ ID NO: 4239506 - DNA, 19 bp, Homo sapiens
cacacggagctcctggcag

SEQ ID NO: 4239507 - DNA, 22 bp, Homo sapiens
cacacttgaagcctaaatttgt

SEQ ID NO: 4239508 - DNA, 18 bp, Homo sapiens
cacagacatactaaccag

SEQ ID NO: 4239509 - DNA, 19 bp, Homo sapiens
cacagacatactaaccagc

SEQ ID NO: 4239510 - DNA, 22 bp, Homo sapiens
cacagaccaagtccaagcccgt

SEQ ID NO: 4239511 - DNA, 16 bp, Homo sapiens
cacagagttgttacat

SEQ ID NO: 4239512 - DNA, 17 bp, Homo sapiens
cacagagttgttacatt

SEQ ID NO: 4239513 - DNA, 23 bp, Homo sapiens
cacagatatactttgtggaccaa

SEQ ID NO: 4239514 - DNA, 14 bp, Homo sapiens
cacaggcagctctg

SEQ ID NO: 4239515 - DNA, 15 bp, Homo sapiens
cacaggcagctctga

SEQ ID NO: 4239516 - DNA, 17 bp, Homo sapiens
cacaggcagctctgagc

SEQ ID NO: 4239517 - DNA, 16 bp, Homo sapiens
cacagtgcttagaagt

SEQ ID NO: 4239518 - DNA, 19 bp, Homo sapiens
cacagtgttgcccaggctg

SEQ ID NO: 4239519 - DNA, 13 bp, Homo sapiens
cacatctgcattt

SEQ ID NO: 4239520 - DNA, 19 bp, Homo sapiens
cacatgcaaggtcattttt

SEQ ID NO: 4239521 - DNA, 20 bp, Homo sapiens
cacatgcaaggtcatttttt

SEQ ID NO: 4239522 - DNA, 15 bp, Homo sapiens
cacattttattttat

SEQ ID NO: 4239523 - DNA, 17 bp, Homo sapiens
cacattttattttatta

SEQ ID NO: 4239524 - DNA, 21 bp, Homo sapiens
cacattttattttattatgca

SEQ ID NO: 4239525 - DNA, 14 bp, Homo sapiens
cacatttttcttag

SEQ ID NO: 4239526 - DNA, 17 bp, Homo sapiens
cacattttttaaatgca

SEQ ID NO: 4239527 - DNA, 17 bp, Homo sapiens
caccactacattctgtt

SEQ ID NO: 4239528 - DNA, 18 bp, Homo sapiens
caccactacattctgtta

SEQ ID NO: 4239529 - DNA, 19 bp, Homo sapiens
caccactacattctgttaa

SEQ ID NO: 4239530 - DNA, 20 bp, Homo sapiens
caccactacattctgttaat

SEQ ID NO: 4239531 - DNA, 23 bp, Homo sapiens
caccatggtatcatatattaaaa

SEQ ID NO: 4239532 - DNA, 14 bp, Homo sapiens
cacccagctcagca

SEQ ID NO: 4239533 - DNA, 18 bp, Homo sapiens
cacccccaattccttgag

SEQ ID NO: 4239534 - DNA, 17 bp, Homo sapiens
cacccccatctctccct

SEQ ID NO: 4239535 - DNA, 15 bp, Homo sapiens
cacctatgttatttt

SEQ ID NO: 4239536 - DNA, 13 bp, Homo sapiens
cacctgagcctgt

SEQ ID NO: 4239537 - DNA, 17 bp, Homo sapiens
cacctgtctcagcctcc

SEQ ID NO: 4239538 - DNA, 19 bp, Homo sapiens
cacctgtctcagcctccca

SEQ ID NO: 4239539 - DNA, 15 bp, Homo sapiens
cacctgttatgtatg

SEQ ID NO: 4239540 - DNA, 16 bp, Homo sapiens
cacctgttatgtatga

SEQ ID NO: 4239541 - DNA, 13 bp, Homo sapiens
cacgccccaggac

SEQ ID NO: 4239542 - DNA, 21 bp, Homo sapiens
cacgcctctccctaggagaag

SEQ ID NO: 4239543 - DNA, 17 bp, Homo sapiens
cacggagctcctggcag

SEQ ID NO: 4239544 - DNA, 17 bp, Homo sapiens
cacgtccactcccaagc

SEQ ID NO: 4239545 - DNA, 15 bp, Homo sapiens
cacgtggccaggagc

SEQ ID NO: 4239546 - DNA, 12 bp, Homo sapiens
cacgtttctaaa

SEQ ID NO: 4239547 - DNA, 14 bp, Homo sapiens
cactacattctgtt

SEQ ID NO: 4239548 - DNA, 15 bp, Homo sapiens
cactacattctgtta

SEQ ID NO: 4239549 - DNA, 16 bp, Homo sapiens
cactacattctgttaa

SEQ ID NO: 4239550 - DNA, 13 bp, Homo sapiens
cactgacagcctc

SEQ ID NO: 4239551 - DNA, 16 bp, Homo sapiens
cactgacagcctccca

SEQ ID NO: 4239552 - DNA, 19 bp, Homo sapiens
cactgcaacctcacctccc

SEQ ID NO: 4239553 - DNA, 13 bp, Homo sapiens
cactgcttaactt

SEQ ID NO: 4239554 - DNA, 11 bp, Homo sapiens
cactgtatttt

SEQ ID NO: 4239555 - DNA, 14 bp, Homo sapiens
cactgtgggaaggc

SEQ ID NO: 4239556 - DNA, 21 bp, Homo sapiens
cactgtgggaaggccagctgc

SEQ ID NO: 4239557 - DNA, 14 bp, Homo sapiens
cactgttctgcaaa

SEQ ID NO: 4239558 - DNA, 13 bp, Homo sapiens
cacttcaggagcc

SEQ ID NO: 4239559 - DNA, 21 bp, Homo sapiens
cacttctcttaaacttgtgaa

SEQ ID NO: 4239560 - DNA, 15 bp, Homo sapiens
cactttgtaattttt

SEQ ID NO: 4239561 - DNA, 18 bp, Homo sapiens
cacttttgttctgcttta

SEQ ID NO: 4239562 - DNA, 19 bp, Homo sapiens
cactttttaagtttgaaga

SEQ ID NO: 4239563 - DNA, 17 bp, Homo sapiens
cagaaaatatttaatat

SEQ ID NO: 4239564 - DNA, 20 bp, Homo sapiens
cagaaaatatttaatatcaa

SEQ ID NO: 4239565 - DNA, 14 bp, Homo sapiens
cagaagaaaattct

SEQ ID NO: 4239566 - DNA, 16 bp, Homo sapiens
cagaataatggaaaca

SEQ ID NO: 4239567 - DNA, 19 bp, Homo sapiens
cagaataatggaaacatta

SEQ ID NO: 4239568 - DNA, 23 bp, Homo sapiens
cagaataatggaaacattacagt

SEQ ID NO: 4239569 - DNA, 18 bp, Homo sapiens
cagaattctctagtttga

SEQ ID NO: 4239570 - DNA, 16 bp, Homo sapiens
attcaaatttgatgat

SEQ ID NO: 4239571 - DNA, 16 bp, Homo sapiens
attcagtttttgtatc

SEQ ID NO: 4239572 - DNA, 14 bp, Homo sapiens
attcattctgagcc

SEQ ID NO: 4239573 - DNA, 20 bp, Homo sapiens
attcctagtggatgactgtt

SEQ ID NO: 4239574 - DNA, 19 bp, Homo sapiens
attcgcccgagctgtttat

SEQ ID NO: 4239575 - DNA, 19 bp, Homo sapiens
attctaacattaaatcaca

SEQ ID NO: 4239576 - DNA, 13 bp, Homo sapiens
attctacacagag

SEQ ID NO: 4239577 - DNA, 14 bp, Homo sapiens
attctacagaataa

SEQ ID NO: 4239578 - DNA, 21 bp, Homo sapiens
attctagtgtctgacttttgt

SEQ ID NO: 4239579 - DNA, 13 bp, Homo sapiens
attctatgttaaa

SEQ ID NO: 4239580 - DNA, 14 bp, Homo sapiens
attctatgttaaat

SEQ ID NO: 4239581 - DNA, 19 bp, Homo sapiens
attctatgttaaatactgt

SEQ ID NO: 4239582 - DNA, 17 bp, Homo sapiens
attctccttgtgttact

SEQ ID NO: 4239583 - DNA, 19 bp, Homo sapiens
attctccttgtgttactaa

SEQ ID NO: 4239584 - DNA, 22 bp, Homo sapiens
attctccttgtgttactaagtt

SEQ ID NO: 4239585 - DNA, 17 bp, Homo sapiens
attctccttttatgtgt

SEQ ID NO: 4239586 - DNA, 19 bp, Homo sapiens
attctctagtttgattaaa

SEQ ID NO: 4239587 - DNA, 23 bp, Homo sapiens
attctctagtttgattaaattct

SEQ ID NO: 4239588 - DNA, 16 bp, Homo sapiens
attctctcctgtacct

SEQ ID NO: 4239589 - DNA, 20 bp, Homo sapiens
attctgaccgttaaaaaatt

SEQ ID NO: 4239590 - DNA, 22 bp, Homo sapiens
attctgcaagcacatctgcatt

SEQ ID NO: 4239591 - DNA, 17 bp, Homo sapiens
attcttcacctgttatg

SEQ ID NO: 4239592 - DNA, 17 bp, Homo sapiens
attcttctgtatttcta

SEQ ID NO: 4239593 - DNA, 15 bp, Homo sapiens
attcttgcaaagtat

SEQ ID NO: 4239594 - DNA, 12 bp, Homo sapiens
attctttcccag

SEQ ID NO: 4239595 - DNA, 15 bp, Homo sapiens
attctttcccagtga

SEQ ID NO: 4239596 - DNA, 19 bp, Homo sapiens
attgaaaaacaattttctg

SEQ ID NO: 4239597 - DNA, 16 bp, Homo sapiens
attgaaagcttttaaa

SEQ ID NO: 4239598 - DNA, 22 bp, Homo sapiens
attgatattatattaaacatac

SEQ ID NO: 4239599 - DNA, 16 bp, Homo sapiens
attgcactttttaagt

SEQ ID NO: 4239600 - DNA, 22 bp, Homo sapiens
attgctgaagggcattctttcc

SEQ ID NO: 4239601 - DNA, 13 bp, Homo sapiens
attgcttagtaaa

SEQ ID NO: 4239602 - DNA, 16 bp, Homo sapiens
attgcttagtaaaatt

SEQ ID NO: 4239603 - DNA, 19 bp, Homo sapiens
attggcagtgactttgtat

SEQ ID NO: 4239604 - DNA, 20 bp, Homo sapiens
attggctagaggttcaaaga

SEQ ID NO: 4239605 - DNA, 18 bp, Homo sapiens
attgtagggctttagctt

SEQ ID NO: 4239606 - DNA, 17 bp, Homo sapiens
attgtatcaatttgttt

SEQ ID NO: 4239607 - DNA, 17 bp, Homo sapiens
attgtcttgcaacttca

SEQ ID NO: 4239608 - DNA, 20 bp, Homo sapiens
attgtcttgcaacttcagtt

SEQ ID NO: 4239609 - DNA, 16 bp, Homo sapiens
attgtgagccaccacg

SEQ ID NO: 4239610 - DNA, 12 bp, Homo sapiens
attgtgcttctc

SEQ ID NO: 4239611 - DNA, 16 bp, Homo sapiens
attgtttaaaattcag

SEQ ID NO: 4239612 - DNA, 11 bp, Homo sapiens
atttaaaatta

SEQ ID NO: 4239613 - DNA, 16 bp, Homo sapiens
atttaaagttgtatct

SEQ ID NO: 4239614 - DNA, 13 bp, Homo sapiens
atttaaatatctg

SEQ ID NO: 4239615 - DNA, 15 bp, Homo sapiens
atttaaatatctgtt

SEQ ID NO: 4239616 - DNA, 19 bp, Homo sapiens
atttaacagaaatgtacag

SEQ ID NO: 4239617 - DNA, 20 bp, Homo sapiens
atttaacagaaatgtacagc

SEQ ID NO: 4239618 - DNA, 13 bp, Homo sapiens
atttaatatcaaa

SEQ ID NO: 4239619 - DNA, 17 bp, Homo sapiens
atttaatatcaaaagaa

SEQ ID NO: 4239620 - DNA, 22 bp, Homo sapiens
atttaatggcagctagtgcctt

SEQ ID NO: 4239621 - DNA, 23 bp, Homo sapiens
atttacattaggtattacaagta

SEQ ID NO: 4239622 - DNA, 13 bp, Homo sapiens
atttactggccac

SEQ ID NO: 4239623 - DNA, 14 bp, Homo sapiens
atttagccctttaa

SEQ ID NO: 4239624 - DNA, 21 bp, Homo sapiens
atttatgtaatgaagtaaagc

SEQ ID NO: 4239625 - DNA, 13 bp, Homo sapiens
atttattatggca

SEQ ID NO: 4239626 - DNA, 15 bp, Homo sapiens
atttatttcatttac

SEQ ID NO: 4239627 - DNA, 16 bp, Homo sapiens
atttcacttttgttct

SEQ ID NO: 4239628 - DNA, 18 bp, Homo sapiens
atttcacttttgttctgc

SEQ ID NO: 4239629 - DNA, 16 bp, Homo sapiens
atttcatttaaatatc

SEQ ID NO: 4239630 - DNA, 19 bp, Homo sapiens
atttccttcaatgtgcata

SEQ ID NO: 4239631 - DNA, 21 bp, Homo sapiens
atttctgtttagataatacac

SEQ ID NO: 4239632 - DNA, 23 bp, Homo sapiens
atttctgtttcctatttaataca

SEQ ID NO: 4239633 - DNA, 14 bp, Homo sapiens
atttcttgcgagcc

SEQ ID NO: 4239634 - DNA, 20 bp, Homo sapiens
atttcttttgccgttattaa

SEQ ID NO: 4239635 - DNA, 15 bp, Homo sapiens
atttgaggtctgttc

SEQ ID NO: 4239636 - DNA, 17 bp, Homo sapiens
atttgaggtctgttctt

SEQ ID NO: 4239637 - DNA, 18 bp, Homo sapiens
atttgaggtctgttcttt

SEQ ID NO: 4239638 - DNA, 22 bp, Homo sapiens
atttgatgcccaatatattctg

SEQ ID NO: 4239639 - DNA, 15 bp, Homo sapiens
atttgatgtgacttt

SEQ ID NO: 4239640 - DNA, 21 bp, Homo sapiens
atttgctaatgtataatgtgc

SEQ ID NO: 4239641 - DNA, 18 bp, Homo sapiens
atttggtggtttcagaaa

SEQ ID NO: 4239642 - DNA, 21 bp, Homo sapiens
atttggtggtttcagaaatgt

SEQ ID NO: 4239643 - DNA, 13 bp, Homo sapiens
atttgtttgaact

SEQ ID NO: 4239644 - DNA, 15 bp, Homo sapiens
attttaaaatatatg

SEQ ID NO: 4239645 - DNA, 14 bp, Homo sapiens
attttaaaggcaga

SEQ ID NO: 4239646 - DNA, 19 bp, Homo sapiens
attttaatgtacttgaaaa

SEQ ID NO: 4239647 - DNA, 20 bp, Homo sapiens
attttaccaagagtaacttt

SEQ ID NO: 4239648 - DNA, 21 bp, Homo sapiens
attttaccaagagtaacttta

SEQ ID NO: 4239649 - DNA, 19 bp, Homo sapiens
attttagttcacacttagt

SEQ ID NO: 4239650 - DNA, 15 bp, Homo sapiens
attttattatgcatg

SEQ ID NO: 4239651 - DNA, 15 bp, Homo sapiens
attttcaccccaccc

SEQ ID NO: 4239652 - DNA, 16 bp, Homo sapiens
attttcaccccaccct

SEQ ID NO: 4239653 - DNA, 19 bp, Homo sapiens
attttcctgacatttgttt

SEQ ID NO: 4239654 - DNA, 12 bp, Homo sapiens
attttgctttgt

SEQ ID NO: 4239655 - DNA, 23 bp, Homo sapiens
attttggaaactgctaaattcta

SEQ ID NO: 4239656 - DNA, 18 bp, Homo sapiens
atttttaagtgctgcatt

SEQ ID NO: 4239657 - DNA, 15 bp, Homo sapiens
atttttagactattt

SEQ ID NO: 4239658 - DNA, 18 bp, Homo sapiens
atttttagactatttctt

SEQ ID NO: 4239659 - DNA, 19 bp, Homo sapiens
atttttatacaagtaattt

SEQ ID NO: 4239660 - DNA, 14 bp, Homo sapiens
atttttatttatga

SEQ ID NO: 4239661 - DNA, 18 bp, Homo sapiens
atttttcatctttaagaa

SEQ ID NO: 4239662 - DNA, 23 bp, Homo sapiens
atttttccaaatgaaaaatctca

SEQ ID NO: 4239663 - DNA, 22 bp, Homo sapiens
atttttcttagggaaggataca

SEQ ID NO: 4239664 - DNA, 22 bp, Homo sapiens
atttttggtggtggtgggtttg

SEQ ID NO: 4239665 - DNA, 14 bp, Homo sapiens
atttttgtacttga

SEQ ID NO: 4239666 - DNA, 14 bp, Homo sapiens
attttttaaatgca

SEQ ID NO: 4239667 - DNA, 23 bp, Homo sapiens
attttttaagtgggctcctgaca

SEQ ID NO: 4239668 - DNA, 15 bp, Homo sapiens
caaaaaaacaaaaaa

SEQ ID NO: 4239669 - DNA, 16 bp, Homo sapiens
caaaaaaatttaaaat

SEQ ID NO: 4239670 - DNA, 23 bp, Homo sapiens
caaaaaagacttgagacaatgtt

SEQ ID NO: 4239671 - DNA, 20 bp, Homo sapiens
caaaaacaagtaaatatata

SEQ ID NO: 4239672 - DNA, 16 bp, Homo sapiens
caaaagaaaattgata

SEQ ID NO: 4239673 - DNA, 23 bp, Homo sapiens
caaaagaggcttttgggccaaaa

SEQ ID NO: 4239674 - DNA, 12 bp, Homo sapiens
caaaataaaact

SEQ ID NO: 4239675 - DNA, 16 bp, Homo sapiens
caaaataaaacttttt

SEQ ID NO: 4239676 - DNA, 20 bp, Homo sapiens
caaaatattttttgcaagtt

SEQ ID NO: 4239677 - DNA, 21 bp, Homo sapiens
caaaatattttttgcaagtta

SEQ ID NO: 4239678 - DNA, 15 bp, Homo sapiens
caaacatgtatgtat

SEQ ID NO: 4239679 - DNA, 13 bp, Homo sapiens
caaacatgtattt

SEQ ID NO: 4239680 - DNA, 13 bp, Homo sapiens
caaacttttttat

SEQ ID NO: 4239681 - DNA, 14 bp, Homo sapiens
caaagatattttgc

SEQ ID NO: 4239682 - DNA, 19 bp, Homo sapiens
caaagcaaccacaaatgca

SEQ ID NO: 4239683 - DNA, 20 bp, Homo sapiens
caaagctcaaataaaaataa

SEQ ID NO: 4239684 - DNA, 18 bp, Homo sapiens
caaagtgtgtctgggatt

SEQ ID NO: 4239685 - DNA, 17 bp, Homo sapiens
caaatgaaaaatctcaa

SEQ ID NO: 4239686 - DNA, 16 bp, Homo sapiens
atctttaagaatgctt

SEQ ID NO: 4239687 - DNA, 17 bp, Homo sapiens
atctttaagaatgctta

SEQ ID NO: 4239688 - DNA, 14 bp, Homo sapiens
atcttttggttatt

SEQ ID NO: 4239689 - DNA, 20 bp, Homo sapiens
atgaaaaatctcaattgaaa

SEQ ID NO: 4239690 - DNA, 17 bp, Homo sapiens
atgaaccctttgtttct

SEQ ID NO: 4239691 - DNA, 22 bp, Homo sapiens
atgaagtaaagccattaaatga

SEQ ID NO: 4239692 - DNA, 14 bp, Homo sapiens
atgaagtaatatgc

SEQ ID NO: 4239693 - DNA, 21 bp, Homo sapiens
atgaagtaatatgcacacatt

SEQ ID NO: 4239694 - DNA, 12 bp, Homo sapiens
atgaatattttg

SEQ ID NO: 4239695 - DNA, 15 bp, Homo sapiens
atgaatattttgata

SEQ ID NO: 4239696 - DNA, 14 bp, Homo sapiens
atgacacatgcaag

SEQ ID NO: 4239697 - DNA, 17 bp, Homo sapiens
atgacaggcctgaagat

SEQ ID NO: 4239698 - DNA, 19 bp, Homo sapiens
atgacaggcctgaagatat

SEQ ID NO: 4239699 - DNA, 19 bp, Homo sapiens
atgacattaaatgcaataa

SEQ ID NO: 4239700 - DNA, 22 bp, Homo sapiens
atgacattaaatgcaataattt

SEQ ID NO: 4239701 - DNA, 21 bp, Homo sapiens
atgaggcatttgtttgaactg

SEQ ID NO: 4239702 - DNA, 22 bp, Homo sapiens
atgaggggattcccttccttct

SEQ ID NO: 4239703 - DNA, 14 bp, Homo sapiens
atgataaaataaat

SEQ ID NO: 4239704 - DNA, 21 bp, Homo sapiens
atgataaaataaataatttta

SEQ ID NO: 4239705 - DNA, 14 bp, Homo sapiens
atgatattgtttaa

SEQ ID NO: 4239706 - DNA, 18 bp, Homo sapiens
atgatattgtttaaaatt

SEQ ID NO: 4239707 - DNA, 21 bp, Homo sapiens
atgatattgtttaaaattcag

SEQ ID NO: 4239708 - DNA, 17 bp, Homo sapiens
atgcaaagtacaatgtg

SEQ ID NO: 4239709 - DNA, 14 bp, Homo sapiens
atgcaaggtcattt

SEQ ID NO: 4239710 - DNA, 22 bp, Homo sapiens
atgcaaggtcattttttttaag

SEQ ID NO: 4239711 - DNA, 14 bp, Homo sapiens
atgcacacattttt

SEQ ID NO: 4239712 - DNA, 15 bp, Homo sapiens
atgcacagatatact

SEQ ID NO: 4239713 - DNA, 18 bp, Homo sapiens
atgcacagatatactttg

SEQ ID NO: 4239714 - DNA, 13 bp, Homo sapiens
atgcacctggaat

SEQ ID NO: 4239715 - DNA, 14 bp, Homo sapiens
atgcacctggaata

SEQ ID NO: 4239716 - DNA, 19 bp, Homo sapiens
atgcacctggaatatataa

SEQ ID NO: 4239717 - DNA, 21 bp, Homo sapiens
atgcaggcacttattgtaaat

SEQ ID NO: 4239718 - DNA, 14 bp, Homo sapiens
atgcataatttatg

SEQ ID NO: 4239719 - DNA, 15 bp, Homo sapiens
atgcatattcaatgt

SEQ ID NO: 4239720 - DNA, 22 bp, Homo sapiens
atgcattgaacatcttgcattc

SEQ ID NO: 4239721 - DNA, 22 bp, Homo sapiens
atgccacagtggtactctgtgt

SEQ ID NO: 4239722 - DNA, 21 bp, Homo sapiens
atgctatggaacataaagttg

SEQ ID NO: 4239723 - DNA, 23 bp, Homo sapiens
atgctggcatttgcacctacctc

SEQ ID NO: 4239724 - DNA, 14 bp, Homo sapiens
atgcttcattgaaa

SEQ ID NO: 4239725 - DNA, 22 bp, Homo sapiens
atgcttctcatcttgtgaaatg

SEQ ID NO: 4239726 - DNA, 14 bp, Homo sapiens
atgcttgtacataa

SEQ ID NO: 4239727 - DNA, 18 bp, Homo sapiens
atggaaatacagttattt

SEQ ID NO: 4239728 - DNA, 21 bp, Homo sapiens
atggacgctgccgggagactg

SEQ ID NO: 4239729 - DNA, 17 bp, Homo sapiens
atggactggtttgagat

SEQ ID NO: 4239730 - DNA, 12 bp, Homo sapiens
atggagactctg

SEQ ID NO: 4239731 - DNA, 14 bp, Homo sapiens
atggagactctgag

SEQ ID NO: 4239732 - DNA, 15 bp, Homo sapiens
atggagactctgaga

SEQ ID NO: 4239733 - DNA, 13 bp, Homo sapiens
atggatgcaaagt

SEQ ID NO: 4239734 - DNA, 19 bp, Homo sapiens
atggatgcaaagtacaatg

SEQ ID NO: 4239735 - DNA, 14 bp, Homo sapiens
atggcatggagact

SEQ ID NO: 4239736 - DNA, 21 bp, Homo sapiens
atggctcagagcttgaagatt

SEQ ID NO: 4239737 - DNA, 15 bp, Homo sapiens
atgggggtgcatttg

SEQ ID NO: 4239738 - DNA, 20 bp, Homo sapiens
atgggtgtatataattttat

SEQ ID NO: 4239739 - DNA, 13 bp, Homo sapiens
atggtcatataca

SEQ ID NO: 4239740 - DNA, 15 bp, Homo sapiens
atggtcggaaaacat

SEQ ID NO: 4239741 - DNA, 18 bp, Homo sapiens
atggtggactacaaaata

SEQ ID NO: 4239742 - DNA, 15 bp, Homo sapiens
atggtttgatatgta

SEQ ID NO: 4239743 - DNA, 16 bp, Homo sapiens
atggtttgatatgtag

SEQ ID NO: 4239744 - DNA, 19 bp, Homo sapiens
atgtaaagatgatttaagt

SEQ ID NO: 4239745 - DNA, 22 bp, Homo sapiens
atgtaaagttatgtatttaaag

SEQ ID NO: 4239746 - DNA, 14 bp, Homo sapiens
atgtagccagctgt

SEQ ID NO: 4239747 - DNA, 19 bp, Homo sapiens
atgtatatcattctacaga

SEQ ID NO: 4239748 - DNA, 21 bp, Homo sapiens
atgtatgaaggaatcattcca

SEQ ID NO: 4239749 - DNA, 22 bp, Homo sapiens
atgtatgaaggaatcattccag

SEQ ID NO: 4239750 - DNA, 13 bp, Homo sapiens
atgtatttatgta

SEQ ID NO: 4239751 - DNA, 15 bp, Homo sapiens
atgtatttttctaca

SEQ ID NO: 4239752 - DNA, 16 bp, Homo sapiens
atgtatttttctacat

SEQ ID NO: 4239753 - DNA, 19 bp, Homo sapiens
atgtatttttctacattat

SEQ ID NO: 4239754 - DNA, 23 bp, Homo sapiens
atgtatttttctacattattgct

SEQ ID NO: 4239755 - DNA, 19 bp, Homo sapiens
atgtcaattcataaaaaca

SEQ ID NO: 4239756 - DNA, 13 bp, Homo sapiens
atgtcctgccttt

SEQ ID NO: 4239757 - DNA, 19 bp, Homo sapiens
atgtctcactgttctgcaa

SEQ ID NO: 4239758 - DNA, 22 bp, Homo sapiens
atgtgaaactggattaaactta

SEQ ID NO: 4239759 - DNA, 23 bp, Homo sapiens
atgtgaagcctggagctttcctg

SEQ ID NO: 4239760 - DNA, 18 bp, Homo sapiens
atgtgactttttttggta

SEQ ID NO: 4239761 - DNA, 14 bp, Homo sapiens
atgtgagactggtt

SEQ ID NO: 4239762 - DNA, 19 bp, Homo sapiens
atgtgaggtaattattgct

SEQ ID NO: 4239763 - DNA, 13 bp, Homo sapiens
atgtgtttgctgc

SEQ ID NO: 4239764 - DNA, 14 bp, Homo sapiens
atgtgtttgctgcc

SEQ ID NO: 4239765 - DNA, 16 bp, Homo sapiens
atgtgtttttctccag

SEQ ID NO: 4239766 - DNA, 12 bp, Homo sapiens
atgttaaatact

SEQ ID NO: 4239767 - DNA, 20 bp, Homo sapiens
atgttatcggattactgaat

SEQ ID NO: 4239768 - DNA, 20 bp, Homo sapiens
atgttatgatattgtttaaa

SEQ ID NO: 4239769 - DNA, 18 bp, Homo sapiens
atgttccttttttgtata

SEQ ID NO: 4239770 - DNA, 17 bp, Homo sapiens
atgttgggtttgagaca

SEQ ID NO: 4239771 - DNA, 13 bp, Homo sapiens
atgtttaaatcat

SEQ ID NO: 4239772 - DNA, 16 bp, Homo sapiens
atgtttaaatcatgta

SEQ ID NO: 4239773 - DNA, 17 bp, Homo sapiens
atgtttaaatcatgtat

SEQ ID NO: 4239774 - DNA, 18 bp, Homo sapiens
atgtttaaatcatgtatg

SEQ ID NO: 4239775 - DNA, 22 bp, Homo sapiens
atgtttaaatcatgtatgttat

SEQ ID NO: 4239776 - DNA, 16 bp, Homo sapiens
atgtttcaactgtgct

SEQ ID NO: 4239777 - DNA, 23 bp, Homo sapiens
atgtttttaaaaagagtaatttc

SEQ ID NO: 4239778 - DNA, 21 bp, Homo sapiens
atgtttttataaaaataaata

SEQ ID NO: 4239779 - DNA, 15 bp, Homo sapiens
atgttttttatgttc

SEQ ID NO: 4239780 - DNA, 19 bp, Homo sapiens
attaaaaatctcaaatttc

SEQ ID NO: 4239781 - DNA, 17 bp, Homo sapiens
attaaacttaatctaaa

SEQ ID NO: 4239782 - DNA, 21 bp, Homo sapiens
attaaacttaatctaaatgga

SEQ ID NO: 4239783 - DNA, 15 bp, Homo sapiens
attaaagatgctatg

SEQ ID NO: 4239784 - DNA, 16 bp, Homo sapiens
attaaataataaagta

SEQ ID NO: 4239785 - DNA, 18 bp, Homo sapiens
attaaattcttgcaaagt

SEQ ID NO: 4239786 - DNA, 16 bp, Homo sapiens
attaacttttataaac

SEQ ID NO: 4239787 - DNA, 13 bp, Homo sapiens
attacaacattta

SEQ ID NO: 4239788 - DNA, 16 bp, Homo sapiens
attacaacatttatgt

SEQ ID NO: 4239789 - DNA, 14 bp, Homo sapiens
attactcctatttt

SEQ ID NO: 4239790 - DNA, 16 bp, Homo sapiens
attactcctatttttg

SEQ ID NO: 4239791 - DNA, 15 bp, Homo sapiens
attactgaattgtat

SEQ ID NO: 4239792 - DNA, 14 bp, Homo sapiens
attactttttatgg

SEQ ID NO: 4239793 - DNA, 18 bp, Homo sapiens
attagatctaaacagtta

SEQ ID NO: 4239794 - DNA, 19 bp, Homo sapiens
attaggtattacaagtaat

SEQ ID NO: 4239795 - DNA, 16 bp, Homo sapiens
attataacaactattt

SEQ ID NO: 4239796 - DNA, 16 bp, Homo sapiens
attatattaaacatac

SEQ ID NO: 4239797 - DNA, 23 bp, Homo sapiens
attatgcatgaagtaatatgcac

SEQ ID NO: 4239798 - DNA, 11 bp, Homo sapiens
attattgctta

SEQ ID NO: 4239799 - DNA, 19 bp, Homo sapiens
attattgcttattgcttag

SEQ ID NO: 4239800 - DNA, 17 bp, Homo sapiens
attattttaaaatatat

SEQ ID NO: 4239801 - DNA, 19 bp, Homo sapiens
attattttaaaatatatga

SEQ ID NO: 4239802 - DNA, 12 bp, Homo sapiens
attcaaaatctt

SEQ ID NO: 4239803 - DNA, 22 bp, Homo sapiens
ataattgtgtaccttaagatat

SEQ ID NO: 4239804 - DNA, 12 bp, Homo sapiens
atacaaaagcat

SEQ ID NO: 4239805 - DNA, 15 bp, Homo sapiens
atacaaaagcatgtg

SEQ ID NO: 4239806 - DNA, 14 bp, Homo sapiens
atacaatgctgtgc

SEQ ID NO: 4239807 - DNA, 19 bp, Homo sapiens
atacaccactacattctgt

SEQ ID NO: 4239808 - DNA, 21 bp, Homo sapiens
atacaccactacattctgtta

SEQ ID NO: 4239809 - DNA, 17 bp, Homo sapiens
atacagctgaagtcaaa

SEQ ID NO: 4239810 - DNA, 17 bp, Homo sapiens
atacaggaggatgtgaa

SEQ ID NO: 4239811 - DNA, 18 bp, Homo sapiens
atacagttactcagaatt

SEQ ID NO: 4239812 - DNA, 13 bp, Homo sapiens
atacataatacaa

SEQ ID NO: 4239813 - DNA, 22 bp, Homo sapiens
ataccaaggtacaactgtattt

SEQ ID NO: 4239814 - DNA, 17 bp, Homo sapiens
ataccagccagtaaatg

SEQ ID NO: 4239815 - DNA, 18 bp, Homo sapiens
atactgtatcagatgtga

SEQ ID NO: 4239816 - DNA, 17 bp, Homo sapiens
atactgtgcagaataat

SEQ ID NO: 4239817 - DNA, 17 bp, Homo sapiens
atacttcaaaaataatg

SEQ ID NO: 4239818 - DNA, 21 bp, Homo sapiens
atagaaaagtagacaatcatt

SEQ ID NO: 4239819 - DNA, 22 bp, Homo sapiens
atagagctgcagggtggattgt

SEQ ID NO: 4239820 - DNA, 16 bp, Homo sapiens
atagagcttttaaaaa

SEQ ID NO: 4239821 - DNA, 19 bp, Homo sapiens
atagaggtatattggaaga

SEQ ID NO: 4239822 - DNA, 14 bp, Homo sapiens
atagctcaagaatt

SEQ ID NO: 4239823 - DNA, 16 bp, Homo sapiens
ataggggctttgctga

SEQ ID NO: 4239824 - DNA, 17 bp, Homo sapiens
ataggtagtttggatat

SEQ ID NO: 4239825 - DNA, 22 bp, Homo sapiens
ataggtagtttggatatttttg

SEQ ID NO: 4239826 - DNA, 22 bp, Homo sapiens
ataggtcctgtgttaaacacta

SEQ ID NO: 4239827 - DNA, 16 bp, Homo sapiens
atagtatttttatcca

SEQ ID NO: 4239828 - DNA, 23 bp, Homo sapiens
atagtgctacctgcacctctgga

SEQ ID NO: 4239829 - DNA, 15 bp, Homo sapiens
atagtggtgtgattt

SEQ ID NO: 4239830 - DNA, 18 bp, Homo sapiens
atagttagatctttgtaa

SEQ ID NO: 4239831 - DNA, 12 bp, Homo sapiens
atataaaactta

SEQ ID NO: 4239832 - DNA, 14 bp, Homo sapiens
atataaagtataga

SEQ ID NO: 4239833 - DNA, 18 bp, Homo sapiens
atataagaatgagcctgt

SEQ ID NO: 4239834 - DNA, 15 bp, Homo sapiens
atataagtgacttga

SEQ ID NO: 4239835 - DNA, 16 bp, Homo sapiens
atataatgtattttct

SEQ ID NO: 4239836 - DNA, 15 bp, Homo sapiens
atatacaaacatgta

SEQ ID NO: 4239837 - DNA, 15 bp, Homo sapiens
atatacatattgtat

SEQ ID NO: 4239838 - DNA, 16 bp, Homo sapiens
atatacatattgtata

SEQ ID NO: 4239839 - DNA, 14 bp, Homo sapiens
atatactttgtgga

SEQ ID NO: 4239840 - DNA, 16 bp, Homo sapiens
atataggaacttaaat

SEQ ID NO: 4239841 - DNA, 13 bp, Homo sapiens
atatataaccagt

SEQ ID NO: 4239842 - DNA, 14 bp, Homo sapiens
atatatatataaag

SEQ ID NO: 4239843 - DNA, 14 bp, Homo sapiens
atatatatatataa

SEQ ID NO: 4239844 - DNA, 16 bp, Homo sapiens
atatatatatatataa

SEQ ID NO: 4239845 - DNA, 20 bp, Homo sapiens
atatatatggtcatatacat

SEQ ID NO: 4239846 - DNA, 17 bp, Homo sapiens
atatatattataaatat

SEQ ID NO: 4239847 - DNA, 13 bp, Homo sapiens
atatatatttcta

SEQ ID NO: 4239848 - DNA, 24 bp, Homo sapiens
atatattaaaacaataatgcaatt

SEQ ID NO: 4239849 - DNA, 14 bp, Homo sapiens
atatattcttataa

SEQ ID NO: 4239850 - DNA, 15 bp, Homo sapiens
atatatttcactttt

SEQ ID NO: 4239851 - DNA, 20 bp, Homo sapiens
atatcattctacagaataat

SEQ ID NO: 4239852 - DNA, 16 bp, Homo sapiens
atatctgttattcaaa

SEQ ID NO: 4239853 - DNA, 21 bp, Homo sapiens
atatctgttattcaaatttga

SEQ ID NO: 4239854 - DNA, 18 bp, Homo sapiens
atatgaaccctttgtttc

SEQ ID NO: 4239855 - DNA, 19 bp, Homo sapiens
atatgaaccctttgtttct

SEQ ID NO: 4239856 - DNA, 13 bp, Homo sapiens
atatgcacacatt

SEQ ID NO: 4239857 - DNA, 23 bp, Homo sapiens
atattaaacatacataatacaat

SEQ ID NO: 4239858 - DNA, 22 bp, Homo sapiens
atattaccacagacatactaac

SEQ ID NO: 4239859 - DNA, 21 bp, Homo sapiens
atattactcctatttttgtaa

SEQ ID NO: 4239860 - DNA, 15 bp, Homo sapiens
atattataaatatat

SEQ ID NO: 4239861 - DNA, 15 bp, Homo sapiens
atattatattaaaca

SEQ ID NO: 4239862 - DNA, 13 bp, Homo sapiens
atattcttttgtt

SEQ ID NO: 4239863 - DNA, 18 bp, Homo sapiens
atattgaaggagaaaata

SEQ ID NO: 4239864 - DNA, 12 bp, Homo sapiens
atattgtttaaa

SEQ ID NO: 4239865 - DNA, 13 bp, Homo sapiens
atattgtttaaaa

SEQ ID NO: 4239866 - DNA, 14 bp, Homo sapiens
atattgtttaaaat

SEQ ID NO: 4239867 - DNA, 15 bp, Homo sapiens
atattgtttaaaatt

SEQ ID NO: 4239868 - DNA, 13 bp, Homo sapiens
atattgtttttct

SEQ ID NO: 4239869 - DNA, 21 bp, Homo sapiens
atatttatatcatccagaaaa

SEQ ID NO: 4239870 - DNA, 21 bp, Homo sapiens
atatttcacttttgttctgct

SEQ ID NO: 4239871 - DNA, 20 bp, Homo sapiens
atatttctgctttctttgat

SEQ ID NO: 4239872 - DNA, 17 bp, Homo sapiens
atattttgataataata

SEQ ID NO: 4239873 - DNA, 18 bp, Homo sapiens
atattttgataataatat

SEQ ID NO: 4239874 - DNA, 14 bp, Homo sapiens
atattttggaaact

SEQ ID NO: 4239875 - DNA, 19 bp, Homo sapiens
atattttggaaactgctaa

SEQ ID NO: 4239876 - DNA, 16 bp, Homo sapiens
atatttttgtacttga

SEQ ID NO: 4239877 - DNA, 13 bp, Homo sapiens
atattttttgctc

SEQ ID NO: 4239878 - DNA, 12 bp, Homo sapiens
atcaaatcaact

SEQ ID NO: 4239879 - DNA, 14 bp, Homo sapiens
atcaacttttatgc

SEQ ID NO: 4239880 - DNA, 14 bp, Homo sapiens
atcaagtattatac

SEQ ID NO: 4239881 - DNA, 20 bp, Homo sapiens
atcaattggcagtgactttg

SEQ ID NO: 4239882 - DNA, 11 bp, Homo sapiens
atcagatgtga

SEQ ID NO: 4239883 - DNA, 22 bp, Homo sapiens
atcagcacagctctcctcctcc

SEQ ID NO: 4239884 - DNA, 17 bp, Homo sapiens
atcagcacgatttctgt

SEQ ID NO: 4239885 - DNA, 18 bp, Homo sapiens
atcagcacgatttctgtt

SEQ ID NO: 4239886 - DNA, 18 bp, Homo sapiens
atcatatcaattggcagt

SEQ ID NO: 4239887 - DNA, 23 bp, Homo sapiens
atcatcctcagcagcatcgagga

SEQ ID NO: 4239888 - DNA, 20 bp, Homo sapiens
atcatgacaaagactgagta

SEQ ID NO: 4239889 - DNA, 11 bp, Homo sapiens
atcatgtatgt

SEQ ID NO: 4239890 - DNA, 17 bp, Homo sapiens
atcattctacagaataa

SEQ ID NO: 4239891 - DNA, 15 bp, Homo sapiens
atcattgttttgaat

SEQ ID NO: 4239892 - DNA, 18 bp, Homo sapiens
atcattgttttgaatatt

SEQ ID NO: 4239893 - DNA, 16 bp, Homo sapiens
atccacttcaggagcc

SEQ ID NO: 4239894 - DNA, 20 bp, Homo sapiens
atccagtattgctgatttta

SEQ ID NO: 4239895 - DNA, 22 bp, Homo sapiens
atccatgacaggcctgaagata

SEQ ID NO: 4239896 - DNA, 24 bp, Homo sapiens
atccatgacaggcctgaagatatt

SEQ ID NO: 4239897 - DNA, 14 bp, Homo sapiens
atcccacaccctgg

SEQ ID NO: 4239898 - DNA, 15 bp, Homo sapiens
atcctctcctttgaa

SEQ ID NO: 4239899 - DNA, 22 bp, Homo sapiens
atcctgtttataatctgaagat

SEQ ID NO: 4239900 - DNA, 23 bp, Homo sapiens
atcgctcgtgtgttctatccaaa

SEQ ID NO: 4239901 - DNA, 14 bp, Homo sapiens
atcgtcactgctta

SEQ ID NO: 4239902 - DNA, 19 bp, Homo sapiens
atctagatactgtatcatg

SEQ ID NO: 4239903 - DNA, 18 bp, Homo sapiens
atctagtttccctggtgc

SEQ ID NO: 4239904 - DNA, 16 bp, Homo sapiens
atctcaaatttctaaa

SEQ ID NO: 4239905 - DNA, 13 bp, Homo sapiens
atctcaccccatc

SEQ ID NO: 4239906 - DNA, 14 bp, Homo sapiens
atctcaccccatcc

SEQ ID NO: 4239907 - DNA, 16 bp, Homo sapiens
atctcccagatcctgg

SEQ ID NO: 4239908 - DNA, 17 bp, Homo sapiens
atctgaagatatatttc

SEQ ID NO: 4239909 - DNA, 19 bp, Homo sapiens
atctgaagatatatttcac

SEQ ID NO: 4239910 - DNA, 17 bp, Homo sapiens
atctgacccactttgta

SEQ ID NO: 4239911 - DNA, 22 bp, Homo sapiens
atctgcattttcaccccaccct

SEQ ID NO: 4239912 - DNA, 23 bp, Homo sapiens
atctgcattttcaccccaccctt

SEQ ID NO: 4239913 - DNA, 21 bp, Homo sapiens
atctgccgctttgtctgtcca

SEQ ID NO: 4239914 - DNA, 17 bp, Homo sapiens
atctggcacgtggccag

SEQ ID NO: 4239915 - DNA, 22 bp, Homo sapiens
atctggcacgtggccaggagcc

SEQ ID NO: 4239916 - DNA, 20 bp, Homo sapiens
atctgtgaagaaagaggtta

SEQ ID NO: 4239917 - DNA, 14 bp, Homo sapiens
atctgttattcaaa

SEQ ID NO: 4239918 - DNA, 22 bp, Homo sapiens
atcttggctgtttcaaaaaaat

SEQ ID NO: 4239919 - DNA, 21 bp, Homo sapiens
atcttggtttgtcagtttatc

SEQ ID NO: 4239920 - DNA, 17 bp, Homo sapiens
agggaacagcctgagcc

SEQ ID NO: 4239921 - DNA, 22 bp, Homo sapiens
agggaatctaatatccccaaat

SEQ ID NO: 4239922 - DNA, 15 bp, Homo sapiens
agggacagagcccgg

SEQ ID NO: 4239923 - DNA, 18 bp, Homo sapiens
agggacagagcccgggag

SEQ ID NO: 4239924 - DNA, 23 bp, Homo sapiens
agggagagccctgtccctgccct

SEQ ID NO: 4239925 - DNA, 21 bp, Homo sapiens
agggagtctggggtgggaggg

SEQ ID NO: 4239926 - DNA, 9 bp, Homo sapiens
agggcagga

SEQ ID NO: 4239927 - DNA, 23 bp, Homo sapiens
agggccctttcttgcactgtcca

SEQ ID NO: 4239928 - DNA, 14 bp, Homo sapiens
agggccgggcaggg

SEQ ID NO: 4239929 - DNA, 15 bp, Homo sapiens
agggccgggcagggg

SEQ ID NO: 4239930 - DNA, 15 bp, Homo sapiens
agggcgggcaaggag

SEQ ID NO: 4239931 - DNA, 19 bp, Homo sapiens
agggggacagcagggaccg

SEQ ID NO: 4239932 - DNA, 13 bp, Homo sapiens
aggggtgtttggg

SEQ ID NO: 4239933 - DNA, 23 bp, Homo sapiens
aggggtgtttgggagctgctggg

SEQ ID NO: 4239934 - DNA, 20 bp, Homo sapiens
agggtcaacatcttttacat

SEQ ID NO: 4239935 - DNA, 14 bp, Homo sapiens
aggtaattattgct

SEQ ID NO: 4239936 - DNA, 16 bp, Homo sapiens
aggtacaactgtattt

SEQ ID NO: 4239937 - DNA, 14 bp, Homo sapiens
aggtagtttggata

SEQ ID NO: 4239938 - DNA, 17 bp, Homo sapiens
aggtattacaagtaatg

SEQ ID NO: 4239939 - DNA, 20 bp, Homo sapiens
aggtcagggaggatctgttc

SEQ ID NO: 4239940 - DNA, 16 bp, Homo sapiens
aggtcctgtgttaaac

SEQ ID NO: 4239941 - DNA, 13 bp, Homo sapiens
aggtctgttcttt

SEQ ID NO: 4239942 - DNA, 23 bp, Homo sapiens
aggtctgttctttccaaagtaca

SEQ ID NO: 4239943 - DNA, 20 bp, Homo sapiens
aggtgctgggaatacatctg

SEQ ID NO: 4239944 - DNA, 17 bp, Homo sapiens
aggtggcaatgcttaaa

SEQ ID NO: 4239945 - DNA, 16 bp, Homo sapiens
aggtggtaggaggagg

SEQ ID NO: 4239946 - DNA, 13 bp, Homo sapiens
aggtgttgccagt

SEQ ID NO: 4239947 - DNA, 13 bp, Homo sapiens
aggttttgtattt

SEQ ID NO: 4239948 - DNA, 19 bp, Homo sapiens
agtaaatgggggtgcattt

SEQ ID NO: 4239949 - DNA, 21 bp, Homo sapiens
agtaaatgggggtgcatttga

SEQ ID NO: 4239950 - DNA, 22 bp, Homo sapiens
agtaacttatttgactatgaat

SEQ ID NO: 4239951 - DNA, 22 bp, Homo sapiens
agtaactttactctgtgtttaa

SEQ ID NO: 4239952 - DNA, 23 bp, Homo sapiens
agtaactttactctgtgtttaaa

SEQ ID NO: 4239953 - DNA, 20 bp, Homo sapiens
agtaagtaattatgcactaa

SEQ ID NO: 4239954 - DNA, 18 bp, Homo sapiens
agtaatatgcacacattt

SEQ ID NO: 4239955 - DNA, 19 bp, Homo sapiens
agtaatatgcacacatttt

SEQ ID NO: 4239956 - DNA, 15 bp, Homo sapiens
agtaatgcagttttt

SEQ ID NO: 4239957 - DNA, 17 bp, Homo sapiens
agtaatgtaaagatgat

SEQ ID NO: 4239958 - DNA, 13 bp, Homo sapiens
agtacaatgtgtt

SEQ ID NO: 4239959 - DNA, 21 bp, Homo sapiens
agtacactgtttcaaacttta

SEQ ID NO: 4239960 - DNA, 21 bp, Homo sapiens
agtacctctcaagctagtgtt

SEQ ID NO: 4239961 - DNA, 23 bp, Homo sapiens
agtaccttgaactcttagtgatt

SEQ ID NO: 4239962 - DNA, 21 bp, Homo sapiens
agtactgtttaccatttttca

SEQ ID NO: 4239963 - DNA, 19 bp, Homo sapiens
agtagacaatcattgtttt

SEQ ID NO: 4239964 - DNA, 22 bp, Homo sapiens
agtatacttttcccctgttaaa

SEQ ID NO: 4239965 - DNA, 14 bp, Homo sapiens
agtatagagagaag

SEQ ID NO: 4239966 - DNA, 17 bp, Homo sapiens
agtatgaggcatttgtt

SEQ ID NO: 4239967 - DNA, 11 bp, Homo sapiens
agtatttttgg

SEQ ID NO: 4239968 - DNA, 16 bp, Homo sapiens
agtcacatctcttcct

SEQ ID NO: 4239969 - DNA, 22 bp, Homo sapiens
agtcccgcgaaacccggtgcat

SEQ ID NO: 4239970 - DNA, 16 bp, Homo sapiens
agtctctgctggccca

SEQ ID NO: 4239971 - DNA, 17 bp, Homo sapiens
agtctctgctggcccag

SEQ ID NO: 4239972 - DNA, 20 bp, Homo sapiens
agtctggggtgggagggagg

SEQ ID NO: 4239973 - DNA, 14 bp, Homo sapiens
agtgaagacaatga

SEQ ID NO: 4239974 - DNA, 20 bp, Homo sapiens
agtgactttgtatagagaat

SEQ ID NO: 4239975 - DNA, 15 bp, Homo sapiens
agtgcagcccctctc

SEQ ID NO: 4239976 - DNA, 13 bp, Homo sapiens
agtgcctgctggg

SEQ ID NO: 4239977 - DNA, 20 bp, Homo sapiens
agtgcctgctgggtgccagg

SEQ ID NO: 4239978 - DNA, 23 bp, Homo sapiens
agtgcctgctgggtgccaggtgc

SEQ ID NO: 4239979 - DNA, 18 bp, Homo sapiens
agtgctaagctgccctga

SEQ ID NO: 4239980 - DNA, 19 bp, Homo sapiens
agtgctacctgcacctctg

SEQ ID NO: 4239981 - DNA, 19 bp, Homo sapiens
agtgctgcatttaaaagat

SEQ ID NO: 4239982 - DNA, 19 bp, Homo sapiens
agtgctgtccatgcttctc

SEQ ID NO: 4239983 - DNA, 11 bp, Homo sapiens
agtgggctcct

SEQ ID NO: 4239984 - DNA, 18 bp, Homo sapiens
agtggggagggagtctgg

SEQ ID NO: 4239985 - DNA, 15 bp, Homo sapiens
agtggtactctgtgt

SEQ ID NO: 4239986 - DNA, 16 bp, Homo sapiens
agtggtactctgtgtc

SEQ ID NO: 4239987 - DNA, 19 bp, Homo sapiens
agtggtggttttctgttct

SEQ ID NO: 4239988 - DNA, 21 bp, Homo sapiens
agtgtctgacttttgttaaat

SEQ ID NO: 4239989 - DNA, 19 bp, Homo sapiens
agtgttgtggatttaacag

SEQ ID NO: 4239990 - DNA, 14 bp, Homo sapiens
agtgtttctagcta

SEQ ID NO: 4239991 - DNA, 16 bp, Homo sapiens
agttatttcatctttt

SEQ ID NO: 4239992 - DNA, 17 bp, Homo sapiens
agttccacatctgtgga

SEQ ID NO: 4239993 - DNA, 17 bp, Homo sapiens
agttcctctttgccctg

SEQ ID NO: 4239994 - DNA, 12 bp, Homo sapiens
agttctctgcca

SEQ ID NO: 4239995 - DNA, 15 bp, Homo sapiens
agttggggagaaact

SEQ ID NO: 4239996 - DNA, 16 bp, Homo sapiens
agttggtgttgacata

SEQ ID NO: 4239997 - DNA, 19 bp, Homo sapiens
agttgtattcttctgtatt

SEQ ID NO: 4239998 - DNA, 15 bp, Homo sapiens
agttgttacattttt

SEQ ID NO: 4239999 - DNA, 19 bp, Homo sapiens
agttgttacatttttaagt

SEQ ID NO: 4240000 - DNA, 22 bp, Homo sapiens
agttgttacatttttaagtgct

SEQ ID NO: 4240001 - DNA, 17 bp, Homo sapiens
agttgttattgttgaac

SEQ ID NO: 4240002 - DNA, 14 bp, Homo sapiens
agtttgattaaatt

SEQ ID NO: 4240003 - DNA, 16 bp, Homo sapiens
agtttgattaaattct

SEQ ID NO: 4240004 - DNA, 18 bp, Homo sapiens
agtttgattaaattcttg

SEQ ID NO: 4240005 - DNA, 22 bp, Homo sapiens
agtttgattaaattcttgcaaa

SEQ ID NO: 4240006 - DNA, 22 bp, Homo sapiens
agtttgttagtatgaggcattt

SEQ ID NO: 4240007 - DNA, 13 bp, Homo sapiens
agttttatttttg

SEQ ID NO: 4240008 - DNA, 15 bp, Homo sapiens
agttttatttttgcc

SEQ ID NO: 4240009 - DNA, 13 bp, Homo sapiens
agtttttgtatct

SEQ ID NO: 4240010 - DNA, 14 bp, Homo sapiens
agtttttgtatctt

SEQ ID NO: 4240011 - DNA, 17 bp, Homo sapiens
ataaaacttaaaaacaa

SEQ ID NO: 4240012 - DNA, 17 bp, Homo sapiens
ataaaactttttaaaat

SEQ ID NO: 4240013 - DNA, 14 bp, Homo sapiens
ataaactgaatatt

SEQ ID NO: 4240014 - DNA, 23 bp, Homo sapiens
ataaactgaatattttggaaact

SEQ ID NO: 4240015 - DNA, 13 bp, Homo sapiens
ataaactttacct

SEQ ID NO: 4240016 - DNA, 15 bp, Homo sapiens
ataaagaatatatat

SEQ ID NO: 4240017 - DNA, 18 bp, Homo sapiens
ataaagcagcgtttctat

SEQ ID NO: 4240018 - DNA, 19 bp, Homo sapiens
ataaagcagcgtttctatg

SEQ ID NO: 4240019 - DNA, 17 bp, Homo sapiens
ataaagggttgaaaatg

SEQ ID NO: 4240020 - DNA, 11 bp, Homo sapiens
ataaagtatag

SEQ ID NO: 4240021 - DNA, 21 bp, Homo sapiens
ataaatgggtgtatataattt

SEQ ID NO: 4240022 - DNA, 18 bp, Homo sapiens
ataaattgtagggcttta

SEQ ID NO: 4240023 - DNA, 14 bp, Homo sapiens
ataagacaaaaata

SEQ ID NO: 4240024 - DNA, 21 bp, Homo sapiens
ataatacaccactacattctg

SEQ ID NO: 4240025 - DNA, 17 bp, Homo sapiens
ataataggtagtttgga

SEQ ID NO: 4240026 - DNA, 20 bp, Homo sapiens
ataataggtagtttggatat

SEQ ID NO: 4240027 - DNA, 14 bp, Homo sapiens
ataatctgaagata

SEQ ID NO: 4240028 - DNA, 15 bp, Homo sapiens
ataatgaataaactg

SEQ ID NO: 4240029 - DNA, 21 bp, Homo sapiens
ataatggaaacattacagttc

SEQ ID NO: 4240030 - DNA, 14 bp, Homo sapiens
ataatgtattgtaa

SEQ ID NO: 4240031 - DNA, 14 bp, Homo sapiens
ataatgtattttct

SEQ ID NO: 4240032 - DNA, 20 bp, Homo sapiens
ataatgtattttctttttat

SEQ ID NO: 4240033 - DNA, 18 bp, Homo sapiens
ataatgtttaaatcatgt

SEQ ID NO: 4240034 - DNA, 20 bp, Homo sapiens
ataatgtttaaatcatgtat

SEQ ID NO: 4240035 - DNA, 17 bp, Homo sapiens
ataattctgttatatga

SEQ ID NO: 4240036 - DNA, 20 bp, Homo sapiens
agacagagtccctggctcct

SEQ ID NO: 4240037 - DNA, 22 bp, Homo sapiens
agacatactgcttgattttaat

SEQ ID NO: 4240038 - DNA, 15 bp, Homo sapiens
agacatttgtttgct

SEQ ID NO: 4240039 - DNA, 18 bp, Homo sapiens
agacatttgtttgctgta

SEQ ID NO: 4240040 - DNA, 14 bp, Homo sapiens
agaccacgtttcta

SEQ ID NO: 4240041 - DNA, 12 bp, Homo sapiens
agactatttctt

SEQ ID NO: 4240042 - DNA, 13 bp, Homo sapiens
agactatttgcta

SEQ ID NO: 4240043 - DNA, 14 bp, Homo sapiens
agactcaaaaaaac

SEQ ID NO: 4240044 - DNA, 21 bp, Homo sapiens
agactcctcttcccagagtca

SEQ ID NO: 4240045 - DNA, 17 bp, Homo sapiens
agactctcagcccagaa

SEQ ID NO: 4240046 - DNA, 18 bp, Homo sapiens
agactctcagcccagaag

SEQ ID NO: 4240047 - DNA, 20 bp, Homo sapiens
agactctcagcccagaagaa

SEQ ID NO: 4240048 - DNA, 22 bp, Homo sapiens
agactgagtacgttgtgcattt

SEQ ID NO: 4240049 - DNA, 20 bp, Homo sapiens
agactggttccatggcctct

SEQ ID NO: 4240050 - DNA, 13 bp, Homo sapiens
agacttttgaaaa

SEQ ID NO: 4240051 - DNA, 14 bp, Homo sapiens
agagaatgcacaga

SEQ ID NO: 4240052 - DNA, 16 bp, Homo sapiens
agagcatctctgcctc

SEQ ID NO: 4240053 - DNA, 18 bp, Homo sapiens
agagcccgggagagactc

SEQ ID NO: 4240054 - DNA, 11 bp, Homo sapiens
agagccctgtc

SEQ ID NO: 4240055 - DNA, 20 bp, Homo sapiens
agagccctgtccctgccctc

SEQ ID NO: 4240056 - DNA, 20 bp, Homo sapiens
agagccttccacagtgaatg

SEQ ID NO: 4240057 - DNA, 13 bp, Homo sapiens
agaggcagagcct

SEQ ID NO: 4240058 - DNA, 16 bp, Homo sapiens
agaggcttttgggcca

SEQ ID NO: 4240059 - DNA, 15 bp, Homo sapiens
agagggacagagccc

SEQ ID NO: 4240060 - DNA, 21 bp, Homo sapiens
agagggacagagcccgggaga

SEQ ID NO: 4240061 - DNA, 16 bp, Homo sapiens
agagtaactttactct

SEQ ID NO: 4240062 - DNA, 21 bp, Homo sapiens
agagtattttaagaagacata

SEQ ID NO: 4240063 - DNA, 22 bp, Homo sapiens
agagttcctctttgccctgagg

SEQ ID NO: 4240064 - DNA, 22 bp, Homo sapiens
agagttgatactacagtttgtt

SEQ ID NO: 4240065 - DNA, 23 bp, Homo sapiens
agagttggggagaaactgaagcc

SEQ ID NO: 4240066 - DNA, 16 bp, Homo sapiens
agagttgttacatttt

SEQ ID NO: 4240067 - DNA, 18 bp, Homo sapiens
agataatacaccactaca

SEQ ID NO: 4240068 - DNA, 15 bp, Homo sapiens
agatatactttgtgg

SEQ ID NO: 4240069 - DNA, 14 bp, Homo sapiens
agatatatgccttc

SEQ ID NO: 4240070 - DNA, 14 bp, Homo sapiens
agatatatttcact

SEQ ID NO: 4240071 - DNA, 16 bp, Homo sapiens
agatatatttcacttt

SEQ ID NO: 4240072 - DNA, 20 bp, Homo sapiens
agatattttgctttgtgatt

SEQ ID NO: 4240073 - DNA, 11 bp, Homo sapiens
agatcctggaa

SEQ ID NO: 4240074 - DNA, 18 bp, Homo sapiens
agatctctaacttcacca

SEQ ID NO: 4240075 - DNA, 13 bp, Homo sapiens
agatgatggattt

SEQ ID NO: 4240076 - DNA, 19 bp, Homo sapiens
agatgcctgttttgagacc

SEQ ID NO: 4240077 - DNA, 17 bp, Homo sapiens
agatgtattgactgtac

SEQ ID NO: 4240078 - DNA, 12 bp, Homo sapiens
agatgtctattc

SEQ ID NO: 4240079 - DNA, 15 bp, Homo sapiens
agattaggagaaaca

SEQ ID NO: 4240080 - DNA, 20 bp, Homo sapiens
agattctgcctatgtaaaat

SEQ ID NO: 4240081 - DNA, 16 bp, Homo sapiens
agattgccccaggtct

SEQ ID NO: 4240082 - DNA, 14 bp, Homo sapiens
agcaacatttgtat

SEQ ID NO: 4240083 - DNA, 14 bp, Homo sapiens
agcaagcaggagtg

SEQ ID NO: 4240084 - DNA, 19 bp, Homo sapiens
agcaaggagatttacaact

SEQ ID NO: 4240085 - DNA, 17 bp, Homo sapiens
agcaattcccaggtcat

SEQ ID NO: 4240086 - DNA, 23 bp, Homo sapiens
agcacatctgcattttcacccca

SEQ ID NO: 4240087 - DNA, 15 bp, Homo sapiens
agcacgatttctgtt

SEQ ID NO: 4240088 - DNA, 16 bp, Homo sapiens
agcacgatttctgttt

SEQ ID NO: 4240089 - DNA, 18 bp, Homo sapiens
agcactcacgccctaagc

SEQ ID NO: 4240090 - DNA, 19 bp, Homo sapiens
agcagaaatgccttaccct

SEQ ID NO: 4240091 - DNA, 22 bp, Homo sapiens
agcagggaccgggcgcagccct

SEQ ID NO: 4240092 - DNA, 22 bp, Homo sapiens
agcagtcctgcctcagcctccg

SEQ ID NO: 4240093 - DNA, 16 bp, Homo sapiens
agcatacgtacacatt

SEQ ID NO: 4240094 - DNA, 21 bp, Homo sapiens
agcatacgtacacattttatt

SEQ ID NO: 4240095 - DNA, 22 bp, Homo sapiens
agcatctagtttccctggtgcc

SEQ ID NO: 4240096 - DNA, 23 bp, Homo sapiens
agccagtaaatgggggtgcattt

SEQ ID NO: 4240097 - DNA, 12 bp, Homo sapiens
agcccagaagaa

SEQ ID NO: 4240098 - DNA, 17 bp, Homo sapiens
agcccctcatgccacag

SEQ ID NO: 4240099 - DNA, 17 bp, Homo sapiens
agccctctgtggccagg

SEQ ID NO: 4240100 - DNA, 19 bp, Homo sapiens
agccctctgtggccaggag

SEQ ID NO: 4240101 - DNA, 19 bp, Homo sapiens
agccctgacgcaatgaaaa

SEQ ID NO: 4240102 - DNA, 14 bp, Homo sapiens
agccctttaaaacg

SEQ ID NO: 4240103 - DNA, 20 bp, Homo sapiens
agccgcgctttcccctcctc

SEQ ID NO: 4240104 - DNA, 17 bp, Homo sapiens
agccgtgtgtgcatgtg

SEQ ID NO: 4240105 - DNA, 20 bp, Homo sapiens
agcctatatatatagtcaaa

SEQ ID NO: 4240106 - DNA, 14 bp, Homo sapiens
agcctgcctggcag

SEQ ID NO: 4240107 - DNA, 14 bp, Homo sapiens
agcctggagctttc

SEQ ID NO: 4240108 - DNA, 11 bp, Homo sapiens
agcctgtccaa

SEQ ID NO: 4240109 - DNA, 19 bp, Homo sapiens
agccttagagcatctctgc

SEQ ID NO: 4240110 - DNA, 22 bp, Homo sapiens
agccttgaactttgacctctgc

SEQ ID NO: 4240111 - DNA, 17 bp, Homo sapiens
agccttttatctgcaga

SEQ ID NO: 4240112 - DNA, 14 bp, Homo sapiens
agcgccctgcaggg

SEQ ID NO: 4240113 - DNA, 18 bp, Homo sapiens
agcgccgtccggcggccc

SEQ ID NO: 4240114 - DNA, 18 bp, Homo sapiens
agcgtacgatggaggcct

SEQ ID NO: 4240115 - DNA, 11 bp, Homo sapiens
agctaaataaa

SEQ ID NO: 4240116 - DNA, 14 bp, Homo sapiens
agctaatttttgta

SEQ ID NO: 4240117 - DNA, 15 bp, Homo sapiens
agctaccctgtgtat

SEQ ID NO: 4240118 - DNA, 15 bp, Homo sapiens
agctacccttttcct

SEQ ID NO: 4240119 - DNA, 12 bp, Homo sapiens
agctagtgcctt

SEQ ID NO: 4240120 - DNA, 17 bp, Homo sapiens
agctcaaataaaaataa

SEQ ID NO: 4240121 - DNA, 16 bp, Homo sapiens
agctcagcatttccac

SEQ ID NO: 4240122 - DNA, 21 bp, Homo sapiens
agctcattctccttgtgttac

SEQ ID NO: 4240123 - DNA, 13 bp, Homo sapiens
agctcctggcagc

SEQ ID NO: 4240124 - DNA, 13 bp, Homo sapiens
agctcgatccaaa

SEQ ID NO: 4240125 - DNA, 15 bp, Homo sapiens
agctgccccagccag

SEQ ID NO: 4240126 - DNA, 13 bp, Homo sapiens
agctgccctgagg

SEQ ID NO: 4240127 - DNA, 12 bp, Homo sapiens
agctgtttatgt

SEQ ID NO: 4240128 - DNA, 18 bp, Homo sapiens
agctgtttatgtttttat

SEQ ID NO: 4240129 - DNA, 12 bp, Homo sapiens
agcttgaagatt

SEQ ID NO: 4240130 - DNA, 23 bp, Homo sapiens
agcttgaagattaggagaaacac

SEQ ID NO: 4240131 - DNA, 13 bp, Homo sapiens
agctttctgtgca

SEQ ID NO: 4240132 - DNA, 16 bp, Homo sapiens
agctttctgtgcatgt

SEQ ID NO: 4240133 - DNA, 21 bp, Homo sapiens
agctttctgtgcatgtgcagg

SEQ ID NO: 4240134 - DNA, 15 bp, Homo sapiens
agctttgataattgt

SEQ ID NO: 4240135 - DNA, 21 bp, Homo sapiens
aggaacttaaataatgtgaaa

SEQ ID NO: 4240136 - DNA, 21 bp, Homo sapiens
aggactgcacagcgtcctgtc

SEQ ID NO: 4240137 - DNA, 23 bp, Homo sapiens
aggactgcacagcgtcctgtcca

SEQ ID NO: 4240138 - DNA, 19 bp, Homo sapiens
aggagaaacacattcttat

SEQ ID NO: 4240139 - DNA, 14 bp, Homo sapiens
aggagaaatctcag

SEQ ID NO: 4240140 - DNA, 20 bp, Homo sapiens
aggagccccgccaggtgccc

SEQ ID NO: 4240141 - DNA, 21 bp, Homo sapiens
aggagccccgccaggtgcccg

SEQ ID NO: 4240142 - DNA, 10 bp, Homo sapiens
aggagccctg

SEQ ID NO: 4240143 - DNA, 15 bp, Homo sapiens
aggagggagagccct

SEQ ID NO: 4240144 - DNA, 21 bp, Homo sapiens
aggatacaaaagcatgtgaga

SEQ ID NO: 4240145 - DNA, 16 bp, Homo sapiens
aggatgcttgtacata

SEQ ID NO: 4240146 - DNA, 21 bp, Homo sapiens
aggatggtgctgagtaaacat

SEQ ID NO: 4240147 - DNA, 15 bp, Homo sapiens
aggcatctgcatggg

SEQ ID NO: 4240148 - DNA, 15 bp, Homo sapiens
aggctacctttgtat

SEQ ID NO: 4240149 - DNA, 16 bp, Homo sapiens
aggctactctgcccac

SEQ ID NO: 4240150 - DNA, 20 bp, Homo sapiens
aggctgtcacagtcctgagt

SEQ ID NO: 4240151 - DNA, 17 bp, Homo sapiens
aggctgtctggccaggc

SEQ ID NO: 4240152 - DNA, 21 bp, Homo sapiens
agggaaaggttttgtattttt

SEQ ID NO: 4240153 - DNA, 22 bp, Homo sapiens
acctcccacctatccgccctgc

SEQ ID NO: 4240154 - DNA, 18 bp, Homo sapiens
acctccggagcgccctgc

SEQ ID NO: 4240155 - DNA, 22 bp, Homo sapiens
acctcctaatggcatggagact

SEQ ID NO: 4240156 - DNA, 20 bp, Homo sapiens
acctctgcagcaataaagca

SEQ ID NO: 4240157 - DNA, 17 bp, Homo sapiens
acctcttgagccttgaa

SEQ ID NO: 4240158 - DNA, 20 bp, Homo sapiens
acctcttgagccttgaactt

SEQ ID NO: 4240159 - DNA, 13 bp, Homo sapiens
acctgcttgagct

SEQ ID NO: 4240160 - DNA, 22 bp, Homo sapiens
accttaaaattgatattatatt

SEQ ID NO: 4240161 - DNA, 19 bp, Homo sapiens
accttttttatacataaac

SEQ ID NO: 4240162 - DNA, 12 bp, Homo sapiens
acgatttctgtt

SEQ ID NO: 4240163 - DNA, 14 bp, Homo sapiens
acgatttctgttta

SEQ ID NO: 4240164 - DNA, 21 bp, Homo sapiens
acgctgccgggagactgccag

SEQ ID NO: 4240165 - DNA, 13 bp, Homo sapiens
acggagctcctgg

SEQ ID NO: 4240166 - DNA, 21 bp, Homo sapiens
acgtcttagagccttttatct

SEQ ID NO: 4240167 - DNA, 13 bp, Homo sapiens
acgtggccaggag

SEQ ID NO: 4240168 - DNA, 13 bp, Homo sapiens
acgttgtgcattt

SEQ ID NO: 4240169 - DNA, 14 bp, Homo sapiens
acgttgtgcatttg

SEQ ID NO: 4240170 - DNA, 22 bp, Homo sapiens
actaaatatgaaccctttgttt

SEQ ID NO: 4240171 - DNA, 16 bp, Homo sapiens
actaaccagcagaaat

SEQ ID NO: 4240172 - DNA, 15 bp, Homo sapiens
actaagtttttatgg

SEQ ID NO: 4240173 - DNA, 20 bp, Homo sapiens
actaattattattttaaaat

SEQ ID NO: 4240174 - DNA, 13 bp, Homo sapiens
actacagtttgtt

SEQ ID NO: 4240175 - DNA, 11 bp, Homo sapiens
actacattctg

SEQ ID NO: 4240176 - DNA, 16 bp, Homo sapiens
actacgtcttaagtca

SEQ ID NO: 4240177 - DNA, 15 bp, Homo sapiens
actacttaccatttg

SEQ ID NO: 4240178 - DNA, 23 bp, Homo sapiens
actagagaatgcacagatatact

SEQ ID NO: 4240179 - DNA, 16 bp, Homo sapiens
actatatatatttcta

SEQ ID NO: 4240180 - DNA, 17 bp, Homo sapiens
actatatatatttctag

SEQ ID NO: 4240181 - DNA, 22 bp, Homo sapiens
actatggccctggcctagcata

SEQ ID NO: 4240182 - DNA, 17 bp, Homo sapiens
actatttgctaatgtat

SEQ ID NO: 4240183 - DNA, 14 bp, Homo sapiens
actcagtgccacac

SEQ ID NO: 4240184 - DNA, 16 bp, Homo sapiens
actcctatttttgtaa

SEQ ID NO: 4240185 - DNA, 17 bp, Homo sapiens
actcctcttcccagagt

SEQ ID NO: 4240186 - DNA, 16 bp, Homo sapiens
actctacctaatgtct

SEQ ID NO: 4240187 - DNA, 23 bp, Homo sapiens
actctatcaagtattataccttt

SEQ ID NO: 4240188 - DNA, 12 bp, Homo sapiens
actctgtaattg

SEQ ID NO: 4240189 - DNA, 13 bp, Homo sapiens
actcttaatctgt

SEQ ID NO: 4240190 - DNA, 15 bp, Homo sapiens
actcttaatctgtgt

SEQ ID NO: 4240191 - DNA, 19 bp, Homo sapiens
actgaatattttggaaact

SEQ ID NO: 4240192 - DNA, 19 bp, Homo sapiens
actgaattgtatcaatttg

SEQ ID NO: 4240193 - DNA, 21 bp, Homo sapiens
actgaattgtatcaatttgtt

SEQ ID NO: 4240194 - DNA, 12 bp, Homo sapiens
actgaatttctt

SEQ ID NO: 4240195 - DNA, 23 bp, Homo sapiens
actgaatttcttttgccgttatt

SEQ ID NO: 4240196 - DNA, 20 bp, Homo sapiens
actgcattcattctgagccc

SEQ ID NO: 4240197 - DNA, 16 bp, Homo sapiens
actgctaaattctatg

SEQ ID NO: 4240198 - DNA, 21 bp, Homo sapiens
actgctaaattctatgttaaa

SEQ ID NO: 4240199 - DNA, 18 bp, Homo sapiens
actgcttaacttcacata

SEQ ID NO: 4240200 - DNA, 20 bp, Homo sapiens
actgcttaacttcacatatt

SEQ ID NO: 4240201 - DNA, 17 bp, Homo sapiens
actggattaaaacaatt

SEQ ID NO: 4240202 - DNA, 18 bp, Homo sapiens
actggttccatggcctct

SEQ ID NO: 4240203 - DNA, 15 bp, Homo sapiens
actgtacataaacaa

SEQ ID NO: 4240204 - DNA, 13 bp, Homo sapiens
actgtacatgaaa

SEQ ID NO: 4240205 - DNA, 14 bp, Homo sapiens
actgtacatgaaaa

SEQ ID NO: 4240206 - DNA, 19 bp, Homo sapiens
actgtacatgaaaacacat

SEQ ID NO: 4240207 - DNA, 19 bp, Homo sapiens
actgtaccatggtttgata

SEQ ID NO: 4240208 - DNA, 14 bp, Homo sapiens
actgtatcatgaca

SEQ ID NO: 4240209 - DNA, 19 bp, Homo sapiens
actgttctcctgaatattt

SEQ ID NO: 4240210 - DNA, 13 bp, Homo sapiens
actgttctgcaaa

SEQ ID NO: 4240211 - DNA, 22 bp, Homo sapiens
actgttgatgaagtatactttt

SEQ ID NO: 4240212 - DNA, 14 bp, Homo sapiens
acttaaataatgtg

SEQ ID NO: 4240213 - DNA, 17 bp, Homo sapiens
acttaaataatgtgaaa

SEQ ID NO: 4240214 - DNA, 18 bp, Homo sapiens
acttaaataatgtgaaac

SEQ ID NO: 4240215 - DNA, 16 bp, Homo sapiens
acttaatctaaatgga

SEQ ID NO: 4240216 - DNA, 14 bp, Homo sapiens
acttacctgcttga

SEQ ID NO: 4240217 - DNA, 13 bp, Homo sapiens
acttattgtaaat

SEQ ID NO: 4240218 - DNA, 12 bp, Homo sapiens
acttcaggagcc

SEQ ID NO: 4240219 - DNA, 15 bp, Homo sapiens
acttcaggagcccta

SEQ ID NO: 4240220 - DNA, 19 bp, Homo sapiens
acttcagttttatttttgc

SEQ ID NO: 4240221 - DNA, 19 bp, Homo sapiens
acttcatgacaagcatttt

SEQ ID NO: 4240222 - DNA, 20 bp, Homo sapiens
acttctcttaaacttgtgaa

SEQ ID NO: 4240223 - DNA, 21 bp, Homo sapiens
acttgaagcctaaatttgtgc

SEQ ID NO: 4240224 - DNA, 22 bp, Homo sapiens
acttgaagcctaaatttgtgct

SEQ ID NO: 4240225 - DNA, 16 bp, Homo sapiens
acttggcaggtgcctg

SEQ ID NO: 4240226 - DNA, 22 bp, Homo sapiens
actttaccttttttatacataa

SEQ ID NO: 4240227 - DNA, 12 bp, Homo sapiens
actttgacctct

SEQ ID NO: 4240228 - DNA, 18 bp, Homo sapiens
actttgacctctgcagca

SEQ ID NO: 4240229 - DNA, 19 bp, Homo sapiens
actttgacctctgcagcaa

SEQ ID NO: 4240230 - DNA, 18 bp, Homo sapiens
actttgtggaccaattat

SEQ ID NO: 4240231 - DNA, 20 bp, Homo sapiens
acttttatgcagcaaatata

SEQ ID NO: 4240232 - DNA, 21 bp, Homo sapiens
acttttatgcagcaaatatat

SEQ ID NO: 4240233 - DNA, 16 bp, Homo sapiens
acttttgttaaattca

SEQ ID NO: 4240234 - DNA, 17 bp, Homo sapiens
acttttgttaaattcag

SEQ ID NO: 4240235 - DNA, 13 bp, Homo sapiens
acttttgttctgc

SEQ ID NO: 4240236 - DNA, 18 bp, Homo sapiens
agaaaaaggatgcacaga

SEQ ID NO: 4240237 - DNA, 14 bp, Homo sapiens
agaaaaaggcagtg

SEQ ID NO: 4240238 - DNA, 13 bp, Homo sapiens
agaaaagaaaaat

SEQ ID NO: 4240239 - DNA, 15 bp, Homo sapiens
agaaaagttgcagat

SEQ ID NO: 4240240 - DNA, 15 bp, Homo sapiens
agaaatgtacagcaa

SEQ ID NO: 4240241 - DNA, 17 bp, Homo sapiens
agaaatgtacagcaagg

SEQ ID NO: 4240242 - DNA, 22 bp, Homo sapiens
agaaccaaagcaaccacaaatg

SEQ ID NO: 4240243 - DNA, 12 bp, Homo sapiens
agaagaaaattc

SEQ ID NO: 4240244 - DNA, 23 bp, Homo sapiens
agaagagttgaggaactgtacag

SEQ ID NO: 4240245 - DNA, 13 bp, Homo sapiens
agaataatggaaa

SEQ ID NO: 4240246 - DNA, 16 bp, Homo sapiens
agaataatggaaacat

SEQ ID NO: 4240247 - DNA, 17 bp, Homo sapiens
agaataatggaaacatt

SEQ ID NO: 4240248 - DNA, 12 bp, Homo sapiens
agaatatatata

SEQ ID NO: 4240249 - DNA, 15 bp, Homo sapiens
agaatcccttaaaat

SEQ ID NO: 4240250 - DNA, 20 bp, Homo sapiens
agaatcccttaaaattacca

SEQ ID NO: 4240251 - DNA, 13 bp, Homo sapiens
agaatgagcctgt

SEQ ID NO: 4240252 - DNA, 16 bp, Homo sapiens
agaatgcacagatata

SEQ ID NO: 4240253 - DNA, 18 bp, Homo sapiens
agaatgcacagatatact

SEQ ID NO: 4240254 - DNA, 22 bp, Homo sapiens
agaatgcacagatatactttgt

SEQ ID NO: 4240255 - DNA, 14 bp, Homo sapiens
agaattctctagtt

SEQ ID NO: 4240256 - DNA, 20 bp, Homo sapiens
agacaaaaaaatttaaaatt

SEQ ID NO: 4240257 - DNA, 13 bp, Homo sapiens
agacaaaaacaag

SEQ ID NO: 4240258 - DNA, 23 bp, Homo sapiens
agacaaaaacaagtaaatatata

SEQ ID NO: 4240259 - DNA, 15 bp, Homo sapiens
agacaaagatttctt

SEQ ID NO: 4240260 - DNA, 16 bp, Homo sapiens
agacaaagatttcttc

SEQ ID NO: 4240261 - DNA, 20 bp, Homo sapiens
agacaatgacttactgtaca

SEQ ID NO: 4240262 - DNA, 22 bp, Homo sapiens
agacaatgacttactgtacatg

SEQ ID NO: 4240263 - DNA, 15 bp, Homo sapiens
agacaatgttttctt

SEQ ID NO: 4240264 - DNA, 17 bp, Homo sapiens
agacaatgttttcttca

SEQ ID NO: 4240265 - DNA, 14 bp, Homo sapiens
agacaatttattat

SEQ ID NO: 4240266 - DNA, 16 bp, Homo sapiens
agacacaatatgtatg

SEQ ID NO: 4240267 - DNA, 16 bp, Homo sapiens
agacactttacctctt

SEQ ID NO: 4240268 - DNA, 11 bp, Homo sapiens
agacagaaact

SEQ ID NO: 4240269 - DNA, 18 bp, Homo sapiens
agacagaaactggattaa

SEQ ID NO: 4240270 - DNA, 14 bp, Homo sapiens
aatttgtgatacaa

SEQ ID NO: 4240271 - DNA, 20 bp, Homo sapiens
aatttgtgatacaatgctgt

SEQ ID NO: 4240272 - DNA, 23 bp, Homo sapiens
aatttgtttgtgttcaatatcag

SEQ ID NO: 4240273 - DNA, 14 bp, Homo sapiens
aattttgatgtttt

SEQ ID NO: 4240274 - DNA, 14 bp, Homo sapiens
aatttttgtatttt

SEQ ID NO: 4240275 - DNA, 21 bp, Homo sapiens
aattttttttttcctcttcag

SEQ ID NO: 4240276 - DNA, 11 bp, Homo sapiens
acaaaagcatg

SEQ ID NO: 4240277 - DNA, 15 bp, Homo sapiens
acaaagcactagaga

SEQ ID NO: 4240278 - DNA, 17 bp, Homo sapiens
acaagaccacgtttcta

SEQ ID NO: 4240279 - DNA, 19 bp, Homo sapiens
acaagaccacgtttctaaa

SEQ ID NO: 4240280 - DNA, 17 bp, Homo sapiens
acaaggttggttgctaa

SEQ ID NO: 4240281 - DNA, 14 bp, Homo sapiens
acaagtcatttttg

SEQ ID NO: 4240282 - DNA, 13 bp, Homo sapiens
acaagttgttatt

SEQ ID NO: 4240283 - DNA, 18 bp, Homo sapiens
acaataatgcaattagaa

SEQ ID NO: 4240284 - DNA, 22 bp, Homo sapiens
acaataattctacatgttgtct

SEQ ID NO: 4240285 - DNA, 14 bp, Homo sapiens
acaatatgtatgct

SEQ ID NO: 4240286 - DNA, 17 bp, Homo sapiens
acaatcattgttttgaa

SEQ ID NO: 4240287 - DNA, 21 bp, Homo sapiens
acaatcattgttttgaatatt

SEQ ID NO: 4240288 - DNA, 19 bp, Homo sapiens
acaatgacttactgtacat

SEQ ID NO: 4240289 - DNA, 24 bp, Homo sapiens
acaatgctgtgccctaaagtgtat

SEQ ID NO: 4240290 - DNA, 18 bp, Homo sapiens
acaatgtgtttttctcca

SEQ ID NO: 4240291 - DNA, 19 bp, Homo sapiens
acaatgtgtttttctccag

SEQ ID NO: 4240292 - DNA, 19 bp, Homo sapiens
acaatgttccttttttgta

SEQ ID NO: 4240293 - DNA, 14 bp, Homo sapiens
acaatttattatgg

SEQ ID NO: 4240294 - DNA, 16 bp, Homo sapiens
acaattttttttttcc

SEQ ID NO: 4240295 - DNA, 16 bp, Homo sapiens
acacaatatgtatgct

SEQ ID NO: 4240296 - DNA, 22 bp, Homo sapiens
acacaatatgtatgctttttac

SEQ ID NO: 4240297 - DNA, 18 bp, Homo sapiens
acacatgcaaggtcattt

SEQ ID NO: 4240298 - DNA, 14 bp, Homo sapiens
acacatttgaaaca

SEQ ID NO: 4240299 - DNA, 12 bp, Homo sapiens
acacatttttct

SEQ ID NO: 4240300 - DNA, 18 bp, Homo sapiens
acacattttttaaatgca

SEQ ID NO: 4240301 - DNA, 20 bp, Homo sapiens
acacattttttaaatgcacc

SEQ ID NO: 4240302 - DNA, 22 bp, Homo sapiens
acacattttttaaatgcacctg

SEQ ID NO: 4240303 - DNA, 14 bp, Homo sapiens
acaccactacattc

SEQ ID NO: 4240304 - DNA, 15 bp, Homo sapiens
acaccactacattct

SEQ ID NO: 4240305 - DNA, 17 bp, Homo sapiens
acactgtttcaaacttt

SEQ ID NO: 4240306 - DNA, 20 bp, Homo sapiens
acactgtttcaaactttact

SEQ ID NO: 4240307 - DNA, 23 bp, Homo sapiens
acactgtttcaaactttactatg

SEQ ID NO: 4240308 - DNA, 19 bp, Homo sapiens
acagaaactggattaaaac

SEQ ID NO: 4240309 - DNA, 23 bp, Homo sapiens
acagaataatccagtattgctga

SEQ ID NO: 4240310 - DNA, 15 bp, Homo sapiens
acagacacaatatgt

SEQ ID NO: 4240311 - DNA, 19 bp, Homo sapiens
acagacacaatatgtatgc

SEQ ID NO: 4240312 - DNA, 19 bp, Homo sapiens
acagacatactaaccagca

SEQ ID NO: 4240313 - DNA, 22 bp, Homo sapiens
acagactatttgctaatgtata

SEQ ID NO: 4240314 - DNA, 14 bp, Homo sapiens
acagagcaggactg

SEQ ID NO: 4240315 - DNA, 15 bp, Homo sapiens
acagagcccgggaga

SEQ ID NO: 4240316 - DNA, 19 bp, Homo sapiens
acagagttgttacattttt

SEQ ID NO: 4240317 - DNA, 21 bp, Homo sapiens
acagagttgttacatttttaa

SEQ ID NO: 4240318 - DNA, 15 bp, Homo sapiens
acagatatactttgt

SEQ ID NO: 4240319 - DNA, 19 bp, Homo sapiens
acagatttctcactatata

SEQ ID NO: 4240320 - DNA, 17 bp, Homo sapiens
acagcaaggagatttac

SEQ ID NO: 4240321 - DNA, 15 bp, Homo sapiens
acagcctcccacccc

SEQ ID NO: 4240322 - DNA, 13 bp, Homo sapiens
acagcctgagccg

SEQ ID NO: 4240323 - DNA, 18 bp, Homo sapiens
acaggcagctctgagccg

SEQ ID NO: 4240324 - DNA, 17 bp, Homo sapiens
acagtcatcgctcgtgt

SEQ ID NO: 4240325 - DNA, 13 bp, Homo sapiens
acataaacaatga

SEQ ID NO: 4240326 - DNA, 14 bp, Homo sapiens
acataatacaatgt

SEQ ID NO: 4240327 - DNA, 20 bp, Homo sapiens
acatacttcaaaaataatgt

SEQ ID NO: 4240328 - DNA, 14 bp, Homo sapiens
acatagaggtatat

SEQ ID NO: 4240329 - DNA, 14 bp, Homo sapiens
acatattgatttcc

SEQ ID NO: 4240330 - DNA, 16 bp, Homo sapiens
acatattgatttccgt

SEQ ID NO: 4240331 - DNA, 15 bp, Homo sapiens
acatcagcacgattt

SEQ ID NO: 4240332 - DNA, 17 bp, Homo sapiens
acatcagcacgatttct

SEQ ID NO: 4240333 - DNA, 18 bp, Homo sapiens
acatcgatatgtatatca

SEQ ID NO: 4240334 - DNA, 16 bp, Homo sapiens
acatcttgcattcaaa

SEQ ID NO: 4240335 - DNA, 16 bp, Homo sapiens
acatgaccttaatgga

SEQ ID NO: 4240336 - DNA, 17 bp, Homo sapiens
acatgcaaggtcatttt

SEQ ID NO: 4240337 - DNA, 22 bp, Homo sapiens
acatgctacacactgcatgttt

SEQ ID NO: 4240338 - DNA, 15 bp, Homo sapiens
acattaaatgcaata

SEQ ID NO: 4240339 - DNA, 21 bp, Homo sapiens
acattaaatgcaataatttta

SEQ ID NO: 4240340 - DNA, 12 bp, Homo sapiens
acattacagttc

SEQ ID NO: 4240341 - DNA, 17 bp, Homo sapiens
acattacagttcataat

SEQ ID NO: 4240342 - DNA, 17 bp, Homo sapiens
acattcttattaattct

SEQ ID NO: 4240343 - DNA, 16 bp, Homo sapiens
acatttgtttgctgta

SEQ ID NO: 4240344 - DNA, 12 bp, Homo sapiens
acattttaaata

SEQ ID NO: 4240345 - DNA, 18 bp, Homo sapiens
acattttattttattatg

SEQ ID NO: 4240346 - DNA, 20 bp, Homo sapiens
acattttattttattatgca

SEQ ID NO: 4240347 - DNA, 19 bp, Homo sapiens
acatttttaagtgctgcat

SEQ ID NO: 4240348 - DNA, 23 bp, Homo sapiens
acatttttaagtgctgcatttaa

SEQ ID NO: 4240349 - DNA, 17 bp, Homo sapiens
acattttttaaatgcac

SEQ ID NO: 4240350 - DNA, 21 bp, Homo sapiens
acattttttaaatgcacctgg

SEQ ID NO: 4240351 - DNA, 16 bp, Homo sapiens
accaaagctggcccag

SEQ ID NO: 4240352 - DNA, 17 bp, Homo sapiens
accaattattgatatat

SEQ ID NO: 4240353 - DNA, 14 bp, Homo sapiens
accacaaatgcata

SEQ ID NO: 4240354 - DNA, 22 bp, Homo sapiens
accacagacacaatatgtatgc

SEQ ID NO: 4240355 - DNA, 21 bp, Homo sapiens
accacagacatactaaccagc

SEQ ID NO: 4240356 - DNA, 22 bp, Homo sapiens
accacagacatactaaccagca

SEQ ID NO: 4240357 - DNA, 22 bp, Homo sapiens
accacaggttcatgccaccatg

SEQ ID NO: 4240358 - DNA, 13 bp, Homo sapiens
accacgtttctaa

SEQ ID NO: 4240359 - DNA, 19 bp, Homo sapiens
accacgtttctaaaggcta

SEQ ID NO: 4240360 - DNA, 15 bp, Homo sapiens
accacttttgttctt

SEQ ID NO: 4240361 - DNA, 16 bp, Homo sapiens
accacttttgttcttg

SEQ ID NO: 4240362 - DNA, 21 bp, Homo sapiens
accacttttgttcttggtttg

SEQ ID NO: 4240363 - DNA, 21 bp, Homo sapiens
accagattctgcctatgtaaa

SEQ ID NO: 4240364 - DNA, 14 bp, Homo sapiens
accagcagaaatgc

SEQ ID NO: 4240365 - DNA, 20 bp, Homo sapiens
accagcttagccaacatagt

SEQ ID NO: 4240366 - DNA, 15 bp, Homo sapiens
accatggccagccaa

SEQ ID NO: 4240367 - DNA, 15 bp, Homo sapiens
accatggtttgatat

SEQ ID NO: 4240368 - DNA, 18 bp, Homo sapiens
accatttgctactgtaca

SEQ ID NO: 4240369 - DNA, 17 bp, Homo sapiens
accatttttcattcact

SEQ ID NO: 4240370 - DNA, 15 bp, Homo sapiens
acccacctctgccac

SEQ ID NO: 4240371 - DNA, 16 bp, Homo sapiens
acccagaagaaaatag

SEQ ID NO: 4240372 - DNA, 13 bp, Homo sapiens
accccacccttcc

SEQ ID NO: 4240373 - DNA, 18 bp, Homo sapiens
accccagcatcagcacag

SEQ ID NO: 4240374 - DNA, 16 bp, Homo sapiens
accccaggtgagacct

SEQ ID NO: 4240375 - DNA, 13 bp, Homo sapiens
acccctctgtagc

SEQ ID NO: 4240376 - DNA, 13 bp, Homo sapiens
accctctccaggc

SEQ ID NO: 4240377 - DNA, 14 bp, Homo sapiens
accctggaaatgga

SEQ ID NO: 4240378 - DNA, 23 bp, Homo sapiens
accctggaaatggactggtttga

SEQ ID NO: 4240379 - DNA, 19 bp, Homo sapiens
acccttttcctttgtggtt

SEQ ID NO: 4240380 - DNA, 22 bp, Homo sapiens
accgctctcttttctgtacttc

SEQ ID NO: 4240381 - DNA, 14 bp, Homo sapiens
accgtctttacccc

SEQ ID NO: 4240382 - DNA, 21 bp, Homo sapiens
acctaatgtctcactgttctg

SEQ ID NO: 4240383 - DNA, 19 bp, Homo sapiens
acctagctggtagcataaa

SEQ ID NO: 4240384 - DNA, 21 bp, Homo sapiens
acctatgttattttgtgtaca

SEQ ID NO: 4240385 - DNA, 23 bp, Homo sapiens
acctatgttattttgtgtacaag

SEQ ID NO: 4240386 - DNA, 12 bp, Homo sapiens
aataaaactgaa

SEQ ID NO: 4240387 - DNA, 14 bp, Homo sapiens
aataaaacttttta

SEQ ID NO: 4240388 - DNA, 15 bp, Homo sapiens
aataaaactttttaa

SEQ ID NO: 4240389 - DNA, 18 bp, Homo sapiens
aataaaactttttaaaat

SEQ ID NO: 4240390 - DNA, 19 bp, Homo sapiens
aataaaaggtggatttgag

SEQ ID NO: 4240391 - DNA, 19 bp, Homo sapiens
aataaacagacaaaaacaa

SEQ ID NO: 4240392 - DNA, 22 bp, Homo sapiens
aataaactgaatattttggaaa

SEQ ID NO: 4240393 - DNA, 14 bp, Homo sapiens
aataaagcagcgtt

SEQ ID NO: 4240394 - DNA, 14 bp, Homo sapiens
aataaataaaaatg

SEQ ID NO: 4240395 - DNA, 22 bp, Homo sapiens
aataaatgggtgtatataattt

SEQ ID NO: 4240396 - DNA, 16 bp, Homo sapiens
aataatgaataaactg

SEQ ID NO: 4240397 - DNA, 19 bp, Homo sapiens
aataatgaataaactgaat

SEQ ID NO: 4240398 - DNA, 12 bp, Homo sapiens
aataatggaaac

SEQ ID NO: 4240399 - DNA, 13 bp, Homo sapiens
aataatggaaaca

SEQ ID NO: 4240400 - DNA, 19 bp, Homo sapiens
aataatgtattgtaatctt

SEQ ID NO: 4240401 - DNA, 16 bp, Homo sapiens
aataatgtgaaactgg

SEQ ID NO: 4240402 - DNA, 21 bp, Homo sapiens
aatacaccactacattctgtt

SEQ ID NO: 4240403 - DNA, 22 bp, Homo sapiens
aatactgtgcagaataatggaa

SEQ ID NO: 4240404 - DNA, 23 bp, Homo sapiens
aatagacaatttattatggcaca

SEQ ID NO: 4240405 - DNA, 17 bp, Homo sapiens
aataggagtatttttgg

SEQ ID NO: 4240406 - DNA, 23 bp, Homo sapiens
aatagttagatctttgtaaatgc

SEQ ID NO: 4240407 - DNA, 14 bp, Homo sapiens
aatataagacattt

SEQ ID NO: 4240408 - DNA, 14 bp, Homo sapiens
aatataatgtattt

SEQ ID NO: 4240409 - DNA, 17 bp, Homo sapiens
aatataatgtattttct

SEQ ID NO: 4240410 - DNA, 18 bp, Homo sapiens
aatataggaacttaaata

SEQ ID NO: 4240411 - DNA, 18 bp, Homo sapiens
aatataggtcctgtgtta

SEQ ID NO: 4240412 - DNA, 16 bp, Homo sapiens
aatatcaaaagaaaat

SEQ ID NO: 4240413 - DNA, 16 bp, Homo sapiens
aatatcagctttgata

SEQ ID NO: 4240414 - DNA, 17 bp, Homo sapiens
aatatcagctttgataa

SEQ ID NO: 4240415 - DNA, 18 bp, Homo sapiens
aatatcagctttgataat

SEQ ID NO: 4240416 - DNA, 23 bp, Homo sapiens
aatatctgttattcaaatttgat

SEQ ID NO: 4240417 - DNA, 18 bp, Homo sapiens
aatatgaaccctttgttt

SEQ ID NO: 4240418 - DNA, 19 bp, Homo sapiens
aatatgtaagaacacattt

SEQ ID NO: 4240419 - DNA, 11 bp, Homo sapiens
aatatgtatgc

SEQ ID NO: 4240420 - DNA, 13 bp, Homo sapiens
aatattcttttgt

SEQ ID NO: 4240421 - DNA, 16 bp, Homo sapiens
aatattcttttgtttc

SEQ ID NO: 4240422 - DNA, 15 bp, Homo sapiens
aatattttgataata

SEQ ID NO: 4240423 - DNA, 13 bp, Homo sapiens
aatattttttgct

SEQ ID NO: 4240424 - DNA, 22 bp, Homo sapiens
aatcacagcccaaaatttgatg

SEQ ID NO: 4240425 - DNA, 22 bp, Homo sapiens
aatcagctgcaatccatttatt

SEQ ID NO: 4240426 - DNA, 13 bp, Homo sapiens
aatcagtgataat

SEQ ID NO: 4240427 - DNA, 17 bp, Homo sapiens
aatcattaggtgtgact

SEQ ID NO: 4240428 - DNA, 20 bp, Homo sapiens
aatcattccagtgctagaaa

SEQ ID NO: 4240429 - DNA, 17 bp, Homo sapiens
aatcattgttttgaata

SEQ ID NO: 4240430 - DNA, 22 bp, Homo sapiens
aatcattgttttgaatattact

SEQ ID NO: 4240431 - DNA, 16 bp, Homo sapiens
aatccatttatttcat

SEQ ID NO: 4240432 - DNA, 14 bp, Homo sapiens
aatcctgtttataa

SEQ ID NO: 4240433 - DNA, 12 bp, Homo sapiens
aatctcaaattt

SEQ ID NO: 4240434 - DNA, 14 bp, Homo sapiens
aatctcaaatttct

SEQ ID NO: 4240435 - DNA, 16 bp, Homo sapiens
aatctcaaatttctaa

SEQ ID NO: 4240436 - DNA, 22 bp, Homo sapiens
aatctcaccccatcccacaccc

SEQ ID NO: 4240437 - DNA, 13 bp, Homo sapiens
aatctccaaaata

SEQ ID NO: 4240438 - DNA, 14 bp, Homo sapiens
aatctccaaaataa

SEQ ID NO: 4240439 - DNA, 23 bp, Homo sapiens
aatctgaagatatatttcacttt

SEQ ID NO: 4240440 - DNA, 18 bp, Homo sapiens
aatctttcatccaaaata

SEQ ID NO: 4240441 - DNA, 21 bp, Homo sapiens
aatgaaaaatctcaattgaaa

SEQ ID NO: 4240442 - DNA, 19 bp, Homo sapiens
aatgaaaagtcgttttcca

SEQ ID NO: 4240443 - DNA, 20 bp, Homo sapiens
aatgaaaagtcgttttccaa

SEQ ID NO: 4240444 - DNA, 16 bp, Homo sapiens
aatgaataaactgaat

SEQ ID NO: 4240445 - DNA, 12 bp, Homo sapiens
aatgaattgaaa

SEQ ID NO: 4240446 - DNA, 13 bp, Homo sapiens
aatgaattgaaaa

SEQ ID NO: 4240447 - DNA, 17 bp, Homo sapiens
aatgaattgaaaaacaa

SEQ ID NO: 4240448 - DNA, 21 bp, Homo sapiens
aatgacattaaatgcaataat

SEQ ID NO: 4240449 - DNA, 17 bp, Homo sapiens
aatgacttactgtacat

SEQ ID NO: 4240450 - DNA, 13 bp, Homo sapiens
aatgagcctgtcc

SEQ ID NO: 4240451 - DNA, 22 bp, Homo sapiens
aatgatcatatcaattggcagt

SEQ ID NO: 4240452 - DNA, 17 bp, Homo sapiens
aatgcacagatatactt

SEQ ID NO: 4240453 - DNA, 14 bp, Homo sapiens
aatgcataaatgca

SEQ ID NO: 4240454 - DNA, 19 bp, Homo sapiens
aatggactggtttgagatt

SEQ ID NO: 4240455 - DNA, 17 bp, Homo sapiens
aatgggggtgcatttga

SEQ ID NO: 4240456 - DNA, 18 bp, Homo sapiens
aatgggtgtatataattt

SEQ ID NO: 4240457 - DNA, 15 bp, Homo sapiens
aatggtcctgacttt

SEQ ID NO: 4240458 - DNA, 17 bp, Homo sapiens
aatgtaaaaaagaaaaa

SEQ ID NO: 4240459 - DNA, 17 bp, Homo sapiens
aatgtaaagttatgtat

SEQ ID NO: 4240460 - DNA, 22 bp, Homo sapiens
aatgtaatataatgtattttct

SEQ ID NO: 4240461 - DNA, 16 bp, Homo sapiens
aatgtcctgcctttta

SEQ ID NO: 4240462 - DNA, 16 bp, Homo sapiens
aatgtctcactgttct

SEQ ID NO: 4240463 - DNA, 13 bp, Homo sapiens
aatgtgaagccag

SEQ ID NO: 4240464 - DNA, 16 bp, Homo sapiens
aatgtgcagaaaatat

SEQ ID NO: 4240465 - DNA, 14 bp, Homo sapiens
aatgttacatctgt

SEQ ID NO: 4240466 - DNA, 18 bp, Homo sapiens
aatgtttaaatcatgtat

SEQ ID NO: 4240467 - DNA, 22 bp, Homo sapiens
aatgtttaaatcatgtatgtta

SEQ ID NO: 4240468 - DNA, 17 bp, Homo sapiens
aatgtttttatttttgt

SEQ ID NO: 4240469 - DNA, 22 bp, Homo sapiens
aattaaaaggatagtattttta

SEQ ID NO: 4240470 - DNA, 13 bp, Homo sapiens
aattaacttttat

SEQ ID NO: 4240471 - DNA, 15 bp, Homo sapiens
aattaagatttcctt

SEQ ID NO: 4240472 - DNA, 17 bp, Homo sapiens
aattagataaattgtag

SEQ ID NO: 4240473 - DNA, 22 bp, Homo sapiens
aattagatctaaacagttattt

SEQ ID NO: 4240474 - DNA, 18 bp, Homo sapiens
aattatgcactaaatatg

SEQ ID NO: 4240475 - DNA, 19 bp, Homo sapiens
aattatgcactaaatatga

SEQ ID NO: 4240476 - DNA, 16 bp, Homo sapiens
aattattgatatatat

SEQ ID NO: 4240477 - DNA, 18 bp, Homo sapiens
aattattgatatatatta

SEQ ID NO: 4240478 - DNA, 14 bp, Homo sapiens
aattcacctatgtt

SEQ ID NO: 4240479 - DNA, 16 bp, Homo sapiens
aattcagattgtcttg

SEQ ID NO: 4240480 - DNA, 17 bp, Homo sapiens
aattcagattgtcttgc

SEQ ID NO: 4240481 - DNA, 14 bp, Homo sapiens
aattcataaaaaca

SEQ ID NO: 4240482 - DNA, 16 bp, Homo sapiens
aattcataaaaacaag

SEQ ID NO: 4240483 - DNA, 13 bp, Homo sapiens
aattctatgttaa

SEQ ID NO: 4240484 - DNA, 19 bp, Homo sapiens
aattctatgttaaatactg

SEQ ID NO: 4240485 - DNA, 23 bp, Homo sapiens
aattctatgttaaatactgtgca

SEQ ID NO: 4240486 - DNA, 17 bp, Homo sapiens
aattctctagtttgatt

SEQ ID NO: 4240487 - DNA, 23 bp, Homo sapiens
aattcttcacctgttatgtatga

SEQ ID NO: 4240488 - DNA, 13 bp, Homo sapiens
aattgaaaaaaat

SEQ ID NO: 4240489 - DNA, 21 bp, Homo sapiens
aattgaaaaaaattgaaataa

SEQ ID NO: 4240490 - DNA, 13 bp, Homo sapiens
aattgcagtcatt

SEQ ID NO: 4240491 - DNA, 14 bp, Homo sapiens
aattgcagtcattt

SEQ ID NO: 4240492 - DNA, 17 bp, Homo sapiens
aattgcagtcatttggt

SEQ ID NO: 4240493 - DNA, 16 bp, Homo sapiens
aattggcagtgacttt

SEQ ID NO: 4240494 - DNA, 20 bp, Homo sapiens
aattgtgcttctccccagaa

SEQ ID NO: 4240495 - DNA, 21 bp, Homo sapiens
aattgtgcttctccccagaat

SEQ ID NO: 4240496 - DNA, 16 bp, Homo sapiens
aatttaaaattacgtt

SEQ ID NO: 4240497 - DNA, 23 bp, Homo sapiens
aatttacaagatattattaattt

SEQ ID NO: 4240498 - DNA, 13 bp, Homo sapiens
aatttattatggc

SEQ ID NO: 4240499 - DNA, 15 bp, Homo sapiens
aatttgaagtaactt

SEQ ID NO: 4240500 - DNA, 21 bp, Homo sapiens
aatttgaagtaacttatttga

SEQ ID NO: 4240501 - DNA, 18 bp, Homo sapiens
aatttgatgcccaatata

SEQ ID NO: 4240502 - DNA, 22 bp, Homo sapiens
aatttgggagaagcaaatatag

SEQ ID NO: 4240503 - DNA, 20 bp, Homo sapiens
aacatacttcaaaaataatg

SEQ ID NO: 4240504 - DNA, 21 bp, Homo sapiens
aacatacttcaaaaataatgt

SEQ ID NO: 4240505 - DNA, 14 bp, Homo sapiens
aacattaaggaatt

SEQ ID NO: 4240506 - DNA, 18 bp, Homo sapiens
aacattacagttcataat

SEQ ID NO: 4240507 - DNA, 20 bp, Homo sapiens
aacattacagttcataatag

SEQ ID NO: 4240508 - DNA, 22 bp, Homo sapiens
aacatttatgtgaggtaattat

SEQ ID NO: 4240509 - DNA, 19 bp, Homo sapiens
aaccagtgttgtggattta

SEQ ID NO: 4240510 - DNA, 19 bp, Homo sapiens
aacccaagcaacatttgta

SEQ ID NO: 4240511 - DNA, 21 bp, Homo sapiens
aacccagcagttctctgccaa

SEQ ID NO: 4240512 - DNA, 18 bp, Homo sapiens
aacctcacctcccgggtt

SEQ ID NO: 4240513 - DNA, 15 bp, Homo sapiens
aactaaataatgaat

SEQ ID NO: 4240514 - DNA, 13 bp, Homo sapiens
aactaggctctta

SEQ ID NO: 4240515 - DNA, 16 bp, Homo sapiens
aactagggctcatttt

SEQ ID NO: 4240516 - DNA, 14 bp, Homo sapiens
aactatttactttt

SEQ ID NO: 4240517 - DNA, 16 bp, Homo sapiens
aactcttaatctgtgt

SEQ ID NO: 4240518 - DNA, 15 bp, Homo sapiens
aactgaatattttgg

SEQ ID NO: 4240519 - DNA, 14 bp, Homo sapiens
aactgataaagatg

SEQ ID NO: 4240520 - DNA, 15 bp, Homo sapiens
aactgctaaattcta

SEQ ID NO: 4240521 - DNA, 19 bp, Homo sapiens
aactgctaaattctatgtt

SEQ ID NO: 4240522 - DNA, 16 bp, Homo sapiens
aactggattaaaacaa

SEQ ID NO: 4240523 - DNA, 16 bp, Homo sapiens
aactggattaaactta

SEQ ID NO: 4240524 - DNA, 16 bp, Homo sapiens
aactggtattgtttac

SEQ ID NO: 4240525 - DNA, 18 bp, Homo sapiens
aacttaaaaattaatatg

SEQ ID NO: 4240526 - DNA, 15 bp, Homo sapiens
aacttaatctaaatg

SEQ ID NO: 4240527 - DNA, 21 bp, Homo sapiens
aacttagactcctcttcccag

SEQ ID NO: 4240528 - DNA, 14 bp, Homo sapiens
aacttcacatattg

SEQ ID NO: 4240529 - DNA, 23 bp, Homo sapiens
aacttcagttttatttttgccaa

SEQ ID NO: 4240530 - DNA, 13 bp, Homo sapiens
aacttgtgaatgc

SEQ ID NO: 4240531 - DNA, 17 bp, Homo sapiens
aacttgtgaatgcttct

SEQ ID NO: 4240532 - DNA, 13 bp, Homo sapiens
aactttacctttt

SEQ ID NO: 4240533 - DNA, 16 bp, Homo sapiens
aactttactctgtgtt

SEQ ID NO: 4240534 - DNA, 18 bp, Homo sapiens
aactttactctgtgttta

SEQ ID NO: 4240535 - DNA, 13 bp, Homo sapiens
aactttgaagcca

SEQ ID NO: 4240536 - DNA, 14 bp, Homo sapiens
aactttgaagccat

SEQ ID NO: 4240537 - DNA, 14 bp, Homo sapiens
aactttgacctctg

SEQ ID NO: 4240538 - DNA, 15 bp, Homo sapiens
aacttttataaactt

SEQ ID NO: 4240539 - DNA, 16 bp, Homo sapiens
aacttttataaacttt

SEQ ID NO: 4240540 - DNA, 15 bp, Homo sapiens
aagaaaaaggatgca

SEQ ID NO: 4240541 - DNA, 17 bp, Homo sapiens
aagaaaaaggatgcaca

SEQ ID NO: 4240542 - DNA, 22 bp, Homo sapiens
aagaaaaaggatgcacagagtt

SEQ ID NO: 4240543 - DNA, 16 bp, Homo sapiens
aagaacacattttaaa

SEQ ID NO: 4240544 - DNA, 11 bp, Homo sapiens
aagaagacata

SEQ ID NO: 4240545 - DNA, 12 bp, Homo sapiens
aagaatatatat

SEQ ID NO: 4240546 - DNA, 14 bp, Homo sapiens
aagaatatttttag

SEQ ID NO: 4240547 - DNA, 23 bp, Homo sapiens
aagacaataattctacatgttgt

SEQ ID NO: 4240548 - DNA, 22 bp, Homo sapiens
aagacaatgacttactgtacat

SEQ ID NO: 4240549 - DNA, 17 bp, Homo sapiens
aagaccacgtttctaaa

SEQ ID NO: 4240550 - DNA, 17 bp, Homo sapiens
aagactgagtacgttgt

SEQ ID NO: 4240551 - DNA, 13 bp, Homo sapiens
aagacttgagaca

SEQ ID NO: 4240552 - DNA, 21 bp, Homo sapiens
aagacttgagacaatgttttc

SEQ ID NO: 4240553 - DNA, 13 bp, Homo sapiens
aagagacaaagat

SEQ ID NO: 4240554 - DNA, 19 bp, Homo sapiens
aagagacaaagatttcttc

SEQ ID NO: 4240555 - DNA, 14 bp, Homo sapiens
aagagggacagagc

SEQ ID NO: 4240556 - DNA, 17 bp, Homo sapiens
aagagggacagagcccg

SEQ ID NO: 4240557 - DNA, 23 bp, Homo sapiens
aagatacagttactcagaattct

SEQ ID NO: 4240558 - DNA, 17 bp, Homo sapiens
aagatatggagaattgc

SEQ ID NO: 4240559 - DNA, 14 bp, Homo sapiens
aagatattgaagga

SEQ ID NO: 4240560 - DNA, 22 bp, Homo sapiens
aagatgatttaagtatacagga

SEQ ID NO: 4240561 - DNA, 16 bp, Homo sapiens
aagatggaaatacagt

SEQ ID NO: 4240562 - DNA, 17 bp, Homo sapiens
aagatggtttcaattca

SEQ ID NO: 4240563 - DNA, 18 bp, Homo sapiens
aagattaggagaaacaca

SEQ ID NO: 4240564 - DNA, 13 bp, Homo sapiens
aagcactagagaa

SEQ ID NO: 4240565 - DNA, 20 bp, Homo sapiens
aagcactagagaatgcacag

SEQ ID NO: 4240566 - DNA, 17 bp, Homo sapiens
aagcagcgtttctatga

SEQ ID NO: 4240567 - DNA, 22 bp, Homo sapiens
aagcagcgtttctatgacacat

SEQ ID NO: 4240568 - DNA, 22 bp, Homo sapiens
aagccattaaatgaatattttg

SEQ ID NO: 4240569 - DNA, 13 bp, Homo sapiens
aagctagtgtttc

SEQ ID NO: 4240570 - DNA, 15 bp, Homo sapiens
aagctagtgtttcta

SEQ ID NO: 4240571 - DNA, 18 bp, Homo sapiens
aagctcaaataaaaataa

SEQ ID NO: 4240572 - DNA, 19 bp, Homo sapiens
aagctcccacacccacctc

SEQ ID NO: 4240573 - DNA, 23 bp, Homo sapiens
aagctcccacacccacctctgcc

SEQ ID NO: 4240574 - DNA, 20 bp, Homo sapiens
aagcttcaaagtttatatgc

SEQ ID NO: 4240575 - DNA, 17 bp, Homo sapiens
aaggatgcttgtacata

SEQ ID NO: 4240576 - DNA, 13 bp, Homo sapiens
aaggattgaaaat

SEQ ID NO: 4240577 - DNA, 19 bp, Homo sapiens
aagggaacagcctgagccg

SEQ ID NO: 4240578 - DNA, 20 bp, Homo sapiens
aagggcatcatcctcagcag

SEQ ID NO: 4240579 - DNA, 18 bp, Homo sapiens
aaggtacaactgtattta

SEQ ID NO: 4240580 - DNA, 19 bp, Homo sapiens
aaggtcattttttttaaga

SEQ ID NO: 4240581 - DNA, 16 bp, Homo sapiens
aaggttggttgctaag

SEQ ID NO: 4240582 - DNA, 15 bp, Homo sapiens
aaggttttgtatttt

SEQ ID NO: 4240583 - DNA, 17 bp, Homo sapiens
aagtaaagccattaaat

SEQ ID NO: 4240584 - DNA, 15 bp, Homo sapiens
aagtaaatatatatg

SEQ ID NO: 4240585 - DNA, 17 bp, Homo sapiens
aagtaacttatttgact

SEQ ID NO: 4240586 - DNA, 16 bp, Homo sapiens
aagtaatatgcacaca

SEQ ID NO: 4240587 - DNA, 20 bp, Homo sapiens
aagtaatatgcacacatttt

SEQ ID NO: 4240588 - DNA, 19 bp, Homo sapiens
aagtacactgtttcaaact

SEQ ID NO: 4240589 - DNA, 20 bp, Homo sapiens
aagtacactgtttcaaactt

SEQ ID NO: 4240590 - DNA, 14 bp, Homo sapiens
aagtactgtttacc

SEQ ID NO: 4240591 - DNA, 18 bp, Homo sapiens
aagtagaaaagttgcaga

SEQ ID NO: 4240592 - DNA, 18 bp, Homo sapiens
aagtagacaatcattgtt

SEQ ID NO: 4240593 - DNA, 21 bp, Homo sapiens
aagtagacaatcattgttttg

SEQ ID NO: 4240594 - DNA, 14 bp, Homo sapiens
aagtagcctctggg

SEQ ID NO: 4240595 - DNA, 19 bp, Homo sapiens
aagtagtgggcatttcata

SEQ ID NO: 4240596 - DNA, 23 bp, Homo sapiens
aagtatacaggaggatgtgaata

SEQ ID NO: 4240597 - DNA, 23 bp, Homo sapiens
aagtatagagagaagttcataca

SEQ ID NO: 4240598 - DNA, 17 bp, Homo sapiens
aagtatccctactgtaa

SEQ ID NO: 4240599 - DNA, 18 bp, Homo sapiens
aagtatccctactgtaat

SEQ ID NO: 4240600 - DNA, 20 bp, Homo sapiens
aagtatgacccacattactt

SEQ ID NO: 4240601 - DNA, 15 bp, Homo sapiens
aagtattataccttt

SEQ ID NO: 4240602 - DNA, 16 bp, Homo sapiens
aagtattatacctttt

SEQ ID NO: 4240603 - DNA, 14 bp, Homo sapiens
aagtcaaaatatgt

SEQ ID NO: 4240604 - DNA, 18 bp, Homo sapiens
aagtcatttttgtatttt

SEQ ID NO: 4240605 - DNA, 17 bp, Homo sapiens
aagtcgttttccaaact

SEQ ID NO: 4240606 - DNA, 13 bp, Homo sapiens
aagtgcctgctgg

SEQ ID NO: 4240607 - DNA, 13 bp, Homo sapiens
aagtgctgcattt

SEQ ID NO: 4240608 - DNA, 22 bp, Homo sapiens
aagtgctgcatttaaaagatac

SEQ ID NO: 4240609 - DNA, 17 bp, Homo sapiens
aagtgggctcctgacaa

SEQ ID NO: 4240610 - DNA, 23 bp, Homo sapiens
aagtgtatttttttactaataga

SEQ ID NO: 4240611 - DNA, 13 bp, Homo sapiens
aagttaataatgt

SEQ ID NO: 4240612 - DNA, 24 bp, Homo sapiens
aagttaataatgtattgtaatctt

SEQ ID NO: 4240613 - DNA, 19 bp, Homo sapiens
aagttaattcacctatgtt

SEQ ID NO: 4240614 - DNA, 14 bp, Homo sapiens
aagttatgtattta

SEQ ID NO: 4240615 - DNA, 19 bp, Homo sapiens
aagttctcaaagttaattc

SEQ ID NO: 4240616 - DNA, 18 bp, Homo sapiens
aagttgcagatgtattga

SEQ ID NO: 4240617 - DNA, 13 bp, Homo sapiens
aagttgttattgt

SEQ ID NO: 4240618 - DNA, 13 bp, Homo sapiens
aagtttatatgcc

SEQ ID NO: 4240619 - DNA, 20 bp, Homo sapiens
aagttttaactttaatacag

SEQ ID NO: 4240620 - DNA, 15 bp, Homo sapiens
aaaataaataatttt

SEQ ID NO: 4240621 - DNA, 15 bp, Homo sapiens
aaaatacaatcctgt

SEQ ID NO: 4240622 - DNA, 14 bp, Homo sapiens
aaaataccagccag

SEQ ID NO: 4240623 - DNA, 21 bp, Homo sapiens
aaaatagagcttttaaaaatg

SEQ ID NO: 4240624 - DNA, 21 bp, Homo sapiens
aaaatatgtaagaacacattt

SEQ ID NO: 4240625 - DNA, 15 bp, Homo sapiens
aaaatattttttgca

SEQ ID NO: 4240626 - DNA, 23 bp, Homo sapiens
aaaatgcttaaaaaataatacaa

SEQ ID NO: 4240627 - DNA, 13 bp, Homo sapiens
aaaatgtattttt

SEQ ID NO: 4240628 - DNA, 16 bp, Homo sapiens
aaaatgtatttttcta

SEQ ID NO: 4240629 - DNA, 18 bp, Homo sapiens
aaaatgtcctgcctttta

SEQ ID NO: 4240630 - DNA, 21 bp, Homo sapiens
aaaattacgtttgttattcct

SEQ ID NO: 4240631 - DNA, 13 bp, Homo sapiens
aaaattcagtttt

SEQ ID NO: 4240632 - DNA, 20 bp, Homo sapiens
aaaattcagtttttgtatct

SEQ ID NO: 4240633 - DNA, 21 bp, Homo sapiens
aaaattcagtttttgtatctt

SEQ ID NO: 4240634 - DNA, 17 bp, Homo sapiens
aaaattgatattatatt

SEQ ID NO: 4240635 - DNA, 18 bp, Homo sapiens
aaaatttagccctttaaa

SEQ ID NO: 4240636 - DNA, 20 bp, Homo sapiens
aaacaacagctcgatccaaa

SEQ ID NO: 4240637 - DNA, 22 bp, Homo sapiens
aaacaacagctcgatccaaatt

SEQ ID NO: 4240638 - DNA, 13 bp, Homo sapiens
aaacaataatgca

SEQ ID NO: 4240639 - DNA, 20 bp, Homo sapiens
aaacaattttctgtaatctt

SEQ ID NO: 4240640 - DNA, 12 bp, Homo sapiens
aaacacattttt

SEQ ID NO: 4240641 - DNA, 15 bp, Homo sapiens
aaacactacacattt

SEQ ID NO: 4240642 - DNA, 17 bp, Homo sapiens
aaacactacacatttga

SEQ ID NO: 4240643 - DNA, 16 bp, Homo sapiens
aaacagacaaaaacaa

SEQ ID NO: 4240644 - DNA, 19 bp, Homo sapiens
aaacagtagttgtattctt

SEQ ID NO: 4240645 - DNA, 20 bp, Homo sapiens
aaacagtagttgtattcttc

SEQ ID NO: 4240646 - DNA, 22 bp, Homo sapiens
aaacagtatttctggtgtatat

SEQ ID NO: 4240647 - DNA, 14 bp, Homo sapiens
aaacagttatttct

SEQ ID NO: 4240648 - DNA, 15 bp, Homo sapiens
aaacatgtatttatg

SEQ ID NO: 4240649 - DNA, 17 bp, Homo sapiens
aaactcttaatctgtgt

SEQ ID NO: 4240650 - DNA, 14 bp, Homo sapiens
aaactgaatatttt

SEQ ID NO: 4240651 - DNA, 15 bp, Homo sapiens
aaactgaatattttg

SEQ ID NO: 4240652 - DNA, 17 bp, Homo sapiens
aaacttaatctaaatgg

SEQ ID NO: 4240653 - DNA, 15 bp, Homo sapiens
aaacttgtgaatgct

SEQ ID NO: 4240654 - DNA, 17 bp, Homo sapiens
aaactttacctttttta

SEQ ID NO: 4240655 - DNA, 20 bp, Homo sapiens
aaacttttttatatcttttg

SEQ ID NO: 4240656 - DNA, 23 bp, Homo sapiens
aaagacttgagacaatgttttct

SEQ ID NO: 4240657 - DNA, 23 bp, Homo sapiens
aaagatatggagaattgctgaag

SEQ ID NO: 4240658 - DNA, 12 bp, Homo sapiens
aaagatattttg

SEQ ID NO: 4240659 - DNA, 15 bp, Homo sapiens
aaagcagcgtttcta

SEQ ID NO: 4240660 - DNA, 18 bp, Homo sapiens
aaaggcagagaagttctc

SEQ ID NO: 4240661 - DNA, 17 bp, Homo sapiens
aaaggttttgtattttt

SEQ ID NO: 4240662 - DNA, 12 bp, Homo sapiens
aaagtaagttaa

SEQ ID NO: 4240663 - DNA, 13 bp, Homo sapiens
aaagtaagttaat

SEQ ID NO: 4240664 - DNA, 15 bp, Homo sapiens
aaagtaagttaataa

SEQ ID NO: 4240665 - DNA, 21 bp, Homo sapiens
aaagtaagttaataatgtatt

SEQ ID NO: 4240666 - DNA, 18 bp, Homo sapiens
aaagtacactgtttcaaa

SEQ ID NO: 4240667 - DNA, 19 bp, Homo sapiens
aaagtacactgtttcaaac

SEQ ID NO: 4240668 - DNA, 18 bp, Homo sapiens
aaagtcgttttccaaact

SEQ ID NO: 4240669 - DNA, 20 bp, Homo sapiens
aaagttaattcacctatgtt

SEQ ID NO: 4240670 - DNA, 18 bp, Homo sapiens
aaagttgcagatgtattg

SEQ ID NO: 4240671 - DNA, 13 bp, Homo sapiens
aaataaaactgaa

SEQ ID NO: 4240672 - DNA, 17 bp, Homo sapiens
aaataaataattttaat

SEQ ID NO: 4240673 - DNA, 19 bp, Homo sapiens
aaataagacaaaaataata

SEQ ID NO: 4240674 - DNA, 13 bp, Homo sapiens
aaataatgtgaaa

SEQ ID NO: 4240675 - DNA, 12 bp, Homo sapiens
aaataattttaa

SEQ ID NO: 4240676 - DNA, 13 bp, Homo sapiens
aaataattttaat

SEQ ID NO: 4240677 - DNA, 16 bp, Homo sapiens
aaatacaatcctgttt

SEQ ID NO: 4240678 - DNA, 16 bp, Homo sapiens
aaatactgtgcagaat

SEQ ID NO: 4240679 - DNA, 20 bp, Homo sapiens
aaatagagcttttaaaaatg

SEQ ID NO: 4240680 - DNA, 20 bp, Homo sapiens
aaatagttagatctttgtaa

SEQ ID NO: 4240681 - DNA, 19 bp, Homo sapiens
aaatataagacatttgttt

SEQ ID NO: 4240682 - DNA, 21 bp, Homo sapiens
aaatatgaaccctttgtttct

SEQ ID NO: 4240683 - DNA, 15 bp, Homo sapiens
aaatatgtaagaaca

SEQ ID NO: 4240684 - DNA, 15 bp, Homo sapiens
aaatatttaatatca

SEQ ID NO: 4240685 - DNA, 14 bp, Homo sapiens
aaatcatgtatgtt

SEQ ID NO: 4240686 - DNA, 15 bp, Homo sapiens
aaatctcaaatttct

SEQ ID NO: 4240687 - DNA, 16 bp, Homo sapiens
aaatctcaaatttcta

SEQ ID NO: 4240688 - DNA, 19 bp, Homo sapiens
aaatctccaaaataaaact

SEQ ID NO: 4240689 - DNA, 18 bp, Homo sapiens
aaatgaattgaaaaacaa

SEQ ID NO: 4240690 - DNA, 16 bp, Homo sapiens
aaatgacagatttctg

SEQ ID NO: 4240691 - DNA, 17 bp, Homo sapiens
aaatgacagatttctgt

SEQ ID NO: 4240692 - DNA, 15 bp, Homo sapiens
aaatgcattgaacat

SEQ ID NO: 4240693 - DNA, 13 bp, Homo sapiens
aaatgcttaaaaa

SEQ ID NO: 4240694 - DNA, 15 bp, Homo sapiens
aaatgcttaaaaaat

SEQ ID NO: 4240695 - DNA, 19 bp, Homo sapiens
aaatggactggtttgagat

SEQ ID NO: 4240696 - DNA, 17 bp, Homo sapiens
aaatggatgcaaagtac

SEQ ID NO: 4240697 - DNA, 16 bp, Homo sapiens
aaatgggaaaaaactt

SEQ ID NO: 4240698 - DNA, 21 bp, Homo sapiens
aaatgggaaaaaacttaaaaa

SEQ ID NO: 4240699 - DNA, 19 bp, Homo sapiens
aaatgggggtgcatttgag

SEQ ID NO: 4240700 - DNA, 12 bp, Homo sapiens
aaatgtattttt

SEQ ID NO: 4240701 - DNA, 13 bp, Homo sapiens
aaatgtgtttgct

SEQ ID NO: 4240702 - DNA, 15 bp, Homo sapiens
aaatgtttttatttt

SEQ ID NO: 4240703 - DNA, 13 bp, Homo sapiens
aaattaactttta

SEQ ID NO: 4240704 - DNA, 14 bp, Homo sapiens
aaattaacttttat

SEQ ID NO: 4240705 - DNA, 19 bp, Homo sapiens
aaattaacttttataaact

SEQ ID NO: 4240706 - DNA, 23 bp, Homo sapiens
aaattaacttttataaactttac

SEQ ID NO: 4240707 - DNA, 12 bp, Homo sapiens
aaattaagattt

SEQ ID NO: 4240708 - DNA, 16 bp, Homo sapiens
aaattaagatttcctt

SEQ ID NO: 4240709 - DNA, 21 bp, Homo sapiens
aaattaatatggtgtattttt

SEQ ID NO: 4240710 - DNA, 23 bp, Homo sapiens
aaattacgtttgttattcctagt

SEQ ID NO: 4240711 - DNA, 18 bp, Homo sapiens
aaattagataaattgtag

SEQ ID NO: 4240712 - DNA, 13 bp, Homo sapiens
aaattcagttttt

SEQ ID NO: 4240713 - DNA, 21 bp, Homo sapiens
aaattcagtttttgtatcttg

SEQ ID NO: 4240714 - DNA, 19 bp, Homo sapiens
aaattcgcccgagctgttt

SEQ ID NO: 4240715 - DNA, 16 bp, Homo sapiens
aaattctatgttaaat

SEQ ID NO: 4240716 - DNA, 22 bp, Homo sapiens
aaattctatgttaaatactgtg

SEQ ID NO: 4240717 - DNA, 14 bp, Homo sapiens
aaattgatattata

SEQ ID NO: 4240718 - DNA, 21 bp, Homo sapiens
aaattgtgcttctccccagaa

SEQ ID NO: 4240719 - DNA, 16 bp, Homo sapiens
aaatttaaaattacgt

SEQ ID NO: 4240720 - DNA, 18 bp, Homo sapiens
aaatttagccctttaaaa

SEQ ID NO: 4240721 - DNA, 12 bp, Homo sapiens
aaatttctaaat

SEQ ID NO: 4240722 - DNA, 17 bp, Homo sapiens
aacaagaccacgtttct

SEQ ID NO: 4240723 - DNA, 15 bp, Homo sapiens
aacaagtaaatatat

SEQ ID NO: 4240724 - DNA, 20 bp, Homo sapiens
aacaagtcatttttgtattt

SEQ ID NO: 4240725 - DNA, 21 bp, Homo sapiens
aacaagtcatttttgtatttt

SEQ ID NO: 4240726 - DNA, 13 bp, Homo sapiens
aacacattttaaa

SEQ ID NO: 4240727 - DNA, 13 bp, Homo sapiens
aacagaaatgtac

SEQ ID NO: 4240728 - DNA, 14 bp, Homo sapiens
aacagaaatgtaca

SEQ ID NO: 4240729 - DNA, 21 bp, Homo sapiens
aacagaaatgtacagcaagga

SEQ ID NO: 4240730 - DNA, 13 bp, Homo sapiens
aacagcctgagcc

SEQ ID NO: 4240731 - DNA, 24 bp, Homo sapiens
aacagctcgatccaaattgtgctt

SEQ ID NO: 4240732 - DNA, 22 bp, Homo sapiens
aacagtatttctggtgtatatt

SEQ ID NO: 4240733 - DNA, 11 bp, Homo sapiens
aacagtggctg

SEQ ID NO: 4240734 - DNA, 16 bp, Homo sapiens
aacataaaaactgatt

SEQ ID NO: 4240735 - DNA, 16 bp, Homo sapiens
aacatacataatacaa

SEQ ID NO: 4240736 - DNA, 19 bp, Homo sapiens
aacatacttcaaaaataat

SEQ ID NO: 4240737 - DNA, 18 bp, Homo sapiens
tgcataccacttttgttc

SEQ ID NO: 4240738 - DNA, 14 bp, Homo sapiens
tgcatattcaatgt

SEQ ID NO: 4240739 - DNA, 16 bp, Homo sapiens
tgcatccacttcagga

SEQ ID NO: 4240740 - DNA, 19 bp, Homo sapiens
tgcatccacttcaggagcc

SEQ ID NO: 4240741 - DNA, 12 bp, Homo sapiens
tgcatctggcac

SEQ ID NO: 4240742 - DNA, 20 bp, Homo sapiens
tgcatctggcacgtggccag

SEQ ID NO: 4240743 - DNA, 16 bp, Homo sapiens
tgcatgcaatttgaag

SEQ ID NO: 4240744 - DNA, 21 bp, Homo sapiens
tgcattaaaggagatcttccc

SEQ ID NO: 4240745 - DNA, 21 bp, Homo sapiens
tgcattatctagatactgtat

SEQ ID NO: 4240746 - DNA, 22 bp, Homo sapiens
tgcattatctagatactgtatc

SEQ ID NO: 4240747 - DNA, 17 bp, Homo sapiens
tgcattcattctgagcc

SEQ ID NO: 4240748 - DNA, 16 bp, Homo sapiens
tgcatttaaaagatac

SEQ ID NO: 4240749 - DNA, 19 bp, Homo sapiens
tgcatttgaaaattttgat

SEQ ID NO: 4240750 - DNA, 23 bp, Homo sapiens
tgcatttgaaaattttgatgttt

SEQ ID NO: 4240751 - DNA, 19 bp, Homo sapiens
tgcatttgaggtctgttct

SEQ ID NO: 4240752 - DNA, 20 bp, Homo sapiens
tgcatttgaggtctgttctt

SEQ ID NO: 4240753 - DNA, 15 bp, Homo sapiens
tgccaaagcttgtgg

SEQ ID NO: 4240754 - DNA, 22 bp, Homo sapiens
tgccagtggagacggaatctgc

SEQ ID NO: 4240755 - DNA, 17 bp, Homo sapiens
tgcccaccccagcatca

SEQ ID NO: 4240756 - DNA, 15 bp, Homo sapiens
tgcccgcgccaggcc

SEQ ID NO: 4240757 - DNA, 17 bp, Homo sapiens
tgccctaaagtgtattt

SEQ ID NO: 4240758 - DNA, 19 bp, Homo sapiens
tgcccttacacgtgcgtgt

SEQ ID NO: 4240759 - DNA, 20 bp, Homo sapiens
tgccgaggtgcgtcccccgt

SEQ ID NO: 4240760 - DNA, 15 bp, Homo sapiens
tgccggttccgcccg

SEQ ID NO: 4240761 - DNA, 14 bp, Homo sapiens
tgcctcagcctccg

SEQ ID NO: 4240762 - DNA, 15 bp, Homo sapiens
tgcctggcaggctgt

SEQ ID NO: 4240763 - DNA, 15 bp, Homo sapiens
tgcctggttcgtgcc

SEQ ID NO: 4240764 - DNA, 18 bp, Homo sapiens
tgcctggttcgtgccatg

SEQ ID NO: 4240765 - DNA, 19 bp, Homo sapiens
tgcctggttcgtgccatgc

SEQ ID NO: 4240766 - DNA, 19 bp, Homo sapiens
tgcctgttttgagaccaga

SEQ ID NO: 4240767 - DNA, 22 bp, Homo sapiens
tgcgctcttgggaccccagaga

SEQ ID NO: 4240768 - DNA, 18 bp, Homo sapiens
tgcgtcccccgttgtgcc

SEQ ID NO: 4240769 - DNA, 22 bp, Homo sapiens
tgcgtcccccgttgtgcctggt

SEQ ID NO: 4240770 - DNA, 18 bp, Homo sapiens
tgcgtgtgagtgtgtgtg

SEQ ID NO: 4240771 - DNA, 19 bp, Homo sapiens
tgctaagaagcctataaga

SEQ ID NO: 4240772 - DNA, 19 bp, Homo sapiens
tgctcaacagacaattaga

SEQ ID NO: 4240773 - DNA, 22 bp, Homo sapiens
tgctcaatctctgttgcacctg

SEQ ID NO: 4240774 - DNA, 18 bp, Homo sapiens
tgctcctagcagacagaa

SEQ ID NO: 4240775 - DNA, 20 bp, Homo sapiens
tgctctgtaggagctaccct

SEQ ID NO: 4240776 - DNA, 17 bp, Homo sapiens
tgctgcatttaaaagat

SEQ ID NO: 4240777 - DNA, 18 bp, Homo sapiens
tgctgcatttaaaagata

SEQ ID NO: 4240778 - DNA, 14 bp, Homo sapiens
tgctgggtgccagg

SEQ ID NO: 4240779 - DNA, 13 bp, Homo sapiens
tgctggtgcctct

SEQ ID NO: 4240780 - DNA, 22 bp, Homo sapiens
tgctggtgtactctaggacttc

SEQ ID NO: 4240781 - DNA, 17 bp, Homo sapiens
tgcttaaaaaagctaat

SEQ ID NO: 4240782 - DNA, 20 bp, Homo sapiens
tgcttaaactaaataatgaa

SEQ ID NO: 4240783 - DNA, 19 bp, Homo sapiens
tgcttaacttcacatattg

SEQ ID NO: 4240784 - DNA, 14 bp, Homo sapiens
tgcttagtaaaatt

SEQ ID NO: 4240785 - DNA, 17 bp, Homo sapiens
tgcttattgcttagtaa

SEQ ID NO: 4240786 - DNA, 21 bp, Homo sapiens
tgcttattgcttagtaaaatt

SEQ ID NO: 4240787 - DNA, 18 bp, Homo sapiens
tgcttctcatcttgtgaa

SEQ ID NO: 4240788 - DNA, 15 bp, Homo sapiens
tgcttctccccagaa

SEQ ID NO: 4240789 - DNA, 19 bp, Homo sapiens
tgcttgagctttctgtgca

SEQ ID NO: 4240790 - DNA, 20 bp, Homo sapiens
tgcttgagctttctgtgcat

SEQ ID NO: 4240791 - DNA, 21 bp, Homo sapiens
tgcttgagctttctgtgcatg

SEQ ID NO: 4240792 - DNA, 13 bp, Homo sapiens
tgcttgtacataa

SEQ ID NO: 4240793 - DNA, 14 bp, Homo sapiens
tgcttgtacataat

SEQ ID NO: 4240794 - DNA, 22 bp, Homo sapiens
tgctttgtgatttttgtaattt

SEQ ID NO: 4240795 - DNA, 20 bp, Homo sapiens
tggaaactgctaaattctat

SEQ ID NO: 4240796 - DNA, 22 bp, Homo sapiens
tggaaactgctaaattctatgt

SEQ ID NO: 4240797 - DNA, 15 bp, Homo sapiens
tggaaatacagttat

SEQ ID NO: 4240798 - DNA, 17 bp, Homo sapiens
tggaaatggatgcaaag

SEQ ID NO: 4240799 - DNA, 17 bp, Homo sapiens
tggaaccaaagctggcc

SEQ ID NO: 4240800 - DNA, 15 bp, Homo sapiens
tggaagccgcgcggc

SEQ ID NO: 4240801 - DNA, 21 bp, Homo sapiens
tggaattaaaaggatagtatt

SEQ ID NO: 4240802 - DNA, 19 bp, Homo sapiens
tggacaagacatgcttggg

SEQ ID NO: 4240803 - DNA, 20 bp, Homo sapiens
tggaccaattattgatatat

SEQ ID NO: 4240804 - DNA, 22 bp, Homo sapiens
tggaccaattattgatatatat

SEQ ID NO: 4240805 - DNA, 14 bp, Homo sapiens
tggactccagcctg

SEQ ID NO: 4240806 - DNA, 21 bp, Homo sapiens
tggactccagcctgcctggca

SEQ ID NO: 4240807 - DNA, 23 bp, Homo sapiens
tggactccagcctgcctggcagg

SEQ ID NO: 4240808 - DNA, 17 bp, Homo sapiens
tggagaactcagtgcca

SEQ ID NO: 4240809 - DNA, 22 bp, Homo sapiens
tggagaattgctgaagggcatt

SEQ ID NO: 4240810 - DNA, 16 bp, Homo sapiens
tggagaccaggctcct

SEQ ID NO: 4240811 - DNA, 16 bp, Homo sapiens
tggagactctgagagc

SEQ ID NO: 4240812 - DNA, 22 bp, Homo sapiens
tggagcactgtaaaaagagctg

SEQ ID NO: 4240813 - DNA, 19 bp, Homo sapiens
tggaggagggagagccctg

SEQ ID NO: 4240814 - DNA, 16 bp, Homo sapiens
tggaggcctacctctc

SEQ ID NO: 4240815 - DNA, 18 bp, Homo sapiens
tggaggtctctccctccc

SEQ ID NO: 4240816 - DNA, 12 bp, Homo sapiens
tggattaaaaca

SEQ ID NO: 4240817 - DNA, 13 bp, Homo sapiens
tggattaaaacaa

SEQ ID NO: 4240818 - DNA, 22 bp, Homo sapiens
tggattaaacttaatctaaatg

SEQ ID NO: 4240819 - DNA, 23 bp, Homo sapiens
tggatttaagagtattttaagaa

SEQ ID NO: 4240820 - DNA, 16 bp, Homo sapiens
tggcaataaataaagc

SEQ ID NO: 4240821 - DNA, 16 bp, Homo sapiens
tggcaatgcttaaact

SEQ ID NO: 4240822 - DNA, 19 bp, Homo sapiens
tggcaattccaatatttct

SEQ ID NO: 4240823 - DNA, 18 bp, Homo sapiens
tggcacgtggccaggagc

SEQ ID NO: 4240824 - DNA, 19 bp, Homo sapiens
tggcacgtggccaggagcc

SEQ ID NO: 4240825 - DNA, 20 bp, Homo sapiens
tggcagatactccttttgcc

SEQ ID NO: 4240826 - DNA, 19 bp, Homo sapiens
tggcaggctactctgccca

SEQ ID NO: 4240827 - DNA, 14 bp, Homo sapiens
tggcagtgactttg

SEQ ID NO: 4240828 - DNA, 11 bp, Homo sapiens
tggccaggagc

SEQ ID NO: 4240829 - DNA, 16 bp, Homo sapiens
tggccaggagccctgg

SEQ ID NO: 4240830 - DNA, 19 bp, Homo sapiens
tggccaggcctcttggcag

SEQ ID NO: 4240831 - DNA, 17 bp, Homo sapiens
tggcccagttgtccatg

SEQ ID NO: 4240832 - DNA, 20 bp, Homo sapiens
tggcctagcatacgtacaca

SEQ ID NO: 4240833 - DNA, 13 bp, Homo sapiens
tggcctcttcaga

SEQ ID NO: 4240834 - DNA, 15 bp, Homo sapiens
tggcggcccggccgg

SEQ ID NO: 4240835 - DNA, 12 bp, Homo sapiens
tggctgcttctc

SEQ ID NO: 4240836 - DNA, 15 bp, Homo sapiens
tggctgcttctctct

SEQ ID NO: 4240837 - DNA, 16 bp, Homo sapiens
tggcttttgtgcatta

SEQ ID NO: 4240838 - DNA, 15 bp, Homo sapiens
tgggaaatgagccag

SEQ ID NO: 4240839 - DNA, 15 bp, Homo sapiens
tgggaaggccagctg

SEQ ID NO: 4240840 - DNA, 18 bp, Homo sapiens
tgggagctgctgggtggc

SEQ ID NO: 4240841 - DNA, 15 bp, Homo sapiens
tgggaggggccggag

SEQ ID NO: 4240842 - DNA, 23 bp, Homo sapiens
tgggcagggaaggaatcctggtg

SEQ ID NO: 4240843 - DNA, 20 bp, Homo sapiens
tgggccaatttactggccac

SEQ ID NO: 4240844 - DNA, 23 bp, Homo sapiens
tggggtttagaaccccaggtgag

SEQ ID NO: 4240845 - DNA, 19 bp, Homo sapiens
tgggtcctactcctggagc

SEQ ID NO: 4240846 - DNA, 17 bp, Homo sapiens
tgggtgaagtgcctgct

SEQ ID NO: 4240847 - DNA, 20 bp, Homo sapiens
tgggtgaagtgcctgctggg

SEQ ID NO: 4240848 - DNA, 13 bp, Homo sapiens
tgggtgccaggtg

SEQ ID NO: 4240849 - DNA, 17 bp, Homo sapiens
tgggtgtatataatttt

SEQ ID NO: 4240850 - DNA, 15 bp, Homo sapiens
tgggtttgagacaga

SEQ ID NO: 4240851 - DNA, 18 bp, Homo sapiens
tggtataatgtttaaatc

SEQ ID NO: 4240852 - DNA, 16 bp, Homo sapiens
tggtatcatatattaa

SEQ ID NO: 4240853 - DNA, 21 bp, Homo sapiens
caatgcttaaactaaataatg

SEQ ID NO: 4240854 - DNA, 14 bp, Homo sapiens
caatgtgtttttct

SEQ ID NO: 4240855 - DNA, 14 bp, Homo sapiens
caatgttttcttca

SEQ ID NO: 4240856 - DNA, 14 bp, Homo sapiens
caattattgatata

SEQ ID NO: 4240857 - DNA, 19 bp, Homo sapiens
caattcagattgtcttgca

SEQ ID NO: 4240858 - DNA, 16 bp, Homo sapiens
caattggcagtgactt

SEQ ID NO: 4240859 - DNA, 18 bp, Homo sapiens
caattggcagtgactttg

SEQ ID NO: 4240860 - DNA, 24 bp, Homo sapiens
caatttgaagtaacttatttgact

SEQ ID NO: 4240861 - DNA, 21 bp, Homo sapiens
caattttttttttcctcttca

SEQ ID NO: 4240862 - DNA, 19 bp, Homo sapiens
cacaacccaagcaacattt

SEQ ID NO: 4240863 - DNA, 17 bp, Homo sapiens
cacaagtagcctctggg

SEQ ID NO: 4240864 - DNA, 21 bp, Homo sapiens
cacaatgttccttttttgtat

SEQ ID NO: 4240865 - DNA, 12 bp, Homo sapiens
cacacatttttt

SEQ ID NO: 4240866 - DNA, 19 bp, Homo sapiens
cacacattttttaaatgca

SEQ ID NO: 4240867 - DNA, 14 bp, Homo sapiens
cacacccacctctg

SEQ ID NO: 4240868 - DNA, 16 bp, Homo sapiens
cacacccacctctgcc

SEQ ID NO: 4240869 - DNA, 17 bp, Homo sapiens
cacacggagctcctggc

SEQ ID NO: 4240870 - DNA, 21 bp, Homo sapiens
cacacgtccactcccaagcca

SEQ ID NO: 4240871 - DNA, 21 bp, Homo sapiens
cacagagttgttacattttta

SEQ ID NO: 4240872 - DNA, 19 bp, Homo sapiens
cacagatatactttgtgga

SEQ ID NO: 4240873 - DNA, 20 bp, Homo sapiens
cacagatatactttgtggac

SEQ ID NO: 4240874 - DNA, 22 bp, Homo sapiens
cacaggaaatgggaaaaaactt

SEQ ID NO: 4240875 - DNA, 19 bp, Homo sapiens
cacaggcagctctgagccg

SEQ ID NO: 4240876 - DNA, 13 bp, Homo sapiens
cacatattgattt

SEQ ID NO: 4240877 - DNA, 20 bp, Homo sapiens
cacatattgatttccgttaa

SEQ ID NO: 4240878 - DNA, 19 bp, Homo sapiens
cacatcagcacgatttctg

SEQ ID NO: 4240879 - DNA, 17 bp, Homo sapiens
cacatgcaaggtcattt

SEQ ID NO: 4240880 - DNA, 21 bp, Homo sapiens
cacattttttaaatgcacctg

SEQ ID NO: 4240881 - DNA, 22 bp, Homo sapiens
caccaagacttgttttatgctc

SEQ ID NO: 4240882 - DNA, 16 bp, Homo sapiens
caccacgattctccca

SEQ ID NO: 4240883 - DNA, 15 bp, Homo sapiens
caccacgtccagctg

SEQ ID NO: 4240884 - DNA, 20 bp, Homo sapiens
caccatgcccagctaatttt

SEQ ID NO: 4240885 - DNA, 14 bp, Homo sapiens
caccccacccttcc

SEQ ID NO: 4240886 - DNA, 15 bp, Homo sapiens
caccccatcccacac

SEQ ID NO: 4240887 - DNA, 22 bp, Homo sapiens
caccctgctttggcggcccggc

SEQ ID NO: 4240888 - DNA, 13 bp, Homo sapiens
cacccttcccctc

SEQ ID NO: 4240889 - DNA, 22 bp, Homo sapiens
cacccttcccctccttctccct

SEQ ID NO: 4240890 - DNA, 17 bp, Homo sapiens
cacctatgttattttgt

SEQ ID NO: 4240891 - DNA, 22 bp, Homo sapiens
cacctatgttattttgtgtaca

SEQ ID NO: 4240892 - DNA, 14 bp, Homo sapiens
cacctgagggggaa

SEQ ID NO: 4240893 - DNA, 15 bp, Homo sapiens
cacctgtctcagcct

SEQ ID NO: 4240894 - DNA, 16 bp, Homo sapiens
cacgatttctgtttag

SEQ ID NO: 4240895 - DNA, 16 bp, Homo sapiens
cacggagctcctggca

SEQ ID NO: 4240896 - DNA, 22 bp, Homo sapiens
cacggagctcctggcagcgaga

SEQ ID NO: 4240897 - DNA, 16 bp, Homo sapiens
cacgtggccaggagcc

SEQ ID NO: 4240898 - DNA, 23 bp, Homo sapiens
cacgtttctaaaggctacctttg

SEQ ID NO: 4240899 - DNA, 17 bp, Homo sapiens
cactacattctgttaat

SEQ ID NO: 4240900 - DNA, 21 bp, Homo sapiens
cactacattctgttaatcatt

SEQ ID NO: 4240901 - DNA, 17 bp, Homo sapiens
cactagtaagtaattat

SEQ ID NO: 4240902 - DNA, 20 bp, Homo sapiens
cactgcattcattctgagcc

SEQ ID NO: 4240903 - DNA, 21 bp, Homo sapiens
cactgcattcattctgagccc

SEQ ID NO: 4240904 - DNA, 17 bp, Homo sapiens
cactgtgggaaggccag

SEQ ID NO: 4240905 - DNA, 11 bp, Homo sapiens
cactgttctgc

SEQ ID NO: 4240906 - DNA, 17 bp, Homo sapiens
cactgttgaattttctc

SEQ ID NO: 4240907 - DNA, 13 bp, Homo sapiens
cacttacctgctt

SEQ ID NO: 4240908 - DNA, 17 bp, Homo sapiens
cacttacctgcttgagc

SEQ ID NO: 4240909 - DNA, 12 bp, Homo sapiens
cacttagtcctt

SEQ ID NO: 4240910 - DNA, 20 bp, Homo sapiens
cacttgaagcctaaatttgt

SEQ ID NO: 4240911 - DNA, 13 bp, Homo sapiens
cactttacctctt

SEQ ID NO: 4240912 - DNA, 14 bp, Homo sapiens
cacttttgttctgc

SEQ ID NO: 4240913 - DNA, 15 bp, Homo sapiens
cacttttgttctgct

SEQ ID NO: 4240914 - DNA, 19 bp, Homo sapiens
cacttttgttctgctttat

SEQ ID NO: 4240915 - DNA, 17 bp, Homo sapiens
cagaaatgtgttatcac

SEQ ID NO: 4240916 - DNA, 14 bp, Homo sapiens
cagaataatccagt

SEQ ID NO: 4240917 - DNA, 18 bp, Homo sapiens
cagaataatggaaacatt

SEQ ID NO: 4240918 - DNA, 19 bp, Homo sapiens
cagacacaatatgtatgct

SEQ ID NO: 4240919 - DNA, 21 bp, Homo sapiens
cagacagaaactggattaaaa

SEQ ID NO: 4240920 - DNA, 17 bp, Homo sapiens
cagaccaagtccaagcc

SEQ ID NO: 4240921 - DNA, 21 bp, Homo sapiens
cagactatttgctaatgtata

SEQ ID NO: 4240922 - DNA, 20 bp, Homo sapiens
cagagcccctcatgccacag

SEQ ID NO: 4240923 - DNA, 14 bp, Homo sapiens
cagagcccgggaga

SEQ ID NO: 4240924 - DNA, 15 bp, Homo sapiens
cagagttgttacatt

SEQ ID NO: 4240925 - DNA, 18 bp, Homo sapiens
cagagttgttacattttt

SEQ ID NO: 4240926 - DNA, 20 bp, Homo sapiens
cagatctctaacttcaccat

SEQ ID NO: 4240927 - DNA, 12 bp, Homo sapiens
cagatgtattga

SEQ ID NO: 4240928 - DNA, 13 bp, Homo sapiens
cagatttctgtaa

SEQ ID NO: 4240929 - DNA, 17 bp, Homo sapiens
cagatttttatttatga

SEQ ID NO: 4240930 - DNA, 21 bp, Homo sapiens
cagcaataaagcagcgtttct

SEQ ID NO: 4240931 - DNA, 20 bp, Homo sapiens
cagcacgatttctgtttaga

SEQ ID NO: 4240932 - DNA, 15 bp, Homo sapiens
cagcactttgggagg

SEQ ID NO: 4240933 - DNA, 19 bp, Homo sapiens
cagcagaaatgccttaccc

SEQ ID NO: 4240934 - DNA, 19 bp, Homo sapiens
cagcagggaccgggcgcag

SEQ ID NO: 4240935 - DNA, 15 bp, Homo sapiens
cagccaaaccctgtc

SEQ ID NO: 4240936 - DNA, 16 bp, Homo sapiens
cagccaaaccctgtct

SEQ ID NO: 4240937 - DNA, 22 bp, Homo sapiens
cagccagatggactccagcctg

SEQ ID NO: 4240938 - DNA, 21 bp, Homo sapiens
cagccccgggcggagccttcc

SEQ ID NO: 4240939 - DNA, 13 bp, Homo sapiens
cagccctctgtgg

SEQ ID NO: 4240940 - DNA, 19 bp, Homo sapiens
cagccctctgtggccagga

SEQ ID NO: 4240941 - DNA, 18 bp, Homo sapiens
cagccgtgtgtgcatgtg

SEQ ID NO: 4240942 - DNA, 19 bp, Homo sapiens
cagcctcccacccccatct

SEQ ID NO: 4240943 - DNA, 17 bp, Homo sapiens
cagcctttttgtaattt

SEQ ID NO: 4240944 - DNA, 16 bp, Homo sapiens
cagcgccacctggaag

SEQ ID NO: 4240945 - DNA, 19 bp, Homo sapiens
cagcgtttctatgacacat

SEQ ID NO: 4240946 - DNA, 13 bp, Homo sapiens
cagctagtgcctt

SEQ ID NO: 4240947 - DNA, 14 bp, Homo sapiens
cagctataattctg

SEQ ID NO: 4240948 - DNA, 16 bp, Homo sapiens
cagctataattctgtt

SEQ ID NO: 4240949 - DNA, 18 bp, Homo sapiens
cagctcgatccaaattgt

SEQ ID NO: 4240950 - DNA, 22 bp, Homo sapiens
cagctgaagtcaaaatatgtaa

SEQ ID NO: 4240951 - DNA, 13 bp, Homo sapiens
cagctggcgggtg

SEQ ID NO: 4240952 - DNA, 19 bp, Homo sapiens
cagcttcttcacaggcact

SEQ ID NO: 4240953 - DNA, 20 bp, Homo sapiens
caggacctccggagcgccct

SEQ ID NO: 4240954 - DNA, 20 bp, Homo sapiens
caggagccccgccaggtgcc

SEQ ID NO: 4240955 - DNA, 21 bp, Homo sapiens
caggagccccgccaggtgccc

SEQ ID NO: 4240956 - DNA, 11 bp, Homo sapiens
caggagcccta

SEQ ID NO: 4240957 - DNA, 20 bp, Homo sapiens
caggatcctctcctttgaaa

SEQ ID NO: 4240958 - DNA, 23 bp, Homo sapiens
cattttttttaagaaaaaggatg

SEQ ID NO: 4240959 - DNA, 12 bp, Homo sapiens
ccaaacatgtat

SEQ ID NO: 4240960 - DNA, 21 bp, Homo sapiens
ccaaagcaaccacaaatgcat

SEQ ID NO: 4240961 - DNA, 15 bp, Homo sapiens
ccaaagctggcccag

SEQ ID NO: 4240962 - DNA, 23 bp, Homo sapiens
ccaaagctggcccagttgtccat

SEQ ID NO: 4240963 - DNA, 15 bp, Homo sapiens
ccaaagtacactgtt

SEQ ID NO: 4240964 - DNA, 20 bp, Homo sapiens
ccaaagtacactgtttcaaa

SEQ ID NO: 4240965 - DNA, 15 bp, Homo sapiens
ccaaatataagacat

SEQ ID NO: 4240966 - DNA, 16 bp, Homo sapiens
ccaaatataagacatt

SEQ ID NO: 4240967 - DNA, 20 bp, Homo sapiens
ccaaattgtgcttctcccca

SEQ ID NO: 4240968 - DNA, 13 bp, Homo sapiens
ccaacccagcagt

SEQ ID NO: 4240969 - DNA, 21 bp, Homo sapiens
ccaaccttcacatctgtcacg

SEQ ID NO: 4240970 - DNA, 17 bp, Homo sapiens
ccaagagtaactttact

SEQ ID NO: 4240971 - DNA, 16 bp, Homo sapiens
ccaagcaacatttgta

SEQ ID NO: 4240972 - DNA, 17 bp, Homo sapiens
ccaagcaacatttgtat

SEQ ID NO: 4240973 - DNA, 16 bp, Homo sapiens
ctgggtgccaggtgct

SEQ ID NO: 4240974 - DNA, 12 bp, Homo sapiens
ctgggtggcagg

SEQ ID NO: 4240975 - DNA, 14 bp, Homo sapiens
ctgggtggcagggg

SEQ ID NO: 4240976 - DNA, 15 bp, Homo sapiens
ctggtattgtttacg

SEQ ID NO: 4240977 - DNA, 17 bp, Homo sapiens
ctggttcgtgccatgcc

SEQ ID NO: 4240978 - DNA, 19 bp, Homo sapiens
ctggttgtaccctctccag

SEQ ID NO: 4240979 - DNA, 21 bp, Homo sapiens
ctgtacagaaagtatcacaaa

SEQ ID NO: 4240980 - DNA, 18 bp, Homo sapiens
ctgtccaatttctgctgt

SEQ ID NO: 4240981 - DNA, 20 bp, Homo sapiens
ctgtccacacccagctcagc

SEQ ID NO: 4240982 - DNA, 20 bp, Homo sapiens
ctgtccgtgcttgctggtgc

SEQ ID NO: 4240983 - DNA, 12 bp, Homo sapiens
ctgtctcagcct

SEQ ID NO: 4240984 - DNA, 15 bp, Homo sapiens
ctgtctcagcctccc

SEQ ID NO: 4240985 - DNA, 17 bp, Homo sapiens
ctgtctttcatctccca

SEQ ID NO: 4240986 - DNA, 13 bp, Homo sapiens
ctgtgcagaataa

SEQ ID NO: 4240987 - DNA, 12 bp, Homo sapiens
ctgtgcatgtgc

SEQ ID NO: 4240988 - DNA, 19 bp, Homo sapiens
ctgtgccctaaagtgtatt

SEQ ID NO: 4240989 - DNA, 22 bp, Homo sapiens
ctgtggaaccaaagctggccca

SEQ ID NO: 4240990 - DNA, 18 bp, Homo sapiens
ctgtggccaggagccctg

SEQ ID NO: 4240991 - DNA, 18 bp, Homo sapiens
ctgtgggggactggctgg

SEQ ID NO: 4240992 - DNA, 23 bp, Homo sapiens
ctgtgggtggtgatttggtcagc

SEQ ID NO: 4240993 - DNA, 13 bp, Homo sapiens
ctgtgtttaaaaa

SEQ ID NO: 4240994 - DNA, 16 bp, Homo sapiens
ctgtgtttaaaaagta

SEQ ID NO: 4240995 - DNA, 13 bp, Homo sapiens
ctgttaaacagta

SEQ ID NO: 4240996 - DNA, 19 bp, Homo sapiens
ctgttatgatttccttcaa

SEQ ID NO: 4240997 - DNA, 19 bp, Homo sapiens
ctgttctttccaaagtaca

SEQ ID NO: 4240998 - DNA, 19 bp, Homo sapiens
ctgttgatgaagtatactt

SEQ ID NO: 4240999 - DNA, 12 bp, Homo sapiens
ctgttgcacctg

SEQ ID NO: 4241000 - DNA, 11 bp, Homo sapiens
ctgttgctggt

SEQ ID NO: 4241001 - DNA, 17 bp, Homo sapiens
ctgtttagataatacac

SEQ ID NO: 4241002 - DNA, 15 bp, Homo sapiens
ctgtttcaaacttta

SEQ ID NO: 4241003 - DNA, 17 bp, Homo sapiens
ctgtttcaaactttact

SEQ ID NO: 4241004 - DNA, 16 bp, Homo sapiens
cttaaaaaataataca

SEQ ID NO: 4241005 - DNA, 17 bp, Homo sapiens
cttaaaattaagatttc

SEQ ID NO: 4241006 - DNA, 18 bp, Homo sapiens
cttaaaattaccagacaa

SEQ ID NO: 4241007 - DNA, 18 bp, Homo sapiens
cttaaaattgatattata

SEQ ID NO: 4241008 - DNA, 14 bp, Homo sapiens
cttaaactaaataa

SEQ ID NO: 4241009 - DNA, 19 bp, Homo sapiens
cttaaactaaataatgaat

SEQ ID NO: 4241010 - DNA, 13 bp, Homo sapiens
cttaaataatgtg

SEQ ID NO: 4241011 - DNA, 19 bp, Homo sapiens
cttaaataatgtgaaactg

SEQ ID NO: 4241012 - DNA, 14 bp, Homo sapiens
cttaagatattgaa

SEQ ID NO: 4241013 - DNA, 14 bp, Homo sapiens
cttaatctaaatgg

SEQ ID NO: 4241014 - DNA, 20 bp, Homo sapiens
cttaatctgtgtgtatattg

SEQ ID NO: 4241015 - DNA, 14 bp, Homo sapiens
cttacacgtgcgtg

SEQ ID NO: 4241016 - DNA, 19 bp, Homo sapiens
cttaccctcatgttcttaa

SEQ ID NO: 4241017 - DNA, 14 bp, Homo sapiens
cttacctgcttgag

SEQ ID NO: 4241018 - DNA, 16 bp, Homo sapiens
cttactgtacatgaaa

SEQ ID NO: 4241019 - DNA, 14 bp, Homo sapiens
cttagagcatctct

SEQ ID NO: 4241020 - DNA, 23 bp, Homo sapiens
cttagctcattctccttgtgtta

SEQ ID NO: 4241021 - DNA, 19 bp, Homo sapiens
cttagggaaggatacaaaa

SEQ ID NO: 4241022 - DNA, 20 bp, Homo sapiens
cttagtaaaatttatttcat

SEQ ID NO: 4241023 - DNA, 12 bp, Homo sapiens
cttattaattct

SEQ ID NO: 4241024 - DNA, 14 bp, Homo sapiens
cttattgcttagta

SEQ ID NO: 4241025 - DNA, 22 bp, Homo sapiens
cttcaaagtgtgtctgggattt

SEQ ID NO: 4241026 - DNA, 15 bp, Homo sapiens
cttcaaagtttatat

SEQ ID NO: 4241027 - DNA, 15 bp, Homo sapiens
cttcaacatgctcca

SEQ ID NO: 4241028 - DNA, 13 bp, Homo sapiens
cttcaatcccagc

SEQ ID NO: 4241029 - DNA, 14 bp, Homo sapiens
cttcaatcccagcc

SEQ ID NO: 4241030 - DNA, 14 bp, Homo sapiens
cttcacaggcactc

SEQ ID NO: 4241031 - DNA, 15 bp, Homo sapiens
cttcacctgttatgt

SEQ ID NO: 4241032 - DNA, 16 bp, Homo sapiens
cttcacctgttatgta

SEQ ID NO: 4241033 - DNA, 15 bp, Homo sapiens
cttcagaacttgtca

SEQ ID NO: 4241034 - DNA, 14 bp, Homo sapiens
cttcagactctcag

SEQ ID NO: 4241035 - DNA, 12 bp, Homo sapiens
cttcctgccggt

SEQ ID NO: 4241036 - DNA, 23 bp, Homo sapiens
cttcgcagccccgggcggagcct

SEQ ID NO: 4241037 - DNA, 14 bp, Homo sapiens
cttcggggaccagc

SEQ ID NO: 4241038 - DNA, 15 bp, Homo sapiens
cttcggggaccagcc

SEQ ID NO: 4241039 - DNA, 16 bp, Homo sapiens
cttctcatcttgtgaa

SEQ ID NO: 4241040 - DNA, 13 bp, Homo sapiens
cttctccccagaa

SEQ ID NO: 4241041 - DNA, 21 bp, Homo sapiens
cttctgtatttctaggcacaa

SEQ ID NO: 4241042 - DNA, 12 bp, Homo sapiens
cttctgttgctg

SEQ ID NO: 4241043 - DNA, 15 bp, Homo sapiens
cttgaactttgacct

SEQ ID NO: 4241044 - DNA, 17 bp, Homo sapiens
cttgaactttgacctct

SEQ ID NO: 4241045 - DNA, 18 bp, Homo sapiens
cttgagacaatgttttct

SEQ ID NO: 4241046 - DNA, 21 bp, Homo sapiens
cttgagacaatgttttcttca

SEQ ID NO: 4241047 - DNA, 15 bp, Homo sapiens
cttgagccttgaact

SEQ ID NO: 4241048 - DNA, 17 bp, Homo sapiens
cttgagccttgaacttt

SEQ ID NO: 4241049 - DNA, 20 bp, Homo sapiens
cttgagccttgaactttgac

SEQ ID NO: 4241050 - DNA, 22 bp, Homo sapiens
cttgagccttgaactttgacct

SEQ ID NO: 4241051 - DNA, 14 bp, Homo sapiens
cttgagctttctgt

SEQ ID NO: 4241052 - DNA, 17 bp, Homo sapiens
cttgagctttctgtgca

SEQ ID NO: 4241053 - DNA, 13 bp, Homo sapiens
cttgatttgatgt

SEQ ID NO: 4241054 - DNA, 20 bp, Homo sapiens
cttgatttgatgtgactttt

SEQ ID NO: 4241055 - DNA, 14 bp, Homo sapiens
cttgcacctgagcc

SEQ ID NO: 4241056 - DNA, 15 bp, Homo sapiens
cttgcacctgagcct

SEQ ID NO: 4241057 - DNA, 16 bp, Homo sapiens
cttgcacctgagcctg

SEQ ID NO: 4241058 - DNA, 17 bp, Homo sapiens
ctagcccactccccagt

SEQ ID NO: 4241059 - DNA, 17 bp, Homo sapiens
ctagctggtagcataaa

SEQ ID NO: 4241060 - DNA, 12 bp, Homo sapiens
ctaggacttcaa

SEQ ID NO: 4241061 - DNA, 15 bp, Homo sapiens
ctaggcacaaggttg

SEQ ID NO: 4241062 - DNA, 22 bp, Homo sapiens
ctagtaagtaattatgcactaa

SEQ ID NO: 4241063 - DNA, 13 bp, Homo sapiens
ctagtgtttctag

SEQ ID NO: 4241064 - DNA, 21 bp, Homo sapiens
ctagtgtttctagctaaataa

SEQ ID NO: 4241065 - DNA, 13 bp, Homo sapiens
ctagtttgattaa

SEQ ID NO: 4241066 - DNA, 15 bp, Homo sapiens
ctagtttgattaaat

SEQ ID NO: 4241067 - DNA, 21 bp, Homo sapiens
ctataagaggaatttcttttc

SEQ ID NO: 4241068 - DNA, 20 bp, Homo sapiens
ctatcaagtattataccttt

SEQ ID NO: 4241069 - DNA, 18 bp, Homo sapiens
ctatccaaacatgtattt

SEQ ID NO: 4241070 - DNA, 14 bp, Homo sapiens
ctatgcatttgaaa

SEQ ID NO: 4241071 - DNA, 22 bp, Homo sapiens
ctatggaacataaagttgtatt

SEQ ID NO: 4241072 - DNA, 14 bp, Homo sapiens
ctatgttaaatact

SEQ ID NO: 4241073 - DNA, 16 bp, Homo sapiens
ctatgttaaatactgt

SEQ ID NO: 4241074 - DNA, 23 bp, Homo sapiens
ctatgttaaatactgtgcagaat

SEQ ID NO: 4241075 - DNA, 16 bp, Homo sapiens
ctattgacttttcaat

SEQ ID NO: 4241076 - DNA, 14 bp, Homo sapiens
ctatttaatacagc

SEQ ID NO: 4241077 - DNA, 14 bp, Homo sapiens
ctatttacctccta

SEQ ID NO: 4241078 - DNA, 15 bp, Homo sapiens
ctcaaagttaattca

SEQ ID NO: 4241079 - DNA, 20 bp, Homo sapiens
ctcaaagttaattcacctat

SEQ ID NO: 4241080 - DNA, 23 bp, Homo sapiens
ctcaaagttaattcacctatgtt

SEQ ID NO: 4241081 - DNA, 21 bp, Homo sapiens
ctcacagtgttgcccaggctg

SEQ ID NO: 4241082 - DNA, 15 bp, Homo sapiens
tccacttcaggagcc

SEQ ID NO: 4241083 - DNA, 15 bp, Homo sapiens
tccagccgtgtgtgc

SEQ ID NO: 4241084 - DNA, 17 bp, Homo sapiens
tccagccgtgtgtgcat

SEQ ID NO: 4241085 - DNA, 14 bp, Homo sapiens
tccagtattgctga

SEQ ID NO: 4241086 - DNA, 16 bp, Homo sapiens
tccatagtgctacctg

SEQ ID NO: 4241087 - DNA, 15 bp, Homo sapiens
tcccacacccacctc

SEQ ID NO: 4241088 - DNA, 18 bp, Homo sapiens
tcccacacccacctctgc

SEQ ID NO: 4241089 - DNA, 16 bp, Homo sapiens
tcccactcagcagtga

SEQ ID NO: 4241090 - DNA, 23 bp, Homo sapiens
tcccatgttgggtttgagacaga

SEQ ID NO: 4241091 - DNA, 14 bp, Homo sapiens
tcccattttattaa

SEQ ID NO: 4241092 - DNA, 16 bp, Homo sapiens
tccccactgacagcct

SEQ ID NO: 4241093 - DNA, 20 bp, Homo sapiens
tccccagtgctcctggccct

SEQ ID NO: 4241094 - DNA, 19 bp, Homo sapiens
tccccagttggcccttctg

SEQ ID NO: 4241095 - DNA, 14 bp, Homo sapiens
tcccccagagcccc

SEQ ID NO: 4241096 - DNA, 16 bp, Homo sapiens
tcccccgttgtgcctg

SEQ ID NO: 4241097 - DNA, 13 bp, Homo sapiens
tccccggctcgag

SEQ ID NO: 4241098 - DNA, 16 bp, Homo sapiens
tcccctgttaaacagt

SEQ ID NO: 4241099 - DNA, 22 bp, Homo sapiens
tcccggagaggtggccgccatg

SEQ ID NO: 4241100 - DNA, 14 bp, Homo sapiens
tccctcccccagag

SEQ ID NO: 4241101 - DNA, 20 bp, Homo sapiens
tccctctctccacacggagc

SEQ ID NO: 4241102 - DNA, 19 bp, Homo sapiens
tccctgggatggacgctgc

SEQ ID NO: 4241103 - DNA, 20 bp, Homo sapiens
tccctttttatatcccattt

SEQ ID NO: 4241104 - DNA, 17 bp, Homo sapiens
tccgcagggcgcccagc

SEQ ID NO: 4241105 - DNA, 15 bp, Homo sapiens
tccggagcgccctgc

SEQ ID NO: 4241106 - DNA, 19 bp, Homo sapiens
tccggagcgccctgcaggg

SEQ ID NO: 4241107 - DNA, 21 bp, Homo sapiens
tccggagcgccctgcagggcc

SEQ ID NO: 4241108 - DNA, 22 bp, Homo sapiens
tcctaatggcatggagactctg

SEQ ID NO: 4241109 - DNA, 15 bp, Homo sapiens
tcctagcagacagaa

SEQ ID NO: 4241110 - DNA, 17 bp, Homo sapiens
tcctagtggatgactgt

SEQ ID NO: 4241111 - DNA, 22 bp, Homo sapiens
tcctagtggatgactgttgatg

SEQ ID NO: 4241112 - DNA, 21 bp, Homo sapiens
tcctcaaatcagtgataattg

SEQ ID NO: 4241113 - DNA, 17 bp, Homo sapiens
tcctcttcccagagtca

SEQ ID NO: 4241114 - DNA, 13 bp, Homo sapiens
tcctgacatttgt

SEQ ID NO: 4241115 - DNA, 23 bp, Homo sapiens
tcctgacatttgtttattttttg

SEQ ID NO: 4241116 - DNA, 17 bp, Homo sapiens
tcctgagtgtggacttg

SEQ ID NO: 4241117 - DNA, 20 bp, Homo sapiens
tcctgctccctgtggcactc

SEQ ID NO: 4241118 - DNA, 19 bp, Homo sapiens
tcctgtccacacccagctc

SEQ ID NO: 4241119 - DNA, 22 bp, Homo sapiens
tcctgtccacacccagctcagc

SEQ ID NO: 4241120 - DNA, 14 bp, Homo sapiens
tccttcattcatag

SEQ ID NO: 4241121 - DNA, 16 bp, Homo sapiens
tccttctgttgctggt

SEQ ID NO: 4241122 - DNA, 16 bp, Homo sapiens
tccttgcacctgagcc

SEQ ID NO: 4241123 - DNA, 14 bp, Homo sapiens
tccttgtgttacta

SEQ ID NO: 4241124 - DNA, 12 bp, Homo sapiens
tccttttatgtg

SEQ ID NO: 4241125 - DNA, 13 bp, Homo sapiens
tcgatatgtatat

SEQ ID NO: 4241126 - DNA, 22 bp, Homo sapiens
tcgatatgtatatcattctaca

SEQ ID NO: 4241127 - DNA, 15 bp, Homo sapiens
tcgatccaaattgtg

SEQ ID NO: 4241128 - DNA, 21 bp, Homo sapiens
tcgatccaaattgtgcttctc

SEQ ID NO: 4241129 - DNA, 22 bp, Homo sapiens
tcgcccgagctgtttatgtttt

SEQ ID NO: 4241130 - DNA, 15 bp, Homo sapiens
tcggaaaacatgcta

SEQ ID NO: 4241131 - DNA, 15 bp, Homo sapiens
tcgttagaccgctct

SEQ ID NO: 4241132 - DNA, 14 bp, Homo sapiens
tcgtttctgcccag

SEQ ID NO: 4241133 - DNA, 20 bp, Homo sapiens
tcgttttccaaactgactca

SEQ ID NO: 4241134 - DNA, 14 bp, Homo sapiens
tctaaacagttatt

SEQ ID NO: 4241135 - DNA, 21 bp, Homo sapiens
tctaaatctccaaaataaaac

SEQ ID NO: 4241136 - DNA, 22 bp, Homo sapiens
tctaaatctccaaaataaaact

SEQ ID NO: 4241137 - DNA, 16 bp, Homo sapiens
tctaacttcaccatat

SEQ ID NO: 4241138 - DNA, 12 bp, Homo sapiens
tctacagaataa

SEQ ID NO: 4241139 - DNA, 23 bp, Homo sapiens
tctacagaataatccagtattgc

SEQ ID NO: 4241140 - DNA, 19 bp, Homo sapiens
ttgaggctgtcacagtcct

SEQ ID NO: 4241141 - DNA, 13 bp, Homo sapiens
ttgagtttgtagg

SEQ ID NO: 4241142 - DNA, 18 bp, Homo sapiens
ttgataataatattgttt

SEQ ID NO: 4241143 - DNA, 17 bp, Homo sapiens
ttgatactacagtttgt

SEQ ID NO: 4241144 - DNA, 13 bp, Homo sapiens
ttgatatatatta

SEQ ID NO: 4241145 - DNA, 20 bp, Homo sapiens
ttgatgattttcatttcatg

SEQ ID NO: 4241146 - DNA, 15 bp, Homo sapiens
ttgatgcccaatata

SEQ ID NO: 4241147 - DNA, 23 bp, Homo sapiens
ttgatgttttaaggatgcttgta

SEQ ID NO: 4241148 - DNA, 14 bp, Homo sapiens
ttgattaaattctt

SEQ ID NO: 4241149 - DNA, 18 bp, Homo sapiens
ttgatttgatgtgacttt

SEQ ID NO: 4241150 - DNA, 15 bp, Homo sapiens
ttgcacctgagcctg

SEQ ID NO: 4241151 - DNA, 20 bp, Homo sapiens
ttgcagatgtattgactgta

SEQ ID NO: 4241152 - DNA, 15 bp, Homo sapiens
ttgctaatgtataat

SEQ ID NO: 4241153 - DNA, 15 bp, Homo sapiens
ttgctttgtgatttt

SEQ ID NO: 4241154 - DNA, 16 bp, Homo sapiens
ttggaaactgctaaat

SEQ ID NO: 4241155 - DNA, 13 bp, Homo sapiens
ttggatatttttg

SEQ ID NO: 4241156 - DNA, 19 bp, Homo sapiens
ttggatatttttgtacttg

SEQ ID NO: 4241157 - DNA, 18 bp, Homo sapiens
ttggctagaggttcaaag

SEQ ID NO: 4241158 - DNA, 22 bp, Homo sapiens
ttggctagaggttcaaagatat

SEQ ID NO: 4241159 - DNA, 17 bp, Homo sapiens
ttggcttactgcagcct

SEQ ID NO: 4241160 - DNA, 19 bp, Homo sapiens
ttgggggctcatttttgct

SEQ ID NO: 4241161 - DNA, 18 bp, Homo sapiens
ttggtggtttcagaaatg

SEQ ID NO: 4241162 - DNA, 19 bp, Homo sapiens
ttggtggtttcagaaatgt

SEQ ID NO: 4241163 - DNA, 20 bp, Homo sapiens
ttggttgctaagaagcctat

SEQ ID NO: 4241164 - DNA, 16 bp, Homo sapiens
ttgtaaattaactttt

SEQ ID NO: 4241165 - DNA, 19 bp, Homo sapiens
ttgtattctctcctgtacc

SEQ ID NO: 4241166 - DNA, 15 bp, Homo sapiens
ttgtccttgcacctg

SEQ ID NO: 4241167 - DNA, 15 bp, Homo sapiens
ttgtctctcttcaga

SEQ ID NO: 4241168 - DNA, 12 bp, Homo sapiens
ttgtctgtccag

SEQ ID NO: 4241169 - DNA, 23 bp, Homo sapiens
ttgtgaaatggccaggatcctct

SEQ ID NO: 4241170 - DNA, 15 bp, Homo sapiens
ttgtgaatgcttctc

SEQ ID NO: 4241171 - DNA, 19 bp, Homo sapiens
ttgtgatacaatgctgtgc

SEQ ID NO: 4241172 - DNA, 14 bp, Homo sapiens
ttgtgcttctcccc

SEQ ID NO: 4241173 - DNA, 17 bp, Homo sapiens
ttgtgcttctccccaga

SEQ ID NO: 4241174 - DNA, 23 bp, Homo sapiens
ttgtggaggagggagagccctgt

SEQ ID NO: 4241175 - DNA, 15 bp, Homo sapiens
ttgtggttttatgga

SEQ ID NO: 4241176 - DNA, 16 bp, Homo sapiens
ttgtggttttatggag

SEQ ID NO: 4241177 - DNA, 13 bp, Homo sapiens
ttgtgttactaag

SEQ ID NO: 4241178 - DNA, 20 bp, Homo sapiens
ttgtgttactaagtttttat

SEQ ID NO: 4241179 - DNA, 22 bp, Homo sapiens
ttgttagtatgaggcatttgtt

SEQ ID NO: 4241180 - DNA, 12 bp, Homo sapiens
ttgttctgcttt

SEQ ID NO: 4241181 - DNA, 16 bp, Homo sapiens
ttgttgaacatacttc

SEQ ID NO: 4241182 - DNA, 16 bp, Homo sapiens
ttgtttaaaattcagt

SEQ ID NO: 4241183 - DNA, 24 bp, Homo sapiens
ttgtttattgagtttgtaggtaaa

SEQ ID NO: 4241184 - DNA, 13 bp, Homo sapiens
ttgtttcttgttt

SEQ ID NO: 4241185 - DNA, 17 bp, Homo sapiens
ttgtttcttgtttattg

SEQ ID NO: 4241186 - DNA, 14 bp, Homo sapiens
ttgtttttctttct

SEQ ID NO: 4241187 - DNA, 13 bp, Homo sapiens
tttaaaacactaa

SEQ ID NO: 4241188 - DNA, 13 bp, Homo sapiens
tttaaaatatatg

SEQ ID NO: 4241189 - DNA, 21 bp, Homo sapiens
tttaaaatgtagaaacttaaa

SEQ ID NO: 4241190 - DNA, 13 bp, Homo sapiens
tttaacagaaatg

SEQ ID NO: 4241191 - DNA, 14 bp, Homo sapiens
tttaactttaatac

SEQ ID NO: 4241192 - DNA, 22 bp, Homo sapiens
tttaagaaaaaggatgcacaga

SEQ ID NO: 4241193 - DNA, 22 bp, Homo sapiens
tttaaggatgcttgtacataat

SEQ ID NO: 4241194 - DNA, 21 bp, Homo sapiens
tttaagtagaaaagttgcaga

SEQ ID NO: 4241195 - DNA, 23 bp, Homo sapiens
tttaagtagaaaagttgcagatg

SEQ ID NO: 4241196 - DNA, 22 bp, Homo sapiens
tttaagtagtgggcatttcata

SEQ ID NO: 4241197 - DNA, 17 bp, Homo sapiens
tttaagtgctgcattta

SEQ ID NO: 4241198 - DNA, 17 bp, Homo sapiens
tttaagtgggctcctga

SEQ ID NO: 4241199 - DNA, 18 bp, Homo sapiens
tttaagtgggctcctgac

SEQ ID NO: 4241200 - DNA, 20 bp, Homo sapiens
tttaagtgggctcctgacaa

SEQ ID NO: 4241201 - DNA, 20 bp, Homo sapiens
tttaatacagctcagtaaat

SEQ ID NO: 4241202 - DNA, 21 bp, Homo sapiens
tttaatattcttttgtttcca

SEQ ID NO: 4241203 - DNA, 22 bp, Homo sapiens
tttaatattcttttgtttccat

SEQ ID NO: 4241204 - DNA, 22 bp, Homo sapiens
tttacctagctggtagcataaa

SEQ ID NO: 4241205 - DNA, 14 bp, Homo sapiens
tttaccttttttat

SEQ ID NO: 4241206 - DNA, 20 bp, Homo sapiens
tttaccttttttatacataa

SEQ ID NO: 4241207 - DNA, 21 bp, Homo sapiens
tttaccttttttatacataaa

SEQ ID NO: 4241208 - DNA, 17 bp, Homo sapiens
tttagaaccccaggtga

SEQ ID NO: 4241209 - DNA, 13 bp, Homo sapiens
tttagataataca

SEQ ID NO: 4241210 - DNA, 12 bp, Homo sapiens
tttatatctttt

SEQ ID NO: 4241211 - DNA, 17 bp, Homo sapiens
tttatatcttttggtta

SEQ ID NO: 4241212 - DNA, 15 bp, Homo sapiens
tttatctgcagaaca

SEQ ID NO: 4241213 - DNA, 14 bp, Homo sapiens
tttatgcagcaaat

SEQ ID NO: 4241214 - DNA, 18 bp, Homo sapiens
tttatgcagcaaatatat

SEQ ID NO: 4241215 - DNA, 20 bp, Homo sapiens
tttatggcttttgtgcatta

SEQ ID NO: 4241216 - DNA, 17 bp, Homo sapiens
tttatgtgtagttgtct

SEQ ID NO: 4241217 - DNA, 20 bp, Homo sapiens
tttattaataatatttatgt

SEQ ID NO: 4241218 - DNA, 22 bp, Homo sapiens
tttcaaactttactatggccct

SEQ ID NO: 4241219 - DNA, 14 bp, Homo sapiens
tttcaattcagatt

SEQ ID NO: 4241220 - DNA, 18 bp, Homo sapiens
tttggcaataaataaagc

SEQ ID NO: 4241221 - DNA, 14 bp, Homo sapiens
tttggtataatgtt

SEQ ID NO: 4241222 - DNA, 16 bp, Homo sapiens
tttgtaaattaacttt

SEQ ID NO: 4241223 - DNA, 17 bp, Homo sapiens
tttgtaaattaactttt

SEQ ID NO: 4241224 - DNA, 22 bp, Homo sapiens
tttgtaaattaacttttataaa

SEQ ID NO: 4241225 - DNA, 15 bp, Homo sapiens
tttgtaatttttgct

SEQ ID NO: 4241226 - DNA, 14 bp, Homo sapiens
tttgtatttttagt

SEQ ID NO: 4241227 - DNA, 19 bp, Homo sapiens
tttgtccttgcacctgagc

SEQ ID NO: 4241228 - DNA, 21 bp, Homo sapiens
tttgtccttgcacctgagcct

SEQ ID NO: 4241229 - DNA, 16 bp, Homo sapiens
tttgtgatacaatgct

SEQ ID NO: 4241230 - DNA, 22 bp, Homo sapiens
tttgttagtatgaggcatttgt

SEQ ID NO: 4241231 - DNA, 12 bp, Homo sapiens
tttgtttgaact

SEQ ID NO: 4241232 - DNA, 21 bp, Homo sapiens
ttttaaaaagagtaatttcat

SEQ ID NO: 4241233 - DNA, 23 bp, Homo sapiens
ttttaaaaatgtcctgcctttta

SEQ ID NO: 4241234 - DNA, 14 bp, Homo sapiens
ttttaaaacactaa

SEQ ID NO: 4241235 - DNA, 16 bp, Homo sapiens
ttttaactttaataca

SEQ ID NO: 4241236 - DNA, 18 bp, Homo sapiens
ttttaagtgggctcctga

SEQ ID NO: 4241237 - DNA, 15 bp, Homo sapiens
ttttaatacattgat

SEQ ID NO: 4241238 - DNA, 22 bp, Homo sapiens
ttttaatacattgatcaggcca

SEQ ID NO: 4241239 - DNA, 16 bp, Homo sapiens
ttttataaaaataaat

SEQ ID NO: 4241240 - DNA, 20 bp, Homo sapiens
ttttatacaagtaatttcct

SEQ ID NO: 4241241 - DNA, 13 bp, Homo sapiens
ttttatacataaa

SEQ ID NO: 4241242 - DNA, 18 bp, Homo sapiens
ttttatcgtcactgctta

SEQ ID NO: 4241243 - DNA, 19 bp, Homo sapiens
ttttatggagacctctcct

SEQ ID NO: 4241244 - DNA, 21 bp, Homo sapiens
ttttatggcttttgtgcatta

SEQ ID NO: 4241245 - DNA, 16 bp, Homo sapiens
ttttatgggtgaaaat

SEQ ID NO: 4241246 - DNA, 16 bp, Homo sapiens
ttttattaataatatt

SEQ ID NO: 4241247 - DNA, 13 bp, Homo sapiens
ttttattatgcat

SEQ ID NO: 4241248 - DNA, 11 bp, Homo sapiens
ttttattttat

SEQ ID NO: 4241249 - DNA, 15 bp, Homo sapiens
ttttcagtagtgagc

SEQ ID NO: 4241250 - DNA, 18 bp, Homo sapiens
ttttcatttcatgaaaat

SEQ ID NO: 4241251 - DNA, 19 bp, Homo sapiens
ttttcccctgttaaacagt

SEQ ID NO: 4241252 - DNA, 13 bp, Homo sapiens
ttttcctttgtgg

SEQ ID NO: 4241253 - DNA, 16 bp, Homo sapiens
ttttctacattattgc

SEQ ID NO: 4241254 - DNA, 17 bp, Homo sapiens
ttttctatttacctcct

SEQ ID NO: 4241255 - DNA, 22 bp, Homo sapiens
ttttctgtaatcttttatttaa

SEQ ID NO: 4241256 - DNA, 23 bp, Homo sapiens
ttttcttgggaattgaaaaaaat

SEQ ID NO: 4241257 - DNA, 18 bp, Homo sapiens
ttttgataataatattgt

SEQ ID NO: 4241258 - DNA, 17 bp, Homo sapiens
ttttgctctagggccct

SEQ ID NO: 4241259 - DNA, 23 bp, Homo sapiens
ttttggaagagacaaagatttct

SEQ ID NO: 4241260 - DNA, 14 bp, Homo sapiens
ttttggtataatgt

SEQ ID NO: 4241261 - DNA, 17 bp, Homo sapiens
ttttgtgcattatctag

SEQ ID NO: 4241262 - DNA, 20 bp, Homo sapiens
ttttgtgcattatctagata

SEQ ID NO: 4241263 - DNA, 14 bp, Homo sapiens
ttttgtttccatgg

SEQ ID NO: 4241264 - DNA, 14 bp, Homo sapiens
ttttgtttgatgca

SEQ ID NO: 4241265 - DNA, 13 bp, Homo sapiens
tttttaaaacact

SEQ ID NO: 4241266 - DNA, 12 bp, Homo sapiens
tttttaagaaaa

SEQ ID NO: 4241267 - DNA, 16 bp, Homo sapiens
tttttaagtgctgcat

SEQ ID NO: 4241268 - DNA, 23 bp, Homo sapiens
tttttaagtgctgcatttaaaag

SEQ ID NO: 4241269 - DNA, 20 bp, Homo sapiens
tttttataaaaataaataga

SEQ ID NO: 4241270 - DNA, 20 bp, Homo sapiens
tttttatggcttttgtgcat

SEQ ID NO: 4241271 - DNA, 21 bp, Homo sapiens
tttttatggcttttgtgcatt

SEQ ID NO: 4241272 - DNA, 15 bp, Homo sapiens
tttttgtaaactgga

SEQ ID NO: 4241273 - DNA, 11 bp, Homo sapiens
tttttgtaatt

SEQ ID NO: 4241274 - DNA, 13 bp, Homo sapiens
tttttgtttgatg

SEQ ID NO: 4241275 - DNA, 12 bp, Homo sapiens
ttttttactaat

SEQ ID NO: 4241276 - DNA, 13 bp, Homo sapiens
ttttttgcaagtt

SEQ ID NO: 4241277 - DNA, 13 bp, Homo sapiens
ttttttggtataa

SEQ ID NO: 4241278 - DNA, 13 bp, Homo sapiens
ttttttttttcct

SEQ ID NO: 4241279 - DNA, 14 bp, Homo sapiens
tctacattattgct

SEQ ID NO: 4241280 - DNA, 15 bp, Homo sapiens
tctacattattgctt

SEQ ID NO: 4241281 - DNA, 13 bp, Homo sapiens
tctagatactgta

SEQ ID NO: 4241282 - DNA, 17 bp, Homo sapiens
tctagctaaataaatgg

SEQ ID NO: 4241283 - DNA, 15 bp, Homo sapiens
tctaggcacaaggtt

SEQ ID NO: 4241284 - DNA, 16 bp, Homo sapiens
tctaggcacaaggttg

SEQ ID NO: 4241285 - DNA, 16 bp, Homo sapiens
tctagtttccctggtg

SEQ ID NO: 4241286 - DNA, 21 bp, Homo sapiens
tctatcaagtattataccttt

SEQ ID NO: 4241287 - DNA, 14 bp, Homo sapiens
tctatgttaaatac

SEQ ID NO: 4241288 - DNA, 20 bp, Homo sapiens
tctatgttaaatactgtgca

SEQ ID NO: 4241289 - DNA, 13 bp, Homo sapiens
tctcaaatttcta

SEQ ID NO: 4241290 - DNA, 16 bp, Homo sapiens
tctcaaatttctaaat

SEQ ID NO: 4241291 - DNA, 19 bp, Homo sapiens
tctcaagctagtgtttcta

SEQ ID NO: 4241292 - DNA, 20 bp, Homo sapiens
tctcaagctagtgtttctag

SEQ ID NO: 4241293 - DNA, 17 bp, Homo sapiens
tctcaattgaaagcttt

SEQ ID NO: 4241294 - DNA, 20 bp, Homo sapiens
tctcaattgaaagcttttaa

SEQ ID NO: 4241295 - DNA, 23 bp, Homo sapiens
tctcaattgaaagcttttaaaat

SEQ ID NO: 4241296 - DNA, 20 bp, Homo sapiens
tctcacaggcagctctgagc

SEQ ID NO: 4241297 - DNA, 15 bp, Homo sapiens
tctcaccccatccca

SEQ ID NO: 4241298 - DNA, 19 bp, Homo sapiens
tctcaccccatcccacacc

SEQ ID NO: 4241299 - DNA, 20 bp, Homo sapiens
tctcactatatatatttcta

SEQ ID NO: 4241300 - DNA, 15 bp, Homo sapiens
tctcactgttctgca

SEQ ID NO: 4241301 - DNA, 15 bp, Homo sapiens
tctcagcccagaaga

SEQ ID NO: 4241302 - DNA, 16 bp, Homo sapiens
tctcagcccagaagaa

SEQ ID NO: 4241303 - DNA, 22 bp, Homo sapiens
tctcagcccagaagaaaattct

SEQ ID NO: 4241304 - DNA, 17 bp, Homo sapiens
tctccaaaataaaactt

SEQ ID NO: 4241305 - DNA, 22 bp, Homo sapiens
tctccaaaataaaactttttaa

SEQ ID NO: 4241306 - DNA, 20 bp, Homo sapiens
tctccacacggagctcctgg

SEQ ID NO: 4241307 - DNA, 22 bp, Homo sapiens
tctcccaaagtaccttgaactc

SEQ ID NO: 4241308 - DNA, 14 bp, Homo sapiens
tctccctcccccag

SEQ ID NO: 4241309 - DNA, 12 bp, Homo sapiens
tctccctcccct

SEQ ID NO: 4241310 - DNA, 12 bp, Homo sapiens
tctcctcctcca

SEQ ID NO: 4241311 - DNA, 13 bp, Homo sapiens
tctcctgtacctc

SEQ ID NO: 4241312 - DNA, 19 bp, Homo sapiens
tctctccctcccccagagc

SEQ ID NO: 4241313 - DNA, 21 bp, Homo sapiens
tctctccctcccccagagccc

SEQ ID NO: 4241314 - DNA, 21 bp, Homo sapiens
tctctccctcccctgccattt

SEQ ID NO: 4241315 - DNA, 16 bp, Homo sapiens
tctctcctgtacctct

SEQ ID NO: 4241316 - DNA, 20 bp, Homo sapiens
tctctcttcagactctcagc

SEQ ID NO: 4241317 - DNA, 12 bp, Homo sapiens
tctctgccaaag

SEQ ID NO: 4241318 - DNA, 12 bp, Homo sapiens
tctctgctggcc

SEQ ID NO: 4241319 - DNA, 16 bp, Homo sapiens
tctctggggcaggctg

SEQ ID NO: 4241320 - DNA, 17 bp, Homo sapiens
tctcttcagactctcag

SEQ ID NO: 4241321 - DNA, 19 bp, Homo sapiens
tctcttcctccgaggccag

SEQ ID NO: 4241322 - DNA, 15 bp, Homo sapiens
tctgaagatatattt

SEQ ID NO: 4241323 - DNA, 22 bp, Homo sapiens
tctgaagatatatttcactttt

SEQ ID NO: 4241324 - DNA, 12 bp, Homo sapiens
tctgacttttgt

SEQ ID NO: 4241325 - DNA, 21 bp, Homo sapiens
tctgagagcgaattgtgtgga

SEQ ID NO: 4241326 - DNA, 22 bp, Homo sapiens
tctgcagaacatcgatatgtat

SEQ ID NO: 4241327 - DNA, 17 bp, Homo sapiens
tctgcattttcacccca

SEQ ID NO: 4241328 - DNA, 21 bp, Homo sapiens
tctgcattttcaccccaccct

SEQ ID NO: 4241329 - DNA, 21 bp, Homo sapiens
tgtgcctggttcgtgccatgc

SEQ ID NO: 4241330 - DNA, 16 bp, Homo sapiens
tgtgcttctccccaga

SEQ ID NO: 4241331 - DNA, 22 bp, Homo sapiens
tgtggaaccaaagctggcccag

SEQ ID NO: 4241332 - DNA, 15 bp, Homo sapiens
tgtggaccaattatt

SEQ ID NO: 4241333 - DNA, 16 bp, Homo sapiens
tgtggacttggcaggt

SEQ ID NO: 4241334 - DNA, 19 bp, Homo sapiens
tgtggagaactcagtgcca

SEQ ID NO: 4241335 - DNA, 14 bp, Homo sapiens
tgtggagaccaggc

SEQ ID NO: 4241336 - DNA, 19 bp, Homo sapiens
tgtggatttaacagaaatg

SEQ ID NO: 4241337 - DNA, 22 bp, Homo sapiens
tgtggatttaacagaaatgtac

SEQ ID NO: 4241338 - DNA, 11 bp, Homo sapiens
tgtggccagga

SEQ ID NO: 4241339 - DNA, 18 bp, Homo sapiens
tgtgggtgaagtgcctgc

SEQ ID NO: 4241340 - DNA, 20 bp, Homo sapiens
tgtgggtgaagtgcctgctg

SEQ ID NO: 4241341 - DNA, 17 bp, Homo sapiens
tgtgtaccttaagatat

SEQ ID NO: 4241342 - DNA, 12 bp, Homo sapiens
tgtgtgcatgtg

SEQ ID NO: 4241343 - DNA, 13 bp, Homo sapiens
tgtgtgtgtctgt

SEQ ID NO: 4241344 - DNA, 15 bp, Homo sapiens
tgtgtgtgtgtctgt

SEQ ID NO: 4241345 - DNA, 13 bp, Homo sapiens
tgtgttcaatatc

SEQ ID NO: 4241346 - DNA, 15 bp, Homo sapiens
tgtgtttgctgcctt

SEQ ID NO: 4241347 - DNA, 20 bp, Homo sapiens
tgtgtttttctccagtgctg

SEQ ID NO: 4241348 - DNA, 14 bp, Homo sapiens
tgttaaatactgtg

SEQ ID NO: 4241349 - DNA, 15 bp, Homo sapiens
tgttaaatactgtgc

SEQ ID NO: 4241350 - DNA, 13 bp, Homo sapiens
tgttacattttta

SEQ ID NO: 4241351 - DNA, 22 bp, Homo sapiens
tgttacatttttaagtgctgca

SEQ ID NO: 4241352 - DNA, 14 bp, Homo sapiens
tgttactaagtttt

SEQ ID NO: 4241353 - DNA, 19 bp, Homo sapiens
tgttagtatgaggcatttg

SEQ ID NO: 4241354 - DNA, 12 bp, Homo sapiens
tgttatgtatga

SEQ ID NO: 4241355 - DNA, 15 bp, Homo sapiens
tgttatgtatgaagg

SEQ ID NO: 4241356 - DNA, 24 bp, Homo sapiens
tgttattcctagtggatgactgtt

SEQ ID NO: 4241357 - DNA, 13 bp, Homo sapiens
tgttattgttgaa

SEQ ID NO: 4241358 - DNA, 14 bp, Homo sapiens
tgttattgttgaac

SEQ ID NO: 4241359 - DNA, 16 bp, Homo sapiens
tgttattgttgaacat

SEQ ID NO: 4241360 - DNA, 22 bp, Homo sapiens
tgttcaatatcagctttgataa

SEQ ID NO: 4241361 - DNA, 18 bp, Homo sapiens
tgttccctctccctgttg

SEQ ID NO: 4241362 - DNA, 13 bp, Homo sapiens
tgttctatccaaa

SEQ ID NO: 4241363 - DNA, 22 bp, Homo sapiens
tgttctgctttatcttttcata

SEQ ID NO: 4241364 - DNA, 22 bp, Homo sapiens
tgttcttggtttgtaaattaac

SEQ ID NO: 4241365 - DNA, 13 bp, Homo sapiens
tgttctttccaaa

SEQ ID NO: 4241366 - DNA, 14 bp, Homo sapiens
tgttctttccaaag

SEQ ID NO: 4241367 - DNA, 22 bp, Homo sapiens
tgttctttctggctatgcattt

SEQ ID NO: 4241368 - DNA, 12 bp, Homo sapiens
tgttgacataca

SEQ ID NO: 4241369 - DNA, 14 bp, Homo sapiens
tgtttaaaattcag

SEQ ID NO: 4241370 - DNA, 18 bp, Homo sapiens
tgtttaacaacatggctt

SEQ ID NO: 4241371 - DNA, 20 bp, Homo sapiens
tgtttagataatacaccact

SEQ ID NO: 4241372 - DNA, 14 bp, Homo sapiens
tgtttataatctga

SEQ ID NO: 4241373 - DNA, 20 bp, Homo sapiens
tgtttcctatttaatacagc

SEQ ID NO: 4241374 - DNA, 19 bp, Homo sapiens
tgtttctagctaaataaat

SEQ ID NO: 4241375 - DNA, 21 bp, Homo sapiens
tgtttctagctaaataaatgg

SEQ ID NO: 4241376 - DNA, 17 bp, Homo sapiens
tgtttcttgtttattga

SEQ ID NO: 4241377 - DNA, 19 bp, Homo sapiens
tgtttgtgttcaatatcag

SEQ ID NO: 4241378 - DNA, 15 bp, Homo sapiens
tgtttttataaaaat

SEQ ID NO: 4241379 - DNA, 14 bp, Homo sapiens
tgtttttctccagt

SEQ ID NO: 4241380 - DNA, 16 bp, Homo sapiens
tgtttttctttctaca

SEQ ID NO: 4241381 - DNA, 13 bp, Homo sapiens
tgttttttatgtt

SEQ ID NO: 4241382 - DNA, 15 bp, Homo sapiens
ttaaaaaataataca

SEQ ID NO: 4241383 - DNA, 19 bp, Homo sapiens
ttaaaaatctcaaatttct

SEQ ID NO: 4241384 - DNA, 15 bp, Homo sapiens
ttaaaaggatagtat

SEQ ID NO: 4241385 - DNA, 21 bp, Homo sapiens
ttaaaataccagccagtaaat

SEQ ID NO: 4241386 - DNA, 16 bp, Homo sapiens
ttaaaatatatgaaga

SEQ ID NO: 4241387 - DNA, 15 bp, Homo sapiens
ttaaaattcagtttt

SEQ ID NO: 4241388 - DNA, 19 bp, Homo sapiens
ttaaacactacacatttga

SEQ ID NO: 4241389 - DNA, 21 bp, Homo sapiens
ttaaacactacacatttgaaa

SEQ ID NO: 4241390 - DNA, 18 bp, Homo sapiens
ttaaacatacataataca

SEQ ID NO: 4241391 - DNA, 14 bp, Homo sapiens
ttaaacttgtgaat

SEQ ID NO: 4241392 - DNA, 17 bp, Homo sapiens
ttaaacttgtgaatgct

SEQ ID NO: 4241393 - DNA, 17 bp, Homo sapiens
ttaaataataaagtatg

SEQ ID NO: 4241394 - DNA, 13 bp, Homo sapiens
ttaaataatgtga

SEQ ID NO: 4241395 - DNA, 19 bp, Homo sapiens
ttaaataatgtgaaactgg

SEQ ID NO: 4241396 - DNA, 22 bp, Homo sapiens
ttaaataatgtgaaactggatt

SEQ ID NO: 4241397 - DNA, 22 bp, Homo sapiens
ttaaatactgtgcagaataatg

SEQ ID NO: 4241398 - DNA, 22 bp, Homo sapiens
ttaaatcacagcccaaaatttg

SEQ ID NO: 4241399 - DNA, 20 bp, Homo sapiens
ttaaatcatgtatgttatga

SEQ ID NO: 4241400 - DNA, 21 bp, Homo sapiens
ttaaatgaatattttgataat

SEQ ID NO: 4241401 - DNA, 11 bp, Homo sapiens
ttaaatgcacc

SEQ ID NO: 4241402 - DNA, 16 bp, Homo sapiens
ttaaatgcacctggaa

SEQ ID NO: 4241403 - DNA, 19 bp, Homo sapiens
gaggttcaaagatattttg

SEQ ID NO: 4241404 - DNA, 18 bp, Homo sapiens
gagtacgttgtgcatttg

SEQ ID NO: 4241405 - DNA, 21 bp, Homo sapiens
gagtgtgtgtgtgtgtctgta

SEQ ID NO: 4241406 - DNA, 19 bp, Homo sapiens
gagttgaggaactgtacag

SEQ ID NO: 4241407 - DNA, 19 bp, Homo sapiens
gagttgatactacagtttg

SEQ ID NO: 4241408 - DNA, 22 bp, Homo sapiens
gagttgttacatttttaagtgc

SEQ ID NO: 4241409 - DNA, 11 bp, Homo sapiens
gagtttgtagg

SEQ ID NO: 4241410 - DNA, 16 bp, Homo sapiens
gataaaataaataatt

SEQ ID NO: 4241411 - DNA, 17 bp, Homo sapiens
gataaaataaataattt

SEQ ID NO: 4241412 - DNA, 19 bp, Homo sapiens
gataataatattgtttttc

SEQ ID NO: 4241413 - DNA, 19 bp, Homo sapiens
gatacagttactcagaatt

SEQ ID NO: 4241414 - DNA, 23 bp, Homo sapiens
gatacagttactcagaattctct

SEQ ID NO: 4241415 - DNA, 16 bp, Homo sapiens
gatatactttgtggac

SEQ ID NO: 4241416 - DNA, 23 bp, Homo sapiens
gatatatattataaatatatata

SEQ ID NO: 4241417 - DNA, 22 bp, Homo sapiens
gatatatttcacttttgttctg

SEQ ID NO: 4241418 - DNA, 16 bp, Homo sapiens
gatattatattaaaca

SEQ ID NO: 4241419 - DNA, 18 bp, Homo sapiens
gatattatattaaacata

SEQ ID NO: 4241420 - DNA, 16 bp, Homo sapiens
gatattgtttaaaatt

SEQ ID NO: 4241421 - DNA, 21 bp, Homo sapiens
gatattgtttaaaattcagtt

SEQ ID NO: 4241422 - DNA, 11 bp, Homo sapiens
gatatttttgt

SEQ ID NO: 4241423 - DNA, 19 bp, Homo sapiens
gatccaaattgtgcttctc

SEQ ID NO: 4241424 - DNA, 19 bp, Homo sapiens
gatccacctgtctcagcct

SEQ ID NO: 4241425 - DNA, 21 bp, Homo sapiens
gatcctctcctttgaaacctg

SEQ ID NO: 4241426 - DNA, 14 bp, Homo sapiens
gatgagacctgggg

SEQ ID NO: 4241427 - DNA, 12 bp, Homo sapiens
gatgatttaagt

SEQ ID NO: 4241428 - DNA, 23 bp, Homo sapiens
gatgcaaagtacaatgtgttttt

SEQ ID NO: 4241429 - DNA, 21 bp, Homo sapiens
gatgcacagagttgttacatt

SEQ ID NO: 4241430 - DNA, 22 bp, Homo sapiens
gatgcacagagttgttacattt

SEQ ID NO: 4241431 - DNA, 20 bp, Homo sapiens
gatgcctgttttgagaccag

SEQ ID NO: 4241432 - DNA, 14 bp, Homo sapiens
gatggaaatacagt

SEQ ID NO: 4241433 - DNA, 17 bp, Homo sapiens
gatggtggactacaaaa

SEQ ID NO: 4241434 - DNA, 21 bp, Homo sapiens
gatggtggactacaaaataca

SEQ ID NO: 4241435 - DNA, 12 bp, Homo sapiens
gatgtgactttt

SEQ ID NO: 4241436 - DNA, 12 bp, Homo sapiens
gattaaattctt

SEQ ID NO: 4241437 - DNA, 23 bp, Homo sapiens
gattactctccatatcccttcct

SEQ ID NO: 4241438 - DNA, 13 bp, Homo sapiens
gattcacagacca

SEQ ID NO: 4241439 - DNA, 16 bp, Homo sapiens
gattctcccaaagtac

SEQ ID NO: 4241440 - DNA, 12 bp, Homo sapiens
gattgtcttgca

SEQ ID NO: 4241441 - DNA, 16 bp, Homo sapiens
gattgtcttgcaactt

SEQ ID NO: 4241442 - DNA, 17 bp, Homo sapiens
gatttaacagaaatgta

SEQ ID NO: 4241443 - DNA, 23 bp, Homo sapiens
gatttaacagaaatgtacagcaa

SEQ ID NO: 4241444 - DNA, 12 bp, Homo sapiens
gatttattgtaa

SEQ ID NO: 4241445 - DNA, 15 bp, Homo sapiens
gatttattgtaagca

SEQ ID NO: 4241446 - DNA, 18 bp, Homo sapiens
gatttccgttaaaatacc

SEQ ID NO: 4241447 - DNA, 22 bp, Homo sapiens
gatttccgttaaaataccagcc

SEQ ID NO: 4241448 - DNA, 21 bp, Homo sapiens
gatttctgtttagataataca

SEQ ID NO: 4241449 - DNA, 17 bp, Homo sapiens
gatttgatgtgactttt

SEQ ID NO: 4241450 - DNA, 22 bp, Homo sapiens
gatttgatgtgactttttttgg

SEQ ID NO: 4241451 - DNA, 23 bp, Homo sapiens
gcaaaaaactcttaatctgtgtg

SEQ ID NO: 4241452 - DNA, 15 bp, Homo sapiens
gcaagactgcaaact

SEQ ID NO: 4241453 - DNA, 19 bp, Homo sapiens
gcaagactgcaaacttttt

SEQ ID NO: 4241454 - DNA, 14 bp, Homo sapiens
gcaagagggacaga

SEQ ID NO: 4241455 - DNA, 14 bp, Homo sapiens
gcaaggtcattttt

SEQ ID NO: 4241456 - DNA, 22 bp, Homo sapiens
gcaagttatattagtgaagatg

SEQ ID NO: 4241457 - DNA, 15 bp, Homo sapiens
gcaataaataaagct

SEQ ID NO: 4241458 - DNA, 18 bp, Homo sapiens
gcaatgcttaaactaaat

SEQ ID NO: 4241459 - DNA, 18 bp, Homo sapiens
gcaattggaacaaagtga

SEQ ID NO: 4241460 - DNA, 19 bp, Homo sapiens
gcacagatatactttgtgg

SEQ ID NO: 4241461 - DNA, 20 bp, Homo sapiens
gcacagctctcctcctccat

SEQ ID NO: 4241462 - DNA, 20 bp, Homo sapiens
gcaccatggtatcatatatt

SEQ ID NO: 4241463 - DNA, 14 bp, Homo sapiens
gcacctgagcctgt

SEQ ID NO: 4241464 - DNA, 18 bp, Homo sapiens
gcacctggaatatataac

SEQ ID NO: 4241465 - DNA, 22 bp, Homo sapiens
gcacctggaatatataaccagt

SEQ ID NO: 4241466 - DNA, 13 bp, Homo sapiens
gcacgatttctgt

SEQ ID NO: 4241467 - DNA, 15 bp, Homo sapiens
gcacgatttctgttt

SEQ ID NO: 4241468 - DNA, 19 bp, Homo sapiens
gcacgggattcatgcagtg

SEQ ID NO: 4241469 - DNA, 17 bp, Homo sapiens
gcacgtggccaggagcc

SEQ ID NO: 4241470 - DNA, 14 bp, Homo sapiens
gcactaaatatgaa

SEQ ID NO: 4241471 - DNA, 15 bp, Homo sapiens
gcactaaatatgaac

SEQ ID NO: 4241472 - DNA, 18 bp, Homo sapiens
gcactagagaatgcacag

SEQ ID NO: 4241473 - DNA, 17 bp, Homo sapiens
gcagaataatggaaaca

SEQ ID NO: 4241474 - DNA, 15 bp, Homo sapiens
gcagacagaaactgg

SEQ ID NO: 4241475 - DNA, 21 bp, Homo sapiens
gcagaccagctggcgggtgtg

SEQ ID NO: 4241476 - DNA, 16 bp, Homo sapiens
gcagacgcggcgggga

SEQ ID NO: 4241477 - DNA, 24 bp, Homo sapiens
gcagcatcgaggaagggccgagga

SEQ ID NO: 4241478 - DNA, 18 bp, Homo sapiens
gcagccccgggcggagcc

SEQ ID NO: 4241479 - DNA, 20 bp, Homo sapiens
gcagcccgtgtccaggagcc

SEQ ID NO: 4241480 - DNA, 17 bp, Homo sapiens
gcagcctttgcctcccc

SEQ ID NO: 4241481 - DNA, 20 bp, Homo sapiens
tatgtgaggtaattattgct

SEQ ID NO: 4241482 - DNA, 12 bp, Homo sapiens
tatgttaaatac

SEQ ID NO: 4241483 - DNA, 18 bp, Homo sapiens
tatgttaaatactgtgca

SEQ ID NO: 4241484 - DNA, 20 bp, Homo sapiens
tattaaaaatctcaaatttc

SEQ ID NO: 4241485 - DNA, 19 bp, Homo sapiens
tattaaataataaagtatg

SEQ ID NO: 4241486 - DNA, 14 bp, Homo sapiens
tattaataatattt

SEQ ID NO: 4241487 - DNA, 13 bp, Homo sapiens
tattacaacattt

SEQ ID NO: 4241488 - DNA, 22 bp, Homo sapiens
tattataaatatatataaagaa

SEQ ID NO: 4241489 - DNA, 14 bp, Homo sapiens
tattataccttttt

SEQ ID NO: 4241490 - DNA, 17 bp, Homo sapiens
tattctctcctgtacct

SEQ ID NO: 4241491 - DNA, 24 bp, Homo sapiens
tattctctcctgtacctcttgagc

SEQ ID NO: 4241492 - DNA, 21 bp, Homo sapiens
tattctgaccgttaaaaaatt

SEQ ID NO: 4241493 - DNA, 15 bp, Homo sapiens
tattcttataaaaat

SEQ ID NO: 4241494 - DNA, 16 bp, Homo sapiens
tattcttttgtttcca

SEQ ID NO: 4241495 - DNA, 15 bp, Homo sapiens
tattgacttttcaat

SEQ ID NO: 4241496 - DNA, 20 bp, Homo sapiens
tattgagaatcccttaaaat

SEQ ID NO: 4241497 - DNA, 22 bp, Homo sapiens
tattgagaatcccttaaaatta

SEQ ID NO: 4241498 - DNA, 22 bp, Homo sapiens
tattgagtttgtaggtaaaatg

SEQ ID NO: 4241499 - DNA, 14 bp, Homo sapiens
tattgatatatatt

SEQ ID NO: 4241500 - DNA, 11 bp, Homo sapiens
tattgcataag

SEQ ID NO: 4241501 - DNA, 17 bp, Homo sapiens
tattgcatgcaatttga

SEQ ID NO: 4241502 - DNA, 17 bp, Homo sapiens
tattgcttagtaaaatt

SEQ ID NO: 4241503 - DNA, 19 bp, Homo sapiens
tattgcttagtaaaattta

SEQ ID NO: 4241504 - DNA, 19 bp, Homo sapiens
tattggaaatggatgcaaa

SEQ ID NO: 4241505 - DNA, 16 bp, Homo sapiens
tattgtttaaaattca

SEQ ID NO: 4241506 - DNA, 12 bp, Homo sapiens
tatttaaagttg

SEQ ID NO: 4241507 - DNA, 13 bp, Homo sapiens
tatttaaagttgt

SEQ ID NO: 4241508 - DNA, 12 bp, Homo sapiens
tatttaagtagt

SEQ ID NO: 4241509 - DNA, 22 bp, Homo sapiens
tatttatatcatccagaaaaga

SEQ ID NO: 4241510 - DNA, 19 bp, Homo sapiens
tatttcacttttgttctgc

SEQ ID NO: 4241511 - DNA, 13 bp, Homo sapiens
tatttcatctttt

SEQ ID NO: 4241512 - DNA, 18 bp, Homo sapiens
tatttctggtgtatattt

SEQ ID NO: 4241513 - DNA, 20 bp, Homo sapiens
tatttctgtttcctatttaa

SEQ ID NO: 4241514 - DNA, 14 bp, Homo sapiens
tattttaaaatata

SEQ ID NO: 4241515 - DNA, 19 bp, Homo sapiens
tattttaaaatatatgaag

SEQ ID NO: 4241516 - DNA, 13 bp, Homo sapiens
tattttaatgtac

SEQ ID NO: 4241517 - DNA, 13 bp, Homo sapiens
tattttcttttta

SEQ ID NO: 4241518 - DNA, 18 bp, Homo sapiens
tattttgataataatatt

SEQ ID NO: 4241519 - DNA, 15 bp, Homo sapiens
tattttggaaactgc

SEQ ID NO: 4241520 - DNA, 15 bp, Homo sapiens
tattttgtgtacaag

SEQ ID NO: 4241521 - DNA, 13 bp, Homo sapiens
tattttttgcaag

SEQ ID NO: 4241522 - DNA, 17 bp, Homo sapiens
tatttttttcttttctt

SEQ ID NO: 4241523 - DNA, 14 bp, Homo sapiens
tcaaaaataatgtg

SEQ ID NO: 4241524 - DNA, 22 bp, Homo sapiens
tcaaaagaaaattgatattttt

SEQ ID NO: 4241525 - DNA, 22 bp, Homo sapiens
tcaaagatattttgctttgtga

SEQ ID NO: 4241526 - DNA, 13 bp, Homo sapiens
tcaaatcaacttt

SEQ ID NO: 4241527 - DNA, 15 bp, Homo sapiens
tcaaatcgatttagt

SEQ ID NO: 4241528 - DNA, 14 bp, Homo sapiens
tcaaatttctaaat

SEQ ID NO: 4241529 - DNA, 16 bp, Homo sapiens
tcaaatttctaaatct

SEQ ID NO: 4241530 - DNA, 16 bp, Homo sapiens
tcaagtattatacctt

SEQ ID NO: 4241531 - DNA, 16 bp, Homo sapiens
tcaagtctctgctggc

SEQ ID NO: 4241532 - DNA, 19 bp, Homo sapiens
tcaagtctctgctggccca

SEQ ID NO: 4241533 - DNA, 20 bp, Homo sapiens
tcacagaccaagtccaagcc

SEQ ID NO: 4241534 - DNA, 18 bp, Homo sapiens
tcacatattgatttccgt

SEQ ID NO: 4241535 - DNA, 19 bp, Homo sapiens
tcaccccatcccacaccct

SEQ ID NO: 4241536 - DNA, 17 bp, Homo sapiens
aaatctcaaatttctaa

SEQ ID NO: 4241537 - DNA, 17 bp, Homo sapiens
aaatctcaccccatccc

SEQ ID NO: 4241538 - DNA, 16 bp, Homo sapiens
aaatgaatattttgat

SEQ ID NO: 4241539 - DNA, 18 bp, Homo sapiens
aaatgaatattttgataa

SEQ ID NO: 4241540 - DNA, 17 bp, Homo sapiens
aaatgaattgaaaaaca

SEQ ID NO: 4241541 - DNA, 13 bp, Homo sapiens
aaatgacagattt

SEQ ID NO: 4241542 - DNA, 17 bp, Homo sapiens
aaatgcaataattttac

SEQ ID NO: 4241543 - DNA, 14 bp, Homo sapiens
aaatgcacctggaa

SEQ ID NO: 4241544 - DNA, 12 bp, Homo sapiens
aaatgcattgaa

SEQ ID NO: 4241545 - DNA, 23 bp, Homo sapiens
aaatgccttaccctcatgttctt

SEQ ID NO: 4241546 - DNA, 20 bp, Homo sapiens
aaatgggtgtatataatttt

SEQ ID NO: 4241547 - DNA, 18 bp, Homo sapiens
aaatgtaatataatgtat

SEQ ID NO: 4241548 - DNA, 21 bp, Homo sapiens
aaatgtaatataatgtatttt

SEQ ID NO: 4241549 - DNA, 19 bp, Homo sapiens
aaatgtagaaacttaaaca

SEQ ID NO: 4241550 - DNA, 14 bp, Homo sapiens
aaatgtatttttct

SEQ ID NO: 4241551 - DNA, 21 bp, Homo sapiens
aaattaacttttataaacttt

SEQ ID NO: 4241552 - DNA, 16 bp, Homo sapiens
aaattcagtttttgta

SEQ ID NO: 4241553 - DNA, 17 bp, Homo sapiens
aaattcagtttttgtat

SEQ ID NO: 4241554 - DNA, 23 bp, Homo sapiens
aaattcagtttttgtatcttggg

SEQ ID NO: 4241555 - DNA, 18 bp, Homo sapiens
aaattctatgttaaatac

SEQ ID NO: 4241556 - DNA, 18 bp, Homo sapiens
aaattcttgcaaagtatc

SEQ ID NO: 4241557 - DNA, 21 bp, Homo sapiens
aaattcttgcaaagtatccct

SEQ ID NO: 4241558 - DNA, 21 bp, Homo sapiens
aaattgatattatattaaaca

SEQ ID NO: 4241559 - DNA, 17 bp, Homo sapiens
aaattgtgcttctcccc

SEQ ID NO: 4241560 - DNA, 13 bp, Homo sapiens
aaatttctaaatc

SEQ ID NO: 4241561 - DNA, 15 bp, Homo sapiens
aaatttctaaatctc

SEQ ID NO: 4241562 - DNA, 19 bp, Homo sapiens
aaatttctaaatctccaaa

SEQ ID NO: 4241563 - DNA, 18 bp, Homo sapiens
aaatttgatggactaatt

SEQ ID NO: 4241564 - DNA, 20 bp, Homo sapiens
aaatttgatggactaattat

SEQ ID NO: 4241565 - DNA, 23 bp, Homo sapiens
aaattttgatgttttaaggatgc

SEQ ID NO: 4241566 - DNA, 13 bp, Homo sapiens
aacaaaaaataca

SEQ ID NO: 4241567 - DNA, 14 bp, Homo sapiens
aacaaaaaatacat

SEQ ID NO: 4241568 - DNA, 14 bp, Homo sapiens
aacaagtcattttt

SEQ ID NO: 4241569 - DNA, 17 bp, Homo sapiens
aacaagtcatttttgta

SEQ ID NO: 4241570 - DNA, 17 bp, Homo sapiens
aacaattttttttttcc

SEQ ID NO: 4241571 - DNA, 19 bp, Homo sapiens
aacacatttttcttaggga

SEQ ID NO: 4241572 - DNA, 13 bp, Homo sapiens
aacactgtatttt

SEQ ID NO: 4241573 - DNA, 11 bp, Homo sapiens
aacagaaatgt

SEQ ID NO: 4241574 - DNA, 15 bp, Homo sapiens
aacagaaatgtacag

SEQ ID NO: 4241575 - DNA, 19 bp, Homo sapiens
aacagtagttgtattcttc

SEQ ID NO: 4241576 - DNA, 21 bp, Homo sapiens
aacataaagttgtattgcatg

SEQ ID NO: 4241577 - DNA, 16 bp, Homo sapiens
aacatcgatatgtata

SEQ ID NO: 4241578 - DNA, 18 bp, Homo sapiens
aacatcgatatgtatatc

SEQ ID NO: 4241579 - DNA, 22 bp, Homo sapiens
aacatgctacacactgcatgtt

SEQ ID NO: 4241580 - DNA, 22 bp, Homo sapiens
aaccactctatcaagtattata

SEQ ID NO: 4241581 - DNA, 19 bp, Homo sapiens
aaccagggaagctgtccct

SEQ ID NO: 4241582 - DNA, 17 bp, Homo sapiens
aaccagtgttgtggatt

SEQ ID NO: 4241583 - DNA, 15 bp, Homo sapiens
aaccatctctgtgat

SEQ ID NO: 4241584 - DNA, 23 bp, Homo sapiens
aacccagttaacttactctttaa

SEQ ID NO: 4241585 - DNA, 15 bp, Homo sapiens
aaccccaggtgagac

SEQ ID NO: 4241586 - DNA, 14 bp, Homo sapiens
aacccggtgcatct

SEQ ID NO: 4241587 - DNA, 16 bp, Homo sapiens
aacccggtgcatctgg

SEQ ID NO: 4241588 - DNA, 19 bp, Homo sapiens
aaccttcacatctgtcacg

SEQ ID NO: 4241589 - DNA, 14 bp, Homo sapiens
aacctttgggccaa

SEQ ID NO: 4241590 - DNA, 14 bp, Homo sapiens
aactaaataatgaa

SEQ ID NO: 4241591 - DNA, 12 bp, Homo sapiens
aactatttactt

SEQ ID NO: 4241592 - DNA, 14 bp, Homo sapiens
aactgaatattttg

SEQ ID NO: 4241593 - DNA, 22 bp, Homo sapiens
aactgctaaattctatgttaaa

SEQ ID NO: 4241594 - DNA, 21 bp, Homo sapiens
aactgggggagggtgaagtga

SEQ ID NO: 4241595 - DNA, 14 bp, Homo sapiens
aactggtattgttt

SEQ ID NO: 4241596 - DNA, 19 bp, Homo sapiens
aactggttgtagtgggaag

SEQ ID NO: 4241597 - DNA, 15 bp, Homo sapiens
aactgtactgtctgt

SEQ ID NO: 4241598 - DNA, 17 bp, Homo sapiens
aacttaaataatgtgaa

SEQ ID NO: 4241599 - DNA, 19 bp, Homo sapiens
aacttaaataatgtgaaac

SEQ ID NO: 4241600 - DNA, 16 bp, Homo sapiens
aacttaatctaaatgg

SEQ ID NO: 4241601 - DNA, 20 bp, Homo sapiens
aacttagatcatcagtcacc

SEQ ID NO: 4241602 - DNA, 11 bp, Homo sapiens
aacttgtgaat

SEQ ID NO: 4241603 - DNA, 12 bp, Homo sapiens
aacttgtgaatg

SEQ ID NO: 4241604 - DNA, 11 bp, Homo sapiens
aactttaatac

SEQ ID NO: 4241605 - DNA, 14 bp, Homo sapiens
aactttaatacagc

SEQ ID NO: 4241606 - DNA, 21 bp, Homo sapiens
aactttaccttttttatacat

SEQ ID NO: 4241607 - DNA, 21 bp, Homo sapiens
aactttactctgtgtttaaaa

SEQ ID NO: 4241608 - DNA, 13 bp, Homo sapiens
aactttgacctct

SEQ ID NO: 4241609 - DNA, 12 bp, Homo sapiens
aacttttataaa

SEQ ID NO: 4241610 - DNA, 22 bp, Homo sapiens
aacttttatgcagcaaatatat

SEQ ID NO: 4241611 - DNA, 18 bp, Homo sapiens
aacttttttatatctttt

SEQ ID NO: 4241612 - DNA, 18 bp, Homo sapiens
aagaaaaaggatgcacag

SEQ ID NO: 4241613 - DNA, 18 bp, Homo sapiens
aagaacacattttaaata

SEQ ID NO: 4241614 - DNA, 14 bp, Homo sapiens
aagaatgagcctgt

SEQ ID NO: 4241615 - DNA, 13 bp, Homo sapiens
aagaatgcttaaa

SEQ ID NO: 4241616 - DNA, 16 bp, Homo sapiens
aagacaaaaataatag

SEQ ID NO: 4241617 - DNA, 23 bp, Homo sapiens
aagacatactgcttgattttaat

SEQ ID NO: 4241618 - DNA, 14 bp, Homo sapiens
aagacatgcttggg

SEQ ID NO: 4241619 - DNA, 23 bp, Homo sapiens
aagactgagtacgttgtgcattt

SEQ ID NO: 4241620 - DNA, 20 bp, Homo sapiens
aagacttgagacaatgtttt

SEQ ID NO: 4241621 - DNA, 22 bp, Homo sapiens
aagacttgagacaatgttttct

SEQ ID NO: 4241622 - DNA, 12 bp, Homo sapiens
aagacttgtttt

SEQ ID NO: 4241623 - DNA, 14 bp, Homo sapiens
aagagtaactttac

SEQ ID NO: 4241624 - DNA, 23 bp, Homo sapiens
aagagtaactttactctgtgttt

SEQ ID NO: 4241625 - DNA, 22 bp, Homo sapiens
aagagtattttaagaagacata

SEQ ID NO: 4241626 - DNA, 14 bp, Homo sapiens
aagatggtttcaat

SEQ ID NO: 4241627 - DNA, 13 bp, Homo sapiens
aagcaacatttgt

SEQ ID NO: 4241628 - DNA, 14 bp, Homo sapiens
aagcaacatttgta

SEQ ID NO: 4241629 - DNA, 21 bp, Homo sapiens
aagcaacatttgtatggattt

SEQ ID NO: 4241630 - DNA, 16 bp, Homo sapiens
aagcacatctgcattt

SEQ ID NO: 4241631 - DNA, 19 bp, Homo sapiens
aagcactatgcccttttat

SEQ ID NO: 4241632 - DNA, 14 bp, Homo sapiens
aagcagcgtttcta

SEQ ID NO: 4241633 - DNA, 21 bp, Homo sapiens
aagcagcgtttctatgacaca

SEQ ID NO: 4241634 - DNA, 13 bp, Homo sapiens
aagcatgtcaatt

SEQ ID NO: 4241635 - DNA, 16 bp, Homo sapiens
aagcatgtcaattcat

SEQ ID NO: 4241636 - DNA, 12 bp, Homo sapiens
aagcatgtgaga

SEQ ID NO: 4241637 - DNA, 18 bp, Homo sapiens
aagccattaaatgaatat

SEQ ID NO: 4241638 - DNA, 14 bp, Homo sapiens
aagccctttgccat

SEQ ID NO: 4241639 - DNA, 21 bp, Homo sapiens
aagcgtgcacaaggattgaaa

SEQ ID NO: 4241640 - DNA, 12 bp, Homo sapiens
aagctagtgttt

SEQ ID NO: 4241641 - DNA, 13 bp, Homo sapiens
aagcttgtggagg

SEQ ID NO: 4241642 - DNA, 21 bp, Homo sapiens
aaggaagttttaactttaata

SEQ ID NO: 4241643 - DNA, 16 bp, Homo sapiens
aaggaatcattccagt

SEQ ID NO: 4241644 - DNA, 20 bp, Homo sapiens
aaggaatcattccagtgcta

SEQ ID NO: 4241645 - DNA, 14 bp, Homo sapiens
aaggaatttgatga

SEQ ID NO: 4241646 - DNA, 18 bp, Homo sapiens
aaggatgcacagagttgt

SEQ ID NO: 4241647 - DNA, 23 bp, Homo sapiens
aaggcaaaaaactcttaatctgt

SEQ ID NO: 4241648 - DNA, 17 bp, Homo sapiens
aagggaacagcctgagc

SEQ ID NO: 4241649 - DNA, 22 bp, Homo sapiens
aagggcatcatcctcagcagca

SEQ ID NO: 4241650 - DNA, 21 bp, Homo sapiens
aagggcgggcaaggagtgggg

SEQ ID NO: 4241651 - DNA, 13 bp, Homo sapiens
actgcaaactttt

SEQ ID NO: 4241652 - DNA, 16 bp, Homo sapiens
actgccagtctcactg

SEQ ID NO: 4241653 - DNA, 21 bp, Homo sapiens
actggaaatgtttgtccttgc

SEQ ID NO: 4241654 - DNA, 14 bp, Homo sapiens
actggactgtctga

SEQ ID NO: 4241655 - DNA, 22 bp, Homo sapiens
actggattaaacttaatctaaa

SEQ ID NO: 4241656 - DNA, 20 bp, Homo sapiens
actgtacatgaaaacacatt

SEQ ID NO: 4241657 - DNA, 16 bp, Homo sapiens
actgtatcatgacaaa

SEQ ID NO: 4241658 - DNA, 24 bp, Homo sapiens
actgtggaaccaaagctggcccag

SEQ ID NO: 4241659 - DNA, 14 bp, Homo sapiens
actgttctgcaaag

SEQ ID NO: 4241660 - DNA, 16 bp, Homo sapiens
actgttgatgaagtat

SEQ ID NO: 4241661 - DNA, 20 bp, Homo sapiens
actgttgatgaagtatactt

SEQ ID NO: 4241662 - DNA, 19 bp, Homo sapiens
actgtttaacaacatggct

SEQ ID NO: 4241663 - DNA, 13 bp, Homo sapiens
actgtttcaaact

SEQ ID NO: 4241664 - DNA, 18 bp, Homo sapiens
actgtttcaaactttact

SEQ ID NO: 4241665 - DNA, 17 bp, Homo sapiens
acttaaaaacaagagaa

SEQ ID NO: 4241666 - DNA, 15 bp, Homo sapiens
acttaaataatgtga

SEQ ID NO: 4241667 - DNA, 16 bp, Homo sapiens
acttaaataatgtgaa

SEQ ID NO: 4241668 - DNA, 15 bp, Homo sapiens
acttaatctaaatgg

SEQ ID NO: 4241669 - DNA, 16 bp, Homo sapiens
acttacctgcttgagc

SEQ ID NO: 4241670 - DNA, 13 bp, Homo sapiens
acttactgtacat

SEQ ID NO: 4241671 - DNA, 14 bp, Homo sapiens
acttactgtacatg

SEQ ID NO: 4241672 - DNA, 22 bp, Homo sapiens
acttactgtacatgaaaacaca

SEQ ID NO: 4241673 - DNA, 13 bp, Homo sapiens
acttcaaggccca

SEQ ID NO: 4241674 - DNA, 13 bp, Homo sapiens
acttcagttttat

SEQ ID NO: 4241675 - DNA, 19 bp, Homo sapiens
acttcgcagccccgggcgg

SEQ ID NO: 4241676 - DNA, 19 bp, Homo sapiens
acttgacccccttgagggt

SEQ ID NO: 4241677 - DNA, 17 bp, Homo sapiens
acttgagacaatgtttt

SEQ ID NO: 4241678 - DNA, 12 bp, Homo sapiens
acttgatttgat

SEQ ID NO: 4241679 - DNA, 16 bp, Homo sapiens
acttgatttgatgtga

SEQ ID NO: 4241680 - DNA, 18 bp, Homo sapiens
acttgatttgatgtgact

SEQ ID NO: 4241681 - DNA, 17 bp, Homo sapiens
acttgtacaaacagtat

SEQ ID NO: 4241682 - DNA, 19 bp, Homo sapiens
acttgtacaaacagtattt

SEQ ID NO: 4241683 - DNA, 22 bp, Homo sapiens
acttgtacaaacagtatttctg

SEQ ID NO: 4241684 - DNA, 10 bp, Homo sapiens
acttgtgaat

SEQ ID NO: 4241685 - DNA, 11 bp, Homo sapiens
acttgtgaatg

SEQ ID NO: 4241686 - DNA, 12 bp, Homo sapiens
acttgtgaatgc

SEQ ID NO: 4241687 - DNA, 17 bp, Homo sapiens
acttgtgaatgcttctc

SEQ ID NO: 4241688 - DNA, 18 bp, Homo sapiens
acttgtgaatgcttctca

SEQ ID NO: 4241689 - DNA, 17 bp, Homo sapiens
acttgttttatgctcag

SEQ ID NO: 4241690 - DNA, 23 bp, Homo sapiens
actttaccttttttatacataaa

SEQ ID NO: 4241691 - DNA, 15 bp, Homo sapiens
actttactctgtgtt

SEQ ID NO: 4241692 - DNA, 19 bp, Homo sapiens
actttactctgtgtttaaa

SEQ ID NO: 4241693 - DNA, 16 bp, Homo sapiens
actttgacctctgcag

SEQ ID NO: 4241694 - DNA, 17 bp, Homo sapiens
actttgtaatttttgct

SEQ ID NO: 4241695 - DNA, 17 bp, Homo sapiens
actttgtggaccaatta

SEQ ID NO: 4241696 - DNA, 19 bp, Homo sapiens
acttttataaactttacct

SEQ ID NO: 4241697 - DNA, 17 bp, Homo sapiens
acttttcaataaatcag

SEQ ID NO: 4241698 - DNA, 21 bp, Homo sapiens
acttttcccctgttaaacagt

SEQ ID NO: 4241699 - DNA, 14 bp, Homo sapiens
acttttgttctgct

SEQ ID NO: 4241700 - DNA, 16 bp, Homo sapiens
acttttgttctgcttt

SEQ ID NO: 4241701 - DNA, 16 bp, Homo sapiens
agaaaaacacgagaaa

SEQ ID NO: 4241702 - DNA, 14 bp, Homo sapiens
agaaaagtagacaa

SEQ ID NO: 4241703 - DNA, 15 bp, Homo sapiens
agaaaagtagacaat

SEQ ID NO: 4241704 - DNA, 16 bp, Homo sapiens
agaaaagttgcagatg

SEQ ID NO: 4241705 - DNA, 19 bp, Homo sapiens
agaaaagttgcagatgtat

SEQ ID NO: 4241706 - DNA, 20 bp, Homo sapiens
agaaaagttgcagatgtatt

SEQ ID NO: 4241707 - DNA, 16 bp, Homo sapiens
agaaaatagataattt

SEQ ID NO: 4241708 - DNA, 20 bp, Homo sapiens
agaaaatatttaatatcaaa

SEQ ID NO: 4241709 - DNA, 20 bp, Homo sapiens
agaaaatttagccctttaaa

SEQ ID NO: 4241710 - DNA, 23 bp, Homo sapiens
agaaaatttagccctttaaaacg

SEQ ID NO: 4241711 - DNA, 19 bp, Homo sapiens
agaaacacattcttattaa

SEQ ID NO: 4241712 - DNA, 21 bp, Homo sapiens
agaaactggattaaaacaatt

SEQ ID NO: 4241713 - DNA, 13 bp, Homo sapiens
agaaacttaaaca

SEQ ID NO: 4241714 - DNA, 14 bp, Homo sapiens
agaaatgtacagca

SEQ ID NO: 4241715 - DNA, 16 bp, Homo sapiens
agaaatgtacagcaag

SEQ ID NO: 4241716 - DNA, 11 bp, Homo sapiens
agaaatgtgtt

SEQ ID NO: 4241717 - DNA, 18 bp, Homo sapiens
agaactcagtgccacacc

SEQ ID NO: 4241718 - DNA, 17 bp, Homo sapiens
agaagaaaattctcctg

SEQ ID NO: 4241719 - DNA, 18 bp, Homo sapiens
agaagacatactgcttga

SEQ ID NO: 4241720 - DNA, 22 bp, Homo sapiens
agaagagttgaggaactgtaca

SEQ ID NO: 4241721 - DNA, 18 bp, Homo sapiens
agaagttctcaaagttaa

SEQ ID NO: 4241722 - DNA, 22 bp, Homo sapiens
agaataatccagtattgctgat

SEQ ID NO: 4241723 - DNA, 15 bp, Homo sapiens
agaataatggaaaca

SEQ ID NO: 4241724 - DNA, 14 bp, Homo sapiens
agaatgcttaaaaa

SEQ ID NO: 4241725 - DNA, 14 bp, Homo sapiens
agaatggagacaga

SEQ ID NO: 4241726 - DNA, 12 bp, Homo sapiens
agaatgtaaagt

SEQ ID NO: 4241727 - DNA, 19 bp, Homo sapiens
agaatgtaaagttatgtat

SEQ ID NO: 4241728 - DNA, 21 bp, Homo sapiens
agaatgtaaagttatgtattt

SEQ ID NO: 4241729 - DNA, 19 bp, Homo sapiens
agaattctctagtttgatt

SEQ ID NO: 4241730 - DNA, 20 bp, Homo sapiens
agaatttaagtagaaaagtt

SEQ ID NO: 4241731 - DNA, 12 bp, Homo sapiens
agacaaaaacaa

SEQ ID NO: 4241732 - DNA, 12 bp, Homo sapiens
agacaaaaataa

SEQ ID NO: 4241733 - DNA, 15 bp, Homo sapiens
agacaatcattgttt

SEQ ID NO: 4241734 - DNA, 17 bp, Homo sapiens
agacaatgacttactgt

SEQ ID NO: 4241735 - DNA, 15 bp, Homo sapiens
agacaatttattatg

SEQ ID NO: 4241736 - DNA, 19 bp, Homo sapiens
agacacaatatgtatgctt

SEQ ID NO: 4241737 - DNA, 19 bp, Homo sapiens
agacatactaaccagcaga

SEQ ID NO: 4241738 - DNA, 23 bp, Homo sapiens
agacatactaaccagcagaaatg

SEQ ID NO: 4241739 - DNA, 14 bp, Homo sapiens
agaccgctctcttt

SEQ ID NO: 4241740 - DNA, 22 bp, Homo sapiens
agaccgctctcttttctgtact

SEQ ID NO: 4241741 - DNA, 12 bp, Homo sapiens
agacgcagtccg

SEQ ID NO: 4241742 - DNA, 16 bp, Homo sapiens
agactactggccccgc

SEQ ID NO: 4241743 - DNA, 13 bp, Homo sapiens
agactatttcttt

SEQ ID NO: 4241744 - DNA, 16 bp, Homo sapiens
agactatttcttttta

SEQ ID NO: 4241745 - DNA, 15 bp, Homo sapiens
agactcctcttccca

SEQ ID NO: 4241746 - DNA, 11 bp, Homo sapiens
agactctcagc

SEQ ID NO: 4241747 - DNA, 16 bp, Homo sapiens
agactgtggaaccaaa

SEQ ID NO: 4241748 - DNA, 23 bp, Homo sapiens
agacttttgaaaaaaaagttttt

SEQ ID NO: 4241749 - DNA, 17 bp, Homo sapiens
agagaatggagacagag

SEQ ID NO: 4241750 - DNA, 15 bp, Homo sapiens
agagacaaagatttc

SEQ ID NO: 4241751 - DNA, 21 bp, Homo sapiens
agagagttaataggagtattt

SEQ ID NO: 4241752 - DNA, 21 bp, Homo sapiens
agagccttttatctgcagaac

SEQ ID NO: 4241753 - DNA, 15 bp, Homo sapiens
agagctgcagggtgg

SEQ ID NO: 4241754 - DNA, 16 bp, Homo sapiens
agagggacagagcccg

SEQ ID NO: 4241755 - DNA, 14 bp, Homo sapiens
agaggttaggagta

SEQ ID NO: 4241756 - DNA, 13 bp, Homo sapiens
agaggttcaaaga

SEQ ID NO: 4241757 - DNA, 20 bp, Homo sapiens
agaggttcaaagatattttg

SEQ ID NO: 4241758 - DNA, 23 bp, Homo sapiens
agagtaactttactctgtgttta

SEQ ID NO: 4241759 - DNA, 20 bp, Homo sapiens
agagtcacaagtagcctctg

SEQ ID NO: 4241760 - DNA, 23 bp, Homo sapiens
agagttaataggagtatttttgg

SEQ ID NO: 4241761 - DNA, 12 bp, Homo sapiens
agagttgttaca

SEQ ID NO: 4241762 - DNA, 17 bp, Homo sapiens
agagttgttacattttt

SEQ ID NO: 4241763 - DNA, 20 bp, Homo sapiens
agagttgttacatttttaag

SEQ ID NO: 4241764 - DNA, 13 bp, Homo sapiens
agatacagttact

SEQ ID NO: 4241765 - DNA, 22 bp, Homo sapiens
agatacagttactcagaattct

SEQ ID NO: 4241766 - DNA, 20 bp, Homo sapiens
attcacctatgttattttgt

SEQ ID NO: 4241767 - DNA, 18 bp, Homo sapiens
attcagattgtcttgcaa

SEQ ID NO: 4241768 - DNA, 23 bp, Homo sapiens
attcatagggaaaggttttgtat

SEQ ID NO: 4241769 - DNA, 15 bp, Homo sapiens
attcattctgagccc

SEQ ID NO: 4241770 - DNA, 14 bp, Homo sapiens
attcccttccttct

SEQ ID NO: 4241771 - DNA, 12 bp, Homo sapiens
attctacagaat

SEQ ID NO: 4241772 - DNA, 19 bp, Homo sapiens
attctccttttatgtgtag

SEQ ID NO: 4241773 - DNA, 19 bp, Homo sapiens
attctctcctgtacctctt

SEQ ID NO: 4241774 - DNA, 18 bp, Homo sapiens
attctgaccgttaaaaaa

SEQ ID NO: 4241775 - DNA, 19 bp, Homo sapiens
attctgcaagcacatctgc

SEQ ID NO: 4241776 - DNA, 18 bp, Homo sapiens
attctgcctatgtaaaat

SEQ ID NO: 4241777 - DNA, 14 bp, Homo sapiens
attcttctgtattt

SEQ ID NO: 4241778 - DNA, 15 bp, Homo sapiens
attcttttgtttcca

SEQ ID NO: 4241779 - DNA, 18 bp, Homo sapiens
attcttttgtttccatgg

SEQ ID NO: 4241780 - DNA, 19 bp, Homo sapiens
attgaaaaaaattgaaata

SEQ ID NO: 4241781 - DNA, 15 bp, Homo sapiens
attgaaggagaaaat

SEQ ID NO: 4241782 - DNA, 21 bp, Homo sapiens
attgagtttgtaggtaaaatg

SEQ ID NO: 4241783 - DNA, 20 bp, Homo sapiens
attgatatttttatacaagt

SEQ ID NO: 4241784 - DNA, 22 bp, Homo sapiens
attgcttagtaaaatttatttc

SEQ ID NO: 4241785 - DNA, 23 bp, Homo sapiens
attgcttagtaaaatttatttca

SEQ ID NO: 4241786 - DNA, 15 bp, Homo sapiens
attggcagtgacttt

SEQ ID NO: 4241787 - DNA, 17 bp, Homo sapiens
attggcagtgactttgt

SEQ ID NO: 4241788 - DNA, 19 bp, Homo sapiens
attggctagaggttcaaag

SEQ ID NO: 4241789 - DNA, 22 bp, Homo sapiens
attggctagaggttcaaagata

SEQ ID NO: 4241790 - DNA, 23 bp, Homo sapiens
attggctagaggttcaaagatat

SEQ ID NO: 4241791 - DNA, 15 bp, Homo sapiens
attgtaaattttaga

SEQ ID NO: 4241792 - DNA, 16 bp, Homo sapiens
attgtatcaatttgtt

SEQ ID NO: 4241793 - DNA, 17 bp, Homo sapiens
attgtgcttctccccag

SEQ ID NO: 4241794 - DNA, 18 bp, Homo sapiens
attgtgcttctccccaga

SEQ ID NO: 4241795 - DNA, 20 bp, Homo sapiens
attgtgcttctccccagaat

SEQ ID NO: 4241796 - DNA, 20 bp, Homo sapiens
attgtgtaccttaagatatt

SEQ ID NO: 4241797 - DNA, 14 bp, Homo sapiens
attgtttaaaattc

SEQ ID NO: 4241798 - DNA, 15 bp, Homo sapiens
attgtttaaaattca

SEQ ID NO: 4241799 - DNA, 18 bp, Homo sapiens
attgtttaaaattcagtt

SEQ ID NO: 4241800 - DNA, 19 bp, Homo sapiens
attgtttaaaattcagttt

SEQ ID NO: 4241801 - DNA, 17 bp, Homo sapiens
attgttttgaatattac

SEQ ID NO: 4241802 - DNA, 22 bp, Homo sapiens
attgttttgaatattactccta

SEQ ID NO: 4241803 - DNA, 14 bp, Homo sapiens
attgtttttctttc

SEQ ID NO: 4241804 - DNA, 19 bp, Homo sapiens
attgtttttctttctacaa

SEQ ID NO: 4241805 - DNA, 22 bp, Homo sapiens
atttaaatatctgttattcaaa

SEQ ID NO: 4241806 - DNA, 12 bp, Homo sapiens
atttaacagaaa

SEQ ID NO: 4241807 - DNA, 17 bp, Homo sapiens
atttaacagaaatgtac

SEQ ID NO: 4241808 - DNA, 18 bp, Homo sapiens
atttaagtagaaaagttg

SEQ ID NO: 4241809 - DNA, 23 bp, Homo sapiens
atttaagtagtgggcatttcata

SEQ ID NO: 4241810 - DNA, 12 bp, Homo sapiens
atttaatacagc

SEQ ID NO: 4241811 - DNA, 22 bp, Homo sapiens
atttaatacagctgaagtcaaa

SEQ ID NO: 4241812 - DNA, 20 bp, Homo sapiens
atttaatatcaaaagaaaat

SEQ ID NO: 4241813 - DNA, 21 bp, Homo sapiens
atttaatggcagctagtgcct

SEQ ID NO: 4241814 - DNA, 19 bp, Homo sapiens
atttacaaaagatttattg

SEQ ID NO: 4241815 - DNA, 15 bp, Homo sapiens
atttagtaagtatgt

SEQ ID NO: 4241816 - DNA, 15 bp, Homo sapiens
atttcatgaaaatga

SEQ ID NO: 4241817 - DNA, 15 bp, Homo sapiens
atttccgttaaaata

SEQ ID NO: 4241818 - DNA, 16 bp, Homo sapiens
atttccgttaaaatac

SEQ ID NO: 4241819 - DNA, 17 bp, Homo sapiens
atttccgttaaaatacc

SEQ ID NO: 4241820 - DNA, 21 bp, Homo sapiens
atttctaaatctccaaaataa

SEQ ID NO: 4241821 - DNA, 18 bp, Homo sapiens
atttctaggcacaaggtt

SEQ ID NO: 4241822 - DNA, 16 bp, Homo sapiens
atttctgctttctttg

SEQ ID NO: 4241823 - DNA, 17 bp, Homo sapiens
atttctgctttctttga

SEQ ID NO: 4241824 - DNA, 12 bp, Homo sapiens
atttctgtttag

SEQ ID NO: 4241825 - DNA, 19 bp, Homo sapiens
atttctgtttagataatac

SEQ ID NO: 4241826 - DNA, 20 bp, Homo sapiens
atttctgtttagataataca

SEQ ID NO: 4241827 - DNA, 14 bp, Homo sapiens
atttgaaaattttg

SEQ ID NO: 4241828 - DNA, 21 bp, Homo sapiens
atttgaggtctgttctttcca

SEQ ID NO: 4241829 - DNA, 23 bp, Homo sapiens
atttgaggtctgttctttccaaa

SEQ ID NO: 4241830 - DNA, 17 bp, Homo sapiens
atttgatgatgttaaat

SEQ ID NO: 4241831 - DNA, 16 bp, Homo sapiens
atttgatgattttcat

SEQ ID NO: 4241832 - DNA, 17 bp, Homo sapiens
atttgatggactaatta

SEQ ID NO: 4241833 - DNA, 22 bp, Homo sapiens
atttgatggactaattattatt

SEQ ID NO: 4241834 - DNA, 20 bp, Homo sapiens
atttggtggtttcagaaatg

SEQ ID NO: 4241835 - DNA, 17 bp, Homo sapiens
atttgtgatacaatgct

SEQ ID NO: 4241836 - DNA, 23 bp, Homo sapiens
atttgtttgaactgataaagatg

SEQ ID NO: 4241837 - DNA, 14 bp, Homo sapiens
attttaaaatatat

SEQ ID NO: 4241838 - DNA, 12 bp, Homo sapiens
attttaatacat

SEQ ID NO: 4241839 - DNA, 17 bp, Homo sapiens
attttaatgtacttgaa

SEQ ID NO: 4241840 - DNA, 16 bp, Homo sapiens
attttagtatgtgcag

SEQ ID NO: 4241841 - DNA, 16 bp, Homo sapiens
attttattaataatat

SEQ ID NO: 4241842 - DNA, 13 bp, Homo sapiens
attttattatgca

SEQ ID NO: 4241843 - DNA, 14 bp, Homo sapiens
attttattatgcat

SEQ ID NO: 4241844 - DNA, 18 bp, Homo sapiens
attttcctgacatttgtt

SEQ ID NO: 4241845 - DNA, 17 bp, Homo sapiens
attttctgtaatctttt

SEQ ID NO: 4241846 - DNA, 17 bp, Homo sapiens
attttgaggtaaagata

SEQ ID NO: 4241847 - DNA, 17 bp, Homo sapiens
attttgatgttttaagg

SEQ ID NO: 4241848 - DNA, 18 bp, Homo sapiens
attttgctttgtgatttt

SEQ ID NO: 4241849 - DNA, 20 bp, Homo sapiens
attttgctttgtgatttttg

SEQ ID NO: 4241850 - DNA, 12 bp, Homo sapiens
attttggaaact

SEQ ID NO: 4241851 - DNA, 16 bp, Homo sapiens
attttggaaactgcta

SEQ ID NO: 4241852 - DNA, 19 bp, Homo sapiens
attttggaaactgctaaat

SEQ ID NO: 4241853 - DNA, 13 bp, Homo sapiens
atttttatttatg

SEQ ID NO: 4241854 - DNA, 20 bp, Homo sapiens
atttttatttatttttcttg

SEQ ID NO: 4241855 - DNA, 12 bp, Homo sapiens
atttttgacaga

SEQ ID NO: 4241856 - DNA, 15 bp, Homo sapiens
atttttgtacttgat

SEQ ID NO: 4241857 - DNA, 21 bp, Homo sapiens
atttttgtacttgatttgatg

SEQ ID NO: 4241858 - DNA, 13 bp, Homo sapiens
attttttaaaaca

SEQ ID NO: 4241859 - DNA, 18 bp, Homo sapiens
attttttaaaacactaaa

SEQ ID NO: 4241860 - DNA, 13 bp, Homo sapiens
attttttaaatgc

SEQ ID NO: 4241861 - DNA, 21 bp, Homo sapiens
attttttaagtgggctcctga

SEQ ID NO: 4241862 - DNA, 20 bp, Homo sapiens
caaaaaaatttaaaattacg

SEQ ID NO: 4241863 - DNA, 12 bp, Homo sapiens
caaaaataatag

SEQ ID NO: 4241864 - DNA, 20 bp, Homo sapiens
caaaagaaaattgatatttt

SEQ ID NO: 4241865 - DNA, 23 bp, Homo sapiens
caaaagaaaattgatatttttat

SEQ ID NO: 4241866 - DNA, 22 bp, Homo sapiens
caaaatacaatcctgtttataa

SEQ ID NO: 4241867 - DNA, 16 bp, Homo sapiens
caaaatattttttgca

SEQ ID NO: 4241868 - DNA, 14 bp, Homo sapiens
caaacagtatttct

SEQ ID NO: 4241869 - DNA, 15 bp, Homo sapiens
caaacagtatttctg

SEQ ID NO: 4241870 - DNA, 16 bp, Homo sapiens
caaacatgtatgtata

SEQ ID NO: 4241871 - DNA, 14 bp, Homo sapiens
caaacatgtattta

SEQ ID NO: 4241872 - DNA, 16 bp, Homo sapiens
caaacatgtatttatg

SEQ ID NO: 4241873 - DNA, 18 bp, Homo sapiens
caaacatgtatttatgta

SEQ ID NO: 4241874 - DNA, 17 bp, Homo sapiens
caaactgactcaacagt

SEQ ID NO: 4241875 - DNA, 14 bp, Homo sapiens
caaagagaccaggg

SEQ ID NO: 4241876 - DNA, 18 bp, Homo sapiens
caaagatattttgctttg

SEQ ID NO: 4241877 - DNA, 23 bp, Homo sapiens
caaagatattttgctttgtgatt

SEQ ID NO: 4241878 - DNA, 18 bp, Homo sapiens
caaagctcaaataaaaat

SEQ ID NO: 4241879 - DNA, 13 bp, Homo sapiens
caaagctggccca

SEQ ID NO: 4241880 - DNA, 17 bp, Homo sapiens
caaaggtggcaatgctt

SEQ ID NO: 4241881 - DNA, 21 bp, Homo sapiens
cgtcttaagtcagatttttat

SEQ ID NO: 4241882 - DNA, 14 bp, Homo sapiens
cgtgcataccactt

SEQ ID NO: 4241883 - DNA, 15 bp, Homo sapiens
cgtgcgggcgaggcc

SEQ ID NO: 4241884 - DNA, 15 bp, Homo sapiens
cgtgcgtgtgagtgt

SEQ ID NO: 4241885 - DNA, 12 bp, Homo sapiens
cgtttctgccca

SEQ ID NO: 4241886 - DNA, 19 bp, Homo sapiens
cgttttccaaactgactca

SEQ ID NO: 4241887 - DNA, 15 bp, Homo sapiens
ctaaaggctaccttt

SEQ ID NO: 4241888 - DNA, 12 bp, Homo sapiens
ctaaataaatgg

SEQ ID NO: 4241889 - DNA, 21 bp, Homo sapiens
ctaaatatgaaccctttgttt

SEQ ID NO: 4241890 - DNA, 20 bp, Homo sapiens
ctaaatctccaaaataaaac

SEQ ID NO: 4241891 - DNA, 18 bp, Homo sapiens
ctaaatggaaccactcta

SEQ ID NO: 4241892 - DNA, 14 bp, Homo sapiens
ctaaattctatgtt

SEQ ID NO: 4241893 - DNA, 22 bp, Homo sapiens
ctaaatttgtgctttttaagaa

SEQ ID NO: 4241894 - DNA, 21 bp, Homo sapiens
ctaaccagggaagctgtccct

SEQ ID NO: 4241895 - DNA, 23 bp, Homo sapiens
ctaagtttttatggcttttgtgc

SEQ ID NO: 4241896 - DNA, 22 bp, Homo sapiens
ctaatatccccaaattagggca

SEQ ID NO: 4241897 - DNA, 12 bp, Homo sapiens
ctaatggcatgg

SEQ ID NO: 4241898 - DNA, 17 bp, Homo sapiens
ctaatggcatggagact

SEQ ID NO: 4241899 - DNA, 19 bp, Homo sapiens
ctaatggcatggagactct

SEQ ID NO: 4241900 - DNA, 15 bp, Homo sapiens
ctaatgtctcactgt

SEQ ID NO: 4241901 - DNA, 23 bp, Homo sapiens
ctaattattattttaaaatatat

SEQ ID NO: 4241902 - DNA, 16 bp, Homo sapiens
ctaatttttgtatttt

SEQ ID NO: 4241903 - DNA, 13 bp, Homo sapiens
ctacagaataatc

SEQ ID NO: 4241904 - DNA, 14 bp, Homo sapiens
ctacattctgttaa

SEQ ID NO: 4241905 - DNA, 19 bp, Homo sapiens
ctaccctcctgcactgttt

SEQ ID NO: 4241906 - DNA, 21 bp, Homo sapiens
ctacctctcgtttctgcccag

SEQ ID NO: 4241907 - DNA, 21 bp, Homo sapiens
ctactgtaatttgtgatacaa

SEQ ID NO: 4241908 - DNA, 15 bp, Homo sapiens
ctagagaatgcacag

SEQ ID NO: 4241909 - DNA, 15 bp, Homo sapiens
ctagaggttcaaaga

SEQ ID NO: 4241910 - DNA, 18 bp, Homo sapiens
ctagaggttcaaagatat

SEQ ID NO: 4241911 - DNA, 24 bp, Homo sapiens
ctagatactgtatcatgacaaaga

SEQ ID NO: 4241912 - DNA, 23 bp, Homo sapiens
ctagcatacgtacacattttatt

SEQ ID NO: 4241913 - DNA, 13 bp, Homo sapiens
ctaggacttcaaa

SEQ ID NO: 4241914 - DNA, 20 bp, Homo sapiens
ctaggagaagagttgaggaa

SEQ ID NO: 4241915 - DNA, 15 bp, Homo sapiens
ctagtggatgactgt

SEQ ID NO: 4241916 - DNA, 18 bp, Homo sapiens
ctagtttccctggtgccc

SEQ ID NO: 4241917 - DNA, 17 bp, Homo sapiens
ctagtttgattaaattc

SEQ ID NO: 4241918 - DNA, 21 bp, Homo sapiens
ctagtttgattaaattcttgc

SEQ ID NO: 4241919 - DNA, 22 bp, Homo sapiens
ctataagaggaatttcttttcc

SEQ ID NO: 4241920 - DNA, 17 bp, Homo sapiens
ctataattctgttatat

SEQ ID NO: 4241921 - DNA, 14 bp, Homo sapiens
ctatatatatttct

SEQ ID NO: 4241922 - DNA, 14 bp, Homo sapiens
ctatccaaacatgt

SEQ ID NO: 4241923 - DNA, 20 bp, Homo sapiens
ctatccaaacatgtatttat

SEQ ID NO: 4241924 - DNA, 20 bp, Homo sapiens
ctatgcatattcaatgtatt

SEQ ID NO: 4241925 - DNA, 21 bp, Homo sapiens
ctatgcatttgaaaattttga

SEQ ID NO: 4241926 - DNA, 18 bp, Homo sapiens
ctatggaacataaagttg

SEQ ID NO: 4241927 - DNA, 17 bp, Homo sapiens
ctatgttaaatactgtg

SEQ ID NO: 4241928 - DNA, 22 bp, Homo sapiens
ctatgttaaatactgtgcagaa

SEQ ID NO: 4241929 - DNA, 21 bp, Homo sapiens
ctcaaatcagtgataattggt

SEQ ID NO: 4241930 - DNA, 13 bp, Homo sapiens
ctcaaatttctaa

SEQ ID NO: 4241931 - DNA, 17 bp, Homo sapiens
ctcaagctagtgtttct

SEQ ID NO: 4241932 - DNA, 20 bp, Homo sapiens
ctcaatctctgttgcacctg

SEQ ID NO: 4241933 - DNA, 21 bp, Homo sapiens
ctcaattgaaagcttttaaaa

SEQ ID NO: 4241934 - DNA, 17 bp, Homo sapiens
ctcacagtgttgcccag

SEQ ID NO: 4241935 - DNA, 19 bp, Homo sapiens
ctcaccccatcccacaccc

SEQ ID NO: 4241936 - DNA, 22 bp, Homo sapiens
ctcaccccatcccacaccctgg

SEQ ID NO: 4241937 - DNA, 14 bp, Homo sapiens
ctcacttagtcctt

SEQ ID NO: 4241938 - DNA, 20 bp, Homo sapiens
ctcagcctccggagtagctg

SEQ ID NO: 4241939 - DNA, 22 bp, Homo sapiens
ctcagctataattctgttatat

SEQ ID NO: 4241940 - DNA, 14 bp, Homo sapiens
ctcaggctccccag

SEQ ID NO: 4241941 - DNA, 23 bp, Homo sapiens
ctcaggctccccagtgctcctgg

SEQ ID NO: 4241942 - DNA, 13 bp, Homo sapiens
ctcatcttgtgaa

SEQ ID NO: 4241943 - DNA, 16 bp, Homo sapiens
ctccaaaataaaactt

SEQ ID NO: 4241944 - DNA, 18 bp, Homo sapiens
ctccacaaagagaccagg

SEQ ID NO: 4241945 - DNA, 19 bp, Homo sapiens
ctccacacggagctcctgg

SEQ ID NO: 4241946 - DNA, 13 bp, Homo sapiens
ctcccaagccact

SEQ ID NO: 4241947 - DNA, 15 bp, Homo sapiens
ctcccacccccatct

SEQ ID NO: 4241948 - DNA, 23 bp, Homo sapiens
ctccccagaattcacgcctctcc

SEQ ID NO: 4241949 - DNA, 19 bp, Homo sapiens
ctccccagttggcccttct

SEQ ID NO: 4241950 - DNA, 14 bp, Homo sapiens
ctccctcccctgcc

SEQ ID NO: 4241951 - DNA, 13 bp, Homo sapiens
ctccgaggccagt

SEQ ID NO: 4241952 - DNA, 23 bp, Homo sapiens
ctccgcagggcgcccagcgccgt

SEQ ID NO: 4241953 - DNA, 22 bp, Homo sapiens
ctcctaatggcatggagactct

SEQ ID NO: 4241954 - DNA, 19 bp, Homo sapiens
ctcctagcagacagaaact

SEQ ID NO: 4241955 - DNA, 13 bp, Homo sapiens
ctcctccctggga

SEQ ID NO: 4241956 - DNA, 15 bp, Homo sapiens
ctcctgcactgttta

SEQ ID NO: 4241957 - DNA, 19 bp, Homo sapiens
ctcgatccaaattgtgctt

SEQ ID NO: 4241958 - DNA, 17 bp, Homo sapiens
ctcggagggtgccgtgc

SEQ ID NO: 4241959 - DNA, 16 bp, Homo sapiens
ctcgggtcaccctgct

SEQ ID NO: 4241960 - DNA, 15 bp, Homo sapiens
ctctaggacttcaaa

SEQ ID NO: 4241961 - DNA, 17 bp, Homo sapiens
ctctaggacttcaaagt

SEQ ID NO: 4241962 - DNA, 15 bp, Homo sapiens
ctctagtttgattaa

SEQ ID NO: 4241963 - DNA, 17 bp, Homo sapiens
ctctcacaggcagctct

SEQ ID NO: 4241964 - DNA, 23 bp, Homo sapiens
ctctcacaggcagctctgagccg

SEQ ID NO: 4241965 - DNA, 15 bp, Homo sapiens
ctctcagcccagaag

SEQ ID NO: 4241966 - DNA, 11 bp, Homo sapiens
ctctccatatc

SEQ ID NO: 4241967 - DNA, 17 bp, Homo sapiens
ctctcccccaaggccac

SEQ ID NO: 4241968 - DNA, 20 bp, Homo sapiens
ctctcccccaaggccactgc

SEQ ID NO: 4241969 - DNA, 18 bp, Homo sapiens
ctctccctcccccagagc

SEQ ID NO: 4241970 - DNA, 19 bp, Homo sapiens
ctctccctcccccagagcc

SEQ ID NO: 4241971 - DNA, 13 bp, Homo sapiens
ctctccctcccct

SEQ ID NO: 4241972 - DNA, 12 bp, Homo sapiens
ctctccctgttg

SEQ ID NO: 4241973 - DNA, 18 bp, Homo sapiens
ctctcctgtacctcttga

SEQ ID NO: 4241974 - DNA, 16 bp, Homo sapiens
ctctcgtttctgccca

SEQ ID NO: 4241975 - DNA, 12 bp, Homo sapiens
ctctcttttctg

SEQ ID NO: 4241976 - DNA, 14 bp, Homo sapiens
ctctcttttctgta

SEQ ID NO: 4241977 - DNA, 17 bp, Homo sapiens
ctctcttttctgtactt

SEQ ID NO: 4241978 - DNA, 19 bp, Homo sapiens
ctctcttttctgtacttcc

SEQ ID NO: 4241979 - DNA, 22 bp, Homo sapiens
ctctcttttctgtacttcctga

SEQ ID NO: 4241980 - DNA, 22 bp, Homo sapiens
ctctgagagcgaattgtgtgga

SEQ ID NO: 4241981 - DNA, 14 bp, Homo sapiens
ctctgctggcccag

SEQ ID NO: 4241982 - DNA, 15 bp, Homo sapiens
ctctgggatctgcca

SEQ ID NO: 4241983 - DNA, 21 bp, Homo sapiens
ctctggggaagatggagcagg

SEQ ID NO: 4241984 - DNA, 14 bp, Homo sapiens
ctctgtggccagga

SEQ ID NO: 4241985 - DNA, 15 bp, Homo sapiens
ctctgtggccaggag

SEQ ID NO: 4241986 - DNA, 16 bp, Homo sapiens
ctctgtggccaggagc

SEQ ID NO: 4241987 - DNA, 17 bp, Homo sapiens
ctctgtggccaggagcc

SEQ ID NO: 4241988 - DNA, 18 bp, Homo sapiens
ctctgtggccaggagccc

SEQ ID NO: 4241989 - DNA, 12 bp, Homo sapiens
ctcttaatctgt

SEQ ID NO: 4241990 - DNA, 14 bp, Homo sapiens
ctcttaatctgtgt

SEQ ID NO: 4241991 - DNA, 20 bp, Homo sapiens
ctcttcagactctcagccca

SEQ ID NO: 4241992 - DNA, 19 bp, Homo sapiens
ctcttcagatctctaactt

SEQ ID NO: 4241993 - DNA, 17 bp, Homo sapiens
ctcttgagccttgaact

SEQ ID NO: 4241994 - DNA, 18 bp, Homo sapiens
ctcttgagccttgaactt

SEQ ID NO: 4241995 - DNA, 14 bp, Homo sapiens
ctctttgccctgag

SEQ ID NO: 4241996 - DNA, 21 bp, Homo sapiens
gcggcccggccggagggcagg

SEQ ID NO: 4241997 - DNA, 16 bp, Homo sapiens
gcggcctccatgcact

SEQ ID NO: 4241998 - DNA, 15 bp, Homo sapiens
gcgggtgatgagacc

SEQ ID NO: 4241999 - DNA, 16 bp, Homo sapiens
gctaaattctatgtta

SEQ ID NO: 4242000 - DNA, 14 bp, Homo sapiens
gctaagctgccctg

SEQ ID NO: 4242001 - DNA, 17 bp, Homo sapiens
gctaatttttgtatttt

SEQ ID NO: 4242002 - DNA, 16 bp, Homo sapiens
gctacctgcacctctg

SEQ ID NO: 4242003 - DNA, 17 bp, Homo sapiens
gctacctgcacctctgg

SEQ ID NO: 4242004 - DNA, 19 bp, Homo sapiens
gctagcaaatggcagaacc

SEQ ID NO: 4242005 - DNA, 13 bp, Homo sapiens
gctagtgccttta

SEQ ID NO: 4242006 - DNA, 13 bp, Homo sapiens
gctagtgtttcta

SEQ ID NO: 4242007 - DNA, 13 bp, Homo sapiens
gctatgcatttga

SEQ ID NO: 4242008 - DNA, 24 bp, Homo sapiens
gctcaggcgatccacctgtctcag

SEQ ID NO: 4242009 - DNA, 18 bp, Homo sapiens
gctccagggagattttga

SEQ ID NO: 4242010 - DNA, 22 bp, Homo sapiens
gctccgcagggcgcccagcgcc

SEQ ID NO: 4242011 - DNA, 12 bp, Homo sapiens
gctcctgacaat

SEQ ID NO: 4242012 - DNA, 17 bp, Homo sapiens
gctcgagcagtcctgcc

SEQ ID NO: 4242013 - DNA, 19 bp, Homo sapiens
gctcttgggaccccagaga

SEQ ID NO: 4242014 - DNA, 19 bp, Homo sapiens
gctgcatttaaaagataca

SEQ ID NO: 4242015 - DNA, 16 bp, Homo sapiens
gctggcatttgcacct

SEQ ID NO: 4242016 - DNA, 15 bp, Homo sapiens
gctgggtgccaggtg

SEQ ID NO: 4242017 - DNA, 17 bp, Homo sapiens
gctgggtgccaggtgct

SEQ ID NO: 4242018 - DNA, 16 bp, Homo sapiens
gctggtaacagtggct

SEQ ID NO: 4242019 - DNA, 16 bp, Homo sapiens
gctggtgtactctagg

SEQ ID NO: 4242020 - DNA, 13 bp, Homo sapiens
gctgtctggccag

SEQ ID NO: 4242021 - DNA, 17 bp, Homo sapiens
gctgtggggtcgggctc

SEQ ID NO: 4242022 - DNA, 14 bp, Homo sapiens
gctgtgtgattaga

SEQ ID NO: 4242023 - DNA, 13 bp, Homo sapiens
gctgttcctgaga

SEQ ID NO: 4242024 - DNA, 21 bp, Homo sapiens
gctgttttgattcccgggctt

SEQ ID NO: 4242025 - DNA, 17 bp, Homo sapiens
gcttaaactaaataatg

SEQ ID NO: 4242026 - DNA, 14 bp, Homo sapiens
gcttaacttcacat

SEQ ID NO: 4242027 - DNA, 18 bp, Homo sapiens
gcttactcccaaaacagc

SEQ ID NO: 4242028 - DNA, 16 bp, Homo sapiens
gcttagtaaaatttat

SEQ ID NO: 4242029 - DNA, 19 bp, Homo sapiens
gcttagtaaaatttatttc

SEQ ID NO: 4242030 - DNA, 17 bp, Homo sapiens
gcttattgcttagtaaa

SEQ ID NO: 4242031 - DNA, 18 bp, Homo sapiens
gcttgattttaatacatt

SEQ ID NO: 4242032 - DNA, 19 bp, Homo sapiens
gcttgtacataatgcgtgc

SEQ ID NO: 4242033 - DNA, 23 bp, Homo sapiens
gcttgtggaggagggagagccct

SEQ ID NO: 4242034 - DNA, 18 bp, Homo sapiens
gcttgttccctctccctg

SEQ ID NO: 4242035 - DNA, 13 bp, Homo sapiens
gctttcccctcct

SEQ ID NO: 4242036 - DNA, 19 bp, Homo sapiens
gctttcctgatgatgctgg

SEQ ID NO: 4242037 - DNA, 15 bp, Homo sapiens
gctttctgtgcatgt

SEQ ID NO: 4242038 - DNA, 19 bp, Homo sapiens
gctttctttgattctcctt

SEQ ID NO: 4242039 - DNA, 12 bp, Homo sapiens
gcttttgtgcat

SEQ ID NO: 4242040 - DNA, 20 bp, Homo sapiens
ggaaaatgcttaaaaaataa

SEQ ID NO: 4242041 - DNA, 19 bp, Homo sapiens
ggaaccgaggtgttgccag

SEQ ID NO: 4242042 - DNA, 17 bp, Homo sapiens
ggaatcattccagtgct

SEQ ID NO: 4242043 - DNA, 14 bp, Homo sapiens
ggaattgaaaaaaa

SEQ ID NO: 4242044 - DNA, 12 bp, Homo sapiens
ggacagagcccg

SEQ ID NO: 4242045 - DNA, 15 bp, Homo sapiens
ggaccagcccacagc

SEQ ID NO: 4242046 - DNA, 22 bp, Homo sapiens
ggaccccagagaaaacccggag

SEQ ID NO: 4242047 - DNA, 16 bp, Homo sapiens
ggactcggagggtgcc

SEQ ID NO: 4242048 - DNA, 23 bp, Homo sapiens
ggactgcacagcgtcctgtccac

SEQ ID NO: 4242049 - DNA, 14 bp, Homo sapiens
ggactggtttgaga

SEQ ID NO: 4242050 - DNA, 14 bp, Homo sapiens
ggactgtctgatca

SEQ ID NO: 4242051 - DNA, 17 bp, Homo sapiens
ggagacagaatagagtg

SEQ ID NO: 4242052 - DNA, 13 bp, Homo sapiens
ggagaccaggctc

SEQ ID NO: 4242053 - DNA, 19 bp, Homo sapiens
ggagagactcgctcactcc

SEQ ID NO: 4242054 - DNA, 12 bp, Homo sapiens
ggagagccctgt

SEQ ID NO: 4242055 - DNA, 19 bp, Homo sapiens
ggagatcttcccctaacct

SEQ ID NO: 4242056 - DNA, 21 bp, Homo sapiens
ggagattttgaggtaaagata

SEQ ID NO: 4242057 - DNA, 13 bp, Homo sapiens
ggagcaagcagga

SEQ ID NO: 4242058 - DNA, 20 bp, Homo sapiens
ggagcatttaatggcagcta

SEQ ID NO: 4242059 - DNA, 21 bp, Homo sapiens
ggagcatttaatggcagctag

SEQ ID NO: 4242060 - DNA, 23 bp, Homo sapiens
ggagcatttaatggcagctagtg

SEQ ID NO: 4242061 - DNA, 24 bp, Homo sapiens
ggagcatttaatggcagctagtgc

SEQ ID NO: 4242062 - DNA, 16 bp, Homo sapiens
ggagcgccctgcaggg

SEQ ID NO: 4242063 - DNA, 19 bp, Homo sapiens
ggagcgccctgcagggccg

SEQ ID NO: 4242064 - DNA, 14 bp, Homo sapiens
ggagctcctggcag

SEQ ID NO: 4242065 - DNA, 15 bp, Homo sapiens
ggagctcctggcagc

SEQ ID NO: 4242066 - DNA, 21 bp, Homo sapiens
ggagctgctgggtggcagggg

SEQ ID NO: 4242067 - DNA, 19 bp, Homo sapiens
ggaggaaccgaggtgttgc

SEQ ID NO: 4242068 - DNA, 16 bp, Homo sapiens
ggaggcggcctccatg

SEQ ID NO: 4242069 - DNA, 11 bp, Homo sapiens
ggagggcagga

SEQ ID NO: 4242070 - DNA, 12 bp, Homo sapiens
ggaggggccgga

SEQ ID NO: 4242071 - DNA, 17 bp, Homo sapiens
ggattaaaacaattttt

SEQ ID NO: 4242072 - DNA, 12 bp, Homo sapiens
ggatttaacaga

SEQ ID NO: 4242073 - DNA, 17 bp, Homo sapiens
ggatttaacagaaatgt

SEQ ID NO: 4242074 - DNA, 21 bp, Homo sapiens
ggcaagactgcaaactttttt

SEQ ID NO: 4242075 - DNA, 21 bp, Homo sapiens
ggcaataaataaagcttggga

SEQ ID NO: 4242076 - DNA, 13 bp, Homo sapiens
ggcaattggaaca

SEQ ID NO: 4242077 - DNA, 13 bp, Homo sapiens
ggcagctagtgcc

SEQ ID NO: 4242078 - DNA, 15 bp, Homo sapiens
ggcagctagtgcctt

SEQ ID NO: 4242079 - DNA, 14 bp, Homo sapiens
ggcagctctgagcc

SEQ ID NO: 4242080 - DNA, 16 bp, Homo sapiens
ggcagctctgagccgc

SEQ ID NO: 4242081 - DNA, 11 bp, Homo sapiens
ggcagtgactt

SEQ ID NO: 4242082 - DNA, 18 bp, Homo sapiens
ggcatcatcctcagcagc

SEQ ID NO: 4242083 - DNA, 14 bp, Homo sapiens
ggcatggagactct

SEQ ID NO: 4242084 - DNA, 18 bp, Homo sapiens
ggcatggagactctgaga

SEQ ID NO: 4242085 - DNA, 19 bp, Homo sapiens
ggcattctcggtacttctg

SEQ ID NO: 4242086 - DNA, 16 bp, Homo sapiens
ggccaatttactggcc

SEQ ID NO: 4242087 - DNA, 20 bp, Homo sapiens
ggccagctgccccagccaga

SEQ ID NO: 4242088 - DNA, 11 bp, Homo sapiens
ggccaggagcc

SEQ ID NO: 4242089 - DNA, 14 bp, Homo sapiens
ggccaggagccatg

SEQ ID NO: 4242090 - DNA, 18 bp, Homo sapiens
ggccagtacctttccatt

SEQ ID NO: 4242091 - DNA, 16 bp, Homo sapiens
ggcccggccggagggc

SEQ ID NO: 4242092 - DNA, 16 bp, Homo sapiens
ggccctacagtacccc

SEQ ID NO: 4242093 - DNA, 20 bp, Homo sapiens
ggccgaggaatgtgaagcca

SEQ ID NO: 4242094 - DNA, 23 bp, Homo sapiens
ggcctacctctcgtttctgccca

SEQ ID NO: 4242095 - DNA, 12 bp, Homo sapiens
ggcgcagccctc

SEQ ID NO: 4242096 - DNA, 23 bp, Homo sapiens
ggcggcccggccggagggcagga

SEQ ID NO: 4242097 - DNA, 12 bp, Homo sapiens
ggcggcctccat

SEQ ID NO: 4242098 - DNA, 13 bp, Homo sapiens
ggctacctttgta

SEQ ID NO: 4242099 - DNA, 20 bp, Homo sapiens
ggctactctgcccaccccag

SEQ ID NO: 4242100 - DNA, 22 bp, Homo sapiens
ggctagaggttcaaagatattt

SEQ ID NO: 4242101 - DNA, 12 bp, Homo sapiens
ggctatgcattt

SEQ ID NO: 4242102 - DNA, 15 bp, Homo sapiens
ggctatgcatttgaa

SEQ ID NO: 4242103 - DNA, 17 bp, Homo sapiens
ggctcacgtcgcggccg

SEQ ID NO: 4242104 - DNA, 12 bp, Homo sapiens
ggctcatgcctg

SEQ ID NO: 4242105 - DNA, 21 bp, Homo sapiens
ggctccccagtgctcctggcc

SEQ ID NO: 4242106 - DNA, 21 bp, Homo sapiens
ggctcgagcagtcctgcctca

SEQ ID NO: 4242107 - DNA, 20 bp, Homo sapiens
ggctcttatgtgtgcctttg

SEQ ID NO: 4242108 - DNA, 10 bp, Homo sapiens
ggcttttgtg

SEQ ID NO: 4242109 - DNA, 20 bp, Homo sapiens
gggaaaaaacttaaaaatta

SEQ ID NO: 4242110 - DNA, 14 bp, Homo sapiens
gggaaatgagccag

SEQ ID NO: 4242111 - DNA, 16 bp, Homo sapiens
gggaacagcctgagcc

SEQ ID NO: 4242112 - DNA, 21 bp, Homo sapiens
tataagaatgagcctgtccaa

SEQ ID NO: 4242113 - DNA, 13 bp, Homo sapiens
tataatctgaaga

SEQ ID NO: 4242114 - DNA, 13 bp, Homo sapiens
tataattttatgg

SEQ ID NO: 4242115 - DNA, 19 bp, Homo sapiens
tatacaggaggatgtgaat

SEQ ID NO: 4242116 - DNA, 15 bp, Homo sapiens
tatacatattgtata

SEQ ID NO: 4242117 - DNA, 19 bp, Homo sapiens
tatacttttcccctgttaa

SEQ ID NO: 4242118 - DNA, 22 bp, Homo sapiens
tatacttttcccctgttaaaca

SEQ ID NO: 4242119 - DNA, 23 bp, Homo sapiens
tatacttttcccctgttaaacag

SEQ ID NO: 4242120 - DNA, 14 bp, Homo sapiens
tatataaagtatag

SEQ ID NO: 4242121 - DNA, 14 bp, Homo sapiens
tatataattttatg

SEQ ID NO: 4242122 - DNA, 20 bp, Homo sapiens
tatatattcttataaaaatg

SEQ ID NO: 4242123 - DNA, 16 bp, Homo sapiens
tatatcattctacaga

SEQ ID NO: 4242124 - DNA, 14 bp, Homo sapiens
tatatcttttggtt

SEQ ID NO: 4242125 - DNA, 14 bp, Homo sapiens
tatattaaaacaat

SEQ ID NO: 4242126 - DNA, 12 bp, Homo sapiens
tatattaaacat

SEQ ID NO: 4242127 - DNA, 15 bp, Homo sapiens
tatattagtgaagat

SEQ ID NO: 4242128 - DNA, 16 bp, Homo sapiens
tatattagtgaagatg

SEQ ID NO: 4242129 - DNA, 22 bp, Homo sapiens
tatattagtgaagatggtttca

SEQ ID NO: 4242130 - DNA, 14 bp, Homo sapiens
tatattataaatat

SEQ ID NO: 4242131 - DNA, 22 bp, Homo sapiens
tatattgagaatcccttaaaat

SEQ ID NO: 4242132 - DNA, 20 bp, Homo sapiens
tatatttcacttttgttctg

SEQ ID NO: 4242133 - DNA, 22 bp, Homo sapiens
tatatttcacttttgttctgct

SEQ ID NO: 4242134 - DNA, 22 bp, Homo sapiens
tatattttaatgtttttaaaaa

SEQ ID NO: 4242135 - DNA, 18 bp, Homo sapiens
tatcaagtattatacctt

SEQ ID NO: 4242136 - DNA, 19 bp, Homo sapiens
tatcacccagaagaaaata

SEQ ID NO: 4242137 - DNA, 22 bp, Homo sapiens
tatcacccagaagaaaatagtg

SEQ ID NO: 4242138 - DNA, 18 bp, Homo sapiens
tatcagctttgataattg

SEQ ID NO: 4242139 - DNA, 22 bp, Homo sapiens
tatccatgacaggcctgaagat

SEQ ID NO: 4242140 - DNA, 19 bp, Homo sapiens
tatccctactgtaatttgt

SEQ ID NO: 4242141 - DNA, 16 bp, Homo sapiens
tatcgtcactgcttaa

SEQ ID NO: 4242142 - DNA, 19 bp, Homo sapiens
tatctagatactgtatcat

SEQ ID NO: 4242143 - DNA, 22 bp, Homo sapiens
tatctgacccactttgtaattt

SEQ ID NO: 4242144 - DNA, 19 bp, Homo sapiens
tatctgtgaaatgctggca

SEQ ID NO: 4242145 - DNA, 20 bp, Homo sapiens
tatcttggggcaagactgca

SEQ ID NO: 4242146 - DNA, 17 bp, Homo sapiens
tatgaaggaatcattcc

SEQ ID NO: 4242147 - DNA, 14 bp, Homo sapiens
tatgaggcatttgt

SEQ ID NO: 4242148 - DNA, 15 bp, Homo sapiens
tatgaggcatttgtt

SEQ ID NO: 4242149 - DNA, 21 bp, Homo sapiens
tatgaggcatttgtttgaact

SEQ ID NO: 4242150 - DNA, 16 bp, Homo sapiens
tatgatattgtttaaa

SEQ ID NO: 4242151 - DNA, 23 bp, Homo sapiens
tatgatattgtttaaaattcagt

SEQ ID NO: 4242152 - DNA, 14 bp, Homo sapiens
tatgatttccttca

SEQ ID NO: 4242153 - DNA, 16 bp, Homo sapiens
tatgcactaaatatga

SEQ ID NO: 4242154 - DNA, 16 bp, Homo sapiens
tatgcatattcaatgt

SEQ ID NO: 4242155 - DNA, 18 bp, Homo sapiens
tatggagaattgctgaag

SEQ ID NO: 4242156 - DNA, 20 bp, Homo sapiens
tatggccctggcctagcata

SEQ ID NO: 4242157 - DNA, 12 bp, Homo sapiens
tatgtatgaagg

SEQ ID NO: 4242158 - DNA, 13 bp, Homo sapiens
tatgtatgaagga

SEQ ID NO: 4242159 - DNA, 15 bp, Homo sapiens
tatgtgaggtaatta

SEQ ID NO: 4242160 - DNA, 13 bp, Homo sapiens
tatgttaaatact

SEQ ID NO: 4242161 - DNA, 14 bp, Homo sapiens
tatgttaaatactg

SEQ ID NO: 4242162 - DNA, 21 bp, Homo sapiens
tatgttaaatactgtgcagaa

SEQ ID NO: 4242163 - DNA, 16 bp, Homo sapiens
tatgtttttataaaaa

SEQ ID NO: 4242164 - DNA, 22 bp, Homo sapiens
tattaaaaatctcaaatttcta

SEQ ID NO: 4242165 - DNA, 22 bp, Homo sapiens
tattaaacatacataatacaat

SEQ ID NO: 4242166 - DNA, 13 bp, Homo sapiens
tattaattcttca

SEQ ID NO: 4242167 - DNA, 17 bp, Homo sapiens
tattactcctatttttg

SEQ ID NO: 4242168 - DNA, 21 bp, Homo sapiens
tattagtgaagatggtttcaa

SEQ ID NO: 4242169 - DNA, 13 bp, Homo sapiens
tattataaatata

SEQ ID NO: 4242170 - DNA, 20 bp, Homo sapiens
tattataaatatatataaag

SEQ ID NO: 4242171 - DNA, 23 bp, Homo sapiens
tattataaatatatataaagaat

SEQ ID NO: 4242172 - DNA, 14 bp, Homo sapiens
tattatattaaaca

SEQ ID NO: 4242173 - DNA, 14 bp, Homo sapiens
tattcaaatttgat

SEQ ID NO: 4242174 - DNA, 19 bp, Homo sapiens
tattcatatacaaacatgt

SEQ ID NO: 4242175 - DNA, 23 bp, Homo sapiens
tattcatatacaaacatgtatgt

SEQ ID NO: 4242176 - DNA, 18 bp, Homo sapiens
tattctctcctgtacctc

SEQ ID NO: 4242177 - DNA, 15 bp, Homo sapiens
tattcttttgtttcc

SEQ ID NO: 4242178 - DNA, 22 bp, Homo sapiens
tattgactgtaccacagacaca

SEQ ID NO: 4242179 - DNA, 18 bp, Homo sapiens
tattgagaatcccttaaa

SEQ ID NO: 4242180 - DNA, 14 bp, Homo sapiens
tattgagtttgtag

SEQ ID NO: 4242181 - DNA, 21 bp, Homo sapiens
tattgagtttgtaggtaaaat

SEQ ID NO: 4242182 - DNA, 19 bp, Homo sapiens
tattgcatgcaatttgaag

SEQ ID NO: 4242183 - DNA, 16 bp, Homo sapiens
tattgctgattttaaa

SEQ ID NO: 4242184 - DNA, 21 bp, Homo sapiens
tattgcttattgcttagtaaa

SEQ ID NO: 4242185 - DNA, 18 bp, Homo sapiens
tattggaaatggatgcaa

SEQ ID NO: 4242186 - DNA, 21 bp, Homo sapiens
tattgttgaacatacttcaaa

SEQ ID NO: 4242187 - DNA, 11 bp, Homo sapiens
tattgtttaaa

SEQ ID NO: 4242188 - DNA, 15 bp, Homo sapiens
tattgtttaaaattc

SEQ ID NO: 4242189 - DNA, 22 bp, Homo sapiens
tatttaagtagtgggcatttca

SEQ ID NO: 4242190 - DNA, 13 bp, Homo sapiens
tatttaatatcaa

SEQ ID NO: 4242191 - DNA, 14 bp, Homo sapiens
tatttaatatcaaa

SEQ ID NO: 4242192 - DNA, 18 bp, Homo sapiens
tatttatgtaatgaagta

SEQ ID NO: 4242193 - DNA, 15 bp, Homo sapiens
tatttctgctttctt

SEQ ID NO: 4242194 - DNA, 12 bp, Homo sapiens
tatttcttttta

SEQ ID NO: 4242195 - DNA, 17 bp, Homo sapiens
tattttattatgcatga

SEQ ID NO: 4242196 - DNA, 14 bp, Homo sapiens
tattttctgttcta

SEQ ID NO: 4242197 - DNA, 12 bp, Homo sapiens
tattttggaaac

SEQ ID NO: 4242198 - DNA, 23 bp, Homo sapiens
tatttttatacaagtaatttcct

SEQ ID NO: 4242199 - DNA, 12 bp, Homo sapiens
tatttttatcca

SEQ ID NO: 4242200 - DNA, 13 bp, Homo sapiens
tatttttgtactt

SEQ ID NO: 4242201 - DNA, 17 bp, Homo sapiens
tatttttgtacttgatt

SEQ ID NO: 4242202 - DNA, 17 bp, Homo sapiens
tattttttaaaacacta

SEQ ID NO: 4242203 - DNA, 14 bp, Homo sapiens
tatttttttactaa

SEQ ID NO: 4242204 - DNA, 15 bp, Homo sapiens
tatttttttactaat

SEQ ID NO: 4242205 - DNA, 21 bp, Homo sapiens
tcaaaagaaaattgatatttt

SEQ ID NO: 4242206 - DNA, 13 bp, Homo sapiens
tcaaactttacta

SEQ ID NO: 4242207 - DNA, 20 bp, Homo sapiens
tcaaagtgtaaacaccatag

SEQ ID NO: 4242208 - DNA, 20 bp, Homo sapiens
tcaaagtgtgtctgggattt

SEQ ID NO: 4242209 - DNA, 15 bp, Homo sapiens
tcaaagtttatatgc

SEQ ID NO: 4242210 - DNA, 14 bp, Homo sapiens
tcaacagacaatta

SEQ ID NO: 4242211 - DNA, 15 bp, Homo sapiens
tcaacatcttttaca

SEQ ID NO: 4242212 - DNA, 13 bp, Homo sapiens
tcaacttttatgc

SEQ ID NO: 4242213 - DNA, 14 bp, Homo sapiens
tcaagctagtgttt

SEQ ID NO: 4242214 - DNA, 23 bp, Homo sapiens
tcaagtattataccttttttaga

SEQ ID NO: 4242215 - DNA, 20 bp, Homo sapiens
tcaagtgttaggtcaataac

SEQ ID NO: 4242216 - DNA, 20 bp, Homo sapiens
tcaatatcagctttgataat

SEQ ID NO: 4242217 - DNA, 13 bp, Homo sapiens
tcaatcccagcct

SEQ ID NO: 4242218 - DNA, 15 bp, Homo sapiens
tcaatgtattgagaa

SEQ ID NO: 4242219 - DNA, 18 bp, Homo sapiens
tcaattcagattgtcttg

SEQ ID NO: 4242220 - DNA, 19 bp, Homo sapiens
tcaattggcagtgactttg

SEQ ID NO: 4242221 - DNA, 22 bp, Homo sapiens
tcaattggcagtgactttgtat

SEQ ID NO: 4242222 - DNA, 18 bp, Homo sapiens
tcacaagtagcctctggg

SEQ ID NO: 4242223 - DNA, 21 bp, Homo sapiens
tcacaatgttccttttttgta

SEQ ID NO: 4242224 - DNA, 19 bp, Homo sapiens
tcacaggcagctctgagcc

SEQ ID NO: 4242225 - DNA, 13 bp, Homo sapiens
tcaccccaccctt

SEQ ID NO: 4242226 - DNA, 12 bp, Homo sapiens
tcaccccatccc

SEQ ID NO: 4242227 - DNA, 14 bp, Homo sapiens
tgcttctccccaga

SEQ ID NO: 4242228 - DNA, 22 bp, Homo sapiens
tgcttgagctttctgtgcatgt

SEQ ID NO: 4242229 - DNA, 17 bp, Homo sapiens
tgctttggcggcccggc

SEQ ID NO: 4242230 - DNA, 14 bp, Homo sapiens
tgctttgtgatttt

SEQ ID NO: 4242231 - DNA, 17 bp, Homo sapiens
tgctttgtgatttttgt

SEQ ID NO: 4242232 - DNA, 17 bp, Homo sapiens
tggaaacattacagttc

SEQ ID NO: 4242233 - DNA, 15 bp, Homo sapiens
tggaaactgctaaat

SEQ ID NO: 4242234 - DNA, 16 bp, Homo sapiens
tggaaatacagttatt

SEQ ID NO: 4242235 - DNA, 21 bp, Homo sapiens
tggaaatacagttatttcatc

SEQ ID NO: 4242236 - DNA, 16 bp, Homo sapiens
tggaacaaagtgaagg

SEQ ID NO: 4242237 - DNA, 13 bp, Homo sapiens
tggacaagacatg

SEQ ID NO: 4242238 - DNA, 19 bp, Homo sapiens
tggaccaattattgatata

SEQ ID NO: 4242239 - DNA, 21 bp, Homo sapiens
tggaccaattattgatatata

SEQ ID NO: 4242240 - DNA, 20 bp, Homo sapiens
tggacgctgccgggagactg

SEQ ID NO: 4242241 - DNA, 17 bp, Homo sapiens
tggactacaaaatacaa

SEQ ID NO: 4242242 - DNA, 22 bp, Homo sapiens
tggactccagcctgcctggcag

SEQ ID NO: 4242243 - DNA, 19 bp, Homo sapiens
tggagaattgctgaagggc

SEQ ID NO: 4242244 - DNA, 17 bp, Homo sapiens
tggaggagggagagccc

SEQ ID NO: 4242245 - DNA, 18 bp, Homo sapiens
tggaggagggagagccct

SEQ ID NO: 4242246 - DNA, 21 bp, Homo sapiens
tggaggagggagagccctgtc

SEQ ID NO: 4242247 - DNA, 22 bp, Homo sapiens
tggaggtctctccctcccccag

SEQ ID NO: 4242248 - DNA, 15 bp, Homo sapiens
tggatatttttgtac

SEQ ID NO: 4242249 - DNA, 18 bp, Homo sapiens
tggatatttttgtacttg

SEQ ID NO: 4242250 - DNA, 12 bp, Homo sapiens
tggatgactgtt

SEQ ID NO: 4242251 - DNA, 16 bp, Homo sapiens
tggatgaggagacaga

SEQ ID NO: 4242252 - DNA, 15 bp, Homo sapiens
tggattaaaacaatt

SEQ ID NO: 4242253 - DNA, 20 bp, Homo sapiens
tggatttaacagaaatgtac

SEQ ID NO: 4242254 - DNA, 17 bp, Homo sapiens
tggatttgagctgtggc

SEQ ID NO: 4242255 - DNA, 19 bp, Homo sapiens
tggcaatgcttaaactaaa

SEQ ID NO: 4242256 - DNA, 21 bp, Homo sapiens
tggcaatgcttaaactaaata

SEQ ID NO: 4242257 - DNA, 20 bp, Homo sapiens
tggcacatcagcacgatttc

SEQ ID NO: 4242258 - DNA, 20 bp, Homo sapiens
tggcaccagaggtgcttctg

SEQ ID NO: 4242259 - DNA, 17 bp, Homo sapiens
tggcacgtggccaggag

SEQ ID NO: 4242260 - DNA, 22 bp, Homo sapiens
tggcaggctactctgcccaccc

SEQ ID NO: 4242261 - DNA, 16 bp, Homo sapiens
tggccaggagccatga

SEQ ID NO: 4242262 - DNA, 18 bp, Homo sapiens
tggccaggagccctggcc

SEQ ID NO: 4242263 - DNA, 22 bp, Homo sapiens
tggccccccgaggctaaccctg

SEQ ID NO: 4242264 - DNA, 19 bp, Homo sapiens
tggcccgcaagagggacag

SEQ ID NO: 4242265 - DNA, 14 bp, Homo sapiens
tggccgcctgcagc

SEQ ID NO: 4242266 - DNA, 15 bp, Homo sapiens
tggctatgcatttga

SEQ ID NO: 4242267 - DNA, 19 bp, Homo sapiens
tggctatgcatttgaaaat

SEQ ID NO: 4242268 - DNA, 20 bp, Homo sapiens
tggctcagagcttgaagatt

SEQ ID NO: 4242269 - DNA, 15 bp, Homo sapiens
tggcttttgtgcatt

SEQ ID NO: 4242270 - DNA, 14 bp, Homo sapiens
tgggaaatgagcca

SEQ ID NO: 4242271 - DNA, 16 bp, Homo sapiens
tgggaaatgagccagc

SEQ ID NO: 4242272 - DNA, 20 bp, Homo sapiens
tgggaagctgagggcaaatc

SEQ ID NO: 4242273 - DNA, 16 bp, Homo sapiens
tgggaccccagagaaa

SEQ ID NO: 4242274 - DNA, 14 bp, Homo sapiens
tgggaggagggagg

SEQ ID NO: 4242275 - DNA, 15 bp, Homo sapiens
tgggaggagggaggc

SEQ ID NO: 4242276 - DNA, 23 bp, Homo sapiens
tgggagggaggcatctgcatggg

SEQ ID NO: 4242277 - DNA, 19 bp, Homo sapiens
tgggatggacgctgccggg

SEQ ID NO: 4242278 - DNA, 21 bp, Homo sapiens
tgggatggacgctgccgggag

SEQ ID NO: 4242279 - DNA, 18 bp, Homo sapiens
tggggagaaactgaagcc

SEQ ID NO: 4242280 - DNA, 12 bp, Homo sapiens
tgggggtgcatt

SEQ ID NO: 4242281 - DNA, 15 bp, Homo sapiens
tgggggtgcatttga

SEQ ID NO: 4242282 - DNA, 22 bp, Homo sapiens
tggggtttagaaccccaggtga

SEQ ID NO: 4242283 - DNA, 20 bp, Homo sapiens
tgggtcctactcctggagca

SEQ ID NO: 4242284 - DNA, 20 bp, Homo sapiens
tgggtctcgctttgttgccc

SEQ ID NO: 4242285 - DNA, 22 bp, Homo sapiens
tggtaaacggtttttattaaag

SEQ ID NO: 4242286 - DNA, 13 bp, Homo sapiens
tggtactctgtgt

SEQ ID NO: 4242287 - DNA, 21 bp, Homo sapiens
tggtagcataaataaaactga

SEQ ID NO: 4242288 - DNA, 23 bp, Homo sapiens
tggtagcataaataaaactgaat

SEQ ID NO: 4242289 - DNA, 15 bp, Homo sapiens
tggtataatgtttaa

SEQ ID NO: 4242290 - DNA, 19 bp, Homo sapiens
tggtataatgtttaaatca

SEQ ID NO: 4242291 - DNA, 22 bp, Homo sapiens
tggtcgtcatgctgtccgtgct

SEQ ID NO: 4242292 - DNA, 18 bp, Homo sapiens
tggtgcccttccctggag

SEQ ID NO: 4242293 - DNA, 15 bp, Homo sapiens
tggtggactacaaaa

SEQ ID NO: 4242294 - DNA, 19 bp, Homo sapiens
tggtggttttctgttcttt

SEQ ID NO: 4242295 - DNA, 14 bp, Homo sapiens
tggtgtactctagg

SEQ ID NO: 4242296 - DNA, 17 bp, Homo sapiens
tggtgtactctaggact

SEQ ID NO: 4242297 - DNA, 20 bp, Homo sapiens
tggtgtactctaggacttca

SEQ ID NO: 4242298 - DNA, 20 bp, Homo sapiens
tggttacctgacctaaatta

SEQ ID NO: 4242299 - DNA, 23 bp, Homo sapiens
tggttacctgacctaaattagat

SEQ ID NO: 4242300 - DNA, 19 bp, Homo sapiens
tggttattctaagcccttt

SEQ ID NO: 4242301 - DNA, 16 bp, Homo sapiens
tggtttcaattcagat

SEQ ID NO: 4242302 - DNA, 16 bp, Homo sapiens
tggttttctgttcttt

SEQ ID NO: 4242303 - DNA, 17 bp, Homo sapiens
tgtaaaaaagaaaaaca

SEQ ID NO: 4242304 - DNA, 14 bp, Homo sapiens
tgtaaattaacttt

SEQ ID NO: 4242305 - DNA, 15 bp, Homo sapiens
tgtaaattaactttt

SEQ ID NO: 4242306 - DNA, 16 bp, Homo sapiens
tgtaaattaactttta

SEQ ID NO: 4242307 - DNA, 17 bp, Homo sapiens
tgtaatcttttatttaa

SEQ ID NO: 4242308 - DNA, 20 bp, Homo sapiens
tgtaatttttttatcgtcac

SEQ ID NO: 4242309 - DNA, 19 bp, Homo sapiens
tgtacaaacagtatttctg

SEQ ID NO: 4242310 - DNA, 22 bp, Homo sapiens
tgtacaagttgttattgttgaa

SEQ ID NO: 4242311 - DNA, 22 bp, Homo sapiens
tgtacagcaaggagatttacaa

SEQ ID NO: 4242312 - DNA, 23 bp, Homo sapiens
tgtacagcaaggagatttacaac

SEQ ID NO: 4242313 - DNA, 17 bp, Homo sapiens
tgtacatgaaaacacat

SEQ ID NO: 4242314 - DNA, 20 bp, Homo sapiens
tgtaccatggtttgatatgt

SEQ ID NO: 4242315 - DNA, 14 bp, Homo sapiens
tgtaccctctccag

SEQ ID NO: 4242316 - DNA, 16 bp, Homo sapiens
tgtaccttaagatatt

SEQ ID NO: 4242317 - DNA, 12 bp, Homo sapiens
tgtactctagga

SEQ ID NO: 4242318 - DNA, 16 bp, Homo sapiens
tgtactctaggacttc

SEQ ID NO: 4242319 - DNA, 18 bp, Homo sapiens
tgtactctaggacttcaa

SEQ ID NO: 4242320 - DNA, 19 bp, Homo sapiens
tgtactctaggacttcaaa

SEQ ID NO: 4242321 - DNA, 16 bp, Homo sapiens
tgtactgtctgttatg

SEQ ID NO: 4242322 - DNA, 11 bp, Homo sapiens
tgtacttcctg

SEQ ID NO: 4242323 - DNA, 12 bp, Homo sapiens
tgtacttcctga

SEQ ID NO: 4242324 - DNA, 17 bp, Homo sapiens
tgtacttcctgagtggc

SEQ ID NO: 4242325 - DNA, 20 bp, Homo sapiens
tgtaggagctacccttttcc

SEQ ID NO: 4242326 - DNA, 13 bp, Homo sapiens
tgtaggtaaaatg

SEQ ID NO: 4242327 - DNA, 13 bp, Homo sapiens
tgtagtgggaagt

SEQ ID NO: 4242328 - DNA, 17 bp, Homo sapiens
tgtatagagaatttaag

SEQ ID NO: 4242329 - DNA, 20 bp, Homo sapiens
tgtatatatattcatataca

SEQ ID NO: 4242330 - DNA, 16 bp, Homo sapiens
tgtatatcattctaca

SEQ ID NO: 4242331 - DNA, 22 bp, Homo sapiens
tgtatatcattctacagaataa

SEQ ID NO: 4242332 - DNA, 13 bp, Homo sapiens
tgtatggatttaa

SEQ ID NO: 4242333 - DNA, 22 bp, Homo sapiens
tgtattctctcctgtacctctt

SEQ ID NO: 4242334 - DNA, 18 bp, Homo sapiens
tgtatttttcatctttaa

SEQ ID NO: 4242335 - DNA, 19 bp, Homo sapiens
tgtatttttctacattatt

SEQ ID NO: 4242336 - DNA, 22 bp, Homo sapiens
tgtatttttctacattattgct

SEQ ID NO: 4242337 - DNA, 17 bp, Homo sapiens
tgtcagtttatcttaag

SEQ ID NO: 4242338 - DNA, 12 bp, Homo sapiens
tgtcatctaaag

SEQ ID NO: 4242339 - DNA, 16 bp, Homo sapiens
tgtccaatttctgctg

SEQ ID NO: 4242340 - DNA, 17 bp, Homo sapiens
tgtccaatttctgctgt

SEQ ID NO: 4242341 - DNA, 14 bp, Homo sapiens
ttgctcctagcaga

SEQ ID NO: 4242342 - DNA, 17 bp, Homo sapiens
ttgctcctagcagacag

SEQ ID NO: 4242343 - DNA, 14 bp, Homo sapiens
ttgctgaattctaa

SEQ ID NO: 4242344 - DNA, 19 bp, Homo sapiens
ttgctggtgcctcttttca

SEQ ID NO: 4242345 - DNA, 18 bp, Homo sapiens
ttgctggtgtactctagg

SEQ ID NO: 4242346 - DNA, 22 bp, Homo sapiens
ttgctggtgtactctaggactt

SEQ ID NO: 4242347 - DNA, 12 bp, Homo sapiens
ttgcttagtaaa

SEQ ID NO: 4242348 - DNA, 14 bp, Homo sapiens
ttgcttagtaaaat

SEQ ID NO: 4242349 - DNA, 15 bp, Homo sapiens
ttgcttagtaaaatt

SEQ ID NO: 4242350 - DNA, 20 bp, Homo sapiens
ttgctttgtgatttttgtaa

SEQ ID NO: 4242351 - DNA, 16 bp, Homo sapiens
ttggaacaaagtgaag

SEQ ID NO: 4242352 - DNA, 17 bp, Homo sapiens
ttggaatgttacatctg

SEQ ID NO: 4242353 - DNA, 14 bp, Homo sapiens
ttggcagtgacttt

SEQ ID NO: 4242354 - DNA, 23 bp, Homo sapiens
ttggcggcccggccggagggcag

SEQ ID NO: 4242355 - DNA, 16 bp, Homo sapiens
ttgggaggggccggag

SEQ ID NO: 4242356 - DNA, 20 bp, Homo sapiens
ttgggccaatttactggcca

SEQ ID NO: 4242357 - DNA, 20 bp, Homo sapiens
ttggtataatgtttaaatca

SEQ ID NO: 4242358 - DNA, 14 bp, Homo sapiens
ttgtacataatgcg

SEQ ID NO: 4242359 - DNA, 17 bp, Homo sapiens
ttgtaccctctccaggc

SEQ ID NO: 4242360 - DNA, 13 bp, Homo sapiens
ttgtacttgattt

SEQ ID NO: 4242361 - DNA, 15 bp, Homo sapiens
ttgtaggtaaaatgt

SEQ ID NO: 4242362 - DNA, 22 bp, Homo sapiens
ttgtatcttggggcaagactgc

SEQ ID NO: 4242363 - DNA, 15 bp, Homo sapiens
ttgtattctctcctg

SEQ ID NO: 4242364 - DNA, 12 bp, Homo sapiens
ttgtattcttct

SEQ ID NO: 4242365 - DNA, 17 bp, Homo sapiens
ttgtcagtttatcttaa

SEQ ID NO: 4242366 - DNA, 19 bp, Homo sapiens
ttgtctctcttcagactct

SEQ ID NO: 4242367 - DNA, 16 bp, Homo sapiens
ttgtgaatgcttctca

SEQ ID NO: 4242368 - DNA, 12 bp, Homo sapiens
ttgtgatttttg

SEQ ID NO: 4242369 - DNA, 17 bp, Homo sapiens
ttgtgcattatctagat

SEQ ID NO: 4242370 - DNA, 19 bp, Homo sapiens
ttgtgcctggttcgtgcca

SEQ ID NO: 4242371 - DNA, 11 bp, Homo sapiens
ttgtgcttctc

SEQ ID NO: 4242372 - DNA, 12 bp, Homo sapiens
ttgtgcttctcc

SEQ ID NO: 4242373 - DNA, 19 bp, Homo sapiens
ttgtgcttctccccagaat

SEQ ID NO: 4242374 - DNA, 21 bp, Homo sapiens
ttgtggatttaacagaaatgt

SEQ ID NO: 4242375 - DNA, 22 bp, Homo sapiens
ttgtgtggagaactcagtgcca

SEQ ID NO: 4242376 - DNA, 14 bp, Homo sapiens
ttgttacattttta

SEQ ID NO: 4242377 - DNA, 16 bp, Homo sapiens
ttgttagcaaatgaca

SEQ ID NO: 4242378 - DNA, 19 bp, Homo sapiens
ttgttagtatgaggcattt

SEQ ID NO: 4242379 - DNA, 20 bp, Homo sapiens
ttgttcttggtttgtaaatt

SEQ ID NO: 4242380 - DNA, 13 bp, Homo sapiens
ttgtttattgagt

SEQ ID NO: 4242381 - DNA, 15 bp, Homo sapiens
ttgtttattgagttt

SEQ ID NO: 4242382 - DNA, 18 bp, Homo sapiens
ttgtttcttgtttattga

SEQ ID NO: 4242383 - DNA, 18 bp, Homo sapiens
tttaaaaagtaagttaat

SEQ ID NO: 4242384 - DNA, 15 bp, Homo sapiens
tttaaaattcagttt

SEQ ID NO: 4242385 - DNA, 14 bp, Homo sapiens
tttaaatcatgtat

SEQ ID NO: 4242386 - DNA, 18 bp, Homo sapiens
tttaacagaaatgtacag

SEQ ID NO: 4242387 - DNA, 16 bp, Homo sapiens
tttaagaatattttta

SEQ ID NO: 4242388 - DNA, 18 bp, Homo sapiens
tttaagaatatttttaga

SEQ ID NO: 4242389 - DNA, 19 bp, Homo sapiens
tttaaggatgcttgtacat

SEQ ID NO: 4242390 - DNA, 20 bp, Homo sapiens
tttaaggatgcttgtacata

SEQ ID NO: 4242391 - DNA, 21 bp, Homo sapiens
tttaaggatgcttgtacataa

SEQ ID NO: 4242392 - DNA, 16 bp, Homo sapiens
tttaaggtttttactg

SEQ ID NO: 4242393 - DNA, 16 bp, Homo sapiens
tttaagtgctgcattt

SEQ ID NO: 4242394 - DNA, 19 bp, Homo sapiens
tttaagtgctgcatttaaa

SEQ ID NO: 4242395 - DNA, 13 bp, Homo sapiens
tttaagtttgaag

SEQ ID NO: 4242396 - DNA, 14 bp, Homo sapiens
tttaagtttgaaga

SEQ ID NO: 4242397 - DNA, 14 bp, Homo sapiens
tttaatggcagcta

SEQ ID NO: 4242398 - DNA, 12 bp, Homo sapiens
tttaatttgatg

SEQ ID NO: 4242399 - DNA, 14 bp, Homo sapiens
tttactaatagaca

SEQ ID NO: 4242400 - DNA, 13 bp, Homo sapiens
tttactctgtgtt

SEQ ID NO: 4242401 - DNA, 18 bp, Homo sapiens
tttagagttgatactaca

SEQ ID NO: 4242402 - DNA, 15 bp, Homo sapiens
tttagataatacacc

SEQ ID NO: 4242403 - DNA, 16 bp, Homo sapiens
tttagccctttaaaac

SEQ ID NO: 4242404 - DNA, 14 bp, Homo sapiens
tttagtaagtatgt

SEQ ID NO: 4242405 - DNA, 14 bp, Homo sapiens
tttataaactttac

SEQ ID NO: 4242406 - DNA, 14 bp, Homo sapiens
tttataatctgaag

SEQ ID NO: 4242407 - DNA, 20 bp, Homo sapiens
tttatacataaacaagacca

SEQ ID NO: 4242408 - DNA, 17 bp, Homo sapiens
tttatatcccattttta

SEQ ID NO: 4242409 - DNA, 16 bp, Homo sapiens
tttatcgtcactgctt

SEQ ID NO: 4242410 - DNA, 14 bp, Homo sapiens
tttatggcttttgt

SEQ ID NO: 4242411 - DNA, 16 bp, Homo sapiens
tttatggcttttgtgc

SEQ ID NO: 4242412 - DNA, 19 bp, Homo sapiens
tttatgtaatgaagtaaag

SEQ ID NO: 4242413 - DNA, 22 bp, Homo sapiens
tttatgtaatgaagtaaagcca

SEQ ID NO: 4242414 - DNA, 13 bp, Homo sapiens
tttattatgcatg

SEQ ID NO: 4242415 - DNA, 16 bp, Homo sapiens
tttcaaactttactat

SEQ ID NO: 4242416 - DNA, 12 bp, Homo sapiens
tttcaattcaga

SEQ ID NO: 4242417 - DNA, 12 bp, Homo sapiens
tttccaaagtac

SEQ ID NO: 4242418 - DNA, 15 bp, Homo sapiens
tttccgttaaaatac

SEQ ID NO: 4242419 - DNA, 13 bp, Homo sapiens
tttcctcttcaga

SEQ ID NO: 4242420 - DNA, 23 bp, Homo sapiens
tttctacaaagcactagagaatg

SEQ ID NO: 4242421 - DNA, 15 bp, Homo sapiens
tttctatgacacatg

SEQ ID NO: 4242422 - DNA, 21 bp, Homo sapiens
tttctcactatatatatttct

SEQ ID NO: 4242423 - DNA, 15 bp, Homo sapiens
tttctccagtgctgt

SEQ ID NO: 4242424 - DNA, 22 bp, Homo sapiens
tttctctaacttcaaggcccat

SEQ ID NO: 4242425 - DNA, 21 bp, Homo sapiens
tttctgcccagccctctgtgg

SEQ ID NO: 4242426 - DNA, 19 bp, Homo sapiens
tttctggctatgcatttga

SEQ ID NO: 4242427 - DNA, 23 bp, Homo sapiens
tttcttagggaaggatacaaaag

SEQ ID NO: 4242428 - DNA, 15 bp, Homo sapiens
tttcttatttttgtc

SEQ ID NO: 4242429 - DNA, 17 bp, Homo sapiens
tttcttgcactgtccag

SEQ ID NO: 4242430 - DNA, 12 bp, Homo sapiens
tttcttgtttat

SEQ ID NO: 4242431 - DNA, 19 bp, Homo sapiens
tttgacctctgcagcaata

SEQ ID NO: 4242432 - DNA, 12 bp, Homo sapiens
tttgattctcct

SEQ ID NO: 4242433 - DNA, 20 bp, Homo sapiens
tttgcatccacttcaggagc

SEQ ID NO: 4242434 - DNA, 15 bp, Homo sapiens
tttgccgttattaaa

SEQ ID NO: 4242435 - DNA, 15 bp, Homo sapiens
tttgctttgtgattt

SEQ ID NO: 4242436 - DNA, 17 bp, Homo sapiens
tttggaaactgctaaat

SEQ ID NO: 4242437 - DNA, 13 bp, Homo sapiens
tttggcaataaat

SEQ ID NO: 4242438 - DNA, 19 bp, Homo sapiens
tttggtaaacggtttttat

SEQ ID NO: 4242439 - DNA, 18 bp, Homo sapiens
tttggtataatgtttaaa

SEQ ID NO: 4242440 - DNA, 13 bp, Homo sapiens
tttgtaaatgcat

SEQ ID NO: 4242441 - DNA, 23 bp, Homo sapiens
tttgtaaatgcatattaaataat

SEQ ID NO: 4242442 - DNA, 14 bp, Homo sapiens
tttgtaatttttgc

SEQ ID NO: 4242443 - DNA, 16 bp, Homo sapiens
tttgtaatttttttat

SEQ ID NO: 4242444 - DNA, 20 bp, Homo sapiens
tttgtacttgatttgatgtg

SEQ ID NO: 4242445 - DNA, 15 bp, Homo sapiens
tttgtaggtaaaatg

SEQ ID NO: 4242446 - DNA, 20 bp, Homo sapiens
tttgtaggtaaaatgtattt

SEQ ID NO: 4242447 - DNA, 20 bp, Homo sapiens
tttgtatattacaacattta

SEQ ID NO: 4242448 - DNA, 16 bp, Homo sapiens
tttgtatttttagtag

SEQ ID NO: 4242449 - DNA, 20 bp, Homo sapiens
tttgtatttttcatctttaa

SEQ ID NO: 4242450 - DNA, 18 bp, Homo sapiens
tttgtcagtttatcttaa

SEQ ID NO: 4242451 - DNA, 12 bp, Homo sapiens
tttgtctgtcca

SEQ ID NO: 4242452 - DNA, 19 bp, Homo sapiens
tttgtgcattatctagata

SEQ ID NO: 4242453 - DNA, 12 bp, Homo sapiens
tttgttattcct

SEQ ID NO: 4242454 - DNA, 13 bp, Homo sapiens
tttgtttgatgca

SEQ ID NO: 4242455 - DNA, 18 bp, Homo sapiens
ttttaaaaacctgtatct

SEQ ID NO: 4242456 - DNA, 11 bp, Homo sapiens
ttttaaatgca

SEQ ID NO: 4242457 - DNA, 20 bp, Homo sapiens
aaaaaactcttaatctgtgt

SEQ ID NO: 4242458 - DNA, 14 bp, Homo sapiens
aaaaacctgtatct

SEQ ID NO: 4242459 - DNA, 17 bp, Homo sapiens
aaaaatgcattgaacat

SEQ ID NO: 4242460 - DNA, 18 bp, Homo sapiens
aaaaatgtcctgcctttt

SEQ ID NO: 4242461 - DNA, 21 bp, Homo sapiens
aaaaatttaaaattacgtttg

SEQ ID NO: 4242462 - DNA, 14 bp, Homo sapiens
aaaacaattttctg

SEQ ID NO: 4242463 - DNA, 22 bp, Homo sapiens
aaaacaccgcttctgccttttc

SEQ ID NO: 4242464 - DNA, 14 bp, Homo sapiens
aaaacatgctacac

SEQ ID NO: 4242465 - DNA, 19 bp, Homo sapiens
aaaacttaaaaattaatat

SEQ ID NO: 4242466 - DNA, 13 bp, Homo sapiens
aaaagagtaattt

SEQ ID NO: 4242467 - DNA, 15 bp, Homo sapiens
aaaaggatagtattt

SEQ ID NO: 4242468 - DNA, 22 bp, Homo sapiens
aaaaggatagtatttttatcca

SEQ ID NO: 4242469 - DNA, 14 bp, Homo sapiens
aaaataaaactttt

SEQ ID NO: 4242470 - DNA, 17 bp, Homo sapiens
aaaataaaactttttaa

SEQ ID NO: 4242471 - DNA, 16 bp, Homo sapiens
aaaataaataatttta

SEQ ID NO: 4242472 - DNA, 17 bp, Homo sapiens
aaaatatatgaagacaa

SEQ ID NO: 4242473 - DNA, 14 bp, Homo sapiens
aaaatatttaatat

SEQ ID NO: 4242474 - DNA, 18 bp, Homo sapiens
aaaatatttaatatcaaa

SEQ ID NO: 4242475 - DNA, 15 bp, Homo sapiens
aaaatctcaaatttc

SEQ ID NO: 4242476 - DNA, 16 bp, Homo sapiens
aaaatctcaaatttct

SEQ ID NO: 4242477 - DNA, 13 bp, Homo sapiens
aaaatgaattgaa

SEQ ID NO: 4242478 - DNA, 21 bp, Homo sapiens
aaaatgaattgaaaaacaatt

SEQ ID NO: 4242479 - DNA, 16 bp, Homo sapiens
aaaatgtcctgccttt

SEQ ID NO: 4242480 - DNA, 17 bp, Homo sapiens
aaaatgtcctgcctttt

SEQ ID NO: 4242481 - DNA, 14 bp, Homo sapiens
aaaatgtgtttgct

SEQ ID NO: 4242482 - DNA, 15 bp, Homo sapiens
aaaattcagtttttg

SEQ ID NO: 4242483 - DNA, 16 bp, Homo sapiens
aaaattcagtttttgt

SEQ ID NO: 4242484 - DNA, 18 bp, Homo sapiens
aaaattcagtttttgtat

SEQ ID NO: 4242485 - DNA, 23 bp, Homo sapiens
aaaattcagtttttgtatcttgg

SEQ ID NO: 4242486 - DNA, 19 bp, Homo sapiens
aaaattgatattatattaa

SEQ ID NO: 4242487 - DNA, 21 bp, Homo sapiens
aaaattgatatttttatacaa

SEQ ID NO: 4242488 - DNA, 14 bp, Homo sapiens
aaaatttaaaatta

SEQ ID NO: 4242489 - DNA, 19 bp, Homo sapiens
aaaatttgatggactaatt

SEQ ID NO: 4242490 - DNA, 18 bp, Homo sapiens
aaacaagaccacgtttct

SEQ ID NO: 4242491 - DNA, 11 bp, Homo sapiens
aaacacatttt

SEQ ID NO: 4242492 - DNA, 13 bp, Homo sapiens
aaacatacataat

SEQ ID NO: 4242493 - DNA, 22 bp, Homo sapiens
aaacatgctacacactgcatgt

SEQ ID NO: 4242494 - DNA, 13 bp, Homo sapiens
aaacatgtattta

SEQ ID NO: 4242495 - DNA, 18 bp, Homo sapiens
aaactcttaatctgtgtg

SEQ ID NO: 4242496 - DNA, 13 bp, Homo sapiens
aaactgaatattt

SEQ ID NO: 4242497 - DNA, 18 bp, Homo sapiens
aaactgaatattttggaa

SEQ ID NO: 4242498 - DNA, 15 bp, Homo sapiens
aaactgctaaattct

SEQ ID NO: 4242499 - DNA, 16 bp, Homo sapiens
aaactgctaaattcta

SEQ ID NO: 4242500 - DNA, 16 bp, Homo sapiens
aaactggattaaaaca

SEQ ID NO: 4242501 - DNA, 22 bp, Homo sapiens
aaactggattaaaacaattttt

SEQ ID NO: 4242502 - DNA, 14 bp, Homo sapiens
aaacttaaaaacaa

SEQ ID NO: 4242503 - DNA, 16 bp, Homo sapiens
aaacttaatctaaatg

SEQ ID NO: 4242504 - DNA, 13 bp, Homo sapiens
aaacttgtgaatg

SEQ ID NO: 4242505 - DNA, 22 bp, Homo sapiens
aaactttaccttttttatacat

SEQ ID NO: 4242506 - DNA, 18 bp, Homo sapiens
aaagagtaatttcattta

SEQ ID NO: 4242507 - DNA, 17 bp, Homo sapiens
aaagatattttgctttg

SEQ ID NO: 4242508 - DNA, 13 bp, Homo sapiens
aaagatgatttaa

SEQ ID NO: 4242509 - DNA, 18 bp, Homo sapiens
aaagcactagagaatgca

SEQ ID NO: 4242510 - DNA, 18 bp, Homo sapiens
aaagcagcgtttctatga

SEQ ID NO: 4242511 - DNA, 22 bp, Homo sapiens
aaagcagcgtttctatgacaca

SEQ ID NO: 4242512 - DNA, 19 bp, Homo sapiens
aaagcttttaaaatgtaga

SEQ ID NO: 4242513 - DNA, 17 bp, Homo sapiens
aaaggaaatctcacccc

SEQ ID NO: 4242514 - DNA, 21 bp, Homo sapiens
aaaggatagtatttttatcca

SEQ ID NO: 4242515 - DNA, 14 bp, Homo sapiens
aaaggatgcacaga

SEQ ID NO: 4242516 - DNA, 23 bp, Homo sapiens
aaagggttgaaaatgtgtttgct

SEQ ID NO: 4242517 - DNA, 16 bp, Homo sapiens
aaaggtggcaatgctt

SEQ ID NO: 4242518 - DNA, 13 bp, Homo sapiens
aaaggttttgtat

SEQ ID NO: 4242519 - DNA, 14 bp, Homo sapiens
aaaggttttgtatt

SEQ ID NO: 4242520 - DNA, 16 bp, Homo sapiens
aaaggttttgtatttt

SEQ ID NO: 4242521 - DNA, 17 bp, Homo sapiens
aaagtaagttaataatg

SEQ ID NO: 4242522 - DNA, 18 bp, Homo sapiens
aaagtaagttaataatgt

SEQ ID NO: 4242523 - DNA, 22 bp, Homo sapiens
aaagtaagttaataatgtattg

SEQ ID NO: 4242524 - DNA, 16 bp, Homo sapiens
aaagtacaatgtgttt

SEQ ID NO: 4242525 - DNA, 20 bp, Homo sapiens
aaagtacactgtttcaaact

SEQ ID NO: 4242526 - DNA, 13 bp, Homo sapiens
aaagtatagagag

SEQ ID NO: 4242527 - DNA, 21 bp, Homo sapiens
aaagtatccctactgtaattt

SEQ ID NO: 4242528 - DNA, 15 bp, Homo sapiens
aaagtcgttttccaa

SEQ ID NO: 4242529 - DNA, 22 bp, Homo sapiens
aaagtgtatttttttactaata

SEQ ID NO: 4242530 - DNA, 22 bp, Homo sapiens
aaagttatgtatttaaagttgt

SEQ ID NO: 4242531 - DNA, 17 bp, Homo sapiens
aaagttgcagatgtatt

SEQ ID NO: 4242532 - DNA, 14 bp, Homo sapiens
aaataaaactgaat

SEQ ID NO: 4242533 - DNA, 13 bp, Homo sapiens
aaataaataattt

SEQ ID NO: 4242534 - DNA, 13 bp, Homo sapiens
aaataatgaataa

SEQ ID NO: 4242535 - DNA, 14 bp, Homo sapiens
aaatacagttattt

SEQ ID NO: 4242536 - DNA, 22 bp, Homo sapiens
aaatacattataacaactattt

SEQ ID NO: 4242537 - DNA, 19 bp, Homo sapiens
aaataccagccagtaaatg

SEQ ID NO: 4242538 - DNA, 15 bp, Homo sapiens
aaatagagcttttaa

SEQ ID NO: 4242539 - DNA, 14 bp, Homo sapiens
aaatataagacatt

SEQ ID NO: 4242540 - DNA, 17 bp, Homo sapiens
aaatataagacatttgt

SEQ ID NO: 4242541 - DNA, 21 bp, Homo sapiens
aaatatatgaagacaataatt

SEQ ID NO: 4242542 - DNA, 19 bp, Homo sapiens
aaatatgaaccctttgttt

SEQ ID NO: 4242543 - DNA, 21 bp, Homo sapiens
aaatcatgtatgttatgatat

SEQ ID NO: 4242544 - DNA, 12 bp, Homo sapiens
aaatctattgac

SEQ ID NO: 4242545 - DNA, 22 bp, Homo sapiens
aaatctattgacttttcaataa

SEQ ID NO: 4242546 - DNA, 14 bp, Homo sapiens
aaatctcaattgaa

SEQ ID NO: 4242547 - DNA, 22 bp, Homo sapiens
aaatctccaaaataaaactttt

SEQ ID NO: 4242548 - DNA, 16 bp, Homo sapiens
aaatgcaataatttta

SEQ ID NO: 4242549 - DNA, 18 bp, Homo sapiens
aaatgcacctggaatata

SEQ ID NO: 4242550 - DNA, 16 bp, Homo sapiens
aaatgcatattaaata

SEQ ID NO: 4242551 - DNA, 21 bp, Homo sapiens
aaatgcattgaacatcttgca

SEQ ID NO: 4242552 - DNA, 15 bp, Homo sapiens
aaatgcttcattgaa

SEQ ID NO: 4242553 - DNA, 15 bp, Homo sapiens
aaatgggggtgcatt

SEQ ID NO: 4242554 - DNA, 22 bp, Homo sapiens
aaatgggtgtatataattttat

SEQ ID NO: 4242555 - DNA, 17 bp, Homo sapiens
aaatgtttttatttttg

SEQ ID NO: 4242556 - DNA, 18 bp, Homo sapiens
aaatgtttttatttttgt

SEQ ID NO: 4242557 - DNA, 22 bp, Homo sapiens
aaattaacttttataaacttta

SEQ ID NO: 4242558 - DNA, 14 bp, Homo sapiens
aaattagggcaatt

SEQ ID NO: 4242559 - DNA, 19 bp, Homo sapiens
aaatttagccctttaaaac

SEQ ID NO: 4242560 - DNA, 20 bp, Homo sapiens
aaatttagccctttaaaacg

SEQ ID NO: 4242561 - DNA, 17 bp, Homo sapiens
aaatttgtgctttttaa

SEQ ID NO: 4242562 - DNA, 14 bp, Homo sapiens
aacaactatttact

SEQ ID NO: 4242563 - DNA, 20 bp, Homo sapiens
aacaagaccacgtttctaaa

SEQ ID NO: 4242564 - DNA, 18 bp, Homo sapiens
aacaagtcatttttgtat

SEQ ID NO: 4242565 - DNA, 15 bp, Homo sapiens
aacaatgatgccctg

SEQ ID NO: 4242566 - DNA, 20 bp, Homo sapiens
aacaccgcttctgccttttc

SEQ ID NO: 4242567 - DNA, 15 bp, Homo sapiens
aacagacaaaaacaa

SEQ ID NO: 4242568 - DNA, 16 bp, Homo sapiens
aacagtagttgtattc

SEQ ID NO: 4242569 - DNA, 17 bp, Homo sapiens
aacataaaaactgattt

SEQ ID NO: 4242570 - DNA, 14 bp, Homo sapiens
aacataaagttgta

SEQ ID NO: 4242571 - DNA, 14 bp, Homo sapiens
aacatcgatatgta

SEQ ID NO: 4242572 - DNA, 17 bp, Homo sapiens
aacatcgatatgtatat

SEQ ID NO: 4242573 - DNA, 19 bp, Homo sapiens
aacatcgatatgtatatca

SEQ ID NO: 4242574 - DNA, 12 bp, Homo sapiens
aacatgtattta

SEQ ID NO: 4242575 - DNA, 15 bp, Homo sapiens
aacatgtatttatgt

SEQ ID NO: 4242576 - DNA, 21 bp, Homo sapiens
aacatgtatttatgtaatgaa

SEQ ID NO: 4242577 - DNA, 17 bp, Homo sapiens
aacattaaggaatttga

SEQ ID NO: 4242578 - DNA, 13 bp, Homo sapiens
aacatttatgtga

SEQ ID NO: 4242579 - DNA, 15 bp, Homo sapiens
aaccaaagctggccc

SEQ ID NO: 4242580 - DNA, 17 bp, Homo sapiens
aaccaaagctggcccag

SEQ ID NO: 4242581 - DNA, 16 bp, Homo sapiens
aaccagaagtgcagcc

SEQ ID NO: 4242582 - DNA, 11 bp, Homo sapiens
aaccatttata

SEQ ID NO: 4242583 - DNA, 16 bp, Homo sapiens
aacccaagcaacattt

SEQ ID NO: 4242584 - DNA, 13 bp, Homo sapiens
aactaaataatga

SEQ ID NO: 4242585 - DNA, 17 bp, Homo sapiens
aactcccccattttaca

SEQ ID NO: 4242586 - DNA, 22 bp, Homo sapiens
aactcccccattttacagattt

SEQ ID NO: 4242587 - DNA, 17 bp, Homo sapiens
aactcttaatctgtgtg

SEQ ID NO: 4242588 - DNA, 14 bp, Homo sapiens
aactgaagccgtgt

SEQ ID NO: 4242589 - DNA, 17 bp, Homo sapiens
aactgaatattttggaa

SEQ ID NO: 4242590 - DNA, 18 bp, Homo sapiens
aactgaatattttggaaa

SEQ ID NO: 4242591 - DNA, 19 bp, Homo sapiens
aactgaatattttggaaac

SEQ ID NO: 4242592 - DNA, 20 bp, Homo sapiens
aactggaattaaaaggatag

SEQ ID NO: 4242593 - DNA, 14 bp, Homo sapiens
aactggattaaaac

SEQ ID NO: 4242594 - DNA, 18 bp, Homo sapiens
aacttaatctaaatggaa

SEQ ID NO: 4242595 - DNA, 21 bp, Homo sapiens
aacttcagttttatttttgcc

SEQ ID NO: 4242596 - DNA, 15 bp, Homo sapiens
aacttgtcaggcatg

SEQ ID NO: 4242597 - DNA, 15 bp, Homo sapiens
aactttactctgtgt

SEQ ID NO: 4242598 - DNA, 17 bp, Homo sapiens
aactttgacctctgcag

SEQ ID NO: 4242599 - DNA, 20 bp, Homo sapiens
aactttgacctctgcagcaa

SEQ ID NO: 4242600 - DNA, 19 bp, Homo sapiens
aagaaaaaggatgcacaga

SEQ ID NO: 4242601 - DNA, 20 bp, Homo sapiens
aagaaaaaggatgcacagag

SEQ ID NO: 4242602 - DNA, 15 bp, Homo sapiens
aagaaaatagtggtg

SEQ ID NO: 4242603 - DNA, 22 bp, Homo sapiens
aagaaaatagtggtgtgatttg

SEQ ID NO: 4242604 - DNA, 18 bp, Homo sapiens
aagaatgagcctgtccaa

SEQ ID NO: 4242605 - DNA, 22 bp, Homo sapiens
aagaattgttagcaaatgacag

SEQ ID NO: 4242606 - DNA, 16 bp, Homo sapiens
aagacatttgtttgct

SEQ ID NO: 4242607 - DNA, 15 bp, Homo sapiens
aagaccacgtttcta

SEQ ID NO: 4242608 - DNA, 22 bp, Homo sapiens
aagactgagtacgttgtgcatt

SEQ ID NO: 4242609 - DNA, 18 bp, Homo sapiens
aagactgcaaactttttt

SEQ ID NO: 4242610 - DNA, 15 bp, Homo sapiens
aagacttgagacaat

SEQ ID NO: 4242611 - DNA, 17 bp, Homo sapiens
aagacttgagacaatgt

SEQ ID NO: 4242612 - DNA, 17 bp, Homo sapiens
aagagccattttggtaa

SEQ ID NO: 4242613 - DNA, 18 bp, Homo sapiens
aagaggaatttcttttcc

SEQ ID NO: 4242614 - DNA, 13 bp, Homo sapiens
aagagtaacttta

SEQ ID NO: 4242615 - DNA, 22 bp, Homo sapiens
aagatattttgctttgtgattt

SEQ ID NO: 4242616 - DNA, 18 bp, Homo sapiens
aagcaacatttgtatgga

SEQ ID NO: 4242617 - DNA, 23 bp, Homo sapiens
aagccactagcccactccccagt

SEQ ID NO: 4242618 - DNA, 21 bp, Homo sapiens
aagccatggctgacctctgga

SEQ ID NO: 4242619 - DNA, 16 bp, Homo sapiens
aagcctaaatttgtgc

SEQ ID NO: 4242620 - DNA, 14 bp, Homo sapiens
aagctagtgtttct

SEQ ID NO: 4242621 - DNA, 15 bp, Homo sapiens
aagctcccacaccca

SEQ ID NO: 4242622 - DNA, 22 bp, Homo sapiens
aagctcccacacccacctctgc

SEQ ID NO: 4242623 - DNA, 19 bp, Homo sapiens
aagcttcaaagtttatatg

SEQ ID NO: 4242624 - DNA, 21 bp, Homo sapiens
aagcttcaaagtttatatgcc

SEQ ID NO: 4242625 - DNA, 16 bp, Homo sapiens
aaggaaatctcacccc

SEQ ID NO: 4242626 - DNA, 22 bp, Homo sapiens
aaggaaatctcaccccatccca

SEQ ID NO: 4242627 - DNA, 18 bp, Homo sapiens
aaggaatcattccagtgc

SEQ ID NO: 4242628 - DNA, 17 bp, Homo sapiens
aaggagatttacaactg

SEQ ID NO: 4242629 - DNA, 18 bp, Homo sapiens
aaggagatttacaactgg

SEQ ID NO: 4242630 - DNA, 17 bp, Homo sapiens
aaggatagtatttttat

SEQ ID NO: 4242631 - DNA, 22 bp, Homo sapiens
aaggatgcacagagttgttaca

SEQ ID NO: 4242632 - DNA, 24 bp, Homo sapiens
aaggatgcacagagttgttacatt

SEQ ID NO: 4242633 - DNA, 15 bp, Homo sapiens
aaggatgcttgtaca

SEQ ID NO: 4242634 - DNA, 16 bp, Homo sapiens
aaggatgcttgtacat

SEQ ID NO: 4242635 - DNA, 19 bp, Homo sapiens
aaggatgcttgtacataat

SEQ ID NO: 4242636 - DNA, 20 bp, Homo sapiens
aaggcagagaagttctcaaa

SEQ ID NO: 4242637 - DNA, 13 bp, Homo sapiens
aaggctacctttg

SEQ ID NO: 4242638 - DNA, 17 bp, Homo sapiens
aaggtacaactgtattt

SEQ ID NO: 4242639 - DNA, 20 bp, Homo sapiens
aaggtacaactgtatttatt

SEQ ID NO: 4242640 - DNA, 12 bp, Homo sapiens
aaggtcattttt

SEQ ID NO: 4242641 - DNA, 12 bp, Homo sapiens
aagtaagttaat

SEQ ID NO: 4242642 - DNA, 20 bp, Homo sapiens
aagtaagttaataatgtatt

SEQ ID NO: 4242643 - DNA, 15 bp, Homo sapiens
aagtaatatgcacac

SEQ ID NO: 4242644 - DNA, 19 bp, Homo sapiens
aagtaattatgcactaaat

SEQ ID NO: 4242645 - DNA, 13 bp, Homo sapiens
aagtaatttcctg

SEQ ID NO: 4242646 - DNA, 23 bp, Homo sapiens
aagtacactgtttcaaactttac

SEQ ID NO: 4242647 - DNA, 22 bp, Homo sapiens
aagtaccttgaactcttagtga

SEQ ID NO: 4242648 - DNA, 19 bp, Homo sapiens
aagtactgtttaccatttt

SEQ ID NO: 4242649 - DNA, 20 bp, Homo sapiens
aagtactgtttaccattttt

SEQ ID NO: 4242650 - DNA, 23 bp, Homo sapiens
aagtagaaaagttgcagatgtat

SEQ ID NO: 4242651 - DNA, 16 bp, Homo sapiens
aagtatccctactgta

SEQ ID NO: 4242652 - DNA, 23 bp, Homo sapiens
aagtatccctactgtaatttgtg

SEQ ID NO: 4242653 - DNA, 16 bp, Homo sapiens
aagtcatttttgtatt

SEQ ID NO: 4242654 - DNA, 15 bp, Homo sapiens
aagtctctgctggcc

SEQ ID NO: 4242655 - DNA, 21 bp, Homo sapiens
aagtctctgctggcccagcca

SEQ ID NO: 4242656 - DNA, 17 bp, Homo sapiens
aagtgaagacaatgact

SEQ ID NO: 4242657 - DNA, 19 bp, Homo sapiens
aagtgaagacaatgactta

SEQ ID NO: 4242658 - DNA, 18 bp, Homo sapiens
aagttaataatgtattgt

SEQ ID NO: 4242659 - DNA, 15 bp, Homo sapiens
aagttatgtatttaa

SEQ ID NO: 4242660 - DNA, 14 bp, Homo sapiens
aagttctataacta

SEQ ID NO: 4242661 - DNA, 16 bp, Homo sapiens
aagttgcagatgtatt

SEQ ID NO: 4242662 - DNA, 22 bp, Homo sapiens
aagttgcagatgtattgactgt

SEQ ID NO: 4242663 - DNA, 14 bp, Homo sapiens
aagttttaacttta

SEQ ID NO: 4242664 - DNA, 11 bp, Homo sapiens
aagtttttaat

SEQ ID NO: 4242665 - DNA, 20 bp, Homo sapiens
aagtttttatggcttttgtg

SEQ ID NO: 4242666 - DNA, 13 bp, Homo sapiens
aataaaactgaat

SEQ ID NO: 4242667 - DNA, 12 bp, Homo sapiens
aataaactgaat

SEQ ID NO: 4242668 - DNA, 14 bp, Homo sapiens
aataacactgtatt

SEQ ID NO: 4242669 - DNA, 15 bp, Homo sapiens
aataacactgtattt

SEQ ID NO: 4242670 - DNA, 17 bp, Homo sapiens
aataacactgtatttta

SEQ ID NO: 4242671 - DNA, 15 bp, Homo sapiens
aataataaagtatga

SEQ ID NO: 4242672 - DNA, 13 bp, Homo sapiens
aataatattgttt

SEQ ID NO: 4242673 - DNA, 16 bp, Homo sapiens
aataatattgtttttc

SEQ ID NO: 4242674 - DNA, 16 bp, Homo sapiens
aataatccagtattgc

SEQ ID NO: 4242675 - DNA, 20 bp, Homo sapiens
aataatccagtattgctgat

SEQ ID NO: 4242676 - DNA, 15 bp, Homo sapiens
aataatggaaacatt

SEQ ID NO: 4242677 - DNA, 16 bp, Homo sapiens
aataatggaaacatta

SEQ ID NO: 4242678 - DNA, 20 bp, Homo sapiens
aataatggaaacattacagt

SEQ ID NO: 4242679 - DNA, 19 bp, Homo sapiens
aataatgtacatctggcct

SEQ ID NO: 4242680 - DNA, 15 bp, Homo sapiens
aataatgtattgtaa

SEQ ID NO: 4242681 - DNA, 22 bp, Homo sapiens
aataatgtgaaactggattaaa

SEQ ID NO: 4242682 - DNA, 17 bp, Homo sapiens
aatacagctcagtaaat

SEQ ID NO: 4242683 - DNA, 17 bp, Homo sapiens
aatactctacttacagt

SEQ ID NO: 4242684 - DNA, 15 bp, Homo sapiens
aatactgtgcagaat

SEQ ID NO: 4242685 - DNA, 13 bp, Homo sapiens
aatagaaaagtag

SEQ ID NO: 4242686 - DNA, 18 bp, Homo sapiens
aatagaaaagtagacaat

SEQ ID NO: 4242687 - DNA, 15 bp, Homo sapiens
aataggtagtttgga

SEQ ID NO: 4242688 - DNA, 17 bp, Homo sapiens
aatataagacatttgtt

SEQ ID NO: 4242689 - DNA, 23 bp, Homo sapiens
aatataagacatttgtttgctgt

SEQ ID NO: 4242690 - DNA, 21 bp, Homo sapiens
aatataggaacttaaataatg

SEQ ID NO: 4242691 - DNA, 10 bp, Homo sapiens
aatatatata

SEQ ID NO: 4242692 - DNA, 16 bp, Homo sapiens
aatatatataaagaat

SEQ ID NO: 4242693 - DNA, 21 bp, Homo sapiens
aatatatgaagacaataattc

SEQ ID NO: 4242694 - DNA, 15 bp, Homo sapiens
aatatctgttattca

SEQ ID NO: 4242695 - DNA, 14 bp, Homo sapiens
aatatggtgtattt

SEQ ID NO: 4242696 - DNA, 17 bp, Homo sapiens
aatattactcctatttt

SEQ ID NO: 4242697 - DNA, 14 bp, Homo sapiens
aatattgtttttct

SEQ ID NO: 4242698 - DNA, 12 bp, Homo sapiens
aatatttatgtt

SEQ ID NO: 4242699 - DNA, 17 bp, Homo sapiens
aatatttctgctttctt

SEQ ID NO: 4242700 - DNA, 16 bp, Homo sapiens
aatattttggaaactg

SEQ ID NO: 4242701 - DNA, 21 bp, Homo sapiens
aatattttggaaactgctaaa

SEQ ID NO: 4242702 - DNA, 22 bp, Homo sapiens
aatattttttgctctaatctct

SEQ ID NO: 4242703 - DNA, 17 bp, Homo sapiens
aatcatgtatgttatga

SEQ ID NO: 4242704 - DNA, 16 bp, Homo sapiens
aatcattccagtgcta

SEQ ID NO: 4242705 - DNA, 20 bp, Homo sapiens
aatcattgttttgaatatta

SEQ ID NO: 4242706 - DNA, 13 bp, Homo sapiens
aatccagtattgc

SEQ ID NO: 4242707 - DNA, 19 bp, Homo sapiens
aatcctgtttataatctga

SEQ ID NO: 4242708 - DNA, 13 bp, Homo sapiens
aatctaaatggaa

SEQ ID NO: 4242709 - DNA, 15 bp, Homo sapiens
aatctaaatggaacc

SEQ ID NO: 4242710 - DNA, 18 bp, Homo sapiens
aatctaaatggaaccact

SEQ ID NO: 4242711 - DNA, 18 bp, Homo sapiens
aatctaatatccccaaat

SEQ ID NO: 4242712 - DNA, 20 bp, Homo sapiens
aatctattgacttttcaata

SEQ ID NO: 4242713 - DNA, 15 bp, Homo sapiens
aatctcaaatttcta

SEQ ID NO: 4242714 - DNA, 22 bp, Homo sapiens
aatctcaattgaaagcttttaa

SEQ ID NO: 4242715 - DNA, 15 bp, Homo sapiens
aatctcctaaccttg

SEQ ID NO: 4242716 - DNA, 23 bp, Homo sapiens
aatctgccgctttgtctgtccag

SEQ ID NO: 4242717 - DNA, 15 bp, Homo sapiens
aatctgtgtgtatat

SEQ ID NO: 4242718 - DNA, 16 bp, Homo sapiens
aatctgtgtgtatatt

SEQ ID NO: 4242719 - DNA, 21 bp, Homo sapiens
aatgaaataatgtacatctgg

SEQ ID NO: 4242720 - DNA, 15 bp, Homo sapiens
aatgaataaactgaa

SEQ ID NO: 4242721 - DNA, 18 bp, Homo sapiens
aatgaattgaaaaacaat

SEQ ID NO: 4242722 - DNA, 20 bp, Homo sapiens
aatgataaaataaataattt

SEQ ID NO: 4242723 - DNA, 22 bp, Homo sapiens
aatgataaaataaataatttta

SEQ ID NO: 4242724 - DNA, 13 bp, Homo sapiens
aatgcaataattt

SEQ ID NO: 4242725 - DNA, 14 bp, Homo sapiens
aatgcaataatttt

SEQ ID NO: 4242726 - DNA, 16 bp, Homo sapiens
aatgcaataattttac

SEQ ID NO: 4242727 - DNA, 18 bp, Homo sapiens
aatgcacagatatacttt

SEQ ID NO: 4242728 - DNA, 15 bp, Homo sapiens
aatgcagtttttaaa

SEQ ID NO: 4242729 - DNA, 22 bp, Homo sapiens
aatgcataaatgcataatttat

SEQ ID NO: 4242730 - DNA, 23 bp, Homo sapiens
aatgccttaccctcatgttctta

SEQ ID NO: 4242731 - DNA, 19 bp, Homo sapiens
aatgcgtgcataccacttt

SEQ ID NO: 4242732 - DNA, 23 bp, Homo sapiens
aatgcgtgcataccacttttgtt

SEQ ID NO: 4242733 - DNA, 12 bp, Homo sapiens
aatgcttaaaaa

SEQ ID NO: 4242734 - DNA, 16 bp, Homo sapiens
aatgcttaaaaaataa

SEQ ID NO: 4242735 - DNA, 15 bp, Homo sapiens
aatgcttaaactaaa

SEQ ID NO: 4242736 - DNA, 15 bp, Homo sapiens
aatgcttcattgaaa

SEQ ID NO: 4242737 - DNA, 13 bp, Homo sapiens
aatggaaacatta

SEQ ID NO: 4242738 - DNA, 18 bp, Homo sapiens
aatggaaacattacagtt

SEQ ID NO: 4242739 - DNA, 14 bp, Homo sapiens
aatggaaccactct

SEQ ID NO: 4242740 - DNA, 15 bp, Homo sapiens
aatgggggtgcattt

SEQ ID NO: 4242741 - DNA, 19 bp, Homo sapiens
aatgtaaaaaagaaaaaca

SEQ ID NO: 4242742 - DNA, 22 bp, Homo sapiens
aatgtaaagttatgtatttaaa

SEQ ID NO: 4242743 - DNA, 17 bp, Homo sapiens
aatgtacatctggcctt

SEQ ID NO: 4242744 - DNA, 17 bp, Homo sapiens
aatgtattttcttttta

SEQ ID NO: 4242745 - DNA, 14 bp, Homo sapiens
aatgtctcactgtt

SEQ ID NO: 4242746 - DNA, 15 bp, Homo sapiens
aatgtctcactgttc

SEQ ID NO: 4242747 - DNA, 20 bp, Homo sapiens
aatgtgcagaaaatatttaa

SEQ ID NO: 4242748 - DNA, 22 bp, Homo sapiens
aatgtgcagaaaatatttaata

SEQ ID NO: 4242749 - DNA, 17 bp, Homo sapiens
aatgtgcataatgataa

SEQ ID NO: 4242750 - DNA, 15 bp, Homo sapiens
aatgtgtttgctgcc

SEQ ID NO: 4242751 - DNA, 16 bp, Homo sapiens
aatgtgtttttctcca

SEQ ID NO: 4242752 - DNA, 22 bp, Homo sapiens
aatgtgtttttctccagtgctg

SEQ ID NO: 4242753 - DNA, 18 bp, Homo sapiens
aatgttccttttttgtat

SEQ ID NO: 4242754 - DNA, 20 bp, Homo sapiens
aatgttccttttttgtatat

SEQ ID NO: 4242755 - DNA, 21 bp, Homo sapiens
aatgttccttttttgtatatt

SEQ ID NO: 4242756 - DNA, 12 bp, Homo sapiens
aatgtttaaatc

SEQ ID NO: 4242757 - DNA, 20 bp, Homo sapiens
aattaaaaggatagtatttt

SEQ ID NO: 4242758 - DNA, 11 bp, Homo sapiens
aattaactttt

SEQ ID NO: 4242759 - DNA, 22 bp, Homo sapiens
aattaacttttataaactttac

SEQ ID NO: 4242760 - DNA, 21 bp, Homo sapiens
aattaatatggtgtatttttc

SEQ ID NO: 4242761 - DNA, 23 bp, Homo sapiens
aattaatatggtgtatttttcca

SEQ ID NO: 4242762 - DNA, 19 bp, Homo sapiens
aattacgtttgttattcct

SEQ ID NO: 4242763 - DNA, 15 bp, Homo sapiens
aattattattttaaa

SEQ ID NO: 4242764 - DNA, 14 bp, Homo sapiens
aattattgatatat

SEQ ID NO: 4242765 - DNA, 17 bp, Homo sapiens
aattcacctatgttatt

SEQ ID NO: 4242766 - DNA, 21 bp, Homo sapiens
aattcacctatgttattttgt

SEQ ID NO: 4242767 - DNA, 18 bp, Homo sapiens
aattcagtttttgtatct

SEQ ID NO: 4242768 - DNA, 15 bp, Homo sapiens
aattcataaaaacaa

SEQ ID NO: 4242769 - DNA, 21 bp, Homo sapiens
aattctatgttaaatactgtg

SEQ ID NO: 4242770 - DNA, 22 bp, Homo sapiens
aattctatgttaaatactgtgc

SEQ ID NO: 4242771 - DNA, 14 bp, Homo sapiens
aattcttgcaaagt

SEQ ID NO: 4242772 - DNA, 23 bp, Homo sapiens
aattgaaaaacaattttctgtaa

SEQ ID NO: 4242773 - DNA, 15 bp, Homo sapiens
aattgatattatatt

SEQ ID NO: 4242774 - DNA, 22 bp, Homo sapiens
aattgatattatattaaacata

SEQ ID NO: 4242775 - DNA, 14 bp, Homo sapiens
aattgatattttta

SEQ ID NO: 4242776 - DNA, 23 bp, Homo sapiens
aattgctgaagggcattctttcc

SEQ ID NO: 4242777 - DNA, 16 bp, Homo sapiens
aattggaacaaagtga

SEQ ID NO: 4242778 - DNA, 20 bp, Homo sapiens
aattggcagtgactttgtat

SEQ ID NO: 4242779 - DNA, 18 bp, Homo sapiens
aattgtatcaatttgttt

SEQ ID NO: 4242780 - DNA, 12 bp, Homo sapiens
aattgtgcttct

SEQ ID NO: 4242781 - DNA, 22 bp, Homo sapiens
aatttacaagatattattaatt

SEQ ID NO: 4242782 - DNA, 15 bp, Homo sapiens
aatttcatttaaata

SEQ ID NO: 4242783 - DNA, 20 bp, Homo sapiens
aatttcttttccttcattca

SEQ ID NO: 4242784 - DNA, 17 bp, Homo sapiens
aatttgatgatgttaaa

SEQ ID NO: 4242785 - DNA, 21 bp, Homo sapiens
aatttgatgatgttaaatgta

SEQ ID NO: 4242786 - DNA, 17 bp, Homo sapiens
aatttgtgatacaatgc

SEQ ID NO: 4242787 - DNA, 19 bp, Homo sapiens
aatttgtttgtgttcaata

SEQ ID NO: 4242788 - DNA, 16 bp, Homo sapiens
aattttctgtaatctt

SEQ ID NO: 4242789 - DNA, 15 bp, Homo sapiens
aatttttatttattt

SEQ ID NO: 4242790 - DNA, 23 bp, Homo sapiens
aattttttttttcctcttcagaa

SEQ ID NO: 4242791 - DNA, 17 bp, Homo sapiens
acaaaaaaatttaaaat

SEQ ID NO: 4242792 - DNA, 12 bp, Homo sapiens
acaaaagattta

SEQ ID NO: 4242793 - DNA, 18 bp, Homo sapiens
acaaagagaccaggggcg

SEQ ID NO: 4242794 - DNA, 12 bp, Homo sapiens
acaaagatttct

SEQ ID NO: 4242795 - DNA, 18 bp, Homo sapiens
acaacagctcgatccaaa

SEQ ID NO: 4242796 - DNA, 13 bp, Homo sapiens
acaacatttatgt

SEQ ID NO: 4242797 - DNA, 18 bp, Homo sapiens
acaactatttactttttt

SEQ ID NO: 4242798 - DNA, 15 bp, Homo sapiens
acaaggattgaaaat

SEQ ID NO: 4242799 - DNA, 16 bp, Homo sapiens
acaagtaaatatatat

SEQ ID NO: 4242800 - DNA, 14 bp, Homo sapiens
acaagtaatgtaaa

SEQ ID NO: 4242801 - DNA, 16 bp, Homo sapiens
acaagtagcctctggg

SEQ ID NO: 4242802 - DNA, 19 bp, Homo sapiens
acaagttgttattgttgaa

SEQ ID NO: 4242803 - DNA, 18 bp, Homo sapiens
acaataattctacatgtt

SEQ ID NO: 4242804 - DNA, 21 bp, Homo sapiens
acaatactgtatcagatgtga

SEQ ID NO: 4242805 - DNA, 12 bp, Homo sapiens
acaatgacttac

SEQ ID NO: 4242806 - DNA, 22 bp, Homo sapiens
acaatgacttactgtacatgaa

SEQ ID NO: 4242807 - DNA, 21 bp, Homo sapiens
acaatgctgtgccctaaagtg

SEQ ID NO: 4242808 - DNA, 23 bp, Homo sapiens
acaatgttccttttttgtatatt

SEQ ID NO: 4242809 - DNA, 13 bp, Homo sapiens
acaatttattatg

SEQ ID NO: 4242810 - DNA, 23 bp, Homo sapiens
acaattttctgtaatcttttatt

SEQ ID NO: 4242811 - DNA, 12 bp, Homo sapiens
acacaatatgta

SEQ ID NO: 4242812 - DNA, 18 bp, Homo sapiens
acacaatatgtatgcttt

SEQ ID NO: 4242813 - DNA, 11 bp, Homo sapiens
acacattttaa

SEQ ID NO: 4242814 - DNA, 14 bp, Homo sapiens
acacattttatttt

SEQ ID NO: 4242815 - DNA, 20 bp, Homo sapiens
acacattttattttattatg

SEQ ID NO: 4242816 - DNA, 21 bp, Homo sapiens
acacattttattttattatgc

SEQ ID NO: 4242817 - DNA, 22 bp, Homo sapiens
acacattttattttattatgca

SEQ ID NO: 4242818 - DNA, 16 bp, Homo sapiens
acacattttttaaatg

SEQ ID NO: 4242819 - DNA, 16 bp, Homo sapiens
acaccaagcagcaaca

SEQ ID NO: 4242820 - DNA, 20 bp, Homo sapiens
acaccactacattctgttaa

SEQ ID NO: 4242821 - DNA, 16 bp, Homo sapiens
acacccacctctgcca

SEQ ID NO: 4242822 - DNA, 16 bp, Homo sapiens
acacggagctcctggc

SEQ ID NO: 4242823 - DNA, 15 bp, Homo sapiens
acacgtccactccca

SEQ ID NO: 4242824 - DNA, 23 bp, Homo sapiens
acactaaaagcagcgtcactcta

SEQ ID NO: 4242825 - DNA, 14 bp, Homo sapiens
acactgcatgtttg

SEQ ID NO: 4242826 - DNA, 15 bp, Homo sapiens
acactgcatgtttgt

SEQ ID NO: 4242827 - DNA, 14 bp, Homo sapiens
acactgtattttaa

SEQ ID NO: 4242828 - DNA, 15 bp, Homo sapiens
acactgtattttaat

SEQ ID NO: 4242829 - DNA, 23 bp, Homo sapiens
acagaaactggattaaaacaatt

SEQ ID NO: 4242830 - DNA, 13 bp, Homo sapiens
acagaaatgtaca

SEQ ID NO: 4242831 - DNA, 11 bp, Homo sapiens
acagaataatc

SEQ ID NO: 4242832 - DNA, 17 bp, Homo sapiens
acagacacaatatgtat

SEQ ID NO: 4242833 - DNA, 18 bp, Homo sapiens
acagacatactaaccagc

SEQ ID NO: 4242834 - DNA, 21 bp, Homo sapiens
acagaccaagtccaagcccgt

SEQ ID NO: 4242835 - DNA, 16 bp, Homo sapiens
acagagttgttacatt

SEQ ID NO: 4242836 - DNA, 17 bp, Homo sapiens
acagagttgttacattt

SEQ ID NO: 4242837 - DNA, 19 bp, Homo sapiens
acagatatactttgtggac

SEQ ID NO: 4242838 - DNA, 16 bp, Homo sapiens
acagcccaaaatttga

SEQ ID NO: 4242839 - DNA, 12 bp, Homo sapiens
acagcctgagcc

SEQ ID NO: 4242840 - DNA, 19 bp, Homo sapiens
acagctgaagtcaaaatat

SEQ ID NO: 4242841 - DNA, 23 bp, Homo sapiens
acaggaaatgggaaaaaacttaa

SEQ ID NO: 4242842 - DNA, 15 bp, Homo sapiens
acaggcctgaagata

SEQ ID NO: 4242843 - DNA, 21 bp, Homo sapiens
acagtagttgtattcttctgt

SEQ ID NO: 4242844 - DNA, 23 bp, Homo sapiens
acagtatttctggtgtatatttt

SEQ ID NO: 4242845 - DNA, 16 bp, Homo sapiens
acagtgaatgtgtctg

SEQ ID NO: 4242846 - DNA, 15 bp, Homo sapiens
acagtggtactctgt

SEQ ID NO: 4242847 - DNA, 20 bp, Homo sapiens
acagtggtactctgtgtctg

SEQ ID NO: 4242848 - DNA, 19 bp, Homo sapiens
acagtgtgcctggttaata

SEQ ID NO: 4242849 - DNA, 16 bp, Homo sapiens
acagtttgttagtatg

SEQ ID NO: 4242850 - DNA, 19 bp, Homo sapiens
acataaaaactgatttgct

SEQ ID NO: 4242851 - DNA, 23 bp, Homo sapiens
acataaacaagaccacgtttcta

SEQ ID NO: 4242852 - DNA, 15 bp, Homo sapiens
acataaagttgtatt

SEQ ID NO: 4242853 - DNA, 21 bp, Homo sapiens
acataatgcgtgcataccact

SEQ ID NO: 4242854 - DNA, 21 bp, Homo sapiens
acatactaaccagcagaaatg

SEQ ID NO: 4242855 - DNA, 22 bp, Homo sapiens
acatactaaccagcagaaatgc

SEQ ID NO: 4242856 - DNA, 19 bp, Homo sapiens
acatacttcaaaaataatg

SEQ ID NO: 4242857 - DNA, 23 bp, Homo sapiens
acatattgatttccgttaaaata

SEQ ID NO: 4242858 - DNA, 18 bp, Homo sapiens
acatattgtatatatatt

SEQ ID NO: 4242859 - DNA, 14 bp, Homo sapiens
acatcgatatgtat

SEQ ID NO: 4242860 - DNA, 23 bp, Homo sapiens
acatcttgcattcaaaatcttca

SEQ ID NO: 4242861 - DNA, 19 bp, Homo sapiens
acatgaaaacacatttttc

SEQ ID NO: 4242862 - DNA, 16 bp, Homo sapiens
acatgcaaggtcattt

SEQ ID NO: 4242863 - DNA, 19 bp, Homo sapiens
acatgcaaggtcatttttt

SEQ ID NO: 4242864 - DNA, 14 bp, Homo sapiens
acatgtatttatgt

SEQ ID NO: 4242865 - DNA, 19 bp, Homo sapiens
acattaaatgcaataattt

SEQ ID NO: 4242866 - DNA, 20 bp, Homo sapiens
acattaaatgcaataatttt

SEQ ID NO: 4242867 - DNA, 14 bp, Homo sapiens
acattaaggaattt

SEQ ID NO: 4242868 - DNA, 19 bp, Homo sapiens
acattaaggaatttgatga

SEQ ID NO: 4242869 - DNA, 13 bp, Homo sapiens
acattacagttca

SEQ ID NO: 4242870 - DNA, 14 bp, Homo sapiens
acattactttttat

SEQ ID NO: 4242871 - DNA, 18 bp, Homo sapiens
acattataacaactattt

SEQ ID NO: 4242872 - DNA, 21 bp, Homo sapiens
acattataacaactatttact

SEQ ID NO: 4242873 - DNA, 15 bp, Homo sapiens
acattctgttaatca

SEQ ID NO: 4242874 - DNA, 18 bp, Homo sapiens
acattcttattaattctt

SEQ ID NO: 4242875 - DNA, 19 bp, Homo sapiens
acattcttattaattcttc

SEQ ID NO: 4242876 - DNA, 19 bp, Homo sapiens
acattttattttattatgc

SEQ ID NO: 4242877 - DNA, 18 bp, Homo sapiens
acatttttaagtgctgca

SEQ ID NO: 4242878 - DNA, 21 bp, Homo sapiens
acatttttaagtgctgcattt

SEQ ID NO: 4242879 - DNA, 22 bp, Homo sapiens
acatttttaagtgctgcattta

SEQ ID NO: 4242880 - DNA, 16 bp, Homo sapiens
acattttttaaatgca

SEQ ID NO: 4242881 - DNA, 20 bp, Homo sapiens
accaaggacggaaaatgctt

SEQ ID NO: 4242882 - DNA, 21 bp, Homo sapiens
accaaggtacaactgtattta

SEQ ID NO: 4242883 - DNA, 23 bp, Homo sapiens
accaattattgatatatattata

SEQ ID NO: 4242884 - DNA, 24 bp, Homo sapiens
accacagacacaatatgtatgctt

SEQ ID NO: 4242885 - DNA, 14 bp, Homo sapiens
accacgtttctaaa

SEQ ID NO: 4242886 - DNA, 15 bp, Homo sapiens
accactacattctgt

SEQ ID NO: 4242887 - DNA, 17 bp, Homo sapiens
accactacattctgtta

SEQ ID NO: 4242888 - DNA, 22 bp, Homo sapiens
accacttttgttcttggtttgt

SEQ ID NO: 4242889 - DNA, 20 bp, Homo sapiens
accagaagtgcagcccctct

SEQ ID NO: 4242890 - DNA, 21 bp, Homo sapiens
accagaagtgcagcccctctc

SEQ ID NO: 4242891 - DNA, 22 bp, Homo sapiens
accagctggcgggtgtggagac

SEQ ID NO: 4242892 - DNA, 15 bp, Homo sapiens
accagtgttgtggat

SEQ ID NO: 4242893 - DNA, 17 bp, Homo sapiens
accagtgttgtggattt

SEQ ID NO: 4242894 - DNA, 18 bp, Homo sapiens
accagtgttgtggattta

SEQ ID NO: 4242895 - DNA, 13 bp, Homo sapiens
accatctctgtga

SEQ ID NO: 4242896 - DNA, 19 bp, Homo sapiens
accatttgctactgtacat

SEQ ID NO: 4242897 - DNA, 14 bp, Homo sapiens
acccacctctgcca

SEQ ID NO: 4242898 - DNA, 13 bp, Homo sapiens
acccactttgtaa

SEQ ID NO: 4242899 - DNA, 21 bp, Homo sapiens
acccactttgtaatttttgct

SEQ ID NO: 4242900 - DNA, 19 bp, Homo sapiens
acccagcagttctctgcca

SEQ ID NO: 4242901 - DNA, 19 bp, Homo sapiens
acccattctacacagagca

SEQ ID NO: 4242902 - DNA, 19 bp, Homo sapiens
accccacccttcccctcct

SEQ ID NO: 4242903 - DNA, 17 bp, Homo sapiens
accccaggtgagacctc

SEQ ID NO: 4242904 - DNA, 19 bp, Homo sapiens
accccgccatgcatgcagc

SEQ ID NO: 4242905 - DNA, 14 bp, Homo sapiens
accctcatgttctt

SEQ ID NO: 4242906 - DNA, 17 bp, Homo sapiens
accctcatgttcttaat

SEQ ID NO: 4242907 - DNA, 20 bp, Homo sapiens
accctgtgtatacagccctg

SEQ ID NO: 4242908 - DNA, 22 bp, Homo sapiens
acccttcccctccttctccctt

SEQ ID NO: 4242909 - DNA, 17 bp, Homo sapiens
accctttgtttcttgtt

SEQ ID NO: 4242910 - DNA, 19 bp, Homo sapiens
accgaggtgttgccagtgc

SEQ ID NO: 4242911 - DNA, 17 bp, Homo sapiens
accgcttctgccttttc

SEQ ID NO: 4242912 - DNA, 20 bp, Homo sapiens
accgtctttacccctgctga

SEQ ID NO: 4242913 - DNA, 21 bp, Homo sapiens
acctaaaaggaaatctcaccc

SEQ ID NO: 4242914 - DNA, 22 bp, Homo sapiens
acctaatgtctcactgttctgc

SEQ ID NO: 4242915 - DNA, 23 bp, Homo sapiens
acctcccacctatccgccctgca

SEQ ID NO: 4242916 - DNA, 16 bp, Homo sapiens
acctccggagcgccct

SEQ ID NO: 4242917 - DNA, 21 bp, Homo sapiens
acctccggagcgccctgcagg

SEQ ID NO: 4242918 - DNA, 19 bp, Homo sapiens
acctcctaatggcatggag

SEQ ID NO: 4242919 - DNA, 16 bp, Homo sapiens
acctctcaagctagtg

SEQ ID NO: 4242920 - DNA, 22 bp, Homo sapiens
acctctcaagctagtgtttcta

SEQ ID NO: 4242921 - DNA, 19 bp, Homo sapiens
acctctcgtttctgcccag

SEQ ID NO: 4242922 - DNA, 15 bp, Homo sapiens
acctctgcagcaata

SEQ ID NO: 4242923 - DNA, 19 bp, Homo sapiens
acctcttgagccttgaact

SEQ ID NO: 4242924 - DNA, 21 bp, Homo sapiens
acctgcttgagctttctgtgc

SEQ ID NO: 4242925 - DNA, 23 bp, Homo sapiens
acctgcttgagctttctgtgcat

SEQ ID NO: 4242926 - DNA, 24 bp, Homo sapiens
acctgcttgagctttctgtgcatg

SEQ ID NO: 4242927 - DNA, 20 bp, Homo sapiens
accttaaaattaagatttcc

SEQ ID NO: 4242928 - DNA, 16 bp, Homo sapiens
accttaaaattgatat

SEQ ID NO: 4242929 - DNA, 16 bp, Homo sapiens
accttatcaggatggt

SEQ ID NO: 4242930 - DNA, 15 bp, Homo sapiens
acctttgtattctct

SEQ ID NO: 4242931 - DNA, 19 bp, Homo sapiens
acctttgtattctctcctg

SEQ ID NO: 4242932 - DNA, 13 bp, Homo sapiens
accttttttatac

SEQ ID NO: 4242933 - DNA, 16 bp, Homo sapiens
accttttttatacata

SEQ ID NO: 4242934 - DNA, 11 bp, Homo sapiens
acgattctccc

SEQ ID NO: 4242935 - DNA, 13 bp, Homo sapiens
acgatttctgttt

SEQ ID NO: 4242936 - DNA, 23 bp, Homo sapiens
acgatttctgtttagataataca

SEQ ID NO: 4242937 - DNA, 17 bp, Homo sapiens
acgcggcggggactcgg

SEQ ID NO: 4242938 - DNA, 16 bp, Homo sapiens
acgcttactagatgtg

SEQ ID NO: 4242939 - DNA, 14 bp, Homo sapiens
acggagctcctggc

SEQ ID NO: 4242940 - DNA, 16 bp, Homo sapiens
acggagctcctggcag

SEQ ID NO: 4242941 - DNA, 13 bp, Homo sapiens
acgtacacatttt

SEQ ID NO: 4242942 - DNA, 14 bp, Homo sapiens
acgtacacatttta

SEQ ID NO: 4242943 - DNA, 16 bp, Homo sapiens
acgtcgcggccgcctt

SEQ ID NO: 4242944 - DNA, 12 bp, Homo sapiens
acgtttctaaag

SEQ ID NO: 4242945 - DNA, 14 bp, Homo sapiens
acgtttctaaaggc

SEQ ID NO: 4242946 - DNA, 21 bp, Homo sapiens
actaaataatgaataaactga

SEQ ID NO: 4242947 - DNA, 22 bp, Homo sapiens
actaaataatgaataaactgaa

SEQ ID NO: 4242948 - DNA, 15 bp, Homo sapiens
actaatagacaattt

SEQ ID NO: 4242949 - DNA, 22 bp, Homo sapiens
actaattattattttaaaatat

SEQ ID NO: 4242950 - DNA, 15 bp, Homo sapiens
actacaaaatacaat

SEQ ID NO: 4242951 - DNA, 20 bp, Homo sapiens
actacaaaatacaatcctgt

SEQ ID NO: 4242952 - DNA, 14 bp, Homo sapiens
actacacatttgaa

SEQ ID NO: 4242953 - DNA, 12 bp, Homo sapiens
actagagaatgc

SEQ ID NO: 4242954 - DNA, 19 bp, Homo sapiens
actagtaagtaattatgca

SEQ ID NO: 4242955 - DNA, 15 bp, Homo sapiens
actatgcccttttat

SEQ ID NO: 4242956 - DNA, 15 bp, Homo sapiens
actatttctttttat

SEQ ID NO: 4242957 - DNA, 18 bp, Homo sapiens
actatttgctaatgtata

SEQ ID NO: 4242958 - DNA, 15 bp, Homo sapiens
actcaaaaaaacaaa

SEQ ID NO: 4242959 - DNA, 18 bp, Homo sapiens
actcaaggtttaacctta

SEQ ID NO: 4242960 - DNA, 20 bp, Homo sapiens
actcaaggtttaaccttaaa

SEQ ID NO: 4242961 - DNA, 14 bp, Homo sapiens
actcagaattctct

SEQ ID NO: 4242962 - DNA, 22 bp, Homo sapiens
actcagaattctctagtttgat

SEQ ID NO: 4242963 - DNA, 14 bp, Homo sapiens
actcctatttttgt

SEQ ID NO: 4242964 - DNA, 23 bp, Homo sapiens
actctacctaatgtctcactgtt

SEQ ID NO: 4242965 - DNA, 15 bp, Homo sapiens
actctaggacttcaa

SEQ ID NO: 4242966 - DNA, 16 bp, Homo sapiens
actctaggacttcaaa

SEQ ID NO: 4242967 - DNA, 14 bp, Homo sapiens
actctatcaagtat

SEQ ID NO: 4242968 - DNA, 16 bp, Homo sapiens
actctatcaagtatta

SEQ ID NO: 4242969 - DNA, 16 bp, Homo sapiens
actctcagcccagaag

SEQ ID NO: 4242970 - DNA, 13 bp, Homo sapiens
actctccatatcc

SEQ ID NO: 4242971 - DNA, 13 bp, Homo sapiens
actctgtgtttaa

SEQ ID NO: 4242972 - DNA, 17 bp, Homo sapiens
actcttccacctctggg

SEQ ID NO: 4242973 - DNA, 21 bp, Homo sapiens
actgaagggaacagcctgagc

SEQ ID NO: 4242974 - DNA, 17 bp, Homo sapiens
actgaatattttggaaa

SEQ ID NO: 4242975 - DNA, 19 bp, Homo sapiens
actgagtacgttgtgcatt

SEQ ID NO: 4242976 - DNA, 13 bp, Homo sapiens
actgataaagatg

SEQ ID NO: 4242977 - DNA, 21 bp, Homo sapiens
actgataaagatgagtgagca

SEQ ID NO: 4242978 - DNA, 12 bp, Homo sapiens
actgatttgctc

SEQ ID NO: 4242979 - DNA, 23 bp, Homo sapiens
actgcaaacttttttatatcttt

SEQ ID NO: 4242980 - DNA, 24 bp, Homo sapiens
actgcaaacttttttatatctttt

SEQ ID NO: 4242981 - DNA, 19 bp, Homo sapiens
actgcaacctcacctcccg

SEQ ID NO: 4242982 - DNA, 18 bp, Homo sapiens
actgcacagcgtcctgtc

SEQ ID NO: 4242983 - DNA, 15 bp, Homo sapiens
actgcatgtttgtga

SEQ ID NO: 4242984 - DNA, 18 bp, Homo sapiens
actgcattcattctgagc

SEQ ID NO: 4242985 - DNA, 19 bp, Homo sapiens
actgcattcattctgagcc

SEQ ID NO: 4242986 - DNA, 22 bp, Homo sapiens
actggaaatgtttgtccttgca

SEQ ID NO: 4242987 - DNA, 15 bp, Homo sapiens
actggattaaactta

SEQ ID NO: 4242988 - DNA, 14 bp, Homo sapiens
actggtttgagatt

SEQ ID NO: 4242989 - DNA, 16 bp, Homo sapiens
actgtacatgaaaaca

SEQ ID NO: 4242990 - DNA, 23 bp, Homo sapiens
actgtacatgaaaacacattttt

SEQ ID NO: 4242991 - DNA, 16 bp, Homo sapiens
actgtatcagatgtga

SEQ ID NO: 4242992 - DNA, 17 bp, Homo sapiens
actgtatcagatgtgaa

SEQ ID NO: 4242993 - DNA, 20 bp, Homo sapiens
actgtatcatgacaaagact

SEQ ID NO: 4242994 - DNA, 12 bp, Homo sapiens
actgtgcagaat

SEQ ID NO: 4242995 - DNA, 14 bp, Homo sapiens
actgtgcagaataa

SEQ ID NO: 4242996 - DNA, 15 bp, Homo sapiens
actgtgcagaataat

SEQ ID NO: 4242997 - DNA, 16 bp, Homo sapiens
actgtgcagaataatg

SEQ ID NO: 4242998 - DNA, 21 bp, Homo sapiens
actgtgcagaataatggaaac

SEQ ID NO: 4242999 - DNA, 22 bp, Homo sapiens
actgtgcagaataatggaaaca

SEQ ID NO: 4243000 - DNA, 12 bp, Homo sapiens
actgttctgcaa

SEQ ID NO: 4243001 - DNA, 20 bp, Homo sapiens
actgttctgcaaaggtggca

SEQ ID NO: 4243002 - DNA, 15 bp, Homo sapiens
actgtttcaaacttt

SEQ ID NO: 4243003 - DNA, 17 bp, Homo sapiens
acttaatctaaatggaa

SEQ ID NO: 4243004 - DNA, 17 bp, Homo sapiens
acttacctgcttgagct

SEQ ID NO: 4243005 - DNA, 15 bp, Homo sapiens
acttactgtacatga

SEQ ID NO: 4243006 - DNA, 16 bp, Homo sapiens
acttactgtacatgaa

SEQ ID NO: 4243007 - DNA, 16 bp, Homo sapiens
acttcaaaaataatgt

SEQ ID NO: 4243008 - DNA, 19 bp, Homo sapiens
acttcacatattgatttcc

SEQ ID NO: 4243009 - DNA, 19 bp, Homo sapiens
acttctcttaaacttgtga

SEQ ID NO: 4243010 - DNA, 21 bp, Homo sapiens
acttctcttaaacttgtgaat

SEQ ID NO: 4243011 - DNA, 21 bp, Homo sapiens
acttgagacaatgttttcttc

SEQ ID NO: 4243012 - DNA, 21 bp, Homo sapiens
acttgatttgatgtgactttt

SEQ ID NO: 4243013 - DNA, 16 bp, Homo sapiens
acttgtcaggcatggc

SEQ ID NO: 4243014 - DNA, 13 bp, Homo sapiens
actttaatacagc

SEQ ID NO: 4243015 - DNA, 12 bp, Homo sapiens
actttacctttt

SEQ ID NO: 4243016 - DNA, 19 bp, Homo sapiens
actttaccttttttataca

SEQ ID NO: 4243017 - DNA, 13 bp, Homo sapiens
actttgacctctg

SEQ ID NO: 4243018 - DNA, 20 bp, Homo sapiens
actttgtggaccaattattg

SEQ ID NO: 4243019 - DNA, 21 bp, Homo sapiens
actttgtggaccaattattga

SEQ ID NO: 4243020 - DNA, 13 bp, Homo sapiens
acttttataaact

SEQ ID NO: 4243021 - DNA, 15 bp, Homo sapiens
acttttataaacttt

SEQ ID NO: 4243022 - DNA, 22 bp, Homo sapiens
acttttatgcagcaaatatatg

SEQ ID NO: 4243023 - DNA, 18 bp, Homo sapiens
acttttcccctgttaaac

SEQ ID NO: 4243024 - DNA, 20 bp, Homo sapiens
acttttcccctgttaaacag

SEQ ID NO: 4243025 - DNA, 22 bp, Homo sapiens
acttttcccctgttaaacagta

SEQ ID NO: 4243026 - DNA, 16 bp, Homo sapiens
acttttggattttatg

SEQ ID NO: 4243027 - DNA, 17 bp, Homo sapiens
acttttggattttatgg

SEQ ID NO: 4243028 - DNA, 12 bp, Homo sapiens
acttttgttaaa

SEQ ID NO: 4243029 - DNA, 12 bp, Homo sapiens
acttttgttctt

SEQ ID NO: 4243030 - DNA, 13 bp, Homo sapiens
acttttgttcttg

SEQ ID NO: 4243031 - DNA, 23 bp, Homo sapiens
acttttgttcttggtttgtaaat

SEQ ID NO: 4243032 - DNA, 16 bp, Homo sapiens
actttttaagtttgaa

SEQ ID NO: 4243033 - DNA, 19 bp, Homo sapiens
actttttttggtataatgt

SEQ ID NO: 4243034 - DNA, 17 bp, Homo sapiens
agaaaaaggatgcacag

SEQ ID NO: 4243035 - DNA, 19 bp, Homo sapiens
agaaaagtagacaatcatt

SEQ ID NO: 4243036 - DNA, 19 bp, Homo sapiens
agaaaatagtggtgtgatt

SEQ ID NO: 4243037 - DNA, 19 bp, Homo sapiens
agaaaatatttaatatcaa

SEQ ID NO: 4243038 - DNA, 14 bp, Homo sapiens
agaaaattctcctg

SEQ ID NO: 4243039 - DNA, 15 bp, Homo sapiens
agaaaattgatattt

SEQ ID NO: 4243040 - DNA, 16 bp, Homo sapiens
agaaacacattcttat

SEQ ID NO: 4243041 - DNA, 18 bp, Homo sapiens
agaactacgcacagctgc

SEQ ID NO: 4243042 - DNA, 13 bp, Homo sapiens
agaactcagtgcc

SEQ ID NO: 4243043 - DNA, 19 bp, Homo sapiens
agaagacatactgcttgat

SEQ ID NO: 4243044 - DNA, 14 bp, Homo sapiens
agaagcaaatatag

SEQ ID NO: 4243045 - DNA, 23 bp, Homo sapiens
agaataatggaaacattacagtt

SEQ ID NO: 4243046 - DNA, 11 bp, Homo sapiens
agaatatatat

SEQ ID NO: 4243047 - DNA, 17 bp, Homo sapiens
agaatcccttaaaatta

SEQ ID NO: 4243048 - DNA, 19 bp, Homo sapiens
agaatcccttaaaattacc

SEQ ID NO: 4243049 - DNA, 12 bp, Homo sapiens
agaatgagcctg

SEQ ID NO: 4243050 - DNA, 18 bp, Homo sapiens
agacaaaaaaatttaaaa

SEQ ID NO: 4243051 - DNA, 21 bp, Homo sapiens
agacaaaaacaagtaaatata

SEQ ID NO: 4243052 - DNA, 22 bp, Homo sapiens
agacaatcattgttttgaatat

SEQ ID NO: 4243053 - DNA, 23 bp, Homo sapiens
agacaatcattgttttgaatatt

SEQ ID NO: 4243054 - DNA, 19 bp, Homo sapiens
agacaatgacttactgtac

SEQ ID NO: 4243055 - DNA, 21 bp, Homo sapiens
agacaatgacttactgtacat

SEQ ID NO: 4243056 - DNA, 23 bp, Homo sapiens
agacaatgacttactgtacatga

SEQ ID NO: 4243057 - DNA, 14 bp, Homo sapiens
agacaatgttttct

SEQ ID NO: 4243058 - DNA, 14 bp, Homo sapiens
agacagaaactgga

SEQ ID NO: 4243059 - DNA, 15 bp, Homo sapiens
agacagaaactggat

SEQ ID NO: 4243060 - DNA, 23 bp, Homo sapiens
agacagagtccctggctcctcta

SEQ ID NO: 4243061 - DNA, 15 bp, Homo sapiens
agacatactgcttga

SEQ ID NO: 4243062 - DNA, 21 bp, Homo sapiens
agacatttgtttgctgtacag

SEQ ID NO: 4243063 - DNA, 20 bp, Homo sapiens
agacgcggcggggactcgga

SEQ ID NO: 4243064 - DNA, 13 bp, Homo sapiens
agactaaattcaa

SEQ ID NO: 4243065 - DNA, 19 bp, Homo sapiens
agactaaattcaatcacca

SEQ ID NO: 4243066 - DNA, 20 bp, Homo sapiens
agactgagtacgttgtgcat

SEQ ID NO: 4243067 - DNA, 16 bp, Homo sapiens
agactgcaaacttttt

SEQ ID NO: 4243068 - DNA, 21 bp, Homo sapiens
agactgcaaacttttttatat

SEQ ID NO: 4243069 - DNA, 15 bp, Homo sapiens
agacttgagacaatg

SEQ ID NO: 4243070 - DNA, 17 bp, Homo sapiens
agagaaaacccggagca

SEQ ID NO: 4243071 - DNA, 18 bp, Homo sapiens
agagaaaagaaaaatcaa

SEQ ID NO: 4243072 - DNA, 14 bp, Homo sapiens
agagaagttctcaa

SEQ ID NO: 4243073 - DNA, 20 bp, Homo sapiens
agagaatgcacagatatact

SEQ ID NO: 4243074 - DNA, 14 bp, Homo sapiens
agagcatctctgcc

SEQ ID NO: 4243075 - DNA, 14 bp, Homo sapiens
agagcccgggagag

SEQ ID NO: 4243076 - DNA, 17 bp, Homo sapiens
agagcccgggagagact

SEQ ID NO: 4243077 - DNA, 15 bp, Homo sapiens
agagcttttaaaaat

SEQ ID NO: 4243078 - DNA, 16 bp, Homo sapiens
agagcttttaaaaatg

SEQ ID NO: 4243079 - DNA, 20 bp, Homo sapiens
agaggtgcttctgcctgtgc

SEQ ID NO: 4243080 - DNA, 16 bp, Homo sapiens
agaggttcaaagatat

SEQ ID NO: 4243081 - DNA, 20 bp, Homo sapiens
agagtaactttactctgtgt

SEQ ID NO: 4243082 - DNA, 19 bp, Homo sapiens
agagttgaggaactgtaca

SEQ ID NO: 4243083 - DNA, 17 bp, Homo sapiens
agagttgatactacagt

SEQ ID NO: 4243084 - DNA, 22 bp, Homo sapiens
agatattttgctttgtgatttt

SEQ ID NO: 4243085 - DNA, 16 bp, Homo sapiens
agatctaaacagttat

SEQ ID NO: 4243086 - DNA, 21 bp, Homo sapiens
agatctaaacagttatttctg

SEQ ID NO: 4243087 - DNA, 13 bp, Homo sapiens
agatggaaataca

SEQ ID NO: 4243088 - DNA, 23 bp, Homo sapiens
agatggagcaggtctttgggaag

SEQ ID NO: 4243089 - DNA, 16 bp, Homo sapiens
agatggtttcaattca

SEQ ID NO: 4243090 - DNA, 15 bp, Homo sapiens
agatgtattgactgt

SEQ ID NO: 4243091 - DNA, 21 bp, Homo sapiens
agattctgcctatgtaaaatg

SEQ ID NO: 4243092 - DNA, 13 bp, Homo sapiens
agattgtcttgca

SEQ ID NO: 4243093 - DNA, 23 bp, Homo sapiens
agattgtcttgcaacttcagttt

SEQ ID NO: 4243094 - DNA, 13 bp, Homo sapiens
agatttttattta

SEQ ID NO: 4243095 - DNA, 15 bp, Homo sapiens
agatttttatttatg

SEQ ID NO: 4243096 - DNA, 18 bp, Homo sapiens
agatttttatttatgagt

SEQ ID NO: 4243097 - DNA, 16 bp, Homo sapiens
agcaaatgacagattt

SEQ ID NO: 4243098 - DNA, 17 bp, Homo sapiens
agcaaccacaaatgcat

SEQ ID NO: 4243099 - DNA, 15 bp, Homo sapiens
agcacagctctcctc

SEQ ID NO: 4243100 - DNA, 16 bp, Homo sapiens
agcacatctgcatttt

SEQ ID NO: 4243101 - DNA, 14 bp, Homo sapiens
agcagacagaaact

SEQ ID NO: 4243102 - DNA, 16 bp, Homo sapiens
agcagacagaaactgg

SEQ ID NO: 4243103 - DNA, 16 bp, Homo sapiens
agcagggaccgggcgc

SEQ ID NO: 4243104 - DNA, 21 bp, Homo sapiens
agcagggaccgggcgcagccc

SEQ ID NO: 4243105 - DNA, 15 bp, Homo sapiens
agcagttctctgcca

SEQ ID NO: 4243106 - DNA, 16 bp, Homo sapiens
agcagttctctgccaa

SEQ ID NO: 4243107 - DNA, 17 bp, Homo sapiens
agcataaataaaactga

SEQ ID NO: 4243108 - DNA, 15 bp, Homo sapiens
agcatacgtacacat

SEQ ID NO: 4243109 - DNA, 17 bp, Homo sapiens
agcatacgtacacattt

SEQ ID NO: 4243110 - DNA, 20 bp, Homo sapiens
agcatacgtacacattttat

SEQ ID NO: 4243111 - DNA, 23 bp, Homo sapiens
agcatcagcacagctctcctcct

SEQ ID NO: 4243112 - DNA, 23 bp, Homo sapiens
agcatgtcaattcataaaaacaa

SEQ ID NO: 4243113 - DNA, 20 bp, Homo sapiens
agcatttaatggcagctagt

SEQ ID NO: 4243114 - DNA, 16 bp, Homo sapiens
agccaaaccctgtctg

SEQ ID NO: 4243115 - DNA, 19 bp, Homo sapiens
agccactagcccactcccc

SEQ ID NO: 4243116 - DNA, 20 bp, Homo sapiens
agccagatctcgggactcag

SEQ ID NO: 4243117 - DNA, 22 bp, Homo sapiens
agccagtaaatgggggtgcatt

SEQ ID NO: 4243118 - DNA, 18 bp, Homo sapiens
agccattaaatgaatatt

SEQ ID NO: 4243119 - DNA, 21 bp, Homo sapiens
agccattaaatgaatattttg

SEQ ID NO: 4243120 - DNA, 22 bp, Homo sapiens
agccattaaatgaatattttga

SEQ ID NO: 4243121 - DNA, 15 bp, Homo sapiens
agcccaaaatttgat

SEQ ID NO: 4243122 - DNA, 12 bp, Homo sapiens
agcccactcccc

SEQ ID NO: 4243123 - DNA, 16 bp, Homo sapiens
agccccgccaggtgcc

SEQ ID NO: 4243124 - DNA, 15 bp, Homo sapiens
agccctctgtggcca

SEQ ID NO: 4243125 - DNA, 18 bp, Homo sapiens
agccctctgtggccagga

SEQ ID NO: 4243126 - DNA, 20 bp, Homo sapiens
agccctctgtggccaggagc

SEQ ID NO: 4243127 - DNA, 12 bp, Homo sapiens
agccctgtccct

SEQ ID NO: 4243128 - DNA, 21 bp, Homo sapiens
agccgcgctttcccctcctcc

SEQ ID NO: 4243129 - DNA, 16 bp, Homo sapiens
agccgtgtgtgcatgt

SEQ ID NO: 4243130 - DNA, 22 bp, Homo sapiens
agcctataagaggaatttcttt

SEQ ID NO: 4243131 - DNA, 13 bp, Homo sapiens
agcctccggaagc

SEQ ID NO: 4243132 - DNA, 23 bp, Homo sapiens
agcctccggagtagctgggacca

SEQ ID NO: 4243133 - DNA, 15 bp, Homo sapiens
agcctggagctttcc

SEQ ID NO: 4243134 - DNA, 22 bp, Homo sapiens
agcctgtccaatttctgctgta

SEQ ID NO: 4243135 - DNA, 15 bp, Homo sapiens
agccttgaactttga

SEQ ID NO: 4243136 - DNA, 16 bp, Homo sapiens
agcctttgcctccccg

SEQ ID NO: 4243137 - DNA, 19 bp, Homo sapiens
agccttttatctgcagaac

SEQ ID NO: 4243138 - DNA, 12 bp, Homo sapiens
agctaaatgctt

SEQ ID NO: 4243139 - DNA, 13 bp, Homo sapiens
agctaaatgcttc

SEQ ID NO: 4243140 - DNA, 13 bp, Homo sapiens
agctaatttttgt

SEQ ID NO: 4243141 - DNA, 17 bp, Homo sapiens
agctaatttttgtattt

SEQ ID NO: 4243142 - DNA, 18 bp, Homo sapiens
agctcccacacccacctc

SEQ ID NO: 4243143 - DNA, 23 bp, Homo sapiens
agctcccacacccacctctgcca

SEQ ID NO: 4243144 - DNA, 16 bp, Homo sapiens
agctcgatccaaattg

SEQ ID NO: 4243145 - DNA, 14 bp, Homo sapiens
agctggcgggtgtg

SEQ ID NO: 4243146 - DNA, 17 bp, Homo sapiens
agctgtttatgttttta

SEQ ID NO: 4243147 - DNA, 23 bp, Homo sapiens
agcttgtggaggagggagagccc

SEQ ID NO: 4243148 - DNA, 16 bp, Homo sapiens
agctttcctgatgatg

SEQ ID NO: 4243149 - DNA, 14 bp, Homo sapiens
aggaaaggagatca

SEQ ID NO: 4243150 - DNA, 21 bp, Homo sapiens
aggaacccccacaaccccctc

SEQ ID NO: 4243151 - DNA, 13 bp, Homo sapiens
aggaactgtacag

SEQ ID NO: 4243152 - DNA, 15 bp, Homo sapiens
aggaactgtacagaa

SEQ ID NO: 4243153 - DNA, 15 bp, Homo sapiens
aggaagaaggcagtg

SEQ ID NO: 4243154 - DNA, 21 bp, Homo sapiens
aggaatcattccagtgctaga

SEQ ID NO: 4243155 - DNA, 18 bp, Homo sapiens
aggaatttgatgattttc

SEQ ID NO: 4243156 - DNA, 19 bp, Homo sapiens
aggacctccggagcgccct

SEQ ID NO: 4243157 - DNA, 18 bp, Homo sapiens
aggagaagagttgaggaa

SEQ ID NO: 4243158 - DNA, 14 bp, Homo sapiens
aggagccctggccc

SEQ ID NO: 4243159 - DNA, 14 bp, Homo sapiens
aggagggagagccc

SEQ ID NO: 4243160 - DNA, 16 bp, Homo sapiens
aggatagtatttttat

SEQ ID NO: 4243161 - DNA, 15 bp, Homo sapiens
aggatgcttgtacat

SEQ ID NO: 4243162 - DNA, 23 bp, Homo sapiens
aggatgcttgtacataatgcgtg

SEQ ID NO: 4243163 - DNA, 23 bp, Homo sapiens
aggatggtgctgagtaaacataa

SEQ ID NO: 4243164 - DNA, 16 bp, Homo sapiens
aggcaaaaaactctta

SEQ ID NO: 4243165 - DNA, 22 bp, Homo sapiens
aggcacaaggttggttgctaag

SEQ ID NO: 4243166 - DNA, 13 bp, Homo sapiens
aggcagctctgag

SEQ ID NO: 4243167 - DNA, 18 bp, Homo sapiens
aggcatttgtttgaactg

SEQ ID NO: 4243168 - DNA, 19 bp, Homo sapiens
aggccagctgccccagcca

SEQ ID NO: 4243169 - DNA, 22 bp, Homo sapiens
aggccctcagtcttcctgccgg

SEQ ID NO: 4243170 - DNA, 14 bp, Homo sapiens
aggctccccagtgc

SEQ ID NO: 4243171 - DNA, 22 bp, Homo sapiens
aggctcctgaccccgccatgca

SEQ ID NO: 4243172 - DNA, 19 bp, Homo sapiens
aggctcttatgtgtgcctt

SEQ ID NO: 4243173 - DNA, 20 bp, Homo sapiens
aggctggagtggagtggcgt

SEQ ID NO: 4243174 - DNA, 17 bp, Homo sapiens
agggaaaggttttgtat

SEQ ID NO: 4243175 - DNA, 18 bp, Homo sapiens
agggaaaggttttgtatt

SEQ ID NO: 4243176 - DNA, 19 bp, Homo sapiens
agggaaaggttttgtattt

SEQ ID NO: 4243177 - DNA, 19 bp, Homo sapiens
agggacagagcccgggaga

SEQ ID NO: 4243178 - DNA, 23 bp, Homo sapiens
agggacagagcccgggagagact

SEQ ID NO: 4243179 - DNA, 14 bp, Homo sapiens
agggcaattggaac

SEQ ID NO: 4243180 - DNA, 17 bp, Homo sapiens
agggcaattggaacaaa

SEQ ID NO: 4243181 - DNA, 14 bp, Homo sapiens
agggcattctttcc

SEQ ID NO: 4243182 - DNA, 22 bp, Homo sapiens
agggccgaggaatgtgaagcca

SEQ ID NO: 4243183 - DNA, 16 bp, Homo sapiens
agggggacagcaggga

SEQ ID NO: 4243184 - DNA, 21 bp, Homo sapiens
agggttgaaaatgtgtttgct

SEQ ID NO: 4243185 - DNA, 19 bp, Homo sapiens
aggtaaaatgtatttttct

SEQ ID NO: 4243186 - DNA, 17 bp, Homo sapiens
aggtatattggaagagg

SEQ ID NO: 4243187 - DNA, 19 bp, Homo sapiens
aggtattacaagtaatgta

SEQ ID NO: 4243188 - DNA, 13 bp, Homo sapiens
aggtcaataacac

SEQ ID NO: 4243189 - DNA, 22 bp, Homo sapiens
aggtcattttttttaagaaaaa

SEQ ID NO: 4243190 - DNA, 16 bp, Homo sapiens
aggtctgttctttcca

SEQ ID NO: 4243191 - DNA, 18 bp, Homo sapiens
aggtgcccgcgccaggcc

SEQ ID NO: 4243192 - DNA, 18 bp, Homo sapiens
aggtgcgcacttacctgc

SEQ ID NO: 4243193 - DNA, 21 bp, Homo sapiens
aggtgcgtcccccgttgtgcc

SEQ ID NO: 4243194 - DNA, 23 bp, Homo sapiens
aggtgcgtcccccgttgtgcctg

SEQ ID NO: 4243195 - DNA, 12 bp, Homo sapiens
aggtggccgcca

SEQ ID NO: 4243196 - DNA, 22 bp, Homo sapiens
aggtgtattgtgtatgtagcct

SEQ ID NO: 4243197 - DNA, 15 bp, Homo sapiens
aggtgttgccagtgc

SEQ ID NO: 4243198 - DNA, 21 bp, Homo sapiens
aggttcatgccaccatggcca

SEQ ID NO: 4243199 - DNA, 12 bp, Homo sapiens
aggttttgtatt

SEQ ID NO: 4243200 - DNA, 16 bp, Homo sapiens
agtaaaatttatttca

SEQ ID NO: 4243201 - DNA, 20 bp, Homo sapiens
agtaaatgggggtgcatttg

SEQ ID NO: 4243202 - DNA, 14 bp, Homo sapiens
agtaagtaattatg

SEQ ID NO: 4243203 - DNA, 16 bp, Homo sapiens
agtaagttaataatgt

SEQ ID NO: 4243204 - DNA, 22 bp, Homo sapiens
agtaagttaataatgtattgta

SEQ ID NO: 4243205 - DNA, 17 bp, Homo sapiens
agtaatatgcacacatt

SEQ ID NO: 4243206 - DNA, 20 bp, Homo sapiens
agtaatatgcacacattttt

SEQ ID NO: 4243207 - DNA, 15 bp, Homo sapiens
agtaatgtaaagatg

SEQ ID NO: 4243208 - DNA, 18 bp, Homo sapiens
agtacaatgtgtttttct

SEQ ID NO: 4243209 - DNA, 14 bp, Homo sapiens
agtacactgtttca

SEQ ID NO: 4243210 - DNA, 17 bp, Homo sapiens
agtactgtttaccattt

SEQ ID NO: 4243211 - DNA, 21 bp, Homo sapiens
agtagttgtattcttctgtat

SEQ ID NO: 4243212 - DNA, 15 bp, Homo sapiens
agtatgaggcatttg

SEQ ID NO: 4243213 - DNA, 20 bp, Homo sapiens
agtatgaggcatttgtttga

SEQ ID NO: 4243214 - DNA, 17 bp, Homo sapiens
agtatgttttttatgtt

SEQ ID NO: 4243215 - DNA, 14 bp, Homo sapiens
agtattataccttt

SEQ ID NO: 4243216 - DNA, 15 bp, Homo sapiens
agtattatacctttt

SEQ ID NO: 4243217 - DNA, 19 bp, Homo sapiens
agtattttaagaagacata

SEQ ID NO: 4243218 - DNA, 19 bp, Homo sapiens
agtcacactgctagcaaat

SEQ ID NO: 4243219 - DNA, 16 bp, Homo sapiens
agtcctgcctcagcct

SEQ ID NO: 4243220 - DNA, 18 bp, Homo sapiens
agtctctggggcaggctg

SEQ ID NO: 4243221 - DNA, 13 bp, Homo sapiens
agtctgaatattt

SEQ ID NO: 4243222 - DNA, 16 bp, Homo sapiens
agtgaagacaatgact

SEQ ID NO: 4243223 - DNA, 13 bp, Homo sapiens
agtgactttgtat

SEQ ID NO: 4243224 - DNA, 14 bp, Homo sapiens
agtgactttgtata

SEQ ID NO: 4243225 - DNA, 12 bp, Homo sapiens
agtgatcttggc

SEQ ID NO: 4243226 - DNA, 23 bp, Homo sapiens
agtgattgagactcaaaaaaaca

SEQ ID NO: 4243227 - DNA, 17 bp, Homo sapiens
agtgcctgctgggtgcc

SEQ ID NO: 4243228 - DNA, 17 bp, Homo sapiens
agtgctaagctgccctg

SEQ ID NO: 4243229 - DNA, 21 bp, Homo sapiens
agtgctacctgcacctctgga

SEQ ID NO: 4243230 - DNA, 13 bp, Homo sapiens
agtgctagaaaat

SEQ ID NO: 4243231 - DNA, 13 bp, Homo sapiens
agtgctgcattta

SEQ ID NO: 4243232 - DNA, 16 bp, Homo sapiens
agtgctgcatttaaaa

SEQ ID NO: 4243233 - DNA, 22 bp, Homo sapiens
agtgctgcatttaaaagataca

SEQ ID NO: 4243234 - DNA, 20 bp, Homo sapiens
agtgctgtccatgcttctca

SEQ ID NO: 4243235 - DNA, 14 bp, Homo sapiens
agtggatgactgtt

SEQ ID NO: 4243236 - DNA, 14 bp, Homo sapiens
agtgggaagatttt

SEQ ID NO: 4243237 - DNA, 13 bp, Homo sapiens
agtgggctcctga

SEQ ID NO: 4243238 - DNA, 15 bp, Homo sapiens
agtgggctcctgaca

SEQ ID NO: 4243239 - DNA, 23 bp, Homo sapiens
agtggtactctgtgtctggcagg

SEQ ID NO: 4243240 - DNA, 18 bp, Homo sapiens
agtgtatttttttactaa

SEQ ID NO: 4243241 - DNA, 18 bp, Homo sapiens
agtgtctgacttttgtta

SEQ ID NO: 4243242 - DNA, 17 bp, Homo sapiens
agtgtggacttggcagg

SEQ ID NO: 4243243 - DNA, 16 bp, Homo sapiens
agtgttgtggatttaa

SEQ ID NO: 4243244 - DNA, 13 bp, Homo sapiens
agttactcagaat

SEQ ID NO: 4243245 - DNA, 15 bp, Homo sapiens
agttagatctttgta

SEQ ID NO: 4243246 - DNA, 18 bp, Homo sapiens
agttatgtatttaaagtt

SEQ ID NO: 4243247 - DNA, 20 bp, Homo sapiens
agttcctctttgccctgagg

SEQ ID NO: 4243248 - DNA, 16 bp, Homo sapiens
agttgaggaactgtac

SEQ ID NO: 4243249 - DNA, 16 bp, Homo sapiens
agttgatactacagtt

SEQ ID NO: 4243250 - DNA, 17 bp, Homo sapiens
agttgcagatgtattga

SEQ ID NO: 4243251 - DNA, 21 bp, Homo sapiens
agttgcagatgtattgactgt

SEQ ID NO: 4243252 - DNA, 22 bp, Homo sapiens
agttgcagatgtattgactgta

SEQ ID NO: 4243253 - DNA, 19 bp, Homo sapiens
agttgtcaagtctctgctg

SEQ ID NO: 4243254 - DNA, 14 bp, Homo sapiens
agttgtctctcttc

SEQ ID NO: 4243255 - DNA, 13 bp, Homo sapiens
agttgttacattt

SEQ ID NO: 4243256 - DNA, 21 bp, Homo sapiens
agtttatcttaagcatgtcaa

SEQ ID NO: 4243257 - DNA, 22 bp, Homo sapiens
agtttatcttaagcatgtcaat

SEQ ID NO: 4243258 - DNA, 16 bp, Homo sapiens
agtttggatatttttg

SEQ ID NO: 4243259 - DNA, 20 bp, Homo sapiens
agtttgtaggtaaaatgtat

SEQ ID NO: 4243260 - DNA, 21 bp, Homo sapiens
agtttgtaggtaaaatgtatt

SEQ ID NO: 4243261 - DNA, 22 bp, Homo sapiens
agtttgtaggtaaaatgtattt

SEQ ID NO: 4243262 - DNA, 16 bp, Homo sapiens
ataaaaactgatttgc

SEQ ID NO: 4243263 - DNA, 11 bp, Homo sapiens
ataaaactgaa

SEQ ID NO: 4243264 - DNA, 17 bp, Homo sapiens
ataaaactttgctgcca

SEQ ID NO: 4243265 - DNA, 11 bp, Homo sapiens
ataaaactttt

SEQ ID NO: 4243266 - DNA, 16 bp, Homo sapiens
ataaaataaataattt

SEQ ID NO: 4243267 - DNA, 15 bp, Homo sapiens
ataaacaagaccacg

SEQ ID NO: 4243268 - DNA, 23 bp, Homo sapiens
ataaacaagaccacgtttctaaa

SEQ ID NO: 4243269 - DNA, 17 bp, Homo sapiens
ataaacagacaaaaaca

SEQ ID NO: 4243270 - DNA, 17 bp, Homo sapiens
ataaactgaatattttg

SEQ ID NO: 4243271 - DNA, 15 bp, Homo sapiens
ataaactttaccttt

SEQ ID NO: 4243272 - DNA, 16 bp, Homo sapiens
ataaactttacctttt

SEQ ID NO: 4243273 - DNA, 24 bp, Homo sapiens
ataaactttaccttttttatacat

SEQ ID NO: 4243274 - DNA, 16 bp, Homo sapiens
ataaagggttgaaaat

SEQ ID NO: 4243275 - DNA, 16 bp, Homo sapiens
ataaataaaactgaat

SEQ ID NO: 4243276 - DNA, 12 bp, Homo sapiens
ataaataatttt

SEQ ID NO: 4243277 - DNA, 15 bp, Homo sapiens
ataaataattttaat

SEQ ID NO: 4243278 - DNA, 14 bp, Homo sapiens
ataaatatatataa

SEQ ID NO: 4243279 - DNA, 17 bp, Homo sapiens
ataaatgcataatttat

SEQ ID NO: 4243280 - DNA, 13 bp, Homo sapiens
ataaatgggtgta

SEQ ID NO: 4243281 - DNA, 23 bp, Homo sapiens
ataaatgggtgtatataatttta

SEQ ID NO: 4243282 - DNA, 14 bp, Homo sapiens
ataacactgtattt

SEQ ID NO: 4243283 - DNA, 22 bp, Homo sapiens
ataacactgtattttaatgtac

SEQ ID NO: 4243284 - DNA, 20 bp, Homo sapiens
ataaccagtgttgtggattt

SEQ ID NO: 4243285 - DNA, 15 bp, Homo sapiens
ataagacaaaaataa

SEQ ID NO: 4243286 - DNA, 14 bp, Homo sapiens
ataagacatttgtt

SEQ ID NO: 4243287 - DNA, 16 bp, Homo sapiens
ataagaggaatttctt

SEQ ID NO: 4243288 - DNA, 19 bp, Homo sapiens
ataataggtagtttggata

SEQ ID NO: 4243289 - DNA, 16 bp, Homo sapiens
ataatattgtttttct

SEQ ID NO: 4243290 - DNA, 13 bp, Homo sapiens
ataatgtttaaat

SEQ ID NO: 4243291 - DNA, 22 bp, Homo sapiens
ataatgtttaaatcatgtatgt

SEQ ID NO: 4243292 - DNA, 19 bp, Homo sapiens
ataattctacatgttgtct

SEQ ID NO: 4243293 - DNA, 18 bp, Homo sapiens
atacaaagcgtgcacaag

SEQ ID NO: 4243294 - DNA, 13 bp, Homo sapiens
atacaagtaattt

SEQ ID NO: 4243295 - DNA, 16 bp, Homo sapiens
atacaatcctgtttat

SEQ ID NO: 4243296 - DNA, 19 bp, Homo sapiens
atacaatcctgtttataat

SEQ ID NO: 4243297 - DNA, 15 bp, Homo sapiens
atacaccactacatt

SEQ ID NO: 4243298 - DNA, 20 bp, Homo sapiens
atacaccactacattctgtt

SEQ ID NO: 4243299 - DNA, 14 bp, Homo sapiens
atacagctcagtaa

SEQ ID NO: 4243300 - DNA, 18 bp, Homo sapiens
ataccacttttgttcttg

SEQ ID NO: 4243301 - DNA, 19 bp, Homo sapiens
ataccagccagtaaatggg

SEQ ID NO: 4243302 - DNA, 14 bp, Homo sapiens
ataccttttttaga

SEQ ID NO: 4243303 - DNA, 13 bp, Homo sapiens
atacgtacacatt

SEQ ID NO: 4243304 - DNA, 14 bp, Homo sapiens
atacgtacacattt

SEQ ID NO: 4243305 - DNA, 13 bp, Homo sapiens
atactaaccagca

SEQ ID NO: 4243306 - DNA, 18 bp, Homo sapiens
atactgtgcagaataatg

SEQ ID NO: 4243307 - DNA, 19 bp, Homo sapiens
atactgtgcagaataatgg

SEQ ID NO: 4243308 - DNA, 18 bp, Homo sapiens
atacttcaaaaataatgt

SEQ ID NO: 4243309 - DNA, 19 bp, Homo sapiens
atacttcaaaaataatgtg

SEQ ID NO: 4243310 - DNA, 19 bp, Homo sapiens
atacttttcccctgttaaa

SEQ ID NO: 4243311 - DNA, 20 bp, Homo sapiens
atacttttcccctgttaaac

SEQ ID NO: 4243312 - DNA, 13 bp, Homo sapiens
atagaattgcagt

SEQ ID NO: 4243313 - DNA, 16 bp, Homo sapiens
atagacaatttattat

SEQ ID NO: 4243314 - DNA, 22 bp, Homo sapiens
atagacaatttattatggcaca

SEQ ID NO: 4243315 - DNA, 18 bp, Homo sapiens
atagagcttttaaaaatg

SEQ ID NO: 4243316 - DNA, 19 bp, Homo sapiens
ataggaagcgtctggcaga

SEQ ID NO: 4243317 - DNA, 19 bp, Homo sapiens
atagggaaaggttttgtat

SEQ ID NO: 4243318 - DNA, 20 bp, Homo sapiens
ataggtagtttggatatttt

SEQ ID NO: 4243319 - DNA, 19 bp, Homo sapiens
atagtaagacccccatctc

SEQ ID NO: 4243320 - DNA, 23 bp, Homo sapiens
atagttagatctttgtaaatgca

SEQ ID NO: 4243321 - DNA, 14 bp, Homo sapiens
atataaagaatata

SEQ ID NO: 4243322 - DNA, 16 bp, Homo sapiens
atataagacatttgtt

SEQ ID NO: 4243323 - DNA, 14 bp, Homo sapiens
atataatgtatttt

SEQ ID NO: 4243324 - DNA, 11 bp, Homo sapiens
atataatttta

SEQ ID NO: 4243325 - DNA, 12 bp, Homo sapiens
atataattttat

SEQ ID NO: 4243326 - DNA, 13 bp, Homo sapiens
atataattttatg

SEQ ID NO: 4243327 - DNA, 21 bp, Homo sapiens
atatactttgtggaccaatta

SEQ ID NO: 4243328 - DNA, 19 bp, Homo sapiens
atatataaagaatatatat

SEQ ID NO: 4243329 - DNA, 18 bp, Homo sapiens
atatataaagtatagaga

SEQ ID NO: 4243330 - DNA, 14 bp, Homo sapiens
atatatagtcaaat

SEQ ID NO: 4243331 - DNA, 12 bp, Homo sapiens
atatatataaag

SEQ ID NO: 4243332 - DNA, 13 bp, Homo sapiens
atatatataaagt

SEQ ID NO: 4243333 - DNA, 15 bp, Homo sapiens
atatatatatataaa

SEQ ID NO: 4243334 - DNA, 19 bp, Homo sapiens
atatatggtcatatacata

SEQ ID NO: 4243335 - DNA, 17 bp, Homo sapiens
atatattataaatatat

SEQ ID NO: 4243336 - DNA, 17 bp, Homo sapiens
atatattcttataaaaa

SEQ ID NO: 4243337 - DNA, 17 bp, Homo sapiens
atatatttcacttttgt

SEQ ID NO: 4243338 - DNA, 22 bp, Homo sapiens
atatatttcacttttgttctgc

SEQ ID NO: 4243339 - DNA, 20 bp, Homo sapiens
atatcagctttgataattgt

SEQ ID NO: 4243340 - DNA, 15 bp, Homo sapiens
atatcattctacaga

SEQ ID NO: 4243341 - DNA, 23 bp, Homo sapiens
atatccattctgtagacttttga

SEQ ID NO: 4243342 - DNA, 14 bp, Homo sapiens
atatcttttggtta

SEQ ID NO: 4243343 - DNA, 14 bp, Homo sapiens
atatgcacacattt

SEQ ID NO: 4243344 - DNA, 15 bp, Homo sapiens
atatgcacacatttt

SEQ ID NO: 4243345 - DNA, 19 bp, Homo sapiens
atatggtcatatacatatt

SEQ ID NO: 4243346 - DNA, 14 bp, Homo sapiens
atatggtgtatttt

SEQ ID NO: 4243347 - DNA, 10 bp, Homo sapiens
atatgtatgc

SEQ ID NO: 4243348 - DNA, 14 bp, Homo sapiens
atatgtatgctttt

SEQ ID NO: 4243349 - DNA, 19 bp, Homo sapiens
atattaaaacaataatgca

SEQ ID NO: 4243350 - DNA, 15 bp, Homo sapiens
atattacaacattta

SEQ ID NO: 4243351 - DNA, 19 bp, Homo sapiens
atattaccacagacatact

SEQ ID NO: 4243352 - DNA, 21 bp, Homo sapiens
atattactacttaccatttgc

SEQ ID NO: 4243353 - DNA, 15 bp, Homo sapiens
atattcccattttat

SEQ ID NO: 4243354 - DNA, 16 bp, Homo sapiens
atattcttttgtttcc

SEQ ID NO: 4243355 - DNA, 22 bp, Homo sapiens
atattgatttccgttaaaatac

SEQ ID NO: 4243356 - DNA, 15 bp, Homo sapiens
atatttaatatcaaa

SEQ ID NO: 4243357 - DNA, 15 bp, Homo sapiens
atatttcacttttgt

SEQ ID NO: 4243358 - DNA, 14 bp, Homo sapiens
atattttgataata

SEQ ID NO: 4243359 - DNA, 17 bp, Homo sapiens
atattttggaaactgct

SEQ ID NO: 4243360 - DNA, 10 bp, Homo sapiens
atatttttgt

SEQ ID NO: 4243361 - DNA, 12 bp, Homo sapiens
atatttttgtac

SEQ ID NO: 4243362 - DNA, 13 bp, Homo sapiens
atatttttgtact

SEQ ID NO: 4243363 - DNA, 19 bp, Homo sapiens
atcaaaagaaaattgatat

SEQ ID NO: 4243364 - DNA, 22 bp, Homo sapiens
atcaaaagaaaattgatatttt

SEQ ID NO: 4243365 - DNA, 18 bp, Homo sapiens
atcaatttgtttgtgttc

SEQ ID NO: 4243366 - DNA, 14 bp, Homo sapiens
atcacaaatggaat

SEQ ID NO: 4243367 - DNA, 20 bp, Homo sapiens
atcacagcccaaaatttgat

SEQ ID NO: 4243368 - DNA, 21 bp, Homo sapiens
atcactgcattcattctgagc

SEQ ID NO: 4243369 - DNA, 19 bp, Homo sapiens
atcagcacgatttctgttt

SEQ ID NO: 4243370 - DNA, 23 bp, Homo sapiens
atcagcacgatttctgtttagat

SEQ ID NO: 4243371 - DNA, 15 bp, Homo sapiens
atcagccacattcta

SEQ ID NO: 4243372 - DNA, 15 bp, Homo sapiens
atcagtgataattgg

SEQ ID NO: 4243373 - DNA, 20 bp, Homo sapiens
atcagtgataattggtttga

SEQ ID NO: 4243374 - DNA, 11 bp, Homo sapiens
atcattccagt

SEQ ID NO: 4243375 - DNA, 15 bp, Homo sapiens
atcattctacagaat

SEQ ID NO: 4243376 - DNA, 19 bp, Homo sapiens
atccaaaatattttttgca

SEQ ID NO: 4243377 - DNA, 20 bp, Homo sapiens
atccaaacatgtatttatgt

SEQ ID NO: 4243378 - DNA, 21 bp, Homo sapiens
atccacctgtctcagcctccc

SEQ ID NO: 4243379 - DNA, 17 bp, Homo sapiens
atccacttcaggagccc

SEQ ID NO: 4243380 - DNA, 16 bp, Homo sapiens
atccagtattgctgat

SEQ ID NO: 4243381 - DNA, 22 bp, Homo sapiens
atccagtattgctgattttaaa

SEQ ID NO: 4243382 - DNA, 16 bp, Homo sapiens
atccatttatttcatt

SEQ ID NO: 4243383 - DNA, 15 bp, Homo sapiens
atccgccctgcagca

SEQ ID NO: 4243384 - DNA, 16 bp, Homo sapiens
atcctctcctttgaaa

SEQ ID NO: 4243385 - DNA, 14 bp, Homo sapiens
atcctgtttataat

SEQ ID NO: 4243386 - DNA, 14 bp, Homo sapiens
atcgatatgtatat

SEQ ID NO: 4243387 - DNA, 20 bp, Homo sapiens
atcgatttagtaagtatgtt

SEQ ID NO: 4243388 - DNA, 21 bp, Homo sapiens
atcgctcgtgtgttctatcca

SEQ ID NO: 4243389 - DNA, 19 bp, Homo sapiens
atctaaacagttatttctg

SEQ ID NO: 4243390 - DNA, 17 bp, Homo sapiens
atctaaatggaaccact

SEQ ID NO: 4243391 - DNA, 18 bp, Homo sapiens
atctaaatggaaccactc

SEQ ID NO: 4243392 - DNA, 20 bp, Homo sapiens
atctagtttccctggtgccc

SEQ ID NO: 4243393 - DNA, 14 bp, Homo sapiens
atctcaaatttcta

SEQ ID NO: 4243394 - DNA, 22 bp, Homo sapiens
atctcaatcttggtttgtcagt

SEQ ID NO: 4243395 - DNA, 14 bp, Homo sapiens
atctccaaaataaa

SEQ ID NO: 4243396 - DNA, 11 bp, Homo sapiens
atctctccctc

SEQ ID NO: 4243397 - DNA, 16 bp, Homo sapiens
atctctgttgcacctg

SEQ ID NO: 4243398 - DNA, 17 bp, Homo sapiens
atctctgttgcacctga

SEQ ID NO: 4243399 - DNA, 18 bp, Homo sapiens
atctgacccactttgtaa

SEQ ID NO: 4243400 - DNA, 11 bp, Homo sapiens
atctgcagaac

SEQ ID NO: 4243401 - DNA, 19 bp, Homo sapiens
atctgcattttcaccccac

SEQ ID NO: 4243402 - DNA, 22 bp, Homo sapiens
atctgccgctttgtctgtccag

SEQ ID NO: 4243403 - DNA, 18 bp, Homo sapiens
atctggcacgtggccagg

SEQ ID NO: 4243404 - DNA, 20 bp, Homo sapiens
atctggcacgtggccaggag

SEQ ID NO: 4243405 - DNA, 21 bp, Homo sapiens
atctgtgaaatgctggcattt

SEQ ID NO: 4243406 - DNA, 21 bp, Homo sapiens
atcttaagcatgtcaattcat

SEQ ID NO: 4243407 - DNA, 18 bp, Homo sapiens
atcttggggcaagactgc

SEQ ID NO: 4243408 - DNA, 21 bp, Homo sapiens
atctttaagaatgcttaaaaa

SEQ ID NO: 4243409 - DNA, 14 bp, Homo sapiens
atcttttatttaag

SEQ ID NO: 4243410 - DNA, 22 bp, Homo sapiens
atgaaggaatcattccagtgct

SEQ ID NO: 4243411 - DNA, 16 bp, Homo sapiens
atgaagtatacttttc

SEQ ID NO: 4243412 - DNA, 21 bp, Homo sapiens
atgaataaactgaatattttg

SEQ ID NO: 4243413 - DNA, 23 bp, Homo sapiens
atgaataaactgaatattttgga

SEQ ID NO: 4243414 - DNA, 22 bp, Homo sapiens
atgaatattttgataataatat

SEQ ID NO: 4243415 - DNA, 16 bp, Homo sapiens
atgaattgaaaaacaa

SEQ ID NO: 4243416 - DNA, 13 bp, Homo sapiens
atgacaagcattt

SEQ ID NO: 4243417 - DNA, 22 bp, Homo sapiens
atgacacatgcaaggtcatttt

SEQ ID NO: 4243418 - DNA, 22 bp, Homo sapiens
atgacaggcctgaagatattac

SEQ ID NO: 4243419 - DNA, 24 bp, Homo sapiens
atgacaggcctgaagatattacta

SEQ ID NO: 4243420 - DNA, 21 bp, Homo sapiens
atgacattaaatgcaataatt

SEQ ID NO: 4243421 - DNA, 11 bp, Homo sapiens
atgactgttga

SEQ ID NO: 4243422 - DNA, 14 bp, Homo sapiens
atgacttactgtac

SEQ ID NO: 4243423 - DNA, 12 bp, Homo sapiens
atgaggagacag

SEQ ID NO: 4243424 - DNA, 17 bp, Homo sapiens
atgataaaataaataat

SEQ ID NO: 4243425 - DNA, 19 bp, Homo sapiens
atgataaaataaataattt

SEQ ID NO: 4243426 - DNA, 15 bp, Homo sapiens
atgatattgtttaaa

SEQ ID NO: 4243427 - DNA, 19 bp, Homo sapiens
atgatattgtttaaaattc

SEQ ID NO: 4243428 - DNA, 16 bp, Homo sapiens
atgatgccctgctcca

SEQ ID NO: 4243429 - DNA, 15 bp, Homo sapiens
atgatttaagtatac

SEQ ID NO: 4243430 - DNA, 15 bp, Homo sapiens
atgatttccttcaat

SEQ ID NO: 4243431 - DNA, 18 bp, Homo sapiens
atgattttcatttcatga

SEQ ID NO: 4243432 - DNA, 22 bp, Homo sapiens
atgattttcatttcatgaaaat

SEQ ID NO: 4243433 - DNA, 16 bp, Homo sapiens
atgcaaagtacaatgt

SEQ ID NO: 4243434 - DNA, 18 bp, Homo sapiens
atgcaaagtacaatgtgt

SEQ ID NO: 4243435 - DNA, 19 bp, Homo sapiens
atgcaaagtacaatgtgtt

SEQ ID NO: 4243436 - DNA, 16 bp, Homo sapiens
atgcaaggtcattttt

SEQ ID NO: 4243437 - DNA, 15 bp, Homo sapiens
atgcaattagaattt

SEQ ID NO: 4243438 - DNA, 17 bp, Homo sapiens
atgcacacattttttaa

SEQ ID NO: 4243439 - DNA, 21 bp, Homo sapiens
atgcacagagttgttacattt

SEQ ID NO: 4243440 - DNA, 22 bp, Homo sapiens
atgcacagagttgttacatttt

SEQ ID NO: 4243441 - DNA, 15 bp, Homo sapiens
atgcataatttatgg

SEQ ID NO: 4243442 - DNA, 14 bp, Homo sapiens
atgcccaatatatt

SEQ ID NO: 4243443 - DNA, 19 bp, Homo sapiens
atgcctgttttgagaccag

SEQ ID NO: 4243444 - DNA, 17 bp, Homo sapiens
atgctacacactgcatg

SEQ ID NO: 4243445 - DNA, 18 bp, Homo sapiens
atgctacacactgcatgt

SEQ ID NO: 4243446 - DNA, 18 bp, Homo sapiens
atgctggccgctcctccc

SEQ ID NO: 4243447 - DNA, 22 bp, Homo sapiens
atgctgtgccctaaagtgtatt

SEQ ID NO: 4243448 - DNA, 19 bp, Homo sapiens
atgctgtgggggactggct

SEQ ID NO: 4243449 - DNA, 15 bp, Homo sapiens
atgcttaaactaaat

SEQ ID NO: 4243450 - DNA, 16 bp, Homo sapiens
atgcttctcatcttgt

SEQ ID NO: 4243451 - DNA, 14 bp, Homo sapiens
atggaacttagact

SEQ ID NO: 4243452 - DNA, 14 bp, Homo sapiens
atggaatatatcag

SEQ ID NO: 4243453 - DNA, 15 bp, Homo sapiens
atggacgctgccggg

SEQ ID NO: 4243454 - DNA, 22 bp, Homo sapiens
atggatgcaaagtacaatgtgt

SEQ ID NO: 4243455 - DNA, 17 bp, Homo sapiens
atggcatggagactctg

SEQ ID NO: 4243456 - DNA, 20 bp, Homo sapiens
atggcatggagactctgaga

SEQ ID NO: 4243457 - DNA, 17 bp, Homo sapiens
atggcttttgtgcatta

SEQ ID NO: 4243458 - DNA, 14 bp, Homo sapiens
atgggaaatgagcc

SEQ ID NO: 4243459 - DNA, 16 bp, Homo sapiens
atgggaaatgagccag

SEQ ID NO: 4243460 - DNA, 14 bp, Homo sapiens
atgggggtgcattt

SEQ ID NO: 4243461 - DNA, 17 bp, Homo sapiens
atggtggctcatgcctg

SEQ ID NO: 4243462 - DNA, 11 bp, Homo sapiens
atgtaaaaaag

SEQ ID NO: 4243463 - DNA, 15 bp, Homo sapiens
atgtaaaatgaattg

SEQ ID NO: 4243464 - DNA, 12 bp, Homo sapiens
atgtaaagttat

SEQ ID NO: 4243465 - DNA, 15 bp, Homo sapiens
atgtaaagttatgta

SEQ ID NO: 4243466 - DNA, 23 bp, Homo sapiens
atgtaaagttatgtatttaaagt

SEQ ID NO: 4243467 - DNA, 14 bp, Homo sapiens
atgtaagaacacat

SEQ ID NO: 4243468 - DNA, 17 bp, Homo sapiens
atgtaagaacacatttt

SEQ ID NO: 4243469 - DNA, 15 bp, Homo sapiens
atgtaatataatgta

SEQ ID NO: 4243470 - DNA, 13 bp, Homo sapiens
atgtagaaactta

SEQ ID NO: 4243471 - DNA, 16 bp, Homo sapiens
atgtagccagctgtgc

SEQ ID NO: 4243472 - DNA, 22 bp, Homo sapiens
atgtataatgtgcagaaaatat

SEQ ID NO: 4243473 - DNA, 21 bp, Homo sapiens
atgtatatcattctacagaat

SEQ ID NO: 4243474 - DNA, 23 bp, Homo sapiens
atgtatatcattctacagaataa

SEQ ID NO: 4243475 - DNA, 23 bp, Homo sapiens
atgtatgaaggaatcattccagt

SEQ ID NO: 4243476 - DNA, 15 bp, Homo sapiens
atgtatgctttttac

SEQ ID NO: 4243477 - DNA, 21 bp, Homo sapiens
atgtattttctttttattttg

SEQ ID NO: 4243478 - DNA, 17 bp, Homo sapiens
atgtctcactgttctgc

SEQ ID NO: 4243479 - DNA, 19 bp, Homo sapiens
atgtgactttttttggtat

SEQ ID NO: 4243480 - DNA, 21 bp, Homo sapiens
atgtgactttttttggtataa

SEQ ID NO: 4243481 - DNA, 19 bp, Homo sapiens
atgtgggtgaagtgcctgc

SEQ ID NO: 4243482 - DNA, 16 bp, Homo sapiens
atgtgtttgctgcctt

SEQ ID NO: 4243483 - DNA, 15 bp, Homo sapiens
atgtgtttttctcca

SEQ ID NO: 4243484 - DNA, 14 bp, Homo sapiens
atgttaaatactgt

SEQ ID NO: 4243485 - DNA, 19 bp, Homo sapiens
atgttaaatactgtgcaga

SEQ ID NO: 4243486 - DNA, 21 bp, Homo sapiens
atgttaaatactgtgcagaat

SEQ ID NO: 4243487 - DNA, 22 bp, Homo sapiens
atgttaaatactgtgcagaata

SEQ ID NO: 4243488 - DNA, 23 bp, Homo sapiens
atgttaaatactgtgcagaataa

SEQ ID NO: 4243489 - DNA, 15 bp, Homo sapiens
atgttacatctgtct

SEQ ID NO: 4243490 - DNA, 17 bp, Homo sapiens
atgttatcggattactg

SEQ ID NO: 4243491 - DNA, 19 bp, Homo sapiens
atgttatcggattactgaa

SEQ ID NO: 4243492 - DNA, 18 bp, Homo sapiens
atgttatgatattgttta

SEQ ID NO: 4243493 - DNA, 23 bp, Homo sapiens
atgttccttttttgtatattaca

SEQ ID NO: 4243494 - DNA, 14 bp, Homo sapiens
atgttcttaattct

SEQ ID NO: 4243495 - DNA, 15 bp, Homo sapiens
atgtttaaatcatgt

SEQ ID NO: 4243496 - DNA, 11 bp, Homo sapiens
atgtttttaaa

SEQ ID NO: 4243497 - DNA, 16 bp, Homo sapiens
atgtttttatttttgt

SEQ ID NO: 4243498 - DNA, 23 bp, Homo sapiens
attaaaaatctcaaatttctaaa

SEQ ID NO: 4243499 - DNA, 15 bp, Homo sapiens
attaaaacaataatg

SEQ ID NO: 4243500 - DNA, 16 bp, Homo sapiens
attaaaaggatagtat

SEQ ID NO: 4243501 - DNA, 19 bp, Homo sapiens
attaaatgaatattttgat

SEQ ID NO: 4243502 - DNA, 19 bp, Homo sapiens
attaacttttataaacttt

SEQ ID NO: 4243503 - DNA, 23 bp, Homo sapiens
attaacttttataaactttacct

SEQ ID NO: 4243504 - DNA, 11 bp, Homo sapiens
attaagatttc

SEQ ID NO: 4243505 - DNA, 12 bp, Homo sapiens
attacaacattt

SEQ ID NO: 4243506 - DNA, 15 bp, Homo sapiens
attacaacatttatg

SEQ ID NO: 4243507 - DNA, 16 bp, Homo sapiens
attaccagacaaaaaa

SEQ ID NO: 4243508 - DNA, 19 bp, Homo sapiens
attactcctatttttgtaa

SEQ ID NO: 4243509 - DNA, 21 bp, Homo sapiens
attactcctatttttgtaaac

SEQ ID NO: 4243510 - DNA, 18 bp, Homo sapiens
attagggcaattggaaca

SEQ ID NO: 4243511 - DNA, 16 bp, Homo sapiens
attaggtgtgactgaa

SEQ ID NO: 4243512 - DNA, 18 bp, Homo sapiens
attaggtgtgactgaatt

SEQ ID NO: 4243513 - DNA, 21 bp, Homo sapiens
attaggtgtgactgaatttct

SEQ ID NO: 4243514 - DNA, 17 bp, Homo sapiens
attataaatatatataa

SEQ ID NO: 4243515 - DNA, 19 bp, Homo sapiens
attataaatatatataaag

SEQ ID NO: 4243516 - DNA, 20 bp, Homo sapiens
attataaatatatataaaga

SEQ ID NO: 4243517 - DNA, 20 bp, Homo sapiens
attataacaactatttactt

SEQ ID NO: 4243518 - DNA, 18 bp, Homo sapiens
attatctagatactgtat

SEQ ID NO: 4243519 - DNA, 16 bp, Homo sapiens
attatgcactaaatat

SEQ ID NO: 4243520 - DNA, 18 bp, Homo sapiens
attatgcactaaatatga

SEQ ID NO: 4243521 - DNA, 13 bp, Homo sapiens
attattgatatat

SEQ ID NO: 4243522 - DNA, 15 bp, Homo sapiens
attattgcttattgc

SEQ ID NO: 4243523 - DNA, 15 bp, Homo sapiens
attattttaaaatat

SEQ ID NO: 4243524 - DNA, 22 bp, Homo sapiens
attcagattgtcttgcaacttc

SEQ ID NO: 4243525 - DNA, 13 bp, Homo sapiens
attcagtaatgca

SEQ ID NO: 4243526 - DNA, 19 bp, Homo sapiens
attcagtttttgtatcttg

SEQ ID NO: 4243527 - DNA, 20 bp, Homo sapiens
attcagtttttgtatcttgg

SEQ ID NO: 4243528 - DNA, 15 bp, Homo sapiens
attccaatatttctg

SEQ ID NO: 4243529 - DNA, 15 bp, Homo sapiens
attctacagaataat

SEQ ID NO: 4243530 - DNA, 20 bp, Homo sapiens
attctacagaataatccagt

SEQ ID NO: 4243531 - DNA, 20 bp, Homo sapiens
attctatgttaaatactgtg

SEQ ID NO: 4243532 - DNA, 21 bp, Homo sapiens
attctatgttaaatactgtgc

SEQ ID NO: 4243533 - DNA, 24 bp, Homo sapiens
attctatgttaaatactgtgcaga

SEQ ID NO: 4243534 - DNA, 16 bp, Homo sapiens
attctccttgtgttac

SEQ ID NO: 4243535 - DNA, 21 bp, Homo sapiens
attctccttgtgttactaagt

SEQ ID NO: 4243536 - DNA, 16 bp, Homo sapiens
attctccttttatgtg

SEQ ID NO: 4243537 - DNA, 18 bp, Homo sapiens
attctccttttatgtgta

SEQ ID NO: 4243538 - DNA, 21 bp, Homo sapiens
attctctcctgtacctcttga

SEQ ID NO: 4243539 - DNA, 23 bp, Homo sapiens
attctgaccgttaaaaaattctt

SEQ ID NO: 4243540 - DNA, 22 bp, Homo sapiens
attctgagcccccttcctgtcc

SEQ ID NO: 4243541 - DNA, 19 bp, Homo sapiens
attctggattcacagacca

SEQ ID NO: 4243542 - DNA, 15 bp, Homo sapiens
attcttctgtatttc

SEQ ID NO: 4243543 - DNA, 14 bp, Homo sapiens
attcttgcaaagta

SEQ ID NO: 4243544 - DNA, 16 bp, Homo sapiens
attcttgcaaagtatc

SEQ ID NO: 4243545 - DNA, 14 bp, Homo sapiens
attcttttgtttcc

SEQ ID NO: 4243546 - DNA, 17 bp, Homo sapiens
attcttttgtttccatg

SEQ ID NO: 4243547 - DNA, 16 bp, Homo sapiens
attgaaaaacaatttt

SEQ ID NO: 4243548 - DNA, 14 bp, Homo sapiens
attgaaagcttcaa

SEQ ID NO: 4243549 - DNA, 20 bp, Homo sapiens
attgaaagcttcaaagttta

SEQ ID NO: 4243550 - DNA, 16 bp, Homo sapiens
attgagaaccaaagca

SEQ ID NO: 4243551 - DNA, 16 bp, Homo sapiens
attgagtttgtaggta

SEQ ID NO: 4243552 - DNA, 20 bp, Homo sapiens
attgagtttgtaggtaaaat

SEQ ID NO: 4243553 - DNA, 21 bp, Homo sapiens
attgatttccgttaaaatacc

SEQ ID NO: 4243554 - DNA, 12 bp, Homo sapiens
attggaaatgga

SEQ ID NO: 4243555 - DNA, 20 bp, Homo sapiens
attgtatatatattcatata

SEQ ID NO: 4243556 - DNA, 16 bp, Homo sapiens
attgtgtggagaactc

SEQ ID NO: 4243557 - DNA, 22 bp, Homo sapiens
attgttagcaaatgacagattt

SEQ ID NO: 4243558 - DNA, 13 bp, Homo sapiens
attgtttaaaatt

SEQ ID NO: 4243559 - DNA, 15 bp, Homo sapiens
attgttttgaatatt

SEQ ID NO: 4243560 - DNA, 11 bp, Homo sapiens
attgtttttct

SEQ ID NO: 4243561 - DNA, 13 bp, Homo sapiens
atttaaaagatac

SEQ ID NO: 4243562 - DNA, 17 bp, Homo sapiens
atttaaagttgtatctt

SEQ ID NO: 4243563 - DNA, 23 bp, Homo sapiens
atttaaagttgtatcttgacaca

SEQ ID NO: 4243564 - DNA, 16 bp, Homo sapiens
atttaaatatctgtta

SEQ ID NO: 4243565 - DNA, 22 bp, Homo sapiens
atttaagtagaaaagttgcaga

SEQ ID NO: 4243566 - DNA, 12 bp, Homo sapiens
atttaatatcaa

SEQ ID NO: 4243567 - DNA, 15 bp, Homo sapiens
atttaatggcagcta

SEQ ID NO: 4243568 - DNA, 16 bp, Homo sapiens
atttacaaaagattta

SEQ ID NO: 4243569 - DNA, 22 bp, Homo sapiens
atttacaactgggggagggtga

SEQ ID NO: 4243570 - DNA, 14 bp, Homo sapiens
atttacaagatatt

SEQ ID NO: 4243571 - DNA, 18 bp, Homo sapiens
atttacaagatattatta

SEQ ID NO: 4243572 - DNA, 21 bp, Homo sapiens
atttagaaaatagagctttta

SEQ ID NO: 4243573 - DNA, 22 bp, Homo sapiens
atttagaaaatagagcttttaa

SEQ ID NO: 4243574 - DNA, 18 bp, Homo sapiens
atttatgtaatgaagtaa

SEQ ID NO: 4243575 - DNA, 15 bp, Homo sapiens
atttatgttgggtca

SEQ ID NO: 4243576 - DNA, 16 bp, Homo sapiens
atttattatggcacat

SEQ ID NO: 4243577 - DNA, 23 bp, Homo sapiens
atttattcaacaaatgtgggtga

SEQ ID NO: 4243578 - DNA, 15 bp, Homo sapiens
atttcacttttgttc

SEQ ID NO: 4243579 - DNA, 13 bp, Homo sapiens
atttcatttaaat

SEQ ID NO: 4243580 - DNA, 14 bp, Homo sapiens
atttcatttaaata

SEQ ID NO: 4243581 - DNA, 12 bp, Homo sapiens
atttctaaatct

SEQ ID NO: 4243582 - DNA, 13 bp, Homo sapiens
atttctaaatctc

SEQ ID NO: 4243583 - DNA, 16 bp, Homo sapiens
atttctggtgtatatt

SEQ ID NO: 4243584 - DNA, 13 bp, Homo sapiens
atttcttttcctt

SEQ ID NO: 4243585 - DNA, 22 bp, Homo sapiens
atttcttttccttcattcatag

SEQ ID NO: 4243586 - DNA, 24 bp, Homo sapiens
atttcttttccttcattcataggg

SEQ ID NO: 4243587 - DNA, 23 bp, Homo sapiens
atttcttttgccgttattaaaaa

SEQ ID NO: 4243588 - DNA, 15 bp, Homo sapiens
atttctttttatagg

SEQ ID NO: 4243589 - DNA, 15 bp, Homo sapiens
atttgaaaattttga

SEQ ID NO: 4243590 - DNA, 16 bp, Homo sapiens
atttgaaaattttgat

SEQ ID NO: 4243591 - DNA, 24 bp, Homo sapiens
atttgaagtaacttatttgactat

SEQ ID NO: 4243592 - DNA, 20 bp, Homo sapiens
atttgactatgaatgttatc

SEQ ID NO: 4243593 - DNA, 19 bp, Homo sapiens
atttgatgatgttaaatgt

SEQ ID NO: 4243594 - DNA, 14 bp, Homo sapiens
atttgctaatgtat

SEQ ID NO: 4243595 - DNA, 16 bp, Homo sapiens
atttgctactgtacat

SEQ ID NO: 4243596 - DNA, 20 bp, Homo sapiens
atttgggagaagcaaatata

SEQ ID NO: 4243597 - DNA, 17 bp, Homo sapiens
atttggtgctctgctaa

SEQ ID NO: 4243598 - DNA, 14 bp, Homo sapiens
atttgtgatacaat

SEQ ID NO: 4243599 - DNA, 14 bp, Homo sapiens
atttgtgcttttta

SEQ ID NO: 4243600 - DNA, 21 bp, Homo sapiens
atttgtgctttttaagaatat

SEQ ID NO: 4243601 - DNA, 14 bp, Homo sapiens
atttgtttgaactg

SEQ ID NO: 4243602 - DNA, 16 bp, Homo sapiens
atttgtttgaactgat

SEQ ID NO: 4243603 - DNA, 18 bp, Homo sapiens
atttgtttgctgtacaga

SEQ ID NO: 4243604 - DNA, 21 bp, Homo sapiens
atttgtttgtgttcaatatca

SEQ ID NO: 4243605 - DNA, 17 bp, Homo sapiens
attttaaaatatatgaa

SEQ ID NO: 4243606 - DNA, 21 bp, Homo sapiens
attttagaaacccctctgtag

SEQ ID NO: 4243607 - DNA, 15 bp, Homo sapiens
attttatggtggaaa

SEQ ID NO: 4243608 - DNA, 22 bp, Homo sapiens
attttattaataatatttatgt

SEQ ID NO: 4243609 - DNA, 17 bp, Homo sapiens
attttattatgcatgaa

SEQ ID NO: 4243610 - DNA, 15 bp, Homo sapiens
attttattgggaggg

SEQ ID NO: 4243611 - DNA, 15 bp, Homo sapiens
attttcagtgatctt

SEQ ID NO: 4243612 - DNA, 15 bp, Homo sapiens
attttgatgttttaa

SEQ ID NO: 4243613 - DNA, 18 bp, Homo sapiens
attttggaaactgctaaa

SEQ ID NO: 4243614 - DNA, 22 bp, Homo sapiens
attttggaaactgctaaattct

SEQ ID NO: 4243615 - DNA, 17 bp, Homo sapiens
atttttagactatttct

SEQ ID NO: 4243616 - DNA, 19 bp, Homo sapiens
atttttagactatttcttt

SEQ ID NO: 4243617 - DNA, 18 bp, Homo sapiens
atttttatacaagtaatt

SEQ ID NO: 4243618 - DNA, 21 bp, Homo sapiens
atttttgacagactatttgct

SEQ ID NO: 4243619 - DNA, 12 bp, Homo sapiens
atttttgtaatt

SEQ ID NO: 4243620 - DNA, 18 bp, Homo sapiens
atttttgtacttgatttg

SEQ ID NO: 4243621 - DNA, 16 bp, Homo sapiens
attttttaaaacacta

SEQ ID NO: 4243622 - DNA, 21 bp, Homo sapiens
attttttaaaacactaaaagc

SEQ ID NO: 4243623 - DNA, 18 bp, Homo sapiens
atttttttactaatagac

SEQ ID NO: 4243624 - DNA, 17 bp, Homo sapiens
attttttttttcctctt

SEQ ID NO: 4243625 - DNA, 21 bp, Homo sapiens
attttttttttcctcttcaga

SEQ ID NO: 4243626 - DNA, 15 bp, Homo sapiens
caaaaaaatttaaaa

SEQ ID NO: 4243627 - DNA, 18 bp, Homo sapiens
caaaaaaatttaaaatta

SEQ ID NO: 4243628 - DNA, 11 bp, Homo sapiens
caaaaaataca

SEQ ID NO: 4243629 - DNA, 12 bp, Homo sapiens
caaaaaatacat

SEQ ID NO: 4243630 - DNA, 12 bp, Homo sapiens
caaaaataatgt

SEQ ID NO: 4243631 - DNA, 17 bp, Homo sapiens
caaaagaaaattgatat

SEQ ID NO: 4243632 - DNA, 17 bp, Homo sapiens
caaaagatttattgtaa

SEQ ID NO: 4243633 - DNA, 20 bp, Homo sapiens
caaaataaaactttttaaaa

SEQ ID NO: 4243634 - DNA, 15 bp, Homo sapiens
caaacttttttatat

SEQ ID NO: 4243635 - DNA, 17 bp, Homo sapiens
caaacttttttatatct

SEQ ID NO: 4243636 - DNA, 20 bp, Homo sapiens
caaagatattttgctttgtg

SEQ ID NO: 4243637 - DNA, 15 bp, Homo sapiens
caaagcttgtggagg

SEQ ID NO: 4243638 - DNA, 20 bp, Homo sapiens
caaagtacaatgtgtttttc

SEQ ID NO: 4243639 - DNA, 20 bp, Homo sapiens
caaagtacactgtttcaaac

SEQ ID NO: 4243640 - DNA, 21 bp, Homo sapiens
caaagtacactgtttcaaact

SEQ ID NO: 4243641 - DNA, 22 bp, Homo sapiens
caaagtacactgtttcaaactt

SEQ ID NO: 4243642 - DNA, 19 bp, Homo sapiens
caaagtatccctactgtaa

SEQ ID NO: 4243643 - DNA, 21 bp, Homo sapiens
caaagtatccctactgtaatt

SEQ ID NO: 4243644 - DNA, 23 bp, Homo sapiens
caaagtgaaggacatagaggtat

SEQ ID NO: 4243645 - DNA, 24 bp, Homo sapiens
caaagtgatgggagaattggtata

SEQ ID NO: 4243646 - DNA, 22 bp, Homo sapiens
caaagtgtgtctgggatttttt

SEQ ID NO: 4243647 - DNA, 17 bp, Homo sapiens
caaagttaattcaccta

SEQ ID NO: 4243648 - DNA, 22 bp, Homo sapiens
caaagttaattcacctatgtta

SEQ ID NO: 4243649 - DNA, 19 bp, Homo sapiens
caaatataagacatttgtt

SEQ ID NO: 4243650 - DNA, 23 bp, Homo sapiens
caaatataagacatttgtttgct

SEQ ID NO: 4243651 - DNA, 18 bp, Homo sapiens
caaattgtgcttctcccc

SEQ ID NO: 4243652 - DNA, 19 bp, Homo sapiens
caaattgtgcttctcccca

SEQ ID NO: 4243653 - DNA, 15 bp, Homo sapiens
caaatttctaaatct

SEQ ID NO: 4243654 - DNA, 20 bp, Homo sapiens
caacattaaggaatttgatg

SEQ ID NO: 4243655 - DNA, 12 bp, Homo sapiens
caacatttatgt

SEQ ID NO: 4243656 - DNA, 16 bp, Homo sapiens
caagaccacgtttcta

SEQ ID NO: 4243657 - DNA, 13 bp, Homo sapiens
caagactgcaaac

SEQ ID NO: 4243658 - DNA, 14 bp, Homo sapiens
caagactgcaaact

SEQ ID NO: 4243659 - DNA, 18 bp, Homo sapiens
caagactgcaaacttttt

SEQ ID NO: 4243660 - DNA, 23 bp, Homo sapiens
caagactgcaaacttttttatat

SEQ ID NO: 4243661 - DNA, 15 bp, Homo sapiens
caagagggacagagc

SEQ ID NO: 4243662 - DNA, 17 bp, Homo sapiens
caagctagtgtttctag

SEQ ID NO: 4243663 - DNA, 20 bp, Homo sapiens
caagggcatcatcctcagca

SEQ ID NO: 4243664 - DNA, 13 bp, Homo sapiens
caaggtcattttt

SEQ ID NO: 4243665 - DNA, 16 bp, Homo sapiens
caaggttggttgctaa

SEQ ID NO: 4243666 - DNA, 20 bp, Homo sapiens
caagtcatttttgtattttt

SEQ ID NO: 4243667 - DNA, 19 bp, Homo sapiens
caagtctctgctggcccag

SEQ ID NO: 4243668 - DNA, 22 bp, Homo sapiens
caagtctctgctggcccagcca

SEQ ID NO: 4243669 - DNA, 21 bp, Homo sapiens
caagttatattagtgaagatg

SEQ ID NO: 4243670 - DNA, 20 bp, Homo sapiens
caagttgttattgttgaaca

SEQ ID NO: 4243671 - DNA, 18 bp, Homo sapiens
caatatcagctttgataa

SEQ ID NO: 4243672 - DNA, 21 bp, Homo sapiens
caatatcagctttgataattg

SEQ ID NO: 4243673 - DNA, 14 bp, Homo sapiens
caatatgtatgctt

SEQ ID NO: 4243674 - DNA, 22 bp, Homo sapiens
caatatgtatgctttttaccta

SEQ ID NO: 4243675 - DNA, 23 bp, Homo sapiens
caatatttctgctttctttgatt

SEQ ID NO: 4243676 - DNA, 17 bp, Homo sapiens
caatcattgttttgaat

SEQ ID NO: 4243677 - DNA, 12 bp, Homo sapiens
caatgaaaagtc

SEQ ID NO: 4243678 - DNA, 13 bp, Homo sapiens
caatgcttaaact

SEQ ID NO: 4243679 - DNA, 16 bp, Homo sapiens
caatgcttaaactaaa

SEQ ID NO: 4243680 - DNA, 18 bp, Homo sapiens
caatgtgcataatgataa

SEQ ID NO: 4243681 - DNA, 16 bp, Homo sapiens
caatgtgtttttctcc

SEQ ID NO: 4243682 - DNA, 20 bp, Homo sapiens
caatgttccttttttgtata

SEQ ID NO: 4243683 - DNA, 20 bp, Homo sapiens
caattagatctaaacagtta

SEQ ID NO: 4243684 - DNA, 22 bp, Homo sapiens
caattagatctaaacagttatt

SEQ ID NO: 4243685 - DNA, 17 bp, Homo sapiens
caattattgatatatat

SEQ ID NO: 4243686 - DNA, 18 bp, Homo sapiens
caattattgatatatatt

SEQ ID NO: 4243687 - DNA, 16 bp, Homo sapiens
caattcataaaaacaa

SEQ ID NO: 4243688 - DNA, 10 bp, Homo sapiens
caattccaat

SEQ ID NO: 4243689 - DNA, 21 bp, Homo sapiens
caattccaatatttctgcttt

SEQ ID NO: 4243690 - DNA, 17 bp, Homo sapiens
caattggcagtgacttt

SEQ ID NO: 4243691 - DNA, 18 bp, Homo sapiens
caattgtgagccaccacg

SEQ ID NO: 4243692 - DNA, 13 bp, Homo sapiens
caatttctgctgt

SEQ ID NO: 4243693 - DNA, 20 bp, Homo sapiens
caatttgaagtaacttattt

SEQ ID NO: 4243694 - DNA, 16 bp, Homo sapiens
caatttgtttgtgttc

SEQ ID NO: 4243695 - DNA, 22 bp, Homo sapiens
caatttgtttgtgttcaatatc

SEQ ID NO: 4243696 - DNA, 19 bp, Homo sapiens
caattttctgtaatctttt

SEQ ID NO: 4243697 - DNA, 16 bp, Homo sapiens
caattttttttttcct

SEQ ID NO: 4243698 - DNA, 17 bp, Homo sapiens
cacaaagagaccagggg

SEQ ID NO: 4243699 - DNA, 16 bp, Homo sapiens
cacaaggattgaaaat

SEQ ID NO: 4243700 - DNA, 18 bp, Homo sapiens
cacaagtagcctctggga

SEQ ID NO: 4243701 - DNA, 20 bp, Homo sapiens
cacacattttttaaatgcac

SEQ ID NO: 4243702 - DNA, 18 bp, Homo sapiens
cacacggagctcctggca

SEQ ID NO: 4243703 - DNA, 19 bp, Homo sapiens
cacagacacaatatgtatg

SEQ ID NO: 4243704 - DNA, 20 bp, Homo sapiens
cacagaccaagtccaagccc

SEQ ID NO: 4243705 - DNA, 21 bp, Homo sapiens
cacagagcaggactgcacagc

SEQ ID NO: 4243706 - DNA, 20 bp, Homo sapiens
cacagagttgttacattttt

SEQ ID NO: 4243707 - DNA, 17 bp, Homo sapiens
cacagatatactttgtg

SEQ ID NO: 4243708 - DNA, 18 bp, Homo sapiens
cacaggcagctctgagcc

SEQ ID NO: 4243709 - DNA, 19 bp, Homo sapiens
cacaggttcatgccaccat

SEQ ID NO: 4243710 - DNA, 23 bp, Homo sapiens
cacagtggtactctgtgtctggc

SEQ ID NO: 4243711 - DNA, 14 bp, Homo sapiens
cacagtgttgccca

SEQ ID NO: 4243712 - DNA, 13 bp, Homo sapiens
cacataccaggtc

SEQ ID NO: 4243713 - DNA, 18 bp, Homo sapiens
cacatcagcacgatttct

SEQ ID NO: 4243714 - DNA, 20 bp, Homo sapiens
cacatcagcacgatttctgt

SEQ ID NO: 4243715 - DNA, 21 bp, Homo sapiens
cacatcagcacgatttctgtt

SEQ ID NO: 4243716 - DNA, 22 bp, Homo sapiens
cacatcagcacgatttctgttt

SEQ ID NO: 4243717 - DNA, 21 bp, Homo sapiens
cacatctgcattttcacccca

SEQ ID NO: 4243718 - DNA, 13 bp, Homo sapiens
cacatttttctta

SEQ ID NO: 4243719 - DNA, 20 bp, Homo sapiens
caccacttttggattttatg

SEQ ID NO: 4243720 - DNA, 21 bp, Homo sapiens
caccatattaccacagacata

SEQ ID NO: 4243721 - DNA, 12 bp, Homo sapiens
caccatggccag

SEQ ID NO: 4243722 - DNA, 20 bp, Homo sapiens
caccatggtatcatatatta

SEQ ID NO: 4243723 - DNA, 12 bp, Homo sapiens
cacccacctctg

SEQ ID NO: 4243724 - DNA, 15 bp, Homo sapiens
cacccacctctgcca

SEQ ID NO: 4243725 - DNA, 15 bp, Homo sapiens
caccccagcatcagc

SEQ ID NO: 4243726 - DNA, 19 bp, Homo sapiens
caccccagcatcagcacag

SEQ ID NO: 4243727 - DNA, 12 bp, Homo sapiens
caccccatccca

SEQ ID NO: 4243728 - DNA, 21 bp, Homo sapiens
caccccatcccacaccctgga

SEQ ID NO: 4243729 - DNA, 13 bp, Homo sapiens
cacccccatctct

SEQ ID NO: 4243730 - DNA, 21 bp, Homo sapiens
caccctggaggatttcatctc

SEQ ID NO: 4243731 - DNA, 14 bp, Homo sapiens
cacccttcccctcc

SEQ ID NO: 4243732 - DNA, 13 bp, Homo sapiens
cacctatgttatt

SEQ ID NO: 4243733 - DNA, 15 bp, Homo sapiens
cacctctgccactct

SEQ ID NO: 4243734 - DNA, 22 bp, Homo sapiens
cacctctggggaagatggagca

SEQ ID NO: 4243735 - DNA, 18 bp, Homo sapiens
cacctgtctcagcctccc

SEQ ID NO: 4243736 - DNA, 12 bp, Homo sapiens
cacgatttctgt

SEQ ID NO: 4243737 - DNA, 14 bp, Homo sapiens
cacgatttctgttt

SEQ ID NO: 4243738 - DNA, 19 bp, Homo sapiens
cacgtccactcccaagcca

SEQ ID NO: 4243739 - DNA, 13 bp, Homo sapiens
cacgtggccagga

SEQ ID NO: 4243740 - DNA, 14 bp, Homo sapiens
cacgtggccaggag

SEQ ID NO: 4243741 - DNA, 14 bp, Homo sapiens
cacgtttctaaagg

SEQ ID NO: 4243742 - DNA, 16 bp, Homo sapiens
cactacacatttgaaa

SEQ ID NO: 4243743 - DNA, 16 bp, Homo sapiens
cactagagaatgcaca

SEQ ID NO: 4243744 - DNA, 23 bp, Homo sapiens
cactagagaatgcacagatatac

SEQ ID NO: 4243745 - DNA, 17 bp, Homo sapiens
cactatatatatttcta

SEQ ID NO: 4243746 - DNA, 22 bp, Homo sapiens
cactgaagaaagaggaaccccc

SEQ ID NO: 4243747 - DNA, 20 bp, Homo sapiens
cactgtgggaaggccagctg

SEQ ID NO: 4243748 - DNA, 15 bp, Homo sapiens
cactgttctgcaaag

SEQ ID NO: 4243749 - DNA, 21 bp, Homo sapiens
cactgtttaagtactgtttac

SEQ ID NO: 4243750 - DNA, 19 bp, Homo sapiens
cactgtttcaaactttact

SEQ ID NO: 4243751 - DNA, 15 bp, Homo sapiens
cacttacctgcttga

SEQ ID NO: 4243752 - DNA, 18 bp, Homo sapiens
cacttcttgttccccact

SEQ ID NO: 4243753 - DNA, 17 bp, Homo sapiens
cactttgtaatttttgc

SEQ ID NO: 4243754 - DNA, 14 bp, Homo sapiens
cacttttgttcttg

SEQ ID NO: 4243755 - DNA, 22 bp, Homo sapiens
cacttttgttcttggtttgtaa

SEQ ID NO: 4243756 - DNA, 15 bp, Homo sapiens
cagaaaaaggcagtg

SEQ ID NO: 4243757 - DNA, 19 bp, Homo sapiens
cagaacatcgatatgtata

SEQ ID NO: 4243758 - DNA, 16 bp, Homo sapiens
cagaaccaaagctcaa

SEQ ID NO: 4243759 - DNA, 9 bp, Homo sapiens
cagaacttg

SEQ ID NO: 4243760 - DNA, 11 bp, Homo sapiens
cagaataatgg

SEQ ID NO: 4243761 - DNA, 15 bp, Homo sapiens
cagaataatggaaac

SEQ ID NO: 4243762 - DNA, 15 bp, Homo sapiens
cagaattctctagtt

SEQ ID NO: 4243763 - DNA, 15 bp, Homo sapiens
cagacaattccattc

SEQ ID NO: 4243764 - DNA, 18 bp, Homo sapiens
cagacacaatatgtatgc

SEQ ID NO: 4243765 - DNA, 15 bp, Homo sapiens
cagaccagctggcgg

SEQ ID NO: 4243766 - DNA, 17 bp, Homo sapiens
cagaccagctggcgggt

SEQ ID NO: 4243767 - DNA, 14 bp, Homo sapiens
cagactatttgcta

SEQ ID NO: 4243768 - DNA, 15 bp, Homo sapiens
cagactctcagccca

SEQ ID NO: 4243769 - DNA, 18 bp, Homo sapiens
cagagaaaacccggagca

SEQ ID NO: 4243770 - DNA, 19 bp, Homo sapiens
cagagttgttacattttta

SEQ ID NO: 4243771 - DNA, 18 bp, Homo sapiens
cagattctgcctatgtaa

SEQ ID NO: 4243772 - DNA, 16 bp, Homo sapiens
cagatttttatttatg

SEQ ID NO: 4243773 - DNA, 22 bp, Homo sapiens
cagcaataaagcagcgtttcta

SEQ ID NO: 4243774 - DNA, 15 bp, Homo sapiens
cagcacgatttctgt

SEQ ID NO: 4243775 - DNA, 18 bp, Homo sapiens
cagcacgatttctgttta

SEQ ID NO: 4243776 - DNA, 19 bp, Homo sapiens
cagcacgatttctgtttag

SEQ ID NO: 4243777 - DNA, 22 bp, Homo sapiens
cagcactttgggaggctgaggc

SEQ ID NO: 4243778 - DNA, 22 bp, Homo sapiens
cagcagaaatgccttaccctca

SEQ ID NO: 4243779 - DNA, 21 bp, Homo sapiens
cagcagggaccgggcgcagcc

SEQ ID NO: 4243780 - DNA, 19 bp, Homo sapiens
cagcagtgagagttcctct

SEQ ID NO: 4243781 - DNA, 16 bp, Homo sapiens
cagcagttctctgcca

SEQ ID NO: 4243782 - DNA, 15 bp, Homo sapiens
cagcatcgaggaagg

SEQ ID NO: 4243783 - DNA, 21 bp, Homo sapiens
cagcatttccacaccaagcag

SEQ ID NO: 4243784 - DNA, 13 bp, Homo sapiens
cagccagtaaatg

SEQ ID NO: 4243785 - DNA, 15 bp, Homo sapiens
cagcccgtgtccagg

SEQ ID NO: 4243786 - DNA, 16 bp, Homo sapiens
cagccctctgtggcca

SEQ ID NO: 4243787 - DNA, 20 bp, Homo sapiens
cagccctctgtggccaggag

SEQ ID NO: 4243788 - DNA, 21 bp, Homo sapiens
cagccctctgtggccaggagc

SEQ ID NO: 4243789 - DNA, 13 bp, Homo sapiens
cagccgtgtgtgc

SEQ ID NO: 4243790 - DNA, 18 bp, Homo sapiens
cagcctcccacccccatc

SEQ ID NO: 4243791 - DNA, 18 bp, Homo sapiens
cagcctttttgtaattta

SEQ ID NO: 4243792 - DNA, 20 bp, Homo sapiens
cagcgccacctggaagccgc

SEQ ID NO: 4243793 - DNA, 19 bp, Homo sapiens
cagcgtcactctacctaat

SEQ ID NO: 4243794 - DNA, 14 bp, Homo sapiens
cagcgtcctgtcca

SEQ ID NO: 4243795 - DNA, 16 bp, Homo sapiens
cagcgtttctatgaca

SEQ ID NO: 4243796 - DNA, 18 bp, Homo sapiens
cagctaatttttgtattt

SEQ ID NO: 4243797 - DNA, 17 bp, Homo sapiens
cagctaccctgtgtata

SEQ ID NO: 4243798 - DNA, 12 bp, Homo sapiens
cagctagtgcct

SEQ ID NO: 4243799 - DNA, 22 bp, Homo sapiens
cagctcgatccaaattgtgctt

SEQ ID NO: 4243800 - DNA, 22 bp, Homo sapiens
caggacctccggagcgccctgc

SEQ ID NO: 4243801 - DNA, 13 bp, Homo sapiens
caggactgcacag

SEQ ID NO: 4243802 - DNA, 18 bp, Homo sapiens
caggagccccgccaggtg

SEQ ID NO: 4243803 - DNA, 13 bp, Homo sapiens
caggagccctggc

SEQ ID NO: 4243804 - DNA, 17 bp, Homo sapiens
caggcagctctgagccg

SEQ ID NO: 4243805 - DNA, 15 bp, Homo sapiens
caggcatggctcaga

SEQ ID NO: 4243806 - DNA, 16 bp, Homo sapiens
caggcatggctcagag

SEQ ID NO: 4243807 - DNA, 19 bp, Homo sapiens
caggctactctgcccaccc

SEQ ID NO: 4243808 - DNA, 23 bp, Homo sapiens
caggctcctgaccccgccatgca

SEQ ID NO: 4243809 - DNA, 17 bp, Homo sapiens
caggctgtctggccagg

SEQ ID NO: 4243810 - DNA, 22 bp, Homo sapiens
cagggagcatttaatggcagct

SEQ ID NO: 4243811 - DNA, 13 bp, Homo sapiens
caggtatcaaatc

SEQ ID NO: 4243812 - DNA, 21 bp, Homo sapiens
caggtcagggaggatctgttc

SEQ ID NO: 4243813 - DNA, 16 bp, Homo sapiens
caggtctttgggaagc

SEQ ID NO: 4243814 - DNA, 16 bp, Homo sapiens
caggtggatgaggaga

SEQ ID NO: 4243815 - DNA, 20 bp, Homo sapiens
cagtaaatgggggtgcattt

SEQ ID NO: 4243816 - DNA, 21 bp, Homo sapiens
cagtaaatgggggtgcatttg

SEQ ID NO: 4243817 - DNA, 22 bp, Homo sapiens
cagtaaatgggggtgcatttga

SEQ ID NO: 4243818 - DNA, 13 bp, Homo sapiens
cagtacctctcaa

SEQ ID NO: 4243819 - DNA, 17 bp, Homo sapiens
cagtattgctgatttta

SEQ ID NO: 4243820 - DNA, 21 bp, Homo sapiens
cagtcccagacaattccattc

SEQ ID NO: 4243821 - DNA, 22 bp, Homo sapiens
cagtcccagacaattccattca

SEQ ID NO: 4243822 - DNA, 17 bp, Homo sapiens
cagtgctaagctgccct

SEQ ID NO: 4243823 - DNA, 19 bp, Homo sapiens
cagtggtggttttctgttc

SEQ ID NO: 4243824 - DNA, 14 bp, Homo sapiens
cagttactcagaat

SEQ ID NO: 4243825 - DNA, 16 bp, Homo sapiens
cagttctctgccaaag

SEQ ID NO: 4243826 - DNA, 23 bp, Homo sapiens
cagtttgttagtatgaggcattt

SEQ ID NO: 4243827 - DNA, 15 bp, Homo sapiens
cagttttatttttgc

SEQ ID NO: 4243828 - DNA, 20 bp, Homo sapiens
cataaacaagaccacgtttc

SEQ ID NO: 4243829 - DNA, 16 bp, Homo sapiens
cataaagggttgaaaa

SEQ ID NO: 4243830 - DNA, 14 bp, Homo sapiens
cataaagttgtatt

SEQ ID NO: 4243831 - DNA, 14 bp, Homo sapiens
cataaataaaactg

SEQ ID NO: 4243832 - DNA, 16 bp, Homo sapiens
cataaataaaactgaa

SEQ ID NO: 4243833 - DNA, 20 bp, Homo sapiens
cataaatgcataatttatgg

SEQ ID NO: 4243834 - DNA, 22 bp, Homo sapiens
cataataggtagtttggatatt

SEQ ID NO: 4243835 - DNA, 19 bp, Homo sapiens
cataatgataaaataaata

SEQ ID NO: 4243836 - DNA, 23 bp, Homo sapiens
cataatgataaaataaataattt

SEQ ID NO: 4243837 - DNA, 12 bp, Homo sapiens
cataatttatgg

SEQ ID NO: 4243838 - DNA, 21 bp, Homo sapiens
catacattccctctaatttga

SEQ ID NO: 4243839 - DNA, 13 bp, Homo sapiens
cataccacttttg

SEQ ID NO: 4243840 - DNA, 13 bp, Homo sapiens
catacgtacacat

SEQ ID NO: 4243841 - DNA, 15 bp, Homo sapiens
catacgtacacattt

SEQ ID NO: 4243842 - DNA, 17 bp, Homo sapiens
catacgtacacatttta

SEQ ID NO: 4243843 - DNA, 21 bp, Homo sapiens
catactaaccagcagaaatgc

SEQ ID NO: 4243844 - DNA, 18 bp, Homo sapiens
catacttcaaaaataatg

SEQ ID NO: 4243845 - DNA, 17 bp, Homo sapiens
catatacatattgtata

SEQ ID NO: 4243846 - DNA, 23 bp, Homo sapiens
catatcaattggcagtgactttg

SEQ ID NO: 4243847 - DNA, 15 bp, Homo sapiens
catattaaataataa

SEQ ID NO: 4243848 - DNA, 21 bp, Homo sapiens
catattgatttccgttaaaat

SEQ ID NO: 4243849 - DNA, 19 bp, Homo sapiens
catcagcacgatttctgtt

SEQ ID NO: 4243850 - DNA, 17 bp, Homo sapiens
catcatcctcagcagca

SEQ ID NO: 4243851 - DNA, 16 bp, Homo sapiens
catccacttcaggagc

SEQ ID NO: 4243852 - DNA, 17 bp, Homo sapiens
catccacttcaggagcc

SEQ ID NO: 4243853 - DNA, 18 bp, Homo sapiens
catcgatatgtatatcat

SEQ ID NO: 4243854 - DNA, 23 bp, Homo sapiens
catcgcgggatggtgcagacgcg

SEQ ID NO: 4243855 - DNA, 16 bp, Homo sapiens
catcgctcgtgtgttc

SEQ ID NO: 4243856 - DNA, 20 bp, Homo sapiens
catctagtttccctggtgcc

SEQ ID NO: 4243857 - DNA, 16 bp, Homo sapiens
catctctccctcccct

SEQ ID NO: 4243858 - DNA, 23 bp, Homo sapiens
catctctccctcccctgccattt

SEQ ID NO: 4243859 - DNA, 21 bp, Homo sapiens
catctcttcctccgaggccag

SEQ ID NO: 4243860 - DNA, 16 bp, Homo sapiens
catctgcatgggtctt

SEQ ID NO: 4243861 - DNA, 19 bp, Homo sapiens
catctgcattttcacccca

SEQ ID NO: 4243862 - DNA, 21 bp, Homo sapiens
catctggcacgtggccaggag

SEQ ID NO: 4243863 - DNA, 22 bp, Homo sapiens
catctggcacgtggccaggagc

SEQ ID NO: 4243864 - DNA, 15 bp, Homo sapiens
catgaaaacacattt

SEQ ID NO: 4243865 - DNA, 16 bp, Homo sapiens
catgaaaacacatttt

SEQ ID NO: 4243866 - DNA, 15 bp, Homo sapiens
catgaagtaatatgc

SEQ ID NO: 4243867 - DNA, 19 bp, Homo sapiens
catgaagtaatatgcacac

SEQ ID NO: 4243868 - DNA, 12 bp, Homo sapiens
catgcaaggtca

SEQ ID NO: 4243869 - DNA, 18 bp, Homo sapiens
catgcaaggtcatttttt

SEQ ID NO: 4243870 - DNA, 22 bp, Homo sapiens
catgcaaggtcattttttttaa

SEQ ID NO: 4243871 - DNA, 15 bp, Homo sapiens
catgcaatttgaagt

SEQ ID NO: 4243872 - DNA, 14 bp, Homo sapiens
catgcatgcagcgc

SEQ ID NO: 4243873 - DNA, 13 bp, Homo sapiens
catgcccctgaac

SEQ ID NO: 4243874 - DNA, 14 bp, Homo sapiens
catgctacacactg

SEQ ID NO: 4243875 - DNA, 23 bp, Homo sapiens
catgctacacactgcatgtttgt

SEQ ID NO: 4243876 - DNA, 14 bp, Homo sapiens
catgctccaaatat

SEQ ID NO: 4243877 - DNA, 20 bp, Homo sapiens
catgctgtccgtgcttgctg

SEQ ID NO: 4243878 - DNA, 22 bp, Homo sapiens
catgcttctcatcttgtgaaat

SEQ ID NO: 4243879 - DNA, 16 bp, Homo sapiens
catgggaaatgagcca

SEQ ID NO: 4243880 - DNA, 19 bp, Homo sapiens
catggtcggaaaacatgct

SEQ ID NO: 4243881 - DNA, 19 bp, Homo sapiens
catggtggctcatgcctgt

SEQ ID NO: 4243882 - DNA, 15 bp, Homo sapiens
catgtatttatgtaa

SEQ ID NO: 4243883 - DNA, 23 bp, Homo sapiens
catgtgtatccatgcattatata

SEQ ID NO: 4243884 - DNA, 18 bp, Homo sapiens
catgttcttaattcttag

SEQ ID NO: 4243885 - DNA, 20 bp, Homo sapiens
catgttgggtttgagacaga

SEQ ID NO: 4243886 - DNA, 22 bp, Homo sapiens
catgttgggtttgagacagaca

SEQ ID NO: 4243887 - DNA, 14 bp, Homo sapiens
catgtttgtgattg

SEQ ID NO: 4243888 - DNA, 11 bp, Homo sapiens
cattaaatgaa

SEQ ID NO: 4243889 - DNA, 15 bp, Homo sapiens
cattaaatgaatatt

SEQ ID NO: 4243890 - DNA, 18 bp, Homo sapiens
cattaaatgaatattttg

SEQ ID NO: 4243891 - DNA, 19 bp, Homo sapiens
cattaaatgcaataatttt

SEQ ID NO: 4243892 - DNA, 15 bp, Homo sapiens
cattacagttcataa

SEQ ID NO: 4243893 - DNA, 18 bp, Homo sapiens
cattatctagatactgta

SEQ ID NO: 4243894 - DNA, 23 bp, Homo sapiens
cattatctagatactgtatcatg

SEQ ID NO: 4243895 - DNA, 14 bp, Homo sapiens
cattattgcttatt

SEQ ID NO: 4243896 - DNA, 15 bp, Homo sapiens
cattcattctgagcc

SEQ ID NO: 4243897 - DNA, 21 bp, Homo sapiens
cattccagtgctagaaaattt

SEQ ID NO: 4243898 - DNA, 16 bp, Homo sapiens
cattctacacagagca

SEQ ID NO: 4243899 - DNA, 17 bp, Homo sapiens
cattctacacagagcag

SEQ ID NO: 4243900 - DNA, 15 bp, Homo sapiens
cattctacagaataa

SEQ ID NO: 4243901 - DNA, 16 bp, Homo sapiens
cattctacagaataat

SEQ ID NO: 4243902 - DNA, 21 bp, Homo sapiens
cattctacagaataatccagt

SEQ ID NO: 4243903 - DNA, 20 bp, Homo sapiens
cattctccttgtgttactaa

SEQ ID NO: 4243904 - DNA, 12 bp, Homo sapiens
cattctgagccc

SEQ ID NO: 4243905 - DNA, 20 bp, Homo sapiens
cattctgagcccccttcctg

SEQ ID NO: 4243906 - DNA, 17 bp, Homo sapiens
cattctgttaatcatta

SEQ ID NO: 4243907 - DNA, 22 bp, Homo sapiens
cattgttttgaatattactcct

SEQ ID NO: 4243908 - DNA, 21 bp, Homo sapiens
catttaaaagatacagttact

SEQ ID NO: 4243909 - DNA, 20 bp, Homo sapiens
catttacattaggtattaca

SEQ ID NO: 4243910 - DNA, 18 bp, Homo sapiens
catttgaggtctgttctt

SEQ ID NO: 4243911 - DNA, 19 bp, Homo sapiens
catttgaggtctgttcttt

SEQ ID NO: 4243912 - DNA, 22 bp, Homo sapiens
catttggtggtttcagaaatgt

SEQ ID NO: 4243913 - DNA, 23 bp, Homo sapiens
catttggtggtttcagaaatgtg

SEQ ID NO: 4243914 - DNA, 22 bp, Homo sapiens
catttgtttgaactgataaaga

SEQ ID NO: 4243915 - DNA, 13 bp, Homo sapiens
cattttattaata

SEQ ID NO: 4243916 - DNA, 17 bp, Homo sapiens
cattttattaataatat

SEQ ID NO: 4243917 - DNA, 20 bp, Homo sapiens
cattttattaataatattta

SEQ ID NO: 4243918 - DNA, 22 bp, Homo sapiens
cattttattaataatatttatg

SEQ ID NO: 4243919 - DNA, 19 bp, Homo sapiens
cattttcctgacatttgtt

SEQ ID NO: 4243920 - DNA, 15 bp, Homo sapiens
catttttaagtgctg

SEQ ID NO: 4243921 - DNA, 20 bp, Homo sapiens
catttttaagtgctgcattt

SEQ ID NO: 4243922 - DNA, 21 bp, Homo sapiens
catttttaagtgctgcattta

SEQ ID NO: 4243923 - DNA, 13 bp, Homo sapiens
catttttcattca

SEQ ID NO: 4243924 - DNA, 19 bp, Homo sapiens
cattttttaaatgcacctg

SEQ ID NO: 4243925 - DNA, 21 bp, Homo sapiens
ccaaaataaaactttttaaaa

SEQ ID NO: 4243926 - DNA, 15 bp, Homo sapiens
ccaaacatgtattta

SEQ ID NO: 4243927 - DNA, 17 bp, Homo sapiens
ccaaacatgtatttatg

SEQ ID NO: 4243928 - DNA, 14 bp, Homo sapiens
ccaaagctggccca

SEQ ID NO: 4243929 - DNA, 17 bp, Homo sapiens
ccaaagctggcccagtt

SEQ ID NO: 4243930 - DNA, 18 bp, Homo sapiens
ccaaatgaaaaatctcaa

SEQ ID NO: 4243931 - DNA, 16 bp, Homo sapiens
ccaaattgtgcttctc

SEQ ID NO: 4243932 - DNA, 21 bp, Homo sapiens
ccaaattgtgcttctccccag

SEQ ID NO: 4243933 - DNA, 13 bp, Homo sapiens
ccaagcaacattt

SEQ ID NO: 4243934 - DNA, 16 bp, Homo sapiens
ccaagtccaagcccgt

SEQ ID NO: 4243935 - DNA, 13 bp, Homo sapiens
ccaatatattctg

SEQ ID NO: 4243936 - DNA, 18 bp, Homo sapiens
ccaattattgatatatat

SEQ ID NO: 4243937 - DNA, 18 bp, Homo sapiens
ccacacacagtccaactc

SEQ ID NO: 4243938 - DNA, 16 bp, Homo sapiens
ccacacggagctcctg

SEQ ID NO: 4243939 - DNA, 17 bp, Homo sapiens
ccacacggagctcctgg

SEQ ID NO: 4243940 - DNA, 20 bp, Homo sapiens
ccacacggagctcctggcag

SEQ ID NO: 4243941 - DNA, 21 bp, Homo sapiens
ccacacggagctcctggcagc

SEQ ID NO: 4243942 - DNA, 23 bp, Homo sapiens
ccacacttgaagcctaaatttgt

SEQ ID NO: 4243943 - DNA, 17 bp, Homo sapiens
ccaccaagacttgtttt

SEQ ID NO: 4243944 - DNA, 16 bp, Homo sapiens
ccaccatggccagcca

SEQ ID NO: 4243945 - DNA, 17 bp, Homo sapiens
ccaccatggccagccaa

SEQ ID NO: 4243946 - DNA, 23 bp, Homo sapiens
ccacctgtctcagcctcccagag

SEQ ID NO: 4243947 - DNA, 14 bp, Homo sapiens
ccacgccccaggac

SEQ ID NO: 4243948 - DNA, 16 bp, Homo sapiens
ccacgccccaggacct

SEQ ID NO: 4243949 - DNA, 17 bp, Homo sapiens
ccactacattctgttaa

SEQ ID NO: 4243950 - DNA, 22 bp, Homo sapiens
ccactagtaagtaattatgcac

SEQ ID NO: 4243951 - DNA, 23 bp, Homo sapiens
ccactagtaagtaattatgcact

SEQ ID NO: 4243952 - DNA, 16 bp, Homo sapiens
ccacttcaggagccct

SEQ ID NO: 4243953 - DNA, 20 bp, Homo sapiens
ccacttcttgttccccactg

SEQ ID NO: 4243954 - DNA, 22 bp, Homo sapiens
ccacttttgttcttggtttgta

SEQ ID NO: 4243955 - DNA, 18 bp, Homo sapiens
ccagaagaaaattctcct

SEQ ID NO: 4243956 - DNA, 18 bp, Homo sapiens
ccagagcccctcatgcca

SEQ ID NO: 4243957 - DNA, 13 bp, Homo sapiens
ccagatcctggaa

SEQ ID NO: 4243958 - DNA, 16 bp, Homo sapiens
ccagatggactccagc

SEQ ID NO: 4243959 - DNA, 12 bp, Homo sapiens
ccagcagaaatg

SEQ ID NO: 4243960 - DNA, 17 bp, Homo sapiens
ccagccaaaccctgtct

SEQ ID NO: 4243961 - DNA, 18 bp, Homo sapiens
ccagccaaaccctgtctg

SEQ ID NO: 4243962 - DNA, 21 bp, Homo sapiens
ccagccagatggactccagcc

SEQ ID NO: 4243963 - DNA, 15 bp, Homo sapiens
ccagccctctgtggc

SEQ ID NO: 4243964 - DNA, 21 bp, Homo sapiens
ccagccctctgtggccaggag

SEQ ID NO: 4243965 - DNA, 23 bp, Homo sapiens
ccagccctctgtggccaggagcc

SEQ ID NO: 4243966 - DNA, 20 bp, Homo sapiens
ccagccgtgtgtgcatgtgc

SEQ ID NO: 4243967 - DNA, 18 bp, Homo sapiens
ccagcctgcctggcaggc

SEQ ID NO: 4243968 - DNA, 20 bp, Homo sapiens
ccagcctgcctggcaggctg

SEQ ID NO: 4243969 - DNA, 21 bp, Homo sapiens
ccagcctgcctggcaggctgt

SEQ ID NO: 4243970 - DNA, 20 bp, Homo sapiens
ccagctaatttttgtatttt

SEQ ID NO: 4243971 - DNA, 15 bp, Homo sapiens
ccagctgtgcacttt

SEQ ID NO: 4243972 - DNA, 17 bp, Homo sapiens
ccaggagccctggcccg

SEQ ID NO: 4243973 - DNA, 23 bp, Homo sapiens
ccaggccctcagtcttcctgccg

SEQ ID NO: 4243974 - DNA, 19 bp, Homo sapiens
ccaggcctcttggcagtca

SEQ ID NO: 4243975 - DNA, 23 bp, Homo sapiens
ccaggtctgggaagctgagggca

SEQ ID NO: 4243976 - DNA, 20 bp, Homo sapiens
ccaggtgcccgcgccaggcc

SEQ ID NO: 4243977 - DNA, 20 bp, Homo sapiens
ccagtaaatgggggtgcatt

SEQ ID NO: 4243978 - DNA, 21 bp, Homo sapiens
ccagtaaatgggggtgcattt

SEQ ID NO: 4243979 - DNA, 20 bp, Homo sapiens
ccagtaggagaaatctcagc

SEQ ID NO: 4243980 - DNA, 20 bp, Homo sapiens
ccagtggagacggaatctgc

SEQ ID NO: 4243981 - DNA, 19 bp, Homo sapiens
ccatattaccacagacata

SEQ ID NO: 4243982 - DNA, 12 bp, Homo sapiens
ccatcccacacc

SEQ ID NO: 4243983 - DNA, 16 bp, Homo sapiens
ccatcccacaccctgg

SEQ ID NO: 4243984 - DNA, 14 bp, Homo sapiens
ccatctctccctcc

SEQ ID NO: 4243985 - DNA, 20 bp, Homo sapiens
ccatctctgtgattacctct

SEQ ID NO: 4243986 - DNA, 23 bp, Homo sapiens
ccatgaggggattcccttccttc

SEQ ID NO: 4243987 - DNA, 16 bp, Homo sapiens
ccattaaatgaatatt

SEQ ID NO: 4243988 - DNA, 16 bp, Homo sapiens
cccagaagaaaattct

SEQ ID NO: 4243989 - DNA, 11 bp, Homo sapiens
cccagaattca

SEQ ID NO: 4243990 - DNA, 18 bp, Homo sapiens
cccagcagttctctgcca

SEQ ID NO: 4243991 - DNA, 15 bp, Homo sapiens
cccagcatcagcaca

SEQ ID NO: 4243992 - DNA, 17 bp, Homo sapiens
cccagccaaaccctgtc

SEQ ID NO: 4243993 - DNA, 14 bp, Homo sapiens
cccagccctctgtg

SEQ ID NO: 4243994 - DNA, 16 bp, Homo sapiens
cccagccctctgtggc

SEQ ID NO: 4243995 - DNA, 22 bp, Homo sapiens
cccagccctctgtggccaggag

SEQ ID NO: 4243996 - DNA, 12 bp, Homo sapiens
cccagctcagca

SEQ ID NO: 4243997 - DNA, 19 bp, Homo sapiens
cccagttggcccttctgcc

SEQ ID NO: 4243998 - DNA, 17 bp, Homo sapiens
cccagttgtccatgaca

SEQ ID NO: 4243999 - DNA, 22 bp, Homo sapiens
cccatgttgggtttgagacaga

SEQ ID NO: 4244000 - DNA, 15 bp, Homo sapiens
ccccactgacagcct

SEQ ID NO: 4244001 - DNA, 21 bp, Homo sapiens
ccccactgacagcctcccacc

SEQ ID NO: 4244002 - DNA, 11 bp, Homo sapiens
ccccagagccc

SEQ ID NO: 4244003 - DNA, 19 bp, Homo sapiens
ccccagttggcccttctgc

SEQ ID NO: 4244004 - DNA, 14 bp, Homo sapiens
ccccatgaggggat

SEQ ID NO: 4244005 - DNA, 18 bp, Homo sapiens
ccccgccatgcatgcagc

SEQ ID NO: 4244006 - DNA, 11 bp, Homo sapiens
cccctctgtag

SEQ ID NO: 4244007 - DNA, 19 bp, Homo sapiens
cccctgtggataccaaggt

SEQ ID NO: 4244008 - DNA, 22 bp, Homo sapiens
cccgcaagagggacagagcccg

SEQ ID NO: 4244009 - DNA, 14 bp, Homo sapiens
cccggaagaaccag

SEQ ID NO: 4244010 - DNA, 18 bp, Homo sapiens
cccggaagaaccagaagt

SEQ ID NO: 4244011 - DNA, 16 bp, Homo sapiens
cccggcagtgcacgcg

SEQ ID NO: 4244012 - DNA, 17 bp, Homo sapiens
cccggccggagggcagg

SEQ ID NO: 4244013 - DNA, 17 bp, Homo sapiens
ccctaaagtgtattttt

SEQ ID NO: 4244014 - DNA, 22 bp, Homo sapiens
ccctaaagtgtatttttttact

SEQ ID NO: 4244015 - DNA, 14 bp, Homo sapiens
ccctcccccagagc

SEQ ID NO: 4244016 - DNA, 15 bp, Homo sapiens
ccctcccccagagcc

SEQ ID NO: 4244017 - DNA, 16 bp, Homo sapiens
ccctcccccagagccc

SEQ ID NO: 4244018 - DNA, 17 bp, Homo sapiens
ccctcccccagagcccc

SEQ ID NO: 4244019 - DNA, 22 bp, Homo sapiens
ccctcccggagaggtggccgcc

SEQ ID NO: 4244020 - DNA, 15 bp, Homo sapiens
ccctctgtggccagg

SEQ ID NO: 4244021 - DNA, 19 bp, Homo sapiens
ccctgctttggcggcccgg

SEQ ID NO: 4244022 - DNA, 23 bp, Homo sapiens
ccctggcccgcaagagggacaga

SEQ ID NO: 4244023 - DNA, 20 bp, Homo sapiens
ccctggtgcccttccctgga

SEQ ID NO: 4244024 - DNA, 10 bp, Homo sapiens
ccctgtccct

SEQ ID NO: 4244025 - DNA, 13 bp, Homo sapiens
ccctgttaaacag

SEQ ID NO: 4244026 - DNA, 11 bp, Homo sapiens
cccttaaaatt

SEQ ID NO: 4244027 - DNA, 20 bp, Homo sapiens
cccttccctggaggtctctc

SEQ ID NO: 4244028 - DNA, 19 bp, Homo sapiens
cccttcctgtccccagggg

SEQ ID NO: 4244029 - DNA, 11 bp, Homo sapiens
cccttccttct

SEQ ID NO: 4244030 - DNA, 12 bp, Homo sapiens
cccttctgccct

SEQ ID NO: 4244031 - DNA, 19 bp, Homo sapiens
ccctttgtttcttgtttat

SEQ ID NO: 4244032 - DNA, 14 bp, Homo sapiens
ccgagctgtttatg

SEQ ID NO: 4244033 - DNA, 19 bp, Homo sapiens
ccgccatgcttctgtgccg

SEQ ID NO: 4244034 - DNA, 21 bp, Homo sapiens
ccgctctcttttctgtacttc

SEQ ID NO: 4244035 - DNA, 17 bp, Homo sapiens
ccggaagaaccagaagt

SEQ ID NO: 4244036 - DNA, 23 bp, Homo sapiens
ccggaagaaccagaagtgcagcc

SEQ ID NO: 4244037 - DNA, 16 bp, Homo sapiens
ccggagggcaggaccc

SEQ ID NO: 4244038 - DNA, 15 bp, Homo sapiens
ccggccggagggcag

SEQ ID NO: 4244039 - DNA, 17 bp, Homo sapiens
ccggccggagggcagga

SEQ ID NO: 4244040 - DNA, 19 bp, Homo sapiens
ccggcggccccgccgcaga

SEQ ID NO: 4244041 - DNA, 14 bp, Homo sapiens
ccgggagagactcg

SEQ ID NO: 4244042 - DNA, 15 bp, Homo sapiens
ccgggcgcagccctc

SEQ ID NO: 4244043 - DNA, 15 bp, Homo sapiens
ccggtgcatctggca

SEQ ID NO: 4244044 - DNA, 20 bp, Homo sapiens
ccggtgcatctggcacgtgg

SEQ ID NO: 4244045 - DNA, 19 bp, Homo sapiens
ccgtctttacccctgctga

SEQ ID NO: 4244046 - DNA, 18 bp, Homo sapiens
ccgtgcgggcgaggccgc

SEQ ID NO: 4244047 - DNA, 18 bp, Homo sapiens
ccgtgcttgctggtgcct

SEQ ID NO: 4244048 - DNA, 22 bp, Homo sapiens
ccgtggcctcgtgctccgcagg

SEQ ID NO: 4244049 - DNA, 15 bp, Homo sapiens
ccgtgtgtgcatgtg

SEQ ID NO: 4244050 - DNA, 13 bp, Homo sapiens
ccgttgtgcctgg

SEQ ID NO: 4244051 - DNA, 14 bp, Homo sapiens
ccgttgtgcctggt

SEQ ID NO: 4244052 - DNA, 22 bp, Homo sapiens
cctaaaaggaaatctcacccca

SEQ ID NO: 4244053 - DNA, 18 bp, Homo sapiens
cctaatggcatggagact

SEQ ID NO: 4244054 - DNA, 18 bp, Homo sapiens
cctaatgtctcactgttc

SEQ ID NO: 4244055 - DNA, 15 bp, Homo sapiens
cctactcctggagca

SEQ ID NO: 4244056 - DNA, 12 bp, Homo sapiens
cctatgttattt

SEQ ID NO: 4244057 - DNA, 15 bp, Homo sapiens
cctatttaatacagc

SEQ ID NO: 4244058 - DNA, 21 bp, Homo sapiens
cctcagcttcttcacaggcac

SEQ ID NO: 4244059 - DNA, 22 bp, Homo sapiens
cctcaggctccccagtgctcct

SEQ ID NO: 4244060 - DNA, 19 bp, Homo sapiens
cctccacaaagagaccagg

SEQ ID NO: 4244061 - DNA, 21 bp, Homo sapiens
cctccacaaagagaccagggg

SEQ ID NO: 4244062 - DNA, 15 bp, Homo sapiens
cctcccccagagccc

SEQ ID NO: 4244063 - DNA, 12 bp, Homo sapiens
cctccctgggat

SEQ ID NO: 4244064 - DNA, 20 bp, Homo sapiens
cctctcaagctagtgtttct

SEQ ID NO: 4244065 - DNA, 20 bp, Homo sapiens
cctctcacaggcagctctga

SEQ ID NO: 4244066 - DNA, 13 bp, Homo sapiens
cctctccctgttg

SEQ ID NO: 4244067 - DNA, 14 bp, Homo sapiens
cctctcctttgaaa

SEQ ID NO: 4244068 - DNA, 19 bp, Homo sapiens
cctctcgtttctgcccagc

SEQ ID NO: 4244069 - DNA, 18 bp, Homo sapiens
cctctgcagcaataaagc

SEQ ID NO: 4244070 - DNA, 21 bp, Homo sapiens
cctctgtggccaggagccctg

SEQ ID NO: 4244071 - DNA, 15 bp, Homo sapiens
cctgaccccgccatg

SEQ ID NO: 4244072 - DNA, 20 bp, Homo sapiens
cctgataaaacaacagctcg

SEQ ID NO: 4244073 - DNA, 16 bp, Homo sapiens
cctgatgatgctggcc

SEQ ID NO: 4244074 - DNA, 15 bp, Homo sapiens
cctgccctcaggctc

SEQ ID NO: 4244075 - DNA, 23 bp, Homo sapiens
cctgccctcaggctccccagtgc

SEQ ID NO: 4244076 - DNA, 21 bp, Homo sapiens
cctgccggttccgcccgccct

SEQ ID NO: 4244077 - DNA, 14 bp, Homo sapiens
cctgcctcagcctc

SEQ ID NO: 4244078 - DNA, 15 bp, Homo sapiens
cctgctgggtgccag

SEQ ID NO: 4244079 - DNA, 16 bp, Homo sapiens
cctgctgggtgccagg

SEQ ID NO: 4244080 - DNA, 22 bp, Homo sapiens
cctgcttgagctttctgtgcat

SEQ ID NO: 4244081 - DNA, 20 bp, Homo sapiens
cctggcccgcaagagggaca

SEQ ID NO: 4244082 - DNA, 22 bp, Homo sapiens
cctgggatggacgctgccggga

SEQ ID NO: 4244083 - DNA, 17 bp, Homo sapiens
cctggttcgtgccatgc

SEQ ID NO: 4244084 - DNA, 20 bp, Homo sapiens
cctgtccaatttctgctgta

SEQ ID NO: 4244085 - DNA, 15 bp, Homo sapiens
cctgtctcagcctcc

SEQ ID NO: 4244086 - DNA, 12 bp, Homo sapiens
cctgttaaacag

SEQ ID NO: 4244087 - DNA, 18 bp, Homo sapiens
cctgtttataatctgaag

SEQ ID NO: 4244088 - DNA, 16 bp, Homo sapiens
cctgttttgagaccag

SEQ ID NO: 4244089 - DNA, 18 bp, Homo sapiens
ccttaaaattaccagaca

SEQ ID NO: 4244090 - DNA, 15 bp, Homo sapiens
ccttaccctcatgtt

SEQ ID NO: 4244091 - DNA, 19 bp, Homo sapiens
ccttaccctcatgttctta

SEQ ID NO: 4244092 - DNA, 18 bp, Homo sapiens
ccttcctaccctcctgca

SEQ ID NO: 4244093 - DNA, 13 bp, Homo sapiens
ccttcctgtcccc

SEQ ID NO: 4244094 - DNA, 17 bp, Homo sapiens
ccttgaactttgacctc

SEQ ID NO: 4244095 - DNA, 17 bp, Homo sapiens
cctttgaaacctgctct

SEQ ID NO: 4244096 - DNA, 22 bp, Homo sapiens
cctttgtattctctcctgtacc

SEQ ID NO: 4244097 - DNA, 22 bp, Homo sapiens
cctttgtggttttatggagacc

SEQ ID NO: 4244098 - DNA, 13 bp, Homo sapiens
cctttgtttcttg

SEQ ID NO: 4244099 - DNA, 15 bp, Homo sapiens
ccttttatctgcaga

SEQ ID NO: 4244100 - DNA, 21 bp, Homo sapiens
ccttttttagagttgatacta

SEQ ID NO: 4244101 - DNA, 16 bp, Homo sapiens
cgaagcctagaagcac

SEQ ID NO: 4244102 - DNA, 14 bp, Homo sapiens
cgaaggcataataa

SEQ ID NO: 4244103 - DNA, 20 bp, Homo sapiens
cgaattgtgtggagaactca

SEQ ID NO: 4244104 - DNA, 17 bp, Homo sapiens
cgacccttttgagccta

SEQ ID NO: 4244105 - DNA, 15 bp, Homo sapiens
cgagcagtcctgcct

SEQ ID NO: 4244106 - DNA, 17 bp, Homo sapiens
cgagcagtcctgcctca

SEQ ID NO: 4244107 - DNA, 21 bp, Homo sapiens
cgaggaatgtgaagccagatc

SEQ ID NO: 4244108 - DNA, 11 bp, Homo sapiens
cgaggccagta

SEQ ID NO: 4244109 - DNA, 19 bp, Homo sapiens
cgaggccagtacctttcca

SEQ ID NO: 4244110 - DNA, 20 bp, Homo sapiens
cgatccacctgtctcagcct

SEQ ID NO: 4244111 - DNA, 21 bp, Homo sapiens
cgattctcccaaagtaccttg

SEQ ID NO: 4244112 - DNA, 16 bp, Homo sapiens
cgcacttacctgcttg

SEQ ID NO: 4244113 - DNA, 20 bp, Homo sapiens
cgccaggtgcccgcgccagg

SEQ ID NO: 4244114 - DNA, 19 bp, Homo sapiens
cgcccggcagtgcacgcgg

SEQ ID NO: 4244115 - DNA, 12 bp, Homo sapiens
cgccctcccgga

SEQ ID NO: 4244116 - DNA, 13 bp, Homo sapiens
cgccctcccggag

SEQ ID NO: 4244117 - DNA, 14 bp, Homo sapiens
cgccctcccggaga

SEQ ID NO: 4244118 - DNA, 14 bp, Homo sapiens
cgccctgcagggcc

SEQ ID NO: 4244119 - DNA, 13 bp, Homo sapiens
cgccgcagaccag

SEQ ID NO: 4244120 - DNA, 13 bp, Homo sapiens
cgccgtccggcgg

SEQ ID NO: 4244121 - DNA, 18 bp, Homo sapiens
cgcctttgcgctctcggg

SEQ ID NO: 4244122 - DNA, 13 bp, Homo sapiens
cgctctcttttct

SEQ ID NO: 4244123 - DNA, 20 bp, Homo sapiens
cgcttgggaggggccggagg

SEQ ID NO: 4244124 - DNA, 23 bp, Homo sapiens
cggaagaaccagaagtgcagccc

SEQ ID NO: 4244125 - DNA, 13 bp, Homo sapiens
cggagaggtggcc

SEQ ID NO: 4244126 - DNA, 19 bp, Homo sapiens
cggagaggtggccgccatg

SEQ ID NO: 4244127 - DNA, 16 bp, Homo sapiens
cggagcgccctgcagg

SEQ ID NO: 4244128 - DNA, 15 bp, Homo sapiens
cggagggcaggaccc

SEQ ID NO: 4244129 - DNA, 20 bp, Homo sapiens
cggcttcgttagaccgctct

SEQ ID NO: 4244130 - DNA, 21 bp, Homo sapiens
cggcttgttgacttcgcagcc

SEQ ID NO: 4244131 - DNA, 21 bp, Homo sapiens
cgggcatggtggctcatgcct

SEQ ID NO: 4244132 - DNA, 14 bp, Homo sapiens
cgggcgcagccctc

SEQ ID NO: 4244133 - DNA, 18 bp, Homo sapiens
cggggactcggagggtgc

SEQ ID NO: 4244134 - DNA, 18 bp, Homo sapiens
cgggtcaccctgctttgg

SEQ ID NO: 4244135 - DNA, 17 bp, Homo sapiens
cgggtgatgagacctgg

SEQ ID NO: 4244136 - DNA, 18 bp, Homo sapiens
cgggtgtggagaccaggc

SEQ ID NO: 4244137 - DNA, 22 bp, Homo sapiens
cgggtgtggagaccaggctcct

SEQ ID NO: 4244138 - DNA, 17 bp, Homo sapiens
cgtcagaagcacccagg

SEQ ID NO: 4244139 - DNA, 18 bp, Homo sapiens
cgtcatgctgtccgtgct

SEQ ID NO: 4244140 - DNA, 22 bp, Homo sapiens
cgtcatgctgtccgtgcttgct

SEQ ID NO: 4244141 - DNA, 23 bp, Homo sapiens
cgtcctgtccacacccagctcag

SEQ ID NO: 4244142 - DNA, 14 bp, Homo sapiens
cgtctttacccctg

SEQ ID NO: 4244143 - DNA, 18 bp, Homo sapiens
cgtgcataccacttttgt

SEQ ID NO: 4244144 - DNA, 14 bp, Homo sapiens
cgtgcttgctggtg

SEQ ID NO: 4244145 - DNA, 14 bp, Homo sapiens
cgtggccaggagcc

SEQ ID NO: 4244146 - DNA, 21 bp, Homo sapiens
cgtggcctcgtgctccgcagg

SEQ ID NO: 4244147 - DNA, 16 bp, Homo sapiens
cgttagaccgctctct

SEQ ID NO: 4244148 - DNA, 12 bp, Homo sapiens
cgttgtgcctgg

SEQ ID NO: 4244149 - DNA, 19 bp, Homo sapiens
cgtttctaaaggctacctt

SEQ ID NO: 4244150 - DNA, 23 bp, Homo sapiens
ctaaaatagttagatctttgtaa

SEQ ID NO: 4244151 - DNA, 18 bp, Homo sapiens
ctaaacagttatttctgt

SEQ ID NO: 4244152 - DNA, 16 bp, Homo sapiens
ctaaaggctacctttg

SEQ ID NO: 4244153 - DNA, 19 bp, Homo sapiens
ctaaaggctacctttgtat

SEQ ID NO: 4244154 - DNA, 22 bp, Homo sapiens
ctaaagtgtatttttttactaa

SEQ ID NO: 4244155 - DNA, 20 bp, Homo sapiens
ctaaataatgaataaactga

SEQ ID NO: 4244156 - DNA, 16 bp, Homo sapiens
ctaaatggaaccactc

SEQ ID NO: 4244157 - DNA, 17 bp, Homo sapiens
ctaaatggaaccactct

SEQ ID NO: 4244158 - DNA, 22 bp, Homo sapiens
ctaaattctatgttaaatactg

SEQ ID NO: 4244159 - DNA, 13 bp, Homo sapiens
ctaaccatttata

SEQ ID NO: 4244160 - DNA, 16 bp, Homo sapiens
ctaacttcaccatatt

SEQ ID NO: 4244161 - DNA, 16 bp, Homo sapiens
ctaagccctttgccat

SEQ ID NO: 4244162 - DNA, 17 bp, Homo sapiens
ctaagccctttgccatc

SEQ ID NO: 4244163 - DNA, 20 bp, Homo sapiens
ctaagtttttatggcttttg

SEQ ID NO: 4244164 - DNA, 17 bp, Homo sapiens
ctaatagacaatttatt

SEQ ID NO: 4244165 - DNA, 19 bp, Homo sapiens
ctaatagacaatttattat

SEQ ID NO: 4244166 - DNA, 16 bp, Homo sapiens
ctaatgtctcactgtt

SEQ ID NO: 4244167 - DNA, 19 bp, Homo sapiens
ctaatgtctcactgttctg

SEQ ID NO: 4244168 - DNA, 22 bp, Homo sapiens
ctaatgtctcactgttctgcaa

SEQ ID NO: 4244169 - DNA, 20 bp, Homo sapiens
ctacaaagcactagagaatg

SEQ ID NO: 4244170 - DNA, 15 bp, Homo sapiens
ctacacactgcatgt

SEQ ID NO: 4244171 - DNA, 13 bp, Homo sapiens
ctactctgcccac

SEQ ID NO: 4244172 - DNA, 21 bp, Homo sapiens
ctactgaagggaacagcctga

SEQ ID NO: 4244173 - DNA, 23 bp, Homo sapiens
ctactgaagggaacagcctgagc

SEQ ID NO: 4244174 - DNA, 19 bp, Homo sapiens
ctagaaaatttagcccttt

SEQ ID NO: 4244175 - DNA, 12 bp, Homo sapiens
ctagcagacaga

SEQ ID NO: 4244176 - DNA, 18 bp, Homo sapiens
ctagcatacgtacacatt

SEQ ID NO: 4244177 - DNA, 19 bp, Homo sapiens
ctagcatacgtacacattt

SEQ ID NO: 4244178 - DNA, 13 bp, Homo sapiens
ctaggagaagagt

SEQ ID NO: 4244179 - DNA, 22 bp, Homo sapiens
ctaggctcttatgtgtgccttt

SEQ ID NO: 4244180 - DNA, 19 bp, Homo sapiens
ctagtggatgactgttgat

SEQ ID NO: 4244181 - DNA, 16 bp, Homo sapiens
ctagtttccctggtgc

SEQ ID NO: 4244182 - DNA, 19 bp, Homo sapiens
ctagtttgattaaattctt

SEQ ID NO: 4244183 - DNA, 22 bp, Homo sapiens
ctagtttgattaaattcttgca

SEQ ID NO: 4244184 - DNA, 17 bp, Homo sapiens
ctatccgccctgcagca

SEQ ID NO: 4244185 - DNA, 19 bp, Homo sapiens
ctatggaacataaagttgt

SEQ ID NO: 4244186 - DNA, 18 bp, Homo sapiens
ctatgttaaatactgtgc

SEQ ID NO: 4244187 - DNA, 21 bp, Homo sapiens
ctatgttaaatactgtgcaga

SEQ ID NO: 4244188 - DNA, 14 bp, Homo sapiens
ctatttgctaatgt

SEQ ID NO: 4244189 - DNA, 15 bp, Homo sapiens
ctatttttgtaaact

SEQ ID NO: 4244190 - DNA, 21 bp, Homo sapiens
ctatttttgtaaactggaatt

SEQ ID NO: 4244191 - DNA, 22 bp, Homo sapiens
ctcaaaaaaacaaaaaagactt

SEQ ID NO: 4244192 - DNA, 15 bp, Homo sapiens
ctcaaatttctaaat

SEQ ID NO: 4244193 - DNA, 17 bp, Homo sapiens
ctcaaatttctaaatct

SEQ ID NO: 4244194 - DNA, 19 bp, Homo sapiens
ctcaagctagtgtttctag

SEQ ID NO: 4244195 - DNA, 20 bp, Homo sapiens
ctcaagctagtgtttctagc

SEQ ID NO: 4244196 - DNA, 21 bp, Homo sapiens
ctcacaggcagctctgagccg

SEQ ID NO: 4244197 - DNA, 12 bp, Homo sapiens
ctcaccccatcc

SEQ ID NO: 4244198 - DNA, 21 bp, Homo sapiens
ctcaccccatcccacaccctg

SEQ ID NO: 4244199 - DNA, 16 bp, Homo sapiens
ctcactatatatattt

SEQ ID NO: 4244200 - DNA, 24 bp, Homo sapiens
ctcactgtgggaaggccagctgcc

SEQ ID NO: 4244201 - DNA, 15 bp, Homo sapiens
ctcactgttctgcaa

SEQ ID NO: 4244202 - DNA, 15 bp, Homo sapiens
ctcactgttgaattt

SEQ ID NO: 4244203 - DNA, 15 bp, Homo sapiens
ctcacttagtccttt

SEQ ID NO: 4244204 - DNA, 19 bp, Homo sapiens
ctcagaaaaaggcagtggc

SEQ ID NO: 4244205 - DNA, 21 bp, Homo sapiens
ctcagactgtggaaccaaagc

SEQ ID NO: 4244206 - DNA, 17 bp, Homo sapiens
ctcagagcttgaagatt

SEQ ID NO: 4244207 - DNA, 20 bp, Homo sapiens
ctcagcccagaagaaaattc

SEQ ID NO: 4244208 - DNA, 20 bp, Homo sapiens
ctcaggcgatccacctgtct

SEQ ID NO: 4244209 - DNA, 18 bp, Homo sapiens
ctcaggctccccagtgct

SEQ ID NO: 4244210 - DNA, 15 bp, Homo sapiens
ctcagtgccacacct

SEQ ID NO: 4244211 - DNA, 22 bp, Homo sapiens
ctcattctccttgtgttactaa

SEQ ID NO: 4244212 - DNA, 15 bp, Homo sapiens
ctccaaaataaaact

SEQ ID NO: 4244213 - DNA, 16 bp, Homo sapiens
ctccacaaagagacca

SEQ ID NO: 4244214 - DNA, 21 bp, Homo sapiens
ctccacaaagagaccaggggc

SEQ ID NO: 4244215 - DNA, 21 bp, Homo sapiens
ctccacttcttgttccccact

SEQ ID NO: 4244216 - DNA, 17 bp, Homo sapiens
ctccagcctgcctggca

SEQ ID NO: 4244217 - DNA, 18 bp, Homo sapiens
ctccagggagattttgag

SEQ ID NO: 4244218 - DNA, 22 bp, Homo sapiens
ctccagtgctgtccatgcttct

SEQ ID NO: 4244219 - DNA, 19 bp, Homo sapiens
ctcccacccccatctctcc

SEQ ID NO: 4244220 - DNA, 14 bp, Homo sapiens
ctccccagaattca

SEQ ID NO: 4244221 - DNA, 21 bp, Homo sapiens
ctccccagtgctcctggccct

SEQ ID NO: 4244222 - DNA, 14 bp, Homo sapiens
ctcccccagagccc

SEQ ID NO: 4244223 - DNA, 16 bp, Homo sapiens
ctccctcccccagagc

SEQ ID NO: 4244224 - DNA, 18 bp, Homo sapiens
ctccctcccccagagccc

SEQ ID NO: 4244225 - DNA, 22 bp, Homo sapiens
ctccctgtggcactcagggagc

SEQ ID NO: 4244226 - DNA, 14 bp, Homo sapiens
ctccctttttatat

SEQ ID NO: 4244227 - DNA, 19 bp, Homo sapiens
ctcctaatggcatggagac

SEQ ID NO: 4244228 - DNA, 16 bp, Homo sapiens
ctcctatttttgtaaa

SEQ ID NO: 4244229 - DNA, 15 bp, Homo sapiens
ctcctccctgggatg

SEQ ID NO: 4244230 - DNA, 16 bp, Homo sapiens
ctcctcttcccagagt

SEQ ID NO: 4244231 - DNA, 23 bp, Homo sapiens
ctcctgataaaacaacagctcga

SEQ ID NO: 4244232 - DNA, 19 bp, Homo sapiens
ctcctgcctcagcctcctg

SEQ ID NO: 4244233 - DNA, 13 bp, Homo sapiens
ctcctgggctcag

SEQ ID NO: 4244234 - DNA, 13 bp, Homo sapiens
ctccttctccctt

SEQ ID NO: 4244235 - DNA, 17 bp, Homo sapiens
ctcgagcagtcctgcct

SEQ ID NO: 4244236 - DNA, 14 bp, Homo sapiens
ctcgatccaaattg

SEQ ID NO: 4244237 - DNA, 18 bp, Homo sapiens
ctcgtgctccgcagggcg

SEQ ID NO: 4244238 - DNA, 17 bp, Homo sapiens
ctcgtttctgcccagcc

SEQ ID NO: 4244239 - DNA, 17 bp, Homo sapiens
ctctacctaatgtctca

SEQ ID NO: 4244240 - DNA, 15 bp, Homo sapiens
ctctcacaggcagct

SEQ ID NO: 4244241 - DNA, 22 bp, Homo sapiens
ctctcacaggcagctctgagcc

SEQ ID NO: 4244242 - DNA, 16 bp, Homo sapiens
ctctccacacggagct

SEQ ID NO: 4244243 - DNA, 20 bp, Homo sapiens
ctctccctcccccagagccc

SEQ ID NO: 4244244 - DNA, 15 bp, Homo sapiens
ctctcctgtacctct

SEQ ID NO: 4244245 - DNA, 18 bp, Homo sapiens
ctctctccacacggagct

SEQ ID NO: 4244246 - DNA, 22 bp, Homo sapiens
ctctctccacacggagctcctg

SEQ ID NO: 4244247 - DNA, 18 bp, Homo sapiens
ctctcttttctgtacttc

SEQ ID NO: 4244248 - DNA, 18 bp, Homo sapiens
ctctgcagcaataaagca

SEQ ID NO: 4244249 - DNA, 19 bp, Homo sapiens
ctctgccaaagcttgtgga

SEQ ID NO: 4244250 - DNA, 16 bp, Homo sapiens
ctctgtgattacctct

SEQ ID NO: 4244251 - DNA, 21 bp, Homo sapiens
ctctgtggccaggagccctgg

SEQ ID NO: 4244252 - DNA, 22 bp, Homo sapiens
ctctgtggccaggagccctggc

SEQ ID NO: 4244253 - DNA, 23 bp, Homo sapiens
ctctgtggccaggagccctggcc

SEQ ID NO: 4244254 - DNA, 15 bp, Homo sapiens
ctctgtgtctggcag

SEQ ID NO: 4244255 - DNA, 17 bp, Homo sapiens
ctcttaaacttgtgaat

SEQ ID NO: 4244256 - DNA, 16 bp, Homo sapiens
ctcttatgtgtgcctt

SEQ ID NO: 4244257 - DNA, 15 bp, Homo sapiens
ctcttattttacaat

SEQ ID NO: 4244258 - DNA, 12 bp, Homo sapiens
ctcttcagaact

SEQ ID NO: 4244259 - DNA, 15 bp, Homo sapiens
ctcttcagactctca

SEQ ID NO: 4244260 - DNA, 23 bp, Homo sapiens
ctcttcagactctcagcccagaa

SEQ ID NO: 4244261 - DNA, 16 bp, Homo sapiens
ctcttgagccttgaac

SEQ ID NO: 4244262 - DNA, 15 bp, Homo sapiens
ctctttgccctgagg

SEQ ID NO: 4244263 - DNA, 15 bp, Homo sapiens
ctcttttctgtactt

SEQ ID NO: 4244264 - DNA, 20 bp, Homo sapiens
ctgaagggcattctttccca

SEQ ID NO: 4244265 - DNA, 11 bp, Homo sapiens
ctgaatatttt

SEQ ID NO: 4244266 - DNA, 14 bp, Homo sapiens
ctgaatttcttttg

SEQ ID NO: 4244267 - DNA, 14 bp, Homo sapiens
ctgacagcctccca

SEQ ID NO: 4244268 - DNA, 21 bp, Homo sapiens
ctgacatttgtttattttttg

SEQ ID NO: 4244269 - DNA, 18 bp, Homo sapiens
ctgacgcaatgaaaagtc

SEQ ID NO: 4244270 - DNA, 23 bp, Homo sapiens
ctgagccgcgctttcccctcctc

SEQ ID NO: 4244271 - DNA, 13 bp, Homo sapiens
ctgagggcaaatc

SEQ ID NO: 4244272 - DNA, 14 bp, Homo sapiens
ctgagtaaacataa

SEQ ID NO: 4244273 - DNA, 21 bp, Homo sapiens
ctgagtacgttgtgcatttgg

SEQ ID NO: 4244274 - DNA, 18 bp, Homo sapiens
ctgagtatagtatttaac

SEQ ID NO: 4244275 - DNA, 21 bp, Homo sapiens
ctgataaagatgagtgagcat

SEQ ID NO: 4244276 - DNA, 13 bp, Homo sapiens
ctgatgatgctgg

SEQ ID NO: 4244277 - DNA, 14 bp, Homo sapiens
ctgatgatgctggc

SEQ ID NO: 4244278 - DNA, 19 bp, Homo sapiens
ctgattttaaaggcagaga

SEQ ID NO: 4244279 - DNA, 23 bp, Homo sapiens
ctgattttaaaggcagagaagtt

SEQ ID NO: 4244280 - DNA, 19 bp, Homo sapiens
ctgcaacctcacctcccgg

SEQ ID NO: 4244281 - DNA, 16 bp, Homo sapiens
ctgcagcaataaagca

SEQ ID NO: 4244282 - DNA, 17 bp, Homo sapiens
ctgcagggccgggcagg

SEQ ID NO: 4244283 - DNA, 18 bp, Homo sapiens
ctgcagggccgggcaggg

SEQ ID NO: 4244284 - DNA, 18 bp, Homo sapiens
ctgcattcattctgagcc

SEQ ID NO: 4244285 - DNA, 22 bp, Homo sapiens
ctgcatttaaaagatacagtta

SEQ ID NO: 4244286 - DNA, 15 bp, Homo sapiens
ctgccaaagcttgtg

SEQ ID NO: 4244287 - DNA, 18 bp, Homo sapiens
ctgccagtctcactgtgg

SEQ ID NO: 4244288 - DNA, 13 bp, Homo sapiens
ctgccagtggaga

SEQ ID NO: 4244289 - DNA, 15 bp, Homo sapiens
ctgccagtggagacg

SEQ ID NO: 4244290 - DNA, 13 bp, Homo sapiens
ctgccccagccag

SEQ ID NO: 4244291 - DNA, 20 bp, Homo sapiens
ctgccctcaggctccccagt

SEQ ID NO: 4244292 - DNA, 18 bp, Homo sapiens
ctgccgggagactgccag

SEQ ID NO: 4244293 - DNA, 12 bp, Homo sapiens
ctgcctcagcct

SEQ ID NO: 4244294 - DNA, 15 bp, Homo sapiens
ctgctggcccagcca

SEQ ID NO: 4244295 - DNA, 15 bp, Homo sapiens
ctgctgggtgccagg

SEQ ID NO: 4244296 - DNA, 16 bp, Homo sapiens
ctgctgggtgccaggt

SEQ ID NO: 4244297 - DNA, 19 bp, Homo sapiens
ctgctgggtgccaggtgct

SEQ ID NO: 4244298 - DNA, 22 bp, Homo sapiens
ctgctgggtgccaggtgctggg

SEQ ID NO: 4244299 - DNA, 17 bp, Homo sapiens
ctgctgggtggcagggg

SEQ ID NO: 4244300 - DNA, 17 bp, Homo sapiens
ctgcttaacttcacata

SEQ ID NO: 4244301 - DNA, 23 bp, Homo sapiens
ctgcttgagctttctgtgcatgt

SEQ ID NO: 4244302 - DNA, 15 bp, Homo sapiens
ctgctttctttgatt

SEQ ID NO: 4244303 - DNA, 16 bp, Homo sapiens
ctggaaacagcagtgt

SEQ ID NO: 4244304 - DNA, 16 bp, Homo sapiens
ctggaaacctctggag

SEQ ID NO: 4244305 - DNA, 23 bp, Homo sapiens
ctggattaaacttaatctaaatg

SEQ ID NO: 4244306 - DNA, 16 bp, Homo sapiens
ctggattcacagacca

SEQ ID NO: 4244307 - DNA, 18 bp, Homo sapiens
ctggcacgtggccaggag

SEQ ID NO: 4244308 - DNA, 19 bp, Homo sapiens
ctggcacgtggccaggagc

SEQ ID NO: 4244309 - DNA, 16 bp, Homo sapiens
ctggcagcgagaacta

SEQ ID NO: 4244310 - DNA, 16 bp, Homo sapiens
ctggcaggctactctg

SEQ ID NO: 4244311 - DNA, 14 bp, Homo sapiens
ctggccctacagta

SEQ ID NO: 4244312 - DNA, 19 bp, Homo sapiens
ctggccttgaaaccacctt

SEQ ID NO: 4244313 - DNA, 13 bp, Homo sapiens
ctggctatgcatt

SEQ ID NO: 4244314 - DNA, 19 bp, Homo sapiens
ctgggaagctgagggcaaa

SEQ ID NO: 4244315 - DNA, 20 bp, Homo sapiens
ctgggaagctgagggcaaat

SEQ ID NO: 4244316 - DNA, 23 bp, Homo sapiens
ctgggatggacgctgccgggaga

SEQ ID NO: 4244317 - DNA, 19 bp, Homo sapiens
ctgggtattggaaatggat

SEQ ID NO: 4244318 - DNA, 13 bp, Homo sapiens
ctgggtggcaggg

SEQ ID NO: 4244319 - DNA, 14 bp, Homo sapiens
ctggtaacagtggc

SEQ ID NO: 4244320 - DNA, 16 bp, Homo sapiens
ctggtggaagtcttgg

SEQ ID NO: 4244321 - DNA, 18 bp, Homo sapiens
ctggtgtactctaggact

SEQ ID NO: 4244322 - DNA, 19 bp, Homo sapiens
ctggtgtactctaggactt

SEQ ID NO: 4244323 - DNA, 22 bp, Homo sapiens
ctggtgtactctaggacttcaa

SEQ ID NO: 4244324 - DNA, 17 bp, Homo sapiens
ctgtaagcctatatata

SEQ ID NO: 4244325 - DNA, 20 bp, Homo sapiens
ctgtaatcttttatttaagt

SEQ ID NO: 4244326 - DNA, 21 bp, Homo sapiens
ctgtaattgcactttttaagt

SEQ ID NO: 4244327 - DNA, 15 bp, Homo sapiens
ctgtaatttgtgata

SEQ ID NO: 4244328 - DNA, 21 bp, Homo sapiens
ctgtaatttgtgatacaatgc

SEQ ID NO: 4244329 - DNA, 17 bp, Homo sapiens
ctgtacataaacaatga

SEQ ID NO: 4244330 - DNA, 23 bp, Homo sapiens
ctgtaccacagacacaatatgta

SEQ ID NO: 4244331 - DNA, 21 bp, Homo sapiens
ctgtacctcttgagccttgaa

SEQ ID NO: 4244332 - DNA, 22 bp, Homo sapiens
ctgtacctcttgagccttgaac

SEQ ID NO: 4244333 - DNA, 22 bp, Homo sapiens
ctgtaggagctacccttttcct

SEQ ID NO: 4244334 - DNA, 23 bp, Homo sapiens
ctgtcatctaaagtcctggccct

SEQ ID NO: 4244335 - DNA, 22 bp, Homo sapiens
ctgtccagccgtgtgtgcatgt

SEQ ID NO: 4244336 - DNA, 16 bp, Homo sapiens
ctgtccatgcttctca

SEQ ID NO: 4244337 - DNA, 13 bp, Homo sapiens
ctgtccctcactg

SEQ ID NO: 4244338 - DNA, 17 bp, Homo sapiens
ctgtctcagcctcccag

SEQ ID NO: 4244339 - DNA, 20 bp, Homo sapiens
ctgtctgacaacctcttggt

SEQ ID NO: 4244340 - DNA, 15 bp, Homo sapiens
ctgtctggccaggcc

SEQ ID NO: 4244341 - DNA, 17 bp, Homo sapiens
ctgtgaggggtgtttgg

SEQ ID NO: 4244342 - DNA, 21 bp, Homo sapiens
ctgtgcagaataatggaaaca

SEQ ID NO: 4244343 - DNA, 15 bp, Homo sapiens
ctgtgcatgtgcagg

SEQ ID NO: 4244344 - DNA, 22 bp, Homo sapiens
ctgtgccgaccacgccccagga

SEQ ID NO: 4244345 - DNA, 15 bp, Homo sapiens
ctgtggaaccaaagc

SEQ ID NO: 4244346 - DNA, 12 bp, Homo sapiens
ctgtggccagga

SEQ ID NO: 4244347 - DNA, 15 bp, Homo sapiens
ctgtggccaggagcc

SEQ ID NO: 4244348 - DNA, 16 bp, Homo sapiens
ctgtggccaggagccc

SEQ ID NO: 4244349 - DNA, 15 bp, Homo sapiens
ctgtgggaaggccag

SEQ ID NO: 4244350 - DNA, 19 bp, Homo sapiens
ctgtgtgtatattgagaat

SEQ ID NO: 4244351 - DNA, 19 bp, Homo sapiens
ctgtgtttaaaaagtaagt

SEQ ID NO: 4244352 - DNA, 23 bp, Homo sapiens
ctgttaaacagtagttgtattct

SEQ ID NO: 4244353 - DNA, 20 bp, Homo sapiens
ctgttatgatttccttcaat

SEQ ID NO: 4244354 - DNA, 13 bp, Homo sapiens
ctgttatgtatga

SEQ ID NO: 4244355 - DNA, 13 bp, Homo sapiens
ctgttctgcaaag

SEQ ID NO: 4244356 - DNA, 20 bp, Homo sapiens
ctgttctgcaaaggtggcaa

SEQ ID NO: 4244357 - DNA, 15 bp, Homo sapiens
ctgttctttccaaag

SEQ ID NO: 4244358 - DNA, 21 bp, Homo sapiens
ctgttctttctggctatgcat

SEQ ID NO: 4244359 - DNA, 23 bp, Homo sapiens
ctgttctttctggctatgcattt

SEQ ID NO: 4244360 - DNA, 20 bp, Homo sapiens
ctgttgatgaagtatacttt

SEQ ID NO: 4244361 - DNA, 20 bp, Homo sapiens
ctgttgctggtgtactctag

SEQ ID NO: 4244362 - DNA, 11 bp, Homo sapiens
ctgtttataat

SEQ ID NO: 4244363 - DNA, 15 bp, Homo sapiens
ctgtttataatctga

SEQ ID NO: 4244364 - DNA, 18 bp, Homo sapiens
ctgtttataatctgaaga

SEQ ID NO: 4244365 - DNA, 19 bp, Homo sapiens
ctgtttcctatttaataca

SEQ ID NO: 4244366 - DNA, 15 bp, Homo sapiens
cttaaactaaataat

SEQ ID NO: 4244367 - DNA, 15 bp, Homo sapiens
cttaaacttgtgaat

SEQ ID NO: 4244368 - DNA, 14 bp, Homo sapiens
cttaacttcacata

SEQ ID NO: 4244369 - DNA, 16 bp, Homo sapiens
cttaacttcacatatt

SEQ ID NO: 4244370 - DNA, 17 bp, Homo sapiens
cttaacttcacatattg

SEQ ID NO: 4244371 - DNA, 17 bp, Homo sapiens
cttaagatattgaagga

SEQ ID NO: 4244372 - DNA, 16 bp, Homo sapiens
cttacacgtgcgtgtg

SEQ ID NO: 4244373 - DNA, 17 bp, Homo sapiens
cttaccctcatgttctt

SEQ ID NO: 4244374 - DNA, 13 bp, Homo sapiens
cttactgtacatg

SEQ ID NO: 4244375 - DNA, 11 bp, Homo sapiens
cttagacactt

SEQ ID NO: 4244376 - DNA, 22 bp, Homo sapiens
cttagagccttttatctgcaga

SEQ ID NO: 4244377 - DNA, 15 bp, Homo sapiens
cttagtaaaatttat

SEQ ID NO: 4244378 - DNA, 21 bp, Homo sapiens
cttagtgattgagactcaaaa

SEQ ID NO: 4244379 - DNA, 21 bp, Homo sapiens
cttatggtatgtagccagctg

SEQ ID NO: 4244380 - DNA, 17 bp, Homo sapiens
cttcaaagtgtgtctgg

SEQ ID NO: 4244381 - DNA, 20 bp, Homo sapiens
cttcaaagtgtgtctgggat

SEQ ID NO: 4244382 - DNA, 21 bp, Homo sapiens
cttcaaagtgtgtctgggatt

SEQ ID NO: 4244383 - DNA, 19 bp, Homo sapiens
cttcaacatgctccaaata

SEQ ID NO: 4244384 - DNA, 14 bp, Homo sapiens
cttcacatattgat

SEQ ID NO: 4244385 - DNA, 20 bp, Homo sapiens
cttcaggtggatgaggagac

SEQ ID NO: 4244386 - DNA, 13 bp, Homo sapiens
cttcattgaaagc

SEQ ID NO: 4244387 - DNA, 14 bp, Homo sapiens
cttccacctctggg

SEQ ID NO: 4244388 - DNA, 13 bp, Homo sapiens
cttcccgggcggg

SEQ ID NO: 4244389 - DNA, 16 bp, Homo sapiens
cttcctaccctcctgc

SEQ ID NO: 4244390 - DNA, 13 bp, Homo sapiens
cttcctctcaggc

SEQ ID NO: 4244391 - DNA, 15 bp, Homo sapiens
cttcctgtccccagg

SEQ ID NO: 4244392 - DNA, 18 bp, Homo sapiens
cttcctgtccccagggga

SEQ ID NO: 4244393 - DNA, 13 bp, Homo sapiens
cttctcacttttt

SEQ ID NO: 4244394 - DNA, 14 bp, Homo sapiens
cttctccccagaat

SEQ ID NO: 4244395 - DNA, 16 bp, Homo sapiens
cttctcttaaacttgt

SEQ ID NO: 4244396 - DNA, 19 bp, Homo sapiens
cttctcttaaacttgtgaa

SEQ ID NO: 4244397 - DNA, 13 bp, Homo sapiens
cttcttgttcccc

SEQ ID NO: 4244398 - DNA, 21 bp, Homo sapiens
cttcttttactggactgtctg

SEQ ID NO: 4244399 - DNA, 16 bp, Homo sapiens
cttgagacaatgtttt

SEQ ID NO: 4244400 - DNA, 19 bp, Homo sapiens
cttgagccttgaactttga

SEQ ID NO: 4244401 - DNA, 18 bp, Homo sapiens
cttgagctttctgtgcat

SEQ ID NO: 4244402 - DNA, 19 bp, Homo sapiens
cttgagctttctgtgcatg

SEQ ID NO: 4244403 - DNA, 20 bp, Homo sapiens
cttgagctttctgtgcatgt

SEQ ID NO: 4244404 - DNA, 21 bp, Homo sapiens
cttgagctttctgtgcatgtg

SEQ ID NO: 4244405 - DNA, 12 bp, Homo sapiens
cttgcaaagtat

SEQ ID NO: 4244406 - DNA, 22 bp, Homo sapiens
cttgcaaagtatccctactgta

SEQ ID NO: 4244407 - DNA, 13 bp, Homo sapiens
cttgcactgtcca

SEQ ID NO: 4244408 - DNA, 14 bp, Homo sapiens
cttgggaccccaga

SEQ ID NO: 4244409 - DNA, 16 bp, Homo sapiens
cttgggaccccagaga

SEQ ID NO: 4244410 - DNA, 22 bp, Homo sapiens
cttgggtcctactcctggagca

SEQ ID NO: 4244411 - DNA, 22 bp, Homo sapiens
cttgtacataatgcgtgcatac

SEQ ID NO: 4244412 - DNA, 17 bp, Homo sapiens
cttgtgaatgcttctca

SEQ ID NO: 4244413 - DNA, 13 bp, Homo sapiens
cttgttcatatgg

SEQ ID NO: 4244414 - DNA, 19 bp, Homo sapiens
ctttaccttttttatacat

SEQ ID NO: 4244415 - DNA, 16 bp, Homo sapiens
ctttccaaagtacact

SEQ ID NO: 4244416 - DNA, 18 bp, Homo sapiens
ctttctggctatgcattt

SEQ ID NO: 4244417 - DNA, 20 bp, Homo sapiens
ctttctggctatgcatttga

SEQ ID NO: 4244418 - DNA, 18 bp, Homo sapiens
ctttcttgcactgtccag

SEQ ID NO: 4244419 - DNA, 12 bp, Homo sapiens
ctttctttgatt

SEQ ID NO: 4244420 - DNA, 17 bp, Homo sapiens
ctttctttgattctcct

SEQ ID NO: 4244421 - DNA, 19 bp, Homo sapiens
ctttgaaacctgctctgta

SEQ ID NO: 4244422 - DNA, 17 bp, Homo sapiens
ctttgacctctgcagca

SEQ ID NO: 4244423 - DNA, 21 bp, Homo sapiens
ctttgccatcaatgatcatat

SEQ ID NO: 4244424 - DNA, 22 bp, Homo sapiens
ctttgggccaatttactggcca

SEQ ID NO: 4244425 - DNA, 15 bp, Homo sapiens
ctttgtcccggggct

SEQ ID NO: 4244426 - DNA, 13 bp, Homo sapiens
ctttgtctgtcca

SEQ ID NO: 4244427 - DNA, 17 bp, Homo sapiens
ctttgtgatttttgtaa

SEQ ID NO: 4244428 - DNA, 18 bp, Homo sapiens
ctttgtgatttttgtaat

SEQ ID NO: 4244429 - DNA, 19 bp, Homo sapiens
ctttgtggaccaattattg

SEQ ID NO: 4244430 - DNA, 22 bp, Homo sapiens
cttttactggactgtctgatca

SEQ ID NO: 4244431 - DNA, 18 bp, Homo sapiens
cttttataaactttacct

SEQ ID NO: 4244432 - DNA, 21 bp, Homo sapiens
cttttatataagtgacttgaa

SEQ ID NO: 4244433 - DNA, 17 bp, Homo sapiens
cttttatgcagcaaata

SEQ ID NO: 4244434 - DNA, 14 bp, Homo sapiens
cttttcccctgtta

SEQ ID NO: 4244435 - DNA, 15 bp, Homo sapiens
cttttcccctgttaa

SEQ ID NO: 4244436 - DNA, 16 bp, Homo sapiens
cttttcccctgttaaa

SEQ ID NO: 4244437 - DNA, 19 bp, Homo sapiens
cttttccttcattcatagg

SEQ ID NO: 4244438 - DNA, 17 bp, Homo sapiens
cttttctatttacctcc

SEQ ID NO: 4244439 - DNA, 19 bp, Homo sapiens
cttttgaaaaaaaagtttt

SEQ ID NO: 4244440 - DNA, 18 bp, Homo sapiens
cttttgccactgctgtgt

SEQ ID NO: 4244441 - DNA, 16 bp, Homo sapiens
cttttgccgttattaa

SEQ ID NO: 4244442 - DNA, 12 bp, Homo sapiens
cttttgtgcatt

SEQ ID NO: 4244443 - DNA, 13 bp, Homo sapiens
cttttgtgcatta

SEQ ID NO: 4244444 - DNA, 12 bp, Homo sapiens
cttttgtttcca

SEQ ID NO: 4244445 - DNA, 17 bp, Homo sapiens
ctttttaagaatatttt

SEQ ID NO: 4244446 - DNA, 15 bp, Homo sapiens
cttttttatacataa

SEQ ID NO: 4244447 - DNA, 16 bp, Homo sapiens
cttttttatacataaa

SEQ ID NO: 4244448 - DNA, 18 bp, Homo sapiens
cttttttatacataaaca

SEQ ID NO: 4244449 - DNA, 23 bp, Homo sapiens
ctttttttggtataatgtttaaa

SEQ ID NO: 4244450 - DNA, 20 bp, Homo sapiens
ctttttttttttaagaaaaa

SEQ ID NO: 4244451 - DNA, 19 bp, Homo sapiens
gaaaaaaaagtttttaatt

SEQ ID NO: 4244452 - DNA, 12 bp, Homo sapiens
gaaaaaggcagt

SEQ ID NO: 4244453 - DNA, 14 bp, Homo sapiens
gaaaacatgctaca

SEQ ID NO: 4244454 - DNA, 18 bp, Homo sapiens
gaaaacatgctacacact

SEQ ID NO: 4244455 - DNA, 18 bp, Homo sapiens
gaaaaccatctctgtgat

SEQ ID NO: 4244456 - DNA, 22 bp, Homo sapiens
gaaaataaacagacaaaaacaa

SEQ ID NO: 4244457 - DNA, 22 bp, Homo sapiens
gaaaatttagccctttaaaacg

SEQ ID NO: 4244458 - DNA, 19 bp, Homo sapiens
gaaacctgctctgtaggag

SEQ ID NO: 4244459 - DNA, 17 bp, Homo sapiens
gaaactggattaaaaca

SEQ ID NO: 4244460 - DNA, 23 bp, Homo sapiens
gaaaggttttgtattttttaaaa

SEQ ID NO: 4244461 - DNA, 19 bp, Homo sapiens
gaaataatgtacatctggc

SEQ ID NO: 4244462 - DNA, 17 bp, Homo sapiens
gaaatataggaacttaa

SEQ ID NO: 4244463 - DNA, 20 bp, Homo sapiens
gaaatggactggtttgagat

SEQ ID NO: 4244464 - DNA, 17 bp, Homo sapiens
gaaatggatgcaaagta

SEQ ID NO: 4244465 - DNA, 19 bp, Homo sapiens
gaaatgggaaaaaacttaa

SEQ ID NO: 4244466 - DNA, 15 bp, Homo sapiens
gaacacattttaaat

SEQ ID NO: 4244467 - DNA, 15 bp, Homo sapiens
gaacatacttcaaaa

SEQ ID NO: 4244468 - DNA, 21 bp, Homo sapiens
gaacatacttcaaaaataatg

SEQ ID NO: 4244469 - DNA, 13 bp, Homo sapiens
gaaccaaagctca

SEQ ID NO: 4244470 - DNA, 16 bp, Homo sapiens
gaactcagtgccacac

SEQ ID NO: 4244471 - DNA, 19 bp, Homo sapiens
gaagagacaaagatttctt

SEQ ID NO: 4244472 - DNA, 19 bp, Homo sapiens
gaagattaggagaaacaca

SEQ ID NO: 4244473 - DNA, 22 bp, Homo sapiens
gaagctcccacacccacctctg

SEQ ID NO: 4244474 - DNA, 13 bp, Homo sapiens
gaaggacatagag

SEQ ID NO: 4244475 - DNA, 12 bp, Homo sapiens
gaaggatacaaa

SEQ ID NO: 4244476 - DNA, 20 bp, Homo sapiens
gaagtaatatgcacacattt

SEQ ID NO: 4244477 - DNA, 21 bp, Homo sapiens
gaagtaatatgcacacatttt

SEQ ID NO: 4244478 - DNA, 15 bp, Homo sapiens
gaagtatacttttcc

SEQ ID NO: 4244479 - DNA, 18 bp, Homo sapiens
gaagtatacttttcccct

SEQ ID NO: 4244480 - DNA, 12 bp, Homo sapiens
gaagtgcagccc

SEQ ID NO: 4244481 - DNA, 21 bp, Homo sapiens
gaataaactgaatattttgga

SEQ ID NO: 4244482 - DNA, 22 bp, Homo sapiens
gaataaactgaatattttggaa

SEQ ID NO: 4244483 - DNA, 16 bp, Homo sapiens
gaataatggaaacatt

SEQ ID NO: 4244484 - DNA, 20 bp, Homo sapiens
gaataatggaaacattacag

SEQ ID NO: 4244485 - DNA, 15 bp, Homo sapiens
gaatatataaccagt

SEQ ID NO: 4244486 - DNA, 16 bp, Homo sapiens
gaatattttggaaact

SEQ ID NO: 4244487 - DNA, 18 bp, Homo sapiens
gaatattttggaaactgc

SEQ ID NO: 4244488 - DNA, 20 bp, Homo sapiens
gaatattttggaaactgcta

SEQ ID NO: 4244489 - DNA, 21 bp, Homo sapiens
gaatatttttagactatttct

SEQ ID NO: 4244490 - DNA, 17 bp, Homo sapiens
gaatgcacagatatact

SEQ ID NO: 4244491 - DNA, 12 bp, Homo sapiens
gaatgcttctca

SEQ ID NO: 4244492 - DNA, 19 bp, Homo sapiens
gaatgtaaagttatgtatt

SEQ ID NO: 4244493 - DNA, 22 bp, Homo sapiens
gaattctaacattaaatcacag

SEQ ID NO: 4244494 - DNA, 13 bp, Homo sapiens
gaattgaaaaaca

SEQ ID NO: 4244495 - DNA, 14 bp, Homo sapiens
gaattgaaaaacaa

SEQ ID NO: 4244496 - DNA, 14 bp, Homo sapiens
gaattgcagtcatt

SEQ ID NO: 4244497 - DNA, 22 bp, Homo sapiens
gaatttcttttgccgttattaa

SEQ ID NO: 4244498 - DNA, 23 bp, Homo sapiens
gaatttgggagaagcaaatatag

SEQ ID NO: 4244499 - DNA, 17 bp, Homo sapiens
gacaaaaaaatttaaaa

SEQ ID NO: 4244500 - DNA, 23 bp, Homo sapiens
gacaataattctacatgttgtct

SEQ ID NO: 4244501 - DNA, 20 bp, Homo sapiens
gacaatgacttactgtacat

SEQ ID NO: 4244502 - DNA, 16 bp, Homo sapiens
gacaattagaaaaaag

SEQ ID NO: 4244503 - DNA, 12 bp, Homo sapiens
gacaatttatta

SEQ ID NO: 4244504 - DNA, 13 bp, Homo sapiens
gacaatttattat

SEQ ID NO: 4244505 - DNA, 21 bp, Homo sapiens
gacacaatatgtatgcttttt

SEQ ID NO: 4244506 - DNA, 19 bp, Homo sapiens
gacacatgcaaggtcattt

SEQ ID NO: 4244507 - DNA, 12 bp, Homo sapiens
gacagagcccgg

SEQ ID NO: 4244508 - DNA, 18 bp, Homo sapiens
gacagcagggaccgggcg

SEQ ID NO: 4244509 - DNA, 23 bp, Homo sapiens
gacatactaaccagcagaaatgc

SEQ ID NO: 4244510 - DNA, 17 bp, Homo sapiens
gacatttgtttgctgta

SEQ ID NO: 4244511 - DNA, 20 bp, Homo sapiens
gaccaattattgatatatat

SEQ ID NO: 4244512 - DNA, 19 bp, Homo sapiens
gaccacgccccaggacctc

SEQ ID NO: 4244513 - DNA, 16 bp, Homo sapiens
gaccccagagaaaacc

SEQ ID NO: 4244514 - DNA, 20 bp, Homo sapiens
gaccccgccatgcatgcagc

SEQ ID NO: 4244515 - DNA, 12 bp, Homo sapiens
gacctccggagc

SEQ ID NO: 4244516 - DNA, 15 bp, Homo sapiens
gactacaaaatacaa

SEQ ID NO: 4244517 - DNA, 19 bp, Homo sapiens
gactacttggaactaggct

SEQ ID NO: 4244518 - DNA, 13 bp, Homo sapiens
gactatttctttt

SEQ ID NO: 4244519 - DNA, 19 bp, Homo sapiens
gactatttgctaatgtata

SEQ ID NO: 4244520 - DNA, 19 bp, Homo sapiens
gactctcagcccagaagaa

SEQ ID NO: 4244521 - DNA, 18 bp, Homo sapiens
gactgagtacgttgtgca

SEQ ID NO: 4244522 - DNA, 21 bp, Homo sapiens
gactgagtacgttgtgcattt

SEQ ID NO: 4244523 - DNA, 16 bp, Homo sapiens
gactgtaccacagaca

SEQ ID NO: 4244524 - DNA, 23 bp, Homo sapiens
gactgtaccatggtttgatatgt

SEQ ID NO: 4244525 - DNA, 15 bp, Homo sapiens
gacttactgtacatg

SEQ ID NO: 4244526 - DNA, 16 bp, Homo sapiens
gacttactgtacatga

SEQ ID NO: 4244527 - DNA, 22 bp, Homo sapiens
gacttcaaagtgtgtctgggat

SEQ ID NO: 4244528 - DNA, 18 bp, Homo sapiens
gacttgagacaatgtttt

SEQ ID NO: 4244529 - DNA, 17 bp, Homo sapiens
gacttgtacaaacagta

SEQ ID NO: 4244530 - DNA, 13 bp, Homo sapiens
gacttttgaaaaa

SEQ ID NO: 4244531 - DNA, 13 bp, Homo sapiens
gagaaactgaagc

SEQ ID NO: 4244532 - DNA, 18 bp, Homo sapiens
gagaagttctcaaagtta

SEQ ID NO: 4244533 - DNA, 19 bp, Homo sapiens
gagaagttctcaaagttaa

SEQ ID NO: 4244534 - DNA, 18 bp, Homo sapiens
gagaatcccttaaaatta

SEQ ID NO: 4244535 - DNA, 14 bp, Homo sapiens
gagaatggagacag

SEQ ID NO: 4244536 - DNA, 18 bp, Homo sapiens
gagactcaaaaaaacaaa

SEQ ID NO: 4244537 - DNA, 12 bp, Homo sapiens
gagactctgaga

SEQ ID NO: 4244538 - DNA, 15 bp, Homo sapiens
gagagccctgtccct

SEQ ID NO: 4244539 - DNA, 20 bp, Homo sapiens
gagagttaataggagtattt

SEQ ID NO: 4244540 - DNA, 21 bp, Homo sapiens
gagatcttcccctaacctttg

SEQ ID NO: 4244541 - DNA, 13 bp, Homo sapiens
gagatttacaact

SEQ ID NO: 4244542 - DNA, 18 bp, Homo sapiens
gagcagcatctagtttcc

SEQ ID NO: 4244543 - DNA, 18 bp, Homo sapiens
gagcaggtctttgggaag

SEQ ID NO: 4244544 - DNA, 22 bp, Homo sapiens
gagcccccttcctgtccccagg

SEQ ID NO: 4244545 - DNA, 19 bp, Homo sapiens
gagcccctcatgccacagt

SEQ ID NO: 4244546 - DNA, 20 bp, Homo sapiens
gagccctggcccgcaagagg

SEQ ID NO: 4244547 - DNA, 12 bp, Homo sapiens
gagccctgtccc

SEQ ID NO: 4244548 - DNA, 14 bp, Homo sapiens
gagccctgtccctg

SEQ ID NO: 4244549 - DNA, 15 bp, Homo sapiens
gagccctgtccctgc

SEQ ID NO: 4244550 - DNA, 13 bp, Homo sapiens
gagcgccctgcag

SEQ ID NO: 4244551 - DNA, 18 bp, Homo sapiens
gagcgccctgcagggccg

SEQ ID NO: 4244552 - DNA, 19 bp, Homo sapiens
gagcgccctgcagggccgg

SEQ ID NO: 4244553 - DNA, 16 bp, Homo sapiens
gagctttctgtgcatg

SEQ ID NO: 4244554 - DNA, 19 bp, Homo sapiens
gagctttctgtgcatgtgc

SEQ ID NO: 4244555 - DNA, 21 bp, Homo sapiens
gagctttctgtgcatgtgcag

SEQ ID NO: 4244556 - DNA, 21 bp, Homo sapiens
gaggaaccgaggtgttgccag

SEQ ID NO: 4244557 - DNA, 22 bp, Homo sapiens
gaggaaccgaggtgttgccagt

SEQ ID NO: 4244558 - DNA, 15 bp, Homo sapiens
gaggaactgtacaga

SEQ ID NO: 4244559 - DNA, 16 bp, Homo sapiens
gaggaactgtacagaa

SEQ ID NO: 4244560 - DNA, 15 bp, Homo sapiens
gaggaatgtgaagcc

SEQ ID NO: 4244561 - DNA, 16 bp, Homo sapiens
gaggaatgtgaagcca

SEQ ID NO: 4244562 - DNA, 20 bp, Homo sapiens
gaggaccctggaaatggact

SEQ ID NO: 4244563 - DNA, 17 bp, Homo sapiens
gaggagggagagccctg

SEQ ID NO: 4244564 - DNA, 15 bp, Homo sapiens
gaggcatctgcatgg

SEQ ID NO: 4244565 - DNA, 18 bp, Homo sapiens
gaggcggcctccatgcac

SEQ ID NO: 4244566 - DNA, 17 bp, Homo sapiens
gaggctgtcacagtcct

SEQ ID NO: 4244567 - DNA, 12 bp, Homo sapiens
gagggacagagc

SEQ ID NO: 4244568 - DNA, 20 bp, Homo sapiens
gagggacagagcccgggaga

SEQ ID NO: 4244569 - DNA, 16 bp, Homo sapiens
gagggcaggaccctca

SEQ ID NO: 4244570 - DNA, 21 bp, Homo sapiens
gagggtgaagtgaagacaatg

SEQ ID NO: 4244571 - DNA, 15 bp, Homo sapiens
gagggtggtgggtgg

SEQ ID NO: 4244572 - DNA, 14 bp, Homo sapiens
gagtaatttcattt

SEQ ID NO: 4244573 - DNA, 16 bp, Homo sapiens
gagtacgttgtgcatt

SEQ ID NO: 4244574 - DNA, 20 bp, Homo sapiens
gagtacgttgtgcatttggt

SEQ ID NO: 4244575 - DNA, 12 bp, Homo sapiens
gagtattttaag

SEQ ID NO: 4244576 - DNA, 19 bp, Homo sapiens
gagtggggagggagtctgg

SEQ ID NO: 4244577 - DNA, 14 bp, Homo sapiens
gagtgtgtgtgtgt

SEQ ID NO: 4244578 - DNA, 19 bp, Homo sapiens
gagttcctctttgccctga

SEQ ID NO: 4244579 - DNA, 23 bp, Homo sapiens
gagttggggagaaactgaagccg

SEQ ID NO: 4244580 - DNA, 16 bp, Homo sapiens
gagttgttacattttt

SEQ ID NO: 4244581 - DNA, 20 bp, Homo sapiens
gataataatattgtttttct

SEQ ID NO: 4244582 - DNA, 18 bp, Homo sapiens
gataatacaccactacat

SEQ ID NO: 4244583 - DNA, 23 bp, Homo sapiens
gataatacaccactacattctgt

SEQ ID NO: 4244584 - DNA, 16 bp, Homo sapiens
gatacagttactcaga

SEQ ID NO: 4244585 - DNA, 18 bp, Homo sapiens
gataccaaggtacaactg

SEQ ID NO: 4244586 - DNA, 17 bp, Homo sapiens
gatactgtatcatgaca

SEQ ID NO: 4244587 - DNA, 21 bp, Homo sapiens
gatatatttcacttttgttct

SEQ ID NO: 4244588 - DNA, 23 bp, Homo sapiens
gatatatttcacttttgttctgc

SEQ ID NO: 4244589 - DNA, 21 bp, Homo sapiens
gatattgaaggagaaaataga

SEQ ID NO: 4244590 - DNA, 17 bp, Homo sapiens
gatattgtttaaaattc

SEQ ID NO: 4244591 - DNA, 16 bp, Homo sapiens
gatattttgctttgtg

SEQ ID NO: 4244592 - DNA, 21 bp, Homo sapiens
gatatttttgtacttgatttg

SEQ ID NO: 4244593 - DNA, 20 bp, Homo sapiens
gatccaaattgtgcttctcc

SEQ ID NO: 4244594 - DNA, 14 bp, Homo sapiens
gatccacctgtctc

SEQ ID NO: 4244595 - DNA, 13 bp, Homo sapiens
gatctaaacagtt

SEQ ID NO: 4244596 - DNA, 15 bp, Homo sapiens
gatgaagtatacttt

SEQ ID NO: 4244597 - DNA, 21 bp, Homo sapiens
gatgcaaagtacaatgtgttt

SEQ ID NO: 4244598 - DNA, 22 bp, Homo sapiens
gatgcaggcacttattgtaaat

SEQ ID NO: 4244599 - DNA, 16 bp, Homo sapiens
gatggacgctgccggg

SEQ ID NO: 4244600 - DNA, 18 bp, Homo sapiens
gatggacgctgccgggag

SEQ ID NO: 4244601 - DNA, 19 bp, Homo sapiens
gatggacgctgccgggaga

SEQ ID NO: 4244602 - DNA, 18 bp, Homo sapiens
gatggaggcctacctctc

SEQ ID NO: 4244603 - DNA, 14 bp, Homo sapiens
gatggtgcagacgc

SEQ ID NO: 4244604 - DNA, 23 bp, Homo sapiens
gatgtgaataggttatatgcaag

SEQ ID NO: 4244605 - DNA, 21 bp, Homo sapiens
gatgttttaaggatgcttgta

SEQ ID NO: 4244606 - DNA, 15 bp, Homo sapiens
gattaaacttaatct

SEQ ID NO: 4244607 - DNA, 17 bp, Homo sapiens
gattactgaattgtatc

SEQ ID NO: 4244608 - DNA, 20 bp, Homo sapiens
gattaggagaaacacattct

SEQ ID NO: 4244609 - DNA, 15 bp, Homo sapiens
gattgaaaattcgcc

SEQ ID NO: 4244610 - DNA, 13 bp, Homo sapiens
gatttaacagaaa

SEQ ID NO: 4244611 - DNA, 14 bp, Homo sapiens
gatttaacagaaat

SEQ ID NO: 4244612 - DNA, 15 bp, Homo sapiens
gatttaacagaaatg

SEQ ID NO: 4244613 - DNA, 19 bp, Homo sapiens
gatttaacagaaatgtaca

SEQ ID NO: 4244614 - DNA, 20 bp, Homo sapiens
gatttaacagaaatgtacag

SEQ ID NO: 4244615 - DNA, 15 bp, Homo sapiens
gatttccttcaatgt

SEQ ID NO: 4244616 - DNA, 19 bp, Homo sapiens
gatttctgtttagataata

SEQ ID NO: 4244617 - DNA, 15 bp, Homo sapiens
gatttgatgtgactt

SEQ ID NO: 4244618 - DNA, 19 bp, Homo sapiens
gatttgatgtgactttttt

SEQ ID NO: 4244619 - DNA, 17 bp, Homo sapiens
gattttgaggtaaagat

SEQ ID NO: 4244620 - DNA, 13 bp, Homo sapiens
gcaaaaaactctt

SEQ ID NO: 4244621 - DNA, 21 bp, Homo sapiens
gcaaaggtggcaatgcttaaa

SEQ ID NO: 4244622 - DNA, 14 bp, Homo sapiens
gcaaatatatgatt

SEQ ID NO: 4244623 - DNA, 16 bp, Homo sapiens
gcaaatgacagatttc

SEQ ID NO: 4244624 - DNA, 15 bp, Homo sapiens
gcaacttcagtttta

SEQ ID NO: 4244625 - DNA, 23 bp, Homo sapiens
gcaacttcagttttatttttgcc

SEQ ID NO: 4244626 - DNA, 13 bp, Homo sapiens
gcaagagggacag

SEQ ID NO: 4244627 - DNA, 19 bp, Homo sapiens
gcaagagggacagagcccg

SEQ ID NO: 4244628 - DNA, 16 bp, Homo sapiens
gcaagcaggagtgtgc

SEQ ID NO: 4244629 - DNA, 11 bp, Homo sapiens
gcaataaagca

SEQ ID NO: 4244630 - DNA, 23 bp, Homo sapiens
gcaatcacacgactgtcatctaa

SEQ ID NO: 4244631 - DNA, 17 bp, Homo sapiens
gcaatgcttaaactaaa

SEQ ID NO: 4244632 - DNA, 11 bp, Homo sapiens
gcaattccaat

SEQ ID NO: 4244633 - DNA, 19 bp, Homo sapiens
gcacaaggttggttgctaa

SEQ ID NO: 4244634 - DNA, 14 bp, Homo sapiens
gcacacatttttta

SEQ ID NO: 4244635 - DNA, 16 bp, Homo sapiens
gcacagagttgttaca

SEQ ID NO: 4244636 - DNA, 17 bp, Homo sapiens
gcacagatatactttgt

SEQ ID NO: 4244637 - DNA, 19 bp, Homo sapiens
gcacatcagcacgatttct

SEQ ID NO: 4244638 - DNA, 23 bp, Homo sapiens
gcacctgagggggaaaaaacagt

SEQ ID NO: 4244639 - DNA, 21 bp, Homo sapiens
gcacctggaatatataaccag

SEQ ID NO: 4244640 - DNA, 16 bp, Homo sapiens
gcacgatttctgttta

SEQ ID NO: 4244641 - DNA, 12 bp, Homo sapiens
gcacgtggccag

SEQ ID NO: 4244642 - DNA, 18 bp, Homo sapiens
gcacttacctgcttgagc

SEQ ID NO: 4244643 - DNA, 23 bp, Homo sapiens
gcacttacctgcttgagctttct

SEQ ID NO: 4244644 - DNA, 16 bp, Homo sapiens
gcacttattgtaaatt

SEQ ID NO: 4244645 - DNA, 18 bp, Homo sapiens
gcactttatgtggagact

SEQ ID NO: 4244646 - DNA, 11 bp, Homo sapiens
gcagaataatg

SEQ ID NO: 4244647 - DNA, 15 bp, Homo sapiens
gcagaataatggaaa

SEQ ID NO: 4244648 - DNA, 16 bp, Homo sapiens
gcagaataatggaaac

SEQ ID NO: 4244649 - DNA, 18 bp, Homo sapiens
gcagacagaaactggatt

SEQ ID NO: 4244650 - DNA, 18 bp, Homo sapiens
gcagaccagctggcgggt

SEQ ID NO: 4244651 - DNA, 19 bp, Homo sapiens
gcagcccctctcacaggca

SEQ ID NO: 4244652 - DNA, 22 bp, Homo sapiens
gcagcccctctcacaggcagct

SEQ ID NO: 4244653 - DNA, 12 bp, Homo sapiens
gcagctagtgcc

SEQ ID NO: 4244654 - DNA, 15 bp, Homo sapiens
gcagctagtgccttt

SEQ ID NO: 4244655 - DNA, 16 bp, Homo sapiens
gcagggccgggcaggg

SEQ ID NO: 4244656 - DNA, 16 bp, Homo sapiens
gcagggcgcccagcgc

SEQ ID NO: 4244657 - DNA, 17 bp, Homo sapiens
gcagggcgcccagcgcc

SEQ ID NO: 4244658 - DNA, 13 bp, Homo sapiens
gcagtgactttgt

SEQ ID NO: 4244659 - DNA, 18 bp, Homo sapiens
gcagtgagagttcctctt

SEQ ID NO: 4244660 - DNA, 20 bp, Homo sapiens
gcagtggtggttttctgttc

SEQ ID NO: 4244661 - DNA, 23 bp, Homo sapiens
gcagtggtggttttctgttcttt

SEQ ID NO: 4244662 - DNA, 18 bp, Homo sapiens
gcataaataaaactgaat

SEQ ID NO: 4244663 - DNA, 19 bp, Homo sapiens
gcataaataaaactgaatc

SEQ ID NO: 4244664 - DNA, 17 bp, Homo sapiens
gcataatgataaaataa

SEQ ID NO: 4244665 - DNA, 15 bp, Homo sapiens
gcataccacttttgt

SEQ ID NO: 4244666 - DNA, 20 bp, Homo sapiens
gcataccacttttgttcttg

SEQ ID NO: 4244667 - DNA, 14 bp, Homo sapiens
gcatacgtacacat

SEQ ID NO: 4244668 - DNA, 15 bp, Homo sapiens
gcatacgtacacatt

SEQ ID NO: 4244669 - DNA, 19 bp, Homo sapiens
gcatacgtacacattttat

SEQ ID NO: 4244670 - DNA, 13 bp, Homo sapiens
gcatctgcatggg

SEQ ID NO: 4244671 - DNA, 18 bp, Homo sapiens
gcatgaagtaatatgcac

SEQ ID NO: 4244672 - DNA, 13 bp, Homo sapiens
gcatgcaatttga

SEQ ID NO: 4244673 - DNA, 16 bp, Homo sapiens
gcatggagactctgag

SEQ ID NO: 4244674 - DNA, 20 bp, Homo sapiens
gcatggagactctgagagcg

SEQ ID NO: 4244675 - DNA, 17 bp, Homo sapiens
gcattatctagatactg

SEQ ID NO: 4244676 - DNA, 14 bp, Homo sapiens
gcattcaaaatctt

SEQ ID NO: 4244677 - DNA, 16 bp, Homo sapiens
gcattcattctgagcc

SEQ ID NO: 4244678 - DNA, 18 bp, Homo sapiens
gcattctcggtacttctg

SEQ ID NO: 4244679 - DNA, 12 bp, Homo sapiens
gcattctttccc

SEQ ID NO: 4244680 - DNA, 14 bp, Homo sapiens
gcatttgaaaattt

SEQ ID NO: 4244681 - DNA, 16 bp, Homo sapiens
gcatttgaaaattttg

SEQ ID NO: 4244682 - DNA, 19 bp, Homo sapiens
gcatttgaggtctgttctt

SEQ ID NO: 4244683 - DNA, 20 bp, Homo sapiens
gcatttgaggtctgttcttt

SEQ ID NO: 4244684 - DNA, 17 bp, Homo sapiens
gccaatttactggccac

SEQ ID NO: 4244685 - DNA, 17 bp, Homo sapiens
gccaccatggccagcca

SEQ ID NO: 4244686 - DNA, 18 bp, Homo sapiens
gccaccatggccagccaa

SEQ ID NO: 4244687 - DNA, 22 bp, Homo sapiens
gccagatggactccagcctgcc

SEQ ID NO: 4244688 - DNA, 18 bp, Homo sapiens
gccagctgccccagccag

SEQ ID NO: 4244689 - DNA, 12 bp, Homo sapiens
gccagctgtgca

SEQ ID NO: 4244690 - DNA, 14 bp, Homo sapiens
gccagctgtgcact

SEQ ID NO: 4244691 - DNA, 17 bp, Homo sapiens
gccagctgtgcactttc

SEQ ID NO: 4244692 - DNA, 14 bp, Homo sapiens
gccaggagccctgg

SEQ ID NO: 4244693 - DNA, 13 bp, Homo sapiens
gccaggccctcag

SEQ ID NO: 4244694 - DNA, 17 bp, Homo sapiens
gccaggcctcttggcag

SEQ ID NO: 4244695 - DNA, 15 bp, Homo sapiens
gccaggtgctgggaa

SEQ ID NO: 4244696 - DNA, 22 bp, Homo sapiens
gccagtctcactgtgggaaggc

SEQ ID NO: 4244697 - DNA, 22 bp, Homo sapiens
gccatcgcgggatggtgcagac

SEQ ID NO: 4244698 - DNA, 19 bp, Homo sapiens
gccatgggaaatgagccag

SEQ ID NO: 4244699 - DNA, 17 bp, Homo sapiens
gcccagccaaaccctgt

SEQ ID NO: 4244700 - DNA, 20 bp, Homo sapiens
gcccagccaaaccctgtctg

SEQ ID NO: 4244701 - DNA, 17 bp, Homo sapiens
gcccagccctctgtggc

SEQ ID NO: 4244702 - DNA, 17 bp, Homo sapiens
gcccagctaatttttgt

SEQ ID NO: 4244703 - DNA, 15 bp, Homo sapiens
gcccccttcctgtcc

SEQ ID NO: 4244704 - DNA, 22 bp, Homo sapiens
gcccccttcctgtccccagggg

SEQ ID NO: 4244705 - DNA, 13 bp, Homo sapiens
gccccgccgcaga

SEQ ID NO: 4244706 - DNA, 16 bp, Homo sapiens
gcccctcatgccacag

SEQ ID NO: 4244707 - DNA, 22 bp, Homo sapiens
gcccctctcacaggcagctctg

SEQ ID NO: 4244708 - DNA, 22 bp, Homo sapiens
gcccgagctgtttatgttttta

SEQ ID NO: 4244709 - DNA, 21 bp, Homo sapiens
gcccgcaagagggacagagcc

SEQ ID NO: 4244710 - DNA, 17 bp, Homo sapiens
gcccgccctcccggaga

SEQ ID NO: 4244711 - DNA, 16 bp, Homo sapiens
gcccgggagagactcg

SEQ ID NO: 4244712 - DNA, 17 bp, Homo sapiens
gccctctgtggccagga

SEQ ID NO: 4244713 - DNA, 23 bp, Homo sapiens
gccctctgtggccaggagccctg

SEQ ID NO: 4244714 - DNA, 13 bp, Homo sapiens
gccctgcagggcc

SEQ ID NO: 4244715 - DNA, 16 bp, Homo sapiens
gccctgcagggccggg

SEQ ID NO: 4244716 - DNA, 18 bp, Homo sapiens
gcccttacacgtgcgtgt

SEQ ID NO: 4244717 - DNA, 20 bp, Homo sapiens
gcccttacacgtgcgtgtga

SEQ ID NO: 4244718 - DNA, 14 bp, Homo sapiens
gcccttctgccctt

SEQ ID NO: 4244719 - DNA, 19 bp, Homo sapiens
gccgaggaatgtgaagcca

SEQ ID NO: 4244720 - DNA, 17 bp, Homo sapiens
gccgcagaccagctggc

SEQ ID NO: 4244721 - DNA, 13 bp, Homo sapiens
gccgcctgcagcc

SEQ ID NO: 4244722 - DNA, 17 bp, Homo sapiens
gccgtgtgtgcatgtgc

SEQ ID NO: 4244723 - DNA, 20 bp, Homo sapiens
gcctagcatacgtacacatt

SEQ ID NO: 4244724 - DNA, 17 bp, Homo sapiens
gcctccaacccagcagt

SEQ ID NO: 4244725 - DNA, 17 bp, Homo sapiens
gcctcgtgctccgcagg

SEQ ID NO: 4244726 - DNA, 21 bp, Homo sapiens
gcctcttttcagtagtgagca

SEQ ID NO: 4244727 - DNA, 23 bp, Homo sapiens
gcctgcagcccgtgtccaggagc

SEQ ID NO: 4244728 - DNA, 13 bp, Homo sapiens
gcctgcctggcag

SEQ ID NO: 4244729 - DNA, 17 bp, Homo sapiens
gcctgctgggtgccagg

SEQ ID NO: 4244730 - DNA, 20 bp, Homo sapiens
gcctgctgggtgccaggtgc

SEQ ID NO: 4244731 - DNA, 21 bp, Homo sapiens
gcctgctgggtgccaggtgct

SEQ ID NO: 4244732 - DNA, 13 bp, Homo sapiens
gcctggagctttc

SEQ ID NO: 4244733 - DNA, 15 bp, Homo sapiens
gcctggagctttcct

SEQ ID NO: 4244734 - DNA, 19 bp, Homo sapiens
gccttaccctcatgttctt

SEQ ID NO: 4244735 - DNA, 18 bp, Homo sapiens
gccttccacagtgaatgt

SEQ ID NO: 4244736 - DNA, 16 bp, Homo sapiens
gccttcccgggcgggc

SEQ ID NO: 4244737 - DNA, 16 bp, Homo sapiens
gccttttatctgcaga

SEQ ID NO: 4244738 - DNA, 17 bp, Homo sapiens
gcgaattgtgtggagaa

SEQ ID NO: 4244739 - DNA, 18 bp, Homo sapiens
gcgagaactacgcacagc

SEQ ID NO: 4244740 - DNA, 17 bp, Homo sapiens
gcgccctgcagggccgg

SEQ ID NO: 4244741 - DNA, 19 bp, Homo sapiens
gcgccctgcagggccgggc

SEQ ID NO: 4244742 - DNA, 21 bp, Homo sapiens
gcgctcttgggaccccagaga

SEQ ID NO: 4244743 - DNA, 19 bp, Homo sapiens
gcgcttgggaggggccgga

SEQ ID NO: 4244744 - DNA, 16 bp, Homo sapiens
gcggccccgccgcaga

SEQ ID NO: 4244745 - DNA, 14 bp, Homo sapiens
gcgggcaaggagtg

SEQ ID NO: 4244746 - DNA, 20 bp, Homo sapiens
gcgggtgtggagaccaggct

SEQ ID NO: 4244747 - DNA, 19 bp, Homo sapiens
gcgtcccccgttgtgcctg

SEQ ID NO: 4244748 - DNA, 19 bp, Homo sapiens
gcgtcctgtccacacccag

SEQ ID NO: 4244749 - DNA, 21 bp, Homo sapiens
gcgtcctgtccacacccagct

SEQ ID NO: 4244750 - DNA, 17 bp, Homo sapiens
gcgtttctatgacacat

SEQ ID NO: 4244751 - DNA, 18 bp, Homo sapiens
gcgtttctatgacacatg

SEQ ID NO: 4244752 - DNA, 18 bp, Homo sapiens
gctaaattctatgttaaa

SEQ ID NO: 4244753 - DNA, 22 bp, Homo sapiens
gctaaattctatgttaaatact

SEQ ID NO: 4244754 - DNA, 13 bp, Homo sapiens
gctaatttttgta

SEQ ID NO: 4244755 - DNA, 20 bp, Homo sapiens
gctacacactgcatgtttgt

SEQ ID NO: 4244756 - DNA, 20 bp, Homo sapiens
gctacctttgtattctctcc

SEQ ID NO: 4244757 - DNA, 19 bp, Homo sapiens
gctagaggttcaaagatat

SEQ ID NO: 4244758 - DNA, 11 bp, Homo sapiens
gctagtgcctt

SEQ ID NO: 4244759 - DNA, 14 bp, Homo sapiens
gctatggaacataa

SEQ ID NO: 4244760 - DNA, 19 bp, Homo sapiens
gctcaacagacaattagaa

SEQ ID NO: 4244761 - DNA, 16 bp, Homo sapiens
gctcagagcttgaaga

SEQ ID NO: 4244762 - DNA, 15 bp, Homo sapiens
gctcccgcagggctg

SEQ ID NO: 4244763 - DNA, 16 bp, Homo sapiens
gctccctgtggcactc

SEQ ID NO: 4244764 - DNA, 13 bp, Homo sapiens
gctccgcagggcg

SEQ ID NO: 4244765 - DNA, 15 bp, Homo sapiens
gctccgcagggcgcc

SEQ ID NO: 4244766 - DNA, 22 bp, Homo sapiens
gctcctagcagacagaaactgg

SEQ ID NO: 4244767 - DNA, 17 bp, Homo sapiens
gctctcttttctgtact

SEQ ID NO: 4244768 - DNA, 19 bp, Homo sapiens
gctctcttttctgtacttc

SEQ ID NO: 4244769 - DNA, 21 bp, Homo sapiens
gctcttgggaccccagagaaa

SEQ ID NO: 4244770 - DNA, 12 bp, Homo sapiens
gctgccccagcc

SEQ ID NO: 4244771 - DNA, 16 bp, Homo sapiens
gctgccccagccagat

SEQ ID NO: 4244772 - DNA, 12 bp, Homo sapiens
gctgccctgagg

SEQ ID NO: 4244773 - DNA, 13 bp, Homo sapiens
gctggaagggtca

SEQ ID NO: 4244774 - DNA, 16 bp, Homo sapiens
gctggccgcctgcagc

SEQ ID NO: 4244775 - DNA, 23 bp, Homo sapiens
gctgggtattggaaatggatgca

SEQ ID NO: 4244776 - DNA, 14 bp, Homo sapiens
gctgggtgccaggt

SEQ ID NO: 4244777 - DNA, 22 bp, Homo sapiens
gctggtagcataaataaaactg

SEQ ID NO: 4244778 - DNA, 19 bp, Homo sapiens
gctggtgtactctaggact

SEQ ID NO: 4244779 - DNA, 13 bp, Homo sapiens
gctgtccctcact

SEQ ID NO: 4244780 - DNA, 22 bp, Homo sapiens
gctgtccgtgcttgctggtgcc

SEQ ID NO: 4244781 - DNA, 16 bp, Homo sapiens
gcttaaactaaataat

SEQ ID NO: 4244782 - DNA, 16 bp, Homo sapiens
gcttaacttcacatat

SEQ ID NO: 4244783 - DNA, 17 bp, Homo sapiens
gcttaacttcacatatt

SEQ ID NO: 4244784 - DNA, 16 bp, Homo sapiens
gcttgagctttctgtg

SEQ ID NO: 4244785 - DNA, 23 bp, Homo sapiens
gcttgagctttctgtgcatgtgc

SEQ ID NO: 4244786 - DNA, 17 bp, Homo sapiens
gcttgggaggggccgga

SEQ ID NO: 4244787 - DNA, 21 bp, Homo sapiens
gcttgggtcctactcctggag

SEQ ID NO: 4244788 - DNA, 16 bp, Homo sapiens
gcttgtacataatgcg

SEQ ID NO: 4244789 - DNA, 13 bp, Homo sapiens
gctttctgtgcat

SEQ ID NO: 4244790 - DNA, 16 bp, Homo sapiens
gctttctgtgcatgtg

SEQ ID NO: 4244791 - DNA, 17 bp, Homo sapiens
gctttctgtgcatgtgc

SEQ ID NO: 4244792 - DNA, 16 bp, Homo sapiens
gctttgtctgtccagc

SEQ ID NO: 4244793 - DNA, 17 bp, Homo sapiens
gctttgtctgtccagcc

SEQ ID NO: 4244794 - DNA, 15 bp, Homo sapiens
gctttgtgatttttg

SEQ ID NO: 4244795 - DNA, 15 bp, Homo sapiens
gcttttaaaatgtag

SEQ ID NO: 4244796 - DNA, 13 bp, Homo sapiens
gcttttgtgcatt

SEQ ID NO: 4244797 - DNA, 17 bp, Homo sapiens
ggaaactgctaaattct

SEQ ID NO: 4244798 - DNA, 18 bp, Homo sapiens
ggaaatctcaccccatcc

SEQ ID NO: 4244799 - DNA, 23 bp, Homo sapiens
ggaaatgggaaaaaacttaaaaa

SEQ ID NO: 4244800 - DNA, 14 bp, Homo sapiens
ggaagaaggcagtg

SEQ ID NO: 4244801 - DNA, 13 bp, Homo sapiens
ggaagagacaaag

SEQ ID NO: 4244802 - DNA, 19 bp, Homo sapiens
ggaagggcgggcaaggagt

SEQ ID NO: 4244803 - DNA, 21 bp, Homo sapiens
ggaagtcttgggtgttagtgt

SEQ ID NO: 4244804 - DNA, 23 bp, Homo sapiens
ggaagttttaactttaatacagc

SEQ ID NO: 4244805 - DNA, 22 bp, Homo sapiens
ggaatcattccagtgctagaaa

SEQ ID NO: 4244806 - DNA, 11 bp, Homo sapiens
ggacagagccc

SEQ ID NO: 4244807 - DNA, 14 bp, Homo sapiens
ggacagagcccggg

SEQ ID NO: 4244808 - DNA, 12 bp, Homo sapiens
ggacagcaggga

SEQ ID NO: 4244809 - DNA, 23 bp, Homo sapiens
ggacatagaggtatattggaaga

SEQ ID NO: 4244810 - DNA, 21 bp, Homo sapiens
ggaccgtctttacccctgctg

SEQ ID NO: 4244811 - DNA, 22 bp, Homo sapiens
ggactgcacagcgtcctgtcca

SEQ ID NO: 4244812 - DNA, 19 bp, Homo sapiens
ggagaagagttgaggaact

SEQ ID NO: 4244813 - DNA, 21 bp, Homo sapiens
ggagacctctccttcctaccc

SEQ ID NO: 4244814 - DNA, 21 bp, Homo sapiens
ggagagccctgtccctgccct

SEQ ID NO: 4244815 - DNA, 13 bp, Homo sapiens
ggagaggtggccg

SEQ ID NO: 4244816 - DNA, 15 bp, Homo sapiens
ggagcaagcaggagt

SEQ ID NO: 4244817 - DNA, 16 bp, Homo sapiens
ggagccccgccaggtg

SEQ ID NO: 4244818 - DNA, 15 bp, Homo sapiens
ggagcgccctgcagg

SEQ ID NO: 4244819 - DNA, 22 bp, Homo sapiens
ggagcgccctgcagggccgggc

SEQ ID NO: 4244820 - DNA, 23 bp, Homo sapiens
ggagcgccctgcagggccgggca

SEQ ID NO: 4244821 - DNA, 14 bp, Homo sapiens
ggagctgctgggtg

SEQ ID NO: 4244822 - DNA, 16 bp, Homo sapiens
ggagctgctgggtggc

SEQ ID NO: 4244823 - DNA, 18 bp, Homo sapiens
ggagctgctgggtggcag

SEQ ID NO: 4244824 - DNA, 20 bp, Homo sapiens
ggagctgctgggtggcaggg

SEQ ID NO: 4244825 - DNA, 22 bp, Homo sapiens
ggagctttcctgatgatgctgg

SEQ ID NO: 4244826 - DNA, 23 bp, Homo sapiens
ggagctttcctgatgatgctggc

SEQ ID NO: 4244827 - DNA, 13 bp, Homo sapiens
ggaggagggagag

SEQ ID NO: 4244828 - DNA, 18 bp, Homo sapiens
ggaggagggagagccctg

SEQ ID NO: 4244829 - DNA, 16 bp, Homo sapiens
ggaggcctacctctcg

SEQ ID NO: 4244830 - DNA, 14 bp, Homo sapiens
ggagggagagccct

SEQ ID NO: 4244831 - DNA, 22 bp, Homo sapiens
ggagttgtcaagtctctgctgg

SEQ ID NO: 4244832 - DNA, 15 bp, Homo sapiens
ggatgcttgtacata

SEQ ID NO: 4244833 - DNA, 18 bp, Homo sapiens
ggattaaaacaatttttt

SEQ ID NO: 4244834 - DNA, 16 bp, Homo sapiens
ggatttaacagaaatg

SEQ ID NO: 4244835 - DNA, 19 bp, Homo sapiens
ggcaattccaatatttctg

SEQ ID NO: 4244836 - DNA, 13 bp, Homo sapiens
ggcacatcagcac

SEQ ID NO: 4244837 - DNA, 14 bp, Homo sapiens
ggcacgtggccagg

SEQ ID NO: 4244838 - DNA, 19 bp, Homo sapiens
ggcacgtggccaggagcca

SEQ ID NO: 4244839 - DNA, 22 bp, Homo sapiens
ggcacttattgtaaattttaga

SEQ ID NO: 4244840 - DNA, 16 bp, Homo sapiens
ggcagctagtgccttt

SEQ ID NO: 4244841 - DNA, 13 bp, Homo sapiens
ggcagctctgagc

SEQ ID NO: 4244842 - DNA, 14 bp, Homo sapiens
ggcatcatcctcag

SEQ ID NO: 4244843 - DNA, 13 bp, Homo sapiens
ggcatggagactc

SEQ ID NO: 4244844 - DNA, 21 bp, Homo sapiens
ggcatggtggctcatgcctgt

SEQ ID NO: 4244845 - DNA, 17 bp, Homo sapiens
ggccaatttactggcca

SEQ ID NO: 4244846 - DNA, 18 bp, Homo sapiens
ggccaatttactggccac

SEQ ID NO: 4244847 - DNA, 19 bp, Homo sapiens
ggccactgcgctcttggga

SEQ ID NO: 4244848 - DNA, 13 bp, Homo sapiens
ggccaggagccct

SEQ ID NO: 4244849 - DNA, 14 bp, Homo sapiens
ggccaggagccctg

SEQ ID NO: 4244850 - DNA, 15 bp, Homo sapiens
ggccaggagccctgg

SEQ ID NO: 4244851 - DNA, 17 bp, Homo sapiens
ggccaggagccctggcc

SEQ ID NO: 4244852 - DNA, 16 bp, Homo sapiens
ggccagtacctttcca

SEQ ID NO: 4244853 - DNA, 12 bp, Homo sapiens
ggcccggaagaa

SEQ ID NO: 4244854 - DNA, 21 bp, Homo sapiens
ggccctcagtcttcctgccgg

SEQ ID NO: 4244855 - DNA, 22 bp, Homo sapiens
ggccctttcttgcactgtccag

SEQ ID NO: 4244856 - DNA, 13 bp, Homo sapiens
ggccgcccggcag

SEQ ID NO: 4244857 - DNA, 17 bp, Homo sapiens
ggccgcccggcagtgca

SEQ ID NO: 4244858 - DNA, 14 bp, Homo sapiens
ggccgggcaggggg

SEQ ID NO: 4244859 - DNA, 16 bp, Homo sapiens
ggccgggcagggggac

SEQ ID NO: 4244860 - DNA, 20 bp, Homo sapiens
ggcctagcatacgtacacat

SEQ ID NO: 4244861 - DNA, 23 bp, Homo sapiens
ggcctagcatacgtacacatttt

SEQ ID NO: 4244862 - DNA, 13 bp, Homo sapiens
ggcctcttggcag

SEQ ID NO: 4244863 - DNA, 17 bp, Homo sapiens
ggcgatccacctgtctc

SEQ ID NO: 4244864 - DNA, 18 bp, Homo sapiens
ggcgatccacctgtctca

SEQ ID NO: 4244865 - DNA, 20 bp, Homo sapiens
ggcggcccggccggagggca

SEQ ID NO: 4244866 - DNA, 18 bp, Homo sapiens
ggcgggtgatgagacctg

SEQ ID NO: 4244867 - DNA, 19 bp, Homo sapiens
ggcgggtgatgagacctgg

SEQ ID NO: 4244868 - DNA, 13 bp, Homo sapiens
ggctactctgccc

SEQ ID NO: 4244869 - DNA, 13 bp, Homo sapiens
ggctatgcatttg

SEQ ID NO: 4244870 - DNA, 20 bp, Homo sapiens
ggctcacgtcgcggccgcct

SEQ ID NO: 4244871 - DNA, 21 bp, Homo sapiens
ggctcatgcctgtaatctcag

SEQ ID NO: 4244872 - DNA, 11 bp, Homo sapiens
ggctccccagt

SEQ ID NO: 4244873 - DNA, 15 bp, Homo sapiens
ggctgctgcaggccg

SEQ ID NO: 4244874 - DNA, 19 bp, Homo sapiens
ggctggagtggagtggcgt

SEQ ID NO: 4244875 - DNA, 23 bp, Homo sapiens
ggcttgttgacttcgcagccccg

SEQ ID NO: 4244876 - DNA, 17 bp, Homo sapiens
gggaacagcctgagccg

SEQ ID NO: 4244877 - DNA, 23 bp, Homo sapiens
gggaagatggagcaggtctttgg

SEQ ID NO: 4244878 - DNA, 22 bp, Homo sapiens
gggaagctcccacacccacctc

SEQ ID NO: 4244879 - DNA, 16 bp, Homo sapiens
gggaaggatacaaaag

SEQ ID NO: 4244880 - DNA, 16 bp, Homo sapiens
gggaatacatctgtgg

SEQ ID NO: 4244881 - DNA, 21 bp, Homo sapiens
gggaatctaatatccccaaat

SEQ ID NO: 4244882 - DNA, 15 bp, Homo sapiens
gggaattgaaaaaaa

SEQ ID NO: 4244883 - DNA, 12 bp, Homo sapiens
gggacagagccc

SEQ ID NO: 4244884 - DNA, 13 bp, Homo sapiens
gggacagagcccg

SEQ ID NO: 4244885 - DNA, 14 bp, Homo sapiens
gggacagagcccgg

SEQ ID NO: 4244886 - DNA, 19 bp, Homo sapiens
gggaccgggcgcagccctc

SEQ ID NO: 4244887 - DNA, 11 bp, Homo sapiens
gggagagccct

SEQ ID NO: 4244888 - DNA, 22 bp, Homo sapiens
gggagcatttaatggcagctag

SEQ ID NO: 4244889 - DNA, 13 bp, Homo sapiens
gggagctgctggg

SEQ ID NO: 4244890 - DNA, 19 bp, Homo sapiens
gggagctgctgggtggcag

SEQ ID NO: 4244891 - DNA, 14 bp, Homo sapiens
gggagggagtctgg

SEQ ID NO: 4244892 - DNA, 16 bp, Homo sapiens
gggcagggggacagca

SEQ ID NO: 4244893 - DNA, 21 bp, Homo sapiens
gggcatggtggctcatgcctg

SEQ ID NO: 4244894 - DNA, 20 bp, Homo sapiens
gggccctttcttgcactgtc

SEQ ID NO: 4244895 - DNA, 13 bp, Homo sapiens
gggccgggcaggg

SEQ ID NO: 4244896 - DNA, 22 bp, Homo sapiens
ggggactcggagggtgccgtgc

SEQ ID NO: 4244897 - DNA, 17 bp, Homo sapiens
ggggattcccttccttc

SEQ ID NO: 4244898 - DNA, 20 bp, Homo sapiens
ggggcgggtgatgagacctg

SEQ ID NO: 4244899 - DNA, 14 bp, Homo sapiens
gggggacagcaggg

SEQ ID NO: 4244900 - DNA, 21 bp, Homo sapiens
ggggtttagaaccccaggtga

SEQ ID NO: 4244901 - DNA, 12 bp, Homo sapiens
gggtattggaaa

SEQ ID NO: 4244902 - DNA, 19 bp, Homo sapiens
gggtcctactcctggagca

SEQ ID NO: 4244903 - DNA, 14 bp, Homo sapiens
gggtggggaaggga

SEQ ID NO: 4244904 - DNA, 16 bp, Homo sapiens
gggttgaaaatgtgtt

SEQ ID NO: 4244905 - DNA, 14 bp, Homo sapiens
gggtttgagacaga

SEQ ID NO: 4244906 - DNA, 16 bp, Homo sapiens
gggtttgagacagaca

SEQ ID NO: 4244907 - DNA, 14 bp, Homo sapiens
ggtaacagtggctg

SEQ ID NO: 4244908 - DNA, 16 bp, Homo sapiens
ggtacccaattcaatt

SEQ ID NO: 4244909 - DNA, 15 bp, Homo sapiens
ggtagcataaataaa

SEQ ID NO: 4244910 - DNA, 21 bp, Homo sapiens
ggtagcataaataaaactgaa

SEQ ID NO: 4244911 - DNA, 14 bp, Homo sapiens
ggtataatgtttaa

SEQ ID NO: 4244912 - DNA, 23 bp, Homo sapiens
ggtcaacatcttttacattctgc

SEQ ID NO: 4244913 - DNA, 20 bp, Homo sapiens
ggtcaataacactgtatttt

SEQ ID NO: 4244914 - DNA, 16 bp, Homo sapiens
ggtcctactcctggag

SEQ ID NO: 4244915 - DNA, 17 bp, Homo sapiens
ggtcctactcctggagc

SEQ ID NO: 4244916 - DNA, 21 bp, Homo sapiens
ggtcctactcctggagcactg

SEQ ID NO: 4244917 - DNA, 21 bp, Homo sapiens
ggtcgtcatgctgtccgtgct

SEQ ID NO: 4244918 - DNA, 21 bp, Homo sapiens
ggtctcacagtgttgcccagg

SEQ ID NO: 4244919 - DNA, 23 bp, Homo sapiens
ggtctctccctcccccagagccc

SEQ ID NO: 4244920 - DNA, 12 bp, Homo sapiens
ggtctgttcttt

SEQ ID NO: 4244921 - DNA, 21 bp, Homo sapiens
ggtgaaaataagacaaaaata

SEQ ID NO: 4244922 - DNA, 18 bp, Homo sapiens
ggtgaagtgcctgctggg

SEQ ID NO: 4244923 - DNA, 11 bp, Homo sapiens
ggtgcatctgg

SEQ ID NO: 4244924 - DNA, 16 bp, Homo sapiens
ggtgcatctggcacgt

SEQ ID NO: 4244925 - DNA, 23 bp, Homo sapiens
ggtgcatctggcacgtggccagg

SEQ ID NO: 4244926 - DNA, 17 bp, Homo sapiens
ggtgcccttccctggag

SEQ ID NO: 4244927 - DNA, 18 bp, Homo sapiens
ggtgcccttccctggagg

SEQ ID NO: 4244928 - DNA, 22 bp, Homo sapiens
ggtgcgtcccccgttgtgcctg

SEQ ID NO: 4244929 - DNA, 23 bp, Homo sapiens
ggtgcgtcccccgttgtgcctgg

SEQ ID NO: 4244930 - DNA, 21 bp, Homo sapiens
ggtgcttgttccctctccctg

SEQ ID NO: 4244931 - DNA, 18 bp, Homo sapiens
ggtggttttctgttcttt

SEQ ID NO: 4244932 - DNA, 21 bp, Homo sapiens
ggttcaaagatattttgcttt

SEQ ID NO: 4244933 - DNA, 12 bp, Homo sapiens
ggtttcagaaat

SEQ ID NO: 4244934 - DNA, 13 bp, Homo sapiens
ggtttcagaaatg

SEQ ID NO: 4244935 - DNA, 12 bp, Homo sapiens
ggttttctgttc

SEQ ID NO: 4244936 - DNA, 17 bp, Homo sapiens
gtaaaatgaattgaaaa

SEQ ID NO: 4244937 - DNA, 17 bp, Homo sapiens
gtaaaatgtatttttct

SEQ ID NO: 4244938 - DNA, 17 bp, Homo sapiens
gtaaagttatgtattta

SEQ ID NO: 4244939 - DNA, 11 bp, Homo sapiens
gtaaatatata

SEQ ID NO: 4244940 - DNA, 12 bp, Homo sapiens
gtaaatgcatat

SEQ ID NO: 4244941 - DNA, 19 bp, Homo sapiens
gtaaatgggggtgcatttg

SEQ ID NO: 4244942 - DNA, 16 bp, Homo sapiens
gtaaattaacttttat

SEQ ID NO: 4244943 - DNA, 21 bp, Homo sapiens
gtaaattaacttttataaact

SEQ ID NO: 4244944 - DNA, 22 bp, Homo sapiens
gtaactttactctgtgtttaaa

SEQ ID NO: 4244945 - DNA, 15 bp, Homo sapiens
gtaagtaattatgca

SEQ ID NO: 4244946 - DNA, 16 bp, Homo sapiens
gtaagtatgtttttta

SEQ ID NO: 4244947 - DNA, 14 bp, Homo sapiens
gtaatatgcacaca

SEQ ID NO: 4244948 - DNA, 17 bp, Homo sapiens
gtaatatgcacacattt

SEQ ID NO: 4244949 - DNA, 21 bp, Homo sapiens
gtaattatgcactaaatatga

SEQ ID NO: 4244950 - DNA, 20 bp, Homo sapiens
gtaatttgtgatacaatgct

SEQ ID NO: 4244951 - DNA, 21 bp, Homo sapiens
gtaatttttttatcgtcactg

SEQ ID NO: 4244952 - DNA, 15 bp, Homo sapiens
gtacaactgtattta

SEQ ID NO: 4244953 - DNA, 13 bp, Homo sapiens
gtacaatgtgttt

SEQ ID NO: 4244954 - DNA, 19 bp, Homo sapiens
gtacactgtttcaaacttt

SEQ ID NO: 4244955 - DNA, 17 bp, Homo sapiens
gtacatgaaaacacatt

SEQ ID NO: 4244956 - DNA, 18 bp, Homo sapiens
gtacatgaaaacacattt

SEQ ID NO: 4244957 - DNA, 22 bp, Homo sapiens
gtaccacagacacaatatgtat

SEQ ID NO: 4244958 - DNA, 22 bp, Homo sapiens
gtacgatggaggcctacctctc

SEQ ID NO: 4244959 - DNA, 16 bp, Homo sapiens
gtacgttgtgcatttg

SEQ ID NO: 4244960 - DNA, 11 bp, Homo sapiens
gtactctagga

SEQ ID NO: 4244961 - DNA, 16 bp, Homo sapiens
gtactctaggacttca

SEQ ID NO: 4244962 - DNA, 19 bp, Homo sapiens
gtactctaggacttcaaag

SEQ ID NO: 4244963 - DNA, 21 bp, Homo sapiens
gtacttcctgagtggccaggg

SEQ ID NO: 4244964 - DNA, 23 bp, Homo sapiens
gtacttgaaaaatgtttttattt

SEQ ID NO: 4244965 - DNA, 13 bp, Homo sapiens
gtacttgatttga

SEQ ID NO: 4244966 - DNA, 15 bp, Homo sapiens
gtagaaacttaaaca

SEQ ID NO: 4244967 - DNA, 18 bp, Homo sapiens
gtagacaatcattgtttt

SEQ ID NO: 4244968 - DNA, 20 bp, Homo sapiens
gtagcataaataaaactgaa

SEQ ID NO: 4244969 - DNA, 13 bp, Homo sapiens
gtagcctctggga

SEQ ID NO: 4244970 - DNA, 22 bp, Homo sapiens
gtaggtaaaatgtatttttcta

SEQ ID NO: 4244971 - DNA, 20 bp, Homo sapiens
gtagtttggatatttttgta

SEQ ID NO: 4244972 - DNA, 14 bp, Homo sapiens
gtataatgtttaaa

SEQ ID NO: 4244973 - DNA, 13 bp, Homo sapiens
gtatatatattca

SEQ ID NO: 4244974 - DNA, 14 bp, Homo sapiens
gtatattgagaatc

SEQ ID NO: 4244975 - DNA, 12 bp, Homo sapiens
gtatattggaag

SEQ ID NO: 4244976 - DNA, 15 bp, Homo sapiens
gtatccctactgtaa

SEQ ID NO: 4244977 - DNA, 19 bp, Homo sapiens
gtatcttgacacaggaaat

SEQ ID NO: 4244978 - DNA, 15 bp, Homo sapiens
gtatgaggcatttgt

SEQ ID NO: 4244979 - DNA, 21 bp, Homo sapiens
gtatgttatgatattgtttaa

SEQ ID NO: 4244980 - DNA, 10 bp, Homo sapiens
gtattggaaa

SEQ ID NO: 4244981 - DNA, 22 bp, Homo sapiens
gtattggctagaggttcaaaga

SEQ ID NO: 4244982 - DNA, 13 bp, Homo sapiens
gtattgtaatctt

SEQ ID NO: 4244983 - DNA, 22 bp, Homo sapiens
gtatttatgtaatgaagtaaag

SEQ ID NO: 4244984 - DNA, 15 bp, Homo sapiens
gtattttttaaaaca

SEQ ID NO: 4244985 - DNA, 18 bp, Homo sapiens
gtcaagtgttaggtcaat

SEQ ID NO: 4244986 - DNA, 13 bp, Homo sapiens
gtcagatttttat

SEQ ID NO: 4244987 - DNA, 22 bp, Homo sapiens
gtcagccatgggaaatgagcca

SEQ ID NO: 4244988 - DNA, 23 bp, Homo sapiens
gtcagccatgggaaatgagccag

SEQ ID NO: 4244989 - DNA, 11 bp, Homo sapiens
gtcatttttgt

SEQ ID NO: 4244990 - DNA, 19 bp, Homo sapiens
gtcattttttttaagaaaa

SEQ ID NO: 4244991 - DNA, 21 bp, Homo sapiens
gtcattttttttaagaaaaag

SEQ ID NO: 4244992 - DNA, 16 bp, Homo sapiens
gtccactcccaagcca

SEQ ID NO: 4244993 - DNA, 15 bp, Homo sapiens
gtccagccgtgtgtg

SEQ ID NO: 4244994 - DNA, 16 bp, Homo sapiens
gtcccccgttgtgcct

SEQ ID NO: 4244995 - DNA, 17 bp, Homo sapiens
gtcccccgttgtgcctg

SEQ ID NO: 4244996 - DNA, 24 bp, Homo sapiens
gtcccgcgaaacccggtgcatctg

SEQ ID NO: 4244997 - DNA, 15 bp, Homo sapiens
gtcccggggctccac

SEQ ID NO: 4244998 - DNA, 16 bp, Homo sapiens
gtcctactcctggagc

SEQ ID NO: 4244999 - DNA, 18 bp, Homo sapiens
gtcctgtccacacccagc

SEQ ID NO: 4245000 - DNA, 18 bp, Homo sapiens
gtcctgtgttaaacacta

SEQ ID NO: 4245001 - DNA, 17 bp, Homo sapiens
gtccttgcacctgagcc

SEQ ID NO: 4245002 - DNA, 20 bp, Homo sapiens
gtccttgcacctgagcctgt

SEQ ID NO: 4245003 - DNA, 12 bp, Homo sapiens
gtcgttttccaa

SEQ ID NO: 4245004 - DNA, 23 bp, Homo sapiens
gtctcactgtgggaaggccagct

SEQ ID NO: 4245005 - DNA, 22 bp, Homo sapiens
gtctctccctcccccagagccc

SEQ ID NO: 4245006 - DNA, 15 bp, Homo sapiens
gtctctgctggccca

SEQ ID NO: 4245007 - DNA, 16 bp, Homo sapiens
gtctctgctggcccag

SEQ ID NO: 4245008 - DNA, 21 bp, Homo sapiens
gtctctggggcaggctgcttc

SEQ ID NO: 4245009 - DNA, 20 bp, Homo sapiens
gtctggcaggctactctgcc

SEQ ID NO: 4245010 - DNA, 20 bp, Homo sapiens
gtcttaagatggaaatacag

SEQ ID NO: 4245011 - DNA, 16 bp, Homo sapiens
gtcttgaaagtggcac

SEQ ID NO: 4245012 - DNA, 17 bp, Homo sapiens
gtctttacccctgctga

SEQ ID NO: 4245013 - DNA, 17 bp, Homo sapiens
gtgaaaataagacaaaa

SEQ ID NO: 4245014 - DNA, 15 bp, Homo sapiens
gtgactgaatttctt

SEQ ID NO: 4245015 - DNA, 18 bp, Homo sapiens
gtgactgaatttcttttg

SEQ ID NO: 4245016 - DNA, 20 bp, Homo sapiens
gtgatgggagaattggtata

SEQ ID NO: 4245017 - DNA, 12 bp, Homo sapiens
gtgattacctct

SEQ ID NO: 4245018 - DNA, 13 bp, Homo sapiens
gtgatttttgtaa

SEQ ID NO: 4245019 - DNA, 22 bp, Homo sapiens
gtgcagcccctctcacaggcag

SEQ ID NO: 4245020 - DNA, 22 bp, Homo sapiens
gtgcataccacttttgttcttg

SEQ ID NO: 4245021 - DNA, 21 bp, Homo sapiens
gtgcatctggcacgtggccag

SEQ ID NO: 4245022 - DNA, 13 bp, Homo sapiens
gtgcatgtgcagg

SEQ ID NO: 4245023 - DNA, 19 bp, Homo sapiens
gtgcattatctagatactg

SEQ ID NO: 4245024 - DNA, 23 bp, Homo sapiens
gtgcattatctagatactgtatc

SEQ ID NO: 4245025 - DNA, 17 bp, Homo sapiens
gtgcatttgaggtctgt

SEQ ID NO: 4245026 - DNA, 17 bp, Homo sapiens
gtgcccgcgccaggccc

SEQ ID NO: 4245027 - DNA, 21 bp, Homo sapiens
gtgccgaccacgccccaggac

SEQ ID NO: 4245028 - DNA, 19 bp, Homo sapiens
gtgcctcctcagaggacag

SEQ ID NO: 4245029 - DNA, 20 bp, Homo sapiens
gtgcctcctcagaggacagt

SEQ ID NO: 4245030 - DNA, 18 bp, Homo sapiens
gtgcgcacttacctgctt

SEQ ID NO: 4245031 - DNA, 14 bp, Homo sapiens
gtgctaagctgccc

SEQ ID NO: 4245032 - DNA, 19 bp, Homo sapiens
gtgctacctgcacctctgg

SEQ ID NO: 4245033 - DNA, 12 bp, Homo sapiens
gtgctgcattta

SEQ ID NO: 4245034 - DNA, 17 bp, Homo sapiens
gtgcttctccccagaat

SEQ ID NO: 4245035 - DNA, 16 bp, Homo sapiens
gtggatgaggagacag

SEQ ID NO: 4245036 - DNA, 18 bp, Homo sapiens
gtggatttaacagaaatg

SEQ ID NO: 4245037 - DNA, 19 bp, Homo sapiens
gtggatttaacagaaatgt

SEQ ID NO: 4245038 - DNA, 13 bp, Homo sapiens
gtggccaggagcc

SEQ ID NO: 4245039 - DNA, 16 bp, Homo sapiens
gtggccaggagccatg

SEQ ID NO: 4245040 - DNA, 14 bp, Homo sapiens
gtggctcatgcctg

SEQ ID NO: 4245041 - DNA, 18 bp, Homo sapiens
gtgggccccttagcaatg

SEQ ID NO: 4245042 - DNA, 14 bp, Homo sapiens
gtggggaagggaag

SEQ ID NO: 4245043 - DNA, 20 bp, Homo sapiens
gtgggtgaagtgcctgctgg

SEQ ID NO: 4245044 - DNA, 22 bp, Homo sapiens
gtgggtgggatgggcagggaag

SEQ ID NO: 4245045 - DNA, 15 bp, Homo sapiens
gtggtttcagaaatg

SEQ ID NO: 4245046 - DNA, 17 bp, Homo sapiens
gtggttttctgttcttt

SEQ ID NO: 4245047 - DNA, 17 bp, Homo sapiens
gtgtactctaggacttc

SEQ ID NO: 4245048 - DNA, 14 bp, Homo sapiens
gtgtatattttaat

SEQ ID NO: 4245049 - DNA, 17 bp, Homo sapiens
gtgtatttttttactaa

SEQ ID NO: 4245050 - DNA, 23 bp, Homo sapiens
gtgtatttttttactaatagaca

SEQ ID NO: 4245051 - DNA, 15 bp, Homo sapiens
gtgtgagtgtgtgtg

SEQ ID NO: 4245052 - DNA, 14 bp, Homo sapiens
gtgtgcatgtgccg

SEQ ID NO: 4245053 - DNA, 16 bp, Homo sapiens
gtgtgcctggttaata

SEQ ID NO: 4245054 - DNA, 19 bp, Homo sapiens
gtgtggagaactcagtgcc

SEQ ID NO: 4245055 - DNA, 17 bp, Homo sapiens
gtgtggagaccaggctc

SEQ ID NO: 4245056 - DNA, 19 bp, Homo sapiens
gtgtggagaccaggctcct

SEQ ID NO: 4245057 - DNA, 13 bp, Homo sapiens
gtgtgtctgggat

SEQ ID NO: 4245058 - DNA, 15 bp, Homo sapiens
gtgtgtctgggattt

SEQ ID NO: 4245059 - DNA, 22 bp, Homo sapiens
gtgttaaacactacacatttga

SEQ ID NO: 4245060 - DNA, 12 bp, Homo sapiens
gtgttactaagt

SEQ ID NO: 4245061 - DNA, 14 bp, Homo sapiens
gtgttcaatatcag

SEQ ID NO: 4245062 - DNA, 13 bp, Homo sapiens
gtgtttttctcca

SEQ ID NO: 4245063 - DNA, 18 bp, Homo sapiens
gtgtttttctccagtgct

SEQ ID NO: 4245064 - DNA, 17 bp, Homo sapiens
gttaaatactgtgcaga

SEQ ID NO: 4245065 - DNA, 22 bp, Homo sapiens
gttaaatactgtgcagaataat

SEQ ID NO: 4245066 - DNA, 13 bp, Homo sapiens
gttaattcaccta

SEQ ID NO: 4245067 - DNA, 21 bp, Homo sapiens
gttagatctttgtaaatgcat

SEQ ID NO: 4245068 - DNA, 17 bp, Homo sapiens
gttatgatattgtttaa

SEQ ID NO: 4245069 - DNA, 21 bp, Homo sapiens
gttatgatattgtttaaaatt

SEQ ID NO: 4245070 - DNA, 21 bp, Homo sapiens
gttattctaagccctttgcca

SEQ ID NO: 4245071 - DNA, 20 bp, Homo sapiens
gttattttgtgtacaagttg

SEQ ID NO: 4245072 - DNA, 14 bp, Homo sapiens
gttctatccaaaca

SEQ ID NO: 4245073 - DNA, 21 bp, Homo sapiens
gttctatccaaacatgtattt

SEQ ID NO: 4245074 - DNA, 17 bp, Homo sapiens
gttctgctttatctttt

SEQ ID NO: 4245075 - DNA, 13 bp, Homo sapiens
gttctttccaaag

SEQ ID NO: 4245076 - DNA, 14 bp, Homo sapiens
gttctttccaaagt

SEQ ID NO: 4245077 - DNA, 18 bp, Homo sapiens
gttgacttcgcagccccg

SEQ ID NO: 4245078 - DNA, 19 bp, Homo sapiens
gttgcagatgtattgactg

SEQ ID NO: 4245079 - DNA, 17 bp, Homo sapiens
gttggcccttctgccct

SEQ ID NO: 4245080 - DNA, 13 bp, Homo sapiens
gttggcctgcact

SEQ ID NO: 4245081 - DNA, 18 bp, Homo sapiens
gttgtaccctctccaggc

SEQ ID NO: 4245082 - DNA, 22 bp, Homo sapiens
gttgtcaagtctctgctggccc

SEQ ID NO: 4245083 - DNA, 20 bp, Homo sapiens
gttgtgcctggttcgtgcca

SEQ ID NO: 4245084 - DNA, 19 bp, Homo sapiens
gtttaaaaagtaagttaat

SEQ ID NO: 4245085 - DNA, 11 bp, Homo sapiens
gtttaaaattc

SEQ ID NO: 4245086 - DNA, 13 bp, Homo sapiens
gtttaaaattcag

SEQ ID NO: 4245087 - DNA, 17 bp, Homo sapiens
gtttaaatcatgtatgt

SEQ ID NO: 4245088 - DNA, 15 bp, Homo sapiens
gtttagataatacac

SEQ ID NO: 4245089 - DNA, 16 bp, Homo sapiens
gtttcaaactttacta

SEQ ID NO: 4245090 - DNA, 17 bp, Homo sapiens
gtttcaaactttactat

SEQ ID NO: 4245091 - DNA, 18 bp, Homo sapiens
gtttcagaaatgtgttat

SEQ ID NO: 4245092 - DNA, 14 bp, Homo sapiens
gtttccctggtgcc

SEQ ID NO: 4245093 - DNA, 16 bp, Homo sapiens
gtttcctatttaatac

SEQ ID NO: 4245094 - DNA, 22 bp, Homo sapiens
gtttctatgacacatgcaaggt

SEQ ID NO: 4245095 - DNA, 13 bp, Homo sapiens
gtttctgcccagc

SEQ ID NO: 4245096 - DNA, 20 bp, Homo sapiens
gtttctgcccagccctctgt

SEQ ID NO: 4245097 - DNA, 22 bp, Homo sapiens
gtttgatgcaggcacttattgt

SEQ ID NO: 4245098 - DNA, 22 bp, Homo sapiens
gtttgattaaattcttgcaaag

SEQ ID NO: 4245099 - DNA, 23 bp, Homo sapiens
gtttgattaaattcttgcaaagt

SEQ ID NO: 4245100 - DNA, 22 bp, Homo sapiens
gtttgcatccacttcaggagcc

SEQ ID NO: 4245101 - DNA, 20 bp, Homo sapiens
gtttgtaaattaacttttat

SEQ ID NO: 4245102 - DNA, 13 bp, Homo sapiens
gtttgtccttgca

SEQ ID NO: 4245103 - DNA, 17 bp, Homo sapiens
gttttaactttaataca

SEQ ID NO: 4245104 - DNA, 18 bp, Homo sapiens
gttttaaggatgcttgta

SEQ ID NO: 4245105 - DNA, 22 bp, Homo sapiens
gttttaaggatgcttgtacata

SEQ ID NO: 4245106 - DNA, 14 bp, Homo sapiens
gttttctgttcttt

SEQ ID NO: 4245107 - DNA, 18 bp, Homo sapiens
gttttgaatattactcct

SEQ ID NO: 4245108 - DNA, 19 bp, Homo sapiens
gttttgtcttgaaagtggc

SEQ ID NO: 4245109 - DNA, 16 bp, Homo sapiens
taaaaagagtaatttc

SEQ ID NO: 4245110 - DNA, 17 bp, Homo sapiens
taaaaagagtaatttca

SEQ ID NO: 4245111 - DNA, 17 bp, Homo sapiens
taaaaataaatagaaaa

SEQ ID NO: 4245112 - DNA, 16 bp, Homo sapiens
taaaaatctcaaattt

SEQ ID NO: 4245113 - DNA, 17 bp, Homo sapiens
taaaaatctcaaatttc

SEQ ID NO: 4245114 - DNA, 20 bp, Homo sapiens
taaaaatctcaaatttctaa

SEQ ID NO: 4245115 - DNA, 14 bp, Homo sapiens
taaaactttgctgc

SEQ ID NO: 4245116 - DNA, 16 bp, Homo sapiens
taaaactttgctgcca

SEQ ID NO: 4245117 - DNA, 14 bp, Homo sapiens
taaaagatacagtt

SEQ ID NO: 4245118 - DNA, 15 bp, Homo sapiens
taaaaggatagtatt

SEQ ID NO: 4245119 - DNA, 15 bp, Homo sapiens
taaaataaataattt

SEQ ID NO: 4245120 - DNA, 22 bp, Homo sapiens
taaaataccagccagtaaatgg

SEQ ID NO: 4245121 - DNA, 21 bp, Homo sapiens
taaaatgtagaaacttaaaca

SEQ ID NO: 4245122 - DNA, 18 bp, Homo sapiens
taaaattcagtttttgta

SEQ ID NO: 4245123 - DNA, 12 bp, Homo sapiens
taaaattgatat

SEQ ID NO: 4245124 - DNA, 23 bp, Homo sapiens
taaacaagaccacgtttctaaag

SEQ ID NO: 4245125 - DNA, 22 bp, Homo sapiens
taaacaatgatgccctgctcca

SEQ ID NO: 4245126 - DNA, 21 bp, Homo sapiens
taaacagtagttgtattcttc

SEQ ID NO: 4245127 - DNA, 14 bp, Homo sapiens
taaacagttatttc

SEQ ID NO: 4245128 - DNA, 16 bp, Homo sapiens
taaacagttatttctg

SEQ ID NO: 4245129 - DNA, 17 bp, Homo sapiens
taaacagttatttctgt

SEQ ID NO: 4245130 - DNA, 14 bp, Homo sapiens
taaacataaaaact

SEQ ID NO: 4245131 - DNA, 15 bp, Homo sapiens
taaactaaataatga

SEQ ID NO: 4245132 - DNA, 17 bp, Homo sapiens
taaactgaatattttgg

SEQ ID NO: 4245133 - DNA, 20 bp, Homo sapiens
taaactgaatattttggaaa

SEQ ID NO: 4245134 - DNA, 22 bp, Homo sapiens
taaactgaatattttggaaact

SEQ ID NO: 4245135 - DNA, 13 bp, Homo sapiens
taaacttgtgaat

SEQ ID NO: 4245136 - DNA, 22 bp, Homo sapiens
taaactttaccttttttataca

SEQ ID NO: 4245137 - DNA, 24 bp, Homo sapiens
taaagatatggagaattgctgaag

SEQ ID NO: 4245138 - DNA, 15 bp, Homo sapiens
taaaggctacctttg

SEQ ID NO: 4245139 - DNA, 23 bp, Homo sapiens
taaagtatgacccacattacttt

SEQ ID NO: 4245140 - DNA, 15 bp, Homo sapiens
taaataaaactgaat

SEQ ID NO: 4245141 - DNA, 17 bp, Homo sapiens
taaataaagcttgggaa

SEQ ID NO: 4245142 - DNA, 18 bp, Homo sapiens
taaataatgaataaactg

SEQ ID NO: 4245143 - DNA, 20 bp, Homo sapiens
taaataatgaataaactgaa

SEQ ID NO: 4245144 - DNA, 21 bp, Homo sapiens
taaataatgaataaactgaat

SEQ ID NO: 4245145 - DNA, 19 bp, Homo sapiens
taaatactctacttacagt

SEQ ID NO: 4245146 - DNA, 20 bp, Homo sapiens
taaatactgtgcagaataat

SEQ ID NO: 4245147 - DNA, 11 bp, Homo sapiens
taaatatatat

SEQ ID NO: 4245148 - DNA, 20 bp, Homo sapiens
taaatatatataaagaatat

SEQ ID NO: 4245149 - DNA, 14 bp, Homo sapiens
taaatatatatggt

SEQ ID NO: 4245150 - DNA, 23 bp, Homo sapiens
taaatatatatggtcatatacat

SEQ ID NO: 4245151 - DNA, 18 bp, Homo sapiens
taaatatgaaccctttgt

SEQ ID NO: 4245152 - DNA, 12 bp, Homo sapiens
taaatcatgtat

SEQ ID NO: 4245153 - DNA, 16 bp, Homo sapiens
taaatcatgtatgtta

SEQ ID NO: 4245154 - DNA, 15 bp, Homo sapiens
taaatgcaataattt

SEQ ID NO: 4245155 - DNA, 19 bp, Homo sapiens
taaatgcttcattgaaagc

SEQ ID NO: 4245156 - DNA, 17 bp, Homo sapiens
taaatgggggtgcattt

SEQ ID NO: 4245157 - DNA, 19 bp, Homo sapiens
taaatgggggtgcatttga

SEQ ID NO: 4245158 - DNA, 23 bp, Homo sapiens
taaatgggtgtatataattttat

SEQ ID NO: 4245159 - DNA, 16 bp, Homo sapiens
taaattaacttttata

SEQ ID NO: 4245160 - DNA, 21 bp, Homo sapiens
taaattaacttttataaactt

SEQ ID NO: 4245161 - DNA, 16 bp, Homo sapiens
taaattctatgttaaa

SEQ ID NO: 4245162 - DNA, 21 bp, Homo sapiens
taaattctatgttaaatactg

SEQ ID NO: 4245163 - DNA, 17 bp, Homo sapiens
taaattcttgcaaagta

SEQ ID NO: 4245164 - DNA, 22 bp, Homo sapiens
taaattgtagggctttagcttt

SEQ ID NO: 4245165 - DNA, 23 bp, Homo sapiens
taaattgtagggctttagctttc

SEQ ID NO: 4245166 - DNA, 14 bp, Homo sapiens
taacactgtatttt

SEQ ID NO: 4245167 - DNA, 12 bp, Homo sapiens
taacagaaatgt

SEQ ID NO: 4245168 - DNA, 13 bp, Homo sapiens
taacagaaatgta

SEQ ID NO: 4245169 - DNA, 18 bp, Homo sapiens
taaccatttatataaaac

SEQ ID NO: 4245170 - DNA, 20 bp, Homo sapiens
taaccttaaaattgatatta

SEQ ID NO: 4245171 - DNA, 16 bp, Homo sapiens
taaccttatcaggatg

SEQ ID NO: 4245172 - DNA, 21 bp, Homo sapiens
taacttcacatattgatttcc

SEQ ID NO: 4245173 - DNA, 17 bp, Homo sapiens
taacttttataaacttt

SEQ ID NO: 4245174 - DNA, 19 bp, Homo sapiens
taacttttataaactttac

SEQ ID NO: 4245175 - DNA, 22 bp, Homo sapiens
taagaagcctataagaggaatt

SEQ ID NO: 4245176 - DNA, 16 bp, Homo sapiens
taagaatgagcctgtc

SEQ ID NO: 4245177 - DNA, 12 bp, Homo sapiens
taagcatgtcaa

SEQ ID NO: 4245178 - DNA, 16 bp, Homo sapiens
taagtactgtttacca

SEQ ID NO: 4245179 - DNA, 15 bp, Homo sapiens
taagtgctgcattta

SEQ ID NO: 4245180 - DNA, 16 bp, Homo sapiens
taagtgctgcatttaa

SEQ ID NO: 4245181 - DNA, 14 bp, Homo sapiens
taagtgggctcctg

SEQ ID NO: 4245182 - DNA, 14 bp, Homo sapiens
taagttaataatgt

SEQ ID NO: 4245183 - DNA, 13 bp, Homo sapiens
taagtttgaagag

SEQ ID NO: 4245184 - DNA, 20 bp, Homo sapiens
taagtttttatggcttttgt

SEQ ID NO: 4245185 - DNA, 19 bp, Homo sapiens
taataatattgtttttctt

SEQ ID NO: 4245186 - DNA, 13 bp, Homo sapiens
taataatgtattg

SEQ ID NO: 4245187 - DNA, 21 bp, Homo sapiens
taatacaccactacattctgt

SEQ ID NO: 4245188 - DNA, 14 bp, Homo sapiens
taatagacaattta

SEQ ID NO: 4245189 - DNA, 22 bp, Homo sapiens
taatagacaatttattatggca

SEQ ID NO: 4245190 - DNA, 15 bp, Homo sapiens
taataggagtatttt

SEQ ID NO: 4245191 - DNA, 15 bp, Homo sapiens
taatatcaaaagaaa

SEQ ID NO: 4245192 - DNA, 17 bp, Homo sapiens
taatatcaaaagaaaat

SEQ ID NO: 4245193 - DNA, 15 bp, Homo sapiens
taatatgcacacatt

SEQ ID NO: 4245194 - DNA, 16 bp, Homo sapiens
taatatgcacacattt

SEQ ID NO: 4245195 - DNA, 19 bp, Homo sapiens
taatattcccattttatta

SEQ ID NO: 4245196 - DNA, 20 bp, Homo sapiens
taatattgtttttctttcta

SEQ ID NO: 4245197 - DNA, 23 bp, Homo sapiens
taatattgtttttctttctacaa

SEQ ID NO: 4245198 - DNA, 12 bp, Homo sapiens
taatatttatgt

SEQ ID NO: 4245199 - DNA, 13 bp, Homo sapiens
taatctaaatgga

SEQ ID NO: 4245200 - DNA, 23 bp, Homo sapiens
taatctctctgccgaaagtcaaa

SEQ ID NO: 4245201 - DNA, 16 bp, Homo sapiens
taatgaagtaaagcca

SEQ ID NO: 4245202 - DNA, 23 bp, Homo sapiens
taatgaataaactgaatattttg

SEQ ID NO: 4245203 - DNA, 15 bp, Homo sapiens
taatgataaaataaa

SEQ ID NO: 4245204 - DNA, 18 bp, Homo sapiens
taatgataaaataaataa

SEQ ID NO: 4245205 - DNA, 20 bp, Homo sapiens
taatgataaaataaataatt

SEQ ID NO: 4245206 - DNA, 20 bp, Homo sapiens
taatgcagtttttaaaaacc

SEQ ID NO: 4245207 - DNA, 18 bp, Homo sapiens
taatggaaacattacagt

SEQ ID NO: 4245208 - DNA, 21 bp, Homo sapiens
taatggatcatagaattgcag

SEQ ID NO: 4245209 - DNA, 15 bp, Homo sapiens
taatgtattttcttt

SEQ ID NO: 4245210 - DNA, 15 bp, Homo sapiens
taatgtctcactgtt

SEQ ID NO: 4245211 - DNA, 17 bp, Homo sapiens
taatgtctcactgttct

SEQ ID NO: 4245212 - DNA, 11 bp, Homo sapiens
taatgtttaaa

SEQ ID NO: 4245213 - DNA, 17 bp, Homo sapiens
taattcacctatgttat

SEQ ID NO: 4245214 - DNA, 19 bp, Homo sapiens
taattgcactttttaagtt

SEQ ID NO: 4245215 - DNA, 16 bp, Homo sapiens
taatttacaagatatt

SEQ ID NO: 4245216 - DNA, 15 bp, Homo sapiens
taatttattttttaa

SEQ ID NO: 4245217 - DNA, 13 bp, Homo sapiens
taatttcatttaa

SEQ ID NO: 4245218 - DNA, 14 bp, Homo sapiens
taatttcatttaaa

SEQ ID NO: 4245219 - DNA, 19 bp, Homo sapiens
taatttgtgatacaatgct

SEQ ID NO: 4245220 - DNA, 15 bp, Homo sapiens
tacaaacagtatttc

SEQ ID NO: 4245221 - DNA, 17 bp, Homo sapiens
tacaaagcgtgcacaag

SEQ ID NO: 4245222 - DNA, 21 bp, Homo sapiens
tacaacaacaacaaaaaatac

SEQ ID NO: 4245223 - DNA, 14 bp, Homo sapiens
tacaagatattatt

SEQ ID NO: 4245224 - DNA, 12 bp, Homo sapiens
tacaagtaattt

SEQ ID NO: 4245225 - DNA, 22 bp, Homo sapiens
tacaagttgttattgttgaaca

SEQ ID NO: 4245226 - DNA, 16 bp, Homo sapiens
tacaatgctgtgccct

SEQ ID NO: 4245227 - DNA, 19 bp, Homo sapiens
tacaatgtgtttttctcca

SEQ ID NO: 4245228 - DNA, 20 bp, Homo sapiens
tacaatgtgtttttctccag

SEQ ID NO: 4245229 - DNA, 17 bp, Homo sapiens
tacacactgcatgtttg

SEQ ID NO: 4245230 - DNA, 18 bp, Homo sapiens
tacacagagcaggactgc

SEQ ID NO: 4245231 - DNA, 21 bp, Homo sapiens
tacacattttattttattatg

SEQ ID NO: 4245232 - DNA, 22 bp, Homo sapiens
tacacattttattttattatgc

SEQ ID NO: 4245233 - DNA, 17 bp, Homo sapiens
tacacgtgcgtgtgagt

SEQ ID NO: 4245234 - DNA, 14 bp, Homo sapiens
tacactgtttcaaa

SEQ ID NO: 4245235 - DNA, 18 bp, Homo sapiens
tacactgtttcaaacttt

SEQ ID NO: 4245236 - DNA, 20 bp, Homo sapiens
tacactgtttcaaactttac

SEQ ID NO: 4245237 - DNA, 22 bp, Homo sapiens
tacactgtttcaaactttacta

SEQ ID NO: 4245238 - DNA, 23 bp, Homo sapiens
tacagaataatccagtattgctg

SEQ ID NO: 4245239 - DNA, 24 bp, Homo sapiens
tacagcaaggagatttacaactgg

SEQ ID NO: 4245240 - DNA, 19 bp, Homo sapiens
tacagttactcagaattct

SEQ ID NO: 4245241 - DNA, 16 bp, Homo sapiens
tacatgaaaacacatt

SEQ ID NO: 4245242 - DNA, 17 bp, Homo sapiens
tacatgaaaacacattt

SEQ ID NO: 4245243 - DNA, 19 bp, Homo sapiens
tacatttttaagtgctgca

SEQ ID NO: 4245244 - DNA, 22 bp, Homo sapiens
tacatttttaagtgctgcattt

SEQ ID NO: 4245245 - DNA, 15 bp, Homo sapiens
taccaagagtaactt

SEQ ID NO: 4245246 - DNA, 17 bp, Homo sapiens
taccaagagtaacttta

SEQ ID NO: 4245247 - DNA, 21 bp, Homo sapiens
taccaaggtacaactgtattt

SEQ ID NO: 4245248 - DNA, 13 bp, Homo sapiens
taccacagacata

SEQ ID NO: 4245249 - DNA, 17 bp, Homo sapiens
taccacttttgttcttg

SEQ ID NO: 4245250 - DNA, 16 bp, Homo sapiens
taccctcatgttctta

SEQ ID NO: 4245251 - DNA, 13 bp, Homo sapiens
taccctctccagg

SEQ ID NO: 4245252 - DNA, 16 bp, Homo sapiens
tacccttttcctttgt

SEQ ID NO: 4245253 - DNA, 22 bp, Homo sapiens
tacctaaaaggaaatctcaccc

SEQ ID NO: 4245254 - DNA, 23 bp, Homo sapiens
tacctaaaaggaaatctcacccc

SEQ ID NO: 4245255 - DNA, 17 bp, Homo sapiens
tacctcctaatggcatg

SEQ ID NO: 4245256 - DNA, 22 bp, Homo sapiens
tacctcttgagccttgaacttt

SEQ ID NO: 4245257 - DNA, 13 bp, Homo sapiens
tacctgcttgagc

SEQ ID NO: 4245258 - DNA, 19 bp, Homo sapiens
taccttttttatacataaa

SEQ ID NO: 4245259 - DNA, 22 bp, Homo sapiens
taccttttttatacataaacaa

SEQ ID NO: 4245260 - DNA, 12 bp, Homo sapiens
tacgtacacatt

SEQ ID NO: 4245261 - DNA, 13 bp, Homo sapiens
tacgtacacattt

SEQ ID NO: 4245262 - DNA, 14 bp, Homo sapiens
tacgtacacatttt

SEQ ID NO: 4245263 - DNA, 13 bp, Homo sapiens
tacgttgtgcatt

SEQ ID NO: 4245264 - DNA, 17 bp, Homo sapiens
tactaaccagcagaaat

SEQ ID NO: 4245265 - DNA, 19 bp, Homo sapiens
tactaaccagcagaaatgc

SEQ ID NO: 4245266 - DNA, 20 bp, Homo sapiens
tactacagtttgttagtatg

SEQ ID NO: 4245267 - DNA, 17 bp, Homo sapiens
tactctaggacttcaaa

SEQ ID NO: 4245268 - DNA, 18 bp, Homo sapiens
tactctaggacttcaaag

SEQ ID NO: 4245269 - DNA, 12 bp, Homo sapiens
tactctgcccac

SEQ ID NO: 4245270 - DNA, 23 bp, Homo sapiens
tactgaagggaacagcctgagcc

SEQ ID NO: 4245271 - DNA, 13 bp, Homo sapiens
tactgaattgtat

SEQ ID NO: 4245272 - DNA, 15 bp, Homo sapiens
tactgaattgtatca

SEQ ID NO: 4245273 - DNA, 19 bp, Homo sapiens
tactgtacataaacaatga

SEQ ID NO: 4245274 - DNA, 21 bp, Homo sapiens
tactgtatcatgacaaagact

SEQ ID NO: 4245275 - DNA, 17 bp, Homo sapiens
tactgtgcagaataatg

SEQ ID NO: 4245276 - DNA, 20 bp, Homo sapiens
tactgtgcagaataatggaa

SEQ ID NO: 4245277 - DNA, 13 bp, Homo sapiens
tacttcaaaaata

SEQ ID NO: 4245278 - DNA, 22 bp, Homo sapiens
tacttgatttgatgtgactttt

SEQ ID NO: 4245279 - DNA, 22 bp, Homo sapiens
tactttgtggaccaattattga

SEQ ID NO: 4245280 - DNA, 16 bp, Homo sapiens
tacttttcccctgtta

SEQ ID NO: 4245281 - DNA, 22 bp, Homo sapiens
tacttttcccctgttaaacagt

SEQ ID NO: 4245282 - DNA, 16 bp, Homo sapiens
tagaaaagtagacaat

SEQ ID NO: 4245283 - DNA, 20 bp, Homo sapiens
tagaaaagttgcagatgtat

SEQ ID NO: 4245284 - DNA, 16 bp, Homo sapiens
tagacaatttattatg

SEQ ID NO: 4245285 - DNA, 22 bp, Homo sapiens
tagactcctcttcccagagtca

SEQ ID NO: 4245286 - DNA, 22 bp, Homo sapiens
tagagccttttatctgcagaac

SEQ ID NO: 4245287 - DNA, 17 bp, Homo sapiens
tagaggtatattggaag

SEQ ID NO: 4245288 - DNA, 15 bp, Homo sapiens
tagaggttcaaagat

SEQ ID NO: 4245289 - DNA, 17 bp, Homo sapiens
tagagttgatactacag

SEQ ID NO: 4245290 - DNA, 20 bp, Homo sapiens
tagatgcctgttttgagacc

SEQ ID NO: 4245291 - DNA, 13 bp, Homo sapiens
tagcagacagaaa

SEQ ID NO: 4245292 - DNA, 17 bp, Homo sapiens
tagcagacagaaactgg

SEQ ID NO: 4245293 - DNA, 13 bp, Homo sapiens
tagcataaataaa

SEQ ID NO: 4245294 - DNA, 20 bp, Homo sapiens
tagcataaataaaactgaat

SEQ ID NO: 4245295 - DNA, 19 bp, Homo sapiens
tagcatacgtacacatttt

SEQ ID NO: 4245296 - DNA, 17 bp, Homo sapiens
tagccacttagacactt

SEQ ID NO: 4245297 - DNA, 19 bp, Homo sapiens
tagcctctgggatctgcca

SEQ ID NO: 4245298 - DNA, 17 bp, Homo sapiens
tagctcaagaattgtta

SEQ ID NO: 4245299 - DNA, 12 bp, Homo sapiens
tagctcattctc

SEQ ID NO: 4245300 - DNA, 14 bp, Homo sapiens
taggacttcaaagt

SEQ ID NO: 4245301 - DNA, 17 bp, Homo sapiens
tagggaaaggttttgta

SEQ ID NO: 4245302 - DNA, 18 bp, Homo sapiens
tagggaaaggttttgtat

SEQ ID NO: 4245303 - DNA, 18 bp, Homo sapiens
tagggctttagctttctt

SEQ ID NO: 4245304 - DNA, 14 bp, Homo sapiens
taggtaaaatgtat

SEQ ID NO: 4245305 - DNA, 18 bp, Homo sapiens
tagtaaaatttatttcat

SEQ ID NO: 4245306 - DNA, 17 bp, Homo sapiens
tagtaagtaattatgca

SEQ ID NO: 4245307 - DNA, 15 bp, Homo sapiens
tagtatttttatcca

SEQ ID NO: 4245308 - DNA, 14 bp, Homo sapiens
tagtggatgactgt

SEQ ID NO: 4245309 - DNA, 17 bp, Homo sapiens
tagtgtttctagctaaa

SEQ ID NO: 4245310 - DNA, 19 bp, Homo sapiens
tagttgtattcttctgtat

SEQ ID NO: 4245311 - DNA, 15 bp, Homo sapiens
tagtttccctggtgc

SEQ ID NO: 4245312 - DNA, 16 bp, Homo sapiens
tagtttgattaaattc

SEQ ID NO: 4245313 - DNA, 17 bp, Homo sapiens
tagtttggatatttttg

SEQ ID NO: 4245314 - DNA, 11 bp, Homo sapiens
tataaacttta

SEQ ID NO: 4245315 - DNA, 14 bp, Homo sapiens
tataaactttacct

SEQ ID NO: 4245316 - DNA, 18 bp, Homo sapiens
tataaactttaccttttt

SEQ ID NO: 4245317 - DNA, 20 bp, Homo sapiens
tataaagtatagagagaagt

SEQ ID NO: 4245318 - DNA, 19 bp, Homo sapiens
tataaatatatataaagaa

SEQ ID NO: 4245319 - DNA, 20 bp, Homo sapiens
tataaccagtgttgtggatt

SEQ ID NO: 4245320 - DNA, 17 bp, Homo sapiens
tataagaatgagcctgt

SEQ ID NO: 4245321 - DNA, 20 bp, Homo sapiens
tataagaatgagcctgtcca

SEQ ID NO: 4245322 - DNA, 16 bp, Homo sapiens
tataatgtttaaatca

SEQ ID NO: 4245323 - DNA, 13 bp, Homo sapiens
tatacataaacaa

SEQ ID NO: 4245324 - DNA, 14 bp, Homo sapiens
tatacataaacaag

SEQ ID NO: 4245325 - DNA, 20 bp, Homo sapiens
tataccctggtgcaatcaca

SEQ ID NO: 4245326 - DNA, 23 bp, Homo sapiens
tataggaacttaaataatgtgaa

SEQ ID NO: 4245327 - DNA, 20 bp, Homo sapiens
tataggtcctgtgttaaaca

SEQ ID NO: 4245328 - DNA, 23 bp, Homo sapiens
tataggtcctgtgttaaacacta

SEQ ID NO: 4245329 - DNA, 19 bp, Homo sapiens
tatataaagaatatatata

SEQ ID NO: 4245330 - DNA, 13 bp, Homo sapiens
tatataattttat

SEQ ID NO: 4245331 - DNA, 10 bp, Homo sapiens
tatatataaa

SEQ ID NO: 4245332 - DNA, 13 bp, Homo sapiens
tatatataaagta

SEQ ID NO: 4245333 - DNA, 11 bp, Homo sapiens
tatatatataa

SEQ ID NO: 4245334 - DNA, 12 bp, Homo sapiens
tatatatataaa

SEQ ID NO: 4245335 - DNA, 11 bp, Homo sapiens
tatatatatat

SEQ ID NO: 4245336 - DNA, 13 bp, Homo sapiens
tatatatatataa

SEQ ID NO: 4245337 - DNA, 18 bp, Homo sapiens
tatatatggtcatataca

SEQ ID NO: 4245338 - DNA, 17 bp, Homo sapiens
tatatattcttataaaa

SEQ ID NO: 4245339 - DNA, 21 bp, Homo sapiens
tatatcattctacagaataat

SEQ ID NO: 4245340 - DNA, 12 bp, Homo sapiens
tatattaaaaca

SEQ ID NO: 4245341 - DNA, 22 bp, Homo sapiens
tatattaaaacaataatgcaat

SEQ ID NO: 4245342 - DNA, 16 bp, Homo sapiens
tatcaattggcagtga

SEQ ID NO: 4245343 - DNA, 17 bp, Homo sapiens
tatcatatattaaaaca

SEQ ID NO: 4245344 - DNA, 16 bp, Homo sapiens
tatcatgacaaagact

SEQ ID NO: 4245345 - DNA, 18 bp, Homo sapiens
tatcattctacagaataa

SEQ ID NO: 4245346 - DNA, 13 bp, Homo sapiens
tatccccaaatta

SEQ ID NO: 4245347 - DNA, 16 bp, Homo sapiens
tatctagatactgtat

SEQ ID NO: 4245348 - DNA, 14 bp, Homo sapiens
tatcttaagcatgt

SEQ ID NO: 4245349 - DNA, 12 bp, Homo sapiens
tatcttttcata

SEQ ID NO: 4245350 - DNA, 19 bp, Homo sapiens
tatgaaccctttgtttctt

SEQ ID NO: 4245351 - DNA, 12 bp, Homo sapiens
tatgacacatgc

SEQ ID NO: 4245352 - DNA, 23 bp, Homo sapiens
tatgaggcatttgtttgaactga

SEQ ID NO: 4245353 - DNA, 13 bp, Homo sapiens
tatgcacacattt

SEQ ID NO: 4245354 - DNA, 15 bp, Homo sapiens
tatgcactaaatatg

SEQ ID NO: 4245355 - DNA, 13 bp, Homo sapiens
tatgcatgaagta

SEQ ID NO: 4245356 - DNA, 18 bp, Homo sapiens
tatgcatgaagtaatatg

SEQ ID NO: 4245357 - DNA, 23 bp, Homo sapiens
tatgcatttgaaaattttgatgt

SEQ ID NO: 4245358 - DNA, 14 bp, Homo sapiens
tatggatttaagag

SEQ ID NO: 4245359 - DNA, 22 bp, Homo sapiens
tatggccctggcctagcatacg

SEQ ID NO: 4245360 - DNA, 18 bp, Homo sapiens
tatggcttttgtgcatta

SEQ ID NO: 4245361 - DNA, 16 bp, Homo sapiens
tatggtggaaaagaac

SEQ ID NO: 4245362 - DNA, 20 bp, Homo sapiens
tatgtaaaatgaattgaaaa

SEQ ID NO: 4245363 - DNA, 16 bp, Homo sapiens
tatgtaatgaagtaaa

SEQ ID NO: 4245364 - DNA, 14 bp, Homo sapiens
tatgtatttaaagt

SEQ ID NO: 4245365 - DNA, 16 bp, Homo sapiens
tatgttattttgtgta

SEQ ID NO: 4245366 - DNA, 15 bp, Homo sapiens
tatgttcctcaaatc

SEQ ID NO: 4245367 - DNA, 16 bp, Homo sapiens
tattaaaaatctcaaa

SEQ ID NO: 4245368 - DNA, 14 bp, Homo sapiens
tattaaacatacat

SEQ ID NO: 4245369 - DNA, 20 bp, Homo sapiens
tattaaataataaagtatga

SEQ ID NO: 4245370 - DNA, 17 bp, Homo sapiens
tattaattcttcacctg

SEQ ID NO: 4245371 - DNA, 15 bp, Homo sapiens
tattacaacatttat

SEQ ID NO: 4245372 - DNA, 16 bp, Homo sapiens
tattaccacagacata

SEQ ID NO: 4245373 - DNA, 17 bp, Homo sapiens
tattaggaaaataaaca

SEQ ID NO: 4245374 - DNA, 14 bp, Homo sapiens
tattagtgaagatg

SEQ ID NO: 4245375 - DNA, 15 bp, Homo sapiens
tattataaatatata

SEQ ID NO: 4245376 - DNA, 13 bp, Homo sapiens
tattatacctttt

SEQ ID NO: 4245377 - DNA, 13 bp, Homo sapiens
tattcaaatttga

SEQ ID NO: 4245378 - DNA, 22 bp, Homo sapiens
tattcaaatttgatgatgttaa

SEQ ID NO: 4245379 - DNA, 16 bp, Homo sapiens
tattcaaggaagtttt

SEQ ID NO: 4245380 - DNA, 20 bp, Homo sapiens
tattctctcctgtacctctt

SEQ ID NO: 4245381 - DNA, 13 bp, Homo sapiens
tattgatatatat

SEQ ID NO: 4245382 - DNA, 16 bp, Homo sapiens
tattgcttagtaaaat

SEQ ID NO: 4245383 - DNA, 12 bp, Homo sapiens
tattgtttaaaa

SEQ ID NO: 4245384 - DNA, 20 bp, Homo sapiens
tattgtttaaaattcagttt

SEQ ID NO: 4245385 - DNA, 23 bp, Homo sapiens
tatttaatacagctgaagtcaaa

SEQ ID NO: 4245386 - DNA, 15 bp, Homo sapiens
tatttatttttcttg

SEQ ID NO: 4245387 - DNA, 14 bp, Homo sapiens
tatttctaggcaca

SEQ ID NO: 4245388 - DNA, 21 bp, Homo sapiens
tatttctgtttcctatttaat

SEQ ID NO: 4245389 - DNA, 15 bp, Homo sapiens
tatttgctaatgtat

SEQ ID NO: 4245390 - DNA, 14 bp, Homo sapiens
tattttattatgca

SEQ ID NO: 4245391 - DNA, 14 bp, Homo sapiens
tattttctttttat

SEQ ID NO: 4245392 - DNA, 14 bp, Homo sapiens
tattttgataataa

SEQ ID NO: 4245393 - DNA, 19 bp, Homo sapiens
tattttgataataatattg

SEQ ID NO: 4245394 - DNA, 20 bp, Homo sapiens
tattttgctttgtgattttt

SEQ ID NO: 4245395 - DNA, 13 bp, Homo sapiens
tattttggaaact

SEQ ID NO: 4245396 - DNA, 16 bp, Homo sapiens
tattttggaaactgct

SEQ ID NO: 4245397 - DNA, 19 bp, Homo sapiens
tattttggaaactgctaaa

SEQ ID NO: 4245398 - DNA, 17 bp, Homo sapiens
tattttgtgtacaagtt

SEQ ID NO: 4245399 - DNA, 20 bp, Homo sapiens
tatttttatacaagtaattt

SEQ ID NO: 4245400 - DNA, 12 bp, Homo sapiens
tatttttgtaaa

SEQ ID NO: 4245401 - DNA, 13 bp, Homo sapiens
tatttttgtaaac

SEQ ID NO: 4245402 - DNA, 15 bp, Homo sapiens
tatttttgtacttga

SEQ ID NO: 4245403 - DNA, 20 bp, Homo sapiens
tattttttaagtgggctcct

SEQ ID NO: 4245404 - DNA, 14 bp, Homo sapiens
tcaaaaaaacaaaa

SEQ ID NO: 4245405 - DNA, 22 bp, Homo sapiens
tcaaaatatgtaagaacacatt

SEQ ID NO: 4245406 - DNA, 15 bp, Homo sapiens
tcaaactttactatg

SEQ ID NO: 4245407 - DNA, 17 bp, Homo sapiens
tcaaagtgtgtctggga

SEQ ID NO: 4245408 - DNA, 15 bp, Homo sapiens
tcaaagttaattcac

SEQ ID NO: 4245409 - DNA, 12 bp, Homo sapiens
tcaaagtttata

SEQ ID NO: 4245410 - DNA, 17 bp, Homo sapiens
tcaaagtttatatgcct

SEQ ID NO: 4245411 - DNA, 14 bp, Homo sapiens
tcaaataaaaataa

SEQ ID NO: 4245412 - DNA, 16 bp, Homo sapiens
tcaaatcagtgataat

SEQ ID NO: 4245413 - DNA, 13 bp, Homo sapiens
tcaaatttctaaa

SEQ ID NO: 4245414 - DNA, 17 bp, Homo sapiens
tcaaatttctaaatctc

SEQ ID NO: 4245415 - DNA, 20 bp, Homo sapiens
tcaacatgctccaaatataa

SEQ ID NO: 4245416 - DNA, 16 bp, Homo sapiens
tcaagctagtgtttct

SEQ ID NO: 4245417 - DNA, 19 bp, Homo sapiens
tcaagtaagtagatgcctg

SEQ ID NO: 4245418 - DNA, 11 bp, Homo sapiens
tcaagtattat

SEQ ID NO: 4245419 - DNA, 21 bp, Homo sapiens
tcaagtattatacctttttta

SEQ ID NO: 4245420 - DNA, 17 bp, Homo sapiens
tcaagtctctgctggcc

SEQ ID NO: 4245421 - DNA, 18 bp, Homo sapiens
tcaataacactgtatttt

SEQ ID NO: 4245422 - DNA, 15 bp, Homo sapiens
tcaatatcagctttg

SEQ ID NO: 4245423 - DNA, 19 bp, Homo sapiens
tcaatcttggtttgtcagt

SEQ ID NO: 4245424 - DNA, 16 bp, Homo sapiens
tcaattggcagtgact

SEQ ID NO: 4245425 - DNA, 23 bp, Homo sapiens
tcaattggcagtgactttgtata

SEQ ID NO: 4245426 - DNA, 19 bp, Homo sapiens
tcacacgactgtcatctaa

SEQ ID NO: 4245427 - DNA, 19 bp, Homo sapiens
tcacagcccaaaatttgat

SEQ ID NO: 4245428 - DNA, 12 bp, Homo sapiens
tcaccccaccct

SEQ ID NO: 4245429 - DNA, 15 bp, Homo sapiens
tcacctgttatgtat

SEQ ID NO: 4245430 - DNA, 15 bp, Homo sapiens
tcactatatatattt

SEQ ID NO: 4245431 - DNA, 20 bp, Homo sapiens
tcactgcattcattctgagc

SEQ ID NO: 4245432 - DNA, 15 bp, Homo sapiens
tcactgcttaacttc

SEQ ID NO: 4245433 - DNA, 17 bp, Homo sapiens
tcactgcttaacttcac

SEQ ID NO: 4245434 - DNA, 21 bp, Homo sapiens
tcactgtgggaaggccagctg

SEQ ID NO: 4245435 - DNA, 13 bp, Homo sapiens
tcactgttctgca

SEQ ID NO: 4245436 - DNA, 12 bp, Homo sapiens
tcacttagtcct

SEQ ID NO: 4245437 - DNA, 14 bp, Homo sapiens
tcacttttgttctg

SEQ ID NO: 4245438 - DNA, 15 bp, Homo sapiens
tcacttttgttctgc

SEQ ID NO: 4245439 - DNA, 16 bp, Homo sapiens
tcacttttgttctgct

SEQ ID NO: 4245440 - DNA, 19 bp, Homo sapiens
tcacttttgttctgcttta

SEQ ID NO: 4245441 - DNA, 20 bp, Homo sapiens
tcacttttgttctgctttat

SEQ ID NO: 4245442 - DNA, 18 bp, Homo sapiens
tcagactctcagcccaga

SEQ ID NO: 4245443 - DNA, 19 bp, Homo sapiens
tcagactctcagcccagaa

SEQ ID NO: 4245444 - DNA, 17 bp, Homo sapiens
tcagcacgatttctgtt

SEQ ID NO: 4245445 - DNA, 19 bp, Homo sapiens
tcagcacgatttctgttta

SEQ ID NO: 4245446 - DNA, 19 bp, Homo sapiens
tcagcatttccacaccaag

SEQ ID NO: 4245447 - DNA, 20 bp, Homo sapiens
tcagcctccggagtagctgg

SEQ ID NO: 4245448 - DNA, 21 bp, Homo sapiens
tcagctgcaatccatttattt

SEQ ID NO: 4245449 - DNA, 12 bp, Homo sapiens
tcaggcatggct

SEQ ID NO: 4245450 - DNA, 17 bp, Homo sapiens
tcaggcatggctcagag

SEQ ID NO: 4245451 - DNA, 20 bp, Homo sapiens
tcaggcatggctcagagctt

SEQ ID NO: 4245452 - DNA, 22 bp, Homo sapiens
tcagtaatgcagtttttaaaaa

SEQ ID NO: 4245453 - DNA, 17 bp, Homo sapiens
tcagtttttgtatcttg

SEQ ID NO: 4245454 - DNA, 17 bp, Homo sapiens
tcataaagggttgaaaa

SEQ ID NO: 4245455 - DNA, 15 bp, Homo sapiens
tcatagcttcacaat

SEQ ID NO: 4245456 - DNA, 15 bp, Homo sapiens
tcatagggaaaggtt

SEQ ID NO: 4245457 - DNA, 22 bp, Homo sapiens
tcatagggaaaggttttgtatt

SEQ ID NO: 4245458 - DNA, 12 bp, Homo sapiens
tcatatattaaa

SEQ ID NO: 4245459 - DNA, 19 bp, Homo sapiens
tcatccaaaatattttttg

SEQ ID NO: 4245460 - DNA, 20 bp, Homo sapiens
tcatccaaaatattttttgc

SEQ ID NO: 4245461 - DNA, 21 bp, Homo sapiens
tcatccaaaatattttttgca

SEQ ID NO: 4245462 - DNA, 17 bp, Homo sapiens
tcatcgctcgtgtgttc

SEQ ID NO: 4245463 - DNA, 21 bp, Homo sapiens
tcatctcggctgttcctgaga

SEQ ID NO: 4245464 - DNA, 16 bp, Homo sapiens
tcatgacaagcatttt

SEQ ID NO: 4245465 - DNA, 22 bp, Homo sapiens
tcatgccaccatggccagccaa

SEQ ID NO: 4245466 - DNA, 16 bp, Homo sapiens
tcattaggtgtgactg

SEQ ID NO: 4245467 - DNA, 22 bp, Homo sapiens
tcattaggtgtgactgaatttc

SEQ ID NO: 4245468 - DNA, 21 bp, Homo sapiens
tcattctccttgtgttactaa

SEQ ID NO: 4245469 - DNA, 13 bp, Homo sapiens
tcatttaaatatc

SEQ ID NO: 4245470 - DNA, 14 bp, Homo sapiens
tcatttttgtattt

SEQ ID NO: 4245471 - DNA, 15 bp, Homo sapiens
tcatttttgtatttt

SEQ ID NO: 4245472 - DNA, 13 bp, Homo sapiens
tcattttttttaa

SEQ ID NO: 4245473 - DNA, 17 bp, Homo sapiens
tcattttttttaagaaa

SEQ ID NO: 4245474 - DNA, 20 bp, Homo sapiens
tccaaaataaaactttttaa

SEQ ID NO: 4245475 - DNA, 18 bp, Homo sapiens
tccaaaatattttttgca

SEQ ID NO: 4245476 - DNA, 19 bp, Homo sapiens
tccaaacatgtatttatgt

SEQ ID NO: 4245477 - DNA, 22 bp, Homo sapiens
tccaaatataagacatttgttt

SEQ ID NO: 4245478 - DNA, 19 bp, Homo sapiens
tccaactcttccacctctg

SEQ ID NO: 4245479 - DNA, 19 bp, Homo sapiens
tccaattccttgcacatag

SEQ ID NO: 4245480 - DNA, 15 bp, Homo sapiens
tccacaaagagacca

SEQ ID NO: 4245481 - DNA, 19 bp, Homo sapiens
tccacaaagagaccagggg

SEQ ID NO: 4245482 - DNA, 17 bp, Homo sapiens
tccacaccaagcagcaa

SEQ ID NO: 4245483 - DNA, 17 bp, Homo sapiens
tccacacggagctcctg

SEQ ID NO: 4245484 - DNA, 20 bp, Homo sapiens
tccacacggagctcctggca

SEQ ID NO: 4245485 - DNA, 16 bp, Homo sapiens
tccacctgtctcagcc

SEQ ID NO: 4245486 - DNA, 16 bp, Homo sapiens
tccagccgtgtgtgca

SEQ ID NO: 4245487 - DNA, 20 bp, Homo sapiens
tccagccgtgtgtgcatgtg

SEQ ID NO: 4245488 - DNA, 23 bp, Homo sapiens
tccaggacaccacgattctccca

SEQ ID NO: 4245489 - DNA, 21 bp, Homo sapiens
tccatctcagactgtggaacc

SEQ ID NO: 4245490 - DNA, 20 bp, Homo sapiens
tccatgacaggcctgaagat

SEQ ID NO: 4245491 - DNA, 23 bp, Homo sapiens
tccatgcttctcatcttgtgaaa

SEQ ID NO: 4245492 - DNA, 14 bp, Homo sapiens
tccatgtgtatcca

SEQ ID NO: 4245493 - DNA, 21 bp, Homo sapiens
tcccacacccacctctgccac

SEQ ID NO: 4245494 - DNA, 13 bp, Homo sapiens
tcccacaccctgg

SEQ ID NO: 4245495 - DNA, 13 bp, Homo sapiens
tcccagatcctgg

SEQ ID NO: 4245496 - DNA, 15 bp, Homo sapiens
tccccagtgctcctg

SEQ ID NO: 4245497 - DNA, 20 bp, Homo sapiens
tcccccgttgtgcctggttc

SEQ ID NO: 4245498 - DNA, 18 bp, Homo sapiens
tcccctccttctcccttt

SEQ ID NO: 4245499 - DNA, 13 bp, Homo sapiens
tcccctgccattt

SEQ ID NO: 4245500 - DNA, 15 bp, Homo sapiens
tccctcccccagagc

SEQ ID NO: 4245501 - DNA, 18 bp, Homo sapiens
tccctcccccagagcccc

SEQ ID NO: 4245502 - DNA, 12 bp, Homo sapiens
tccctctccctg

SEQ ID NO: 4245503 - DNA, 23 bp, Homo sapiens
tccctggtgcccttccctggagg

SEQ ID NO: 4245504 - DNA, 11 bp, Homo sapiens
tccgcagggcg

SEQ ID NO: 4245505 - DNA, 14 bp, Homo sapiens
tccgccctgcagca

SEQ ID NO: 4245506 - DNA, 22 bp, Homo sapiens
tccggagcgccctgcagggccg

SEQ ID NO: 4245507 - DNA, 19 bp, Homo sapiens
tccggcggccccgccgcag

SEQ ID NO: 4245508 - DNA, 20 bp, Homo sapiens
tccggcggccccgccgcaga

SEQ ID NO: 4245509 - DNA, 14 bp, Homo sapiens
tcctaatggcatgg

SEQ ID NO: 4245510 - DNA, 18 bp, Homo sapiens
tcctagtggatgactgtt

SEQ ID NO: 4245511 - DNA, 13 bp, Homo sapiens
tcctatttttgta

SEQ ID NO: 4245512 - DNA, 17 bp, Homo sapiens
tcctatttttgtaaact

SEQ ID NO: 4245513 - DNA, 16 bp, Homo sapiens
tcctcagaggacagtt

SEQ ID NO: 4245514 - DNA, 18 bp, Homo sapiens
tcctccctgggatggacg

SEQ ID NO: 4245515 - DNA, 15 bp, Homo sapiens
tcctccgaggccagt

SEQ ID NO: 4245516 - DNA, 17 bp, Homo sapiens
tcctctcctttgaaacc

SEQ ID NO: 4245517 - DNA, 23 bp, Homo sapiens
tcctctcctttgaaacctgctct

SEQ ID NO: 4245518 - DNA, 23 bp, Homo sapiens
tcctgaccccgccatgcatgcag

SEQ ID NO: 4245519 - DNA, 21 bp, Homo sapiens
tcctgataaaacaacagctcg

SEQ ID NO: 4245520 - DNA, 16 bp, Homo sapiens
tcctgatgatgctggc

SEQ ID NO: 4245521 - DNA, 17 bp, Homo sapiens
tcctgatgatgctggcc

SEQ ID NO: 4245522 - DNA, 19 bp, Homo sapiens
tcctgatgatgctggccct

SEQ ID NO: 4245523 - DNA, 15 bp, Homo sapiens
tcctgcactgtttaa

SEQ ID NO: 4245524 - DNA, 12 bp, Homo sapiens
tcctgcctttta

SEQ ID NO: 4245525 - DNA, 12 bp, Homo sapiens
tcctgggctcag

SEQ ID NO: 4245526 - DNA, 13 bp, Homo sapiens
tcctgggctcagg

SEQ ID NO: 4245527 - DNA, 20 bp, Homo sapiens
tcctgtacctcttgagcctt

SEQ ID NO: 4245528 - DNA, 14 bp, Homo sapiens
tcctgtccccaggg

SEQ ID NO: 4245529 - DNA, 17 bp, Homo sapiens
tcctgtttataatctga

SEQ ID NO: 4245530 - DNA, 22 bp, Homo sapiens
tcctgtttataatctgaagata

SEQ ID NO: 4245531 - DNA, 20 bp, Homo sapiens
tccttcggggaccagcccac

SEQ ID NO: 4245532 - DNA, 18 bp, Homo sapiens
tccttgcacctgagcctg

SEQ ID NO: 4245533 - DNA, 23 bp, Homo sapiens
tccttgtgttactaagtttttat

SEQ ID NO: 4245534 - DNA, 17 bp, Homo sapiens
tcgagcagtcctgcctc

SEQ ID NO: 4245535 - DNA, 22 bp, Homo sapiens
tcgagcagtcctgcctcagcct

SEQ ID NO: 4245536 - DNA, 21 bp, Homo sapiens
tcgatatgtatatcattctac

SEQ ID NO: 4245537 - DNA, 14 bp, Homo sapiens
tcgatccaaattgt

SEQ ID NO: 4245538 - DNA, 16 bp, Homo sapiens
tcgccataaaggcccc

SEQ ID NO: 4245539 - DNA, 13 bp, Homo sapiens
tcgttttccaaac

SEQ ID NO: 4245540 - DNA, 17 bp, Homo sapiens
tctaaaggctacctttg

SEQ ID NO: 4245541 - DNA, 15 bp, Homo sapiens
tctaacttcaccata

SEQ ID NO: 4245542 - DNA, 14 bp, Homo sapiens
tctaatttgaactg

SEQ ID NO: 4245543 - DNA, 14 bp, Homo sapiens
tctagctaaataaa

SEQ ID NO: 4245544 - DNA, 12 bp, Homo sapiens
tctaggacttca

SEQ ID NO: 4245545 - DNA, 20 bp, Homo sapiens
tctaggtaggggcccacttc

SEQ ID NO: 4245546 - DNA, 17 bp, Homo sapiens
tctagtttccctggtgc

SEQ ID NO: 4245547 - DNA, 21 bp, Homo sapiens
tctagtttgattaaattcttg

SEQ ID NO: 4245548 - DNA, 14 bp, Homo sapiens
tctatgacacatgc

SEQ ID NO: 4245549 - DNA, 15 bp, Homo sapiens
tctatgttaaatact

SEQ ID NO: 4245550 - DNA, 23 bp, Homo sapiens
tctatgttaaatactgtgcagaa

SEQ ID NO: 4245551 - DNA, 17 bp, Homo sapiens
tctcaccccatcccaca

SEQ ID NO: 4245552 - DNA, 21 bp, Homo sapiens
tctcaccccatcccacaccct

SEQ ID NO: 4245553 - DNA, 14 bp, Homo sapiens
tctcactgttctgc

SEQ ID NO: 4245554 - DNA, 17 bp, Homo sapiens
tctcactgttctgcaaa

SEQ ID NO: 4245555 - DNA, 13 bp, Homo sapiens
tctcagcctccca

SEQ ID NO: 4245556 - DNA, 13 bp, Homo sapiens
tctccaaaataaa

SEQ ID NO: 4245557 - DNA, 15 bp, Homo sapiens
tctccacacggagct

SEQ ID NO: 4245558 - DNA, 13 bp, Homo sapiens
tctcccagatcct

SEQ ID NO: 4245559 - DNA, 15 bp, Homo sapiens
tctcctgtacctctt

SEQ ID NO: 4245560 - DNA, 16 bp, Homo sapiens
tctcctgtacctcttg

SEQ ID NO: 4245561 - DNA, 21 bp, Homo sapiens
tctccttgtgttactaagttt

SEQ ID NO: 4245562 - DNA, 16 bp, Homo sapiens
tctcgtattttgtccc

SEQ ID NO: 4245563 - DNA, 15 bp, Homo sapiens
tctcgtttctgccca

SEQ ID NO: 4245564 - DNA, 12 bp, Homo sapiens
tctctaacttca

SEQ ID NO: 4245565 - DNA, 16 bp, Homo sapiens
tctctcttcagactct

SEQ ID NO: 4245566 - DNA, 14 bp, Homo sapiens
tctctgctggccca

SEQ ID NO: 4245567 - DNA, 16 bp, Homo sapiens
tctctgctggcccagc

SEQ ID NO: 4245568 - DNA, 18 bp, Homo sapiens
tctcttaaacttgtgaat

SEQ ID NO: 4245569 - DNA, 17 bp, Homo sapiens
tctcttttctgtacttc

SEQ ID NO: 4245570 - DNA, 20 bp, Homo sapiens
tctgaagatatatttcactt

SEQ ID NO: 4245571 - DNA, 12 bp, Homo sapiens
tctgaatatttt

SEQ ID NO: 4245572 - DNA, 17 bp, Homo sapiens
tctgacccactttgtaa

SEQ ID NO: 4245573 - DNA, 21 bp, Homo sapiens
tctgcaaaggtggcaatgctt

SEQ ID NO: 4245574 - DNA, 17 bp, Homo sapiens
tctgcagcaataaagca

SEQ ID NO: 4245575 - DNA, 12 bp, Homo sapiens
tctgcccagccc

SEQ ID NO: 4245576 - DNA, 18 bp, Homo sapiens
tctgcccagccctctgtg

SEQ ID NO: 4245577 - DNA, 11 bp, Homo sapiens
tctgccttttc

SEQ ID NO: 4245578 - DNA, 20 bp, Homo sapiens
tctgctggcccagccaaacc

SEQ ID NO: 4245579 - DNA, 17 bp, Homo sapiens
tctggattcacagacca

SEQ ID NO: 4245580 - DNA, 19 bp, Homo sapiens
tctggctatgcatttgaaa

SEQ ID NO: 4245581 - DNA, 22 bp, Homo sapiens
tctggctatgcatttgaaaatt

SEQ ID NO: 4245582 - DNA, 23 bp, Homo sapiens
tctgtccagccgtgtgtgcatgt

SEQ ID NO: 4245583 - DNA, 15 bp, Homo sapiens
tctgtgattacctct

SEQ ID NO: 4245584 - DNA, 12 bp, Homo sapiens
tctgtgcatgtg

SEQ ID NO: 4245585 - DNA, 20 bp, Homo sapiens
tctgtggccaggagccctgg

SEQ ID NO: 4245586 - DNA, 12 bp, Homo sapiens
tctgttatatga

SEQ ID NO: 4245587 - DNA, 13 bp, Homo sapiens
tctgttctttcca

SEQ ID NO: 4245588 - DNA, 22 bp, Homo sapiens
tctgttctttccaaagtacact

SEQ ID NO: 4245589 - DNA, 23 bp, Homo sapiens
tctgttgctggtgtactctagga

SEQ ID NO: 4245590 - DNA, 13 bp, Homo sapiens
tctgtttagataa

SEQ ID NO: 4245591 - DNA, 14 bp, Homo sapiens
tcttaaacttgtga

SEQ ID NO: 4245592 - DNA, 15 bp, Homo sapiens
tcttaaacttgtgaa

SEQ ID NO: 4245593 - DNA, 18 bp, Homo sapiens
tcttaagatggaaataca

SEQ ID NO: 4245594 - DNA, 19 bp, Homo sapiens
tcttaagatggaaatacag

SEQ ID NO: 4245595 - DNA, 16 bp, Homo sapiens
tcttaagtcagatttt

SEQ ID NO: 4245596 - DNA, 18 bp, Homo sapiens
tcttaagtcagattttta

SEQ ID NO: 4245597 - DNA, 15 bp, Homo sapiens
tcttaatctgtgtgt

SEQ ID NO: 4245598 - DNA, 22 bp, Homo sapiens
tcttagagccttttatctgcag

SEQ ID NO: 4245599 - DNA, 18 bp, Homo sapiens
tcttatataagatcactg

SEQ ID NO: 4245600 - DNA, 14 bp, Homo sapiens
tcttatgtgtgcct

SEQ ID NO: 4245601 - DNA, 20 bp, Homo sapiens
tcttcaacatgctccaaata

SEQ ID NO: 4245602 - DNA, 15 bp, Homo sapiens
tcttcacaggcactc

SEQ ID NO: 4245603 - DNA, 15 bp, Homo sapiens
tcttcacctgttatg

SEQ ID NO: 4245604 - DNA, 20 bp, Homo sapiens
tcttcactcaggtctcagct

SEQ ID NO: 4245605 - DNA, 18 bp, Homo sapiens
tcttcagactctcagccc

SEQ ID NO: 4245606 - DNA, 20 bp, Homo sapiens
tcttcagactctcagcccag

SEQ ID NO: 4245607 - DNA, 22 bp, Homo sapiens
tcttcagactctcagcccagaa

SEQ ID NO: 4245608 - DNA, 23 bp, Homo sapiens
tcttcagatctctaacttcacca

SEQ ID NO: 4245609 - DNA, 15 bp, Homo sapiens
tcttcccagagtcac

SEQ ID NO: 4245610 - DNA, 17 bp, Homo sapiens
tcttcccagagtcacaa

SEQ ID NO: 4245611 - DNA, 19 bp, Homo sapiens
tcttctgtatttctaggca

SEQ ID NO: 4245612 - DNA, 20 bp, Homo sapiens
tcttgaaatataggaactta

SEQ ID NO: 4245613 - DNA, 21 bp, Homo sapiens
tcttgaaatataggaacttaa

SEQ ID NO: 4245614 - DNA, 17 bp, Homo sapiens
tcttgagccttgaactt

SEQ ID NO: 4245615 - DNA, 14 bp, Homo sapiens
tcttgcaacttcag

SEQ ID NO: 4245616 - DNA, 16 bp, Homo sapiens
tcttgcaacttcagtt

SEQ ID NO: 4245617 - DNA, 19 bp, Homo sapiens
tcttggcttactgcagcct

SEQ ID NO: 4245618 - DNA, 17 bp, Homo sapiens
tcttgggaccccagaga

SEQ ID NO: 4245619 - DNA, 22 bp, Homo sapiens
tcttgggaccccagagaaaacc

SEQ ID NO: 4245620 - DNA, 20 bp, Homo sapiens
tcttgggtgttagtgtcagc

SEQ ID NO: 4245621 - DNA, 16 bp, Homo sapiens
tcttggtttgtaaatt

SEQ ID NO: 4245622 - DNA, 14 bp, Homo sapiens
tcttgtgaaatggc

SEQ ID NO: 4245623 - DNA, 22 bp, Homo sapiens
tcttgttttgtcttgaaagtgg

SEQ ID NO: 4245624 - DNA, 21 bp, Homo sapiens
tctttacccctgctgacctcc

SEQ ID NO: 4245625 - DNA, 14 bp, Homo sapiens
tctttccaaagtac

SEQ ID NO: 4245626 - DNA, 23 bp, Homo sapiens
tctttccaaagtacactgtttca

SEQ ID NO: 4245627 - DNA, 19 bp, Homo sapiens
tctttctggctatgcattt

SEQ ID NO: 4245628 - DNA, 23 bp, Homo sapiens
tcttttcataaagggttgaaaat

SEQ ID NO: 4245629 - DNA, 20 bp, Homo sapiens
tcttttccttcattcatagg

SEQ ID NO: 4245630 - DNA, 17 bp, Homo sapiens
tcttttgccgttattaa

SEQ ID NO: 4245631 - DNA, 15 bp, Homo sapiens
tcttttgtttccatg

SEQ ID NO: 4245632 - DNA, 20 bp, Homo sapiens
tgaaaaacaattttctgtaa

SEQ ID NO: 4245633 - DNA, 14 bp, Homo sapiens
tgaaaacacatttt

SEQ ID NO: 4245634 - DNA, 17 bp, Homo sapiens
tgaaaacacatttttct

SEQ ID NO: 4245635 - DNA, 19 bp, Homo sapiens
tgaaaacacatttttctta

SEQ ID NO: 4245636 - DNA, 20 bp, Homo sapiens
tgaaaacacatttttcttag

SEQ ID NO: 4245637 - DNA, 12 bp, Homo sapiens
tgaaaagtcgtt

SEQ ID NO: 4245638 - DNA, 22 bp, Homo sapiens
tgaaaattcgcccgagctgttt

SEQ ID NO: 4245639 - DNA, 13 bp, Homo sapiens
tgaaaattttgat

SEQ ID NO: 4245640 - DNA, 18 bp, Homo sapiens
tgaaactggattaaactt

SEQ ID NO: 4245641 - DNA, 19 bp, Homo sapiens
tgaacatacttcaaaaata

SEQ ID NO: 4245642 - DNA, 21 bp, Homo sapiens
tgaacatacttcaaaaataat

SEQ ID NO: 4245643 - DNA, 17 bp, Homo sapiens
tgaaccctttgtttctt

SEQ ID NO: 4245644 - DNA, 13 bp, Homo sapiens
tgaactgataaag

SEQ ID NO: 4245645 - DNA, 11 bp, Homo sapiens
tgaactttgac

SEQ ID NO: 4245646 - DNA, 21 bp, Homo sapiens
tgaagacaatgacttactgta

SEQ ID NO: 4245647 - DNA, 23 bp, Homo sapiens
tgaagacaatgacttactgtaca

SEQ ID NO: 4245648 - DNA, 20 bp, Homo sapiens
tgaagatatatttcactttt

SEQ ID NO: 4245649 - DNA, 23 bp, Homo sapiens
tgaagccagatctcgggactcag

SEQ ID NO: 4245650 - DNA, 15 bp, Homo sapiens
tgaagcctaaatttg

SEQ ID NO: 4245651 - DNA, 20 bp, Homo sapiens
tgaagtaatatgcacacatt

SEQ ID NO: 4245652 - DNA, 22 bp, Homo sapiens
tgaagtaatatgcacacatttt

SEQ ID NO: 4245653 - DNA, 16 bp, Homo sapiens
tgaataaactgaatat

SEQ ID NO: 4245654 - DNA, 22 bp, Homo sapiens
tgaatattactcctatttttgt

SEQ ID NO: 4245655 - DNA, 16 bp, Homo sapiens
tgaatattttggaaac

SEQ ID NO: 4245656 - DNA, 17 bp, Homo sapiens
tgaatattttggaaact

SEQ ID NO: 4245657 - DNA, 23 bp, Homo sapiens
tgaatattttggaaactgctaaa

SEQ ID NO: 4245658 - DNA, 12 bp, Homo sapiens
tgaattgaaaaa

SEQ ID NO: 4245659 - DNA, 15 bp, Homo sapiens
tgaatttcttttgcc

SEQ ID NO: 4245660 - DNA, 23 bp, Homo sapiens
tgacaatactgtatcagatgtga

SEQ ID NO: 4245661 - DNA, 19 bp, Homo sapiens
tgacacaggaaatgggaaa

SEQ ID NO: 4245662 - DNA, 12 bp, Homo sapiens
tgacacatgcaa

SEQ ID NO: 4245663 - DNA, 20 bp, Homo sapiens
tgacacatgcaaggtcattt

SEQ ID NO: 4245664 - DNA, 18 bp, Homo sapiens
tgacaggcctgaagatat

SEQ ID NO: 4245665 - DNA, 20 bp, Homo sapiens
tgacattaaatgcaataatt

SEQ ID NO: 4245666 - DNA, 21 bp, Homo sapiens
tgacattaaatgcaataattt

SEQ ID NO: 4245667 - DNA, 16 bp, Homo sapiens
tgacatttgtttattt

SEQ ID NO: 4245668 - DNA, 13 bp, Homo sapiens
tgacctaaattag

SEQ ID NO: 4245669 - DNA, 16 bp, Homo sapiens
tgacctaaattagata

SEQ ID NO: 4245670 - DNA, 21 bp, Homo sapiens
tgacctcccacctatccgccc

SEQ ID NO: 4245671 - DNA, 13 bp, Homo sapiens
tgacctctgcagc

SEQ ID NO: 4245672 - DNA, 16 bp, Homo sapiens
tgacctctgcagcaat

SEQ ID NO: 4245673 - DNA, 15 bp, Homo sapiens
tgacttactgtacat

SEQ ID NO: 4245674 - DNA, 16 bp, Homo sapiens
tgacttactgtacatg

SEQ ID NO: 4245675 - DNA, 18 bp, Homo sapiens
tgactttttttggtataa

SEQ ID NO: 4245676 - DNA, 17 bp, Homo sapiens
tgagaatcccttaaaat

SEQ ID NO: 4245677 - DNA, 16 bp, Homo sapiens
tgagacaatgttttct

SEQ ID NO: 4245678 - DNA, 15 bp, Homo sapiens
tgagagaatggagac

SEQ ID NO: 4245679 - DNA, 19 bp, Homo sapiens
tgagagcgaattgtgtgga

SEQ ID NO: 4245680 - DNA, 18 bp, Homo sapiens
tgagattgccccaggtct

SEQ ID NO: 4245681 - DNA, 19 bp, Homo sapiens
tgagattgccccaggtctg

SEQ ID NO: 4245682 - DNA, 22 bp, Homo sapiens
tgagcccccttcctgtccccag

SEQ ID NO: 4245683 - DNA, 17 bp, Homo sapiens
tgagccttgaactttga

SEQ ID NO: 4245684 - DNA, 16 bp, Homo sapiens
tgagctttctgtgcat

SEQ ID NO: 4245685 - DNA, 17 bp, Homo sapiens
tgagctttctgtgcatg

SEQ ID NO: 4245686 - DNA, 12 bp, Homo sapiens
tgaggcatttgt

SEQ ID NO: 4245687 - DNA, 20 bp, Homo sapiens
tgaggcatttgtttgaactg

SEQ ID NO: 4245688 - DNA, 23 bp, Homo sapiens
tgaggcatttgtttgaactgata

SEQ ID NO: 4245689 - DNA, 13 bp, Homo sapiens
tgaggctcagtct

SEQ ID NO: 4245690 - DNA, 16 bp, Homo sapiens
tgaggctcagtctctc

SEQ ID NO: 4245691 - DNA, 20 bp, Homo sapiens
tgaggtctgttctttccaaa

SEQ ID NO: 4245692 - DNA, 12 bp, Homo sapiens
tgaggtggtagg

SEQ ID NO: 4245693 - DNA, 17 bp, Homo sapiens
tgagtacgttgtgcatt

SEQ ID NO: 4245694 - DNA, 18 bp, Homo sapiens
tgagtacgttgtgcattt

SEQ ID NO: 4245695 - DNA, 20 bp, Homo sapiens
tgagtacgttgtgcatttgg

SEQ ID NO: 4245696 - DNA, 21 bp, Homo sapiens
tgagtttgtaggtaaaatgta

SEQ ID NO: 4245697 - DNA, 18 bp, Homo sapiens
tgataaaacaacagctcg

SEQ ID NO: 4245698 - DNA, 16 bp, Homo sapiens
tgataaaataaataat

SEQ ID NO: 4245699 - DNA, 16 bp, Homo sapiens
tgataataatattgtt

SEQ ID NO: 4245700 - DNA, 14 bp, Homo sapiens
tgatacaacattaa

SEQ ID NO: 4245701 - DNA, 20 bp, Homo sapiens
tgatacaatgctgtgcccta

SEQ ID NO: 4245702 - DNA, 17 bp, Homo sapiens
tgatactacagtttgtt

SEQ ID NO: 4245703 - DNA, 15 bp, Homo sapiens
tgatattatattaaa

SEQ ID NO: 4245704 - DNA, 19 bp, Homo sapiens
tgatattatattaaacata

SEQ ID NO: 4245705 - DNA, 18 bp, Homo sapiens
tgatattgtttaaaattc

SEQ ID NO: 4245706 - DNA, 21 bp, Homo sapiens
tgatcttggcttactgcagcc

SEQ ID NO: 4245707 - DNA, 12 bp, Homo sapiens
tgatgaagtata

SEQ ID NO: 4245708 - DNA, 13 bp, Homo sapiens
tgatgagacctgg

SEQ ID NO: 4245709 - DNA, 13 bp, Homo sapiens
tgatgcaggcact

SEQ ID NO: 4245710 - DNA, 23 bp, Homo sapiens
tgatgtgactttttttggtataa

SEQ ID NO: 4245711 - DNA, 16 bp, Homo sapiens
tgatgttaaatgtaat

SEQ ID NO: 4245712 - DNA, 19 bp, Homo sapiens
tgattaaattcttgcaaag

SEQ ID NO: 4245713 - DNA, 22 bp, Homo sapiens
tgatttccgttaaaataccagc

SEQ ID NO: 4245714 - DNA, 13 bp, Homo sapiens
tgatttgatgtga

SEQ ID NO: 4245715 - DNA, 22 bp, Homo sapiens
tgattttaaaggcagagaagtt

SEQ ID NO: 4245716 - DNA, 14 bp, Homo sapiens
tgattttaatacat

SEQ ID NO: 4245717 - DNA, 20 bp, Homo sapiens
tgcaaacttttttatatctt

SEQ ID NO: 4245718 - DNA, 15 bp, Homo sapiens
tgcaaagtacaatgt

SEQ ID NO: 4245719 - DNA, 19 bp, Homo sapiens
tgcaaagtacaatgtgttt

SEQ ID NO: 4245720 - DNA, 15 bp, Homo sapiens
tgcaaggtcattttt

SEQ ID NO: 4245721 - DNA, 21 bp, Homo sapiens
tgcaagttatattagtgaaga

SEQ ID NO: 4245722 - DNA, 14 bp, Homo sapiens
tgcaatccatttat

SEQ ID NO: 4245723 - DNA, 18 bp, Homo sapiens
tgcacaaggattgaaaat

SEQ ID NO: 4245724 - DNA, 13 bp, Homo sapiens
tgcacacattttt

SEQ ID NO: 4245725 - DNA, 17 bp, Homo sapiens
tgcacagagttgttaca

SEQ ID NO: 4245726 - DNA, 13 bp, Homo sapiens
tgcacctgagcct

SEQ ID NO: 4245727 - DNA, 17 bp, Homo sapiens
tgcacctggaatatata

SEQ ID NO: 4245728 - DNA, 13 bp, Homo sapiens
tgcactaaatatg

SEQ ID NO: 4245729 - DNA, 20 bp, Homo sapiens
tgcactctgtaattgcactt

SEQ ID NO: 4245730 - DNA, 12 bp, Homo sapiens
tgcactgtccag

SEQ ID NO: 4245731 - DNA, 15 bp, Homo sapiens
tgcactttttaagtt

SEQ ID NO: 4245732 - DNA, 15 bp, Homo sapiens
tgcagaaaatattta

SEQ ID NO: 4245733 - DNA, 20 bp, Homo sapiens
tgcagaataatggaaacatt

SEQ ID NO: 4245734 - DNA, 20 bp, Homo sapiens
tgcagcaaatatatgattct

SEQ ID NO: 4245735 - DNA, 15 bp, Homo sapiens
tgcagcaataaagca

SEQ ID NO: 4245736 - DNA, 17 bp, Homo sapiens
tgcagcccctctcacag

SEQ ID NO: 4245737 - DNA, 18 bp, Homo sapiens
tgcagcccgtgtccagga

SEQ ID NO: 4245738 - DNA, 17 bp, Homo sapiens
tgcataatgataaaata

SEQ ID NO: 4245739 - DNA, 18 bp, Homo sapiens
tgcataatgataaaataa

SEQ ID NO: 4245740 - DNA, 14 bp, Homo sapiens
tgcataccactttt

SEQ ID NO: 4245741 - DNA, 16 bp, Homo sapiens
tgcataccacttttgt

SEQ ID NO: 4245742 - DNA, 15 bp, Homo sapiens
tgcatattaaataat

SEQ ID NO: 4245743 - DNA, 23 bp, Homo sapiens
tgcatctggcacgtggccaggag

SEQ ID NO: 4245744 - DNA, 18 bp, Homo sapiens
tgcattatctagatactg

SEQ ID NO: 4245745 - DNA, 19 bp, Homo sapiens
tgcattcattctgagcccc

SEQ ID NO: 4245746 - DNA, 18 bp, Homo sapiens
tgcatttgaggtctgttc

SEQ ID NO: 4245747 - DNA, 21 bp, Homo sapiens
tgcatttggtggtttcagaaa

SEQ ID NO: 4245748 - DNA, 23 bp, Homo sapiens
tgcatttggtggtttcagaaatg

SEQ ID NO: 4245749 - DNA, 22 bp, Homo sapiens
tgccacacctcgaactggttgt

SEQ ID NO: 4245750 - DNA, 21 bp, Homo sapiens
tgccacagtggtactctgtgt

SEQ ID NO: 4245751 - DNA, 13 bp, Homo sapiens
tgccaggtgctgg

SEQ ID NO: 4245752 - DNA, 22 bp, Homo sapiens
tgccagtgctaagctgccctga

SEQ ID NO: 4245753 - DNA, 23 bp, Homo sapiens
tgccagtggagacggaatctgcc

SEQ ID NO: 4245754 - DNA, 15 bp, Homo sapiens
tgcccagccctctgt

SEQ ID NO: 4245755 - DNA, 18 bp, Homo sapiens
tgcccagccctctgtggc

SEQ ID NO: 4245756 - DNA, 21 bp, Homo sapiens
tgcccagccctctgtggccag

SEQ ID NO: 4245757 - DNA, 17 bp, Homo sapiens
tgcccaggctggtctca

SEQ ID NO: 4245758 - DNA, 17 bp, Homo sapiens
tgcccttaccccacaca

SEQ ID NO: 4245759 - DNA, 16 bp, Homo sapiens
tgcccttccctggagg

SEQ ID NO: 4245760 - DNA, 17 bp, Homo sapiens
tgccgaccacgccccag

SEQ ID NO: 4245761 - DNA, 19 bp, Homo sapiens
tgcctcttttcagtagtga

SEQ ID NO: 4245762 - DNA, 18 bp, Homo sapiens
tgcctgctgggtgccagg

SEQ ID NO: 4245763 - DNA, 18 bp, Homo sapiens
tgcctggttaatattaat

SEQ ID NO: 4245764 - DNA, 16 bp, Homo sapiens
tgcctggttcgtgcca

SEQ ID NO: 4245765 - DNA, 21 bp, Homo sapiens
tgcctgttttgagaccagaag

SEQ ID NO: 4245766 - DNA, 17 bp, Homo sapiens
tgcgcacttacctgctt

SEQ ID NO: 4245767 - DNA, 15 bp, Homo sapiens
tgcgtgcataccact

SEQ ID NO: 4245768 - DNA, 18 bp, Homo sapiens
tgctaaattctatgttaa

SEQ ID NO: 4245769 - DNA, 20 bp, Homo sapiens
tgctaaattctatgttaaat

SEQ ID NO: 4245770 - DNA, 11 bp, Homo sapiens
tgctacacact

SEQ ID NO: 4245771 - DNA, 13 bp, Homo sapiens
tgctacctgcacc

SEQ ID NO: 4245772 - DNA, 22 bp, Homo sapiens
tgctactgtacataaacaatga

SEQ ID NO: 4245773 - DNA, 21 bp, Homo sapiens
tgctagaaaatttagcccttt

SEQ ID NO: 4245774 - DNA, 20 bp, Homo sapiens
tgctatggaacataaagttg

SEQ ID NO: 4245775 - DNA, 16 bp, Homo sapiens
tgctcagggtcaattt

SEQ ID NO: 4245776 - DNA, 22 bp, Homo sapiens
tgctccgcagggcgcccagcgc

SEQ ID NO: 4245777 - DNA, 21 bp, Homo sapiens
tgctgaagggcattctttccc

SEQ ID NO: 4245778 - DNA, 17 bp, Homo sapiens
tgctgccaccacttttg

SEQ ID NO: 4245779 - DNA, 15 bp, Homo sapiens
tgctgggtgccaggt

SEQ ID NO: 4245780 - DNA, 16 bp, Homo sapiens
tgctgggtgccaggtg

SEQ ID NO: 4245781 - DNA, 16 bp, Homo sapiens
tgctggtaacagtggc

SEQ ID NO: 4245782 - DNA, 19 bp, Homo sapiens
tgctggtaacagtggctgc

SEQ ID NO: 4245783 - DNA, 17 bp, Homo sapiens
tgctggtgtactctagg

SEQ ID NO: 4245784 - DNA, 17 bp, Homo sapiens
tgctgtccatgcttctc

SEQ ID NO: 4245785 - DNA, 18 bp, Homo sapiens
tgctgtccgtgcttgctg

SEQ ID NO: 4245786 - DNA, 18 bp, Homo sapiens
tgcttaaaaaataataca

SEQ ID NO: 4245787 - DNA, 20 bp, Homo sapiens
tgcttaaaaaataatacaac

SEQ ID NO: 4245788 - DNA, 14 bp, Homo sapiens
tgcttaacttcaca

SEQ ID NO: 4245789 - DNA, 17 bp, Homo sapiens
tgcttaacttcacatat

SEQ ID NO: 4245790 - DNA, 18 bp, Homo sapiens
tgcttaacttcacatatt

SEQ ID NO: 4245791 - DNA, 17 bp, Homo sapiens
tgcttctcatcttgtga

SEQ ID NO: 4245792 - DNA, 13 bp, Homo sapiens
tgcttctccccag

SEQ ID NO: 4245793 - DNA, 19 bp, Homo sapiens
tgcttctccccagaattca

SEQ ID NO: 4245794 - DNA, 16 bp, Homo sapiens
tgcttgagctttctgt

SEQ ID NO: 4245795 - DNA, 23 bp, Homo sapiens
tgcttgagctttctgtgcatgtg

SEQ ID NO: 4245796 - DNA, 15 bp, Homo sapiens
tgcttgctggtgcct

SEQ ID NO: 4245797 - DNA, 20 bp, Homo sapiens
tgcttgggtcctactcctgg

SEQ ID NO: 4245798 - DNA, 22 bp, Homo sapiens
tgcttgtacataatgcgtgcat

SEQ ID NO: 4245799 - DNA, 16 bp, Homo sapiens
tgcttgttccctctcc

SEQ ID NO: 4245800 - DNA, 16 bp, Homo sapiens
tgctttatcttttcat

SEQ ID NO: 4245801 - DNA, 12 bp, Homo sapiens
tgctttgtgatt

SEQ ID NO: 4245802 - DNA, 13 bp, Homo sapiens
tgctttttaccta

SEQ ID NO: 4245803 - DNA, 16 bp, Homo sapiens
tggaaacattacagtt

SEQ ID NO: 4245804 - DNA, 18 bp, Homo sapiens
tggaaacattacagttca

SEQ ID NO: 4245805 - DNA, 21 bp, Homo sapiens
tggaaactgctaaattctatg

SEQ ID NO: 4245806 - DNA, 19 bp, Homo sapiens
tggaaatggatgcaaagta

SEQ ID NO: 4245807 - DNA, 20 bp, Homo sapiens
tggaacaaagtgaaggacat

SEQ ID NO: 4245808 - DNA, 15 bp, Homo sapiens
tggaatatataacca

SEQ ID NO: 4245809 - DNA, 16 bp, Homo sapiens
tggacgctgccgggag

SEQ ID NO: 4245810 - DNA, 20 bp, Homo sapiens
tggactaattattattttaa

SEQ ID NO: 4245811 - DNA, 14 bp, Homo sapiens
tggactacaaaata

SEQ ID NO: 4245812 - DNA, 15 bp, Homo sapiens
tggagaactcagtgc

SEQ ID NO: 4245813 - DNA, 17 bp, Homo sapiens
tggagaattgctgaagg

SEQ ID NO: 4245814 - DNA, 18 bp, Homo sapiens
tggagaattgctgaaggg

SEQ ID NO: 4245815 - DNA, 13 bp, Homo sapiens
tggagaccaggct

SEQ ID NO: 4245816 - DNA, 22 bp, Homo sapiens
tggagactactggccccgcccg

SEQ ID NO: 4245817 - DNA, 13 bp, Homo sapiens
tggaggcctacct

SEQ ID NO: 4245818 - DNA, 22 bp, Homo sapiens
tggatatttttgtacttgattt

SEQ ID NO: 4245819 - DNA, 17 bp, Homo sapiens
tggatcatagaattgca

SEQ ID NO: 4245820 - DNA, 17 bp, Homo sapiens
tggatgactgttgatga

SEQ ID NO: 4245821 - DNA, 20 bp, Homo sapiens
tggatgcaaagtacaatgtg

SEQ ID NO: 4245822 - DNA, 15 bp, Homo sapiens
tggattcacagacca

SEQ ID NO: 4245823 - DNA, 15 bp, Homo sapiens
tggatttaacagaaa

SEQ ID NO: 4245824 - DNA, 17 bp, Homo sapiens
tggatttaacagaaatg

SEQ ID NO: 4245825 - DNA, 24 bp, Homo sapiens
tggatttaacagaaatgtacagca

SEQ ID NO: 4245826 - DNA, 17 bp, Homo sapiens
tggcaattccaatattt

SEQ ID NO: 4245827 - DNA, 21 bp, Homo sapiens
tggcacatcagcacgatttct

SEQ ID NO: 4245828 - DNA, 20 bp, Homo sapiens
tggcacgtggccaggagcca

SEQ ID NO: 4245829 - DNA, 16 bp, Homo sapiens
tggcagctagtgcctt

SEQ ID NO: 4245830 - DNA, 15 bp, Homo sapiens
tggcatggagactct

SEQ ID NO: 4245831 - DNA, 19 bp, Homo sapiens
tggcatggagactctgaga

SEQ ID NO: 4245832 - DNA, 15 bp, Homo sapiens
tggccaggagccctg

SEQ ID NO: 4245833 - DNA, 22 bp, Homo sapiens
tggcccagccaaaccctgtctg

SEQ ID NO: 4245834 - DNA, 15 bp, Homo sapiens
tggcccagttgtcca

SEQ ID NO: 4245835 - DNA, 16 bp, Homo sapiens
tggcccagttgtccat

SEQ ID NO: 4245836 - DNA, 20 bp, Homo sapiens
tggcccgcaagagggacaga

SEQ ID NO: 4245837 - DNA, 13 bp, Homo sapiens
tggccgccatgct

SEQ ID NO: 4245838 - DNA, 18 bp, Homo sapiens
tggccttgaaaccacctt

SEQ ID NO: 4245839 - DNA, 22 bp, Homo sapiens
tggctagaggttcaaagatatt

SEQ ID NO: 4245840 - DNA, 14 bp, Homo sapiens
tggctatgcatttg

SEQ ID NO: 4245841 - DNA, 19 bp, Homo sapiens
tggctcagagcttgaagat

SEQ ID NO: 4245842 - DNA, 22 bp, Homo sapiens
tggctgcaccacttccagggtt

SEQ ID NO: 4245843 - DNA, 14 bp, Homo sapiens
tggctgtgaggggt

SEQ ID NO: 4245844 - DNA, 21 bp, Homo sapiens
tggcttttgtgcattatctag

SEQ ID NO: 4245845 - DNA, 18 bp, Homo sapiens
tgggaagctcccacaccc

SEQ ID NO: 4245846 - DNA, 15 bp, Homo sapiens
tgggaagctgagggc

SEQ ID NO: 4245847 - DNA, 16 bp, Homo sapiens
tgggaaggccagctgc

SEQ ID NO: 4245848 - DNA, 13 bp, Homo sapiens
tgggaatacatct

SEQ ID NO: 4245849 - DNA, 17 bp, Homo sapiens
tgggaatacatctgtgg

SEQ ID NO: 4245850 - DNA, 19 bp, Homo sapiens
tgggaccccagagaaaacc

SEQ ID NO: 4245851 - DNA, 13 bp, Homo sapiens
tgggaggagggag

SEQ ID NO: 4245852 - DNA, 13 bp, Homo sapiens
tgggatctgccaa

SEQ ID NO: 4245853 - DNA, 17 bp, Homo sapiens
tgggatttttttattaa

SEQ ID NO: 4245854 - DNA, 12 bp, Homo sapiens
tgggcagggaag

SEQ ID NO: 4245855 - DNA, 19 bp, Homo sapiens
tgggccaatttactggcca

SEQ ID NO: 4245856 - DNA, 10 bp, Homo sapiens
tgggctcctg

SEQ ID NO: 4245857 - DNA, 15 bp, Homo sapiens
tggggagggagtctg

SEQ ID NO: 4245858 - DNA, 16 bp, Homo sapiens
tggggagggagtctgg

SEQ ID NO: 4245859 - DNA, 21 bp, Homo sapiens
tggggcaagactgcaaacttt

SEQ ID NO: 4245860 - DNA, 18 bp, Homo sapiens
tggggtggggaagggaag

SEQ ID NO: 4245861 - DNA, 16 bp, Homo sapiens
tggggtttagaacccc

SEQ ID NO: 4245862 - DNA, 16 bp, Homo sapiens
tgggtcctactcctgg

SEQ ID NO: 4245863 - DNA, 22 bp, Homo sapiens
tgggtctcgctttgttgcccag

SEQ ID NO: 4245864 - DNA, 22 bp, Homo sapiens
tgggtcttcttttactggactg

SEQ ID NO: 4245865 - DNA, 18 bp, Homo sapiens
tgggtggcaggggggctg

SEQ ID NO: 4245866 - DNA, 16 bp, Homo sapiens
tggtactctgtgtctg

SEQ ID NO: 4245867 - DNA, 15 bp, Homo sapiens
tggtagcataaataa

SEQ ID NO: 4245868 - DNA, 16 bp, Homo sapiens
tggtataatgtttaaa

SEQ ID NO: 4245869 - DNA, 20 bp, Homo sapiens
tggtataatgtttaaatcat

SEQ ID NO: 4245870 - DNA, 23 bp, Homo sapiens
tggtattggctagaggttcaaag

SEQ ID NO: 4245871 - DNA, 16 bp, Homo sapiens
tggtcatatacatatt

SEQ ID NO: 4245872 - DNA, 17 bp, Homo sapiens
tggtcatatacatattg

SEQ ID NO: 4245873 - DNA, 12 bp, Homo sapiens
tggtcctgactt

SEQ ID NO: 4245874 - DNA, 17 bp, Homo sapiens
tggtcggaaaacatgct

SEQ ID NO: 4245875 - DNA, 17 bp, Homo sapiens
tggtcgtcatgctgtcc

SEQ ID NO: 4245876 - DNA, 20 bp, Homo sapiens
tggtgcccttccctggaggt

SEQ ID NO: 4245877 - DNA, 15 bp, Homo sapiens
tggtggaagtcttgg

SEQ ID NO: 4245878 - DNA, 14 bp, Homo sapiens
tggtggctcatgcc

SEQ ID NO: 4245879 - DNA, 16 bp, Homo sapiens
tggtggctcatgcctg

SEQ ID NO: 4245880 - DNA, 21 bp, Homo sapiens
tggttacctgacctaaattag

SEQ ID NO: 4245881 - DNA, 12 bp, Homo sapiens
tggttttctgtt

SEQ ID NO: 4245882 - DNA, 13 bp, Homo sapiens
tggttttctgttc

SEQ ID NO: 4245883 - DNA, 18 bp, Homo sapiens
tgtaaagttatgtattta

SEQ ID NO: 4245884 - DNA, 20 bp, Homo sapiens
tgtaaagttatgtatttaaa

SEQ ID NO: 4245885 - DNA, 17 bp, Homo sapiens
tgtaaattaacttttat

SEQ ID NO: 4245886 - DNA, 15 bp, Homo sapiens
tgtaatataatgtat

SEQ ID NO: 4245887 - DNA, 16 bp, Homo sapiens
tgtaatataatgtatt

SEQ ID NO: 4245888 - DNA, 23 bp, Homo sapiens
tgtaattgcactttttaagtttg

SEQ ID NO: 4245889 - DNA, 21 bp, Homo sapiens
tgtaatttgtgatacaatgct

SEQ ID NO: 4245890 - DNA, 13 bp, Homo sapiens
tgtaatttttgct

SEQ ID NO: 4245891 - DNA, 20 bp, Homo sapiens
tgtacataatgcgtgcatac

SEQ ID NO: 4245892 - DNA, 14 bp, Homo sapiens
tgtacatgaaaaca

SEQ ID NO: 4245893 - DNA, 18 bp, Homo sapiens
tgtacatgaaaacacatt

SEQ ID NO: 4245894 - DNA, 17 bp, Homo sapiens
tgtaccatggtttgata

SEQ ID NO: 4245895 - DNA, 14 bp, Homo sapiens
tgtacctcttgagc

SEQ ID NO: 4245896 - DNA, 20 bp, Homo sapiens
tgtaccttaagatattgaag

SEQ ID NO: 4245897 - DNA, 14 bp, Homo sapiens
tgtactctaggact

SEQ ID NO: 4245898 - DNA, 13 bp, Homo sapiens
tgtacttgaaaaa

SEQ ID NO: 4245899 - DNA, 15 bp, Homo sapiens
tgtagccagctgtgc

SEQ ID NO: 4245900 - DNA, 19 bp, Homo sapiens
tgtagccttagagcatctc

SEQ ID NO: 4245901 - DNA, 22 bp, Homo sapiens
tgtataatgtgcagaaaatatt

SEQ ID NO: 4245902 - DNA, 22 bp, Homo sapiens
tgtatagagaatttaagtagaa

SEQ ID NO: 4245903 - DNA, 14 bp, Homo sapiens
tgtatataatttta

SEQ ID NO: 4245904 - DNA, 14 bp, Homo sapiens
tgtatcagatgtga

SEQ ID NO: 4245905 - DNA, 21 bp, Homo sapiens
tgtatgaaggaatcattccag

SEQ ID NO: 4245906 - DNA, 12 bp, Homo sapiens
tgtatgtagcct

SEQ ID NO: 4245907 - DNA, 12 bp, Homo sapiens
tgtatgtataca

SEQ ID NO: 4245908 - DNA, 15 bp, Homo sapiens
tgtattcttctgtat

SEQ ID NO: 4245909 - DNA, 22 bp, Homo sapiens
tgtattcttctgtatttctagg

SEQ ID NO: 4245910 - DNA, 15 bp, Homo sapiens
tgtattgcatgcaat

SEQ ID NO: 4245911 - DNA, 17 bp, Homo sapiens
tgtattgtaatctttca

SEQ ID NO: 4245912 - DNA, 16 bp, Homo sapiens
tgtattttttaaaaca

SEQ ID NO: 4245913 - DNA, 19 bp, Homo sapiens
tgtattttttaaaacacta

SEQ ID NO: 4245914 - DNA, 16 bp, Homo sapiens
tgtatttttttactaa

SEQ ID NO: 4245915 - DNA, 16 bp, Homo sapiens
tgtcaagtctctgctg

SEQ ID NO: 4245916 - DNA, 18 bp, Homo sapiens
tgtccacacccagctcag

SEQ ID NO: 4245917 - DNA, 21 bp, Homo sapiens
tgtccagccgtgtgtgcatgt

SEQ ID NO: 4245918 - DNA, 23 bp, Homo sapiens
tgtccagccgtgtgtgcatgtgc

SEQ ID NO: 4245919 - DNA, 16 bp, Homo sapiens
tgtccaggagccccgc

SEQ ID NO: 4245920 - DNA, 20 bp, Homo sapiens
tgtccaggagccccgccagg

SEQ ID NO: 4245921 - DNA, 14 bp, Homo sapiens
tgtccttgcacctg

SEQ ID NO: 4245922 - DNA, 17 bp, Homo sapiens
tgtccttgcacctgagc

SEQ ID NO: 4245923 - DNA, 19 bp, Homo sapiens
tgtccttgcacctgagcct

SEQ ID NO: 4245924 - DNA, 13 bp, Homo sapiens
tgtctcactgttc

SEQ ID NO: 4245925 - DNA, 14 bp, Homo sapiens
tgtctcactgttct

SEQ ID NO: 4245926 - DNA, 16 bp, Homo sapiens
tgtctcactgttctgc

SEQ ID NO: 4245927 - DNA, 18 bp, Homo sapiens
tgtctcactgttctgcaa

SEQ ID NO: 4245928 - DNA, 18 bp, Homo sapiens
tgtctctcttcagactct

SEQ ID NO: 4245929 - DNA, 19 bp, Homo sapiens
tgtctctcttcagactctc

SEQ ID NO: 4245930 - DNA, 17 bp, Homo sapiens
tgtctgacttttgttaa

SEQ ID NO: 4245931 - DNA, 21 bp, Homo sapiens
tgtctgacttttgttaaattc

SEQ ID NO: 4245932 - DNA, 15 bp, Homo sapiens
tgtcttgcaacttca

SEQ ID NO: 4245933 - DNA, 20 bp, Homo sapiens
tgtgaactagggaagctcag

SEQ ID NO: 4245934 - DNA, 14 bp, Homo sapiens
tgtgaatgcttctc

SEQ ID NO: 4245935 - DNA, 12 bp, Homo sapiens
tgtgcagaataa

SEQ ID NO: 4245936 - DNA, 20 bp, Homo sapiens
tgtgcagaataatggaaaca

SEQ ID NO: 4245937 - DNA, 20 bp, Homo sapiens
tgtgcataatgataaaataa

SEQ ID NO: 4245938 - DNA, 21 bp, Homo sapiens
tgtgcataatgataaaataaa

SEQ ID NO: 4245939 - DNA, 11 bp, Homo sapiens
tgtgcatgtgc

SEQ ID NO: 4245940 - DNA, 21 bp, Homo sapiens
tgtgcattatctagatactgt

SEQ ID NO: 4245941 - DNA, 23 bp, Homo sapiens
tgtgcattatctagatactgtat

SEQ ID NO: 4245942 - DNA, 23 bp, Homo sapiens
tgtgcatttggtggtttcagaaa

SEQ ID NO: 4245943 - DNA, 19 bp, Homo sapiens
tgtgctcttgttttgtctt

SEQ ID NO: 4245944 - DNA, 12 bp, Homo sapiens
tgtgcttctccc

SEQ ID NO: 4245945 - DNA, 15 bp, Homo sapiens
tgtgcttctccccag

SEQ ID NO: 4245946 - DNA, 18 bp, Homo sapiens
tgtgcttctccccagaat

SEQ ID NO: 4245947 - DNA, 15 bp, Homo sapiens
tgtgctttttaagaa

SEQ ID NO: 4245948 - DNA, 21 bp, Homo sapiens
tgtgctttttaagaatatttt

SEQ ID NO: 4245949 - DNA, 18 bp, Homo sapiens
tgtggagaactcagtgcc

SEQ ID NO: 4245950 - DNA, 19 bp, Homo sapiens
tgtggaggagggagagccc

SEQ ID NO: 4245951 - DNA, 20 bp, Homo sapiens
tgtggaggagggagagccct

SEQ ID NO: 4245952 - DNA, 23 bp, Homo sapiens
tgtggaggagggagagccctgtc

SEQ ID NO: 4245953 - DNA, 14 bp, Homo sapiens
tgtggccaggagcc

SEQ ID NO: 4245954 - DNA, 21 bp, Homo sapiens
tgtggtcgtcatgctgtccgt

SEQ ID NO: 4245955 - DNA, 10 bp, Homo sapiens
tgtggtttta

SEQ ID NO: 4245956 - DNA, 12 bp, Homo sapiens
tgtgtctgtagg

SEQ ID NO: 4245957 - DNA, 13 bp, Homo sapiens
tgtgtgcatgtgc

SEQ ID NO: 4245958 - DNA, 19 bp, Homo sapiens
tgtgtggagaactcagtgc

SEQ ID NO: 4245959 - DNA, 16 bp, Homo sapiens
tgtgtgtgtgtgtctg

SEQ ID NO: 4245960 - DNA, 22 bp, Homo sapiens
tgtgttatcacccagaagaaaa

SEQ ID NO: 4245961 - DNA, 14 bp, Homo sapiens
tgtgtttttctcca

SEQ ID NO: 4245962 - DNA, 18 bp, Homo sapiens
tgtgtttttctccagtgc

SEQ ID NO: 4245963 - DNA, 12 bp, Homo sapiens
tgttaaacacta

SEQ ID NO: 4245964 - DNA, 20 bp, Homo sapiens
tgttaaacagtagttgtatt

SEQ ID NO: 4245965 - DNA, 13 bp, Homo sapiens
tgttaaatactgt

SEQ ID NO: 4245966 - DNA, 16 bp, Homo sapiens
tgttaaatactgtgca

SEQ ID NO: 4245967 - DNA, 18 bp, Homo sapiens
tgttaaatactgtgcaga

SEQ ID NO: 4245968 - DNA, 18 bp, Homo sapiens
tgttatcggattactgaa

SEQ ID NO: 4245969 - DNA, 21 bp, Homo sapiens
tgttatgatattgtttaaaat

SEQ ID NO: 4245970 - DNA, 18 bp, Homo sapiens
tgttatgatttccttcaa

SEQ ID NO: 4245971 - DNA, 13 bp, Homo sapiens
tgttatgtatgaa

SEQ ID NO: 4245972 - DNA, 22 bp, Homo sapiens
tgttattcaaatttgatgatgt

SEQ ID NO: 4245973 - DNA, 13 bp, Homo sapiens
tgttattcctagt

SEQ ID NO: 4245974 - DNA, 22 bp, Homo sapiens
tgttccccactgacagcctccc

SEQ ID NO: 4245975 - DNA, 23 bp, Homo sapiens
tgttcctcaaatcagtgataatt

SEQ ID NO: 4245976 - DNA, 12 bp, Homo sapiens
tgttctgcaaag

SEQ ID NO: 4245977 - DNA, 13 bp, Homo sapiens
tgttctgctttat

SEQ ID NO: 4245978 - DNA, 14 bp, Homo sapiens
tgttcttaattctt

SEQ ID NO: 4245979 - DNA, 18 bp, Homo sapiens
tgttcttggtttgtaaat

SEQ ID NO: 4245980 - DNA, 20 bp, Homo sapiens
tgttcttggtttgtaaatta

SEQ ID NO: 4245981 - DNA, 18 bp, Homo sapiens
tgttctttccaaagtaca

SEQ ID NO: 4245982 - DNA, 14 bp, Homo sapiens
tgttctttctggct

SEQ ID NO: 4245983 - DNA, 20 bp, Homo sapiens
tgttctttctggctatgcat

SEQ ID NO: 4245984 - DNA, 23 bp, Homo sapiens
tgttctttctggctatgcatttg

SEQ ID NO: 4245985 - DNA, 15 bp, Homo sapiens
tgttgaacatacttc

SEQ ID NO: 4245986 - DNA, 16 bp, Homo sapiens
tgttgccagtgctaag

SEQ ID NO: 4245987 - DNA, 19 bp, Homo sapiens
tgttgggtttgagacagac

SEQ ID NO: 4245988 - DNA, 20 bp, Homo sapiens
tgttgggtttgagacagaca

SEQ ID NO: 4245989 - DNA, 15 bp, Homo sapiens
tgtttaaaattcagt

SEQ ID NO: 4245990 - DNA, 19 bp, Homo sapiens
tgtttaaatcatgtatgtt

SEQ ID NO: 4245991 - DNA, 16 bp, Homo sapiens
tgtttagataatacac

SEQ ID NO: 4245992 - DNA, 17 bp, Homo sapiens
tgtttataatctgaaga

SEQ ID NO: 4245993 - DNA, 14 bp, Homo sapiens
tgtttattgagttt

SEQ ID NO: 4245994 - DNA, 23 bp, Homo sapiens
tgtttgctgccttgctcctagca

SEQ ID NO: 4245995 - DNA, 12 bp, Homo sapiens
tgttttcttcaa

SEQ ID NO: 4245996 - DNA, 19 bp, Homo sapiens
ttaaaaaataatacaacaa

SEQ ID NO: 4245997 - DNA, 13 bp, Homo sapiens
ttaaaaaattctt

SEQ ID NO: 4245998 - DNA, 15 bp, Homo sapiens
ttaaaaagagtaatt

SEQ ID NO: 4245999 - DNA, 15 bp, Homo sapiens
ttaaaacgtcttaga

SEQ ID NO: 4246000 - DNA, 16 bp, Homo sapiens
ttaaaactaagcacaa

SEQ ID NO: 4246001 - DNA, 14 bp, Homo sapiens
ttaaaattcagttt

SEQ ID NO: 4246002 - DNA, 23 bp, Homo sapiens
ttaaaattcagtttttgtatctt

SEQ ID NO: 4246003 - DNA, 21 bp, Homo sapiens
ttaaacagtagttgtattctt

SEQ ID NO: 4246004 - DNA, 12 bp, Homo sapiens
ttaaactaaata

SEQ ID NO: 4246005 - DNA, 21 bp, Homo sapiens
ttaaactaaataatgaataaa

SEQ ID NO: 4246006 - DNA, 18 bp, Homo sapiens
ttaaacttaatctaaatg

SEQ ID NO: 4246007 - DNA, 20 bp, Homo sapiens
ttaaacttaatctaaatgga

SEQ ID NO: 4246008 - DNA, 23 bp, Homo sapiens
ttaaagatgctatggaacataaa

SEQ ID NO: 4246009 - DNA, 21 bp, Homo sapiens
ttaaataatgtgaaactggat

SEQ ID NO: 4246010 - DNA, 14 bp, Homo sapiens
ttaaatcatgtatg

SEQ ID NO: 4246011 - DNA, 16 bp, Homo sapiens
ttaaatcatgtatgtt

SEQ ID NO: 4246012 - DNA, 16 bp, Homo sapiens
ttaaatgcaataattt

SEQ ID NO: 4246013 - DNA, 20 bp, Homo sapiens
ttaaattcttgcaaagtatc

SEQ ID NO: 4246014 - DNA, 14 bp, Homo sapiens
ttaacagaaatgta

SEQ ID NO: 4246015 - DNA, 16 bp, Homo sapiens
ttaacagaaatgtaca

SEQ ID NO: 4246016 - DNA, 16 bp, Homo sapiens
ttaactttaatacagc

SEQ ID NO: 4246017 - DNA, 15 bp, Homo sapiens
ttaacttttataaac

SEQ ID NO: 4246018 - DNA, 18 bp, Homo sapiens
ttaacttttataaacttt

SEQ ID NO: 4246019 - DNA, 18 bp, Homo sapiens
ttaagcatgtcaattcat

SEQ ID NO: 4246020 - DNA, 22 bp, Homo sapiens
ttaagtgctgcatttaaaagat

SEQ ID NO: 4246021 - DNA, 18 bp, Homo sapiens
ttaagtgggctcctgaca

SEQ ID NO: 4246022 - DNA, 21 bp, Homo sapiens
ttaataatgtattgtaatctt

SEQ ID NO: 4246023 - DNA, 23 bp, Homo sapiens
ttaatattcttttgtttccatgg

SEQ ID NO: 4246024 - DNA, 22 bp, Homo sapiens
ttaatcattaggtgtgactgaa

SEQ ID NO: 4246025 - DNA, 16 bp, Homo sapiens
ttaattcttcacctgt

SEQ ID NO: 4246026 - DNA, 13 bp, Homo sapiens
ttaattttaccaa

SEQ ID NO: 4246027 - DNA, 20 bp, Homo sapiens
ttaattttaccaagagtaac

SEQ ID NO: 4246028 - DNA, 18 bp, Homo sapiens
ttacaacatttatgtgag

SEQ ID NO: 4246029 - DNA, 22 bp, Homo sapiens
ttacagatttctcactatatat

SEQ ID NO: 4246030 - DNA, 22 bp, Homo sapiens
ttacatttttaagtgctgcatt

SEQ ID NO: 4246031 - DNA, 14 bp, Homo sapiens
ttaccacagacata

SEQ ID NO: 4246032 - DNA, 17 bp, Homo sapiens
ttaccagacaaaaaaat

SEQ ID NO: 4246033 - DNA, 17 bp, Homo sapiens
ttaccaggtgagaagtg

SEQ ID NO: 4246034 - DNA, 14 bp, Homo sapiens
ttaccatttttcat

SEQ ID NO: 4246035 - DNA, 19 bp, Homo sapiens
ttaccctcatgttcttaat

SEQ ID NO: 4246036 - DNA, 17 bp, Homo sapiens
ttacgtttgttattcct

SEQ ID NO: 4246037 - DNA, 16 bp, Homo sapiens
ttactaatagacaatt

SEQ ID NO: 4246038 - DNA, 16 bp, Homo sapiens
ttactctgtgtttaaa

SEQ ID NO: 4246039 - DNA, 19 bp, Homo sapiens
ttactggactgtctgatca

SEQ ID NO: 4246040 - DNA, 12 bp, Homo sapiens
ttactgtacatg

SEQ ID NO: 4246041 - DNA, 19 bp, Homo sapiens
ttagactatttctttttat

SEQ ID NO: 4246042 - DNA, 14 bp, Homo sapiens
ttagagccttttat

SEQ ID NO: 4246043 - DNA, 19 bp, Homo sapiens
ttaggtatataataacttt

SEQ ID NO: 4246044 - DNA, 16 bp, Homo sapiens
ttaggtgtgactgaat

SEQ ID NO: 4246045 - DNA, 16 bp, Homo sapiens
ttagtatgaggcattt

SEQ ID NO: 4246046 - DNA, 18 bp, Homo sapiens
ttagtatgaggcatttgt

SEQ ID NO: 4246047 - DNA, 12 bp, Homo sapiens
ttagtgaagatg

SEQ ID NO: 4246048 - DNA, 17 bp, Homo sapiens
ttataaatatatataaa

SEQ ID NO: 4246049 - DNA, 11 bp, Homo sapiens
ttatacataaa

SEQ ID NO: 4246050 - DNA, 17 bp, Homo sapiens
ttatatcttttggttat

SEQ ID NO: 4246051 - DNA, 17 bp, Homo sapiens
ttatccatgacaggcct

SEQ ID NO: 4246052 - DNA, 22 bp, Homo sapiens
ttatcggattactgaattgtat

SEQ ID NO: 4246053 - DNA, 14 bp, Homo sapiens
ttatctagatactg

SEQ ID NO: 4246054 - DNA, 14 bp, Homo sapiens
ttatcttttcataa

SEQ ID NO: 4246055 - DNA, 16 bp, Homo sapiens
ttatgatttccttcaa

SEQ ID NO: 4246056 - DNA, 16 bp, Homo sapiens
ttatgcatgaagtaat

SEQ ID NO: 4246057 - DNA, 19 bp, Homo sapiens
ttatggagacctctccttc

SEQ ID NO: 4246058 - DNA, 13 bp, Homo sapiens
ttattaattttta

SEQ ID NO: 4246059 - DNA, 13 bp, Homo sapiens
ttattatgcatga

SEQ ID NO: 4246060 - DNA, 14 bp, Homo sapiens
ttattgagtttgta

SEQ ID NO: 4246061 - DNA, 15 bp, Homo sapiens
ttattgcttagtaaa

SEQ ID NO: 4246062 - DNA, 17 bp, Homo sapiens
ttattgcttagtaaaat

SEQ ID NO: 4246063 - DNA, 20 bp, Homo sapiens
ttattgcttattgcttagta

SEQ ID NO: 4246064 - DNA, 12 bp, Homo sapiens
ttattgtaaatt

SEQ ID NO: 4246065 - DNA, 12 bp, Homo sapiens
ttcaaaaataat

SEQ ID NO: 4246066 - DNA, 13 bp, Homo sapiens
ttcaaagatattt

SEQ ID NO: 4246067 - DNA, 20 bp, Homo sapiens
ttcaatatcagctttgataa

SEQ ID NO: 4246068 - DNA, 17 bp, Homo sapiens
ttcacttttgttctgct

SEQ ID NO: 4246069 - DNA, 11 bp, Homo sapiens
ttcagaaatgt

SEQ ID NO: 4246070 - DNA, 17 bp, Homo sapiens
ttcagatctctaacttc

SEQ ID NO: 4246071 - DNA, 13 bp, Homo sapiens
ttcaggagcccta

SEQ ID NO: 4246072 - DNA, 20 bp, Homo sapiens
ttcaggtggatgaggagaca

SEQ ID NO: 4246073 - DNA, 15 bp, Homo sapiens
ttcagtttttgtatc

SEQ ID NO: 4246074 - DNA, 20 bp, Homo sapiens
ttcatagggaaaggttttgt

SEQ ID NO: 4246075 - DNA, 23 bp, Homo sapiens
ttcatagggaaaggttttgtatt

SEQ ID NO: 4246076 - DNA, 17 bp, Homo sapiens
ttcatatacaaacatgt

SEQ ID NO: 4246077 - DNA, 19 bp, Homo sapiens
ttcatgccaccatggccag

SEQ ID NO: 4246078 - DNA, 13 bp, Homo sapiens
ttccaaagtacac

SEQ ID NO: 4246079 - DNA, 18 bp, Homo sapiens
ttccacaccaagcagcaa

SEQ ID NO: 4246080 - DNA, 17 bp, Homo sapiens
ttcccctccttctccct

SEQ ID NO: 4246081 - DNA, 23 bp, Homo sapiens
ttccctggtgcccttccctggag

SEQ ID NO: 4246082 - DNA, 16 bp, Homo sapiens
ttcctctttgccctga

SEQ ID NO: 4246083 - DNA, 12 bp, Homo sapiens
ttcctgatgatg

SEQ ID NO: 4246084 - DNA, 20 bp, Homo sapiens
ttctaaaggctacctttgta

SEQ ID NO: 4246085 - DNA, 21 bp, Homo sapiens
ttctaaaggctacctttgtat

SEQ ID NO: 4246086 - DNA, 19 bp, Homo sapiens
ttctaaatctccaaaataa

SEQ ID NO: 4246087 - DNA, 21 bp, Homo sapiens
ttctaaatctccaaaataaaa

SEQ ID NO: 4246088 - DNA, 16 bp, Homo sapiens
ttctatgacacatgca

SEQ ID NO: 4246089 - DNA, 12 bp, Homo sapiens
ttctatgttaaa

SEQ ID NO: 4246090 - DNA, 18 bp, Homo sapiens
ttctatgttaaatactgt

SEQ ID NO: 4246091 - DNA, 21 bp, Homo sapiens
ttctctaacttcaaggcccat

SEQ ID NO: 4246092 - DNA, 17 bp, Homo sapiens
ttctctagtttgattaa

SEQ ID NO: 4246093 - DNA, 21 bp, Homo sapiens
ttctctagtttgattaaattc

SEQ ID NO: 4246094 - DNA, 19 bp, Homo sapiens
ttctctcctgtacctcttg

SEQ ID NO: 4246095 - DNA, 18 bp, Homo sapiens
ttctcttgagtcacactg

SEQ ID NO: 4246096 - DNA, 23 bp, Homo sapiens
ttctgaccgttaaaaaattcttg

SEQ ID NO: 4246097 - DNA, 12 bp, Homo sapiens
ttctgccttttc

SEQ ID NO: 4246098 - DNA, 17 bp, Homo sapiens
ttctgctttatcttttc

SEQ ID NO: 4246099 - DNA, 16 bp, Homo sapiens
ttctggctatgcattt

SEQ ID NO: 4246100 - DNA, 18 bp, Homo sapiens
ttctggtgtatattttaa

SEQ ID NO: 4246101 - DNA, 15 bp, Homo sapiens
ttctgtacttcctga

SEQ ID NO: 4246102 - DNA, 19 bp, Homo sapiens
ttctgtagacttttgaaaa

SEQ ID NO: 4246103 - DNA, 14 bp, Homo sapiens
ttctgtgcatgtgc

SEQ ID NO: 4246104 - DNA, 18 bp, Homo sapiens
ttctgttctttctggcta

SEQ ID NO: 4246105 - DNA, 17 bp, Homo sapiens
ttcttagggaaggatac

SEQ ID NO: 4246106 - DNA, 14 bp, Homo sapiens
ttcttatttttgtc

SEQ ID NO: 4246107 - DNA, 13 bp, Homo sapiens
ttcttgcaaagta

SEQ ID NO: 4246108 - DNA, 21 bp, Homo sapiens
ttctttccaaagtacactgtt

SEQ ID NO: 4246109 - DNA, 13 bp, Homo sapiens
ttctttcccagtg

SEQ ID NO: 4246110 - DNA, 12 bp, Homo sapiens
ttctttctggct

SEQ ID NO: 4246111 - DNA, 17 bp, Homo sapiens
ttctttgagactgggtc

SEQ ID NO: 4246112 - DNA, 11 bp, Homo sapiens
ttgaaaaacaa

SEQ ID NO: 4246113 - DNA, 19 bp, Homo sapiens
ttgaaagcttcaaagttta

SEQ ID NO: 4246114 - DNA, 20 bp, Homo sapiens
ttgaaatataggaacttaaa

SEQ ID NO: 4246115 - DNA, 13 bp, Homo sapiens
ttgaactttgacc

SEQ ID NO: 4246116 - DNA, 18 bp, Homo sapiens
ttgaactttgacctctgc

SEQ ID NO: 4246117 - DNA, 20 bp, Homo sapiens
ttgaactttgacctctgcag

SEQ ID NO: 4246118 - DNA, 22 bp, Homo sapiens
ttgaagattaggagaaacacat

SEQ ID NO: 4246119 - DNA, 17 bp, Homo sapiens
ttgaagcctaaatttgt

SEQ ID NO: 4246120 - DNA, 13 bp, Homo sapiens
ttgaatattactc

SEQ ID NO: 4246121 - DNA, 21 bp, Homo sapiens
ttgaatattactcctattttt

SEQ ID NO: 4246122 - DNA, 14 bp, Homo sapiens
ttgacagactattt

SEQ ID NO: 4246123 - DNA, 15 bp, Homo sapiens
ttgagattgccccag

SEQ ID NO: 4246124 - DNA, 20 bp, Homo sapiens
ttgagattgccccaggtctg

SEQ ID NO: 4246125 - DNA, 16 bp, Homo sapiens
ttgagccttgaacttt

SEQ ID NO: 4246126 - DNA, 19 bp, Homo sapiens
ttgagccttgaactttgac

SEQ ID NO: 4246127 - DNA, 16 bp, Homo sapiens
ttgaggtaaagatatg

SEQ ID NO: 4246128 - DNA, 15 bp, Homo sapiens
ttgaggtctgttctt

SEQ ID NO: 4246129 - DNA, 16 bp, Homo sapiens
ttgaggtctgttcttt

SEQ ID NO: 4246130 - DNA, 20 bp, Homo sapiens
ttgagtttgtaggtaaaatg

SEQ ID NO: 4246131 - DNA, 23 bp, Homo sapiens
ttgatatatattataaatatata

SEQ ID NO: 4246132 - DNA, 17 bp, Homo sapiens
ttgatatttttatacaa

SEQ ID NO: 4246133 - DNA, 18 bp, Homo sapiens
ttgatgcaggcacttatt

SEQ ID NO: 4246134 - DNA, 13 bp, Homo sapiens
ttgattaaattct

SEQ ID NO: 4246135 - DNA, 15 bp, Homo sapiens
ttgattaaattcttg

SEQ ID NO: 4246136 - DNA, 18 bp, Homo sapiens
ttgatttccgttaaaata

SEQ ID NO: 4246137 - DNA, 15 bp, Homo sapiens
ttgattttaatacat

SEQ ID NO: 4246138 - DNA, 15 bp, Homo sapiens
ttgcaacttcagttt

SEQ ID NO: 4246139 - DNA, 23 bp, Homo sapiens
ttgcaacttcagttttatttttg

SEQ ID NO: 4246140 - DNA, 14 bp, Homo sapiens
ttgcagatgtattg

SEQ ID NO: 4246141 - DNA, 21 bp, Homo sapiens
ttgcatccacttcaggagccc

SEQ ID NO: 4246142 - DNA, 17 bp, Homo sapiens
ttgccaaggcaaaaaac

SEQ ID NO: 4246143 - DNA, 18 bp, Homo sapiens
ttgcccaggctggtctca

SEQ ID NO: 4246144 - DNA, 14 bp, Homo sapiens
ttgccgttattaaa

SEQ ID NO: 4246145 - DNA, 15 bp, Homo sapiens
ttgctcctagcagac

SEQ ID NO: 4246146 - DNA, 21 bp, Homo sapiens
ttgctcctagcagacagaaac

SEQ ID NO: 4246147 - DNA, 19 bp, Homo sapiens
ttgctgaagggcattcttt

SEQ ID NO: 4246148 - DNA, 21 bp, Homo sapiens
ttgctgaagggcattctttcc

SEQ ID NO: 4246149 - DNA, 18 bp, Homo sapiens
ttggatatttttgtactt

SEQ ID NO: 4246150 - DNA, 20 bp, Homo sapiens
ttggcaccatggtatcatat

SEQ ID NO: 4246151 - DNA, 16 bp, Homo sapiens
ttggcccttctgccct

SEQ ID NO: 4246152 - DNA, 19 bp, Homo sapiens
ttgggagaagcaaatatag

SEQ ID NO: 4246153 - DNA, 14 bp, Homo sapiens
ttggggatattttt

SEQ ID NO: 4246154 - DNA, 19 bp, Homo sapiens
ttggggcaagactgcaaac

SEQ ID NO: 4246155 - DNA, 16 bp, Homo sapiens
ttggtataatgtttaa

SEQ ID NO: 4246156 - DNA, 14 bp, Homo sapiens
ttggtttgtaaatt

SEQ ID NO: 4246157 - DNA, 18 bp, Homo sapiens
ttgtaaattaacttttat

SEQ ID NO: 4246158 - DNA, 22 bp, Homo sapiens
ttgtatattacaacatttatgt

SEQ ID NO: 4246159 - DNA, 16 bp, Homo sapiens
ttgtattctctcctgt

SEQ ID NO: 4246160 - DNA, 21 bp, Homo sapiens
ttgtattgcatgcaatttgaa

SEQ ID NO: 4246161 - DNA, 20 bp, Homo sapiens
ttgtcaagtctctgctggcc

SEQ ID NO: 4246162 - DNA, 15 bp, Homo sapiens
ttgtctccatgtgta

SEQ ID NO: 4246163 - DNA, 14 bp, Homo sapiens
ttgtctctcttcag

SEQ ID NO: 4246164 - DNA, 18 bp, Homo sapiens
ttgtgagccaccacgtcc

SEQ ID NO: 4246165 - DNA, 18 bp, Homo sapiens
ttgtgatacaatgctgtg

SEQ ID NO: 4246166 - DNA, 20 bp, Homo sapiens
ttgtgatacaatgctgtgcc

SEQ ID NO: 4246167 - DNA, 16 bp, Homo sapiens
ttgtgatttttgtaat

SEQ ID NO: 4246168 - DNA, 22 bp, Homo sapiens
ttgtgcattatctagatactgt

SEQ ID NO: 4246169 - DNA, 16 bp, Homo sapiens
ttgtgcttctccccag

SEQ ID NO: 4246170 - DNA, 17 bp, Homo sapiens
ttgtggaccaattattg

SEQ ID NO: 4246171 - DNA, 21 bp, Homo sapiens
ttgtggaggagggagagccct

SEQ ID NO: 4246172 - DNA, 23 bp, Homo sapiens
ttgtggatttaacagaaatgtac

SEQ ID NO: 4246173 - DNA, 13 bp, Homo sapiens
ttgttattcctag

SEQ ID NO: 4246174 - DNA, 14 bp, Homo sapiens
ttgttccctctccc

SEQ ID NO: 4246175 - DNA, 17 bp, Homo sapiens
ttgttcttggtttgtaa

SEQ ID NO: 4246176 - DNA, 19 bp, Homo sapiens
ttgttcttggtttgtaaat

SEQ ID NO: 4246177 - DNA, 18 bp, Homo sapiens
ttgtttaaaattcagttt

SEQ ID NO: 4246178 - DNA, 19 bp, Homo sapiens
ttgtttattgagtttgtag

SEQ ID NO: 4246179 - DNA, 22 bp, Homo sapiens
tttaaaaagtaagttaataatg

SEQ ID NO: 4246180 - DNA, 23 bp, Homo sapiens
tttaaaaagtaagttaataatgt

SEQ ID NO: 4246181 - DNA, 10 bp, Homo sapiens
tttaaaatta

SEQ ID NO: 4246182 - DNA, 13 bp, Homo sapiens
tttaaaattcagt

SEQ ID NO: 4246183 - DNA, 16 bp, Homo sapiens
tttaaatcatgtatgt

SEQ ID NO: 4246184 - DNA, 11 bp, Homo sapiens
tttaaatgcac

SEQ ID NO: 4246185 - DNA, 15 bp, Homo sapiens
tttaacagaaatgta

SEQ ID NO: 4246186 - DNA, 14 bp, Homo sapiens
tttaaccttaaaat

SEQ ID NO: 4246187 - DNA, 18 bp, Homo sapiens
tttaagaaaaaataaaag

SEQ ID NO: 4246188 - DNA, 18 bp, Homo sapiens
tttaagaaaaaggatgca

SEQ ID NO: 4246189 - DNA, 23 bp, Homo sapiens
tttaagtagtgggcatttcatag

SEQ ID NO: 4246190 - DNA, 23 bp, Homo sapiens
tttaagtatacaggaggatgtga

SEQ ID NO: 4246191 - DNA, 16 bp, Homo sapiens
tttaagtgggctcctg

SEQ ID NO: 4246192 - DNA, 13 bp, Homo sapiens
tttacaagatatt

SEQ ID NO: 4246193 - DNA, 18 bp, Homo sapiens
tttaccaagagtaacttt

SEQ ID NO: 4246194 - DNA, 19 bp, Homo sapiens
tttaccttttttatacata

SEQ ID NO: 4246195 - DNA, 15 bp, Homo sapiens
tttactctgtgttta

SEQ ID NO: 4246196 - DNA, 19 bp, Homo sapiens
tttactctgtgtttaaaaa

SEQ ID NO: 4246197 - DNA, 23 bp, Homo sapiens
tttagtaagtatgttttttatgt

SEQ ID NO: 4246198 - DNA, 19 bp, Homo sapiens
tttataaaaataaatagaa

SEQ ID NO: 4246199 - DNA, 22 bp, Homo sapiens
tttataaaaataaatagaaaag

SEQ ID NO: 4246200 - DNA, 23 bp, Homo sapiens
tttataaaaataaatagaaaagt

SEQ ID NO: 4246201 - DNA, 15 bp, Homo sapiens
tttataatctgaaga

SEQ ID NO: 4246202 - DNA, 17 bp, Homo sapiens
tttatgagtctttgaga

SEQ ID NO: 4246203 - DNA, 13 bp, Homo sapiens
tttattatggcac

SEQ ID NO: 4246204 - DNA, 12 bp, Homo sapiens
tttcaaacttta

SEQ ID NO: 4246205 - DNA, 21 bp, Homo sapiens
tttcaattcagattgtcttgc

SEQ ID NO: 4246206 - DNA, 23 bp, Homo sapiens
tttcaattcagattgtcttgcaa

SEQ ID NO: 4246207 - DNA, 16 bp, Homo sapiens
tttcacttttgttctg

SEQ ID NO: 4246208 - DNA, 13 bp, Homo sapiens
tttcagaaatgtg

SEQ ID NO: 4246209 - DNA, 23 bp, Homo sapiens
tttcatccaaaatattttttgca

SEQ ID NO: 4246210 - DNA, 16 bp, Homo sapiens
tttcatctcttgtata

SEQ ID NO: 4246211 - DNA, 20 bp, Homo sapiens
tttcatttaaatatctgtta

SEQ ID NO: 4246212 - DNA, 13 bp, Homo sapiens
tttcatttacaaa

SEQ ID NO: 4246213 - DNA, 19 bp, Homo sapiens
tttcatttacaaaagattt

SEQ ID NO: 4246214 - DNA, 15 bp, Homo sapiens
tttccaaagtacact

SEQ ID NO: 4246215 - DNA, 14 bp, Homo sapiens
tttccctggtgccc

SEQ ID NO: 4246216 - DNA, 18 bp, Homo sapiens
tttcctgatgatgctggc

SEQ ID NO: 4246217 - DNA, 14 bp, Homo sapiens
tttctaaaggctac

SEQ ID NO: 4246218 - DNA, 20 bp, Homo sapiens
tttctaaaggctacctttgt

SEQ ID NO: 4246219 - DNA, 19 bp, Homo sapiens
tttctaaatctccaaaata

SEQ ID NO: 4246220 - DNA, 14 bp, Homo sapiens
tttctcactatata

SEQ ID NO: 4246221 - DNA, 24 bp, Homo sapiens
tttctgcccagccctctgtggcca

SEQ ID NO: 4246222 - DNA, 15 bp, Homo sapiens
tttctggtgtatatt

SEQ ID NO: 4246223 - DNA, 11 bp, Homo sapiens
tttctgtactt

SEQ ID NO: 4246224 - DNA, 18 bp, Homo sapiens
tttcttagggaaggatac

SEQ ID NO: 4246225 - DNA, 23 bp, Homo sapiens
tttcttgggaattgaaaaaaatt

SEQ ID NO: 4246226 - DNA, 19 bp, Homo sapiens
tttgaactggtattgttta

SEQ ID NO: 4246227 - DNA, 17 bp, Homo sapiens
tttgaagtaacttattt

SEQ ID NO: 4246228 - DNA, 18 bp, Homo sapiens
tttgacagactatttgct

SEQ ID NO: 4246229 - DNA, 12 bp, Homo sapiens
tttgacctctgc

SEQ ID NO: 4246230 - DNA, 18 bp, Homo sapiens
tttgacctctgcagcaat

SEQ ID NO: 4246231 - DNA, 22 bp, Homo sapiens
tttgatgattttcatttcatga

SEQ ID NO: 4246232 - DNA, 20 bp, Homo sapiens
tttgatgcccaatatattct

SEQ ID NO: 4246233 - DNA, 23 bp, Homo sapiens
tttgattaaattcttgcaaagta

SEQ ID NO: 4246234 - DNA, 18 bp, Homo sapiens
tttgattcgccctcctcc

SEQ ID NO: 4246235 - DNA, 20 bp, Homo sapiens
tttgcactctgtaattgcac

SEQ ID NO: 4246236 - DNA, 14 bp, Homo sapiens
tttgccctgaggct

SEQ ID NO: 4246237 - DNA, 24 bp, Homo sapiens
tttgctactgtacataaacaatga

SEQ ID NO: 4246238 - DNA, 10 bp, Homo sapiens
tttgctgcca

SEQ ID NO: 4246239 - DNA, 14 bp, Homo sapiens
tttggattttatgg

SEQ ID NO: 4246240 - DNA, 15 bp, Homo sapiens
tttgtaaattaactt

SEQ ID NO: 4246241 - DNA, 11 bp, Homo sapiens
tttgtaattta

SEQ ID NO: 4246242 - DNA, 17 bp, Homo sapiens
tttgtaggtaaaatgta

SEQ ID NO: 4246243 - DNA, 15 bp, Homo sapiens
tttgtattctctcct

SEQ ID NO: 4246244 - DNA, 22 bp, Homo sapiens
tttgtgatacaatgctgtgccc

SEQ ID NO: 4246245 - DNA, 22 bp, Homo sapiens
tttgtgcattatctagatactg

SEQ ID NO: 4246246 - DNA, 16 bp, Homo sapiens
tttgtggttttatgga

SEQ ID NO: 4246247 - DNA, 14 bp, Homo sapiens
tttgttattcctag

SEQ ID NO: 4246248 - DNA, 18 bp, Homo sapiens
tttgtttgaactgataaa

SEQ ID NO: 4246249 - DNA, 21 bp, Homo sapiens
tttgtttttttttttttggta

SEQ ID NO: 4246250 - DNA, 14 bp, Homo sapiens
ttttaaatgacttg

SEQ ID NO: 4246251 - DNA, 21 bp, Homo sapiens
ttttaaatgcacctggaatat

SEQ ID NO: 4246252 - DNA, 18 bp, Homo sapiens
ttttaactttaatacagc

SEQ ID NO: 4246253 - DNA, 17 bp, Homo sapiens
ttttaagtgctgcattt

SEQ ID NO: 4246254 - DNA, 20 bp, Homo sapiens
ttttaatattcttttgtttc

SEQ ID NO: 4246255 - DNA, 21 bp, Homo sapiens
ttttaatattcttttgtttcc

SEQ ID NO: 4246256 - DNA, 11 bp, Homo sapiens
ttttaatttga

SEQ ID NO: 4246257 - DNA, 17 bp, Homo sapiens
ttttaccaagagtaact

SEQ ID NO: 4246258 - DNA, 14 bp, Homo sapiens
ttttataaacttta

SEQ ID NO: 4246259 - DNA, 17 bp, Homo sapiens
ttttataaactttacct

SEQ ID NO: 4246260 - DNA, 19 bp, Homo sapiens
ttttataaactttaccttt

SEQ ID NO: 4246261 - DNA, 20 bp, Homo sapiens
ttttataggggctttgctga

SEQ ID NO: 4246262 - DNA, 18 bp, Homo sapiens
ttttatggcttttgtgca

SEQ ID NO: 4246263 - DNA, 13 bp, Homo sapiens
ttttattaataat

SEQ ID NO: 4246264 - DNA, 12 bp, Homo sapiens
ttttatttttgc

SEQ ID NO: 4246265 - DNA, 13 bp, Homo sapiens
ttttcaccccacc

SEQ ID NO: 4246266 - DNA, 14 bp, Homo sapiens
ttttcatttcatga

SEQ ID NO: 4246267 - DNA, 15 bp, Homo sapiens
ttttcccctgttaaa

SEQ ID NO: 4246268 - DNA, 23 bp, Homo sapiens
ttttgaggtaaagatatggagaa

SEQ ID NO: 4246269 - DNA, 20 bp, Homo sapiens
ttttgataataatattgttt

SEQ ID NO: 4246270 - DNA, 23 bp, Homo sapiens
ttttggaaactgctaaattctat

SEQ ID NO: 4246271 - DNA, 21 bp, Homo sapiens
ttttgtaaactggaattaaaa

SEQ ID NO: 4246272 - DNA, 13 bp, Homo sapiens
tttttaaaaacct

SEQ ID NO: 4246273 - DNA, 22 bp, Homo sapiens
tttttaaaacactaaaagcagc

SEQ ID NO: 4246274 - DNA, 11 bp, Homo sapiens
tttttaaatgc

SEQ ID NO: 4246275 - DNA, 18 bp, Homo sapiens
tttttaagtgctgcattt

SEQ ID NO: 4246276 - DNA, 21 bp, Homo sapiens
tttttaagtgggctcctgaca

SEQ ID NO: 4246277 - DNA, 20 bp, Homo sapiens
tttttatcgtcactgcttaa

SEQ ID NO: 4246278 - DNA, 12 bp, Homo sapiens
tttttatggctt

SEQ ID NO: 4246279 - DNA, 23 bp, Homo sapiens
tttttcctcttcagaacttgtca

SEQ ID NO: 4246280 - DNA, 20 bp, Homo sapiens
tttttggtataatgtttaaa

SEQ ID NO: 4246281 - DNA, 12 bp, Homo sapiens
tttttgtatctt

SEQ ID NO: 4246282 - DNA, 21 bp, Homo sapiens
ttttttggtataatgtttaaa

SEQ ID NO: 4246283 - DNA, 11 bp, Homo sapiens
tttttttacta

SEQ ID NO: 4246284 - DNA, 12 bp, Homo sapiens
ttttttttaaga

SEQ ID NO: 4246285 - DNA, 21 bp, Homo sapiens
aatgtacagcaaggagattta

SEQ ID NO: 4246286 - DNA, 23 bp, Homo sapiens
aatgtacagcaaggagatttaca

SEQ ID NO: 4246287 - DNA, 16 bp, Homo sapiens
aatgtataatgtgcag

SEQ ID NO: 4246288 - DNA, 19 bp, Homo sapiens
aatgtctcactgttctgca

SEQ ID NO: 4246289 - DNA, 22 bp, Homo sapiens
aatgtgaaactggattaaactt

SEQ ID NO: 4246290 - DNA, 15 bp, Homo sapiens
aatgtgcagaaaata

SEQ ID NO: 4246291 - DNA, 19 bp, Homo sapiens
aatgtgcagaaaatattta

SEQ ID NO: 4246292 - DNA, 19 bp, Homo sapiens
aatgtgggtgaagtgcctg

SEQ ID NO: 4246293 - DNA, 19 bp, Homo sapiens
aatgtttaaatcatgtatg

SEQ ID NO: 4246294 - DNA, 21 bp, Homo sapiens
aatgtttaaatcatgtatgtt

SEQ ID NO: 4246295 - DNA, 15 bp, Homo sapiens
aattaacttttataa

SEQ ID NO: 4246296 - DNA, 16 bp, Homo sapiens
aattaacttttataaa

SEQ ID NO: 4246297 - DNA, 20 bp, Homo sapiens
aattaacttttataaacttt

SEQ ID NO: 4246298 - DNA, 16 bp, Homo sapiens
aattacgtttgttatt

SEQ ID NO: 4246299 - DNA, 22 bp, Homo sapiens
aattacgtttgttattcctagt

SEQ ID NO: 4246300 - DNA, 13 bp, Homo sapiens
aattattatttta

SEQ ID NO: 4246301 - DNA, 20 bp, Homo sapiens
aattattattttaaaatata

SEQ ID NO: 4246302 - DNA, 23 bp, Homo sapiens
aattattattttaaaatatatga

SEQ ID NO: 4246303 - DNA, 13 bp, Homo sapiens
aattattgatata

SEQ ID NO: 4246304 - DNA, 15 bp, Homo sapiens
aattattgatatata

SEQ ID NO: 4246305 - DNA, 17 bp, Homo sapiens
aattattgatatatatt

SEQ ID NO: 4246306 - DNA, 23 bp, Homo sapiens
aattcacctatgttattttgtgt

SEQ ID NO: 4246307 - DNA, 18 bp, Homo sapiens
aattcagattgtcttgca

SEQ ID NO: 4246308 - DNA, 19 bp, Homo sapiens
aattcagtttttgtatctt

SEQ ID NO: 4246309 - DNA, 20 bp, Homo sapiens
aattcagtttttgtatcttg

SEQ ID NO: 4246310 - DNA, 21 bp, Homo sapiens
aattcgcccgagctgtttatg

SEQ ID NO: 4246311 - DNA, 23 bp, Homo sapiens
aattcgcccgagctgtttatgtt

SEQ ID NO: 4246312 - DNA, 18 bp, Homo sapiens
aattctaacattaaatca

SEQ ID NO: 4246313 - DNA, 14 bp, Homo sapiens
aattctatgttaaa

SEQ ID NO: 4246314 - DNA, 17 bp, Homo sapiens
aattctatgttaaatac

SEQ ID NO: 4246315 - DNA, 20 bp, Homo sapiens
aattctatgttaaatactgt

SEQ ID NO: 4246316 - DNA, 16 bp, Homo sapiens
aattctcctgataaaa

SEQ ID NO: 4246317 - DNA, 15 bp, Homo sapiens
aattctctagtttga

SEQ ID NO: 4246318 - DNA, 20 bp, Homo sapiens
aattcttgcaaagtatccct

SEQ ID NO: 4246319 - DNA, 13 bp, Homo sapiens
aattgaaaaacaa

SEQ ID NO: 4246320 - DNA, 22 bp, Homo sapiens
aattgaaataaataaaaatgca

SEQ ID NO: 4246321 - DNA, 14 bp, Homo sapiens
aattgatattatat

SEQ ID NO: 4246322 - DNA, 21 bp, Homo sapiens
aattgctgaagggcattcttt

SEQ ID NO: 4246323 - DNA, 13 bp, Homo sapiens
aattgtgtacctt

SEQ ID NO: 4246324 - DNA, 23 bp, Homo sapiens
aattgtgtggagaactcagtgcc

SEQ ID NO: 4246325 - DNA, 12 bp, Homo sapiens
aatttaaaatta

SEQ ID NO: 4246326 - DNA, 18 bp, Homo sapiens
aatttagccctttaaaac

SEQ ID NO: 4246327 - DNA, 13 bp, Homo sapiens
aatttctaaatct

SEQ ID NO: 4246328 - DNA, 23 bp, Homo sapiens
aatttcttttccttcattcatag

SEQ ID NO: 4246329 - DNA, 14 bp, Homo sapiens
aatttgaagtaact

SEQ ID NO: 4246330 - DNA, 23 bp, Homo sapiens
aatttgatggactaattattatt

SEQ ID NO: 4246331 - DNA, 18 bp, Homo sapiens
aatttgtgatacaatgct

SEQ ID NO: 4246332 - DNA, 19 bp, Homo sapiens
aattttaatattcttttgt

SEQ ID NO: 4246333 - DNA, 12 bp, Homo sapiens
aatttttgtatt

SEQ ID NO: 4246334 - DNA, 14 bp, Homo sapiens
aattttttttttcc

SEQ ID NO: 4246335 - DNA, 13 bp, Homo sapiens
acaaaaaatacat

SEQ ID NO: 4246336 - DNA, 22 bp, Homo sapiens
acaaaagcatgtgagactggtt

SEQ ID NO: 4246337 - DNA, 19 bp, Homo sapiens
acaaaatacaatcctgttt

SEQ ID NO: 4246338 - DNA, 14 bp, Homo sapiens
acaaagagaccagg

SEQ ID NO: 4246339 - DNA, 17 bp, Homo sapiens
acaaagcactagagaat

SEQ ID NO: 4246340 - DNA, 15 bp, Homo sapiens
acaaagcgtgcacaa

SEQ ID NO: 4246341 - DNA, 14 bp, Homo sapiens
acaacaaaaaatac

SEQ ID NO: 4246342 - DNA, 19 bp, Homo sapiens
acaacaaaaaatacattat

SEQ ID NO: 4246343 - DNA, 22 bp, Homo sapiens
acaacagctcgatccaaattgt

SEQ ID NO: 4246344 - DNA, 20 bp, Homo sapiens
acaaccccctccacaaagag

SEQ ID NO: 4246345 - DNA, 13 bp, Homo sapiens
acaaggattgaaa

SEQ ID NO: 4246346 - DNA, 13 bp, Homo sapiens
acaagtaatgtaa

SEQ ID NO: 4246347 - DNA, 18 bp, Homo sapiens
acaagtcatttttgtatt

SEQ ID NO: 4246348 - DNA, 12 bp, Homo sapiens
acaataatgcaa

SEQ ID NO: 4246349 - DNA, 13 bp, Homo sapiens
acaatatgtatgc

SEQ ID NO: 4246350 - DNA, 16 bp, Homo sapiens
acaatatgtatgcttt

SEQ ID NO: 4246351 - DNA, 22 bp, Homo sapiens
acaatatgtatgctttttacct

SEQ ID NO: 4246352 - DNA, 16 bp, Homo sapiens
acaatcattgttttga

SEQ ID NO: 4246353 - DNA, 20 bp, Homo sapiens
acaatcattgttttgaatat

SEQ ID NO: 4246354 - DNA, 21 bp, Homo sapiens
acaatcctgtttataatctga

SEQ ID NO: 4246355 - DNA, 17 bp, Homo sapiens
acaatgacttactgtac

SEQ ID NO: 4246356 - DNA, 12 bp, Homo sapiens
acaatgttttct

SEQ ID NO: 4246357 - DNA, 15 bp, Homo sapiens
acaatttattatggc

SEQ ID NO: 4246358 - DNA, 16 bp, Homo sapiens
acaatttattatggca

SEQ ID NO: 4246359 - DNA, 20 bp, Homo sapiens
acaattttctgtaatctttt

SEQ ID NO: 4246360 - DNA, 18 bp, Homo sapiens
acaattttttttttcctc

SEQ ID NO: 4246361 - DNA, 19 bp, Homo sapiens
acacatgcaaggtcatttt

SEQ ID NO: 4246362 - DNA, 21 bp, Homo sapiens
acacatgcaaggtcatttttt

SEQ ID NO: 4246363 - DNA, 13 bp, Homo sapiens
acacattttattt

SEQ ID NO: 4246364 - DNA, 19 bp, Homo sapiens
acacattttattttattat

SEQ ID NO: 4246365 - DNA, 14 bp, Homo sapiens
acacattttttaaa

SEQ ID NO: 4246366 - DNA, 13 bp, Homo sapiens
acaccaagcagca

SEQ ID NO: 4246367 - DNA, 17 bp, Homo sapiens
acaccactacattctgt

SEQ ID NO: 4246368 - DNA, 21 bp, Homo sapiens
acaccactacattctgttaat

SEQ ID NO: 4246369 - DNA, 15 bp, Homo sapiens
acacctgtgcctcct

SEQ ID NO: 4246370 - DNA, 23 bp, Homo sapiens
acactaagtgagagttggggaga

SEQ ID NO: 4246371 - DNA, 12 bp, Homo sapiens
acactgtatttt

SEQ ID NO: 4246372 - DNA, 18 bp, Homo sapiens
acactgtattttaatgta

SEQ ID NO: 4246373 - DNA, 15 bp, Homo sapiens
acactgtttcaaact

SEQ ID NO: 4246374 - DNA, 24 bp, Homo sapiens
acacttgaagcctaaatttgtgct

SEQ ID NO: 4246375 - DNA, 13 bp, Homo sapiens
acactttacctct

SEQ ID NO: 4246376 - DNA, 14 bp, Homo sapiens
acactttacctctt

SEQ ID NO: 4246377 - DNA, 17 bp, Homo sapiens
acagaaatgtacagcaa

SEQ ID NO: 4246378 - DNA, 15 bp, Homo sapiens
acagacaaaaacaag

SEQ ID NO: 4246379 - DNA, 23 bp, Homo sapiens
acagacacaatatgtatgctttt

SEQ ID NO: 4246380 - DNA, 14 bp, Homo sapiens
acagactatttgct

SEQ ID NO: 4246381 - DNA, 20 bp, Homo sapiens
acagagcccgggagagactc

SEQ ID NO: 4246382 - DNA, 15 bp, Homo sapiens
acagagttgttacat

SEQ ID NO: 4246383 - DNA, 16 bp, Homo sapiens
acagcaaggagattta

SEQ ID NO: 4246384 - DNA, 15 bp, Homo sapiens
acagctcgatccaaa

SEQ ID NO: 4246385 - DNA, 22 bp, Homo sapiens
acagctgaagtcaaaatatgta

SEQ ID NO: 4246386 - DNA, 16 bp, Homo sapiens
acaggcagctctgagc

SEQ ID NO: 4246387 - DNA, 17 bp, Homo sapiens
acaggcagctctgagcc

SEQ ID NO: 4246388 - DNA, 20 bp, Homo sapiens
acaggcctgaagatattact

SEQ ID NO: 4246389 - DNA, 23 bp, Homo sapiens
acagtagttgtattcttctgtat

SEQ ID NO: 4246390 - DNA, 13 bp, Homo sapiens
acagtgaatgtgt

SEQ ID NO: 4246391 - DNA, 19 bp, Homo sapiens
acagtgaatgtgtctggac

SEQ ID NO: 4246392 - DNA, 13 bp, Homo sapiens
acagttactcaga

SEQ ID NO: 4246393 - DNA, 20 bp, Homo sapiens
acagttactcagaattctct

SEQ ID NO: 4246394 - DNA, 19 bp, Homo sapiens
acagttatttcatctttta

SEQ ID NO: 4246395 - DNA, 11 bp, Homo sapiens
acataaaaact

SEQ ID NO: 4246396 - DNA, 22 bp, Homo sapiens
acataatgcgtgcataccactt

SEQ ID NO: 4246397 - DNA, 23 bp, Homo sapiens
acataatgcgtgcataccacttt

SEQ ID NO: 4246398 - DNA, 15 bp, Homo sapiens
acataccagcttaga

SEQ ID NO: 4246399 - DNA, 12 bp, Homo sapiens
ataatggaaaca

SEQ ID NO: 4246400 - DNA, 18 bp, Homo sapiens
ataatgtgaaactggatt

SEQ ID NO: 4246401 - DNA, 19 bp, Homo sapiens
ataatgtgaaactggatta

SEQ ID NO: 4246402 - DNA, 21 bp, Homo sapiens
ataatgtgaaactggattaaa

SEQ ID NO: 4246403 - DNA, 18 bp, Homo sapiens
ataatgtgcagaaaatat

SEQ ID NO: 4246404 - DNA, 15 bp, Homo sapiens
ataatgtttaaatca

SEQ ID NO: 4246405 - DNA, 17 bp, Homo sapiens
ataatgtttaaatcatg

SEQ ID NO: 4246406 - DNA, 17 bp, Homo sapiens
ataattggtttgactgt

SEQ ID NO: 4246407 - DNA, 23 bp, Homo sapiens
ataattgtgtaccttaagatatt

SEQ ID NO: 4246408 - DNA, 17 bp, Homo sapiens
ataatttacaagatatt

SEQ ID NO: 4246409 - DNA, 23 bp, Homo sapiens
atacaatcctgtttataatctga

SEQ ID NO: 4246410 - DNA, 17 bp, Homo sapiens
atacaatgctgtgccct

SEQ ID NO: 4246411 - DNA, 20 bp, Homo sapiens
atacagttactcagaattct

SEQ ID NO: 4246412 - DNA, 18 bp, Homo sapiens
atacattccctctaattt

SEQ ID NO: 4246413 - DNA, 15 bp, Homo sapiens
atacgtacacatttt

SEQ ID NO: 4246414 - DNA, 21 bp, Homo sapiens
atactaaccagcagaaatgcc

SEQ ID NO: 4246415 - DNA, 20 bp, Homo sapiens
atactacagtttgttagtat

SEQ ID NO: 4246416 - DNA, 16 bp, Homo sapiens
atactgtgcagaataa

SEQ ID NO: 4246417 - DNA, 20 bp, Homo sapiens
atactgtgcagaataatgga

SEQ ID NO: 4246418 - DNA, 22 bp, Homo sapiens
atactgtgcagaataatggaaa

SEQ ID NO: 4246419 - DNA, 24 bp, Homo sapiens
atactttgtggaccaattattgat

SEQ ID NO: 4246420 - DNA, 18 bp, Homo sapiens
atacttttcccctgttaa

SEQ ID NO: 4246421 - DNA, 23 bp, Homo sapiens
atagacaatttattatggcacat

SEQ ID NO: 4246422 - DNA, 12 bp, Homo sapiens
atagagctttta

SEQ ID NO: 4246423 - DNA, 18 bp, Homo sapiens
atagaggtatattggaag

SEQ ID NO: 4246424 - DNA, 16 bp, Homo sapiens
ataggttatatgcaag

SEQ ID NO: 4246425 - DNA, 13 bp, Homo sapiens
atataaaacttaa

SEQ ID NO: 4246426 - DNA, 18 bp, Homo sapiens
atataaagaatatatata

SEQ ID NO: 4246427 - DNA, 13 bp, Homo sapiens
atataaagtatag

SEQ ID NO: 4246428 - DNA, 15 bp, Homo sapiens
atataagacatttgt

SEQ ID NO: 4246429 - DNA, 22 bp, Homo sapiens
atataatgtattttctttttat

SEQ ID NO: 4246430 - DNA, 13 bp, Homo sapiens
atatataaagtat

SEQ ID NO: 4246431 - DNA, 15 bp, Homo sapiens
atatataaagtatag

SEQ ID NO: 4246432 - DNA, 11 bp, Homo sapiens
atatatataaa

SEQ ID NO: 4246433 - DNA, 15 bp, Homo sapiens
atatatatataaagt

SEQ ID NO: 4246434 - DNA, 18 bp, Homo sapiens
atatatattcatatacaa

SEQ ID NO: 4246435 - DNA, 15 bp, Homo sapiens
atatattaaaacaat

SEQ ID NO: 4246436 - DNA, 14 bp, Homo sapiens
atatcagctttgat

SEQ ID NO: 4246437 - DNA, 16 bp, Homo sapiens
atatcagctttgataa

SEQ ID NO: 4246438 - DNA, 19 bp, Homo sapiens
atatcattctacagaataa

SEQ ID NO: 4246439 - DNA, 21 bp, Homo sapiens
atatgaggggcagtggacagt

SEQ ID NO: 4246440 - DNA, 16 bp, Homo sapiens
atatgcacacattttt

SEQ ID NO: 4246441 - DNA, 22 bp, Homo sapiens
atatgcacacattttttaaatg

SEQ ID NO: 4246442 - DNA, 17 bp, Homo sapiens
atatgtaagaacacatt

SEQ ID NO: 4246443 - DNA, 13 bp, Homo sapiens
atattaaataata

SEQ ID NO: 4246444 - DNA, 18 bp, Homo sapiens
atattacaacatttatgt

SEQ ID NO: 4246445 - DNA, 16 bp, Homo sapiens
atattcaatgtattga

SEQ ID NO: 4246446 - DNA, 21 bp, Homo sapiens
atattgagaatcccttaaaat

SEQ ID NO: 4246447 - DNA, 21 bp, Homo sapiens
atattgatttccgttaaaata

SEQ ID NO: 4246448 - DNA, 16 bp, Homo sapiens
atattgtttaaaattc

SEQ ID NO: 4246449 - DNA, 17 bp, Homo sapiens
atattgtttaaaattca

SEQ ID NO: 4246450 - DNA, 18 bp, Homo sapiens
atattgtttaaaattcag

SEQ ID NO: 4246451 - DNA, 13 bp, Homo sapiens
atatttaatatca

SEQ ID NO: 4246452 - DNA, 14 bp, Homo sapiens
atatttaatatcaa

SEQ ID NO: 4246453 - DNA, 20 bp, Homo sapiens
atatttcacttttgttctgc

SEQ ID NO: 4246454 - DNA, 12 bp, Homo sapiens
atattttaatgt

SEQ ID NO: 4246455 - DNA, 20 bp, Homo sapiens
atattttggaaactgctaaa

SEQ ID NO: 4246456 - DNA, 19 bp, Homo sapiens
atatttttatacaagtaat

SEQ ID NO: 4246457 - DNA, 15 bp, Homo sapiens
atatttttgtacttg

SEQ ID NO: 4246458 - DNA, 12 bp, Homo sapiens
atattttttgca

SEQ ID NO: 4246459 - DNA, 13 bp, Homo sapiens
atattttttgcaa

SEQ ID NO: 4246460 - DNA, 19 bp, Homo sapiens
atattttttgcaagttata

SEQ ID NO: 4246461 - DNA, 21 bp, Homo sapiens
atcaattggcagtgactttgt

SEQ ID NO: 4246462 - DNA, 23 bp, Homo sapiens
atcaattggcagtgactttgtat

SEQ ID NO: 4246463 - DNA, 12 bp, Homo sapiens
atcagatgtgaa

SEQ ID NO: 4246464 - DNA, 13 bp, Homo sapiens
atcagcacgattt

SEQ ID NO: 4246465 - DNA, 15 bp, Homo sapiens
atcagcacgatttct

SEQ ID NO: 4246466 - DNA, 16 bp, Homo sapiens
atcagcacgatttctg

SEQ ID NO: 4246467 - DNA, 19 bp, Homo sapiens
atcagctgcaatccattta

SEQ ID NO: 4246468 - DNA, 14 bp, Homo sapiens
atcagtgataattg

SEQ ID NO: 4246469 - DNA, 17 bp, Homo sapiens
atcagtgataattggtt

SEQ ID NO: 4246470 - DNA, 21 bp, Homo sapiens
atcatagaattgcagtcattt

SEQ ID NO: 4246471 - DNA, 16 bp, Homo sapiens
atcatatattaaaaca

SEQ ID NO: 4246472 - DNA, 19 bp, Homo sapiens
atcatatattaaaacaata

SEQ ID NO: 4246473 - DNA, 16 bp, Homo sapiens
atcattaggtgtgact

SEQ ID NO: 4246474 - DNA, 15 bp, Homo sapiens
atcattccagtgcta

SEQ ID NO: 4246475 - DNA, 19 bp, Homo sapiens
atcattccagtgctagaaa

SEQ ID NO: 4246476 - DNA, 18 bp, Homo sapiens
atcattctacagaataat

SEQ ID NO: 4246477 - DNA, 14 bp, Homo sapiens
atccaaaatatttt

SEQ ID NO: 4246478 - DNA, 20 bp, Homo sapiens
atccaaaatattttttgcaa

SEQ ID NO: 4246479 - DNA, 21 bp, Homo sapiens
atccaaacatgtatttatgta

SEQ ID NO: 4246480 - DNA, 20 bp, Homo sapiens
atccaaattgtgcttctccc

SEQ ID NO: 4246481 - DNA, 15 bp, Homo sapiens
atccacttcaggagc

SEQ ID NO: 4246482 - DNA, 16 bp, Homo sapiens
atccatgcattatata

SEQ ID NO: 4246483 - DNA, 15 bp, Homo sapiens
atccctactgtaatt

SEQ ID NO: 4246484 - DNA, 14 bp, Homo sapiens
atcctctcctttga

SEQ ID NO: 4246485 - DNA, 16 bp, Homo sapiens
atcgctcgtgtgttct

SEQ ID NO: 4246486 - DNA, 18 bp, Homo sapiens
atctaaacagttatttct

SEQ ID NO: 4246487 - DNA, 13 bp, Homo sapiens
atctaaatggaac

SEQ ID NO: 4246488 - DNA, 17 bp, Homo sapiens
atctcaaatttctaaat

SEQ ID NO: 4246489 - DNA, 16 bp, Homo sapiens
atctcacttagtcctt

SEQ ID NO: 4246490 - DNA, 13 bp, Homo sapiens
atctccaaaataa

SEQ ID NO: 4246491 - DNA, 21 bp, Homo sapiens
atctccaaaataaaacttttt

SEQ ID NO: 4246492 - DNA, 14 bp, Homo sapiens
atctctccctcccc

SEQ ID NO: 4246493 - DNA, 15 bp, Homo sapiens
atctctccctcccct

SEQ ID NO: 4246494 - DNA, 23 bp, Homo sapiens
atctctccctcccctgccatttt

SEQ ID NO: 4246495 - DNA, 23 bp, Homo sapiens
atctctgcctccaacccagcagt

SEQ ID NO: 4246496 - DNA, 19 bp, Homo sapiens
atctctgtgattacctctc

SEQ ID NO: 4246497 - DNA, 16 bp, Homo sapiens
atctcttattttacaa

SEQ ID NO: 4246498 - DNA, 21 bp, Homo sapiens
atctgacccactttgtaattt

SEQ ID NO: 4246499 - DNA, 23 bp, Homo sapiens
atctggcacgtggccaggagcca

SEQ ID NO: 4246500 - DNA, 15 bp, Homo sapiens
atctgtgtgtatatt

SEQ ID NO: 4246501 - DNA, 18 bp, Homo sapiens
atctgttattcaaatttg

SEQ ID NO: 4246502 - DNA, 21 bp, Homo sapiens
atcttggggcaagactgcaaa

SEQ ID NO: 4246503 - DNA, 22 bp, Homo sapiens
atcttggggcaagactgcaaac

SEQ ID NO: 4246504 - DNA, 11 bp, Homo sapiens
atcttgtgaaa

SEQ ID NO: 4246505 - DNA, 15 bp, Homo sapiens
atcttgtgaaatggc

SEQ ID NO: 4246506 - DNA, 22 bp, Homo sapiens
atcttttcataaagggttgaaa

SEQ ID NO: 4246507 - DNA, 14 bp, Homo sapiens
atgaaaacacattt

SEQ ID NO: 4246508 - DNA, 15 bp, Homo sapiens
atgaaaacacatttt

SEQ ID NO: 4246509 - DNA, 16 bp, Homo sapiens
atgaaaacacattttt

SEQ ID NO: 4246510 - DNA, 23 bp, Homo sapiens
atgaagtaatatgcacacatttt

SEQ ID NO: 4246511 - DNA, 14 bp, Homo sapiens
atgaagtatacttt

SEQ ID NO: 4246512 - DNA, 14 bp, Homo sapiens
atgaataaactgaa

SEQ ID NO: 4246513 - DNA, 15 bp, Homo sapiens
atgaataaactgaat

SEQ ID NO: 4246514 - DNA, 15 bp, Homo sapiens
ccggagcgccctgca

SEQ ID NO: 4246515 - DNA, 19 bp, Homo sapiens
ccggagcgccctgcagggc

SEQ ID NO: 4246516 - DNA, 23 bp, Homo sapiens
ccggaggaaccgaggtgttgcca

SEQ ID NO: 4246517 - DNA, 20 bp, Homo sapiens
ccgggagactgccagtggag

SEQ ID NO: 4246518 - DNA, 23 bp, Homo sapiens
ccgggagactgccagtggagacg

SEQ ID NO: 4246519 - DNA, 22 bp, Homo sapiens
ccgggcgggcgtgggaggaggg

SEQ ID NO: 4246520 - DNA, 16 bp, Homo sapiens
ccgtgtgtgcatgtgc

SEQ ID NO: 4246521 - DNA, 23 bp, Homo sapiens
cctaaaaggaaatctcaccccat

SEQ ID NO: 4246522 - DNA, 13 bp, Homo sapiens
cctaacctttggg

SEQ ID NO: 4246523 - DNA, 14 bp, Homo sapiens
cctaatggcatgga

SEQ ID NO: 4246524 - DNA, 23 bp, Homo sapiens
cctaatgtctcactgttctgcaa

SEQ ID NO: 4246525 - DNA, 19 bp, Homo sapiens
cctagaagcacggctgtgg

SEQ ID NO: 4246526 - DNA, 17 bp, Homo sapiens
cctagcagacagaaact

SEQ ID NO: 4246527 - DNA, 19 bp, Homo sapiens
cctagcagacagaaactgg

SEQ ID NO: 4246528 - DNA, 19 bp, Homo sapiens
cctagcatacgtacacatt

SEQ ID NO: 4246529 - DNA, 21 bp, Homo sapiens
cctagcatacgtacacatttt

SEQ ID NO: 4246530 - DNA, 17 bp, Homo sapiens
cctagtggatgactgtt

SEQ ID NO: 4246531 - DNA, 12 bp, Homo sapiens
cctatttaatac

SEQ ID NO: 4246532 - DNA, 20 bp, Homo sapiens
cctcacctctcccccaaggc

SEQ ID NO: 4246533 - DNA, 16 bp, Homo sapiens
cctcactgttgaattt

SEQ ID NO: 4246534 - DNA, 14 bp, Homo sapiens
cctcatgccacagt

SEQ ID NO: 4246535 - DNA, 20 bp, Homo sapiens
cctccatctcagactgtgga

SEQ ID NO: 4246536 - DNA, 15 bp, Homo sapiens
cctcctaatggcatg

SEQ ID NO: 4246537 - DNA, 17 bp, Homo sapiens
cctcctaatggcatgga

SEQ ID NO: 4246538 - DNA, 21 bp, Homo sapiens
cctcctaatggcatggagact

SEQ ID NO: 4246539 - DNA, 23 bp, Homo sapiens
cctcctaatggcatggagactct

SEQ ID NO: 4246540 - DNA, 16 bp, Homo sapiens
cctccttctccctttt

SEQ ID NO: 4246541 - DNA, 17 bp, Homo sapiens
cctccttctcccttttt

SEQ ID NO: 4246542 - DNA, 15 bp, Homo sapiens
cctctcgtttctgcc

SEQ ID NO: 4246543 - DNA, 18 bp, Homo sapiens
cctctcgtttctgcccag

SEQ ID NO: 4246544 - DNA, 19 bp, Homo sapiens
cctctctccacacggagct

SEQ ID NO: 4246545 - DNA, 14 bp, Homo sapiens
cctctgtggccagg

SEQ ID NO: 4246546 - DNA, 18 bp, Homo sapiens
cctctgtggccaggagcc

SEQ ID NO: 4246547 - DNA, 22 bp, Homo sapiens
cctctgtggccaggagccctgg

SEQ ID NO: 4246548 - DNA, 13 bp, Homo sapiens
cctcttcagaact

SEQ ID NO: 4246549 - DNA, 14 bp, Homo sapiens
cctcttcagaactt

SEQ ID NO: 4246550 - DNA, 12 bp, Homo sapiens
cctgaatatttt

SEQ ID NO: 4246551 - DNA, 21 bp, Homo sapiens
cctgagtggccagggaatcta

SEQ ID NO: 4246552 - DNA, 14 bp, Homo sapiens
cctgatgatgctgg

SEQ ID NO: 4246553 - DNA, 13 bp, Homo sapiens
cctgcacctctgg

SEQ ID NO: 4246554 - DNA, 14 bp, Homo sapiens
cctgcacctctgga

SEQ ID NO: 4246555 - DNA, 15 bp, Homo sapiens
cctgcacctctggat

SEQ ID NO: 4246556 - DNA, 19 bp, Homo sapiens
cctgcagggccgggcaggg

SEQ ID NO: 4246557 - DNA, 22 bp, Homo sapiens
cctgccctcaggctccccagtg

SEQ ID NO: 4246558 - DNA, 19 bp, Homo sapiens
cctgctgggtgccaggtgc

SEQ ID NO: 4246559 - DNA, 21 bp, Homo sapiens
cctgcttgagctttctgtgca

SEQ ID NO: 4246560 - DNA, 23 bp, Homo sapiens
cctgcttgagctttctgtgcatg

SEQ ID NO: 4246561 - DNA, 24 bp, Homo sapiens
cctgcttgagctttctgtgcatgt

SEQ ID NO: 4246562 - DNA, 18 bp, Homo sapiens
cctggaatatataaccag

SEQ ID NO: 4246563 - DNA, 14 bp, Homo sapiens
cctggagctttcct

SEQ ID NO: 4246564 - DNA, 21 bp, Homo sapiens
cctggcaggctgtctggccag

SEQ ID NO: 4246565 - DNA, 19 bp, Homo sapiens
cctggggtttagaacccca

SEQ ID NO: 4246566 - DNA, 24 bp, Homo sapiens
cctggggtttagaaccccaggtga

SEQ ID NO: 4246567 - DNA, 16 bp, Homo sapiens
cctggttcgtgccatg

SEQ ID NO: 4246568 - DNA, 19 bp, Homo sapiens
cctggttcgtgccatgccc

SEQ ID NO: 4246569 - DNA, 15 bp, Homo sapiens
cctggttgggtggca

SEQ ID NO: 4246570 - DNA, 10 bp, Homo sapiens
cctgtacctc

SEQ ID NO: 4246571 - DNA, 20 bp, Homo sapiens
cctgtcatagagctgcaggg

SEQ ID NO: 4246572 - DNA, 17 bp, Homo sapiens
cctgtgtatacagccct

SEQ ID NO: 4246573 - DNA, 14 bp, Homo sapiens
cctgttaaacagta

SEQ ID NO: 4246574 - DNA, 22 bp, Homo sapiens
cctgttaaacagtagttgtatt

SEQ ID NO: 4246575 - DNA, 17 bp, Homo sapiens
cctgttatgtatgaagg

SEQ ID NO: 4246576 - DNA, 21 bp, Homo sapiens
cctgtttataatctgaagata

SEQ ID NO: 4246577 - DNA, 16 bp, Homo sapiens
ccttaagatattgaag

SEQ ID NO: 4246578 - DNA, 20 bp, Homo sapiens
ccttacacgtgcgtgtgagt

SEQ ID NO: 4246579 - DNA, 22 bp, Homo sapiens
ccttagagcatctctgcctcca

SEQ ID NO: 4246580 - DNA, 16 bp, Homo sapiens
ccttcccctccttctc

SEQ ID NO: 4246581 - DNA, 14 bp, Homo sapiens
ccttcccgggcggg

SEQ ID NO: 4246582 - DNA, 14 bp, Homo sapiens
ccttccctggaggt

SEQ ID NO: 4246583 - DNA, 17 bp, Homo sapiens
ccttcctgtccccaggg

SEQ ID NO: 4246584 - DNA, 18 bp, Homo sapiens
ccttcctgtccccagggg

SEQ ID NO: 4246585 - DNA, 15 bp, Homo sapiens
ccttctgttgctggt

SEQ ID NO: 4246586 - DNA, 19 bp, Homo sapiens
ccttgaactttgacctctg

SEQ ID NO: 4246587 - DNA, 13 bp, Homo sapiens
ccttgcacctgag

SEQ ID NO: 4246588 - DNA, 20 bp, Homo sapiens
ccttgcacctgagcctgttc

SEQ ID NO: 4246589 - DNA, 23 bp, Homo sapiens
ccttgcacctgagcctgttccca

SEQ ID NO: 4246590 - DNA, 15 bp, Homo sapiens
cctttcttgcactgt

SEQ ID NO: 4246591 - DNA, 19 bp, Homo sapiens
cctttcttgcactgtccag

SEQ ID NO: 4246592 - DNA, 15 bp, Homo sapiens
cctttgtattctctc

SEQ ID NO: 4246593 - DNA, 14 bp, Homo sapiens
cctttgtttcttgt

SEQ ID NO: 4246594 - DNA, 17 bp, Homo sapiens
ccttttatctgcagaac

SEQ ID NO: 4246595 - DNA, 19 bp, Homo sapiens
ccttttatctgcagaacat

SEQ ID NO: 4246596 - DNA, 12 bp, Homo sapiens
ccttttttatac

SEQ ID NO: 4246597 - DNA, 17 bp, Homo sapiens
ccttttttatacataaa

SEQ ID NO: 4246598 - DNA, 18 bp, Homo sapiens
cgaaacccggtgcatctg

SEQ ID NO: 4246599 - DNA, 19 bp, Homo sapiens
cgaaacccggtgcatctgg

SEQ ID NO: 4246600 - DNA, 16 bp, Homo sapiens
cgaccacgccccagga

SEQ ID NO: 4246601 - DNA, 18 bp, Homo sapiens
cgacccttttgagcctag

SEQ ID NO: 4246602 - DNA, 23 bp, Homo sapiens
cgagcagtcctgcctcagcctcc

SEQ ID NO: 4246603 - DNA, 21 bp, Homo sapiens
cgagctgtttatgtttttata

SEQ ID NO: 4246604 - DNA, 15 bp, Homo sapiens
cgaggctaaccctga

SEQ ID NO: 4246605 - DNA, 17 bp, Homo sapiens
cgatctcttattttaca

SEQ ID NO: 4246606 - DNA, 13 bp, Homo sapiens
cgatggaggccta

SEQ ID NO: 4246607 - DNA, 19 bp, Homo sapiens
cgatggaggcctacctctc

SEQ ID NO: 4246608 - DNA, 22 bp, Homo sapiens
cgcaatgaaaagtcgttttcca

SEQ ID NO: 4246609 - DNA, 10 bp, Homo sapiens
cgcagccctc

SEQ ID NO: 4246610 - DNA, 17 bp, Homo sapiens
cgcagggcgcccagcgc

SEQ ID NO: 4246611 - DNA, 17 bp, Homo sapiens
cgcccgtggcctcgtgc

SEQ ID NO: 4246612 - DNA, 20 bp, Homo sapiens
cgccctgcagggccgggcag

SEQ ID NO: 4246613 - DNA, 20 bp, Homo sapiens
cgccgtccggcggccccgcc

SEQ ID NO: 4246614 - DNA, 22 bp, Homo sapiens
cgcgctttcccctcctccctgg

SEQ ID NO: 4246615 - DNA, 13 bp, Homo sapiens
cgctgccgggaga

SEQ ID NO: 4246616 - DNA, 20 bp, Homo sapiens
cgctgccgggagactgccag

SEQ ID NO: 4246617 - DNA, 15 bp, Homo sapiens
cgctttcccctcctc

SEQ ID NO: 4246618 - DNA, 21 bp, Homo sapiens
cgctttgtctgtccagccgtg

SEQ ID NO: 4246619 - DNA, 15 bp, Homo sapiens
cggccccgccgcaga

SEQ ID NO: 4246620 - DNA, 15 bp, Homo sapiens
cggcccggccggagg

SEQ ID NO: 4246621 - DNA, 14 bp, Homo sapiens
cggccgcccggcag

SEQ ID NO: 4246622 - DNA, 13 bp, Homo sapiens
cggcctccatgca

SEQ ID NO: 4246623 - DNA, 15 bp, Homo sapiens
cgggtgatgagacct

SEQ ID NO: 4246624 - DNA, 16 bp, Homo sapiens
cgggtgatgagacctg

SEQ ID NO: 4246625 - DNA, 12 bp, Homo sapiens
cgggtgtggaga

SEQ ID NO: 4246626 - DNA, 15 bp, Homo sapiens
cggtgcatctggcac

SEQ ID NO: 4246627 - DNA, 13 bp, Homo sapiens
cgtacacatttta

SEQ ID NO: 4246628 - DNA, 19 bp, Homo sapiens
cgtcccccgttgtgcctgg

SEQ ID NO: 4246629 - DNA, 17 bp, Homo sapiens
gacaatcattgttttga

SEQ ID NO: 4246630 - DNA, 20 bp, Homo sapiens
gacaatcattgttttgaata

SEQ ID NO: 4246631 - DNA, 14 bp, Homo sapiens
gacagaaactggat

SEQ ID NO: 4246632 - DNA, 15 bp, Homo sapiens
gacagactatttgct

SEQ ID NO: 4246633 - DNA, 16 bp, Homo sapiens
gacagagcccgggaga

SEQ ID NO: 4246634 - DNA, 19 bp, Homo sapiens
gacaggcctgaagatatta

SEQ ID NO: 4246635 - DNA, 19 bp, Homo sapiens
gacaggggcgcttgggagg

SEQ ID NO: 4246636 - DNA, 16 bp, Homo sapiens
gacatactaaccagca

SEQ ID NO: 4246637 - DNA, 16 bp, Homo sapiens
gaccaattattgatat

SEQ ID NO: 4246638 - DNA, 18 bp, Homo sapiens
gaccacgccccaggacct

SEQ ID NO: 4246639 - DNA, 17 bp, Homo sapiens
gacccttttgagcctag

SEQ ID NO: 4246640 - DNA, 17 bp, Homo sapiens
gaccgggcgcagccctc

SEQ ID NO: 4246641 - DNA, 14 bp, Homo sapiens
gaccgttaaaaaat

SEQ ID NO: 4246642 - DNA, 17 bp, Homo sapiens
gacctaaattagataaa

SEQ ID NO: 4246643 - DNA, 21 bp, Homo sapiens
gacctccggagcgccctgcag

SEQ ID NO: 4246644 - DNA, 18 bp, Homo sapiens
gacctctgcagcaataaa

SEQ ID NO: 4246645 - DNA, 16 bp, Homo sapiens
gacgcagtccgcccag

SEQ ID NO: 4246646 - DNA, 22 bp, Homo sapiens
gacgctgccgggagactgccag

SEQ ID NO: 4246647 - DNA, 19 bp, Homo sapiens
gacggaaaatgcttaaaaa

SEQ ID NO: 4246648 - DNA, 21 bp, Homo sapiens
gactacaaaatacaatcctgt

SEQ ID NO: 4246649 - DNA, 20 bp, Homo sapiens
gactcctcttcccagagtca

SEQ ID NO: 4246650 - DNA, 21 bp, Homo sapiens
gactctcagcccagaagaaaa

SEQ ID NO: 4246651 - DNA, 14 bp, Homo sapiens
gactgaatttcttt

SEQ ID NO: 4246652 - DNA, 22 bp, Homo sapiens
gactgcaaacttttttatatct

SEQ ID NO: 4246653 - DNA, 21 bp, Homo sapiens
gactgcacagcgtcctgtcca

SEQ ID NO: 4246654 - DNA, 20 bp, Homo sapiens
gactgtaccacagacacaat

SEQ ID NO: 4246655 - DNA, 23 bp, Homo sapiens
gacttactgtacatgaaaacaca

SEQ ID NO: 4246656 - DNA, 16 bp, Homo sapiens
gacttcgcagccccgg

SEQ ID NO: 4246657 - DNA, 14 bp, Homo sapiens
gacttggcaggtgc

SEQ ID NO: 4246658 - DNA, 18 bp, Homo sapiens
gacttggcaggtgcctgt

SEQ ID NO: 4246659 - DNA, 22 bp, Homo sapiens
gacttgtacaaacagtatttct

SEQ ID NO: 4246660 - DNA, 18 bp, Homo sapiens
gacttgttttatgctcag

SEQ ID NO: 4246661 - DNA, 18 bp, Homo sapiens
gacttttcaataaatcag

SEQ ID NO: 4246662 - DNA, 14 bp, Homo sapiens
gagaaaagaaaaat

SEQ ID NO: 4246663 - DNA, 15 bp, Homo sapiens
gagaactcagtgcca

SEQ ID NO: 4246664 - DNA, 17 bp, Homo sapiens
gagaagttctcaaagtt

SEQ ID NO: 4246665 - DNA, 17 bp, Homo sapiens
gagaatcccttaaaatt

SEQ ID NO: 4246666 - DNA, 22 bp, Homo sapiens
gagaatcccttaaaattaccag

SEQ ID NO: 4246667 - DNA, 18 bp, Homo sapiens
gagactcgctcactccca

SEQ ID NO: 4246668 - DNA, 17 bp, Homo sapiens
gagagtctgaatatttt

SEQ ID NO: 4246669 - DNA, 14 bp, Homo sapiens
gagcatctctgcct

SEQ ID NO: 4246670 - DNA, 17 bp, Homo sapiens
gagcatttaatggcagc

SEQ ID NO: 4246671 - DNA, 15 bp, Homo sapiens
gagccattttggtaa

SEQ ID NO: 4246672 - DNA, 17 bp, Homo sapiens
gagcccgggagagactc

SEQ ID NO: 4246673 - DNA, 11 bp, Homo sapiens
gagcctgtcca

SEQ ID NO: 4246674 - DNA, 17 bp, Homo sapiens
gagccttcccgggcggg

SEQ ID NO: 4246675 - DNA, 19 bp, Homo sapiens
gagccttgaactttgacct

SEQ ID NO: 4246676 - DNA, 18 bp, Homo sapiens
gagccttttatctgcaga

SEQ ID NO: 4246677 - DNA, 14 bp, Homo sapiens
gagcgaattgtgtg

SEQ ID NO: 4246678 - DNA, 20 bp, Homo sapiens
gagcgtacgatggaggccta

SEQ ID NO: 4246679 - DNA, 13 bp, Homo sapiens
gagctgctgggtg

SEQ ID NO: 4246680 - DNA, 15 bp, Homo sapiens
gagctgtttatgttt

SEQ ID NO: 4246681 - DNA, 16 bp, Homo sapiens
gagctgtttatgtttt

SEQ ID NO: 4246682 - DNA, 13 bp, Homo sapiens
gagcttgaagatt

SEQ ID NO: 4246683 - DNA, 14 bp, Homo sapiens
gagctttctgtgca

SEQ ID NO: 4246684 - DNA, 17 bp, Homo sapiens
gaggagggaggcggcct

SEQ ID NO: 4246685 - DNA, 18 bp, Homo sapiens
gaggagggaggcggcctc

SEQ ID NO: 4246686 - DNA, 21 bp, Homo sapiens
gaggcatttgtttgaactgat

SEQ ID NO: 4246687 - DNA, 13 bp, Homo sapiens
gaggcctacctct

SEQ ID NO: 4246688 - DNA, 14 bp, Homo sapiens
gagggacagagccc

SEQ ID NO: 4246689 - DNA, 19 bp, Homo sapiens
gagggacagagcccgggag

SEQ ID NO: 4246690 - DNA, 14 bp, Homo sapiens
gagggagagccctg

SEQ ID NO: 4246691 - DNA, 13 bp, Homo sapiens
gagggcaggaccc

SEQ ID NO: 4246692 - DNA, 14 bp, Homo sapiens
gaggtctgttcttt

SEQ ID NO: 4246693 - DNA, 17 bp, Homo sapiens
gagtacgttgtgcattt

SEQ ID NO: 4246694 - DNA, 20 bp, Homo sapiens
gagtattttaagaagacata

SEQ ID NO: 4246695 - DNA, 12 bp, Homo sapiens
gagtatttttgg

SEQ ID NO: 4246696 - DNA, 17 bp, Homo sapiens
gagtctggggtgggagg

SEQ ID NO: 4246697 - DNA, 20 bp, Homo sapiens
gagtctttgagactaaattc

SEQ ID NO: 4246698 - DNA, 19 bp, Homo sapiens
gagttaataggagtatttt

SEQ ID NO: 4246699 - DNA, 16 bp, Homo sapiens
gagttgaggaactgta

SEQ ID NO: 4246700 - DNA, 18 bp, Homo sapiens
gataaaataaataatttt

SEQ ID NO: 4246701 - DNA, 19 bp, Homo sapiens
gataaaataaataatttta

SEQ ID NO: 4246702 - DNA, 17 bp, Homo sapiens
gataataatattgtttt

SEQ ID NO: 4246703 - DNA, 16 bp, Homo sapiens
gatacaaaagcatgtg

SEQ ID NO: 4246704 - DNA, 18 bp, Homo sapiens
gatacaatgctgtgccct

SEQ ID NO: 4246705 - DNA, 21 bp, Homo sapiens
gatactgtatcatgacaaaga

SEQ ID NO: 4246706 - DNA, 16 bp, Homo sapiens
gatagcttgagctcag

SEQ ID NO: 4246707 - DNA, 22 bp, Homo sapiens
gatatactttgtggaccaatta

SEQ ID NO: 4246708 - DNA, 18 bp, Homo sapiens
gatatatttcacttttgt

SEQ ID NO: 4246709 - DNA, 13 bp, Homo sapiens
gatatggagaatt

SEQ ID NO: 4246710 - DNA, 19 bp, Homo sapiens
gatatggagaattgctgaa

SEQ ID NO: 4246711 - DNA, 20 bp, Homo sapiens
gatattatattaaacataca

SEQ ID NO: 4246712 - DNA, 18 bp, Homo sapiens
gatattattaatttttat

SEQ ID NO: 4246713 - DNA, 20 bp, Homo sapiens
gatattgaaggagaaaatag

SEQ ID NO: 4246714 - DNA, 13 bp, Homo sapiens
gatattgtttaaa

SEQ ID NO: 4246715 - DNA, 19 bp, Homo sapiens
gatattgtttaaaattcag

SEQ ID NO: 4246716 - DNA, 14 bp, Homo sapiens
gatatttttgtact

SEQ ID NO: 4246717 - DNA, 15 bp, Homo sapiens
gatatttttgtactt

SEQ ID NO: 4246718 - DNA, 17 bp, Homo sapiens
gatatttttgtacttga

SEQ ID NO: 4246719 - DNA, 15 bp, Homo sapiens
gatatttttttcttt

SEQ ID NO: 4246720 - DNA, 17 bp, Homo sapiens
gatatttttttcttttc

SEQ ID NO: 4246721 - DNA, 21 bp, Homo sapiens
gatccatagtgctacctgcac

SEQ ID NO: 4246722 - DNA, 17 bp, Homo sapiens
gatcctctcctttgaaa

SEQ ID NO: 4246723 - DNA, 20 bp, Homo sapiens
gatcctggaaacagcagtgt

SEQ ID NO: 4246724 - DNA, 15 bp, Homo sapiens
gatctctaacttcac

SEQ ID NO: 4246725 - DNA, 13 bp, Homo sapiens
gatgagacctggg

SEQ ID NO: 4246726 - DNA, 19 bp, Homo sapiens
gatgattttcatttcatga

SEQ ID NO: 4246727 - DNA, 18 bp, Homo sapiens
gatgctatggaacataaa

SEQ ID NO: 4246728 - DNA, 16 bp, Homo sapiens
gatgcttgtacataat

SEQ ID NO: 4246729 - DNA, 20 bp, Homo sapiens
gatggaaatacagttatttc

SEQ ID NO: 4246730 - DNA, 17 bp, Homo sapiens
gatggacgctgccggga

SEQ ID NO: 4246731 - DNA, 23 bp, Homo sapiens
gatggggtctcacagtgttgccc

SEQ ID NO: 4246732 - DNA, 11 bp, Homo sapiens
gatgtgacttt

SEQ ID NO: 4246733 - DNA, 13 bp, Homo sapiens
gatgtgacttttt

SEQ ID NO: 4246734 - DNA, 17 bp, Homo sapiens
gatgtttcaactgtgct

SEQ ID NO: 4246735 - DNA, 11 bp, Homo sapiens
gattacctctc

SEQ ID NO: 4246736 - DNA, 16 bp, Homo sapiens
gattcccttccttctg

SEQ ID NO: 4246737 - DNA, 23 bp, Homo sapiens
gattgacgggactgttggtattg

SEQ ID NO: 4246738 - DNA, 15 bp, Homo sapiens
gatttccgttaaaat

SEQ ID NO: 4246739 - DNA, 23 bp, Homo sapiens
gatttctcactatatatatttct

SEQ ID NO: 4246740 - DNA, 11 bp, Homo sapiens
gatttctgttt

SEQ ID NO: 4246741 - DNA, 22 bp, Homo sapiens
gatttctgtttagataatacac

SEQ ID NO: 4246742 - DNA, 15 bp, Homo sapiens
gattttcatttcatg

SEQ ID NO: 4246743 - DNA, 16 bp, Homo sapiens
gattttcatttcatga

SEQ ID NO: 4246744 - DNA, 19 bp, Homo sapiens
taatgacttgtacaaacag

SEQ ID NO: 4246745 - DNA, 13 bp, Homo sapiens
taatgataaaata

SEQ ID NO: 4246746 - DNA, 22 bp, Homo sapiens
taatgcgtgcataccacttttg

SEQ ID NO: 4246747 - DNA, 19 bp, Homo sapiens
taatggcagctagtgcctt

SEQ ID NO: 4246748 - DNA, 20 bp, Homo sapiens
taatggcagctagtgccttt

SEQ ID NO: 4246749 - DNA, 18 bp, Homo sapiens
taatgtctcactgttctg

SEQ ID NO: 4246750 - DNA, 19 bp, Homo sapiens
taatgtctcactgttctgc

SEQ ID NO: 4246751 - DNA, 22 bp, Homo sapiens
taatgtctcactgttctgcaaa

SEQ ID NO: 4246752 - DNA, 12 bp, Homo sapiens
taatgtgaaact

SEQ ID NO: 4246753 - DNA, 22 bp, Homo sapiens
taatgtgaaactggattaaact

SEQ ID NO: 4246754 - DNA, 22 bp, Homo sapiens
taatgtgcagaaaatatttaat

SEQ ID NO: 4246755 - DNA, 14 bp, Homo sapiens
taatgtttaaatca

SEQ ID NO: 4246756 - DNA, 15 bp, Homo sapiens
taatgtttaaatcat

SEQ ID NO: 4246757 - DNA, 21 bp, Homo sapiens
taatgtttaaatcatgtatgt

SEQ ID NO: 4246758 - DNA, 15 bp, Homo sapiens
taattcttcacctgt

SEQ ID NO: 4246759 - DNA, 18 bp, Homo sapiens
taatttgtgatacaatgc

SEQ ID NO: 4246760 - DNA, 21 bp, Homo sapiens
taattttaccaagagtaactt

SEQ ID NO: 4246761 - DNA, 22 bp, Homo sapiens
taatttttgctccaatatccat

SEQ ID NO: 4246762 - DNA, 18 bp, Homo sapiens
tacaaagcactagagaat

SEQ ID NO: 4246763 - DNA, 23 bp, Homo sapiens
tacaaagcactagagaatgcaca

SEQ ID NO: 4246764 - DNA, 18 bp, Homo sapiens
tacaactgtatttattaa

SEQ ID NO: 4246765 - DNA, 14 bp, Homo sapiens
tacaagtaatgtaa

SEQ ID NO: 4246766 - DNA, 16 bp, Homo sapiens
tacaagttgttattgt

SEQ ID NO: 4246767 - DNA, 20 bp, Homo sapiens
tacaagttgttattgttgaa

SEQ ID NO: 4246768 - DNA, 21 bp, Homo sapiens
tacaataaaactttgctgcca

SEQ ID NO: 4246769 - DNA, 23 bp, Homo sapiens
tacaatcctgtttataatctgaa

SEQ ID NO: 4246770 - DNA, 17 bp, Homo sapiens
tacaatgtgtttttctc

SEQ ID NO: 4246771 - DNA, 19 bp, Homo sapiens
tacacagtgggaagatttt

SEQ ID NO: 4246772 - DNA, 17 bp, Homo sapiens
tacaccactacattctg

SEQ ID NO: 4246773 - DNA, 18 bp, Homo sapiens
tacaccactacattctgt

SEQ ID NO: 4246774 - DNA, 19 bp, Homo sapiens
tacaccactacattctgtt

SEQ ID NO: 4246775 - DNA, 22 bp, Homo sapiens
tacagcaaggagatttacaact

SEQ ID NO: 4246776 - DNA, 24 bp, Homo sapiens
tacataatgcgtgcataccacttt

SEQ ID NO: 4246777 - DNA, 15 bp, Homo sapiens
tacatattgtatata

SEQ ID NO: 4246778 - DNA, 19 bp, Homo sapiens
tacatgaaaacacattttt

SEQ ID NO: 4246779 - DNA, 14 bp, Homo sapiens
tacattattgctta

SEQ ID NO: 4246780 - DNA, 14 bp, Homo sapiens
tacatttttaagtg

SEQ ID NO: 4246781 - DNA, 22 bp, Homo sapiens
taccaaggtacaactgtattta

SEQ ID NO: 4246782 - DNA, 23 bp, Homo sapiens
taccacagacacaatatgtatgc

SEQ ID NO: 4246783 - DNA, 21 bp, Homo sapiens
taccagattctgcctatgtaa

SEQ ID NO: 4246784 - DNA, 11 bp, Homo sapiens
taccccacaca

SEQ ID NO: 4246785 - DNA, 15 bp, Homo sapiens
taccctcatgttctt

SEQ ID NO: 4246786 - DNA, 18 bp, Homo sapiens
taccctcctgcactgttt

SEQ ID NO: 4246787 - DNA, 21 bp, Homo sapiens
tacctaatgtctcactgttct

SEQ ID NO: 4246788 - DNA, 20 bp, Homo sapiens
tacctcctaatggcatggag

SEQ ID NO: 4246789 - DNA, 19 bp, Homo sapiens
tacctctcgtttctgccca

SEQ ID NO: 4246790 - DNA, 21 bp, Homo sapiens
tacctgacctaaattagataa

SEQ ID NO: 4246791 - DNA, 22 bp, Homo sapiens
tacctgcttgagctttctgtgc

SEQ ID NO: 4246792 - DNA, 13 bp, Homo sapiens
taccttttttaga

SEQ ID NO: 4246793 - DNA, 13 bp, Homo sapiens
taccttttttata

SEQ ID NO: 4246794 - DNA, 16 bp, Homo sapiens
taccttttttatacat

SEQ ID NO: 4246795 - DNA, 18 bp, Homo sapiens
taccttttttatacataa

SEQ ID NO: 4246796 - DNA, 15 bp, Homo sapiens
tacgatggaggccta

SEQ ID NO: 4246797 - DNA, 20 bp, Homo sapiens
tacgatggaggcctacctct

SEQ ID NO: 4246798 - DNA, 15 bp, Homo sapiens
tacgttgtgcatttg

SEQ ID NO: 4246799 - DNA, 12 bp, Homo sapiens
tacgtttgttat

SEQ ID NO: 4246800 - DNA, 17 bp, Homo sapiens
tactaatagacaattta

SEQ ID NO: 4246801 - DNA, 23 bp, Homo sapiens
tactatggccctggcctagcata

SEQ ID NO: 4246802 - DNA, 13 bp, Homo sapiens
tactcctattttt

SEQ ID NO: 4246803 - DNA, 21 bp, Homo sapiens
tactcctatttttgtaaactg

SEQ ID NO: 4246804 - DNA, 15 bp, Homo sapiens
tactctaggacttca

SEQ ID NO: 4246805 - DNA, 15 bp, Homo sapiens
tactctgtgtttaaa

SEQ ID NO: 4246806 - DNA, 16 bp, Homo sapiens
tactctgtgtttaaaa

SEQ ID NO: 4246807 - DNA, 15 bp, Homo sapiens
tactgtaatttgtga

SEQ ID NO: 4246808 - DNA, 17 bp, Homo sapiens
tactgtaatttgtgata

SEQ ID NO: 4246809 - DNA, 20 bp, Homo sapiens
tactgtaatttgtgatacaa

SEQ ID NO: 4246810 - DNA, 17 bp, Homo sapiens
tactgtatcagatgtga

SEQ ID NO: 4246811 - DNA, 13 bp, Homo sapiens
tactgtgcagaat

SEQ ID NO: 4246812 - DNA, 23 bp, Homo sapiens
tactgtgcagaataatggaaaca

SEQ ID NO: 4246813 - DNA, 21 bp, Homo sapiens
tactgtttaccatttttcatt

SEQ ID NO: 4246814 - DNA, 17 bp, Homo sapiens
tacttcaaaaataatgt

SEQ ID NO: 4246815 - DNA, 22 bp, Homo sapiens
tacttcctgagtggccagggaa

SEQ ID NO: 4246816 - DNA, 17 bp, Homo sapiens
tacttttcccctgttaa

SEQ ID NO: 4246817 - DNA, 18 bp, Homo sapiens
tacttttcccctgttaaa

SEQ ID NO: 4246818 - DNA, 21 bp, Homo sapiens
tagaaaatttagccctttaaa

SEQ ID NO: 4246819 - DNA, 23 bp, Homo sapiens
tagaaaatttagccctttaaaac

SEQ ID NO: 4246820 - DNA, 16 bp, Homo sapiens
tagaaacttaaacaca

SEQ ID NO: 4246821 - DNA, 15 bp, Homo sapiens
tagaatgtaaagtta

SEQ ID NO: 4246822 - DNA, 16 bp, Homo sapiens
tagaattgcagtcatt

SEQ ID NO: 4246823 - DNA, 17 bp, Homo sapiens
tagacaatcattgtttt

SEQ ID NO: 4246824 - DNA, 14 bp, Homo sapiens
tagactatttcttt

SEQ ID NO: 4246825 - DNA, 16 bp, Homo sapiens
tagaggttcaaagata

SEQ ID NO: 4246826 - DNA, 14 bp, Homo sapiens
tagagttgatacta

SEQ ID NO: 4246827 - DNA, 16 bp, Homo sapiens
tagatactgtatcatg

SEQ ID NO: 4246828 - DNA, 19 bp, Homo sapiens
tagatctttgtaaatgcat

SEQ ID NO: 4246829 - DNA, 23 bp, Homo sapiens
tagcaaatgacagatttctgtaa

SEQ ID NO: 4246830 - DNA, 18 bp, Homo sapiens
tagcagacagaaactgga

SEQ ID NO: 4246831 - DNA, 15 bp, Homo sapiens
tagcataaataaaac

SEQ ID NO: 4246832 - DNA, 19 bp, Homo sapiens
tagcataaataaaactgaa

SEQ ID NO: 4246833 - DNA, 17 bp, Homo sapiens
tagcatacgtacacatt

SEQ ID NO: 4246834 - DNA, 18 bp, Homo sapiens
tagcatacgtacacattt

SEQ ID NO: 4246835 - DNA, 14 bp, Homo sapiens
tagccaacatagta

SEQ ID NO: 4246836 - DNA, 12 bp, Homo sapiens
taggacttcaaa

SEQ ID NO: 4246837 - DNA, 21 bp, Homo sapiens
taggctcttatgtgtgccttt

SEQ ID NO: 4246838 - DNA, 14 bp, Homo sapiens
tagggaaaggtttt

SEQ ID NO: 4246839 - DNA, 21 bp, Homo sapiens
taggtaaaatgtatttttcta

SEQ ID NO: 4246840 - DNA, 22 bp, Homo sapiens
taggtcaataacactgtatttt

SEQ ID NO: 4246841 - DNA, 21 bp, Homo sapiens
taggtgtgactgaatttcttt

SEQ ID NO: 4246842 - DNA, 23 bp, Homo sapiens
taggtgtgactgaatttcttttg

SEQ ID NO: 4246843 - DNA, 15 bp, Homo sapiens
tagtatgaggcattt

SEQ ID NO: 4246844 - DNA, 17 bp, Homo sapiens
tagtatgaggcatttgt

SEQ ID NO: 4246845 - DNA, 14 bp, Homo sapiens
tagtgctacctgca

SEQ ID NO: 4246846 - DNA, 21 bp, Homo sapiens
tagtggatgactgttgatgaa

SEQ ID NO: 4246847 - DNA, 14 bp, Homo sapiens
tagttgtattcttc

SEQ ID NO: 4246848 - DNA, 17 bp, Homo sapiens
tagtttccctggtgccc

SEQ ID NO: 4246849 - DNA, 21 bp, Homo sapiens
tagtttgattaaattcttgca

SEQ ID NO: 4246850 - DNA, 20 bp, Homo sapiens
tagtttggatatttttgtac

SEQ ID NO: 4246851 - DNA, 17 bp, Homo sapiens
tataaaacttaaaaaca

SEQ ID NO: 4246852 - DNA, 13 bp, Homo sapiens
tataaactttacc

SEQ ID NO: 4246853 - DNA, 16 bp, Homo sapiens
tataaactttaccttt

SEQ ID NO: 4246854 - DNA, 17 bp, Homo sapiens
tataaactttacctttt

SEQ ID NO: 4246855 - DNA, 15 bp, Homo sapiens
tataaagtatagaga

SEQ ID NO: 4246856 - DNA, 20 bp, Homo sapiens
tataaatatatataaagaat

SEQ ID NO: 4246857 - DNA, 17 bp, Homo sapiens
tataacaactatttact

SEQ ID NO: 4246858 - DNA, 14 bp, Homo sapiens
tgactgaatttctt

SEQ ID NO: 4246859 - DNA, 14 bp, Homo sapiens
tgactgttgatgaa

SEQ ID NO: 4246860 - DNA, 18 bp, Homo sapiens
tgactgttgatgaagtat

SEQ ID NO: 4246861 - DNA, 19 bp, Homo sapiens
tgacttactgtacatgaaa

SEQ ID NO: 4246862 - DNA, 19 bp, Homo sapiens
tgacttgtacaaacagtat

SEQ ID NO: 4246863 - DNA, 17 bp, Homo sapiens
tgacttttgttaaattc

SEQ ID NO: 4246864 - DNA, 18 bp, Homo sapiens
tgagaatcccttaaaatt

SEQ ID NO: 4246865 - DNA, 13 bp, Homo sapiens
tgagaccagaagg

SEQ ID NO: 4246866 - DNA, 19 bp, Homo sapiens
tgagacctcaaatcactgc

SEQ ID NO: 4246867 - DNA, 19 bp, Homo sapiens
tgagactaaattcaatcac

SEQ ID NO: 4246868 - DNA, 19 bp, Homo sapiens
tgagactcaaaaaaacaaa

SEQ ID NO: 4246869 - DNA, 15 bp, Homo sapiens
tgagatgaaaactag

SEQ ID NO: 4246870 - DNA, 23 bp, Homo sapiens
tgagcccccttcctgtccccagg

SEQ ID NO: 4246871 - DNA, 12 bp, Homo sapiens
tgagcctgtcca

SEQ ID NO: 4246872 - DNA, 18 bp, Homo sapiens
tgagccttgaactttgac

SEQ ID NO: 4246873 - DNA, 20 bp, Homo sapiens
tgagctttctgtgcatgtgc

SEQ ID NO: 4246874 - DNA, 15 bp, Homo sapiens
tgaggaactgtacag

SEQ ID NO: 4246875 - DNA, 17 bp, Homo sapiens
tgaggaactgtacagaa

SEQ ID NO: 4246876 - DNA, 23 bp, Homo sapiens
tgaggagagtctgaatattttca

SEQ ID NO: 4246877 - DNA, 21 bp, Homo sapiens
tgagggtgcttgttccctctc

SEQ ID NO: 4246878 - DNA, 14 bp, Homo sapiens
tgaggtaaagatat

SEQ ID NO: 4246879 - DNA, 13 bp, Homo sapiens
tgagtaaacataa

SEQ ID NO: 4246880 - DNA, 14 bp, Homo sapiens
tgagtaaacataaa

SEQ ID NO: 4246881 - DNA, 16 bp, Homo sapiens
tgagtacgttgtgcat

SEQ ID NO: 4246882 - DNA, 22 bp, Homo sapiens
tgagtctctggggcaggctgct

SEQ ID NO: 4246883 - DNA, 17 bp, Homo sapiens
tgagtggccagggaatc

SEQ ID NO: 4246884 - DNA, 11 bp, Homo sapiens
tgagtgtgtgt

SEQ ID NO: 4246885 - DNA, 11 bp, Homo sapiens
tgataaaataa

SEQ ID NO: 4246886 - DNA, 17 bp, Homo sapiens
tgataataatattgttt

SEQ ID NO: 4246887 - DNA, 16 bp, Homo sapiens
tgatatatattataaa

SEQ ID NO: 4246888 - DNA, 20 bp, Homo sapiens
tgatattatattaaacatac

SEQ ID NO: 4246889 - DNA, 15 bp, Homo sapiens
tgatatttttataca

SEQ ID NO: 4246890 - DNA, 23 bp, Homo sapiens
tgatgagagaatggagacagagt

SEQ ID NO: 4246891 - DNA, 12 bp, Homo sapiens
tgatgatgctgg

SEQ ID NO: 4246892 - DNA, 13 bp, Homo sapiens
tgatgatgttaaa

SEQ ID NO: 4246893 - DNA, 17 bp, Homo sapiens
tgatgattttcatttca

SEQ ID NO: 4246894 - DNA, 13 bp, Homo sapiens
tgatgtgactttt

SEQ ID NO: 4246895 - DNA, 12 bp, Homo sapiens
tgattacctctc

SEQ ID NO: 4246896 - DNA, 23 bp, Homo sapiens
tgattcaagtaagtagatgcctg

SEQ ID NO: 4246897 - DNA, 17 bp, Homo sapiens
tgatttggggatatttt

SEQ ID NO: 4246898 - DNA, 18 bp, Homo sapiens
tgcaaagtacaatgtgtt

SEQ ID NO: 4246899 - DNA, 20 bp, Homo sapiens
tgcaacctcacctcccgggt

SEQ ID NO: 4246900 - DNA, 13 bp, Homo sapiens
tgcaacttcagtt

SEQ ID NO: 4246901 - DNA, 23 bp, Homo sapiens
tgcaagttatattagtgaagatg

SEQ ID NO: 4246902 - DNA, 12 bp, Homo sapiens
tgcaataatttt

SEQ ID NO: 4246903 - DNA, 20 bp, Homo sapiens
tgcaatccatttatttcatt

SEQ ID NO: 4246904 - DNA, 13 bp, Homo sapiens
tgcaatttgaagt

SEQ ID NO: 4246905 - DNA, 12 bp, Homo sapiens
tgcacacatttt

SEQ ID NO: 4246906 - DNA, 16 bp, Homo sapiens
tgcacagatatacttt

SEQ ID NO: 4246907 - DNA, 18 bp, Homo sapiens
tgcacagatatactttgt

SEQ ID NO: 4246908 - DNA, 16 bp, Homo sapiens
tgcacctgagcctgtt

SEQ ID NO: 4246909 - DNA, 16 bp, Homo sapiens
tgcagaaaatatttaa

SEQ ID NO: 4246910 - DNA, 17 bp, Homo sapiens
tgcagaataatggaaac

SEQ ID NO: 4246911 - DNA, 19 bp, Homo sapiens
tgcagcccctctcacaggc

SEQ ID NO: 4246912 - DNA, 20 bp, Homo sapiens
tgcaggcacttattgtaaat

SEQ ID NO: 4246913 - DNA, 17 bp, Homo sapiens
tgcagggccgggcaggg

SEQ ID NO: 4246914 - DNA, 23 bp, Homo sapiens
tgcagtcatttggtgctctgcta

SEQ ID NO: 4246915 - DNA, 20 bp, Homo sapiens
tgcataatgataaaataaat

SEQ ID NO: 4246916 - DNA, 14 bp, Homo sapiens
tgcataatttatgg

SEQ ID NO: 4246917 - DNA, 15 bp, Homo sapiens
tgcataatttatggt

SEQ ID NO: 4246918 - DNA, 22 bp, Homo sapiens
tgcataccacttttgttcttgg

SEQ ID NO: 4246919 - DNA, 17 bp, Homo sapiens
tgcatattaaataataa

SEQ ID NO: 4246920 - DNA, 22 bp, Homo sapiens
tgcatgaagtaatatgcacaca

SEQ ID NO: 4246921 - DNA, 16 bp, Homo sapiens
tgcatgtgccgaggtg

SEQ ID NO: 4246922 - DNA, 12 bp, Homo sapiens
tgcattatctag

SEQ ID NO: 4246923 - DNA, 16 bp, Homo sapiens
tgcattcattctgagc

SEQ ID NO: 4246924 - DNA, 20 bp, Homo sapiens
tgcatttaaaagatacagtt

SEQ ID NO: 4246925 - DNA, 17 bp, Homo sapiens
tgcattttcaccccacc

SEQ ID NO: 4246926 - DNA, 18 bp, Homo sapiens
tgccaccatggccagcca

SEQ ID NO: 4246927 - DNA, 23 bp, Homo sapiens
tgcccagctaatttttgtatttt

SEQ ID NO: 4246928 - DNA, 20 bp, Homo sapiens
tgcccaggttggagtgcagt

SEQ ID NO: 4246929 - DNA, 12 bp, Homo sapiens
tgccccagccag

SEQ ID NO: 4246930 - DNA, 13 bp, Homo sapiens
tgccccagccaga

SEQ ID NO: 4246931 - DNA, 20 bp, Homo sapiens
tgcccgcgccaggccctcag

SEQ ID NO: 4246932 - DNA, 20 bp, Homo sapiens
tgccctaaagtgtatttttt

SEQ ID NO: 4246933 - DNA, 21 bp, Homo sapiens
tgccctcaggctccccagtgc

SEQ ID NO: 4246934 - DNA, 22 bp, Homo sapiens
tgccctcaggctccccagtgct

SEQ ID NO: 4246935 - DNA, 22 bp, Homo sapiens
tgcccttacacgtgcgtgtgag

SEQ ID NO: 4246936 - DNA, 15 bp, Homo sapiens
tgcccttccctggag

SEQ ID NO: 4246937 - DNA, 20 bp, Homo sapiens
tgccgaccacgccccaggac

SEQ ID NO: 4246938 - DNA, 19 bp, Homo sapiens
tgccgctttgtctgtccag

SEQ ID NO: 4246939 - DNA, 19 bp, Homo sapiens
tgccgggagactgccagtg

SEQ ID NO: 4246940 - DNA, 21 bp, Homo sapiens
tgccgggagactgccagtgga

SEQ ID NO: 4246941 - DNA, 17 bp, Homo sapiens
tgccgtgcgggcgaggc

SEQ ID NO: 4246942 - DNA, 16 bp, Homo sapiens
tgcctgctgggtgcca

SEQ ID NO: 4246943 - DNA, 21 bp, Homo sapiens
tgcctgctgggtgccaggtgc

SEQ ID NO: 4246944 - DNA, 19 bp, Homo sapiens
tgcctggtcccagagtggc

SEQ ID NO: 4246945 - DNA, 18 bp, Homo sapiens
tgcctgttttgagaccag

SEQ ID NO: 4246946 - DNA, 22 bp, Homo sapiens
tgcctgttttgagaccagaagg

SEQ ID NO: 4246947 - DNA, 16 bp, Homo sapiens
tgccttgctcctagca

SEQ ID NO: 4246948 - DNA, 19 bp, Homo sapiens
tgcgcacttacctgcttga

SEQ ID NO: 4246949 - DNA, 20 bp, Homo sapiens
tgcgtcccccgttgtgcctg

SEQ ID NO: 4246950 - DNA, 21 bp, Homo sapiens
tgcgtcccccgttgtgcctgg

SEQ ID NO: 4246951 - DNA, 17 bp, Homo sapiens
tgctaagctgccctgag

SEQ ID NO: 4246952 - DNA, 13 bp, Homo sapiens
tgctactgtacat

SEQ ID NO: 4246953 - DNA, 16 bp, Homo sapiens
tgctagaaaatttagc

SEQ ID NO: 4246954 - DNA, 20 bp, Homo sapiens
tgctcagggtcaatttcttt

SEQ ID NO: 4246955 - DNA, 16 bp, Homo sapiens
tgctccagggagattt

SEQ ID NO: 4246956 - DNA, 22 bp, Homo sapiens
tgctccctctctccacacggag

SEQ ID NO: 4246957 - DNA, 13 bp, Homo sapiens
tgctcctagcaga

SEQ ID NO: 4246958 - DNA, 17 bp, Homo sapiens
tgctcctagcagacaga

SEQ ID NO: 4246959 - DNA, 22 bp, Homo sapiens
tgctctagggccctttcttgca

SEQ ID NO: 4246960 - DNA, 14 bp, Homo sapiens
tgctgcatttaaaa

SEQ ID NO: 4246961 - DNA, 23 bp, Homo sapiens
tgctgcatttaaaagatacagtt

SEQ ID NO: 4246962 - DNA, 22 bp, Homo sapiens
tgctgccaccacttttggattt

SEQ ID NO: 4246963 - DNA, 20 bp, Homo sapiens
tgctgggattacaggtgtga

SEQ ID NO: 4246964 - DNA, 21 bp, Homo sapiens
tgctgggtggcaggggggctg

SEQ ID NO: 4246965 - DNA, 17 bp, Homo sapiens
tgctggtaacagtggct

SEQ ID NO: 4246966 - DNA, 13 bp, Homo sapiens
tgcttaaactaaa

SEQ ID NO: 4246967 - DNA, 18 bp, Homo sapiens
tgcttaaactaaataatg

SEQ ID NO: 4246968 - DNA, 13 bp, Homo sapiens
tgcttaacttcac

SEQ ID NO: 4246969 - DNA, 13 bp, Homo sapiens
tgcttagtaaaat

SEQ ID NO: 4246970 - DNA, 20 bp, Homo sapiens
tgcttagtccaattccttgc

SEQ ID NO: 4246971 - DNA, 14 bp, Homo sapiens
tgcttattgcttag

SEQ ID NO: 4246972 - DNA, 19 bp, Homo sapiens
tgcttctcatcttgtgaaa

SEQ ID NO: 4246973 - DNA, 18 bp, Homo sapiens
aaaagcagcgtcactcta

SEQ ID NO: 4246974 - DNA, 13 bp, Homo sapiens
aaaaggatgcaca

SEQ ID NO: 4246975 - DNA, 15 bp, Homo sapiens
aaaagtcgttttcca

SEQ ID NO: 4246976 - DNA, 22 bp, Homo sapiens
aaaagtcgttttccaaactgac

SEQ ID NO: 4246977 - DNA, 22 bp, Homo sapiens
aaaataaacagacaaaaacaag

SEQ ID NO: 4246978 - DNA, 17 bp, Homo sapiens
aaaataaataattttaa

SEQ ID NO: 4246979 - DNA, 15 bp, Homo sapiens
aaaataccagccagt

SEQ ID NO: 4246980 - DNA, 18 bp, Homo sapiens
aaaatctcaaatttctaa

SEQ ID NO: 4246981 - DNA, 19 bp, Homo sapiens
aaaatctcaaatttctaaa

SEQ ID NO: 4246982 - DNA, 22 bp, Homo sapiens
aaaatgaattgaaaaacaattt

SEQ ID NO: 4246983 - DNA, 12 bp, Homo sapiens
aaaatgtatttt

SEQ ID NO: 4246984 - DNA, 20 bp, Homo sapiens
aaaattcgcccgagctgttt

SEQ ID NO: 4246985 - DNA, 16 bp, Homo sapiens
aaaatttaaaattacg

SEQ ID NO: 4246986 - DNA, 14 bp, Homo sapiens
aaaatttatttcat

SEQ ID NO: 4246987 - DNA, 20 bp, Homo sapiens
aaaattttgatgttttaagg

SEQ ID NO: 4246988 - DNA, 20 bp, Homo sapiens
aaacaagaccacgtttctaa

SEQ ID NO: 4246989 - DNA, 16 bp, Homo sapiens
aaacaagtaaatatat

SEQ ID NO: 4246990 - DNA, 17 bp, Homo sapiens
aaacaattttctgtaat

SEQ ID NO: 4246991 - DNA, 14 bp, Homo sapiens
aaacactaaaagca

SEQ ID NO: 4246992 - DNA, 21 bp, Homo sapiens
aaacactacacatttgaaaca

SEQ ID NO: 4246993 - DNA, 23 bp, Homo sapiens
aaacagtagttgtattcttctgt

SEQ ID NO: 4246994 - DNA, 13 bp, Homo sapiens
aaacagtatttct

SEQ ID NO: 4246995 - DNA, 14 bp, Homo sapiens
aaacataaaaactg

SEQ ID NO: 4246996 - DNA, 16 bp, Homo sapiens
aaacatacataataca

SEQ ID NO: 4246997 - DNA, 16 bp, Homo sapiens
aaacatgctacacact

SEQ ID NO: 4246998 - DNA, 18 bp, Homo sapiens
aaacattacagttcataa

SEQ ID NO: 4246999 - DNA, 15 bp, Homo sapiens
aaacgaaggcataat

SEQ ID NO: 4247000 - DNA, 14 bp, Homo sapiens
aaactaaataatga

SEQ ID NO: 4247001 - DNA, 20 bp, Homo sapiens
aaactaaataatgaataaac

SEQ ID NO: 4247002 - DNA, 17 bp, Homo sapiens
aaactgaatattttgga

SEQ ID NO: 4247003 - DNA, 23 bp, Homo sapiens
aaactgctaaattctatgttaaa

SEQ ID NO: 4247004 - DNA, 15 bp, Homo sapiens
aaacttaaaaacaag

SEQ ID NO: 4247005 - DNA, 18 bp, Homo sapiens
aaacttaatctaaatgga

SEQ ID NO: 4247006 - DNA, 12 bp, Homo sapiens
aaactttactat

SEQ ID NO: 4247007 - DNA, 18 bp, Homo sapiens
aaactttactatggccct

SEQ ID NO: 4247008 - DNA, 16 bp, Homo sapiens
aaacttttttatatct

SEQ ID NO: 4247009 - DNA, 23 bp, Homo sapiens
aaagactgagtacgttgtgcatt

SEQ ID NO: 4247010 - DNA, 16 bp, Homo sapiens
aaagacttgagacaat

SEQ ID NO: 4247011 - DNA, 17 bp, Homo sapiens
aaagacttgagacaatg

SEQ ID NO: 4247012 - DNA, 23 bp, Homo sapiens
aaagagtaatttcatttaaatat

SEQ ID NO: 4247013 - DNA, 15 bp, Homo sapiens
aaagatacagttact

SEQ ID NO: 4247014 - DNA, 15 bp, Homo sapiens
aaagatatggagaat

SEQ ID NO: 4247015 - DNA, 19 bp, Homo sapiens
aaagatatggagaattgct

SEQ ID NO: 4247016 - DNA, 16 bp, Homo sapiens
aaagatattttgcttt

SEQ ID NO: 4247017 - DNA, 20 bp, Homo sapiens
aaagatattttgctttgtga

SEQ ID NO: 4247018 - DNA, 17 bp, Homo sapiens
aaagatttattgtaagc

SEQ ID NO: 4247019 - DNA, 22 bp, Homo sapiens
aaagcactagagaatgcacaga

SEQ ID NO: 4247020 - DNA, 16 bp, Homo sapiens
aaagcagcgtttctat

SEQ ID NO: 4247021 - DNA, 18 bp, Homo sapiens
aaaggatagtatttttat

SEQ ID NO: 4247022 - DNA, 14 bp, Homo sapiens
aaaggctacctttg

SEQ ID NO: 4247023 - DNA, 17 bp, Homo sapiens
aaaggctacctttgtat

SEQ ID NO: 4247024 - DNA, 15 bp, Homo sapiens
aaagggttgaaaatg

SEQ ID NO: 4247025 - DNA, 18 bp, Homo sapiens
aaaggtggcaatgcttaa

SEQ ID NO: 4247026 - DNA, 17 bp, Homo sapiens
aaagtacaatgtgtttt

SEQ ID NO: 4247027 - DNA, 17 bp, Homo sapiens
aaagtatagagagaagt

SEQ ID NO: 4247028 - DNA, 18 bp, Homo sapiens
aaagtatccctactgtaa

SEQ ID NO: 4247029 - DNA, 17 bp, Homo sapiens
aaagtcctggccctggc

SEQ ID NO: 4247030 - DNA, 16 bp, Homo sapiens
aaagtcgttttccaaa

SEQ ID NO: 4247031 - DNA, 14 bp, Homo sapiens
aaagtgtatttttt

SEQ ID NO: 4247032 - DNA, 14 bp, Homo sapiens
aaagttatgtattt

SEQ ID NO: 4247033 - DNA, 19 bp, Homo sapiens
aaagttgcagatgtattga

SEQ ID NO: 4247034 - DNA, 23 bp, Homo sapiens
aaagttgcagatgtattgactgt

SEQ ID NO: 4247035 - DNA, 17 bp, Homo sapiens
aaagtttttaatttgat

SEQ ID NO: 4247036 - DNA, 13 bp, Homo sapiens
aaataaaactttt

SEQ ID NO: 4247037 - DNA, 16 bp, Homo sapiens
aaataaaactttttaa

SEQ ID NO: 4247038 - DNA, 19 bp, Homo sapiens
aaataaaactttttaaaat

SEQ ID NO: 4247039 - DNA, 19 bp, Homo sapiens
aaataatgaataaactgaa

SEQ ID NO: 4247040 - DNA, 14 bp, Homo sapiens
aaataatgtgaaac

SEQ ID NO: 4247041 - DNA, 22 bp, Homo sapiens
aaataatgtgaaactggattaa

SEQ ID NO: 4247042 - DNA, 21 bp, Homo sapiens
aaataccagccagtaaatggg

SEQ ID NO: 4247043 - DNA, 18 bp, Homo sapiens
aaatagaaaagtagacaa

SEQ ID NO: 4247044 - DNA, 15 bp, Homo sapiens
aaatataggaactta

SEQ ID NO: 4247045 - DNA, 21 bp, Homo sapiens
aaatatatataaagaatatat

SEQ ID NO: 4247046 - DNA, 14 bp, Homo sapiens
aaatatctgttatt

SEQ ID NO: 4247047 - DNA, 13 bp, Homo sapiens
aaatatttaatat

SEQ ID NO: 4247048 - DNA, 16 bp, Homo sapiens
aaatatttaatatcaa

SEQ ID NO: 4247049 - DNA, 20 bp, Homo sapiens
aaatatttaatatcaaaaga

SEQ ID NO: 4247050 - DNA, 14 bp, Homo sapiens
aacacattttaaat

SEQ ID NO: 4247051 - DNA, 22 bp, Homo sapiens
aacactgtattttaatgtactt

SEQ ID NO: 4247052 - DNA, 10 bp, Homo sapiens
aacagaaatg

SEQ ID NO: 4247053 - DNA, 12 bp, Homo sapiens
aacagaaatgta

SEQ ID NO: 4247054 - DNA, 14 bp, Homo sapiens
aacagcctgagccg

SEQ ID NO: 4247055 - DNA, 21 bp, Homo sapiens
aacagcctttttgtaatttat

SEQ ID NO: 4247056 - DNA, 16 bp, Homo sapiens
aacagctcgatccaaa

SEQ ID NO: 4247057 - DNA, 19 bp, Homo sapiens
aacagctcgatccaaattg

SEQ ID NO: 4247058 - DNA, 16 bp, Homo sapiens
aacagttatttctgtt

SEQ ID NO: 4247059 - DNA, 15 bp, Homo sapiens
aacataaaaactgat

SEQ ID NO: 4247060 - DNA, 16 bp, Homo sapiens
aacatgtatttatgta

SEQ ID NO: 4247061 - DNA, 15 bp, Homo sapiens
aacattaaatcacag

SEQ ID NO: 4247062 - DNA, 17 bp, Homo sapiens
aacattacagttcataa

SEQ ID NO: 4247063 - DNA, 22 bp, Homo sapiens
aaccagaagtgcagcccctctc

SEQ ID NO: 4247064 - DNA, 18 bp, Homo sapiens
aaccagggaagctgtccc

SEQ ID NO: 4247065 - DNA, 19 bp, Homo sapiens
aacccagcagttctctgcc

SEQ ID NO: 4247066 - DNA, 20 bp, Homo sapiens
aacccagcagttctctgcca

SEQ ID NO: 4247067 - DNA, 18 bp, Homo sapiens
aacccggtgcatctggca

SEQ ID NO: 4247068 - DNA, 19 bp, Homo sapiens
aacccggtgcatctggcac

SEQ ID NO: 4247069 - DNA, 16 bp, Homo sapiens
aactaaataatgaata

SEQ ID NO: 4247070 - DNA, 23 bp, Homo sapiens
aactaaataatgaataaactgaa

SEQ ID NO: 4247071 - DNA, 23 bp, Homo sapiens
aactagtactcaaggtttaacct

SEQ ID NO: 4247072 - DNA, 21 bp, Homo sapiens
aactcaactgggctctgtccc

SEQ ID NO: 4247073 - DNA, 17 bp, Homo sapiens
aactcagtgccacacct

SEQ ID NO: 4247074 - DNA, 18 bp, Homo sapiens
aactcttccacctctggg

SEQ ID NO: 4247075 - DNA, 20 bp, Homo sapiens
aactgaatattttggaaact

SEQ ID NO: 4247076 - DNA, 23 bp, Homo sapiens
aactgaatattttggaaactgct

SEQ ID NO: 4247077 - DNA, 21 bp, Homo sapiens
aactgctaaattctatgttaa

SEQ ID NO: 4247078 - DNA, 23 bp, Homo sapiens
aactgctaaattctatgttaaat

SEQ ID NO: 4247079 - DNA, 21 bp, Homo sapiens
aactgcttactcccaaaacag

SEQ ID NO: 4247080 - DNA, 14 bp, Homo sapiens
aactggaattaaaa

SEQ ID NO: 4247081 - DNA, 15 bp, Homo sapiens
aactggattaaactt

SEQ ID NO: 4247082 - DNA, 22 bp, Homo sapiens
aactgggggagggtgaagtgaa

SEQ ID NO: 4247083 - DNA, 13 bp, Homo sapiens
aacttcacatatt

SEQ ID NO: 4247084 - DNA, 22 bp, Homo sapiens
aacttcacatattgatttccgt

SEQ ID NO: 4247085 - DNA, 22 bp, Homo sapiens
aacttcaccatattaccacaga

SEQ ID NO: 4247086 - DNA, 22 bp, Homo sapiens
aacttcagttttatttttgcca

SEQ ID NO: 4247087 - DNA, 22 bp, Homo sapiens
aactttaccttttttatacata

SEQ ID NO: 4247088 - DNA, 23 bp, Homo sapiens
aactttaccttttttatacataa

SEQ ID NO: 4247089 - DNA, 19 bp, Homo sapiens
aactttgacctctgcagca

SEQ ID NO: 4247090 - DNA, 19 bp, Homo sapiens
aacttttataaactttacc

SEQ ID NO: 4247091 - DNA, 21 bp, Homo sapiens
aagaaaatagtggtgtgattt

SEQ ID NO: 4247092 - DNA, 13 bp, Homo sapiens
aagaacacatttt

SEQ ID NO: 4247093 - DNA, 18 bp, Homo sapiens
aagaatatttttagacta

SEQ ID NO: 4247094 - DNA, 21 bp, Homo sapiens
aagaatatttttagactattt

SEQ ID NO: 4247095 - DNA, 21 bp, Homo sapiens
aagactgagtacgttgtgcat

SEQ ID NO: 4247096 - DNA, 15 bp, Homo sapiens
aagagacaaagattt

SEQ ID NO: 4247097 - DNA, 16 bp, Homo sapiens
aagagggacagagccc

SEQ ID NO: 4247098 - DNA, 14 bp, Homo sapiens
aagagtaatttcat

SEQ ID NO: 4247099 - DNA, 17 bp, Homo sapiens
aagatacagttactcag

SEQ ID NO: 4247100 - DNA, 22 bp, Homo sapiens
aagatatatttcacttttgttc

SEQ ID NO: 4247101 - DNA, 13 bp, Homo sapiens
aagatatggagaa

SEQ ID NO: 4247102 - DNA, 15 bp, Homo sapiens
aagatatggagaatt

SEQ ID NO: 4247103 - DNA, 15 bp, Homo sapiens
aagatattttgcttt

SEQ ID NO: 4247104 - DNA, 17 bp, Homo sapiens
aagatattttgctttgt

SEQ ID NO: 4247105 - DNA, 20 bp, Homo sapiens
aagatattttgctttgtgat

SEQ ID NO: 4247106 - DNA, 15 bp, Homo sapiens
aagatggaaatacag

SEQ ID NO: 4247107 - DNA, 19 bp, Homo sapiens
aagattaggagaaacacat

SEQ ID NO: 4247108 - DNA, 12 bp, Homo sapiens
aagatttattgt

SEQ ID NO: 4247109 - DNA, 20 bp, Homo sapiens
aagcagcgtttctatgacac

SEQ ID NO: 4247110 - DNA, 14 bp, Homo sapiens
aagcctaaatttgt

SEQ ID NO: 4247111 - DNA, 15 bp, Homo sapiens
aagcctaaatttgtg

SEQ ID NO: 4247112 - DNA, 23 bp, Homo sapiens
aagcgtgcacaaggattgaaaat

SEQ ID NO: 4247113 - DNA, 20 bp, Homo sapiens
aagctagtgtttctagctaa

SEQ ID NO: 4247114 - DNA, 21 bp, Homo sapiens
aagctcccacacccacctctg

SEQ ID NO: 4247115 - DNA, 13 bp, Homo sapiens
aagctgccctgag

SEQ ID NO: 4247116 - DNA, 21 bp, Homo sapiens
aagcttgtggaggagggagag

SEQ ID NO: 4247117 - DNA, 17 bp, Homo sapiens
aagcttttaaaatgtag

SEQ ID NO: 4247118 - DNA, 14 bp, Homo sapiens
aaggagatttacaa

SEQ ID NO: 4247119 - DNA, 13 bp, Homo sapiens
aaggatacaaaag

SEQ ID NO: 4247120 - DNA, 21 bp, Homo sapiens
aaggatacaaaagcatgtgag

SEQ ID NO: 4247121 - DNA, 14 bp, Homo sapiens
aaggattgaaaatt

SEQ ID NO: 4247122 - DNA, 15 bp, Homo sapiens
aaggctacctttgta

SEQ ID NO: 4247123 - DNA, 19 bp, Homo sapiens
aaggctacctttgtattct

SEQ ID NO: 4247124 - DNA, 18 bp, Homo sapiens
aaggtggcaatgcttaaa

SEQ ID NO: 4247125 - DNA, 20 bp, Homo sapiens
aaggtttaaccttaaaatta

SEQ ID NO: 4247126 - DNA, 23 bp, Homo sapiens
aaggttttgtattttttaaaaca

SEQ ID NO: 4247127 - DNA, 21 bp, Homo sapiens
aagtaaagccattaaatgaat

SEQ ID NO: 4247128 - DNA, 12 bp, Homo sapiens
aagtaaatatat

SEQ ID NO: 4247129 - DNA, 15 bp, Homo sapiens
aagtaacttatttga

SEQ ID NO: 4247130 - DNA, 17 bp, Homo sapiens
aagtaatatgcacacat

SEQ ID NO: 4247131 - DNA, 16 bp, Homo sapiens
aagtaattatgcacta

SEQ ID NO: 4247132 - DNA, 19 bp, Homo sapiens
aagtacaatgtgtttttct

SEQ ID NO: 4247133 - DNA, 13 bp, Homo sapiens
aagtacactgttt

SEQ ID NO: 4247134 - DNA, 12 bp, Homo sapiens
aagtatagagag

SEQ ID NO: 4247135 - DNA, 13 bp, Homo sapiens
aagtatagagaga

SEQ ID NO: 4247136 - DNA, 19 bp, Homo sapiens
aagtattatacctttttta

SEQ ID NO: 4247137 - DNA, 15 bp, Homo sapiens
aagtcaaaatatgta

SEQ ID NO: 4247138 - DNA, 17 bp, Homo sapiens
aagtcaaaatatgtaag

SEQ ID NO: 4247139 - DNA, 20 bp, Homo sapiens
aagtcagatttttatttatg

SEQ ID NO: 4247140 - DNA, 15 bp, Homo sapiens
aagtcgttttccaaa

SEQ ID NO: 4247141 - DNA, 16 bp, Homo sapiens
aagtctctgctggccc

SEQ ID NO: 4247142 - DNA, 14 bp, Homo sapiens
aagtgcctgctggg

SEQ ID NO: 4247143 - DNA, 14 bp, Homo sapiens
aagtgctgcattta

SEQ ID NO: 4247144 - DNA, 13 bp, Homo sapiens
aagtgggctcctg

SEQ ID NO: 4247145 - DNA, 14 bp, Homo sapiens
aagtgggctcctga

SEQ ID NO: 4247146 - DNA, 17 bp, Homo sapiens
aagtgtaaacaccatag

SEQ ID NO: 4247147 - DNA, 13 bp, Homo sapiens
aagttaattcacc

SEQ ID NO: 4247148 - DNA, 20 bp, Homo sapiens
aagttaattcacctatgtta

SEQ ID NO: 4247149 - DNA, 18 bp, Homo sapiens
aagttatattagtgaaga

SEQ ID NO: 4247150 - DNA, 16 bp, Homo sapiens
aagttctcaaagttaa

SEQ ID NO: 4247151 - DNA, 20 bp, Homo sapiens
aagttctcaaagttaattca

SEQ ID NO: 4247152 - DNA, 21 bp, Homo sapiens
aagttttaactttaatacagc

SEQ ID NO: 4247153 - DNA, 12 bp, Homo sapiens
aataaaactttt

SEQ ID NO: 4247154 - DNA, 21 bp, Homo sapiens
aataaactgaatattttggaa

SEQ ID NO: 4247155 - DNA, 14 bp, Homo sapiens
aataaataaagctt

SEQ ID NO: 4247156 - DNA, 12 bp, Homo sapiens
aataaataattt

SEQ ID NO: 4247157 - DNA, 13 bp, Homo sapiens
aataagacaaaaa

SEQ ID NO: 4247158 - DNA, 22 bp, Homo sapiens
aataatattgtttttctttcta

SEQ ID NO: 4247159 - DNA, 14 bp, Homo sapiens
aataatatttatgt

SEQ ID NO: 4247160 - DNA, 14 bp, Homo sapiens
aataatccagtatt

SEQ ID NO: 4247161 - DNA, 23 bp, Homo sapiens
aataattttaatattcttttgtt

SEQ ID NO: 4247162 - DNA, 17 bp, Homo sapiens
aatacaacaacaacaaa

SEQ ID NO: 4247163 - DNA, 19 bp, Homo sapiens
aatacaacaacaacaaaaa

SEQ ID NO: 4247164 - DNA, 15 bp, Homo sapiens
aatacaccactacat

SEQ ID NO: 4247165 - DNA, 18 bp, Homo sapiens
aatacaccactacattct

SEQ ID NO: 4247166 - DNA, 20 bp, Homo sapiens
aatacaccactacattctgt

SEQ ID NO: 4247167 - DNA, 20 bp, Homo sapiens
aatacagctgaagtcaaaat

SEQ ID NO: 4247168 - DNA, 17 bp, Homo sapiens
aataccagccagtaaat

SEQ ID NO: 4247169 - DNA, 17 bp, Homo sapiens
aatactgtgcagaataa

SEQ ID NO: 4247170 - DNA, 19 bp, Homo sapiens
aatactgtgcagaataatg

SEQ ID NO: 4247171 - DNA, 21 bp, Homo sapiens
aatactgtgcagaataatgga

SEQ ID NO: 4247172 - DNA, 12 bp, Homo sapiens
aatagaaaagta

SEQ ID NO: 4247173 - DNA, 18 bp, Homo sapiens
aatagacaatttattatg

SEQ ID NO: 4247174 - DNA, 14 bp, Homo sapiens
aataggagtatttt

SEQ ID NO: 4247175 - DNA, 17 bp, Homo sapiens
aataggtagtttggata

SEQ ID NO: 4247176 - DNA, 16 bp, Homo sapiens
aatagtggtgtgattt

SEQ ID NO: 4247177 - DNA, 19 bp, Homo sapiens
aatagttagatctttgtaa

SEQ ID NO: 4247178 - DNA, 16 bp, Homo sapiens
aatataagacatttgt

SEQ ID NO: 4247179 - DNA, 20 bp, Homo sapiens
aatataggaacttaaataat

SEQ ID NO: 4247180 - DNA, 13 bp, Homo sapiens
aatatatataaag

SEQ ID NO: 4247181 - DNA, 19 bp, Homo sapiens
aatatatataaagaatata

SEQ ID NO: 4247182 - DNA, 22 bp, Homo sapiens
aatatatataaagaatatatat

SEQ ID NO: 4247183 - DNA, 15 bp, Homo sapiens
aatatatatggtcat

SEQ ID NO: 4247184 - DNA, 13 bp, Homo sapiens
aatatatgattct

SEQ ID NO: 4247185 - DNA, 18 bp, Homo sapiens
aatatatgattctagtgt

SEQ ID NO: 4247186 - DNA, 17 bp, Homo sapiens
aatatcaaaagaaaatt

SEQ ID NO: 4247187 - DNA, 23 bp, Homo sapiens
aatatcaaaagaaaattgatatt

SEQ ID NO: 4247188 - DNA, 23 bp, Homo sapiens
aatatcagctttgataattgtgt

SEQ ID NO: 4247189 - DNA, 16 bp, Homo sapiens
aatatccattctgtag

SEQ ID NO: 4247190 - DNA, 22 bp, Homo sapiens
aatatctgttattcaaatttga

SEQ ID NO: 4247191 - DNA, 20 bp, Homo sapiens
aatatgaaccctttgtttct

SEQ ID NO: 4247192 - DNA, 21 bp, Homo sapiens
aatatgaaccctttgtttctt

SEQ ID NO: 4247193 - DNA, 15 bp, Homo sapiens
aatatgcacacattt

SEQ ID NO: 4247194 - DNA, 20 bp, Homo sapiens
aatattactcctatttttgt

SEQ ID NO: 4247195 - DNA, 17 bp, Homo sapiens
aatattcttttgtttcc

SEQ ID NO: 4247196 - DNA, 18 bp, Homo sapiens
aatattcttttgtttcca

SEQ ID NO: 4247197 - DNA, 21 bp, Homo sapiens
aatattcttttgtttccatgg

SEQ ID NO: 4247198 - DNA, 18 bp, Homo sapiens
aatattgtttttctttct

SEQ ID NO: 4247199 - DNA, 14 bp, Homo sapiens
aatattttgataat

SEQ ID NO: 4247200 - DNA, 12 bp, Homo sapiens
aatattttggaa

SEQ ID NO: 4247201 - DNA, 18 bp, Homo sapiens
aatatttttagactattt

SEQ ID NO: 4247202 - DNA, 20 bp, Homo sapiens
aatatttttagactatttct

SEQ ID NO: 4247203 - DNA, 13 bp, Homo sapiens
aatattttttgca

SEQ ID NO: 4247204 - DNA, 15 bp, Homo sapiens
aatattttttgcaag

SEQ ID NO: 4247205 - DNA, 16 bp, Homo sapiens
aatattttttgcaagt

SEQ ID NO: 4247206 - DNA, 20 bp, Homo sapiens
aatattttttgctctaatct

SEQ ID NO: 4247207 - DNA, 13 bp, Homo sapiens
aatcaacttttat

SEQ ID NO: 4247208 - DNA, 17 bp, Homo sapiens
aatcacacgactgtcat

SEQ ID NO: 4247209 - DNA, 12 bp, Homo sapiens
aatcatgtatgt

SEQ ID NO: 4247210 - DNA, 15 bp, Homo sapiens
aatcattaggtgtga

SEQ ID NO: 4247211 - DNA, 16 bp, Homo sapiens
aatcattgttttgaat

SEQ ID NO: 4247212 - DNA, 13 bp, Homo sapiens
aatcccttaaaat

SEQ ID NO: 4247213 - DNA, 12 bp, Homo sapiens
aatctaaatgga

SEQ ID NO: 4247214 - DNA, 12 bp, Homo sapiens
aatctgaagata

SEQ ID NO: 4247215 - DNA, 23 bp, Homo sapiens
aatgaaaaatctcaattgaaagc

SEQ ID NO: 4247216 - DNA, 21 bp, Homo sapiens
aatgaaaagtcgttttccaaa

SEQ ID NO: 4247217 - DNA, 14 bp, Homo sapiens
aatgaataaactga

SEQ ID NO: 4247218 - DNA, 18 bp, Homo sapiens
aatgaatattttgataat

SEQ ID NO: 4247219 - DNA, 14 bp, Homo sapiens
aatgacagatttct

SEQ ID NO: 4247220 - DNA, 18 bp, Homo sapiens
aatgacagatttctgtaa

SEQ ID NO: 4247221 - DNA, 18 bp, Homo sapiens
aatgacttactgtacatg

SEQ ID NO: 4247222 - DNA, 14 bp, Homo sapiens
aatgataaaataaa

SEQ ID NO: 4247223 - DNA, 21 bp, Homo sapiens
aatgataaaataaataatttt

SEQ ID NO: 4247224 - DNA, 18 bp, Homo sapiens
aatgatgccctgctccag

SEQ ID NO: 4247225 - DNA, 16 bp, Homo sapiens
aatgcacagatatact

SEQ ID NO: 4247226 - DNA, 20 bp, Homo sapiens
aatgcataaatgcataattt

SEQ ID NO: 4247227 - DNA, 17 bp, Homo sapiens
aatgcataatttatggt

SEQ ID NO: 4247228 - DNA, 18 bp, Homo sapiens
aatgcgtgcataccactt

SEQ ID NO: 4247229 - DNA, 20 bp, Homo sapiens
aatgctgtgccctaaagtgt

SEQ ID NO: 4247230 - DNA, 21 bp, Homo sapiens
aatgctgtgccctaaagtgta

SEQ ID NO: 4247231 - DNA, 20 bp, Homo sapiens
aatgcttaaactaaataatg

SEQ ID NO: 4247232 - DNA, 21 bp, Homo sapiens
aatgcttcattgaaagcttca

SEQ ID NO: 4247233 - DNA, 13 bp, Homo sapiens
aatggcagctagt

SEQ ID NO: 4247234 - DNA, 16 bp, Homo sapiens
aatggcagctagtgcc

SEQ ID NO: 4247235 - DNA, 18 bp, Homo sapiens
aatggcagctagtgcctt

SEQ ID NO: 4247236 - DNA, 15 bp, Homo sapiens
aatgggaaaaaactt

SEQ ID NO: 4247237 - DNA, 20 bp, Homo sapiens
aatgggtgtatataatttta

SEQ ID NO: 4247238 - DNA, 20 bp, Homo sapiens
aatgtaaagttatgtattta

SEQ ID NO: 4247239 - DNA, 17 bp, Homo sapiens
aatgtaatataatgtat

SEQ ID NO: 4247240 - DNA, 20 bp, Homo sapiens
aatgtaatataatgtatttt

SEQ ID NO: 4247241 - DNA, 14 bp, Homo sapiens
aatgtatttttcta

SEQ ID NO: 4247242 - DNA, 18 bp, Homo sapiens
aatgtctcactgttctgc

SEQ ID NO: 4247243 - DNA, 14 bp, Homo sapiens
aatgtgaaactgga

SEQ ID NO: 4247244 - DNA, 15 bp, Homo sapiens
aatgtgaaactggat

SEQ ID NO: 4247245 - DNA, 21 bp, Homo sapiens
aatgtgcataatgataaaata

SEQ ID NO: 4247246 - DNA, 13 bp, Homo sapiens
aatgtgtttgctg

SEQ ID NO: 4247247 - DNA, 11 bp, Homo sapiens
aatgtttaaat

SEQ ID NO: 4247248 - DNA, 16 bp, Homo sapiens
aatgtttaaatcatgt

SEQ ID NO: 4247249 - DNA, 20 bp, Homo sapiens
aatgtttaaatcatgtatgt

SEQ ID NO: 4247250 - DNA, 23 bp, Homo sapiens
aatgttttcttcaacatgctcca

SEQ ID NO: 4247251 - DNA, 22 bp, Homo sapiens
aatgtttttaaaaagagtaatt

SEQ ID NO: 4247252 - DNA, 12 bp, Homo sapiens
aattaactttta

SEQ ID NO: 4247253 - DNA, 18 bp, Homo sapiens
aattaacttttataaact

SEQ ID NO: 4247254 - DNA, 23 bp, Homo sapiens
aattagataaattgtagggcttt

SEQ ID NO: 4247255 - DNA, 18 bp, Homo sapiens
aattattattttaaaata

SEQ ID NO: 4247256 - DNA, 21 bp, Homo sapiens
aattattattttaaaatatat

SEQ ID NO: 4247257 - DNA, 22 bp, Homo sapiens
aattattattttaaaatatatg

SEQ ID NO: 4247258 - DNA, 20 bp, Homo sapiens
aattattgatatatattata

SEQ ID NO: 4247259 - DNA, 12 bp, Homo sapiens
aattcagttttt

SEQ ID NO: 4247260 - DNA, 16 bp, Homo sapiens
aattcagtttttgtat

SEQ ID NO: 4247261 - DNA, 15 bp, Homo sapiens
aattcgcccgagctg

SEQ ID NO: 4247262 - DNA, 16 bp, Homo sapiens
aattctaacattaaat

SEQ ID NO: 4247263 - DNA, 14 bp, Homo sapiens
aattgaaataaata

SEQ ID NO: 4247264 - DNA, 21 bp, Homo sapiens
aattgatattatattaaacat

SEQ ID NO: 4247265 - DNA, 17 bp, Homo sapiens
aattggaacaaagtgaa

SEQ ID NO: 4247266 - DNA, 15 bp, Homo sapiens
aattggcagtgactt

SEQ ID NO: 4247267 - DNA, 17 bp, Homo sapiens
aattggcagtgactttg

SEQ ID NO: 4247268 - DNA, 14 bp, Homo sapiens
aattgtagggcttt

SEQ ID NO: 4247269 - DNA, 17 bp, Homo sapiens
aattgtatcaatttgtt

SEQ ID NO: 4247270 - DNA, 13 bp, Homo sapiens
aattgtgcttctc

SEQ ID NO: 4247271 - DNA, 14 bp, Homo sapiens
aatttactggccac

SEQ ID NO: 4247272 - DNA, 19 bp, Homo sapiens
aatttagccctttaaaacg

SEQ ID NO: 4247273 - DNA, 14 bp, Homo sapiens
aatttattatggca

SEQ ID NO: 4247274 - DNA, 17 bp, Homo sapiens
aatttattatggcacat

SEQ ID NO: 4247275 - DNA, 18 bp, Homo sapiens
aatttcatttaaatatct

SEQ ID NO: 4247276 - DNA, 21 bp, Homo sapiens
aatttctaaatctccaaaata

SEQ ID NO: 4247277 - DNA, 12 bp, Homo sapiens
aatttcttttcc

SEQ ID NO: 4247278 - DNA, 23 bp, Homo sapiens
aatttgaagtaacttatttgact

SEQ ID NO: 4247279 - DNA, 19 bp, Homo sapiens
aatttgatgcccaatatat

SEQ ID NO: 4247280 - DNA, 20 bp, Homo sapiens
aatttgatgcccaatatatt

SEQ ID NO: 4247281 - DNA, 21 bp, Homo sapiens
aatttgggagaagcaaatata

SEQ ID NO: 4247282 - DNA, 20 bp, Homo sapiens
aattttaatattcttttgtt

SEQ ID NO: 4247283 - DNA, 19 bp, Homo sapiens
aatttttatttatttttct

SEQ ID NO: 4247284 - DNA, 13 bp, Homo sapiens
aatttttgtattt

SEQ ID NO: 4247285 - DNA, 22 bp, Homo sapiens
aatttttttatcgtcactgctt

SEQ ID NO: 4247286 - DNA, 21 bp, Homo sapiens
acaaaaaagacttgagacaat

SEQ ID NO: 4247287 - DNA, 12 bp, Homo sapiens
acaaaaataata

SEQ ID NO: 4247288 - DNA, 14 bp, Homo sapiens
acaaacagtatttc

SEQ ID NO: 4247289 - DNA, 13 bp, Homo sapiens
acaaagactgagt

SEQ ID NO: 4247290 - DNA, 23 bp, Homo sapiens
acaaagcactagagaatgcacag

SEQ ID NO: 4247291 - DNA, 17 bp, Homo sapiens
acaaatgcataaatgca

SEQ ID NO: 4247292 - DNA, 20 bp, Homo sapiens
acaacagctcgatccaaatt

SEQ ID NO: 4247293 - DNA, 12 bp, Homo sapiens
acaacatttatg

SEQ ID NO: 4247294 - DNA, 16 bp, Homo sapiens
acaagaccacgtttct

SEQ ID NO: 4247295 - DNA, 18 bp, Homo sapiens
acaagaccacgtttctaa

SEQ ID NO: 4247296 - DNA, 13 bp, Homo sapiens
acaagatattatt

SEQ ID NO: 4247297 - DNA, 16 bp, Homo sapiens
acaaggattgaaaatt

SEQ ID NO: 4247298 - DNA, 17 bp, Homo sapiens
acaaggattgaaaattc

SEQ ID NO: 4247299 - DNA, 17 bp, Homo sapiens
acaagttgttattgttg

SEQ ID NO: 4247300 - DNA, 19 bp, Homo sapiens
acaatcagccacattctag

SEQ ID NO: 4247301 - DNA, 18 bp, Homo sapiens
acaatgacttactgtaca

SEQ ID NO: 4247302 - DNA, 20 bp, Homo sapiens
acaatgacttactgtacatg

SEQ ID NO: 4247303 - DNA, 20 bp, Homo sapiens
acaatgatgccctgctccag

SEQ ID NO: 4247304 - DNA, 22 bp, Homo sapiens
acaatgctgtgccctaaagtgt

SEQ ID NO: 4247305 - DNA, 23 bp, Homo sapiens
acaatgctgtgccctaaagtgta

SEQ ID NO: 4247306 - DNA, 15 bp, Homo sapiens
acaatgtgtttttct

SEQ ID NO: 4247307 - DNA, 21 bp, Homo sapiens
acaattttctgtaatctttta

SEQ ID NO: 4247308 - DNA, 17 bp, Homo sapiens
acaattttttttttcct

SEQ ID NO: 4247309 - DNA, 15 bp, Homo sapiens
acacaatatgtatgc

SEQ ID NO: 4247310 - DNA, 21 bp, Homo sapiens
acacactgcatgtttgtgatt

SEQ ID NO: 4247311 - DNA, 20 bp, Homo sapiens
acacatgcaaggtcattttt

SEQ ID NO: 4247312 - DNA, 19 bp, Homo sapiens
acacattttttaaatgcac

SEQ ID NO: 4247313 - DNA, 21 bp, Homo sapiens
acaccttttctatttacctcc

SEQ ID NO: 4247314 - DNA, 20 bp, Homo sapiens
acacgtccactcccaagcca

SEQ ID NO: 4247315 - DNA, 22 bp, Homo sapiens
acacgtgcgtgtgagtgtgtgt

SEQ ID NO: 4247316 - DNA, 16 bp, Homo sapiens
acactgtttcaaactt

SEQ ID NO: 4247317 - DNA, 18 bp, Homo sapiens
acactgtttcaaacttta

SEQ ID NO: 4247318 - DNA, 14 bp, Homo sapiens
acagaaatgtacag

SEQ ID NO: 4247319 - DNA, 16 bp, Homo sapiens
acagaaatgtacagca

SEQ ID NO: 4247320 - DNA, 13 bp, Homo sapiens
acagacaaaaaca

SEQ ID NO: 4247321 - DNA, 16 bp, Homo sapiens
acagactatttgctaa

SEQ ID NO: 4247322 - DNA, 18 bp, Homo sapiens
acagagttgttacatttt

SEQ ID NO: 4247323 - DNA, 20 bp, Homo sapiens
acagagttgttacattttta

SEQ ID NO: 4247324 - DNA, 22 bp, Homo sapiens
acagagttgttacatttttaag

SEQ ID NO: 4247325 - DNA, 21 bp, Homo sapiens
acagcaaggagatttacaact

SEQ ID NO: 4247326 - DNA, 15 bp, Homo sapiens
acagcagggaccggg

SEQ ID NO: 4247327 - DNA, 16 bp, Homo sapiens
acagcctcccaccccc

SEQ ID NO: 4247328 - DNA, 17 bp, Homo sapiens
acagcctttttgtaatt

SEQ ID NO: 4247329 - DNA, 14 bp, Homo sapiens
acaggcctgaagat

SEQ ID NO: 4247330 - DNA, 19 bp, Homo sapiens
acagtagttgtattcttct

SEQ ID NO: 4247331 - DNA, 21 bp, Homo sapiens
acagtcatcgctcgtgtgttc

SEQ ID NO: 4247332 - DNA, 18 bp, Homo sapiens
acagtggtactctgtgtc

SEQ ID NO: 4247333 - DNA, 21 bp, Homo sapiens
acagttatttcatcttttatt

SEQ ID NO: 4247334 - DNA, 22 bp, Homo sapiens
acagttatttcatcttttattc

SEQ ID NO: 4247335 - DNA, 12 bp, Homo sapiens
acagttcataat

SEQ ID NO: 4247336 - DNA, 20 bp, Homo sapiens
acagtttgttagtatgaggc

SEQ ID NO: 4247337 - DNA, 15 bp, Homo sapiens
acatacataatacaa

SEQ ID NO: 4247338 - DNA, 17 bp, Homo sapiens
acatacataatacaatg

SEQ ID NO: 4247339 - DNA, 22 bp, Homo sapiens
acatacttcaaaaataatgtgc

SEQ ID NO: 4247340 - DNA, 16 bp, Homo sapiens
acatagaggtatattg

SEQ ID NO: 4247341 - DNA, 18 bp, Homo sapiens
acatagaggtatattgga

SEQ ID NO: 4247342 - DNA, 20 bp, Homo sapiens
acatagaggtatattggaag

SEQ ID NO: 4247343 - DNA, 18 bp, Homo sapiens
acatattgatttccgtta

SEQ ID NO: 4247344 - DNA, 22 bp, Homo sapiens
acatattgatttccgttaaaat

SEQ ID NO: 4247345 - DNA, 18 bp, Homo sapiens
acatcagcacgatttctg

SEQ ID NO: 4247346 - DNA, 19 bp, Homo sapiens
acatcagcacgatttctgt

SEQ ID NO: 4247347 - DNA, 22 bp, Homo sapiens
acatcagcacgatttctgttta

SEQ ID NO: 4247348 - DNA, 16 bp, Homo sapiens
acatcgatatgtatat

SEQ ID NO: 4247349 - DNA, 13 bp, Homo sapiens
acatctcttcctc

SEQ ID NO: 4247350 - DNA, 15 bp, Homo sapiens
acatgaaaacacatt

SEQ ID NO: 4247351 - DNA, 17 bp, Homo sapiens
acatgaaaacacatttt

SEQ ID NO: 4247352 - DNA, 18 bp, Homo sapiens
acatgaaaacacattttt

SEQ ID NO: 4247353 - DNA, 23 bp, Homo sapiens
acatgaaaacacatttttcttag

SEQ ID NO: 4247354 - DNA, 15 bp, Homo sapiens
acatgctacacactg

SEQ ID NO: 4247355 - DNA, 13 bp, Homo sapiens
acatgtatttatg

SEQ ID NO: 4247356 - DNA, 15 bp, Homo sapiens
acatgtatttatgta

SEQ ID NO: 4247357 - DNA, 14 bp, Homo sapiens
acattaaatcacag

SEQ ID NO: 4247358 - DNA, 17 bp, Homo sapiens
acattaaatgcaataat

SEQ ID NO: 4247359 - DNA, 23 bp, Homo sapiens
acattaaatgcaataattttact

SEQ ID NO: 4247360 - DNA, 15 bp, Homo sapiens
acattattgcttatt

SEQ ID NO: 4247361 - DNA, 13 bp, Homo sapiens
acatttttcttag

SEQ ID NO: 4247362 - DNA, 23 bp, Homo sapiens
acatttttcttagggaaggatac

SEQ ID NO: 4247363 - DNA, 18 bp, Homo sapiens
accccgccatgcatgcag

SEQ ID NO: 4247364 - DNA, 15 bp, Homo sapiens
acccggtgcatctgg

SEQ ID NO: 4247365 - DNA, 15 bp, Homo sapiens
accctcatgttctta

SEQ ID NO: 4247366 - DNA, 21 bp, Homo sapiens
accctgctttggcggcccggc

SEQ ID NO: 4247367 - DNA, 14 bp, Homo sapiens
accctttgtttctt

SEQ ID NO: 4247368 - DNA, 18 bp, Homo sapiens
accgaggtgttgccagtg

SEQ ID NO: 4247369 - DNA, 16 bp, Homo sapiens
accgctctcttttctg

SEQ ID NO: 4247370 - DNA, 20 bp, Homo sapiens
accgctctcttttctgtact

SEQ ID NO: 4247371 - DNA, 22 bp, Homo sapiens
acctaaaaggaaatctcacccc

SEQ ID NO: 4247372 - DNA, 19 bp, Homo sapiens
acctatccgccctgcagca

SEQ ID NO: 4247373 - DNA, 18 bp, Homo sapiens
acctcctaatggcatgga

SEQ ID NO: 4247374 - DNA, 15 bp, Homo sapiens
acctctcaagctagt

SEQ ID NO: 4247375 - DNA, 22 bp, Homo sapiens
acctctcccccaaggccactgc

SEQ ID NO: 4247376 - DNA, 16 bp, Homo sapiens
acctctcgtttctgcc

SEQ ID NO: 4247377 - DNA, 18 bp, Homo sapiens
acctctcgtttctgccca

SEQ ID NO: 4247378 - DNA, 18 bp, Homo sapiens
acctctgcagcaataaag

SEQ ID NO: 4247379 - DNA, 21 bp, Homo sapiens
acctctgcagcaataaagcag

SEQ ID NO: 4247380 - DNA, 13 bp, Homo sapiens
acctctgccactc

SEQ ID NO: 4247381 - DNA, 17 bp, Homo sapiens
acctggaatatataacc

SEQ ID NO: 4247382 - DNA, 20 bp, Homo sapiens
acctggaatatataaccagt

SEQ ID NO: 4247383 - DNA, 16 bp, Homo sapiens
accttaaccttaaaat

SEQ ID NO: 4247384 - DNA, 23 bp, Homo sapiens
acctttgtattctctcctgtacc

SEQ ID NO: 4247385 - DNA, 14 bp, Homo sapiens
accttttttataca

SEQ ID NO: 4247386 - DNA, 18 bp, Homo sapiens
accttttttatacataaa

SEQ ID NO: 4247387 - DNA, 20 bp, Homo sapiens
accttttttatacataaaca

SEQ ID NO: 4247388 - DNA, 22 bp, Homo sapiens
accttttttatacataaacaag

SEQ ID NO: 4247389 - DNA, 17 bp, Homo sapiens
acgacccttttgagcct

SEQ ID NO: 4247390 - DNA, 17 bp, Homo sapiens
acgatttctgtttagat

SEQ ID NO: 4247391 - DNA, 17 bp, Homo sapiens
acgctgccgggagactg

SEQ ID NO: 4247392 - DNA, 22 bp, Homo sapiens
acgctgccgggagactgccagt

SEQ ID NO: 4247393 - DNA, 23 bp, Homo sapiens
acgctgccgggagactgccagtg

SEQ ID NO: 4247394 - DNA, 18 bp, Homo sapiens
acgcttactagatgtgag

SEQ ID NO: 4247395 - DNA, 19 bp, Homo sapiens
acggaaaatgcttaaaaaa

SEQ ID NO: 4247396 - DNA, 12 bp, Homo sapiens
acgtacacattt

SEQ ID NO: 4247397 - DNA, 15 bp, Homo sapiens
acgtggccaggagcc

SEQ ID NO: 4247398 - DNA, 21 bp, Homo sapiens
actaaaagcagcgtcactcta

SEQ ID NO: 4247399 - DNA, 12 bp, Homo sapiens
actaaataatga

SEQ ID NO: 4247400 - DNA, 17 bp, Homo sapiens
actaaccagcagaaatg

SEQ ID NO: 4247401 - DNA, 23 bp, Homo sapiens
actaaccagggaagctgtccctc

SEQ ID NO: 4247402 - DNA, 22 bp, Homo sapiens
actaagtttttatggcttttgt

SEQ ID NO: 4247403 - DNA, 14 bp, Homo sapiens
actacaaaatacaa

SEQ ID NO: 4247404 - DNA, 17 bp, Homo sapiens
actacacatttgaaaca

SEQ ID NO: 4247405 - DNA, 14 bp, Homo sapiens
actacagtttgtta

SEQ ID NO: 4247406 - DNA, 12 bp, Homo sapiens
actacattctgt

SEQ ID NO: 4247407 - DNA, 13 bp, Homo sapiens
actacattctgtt

SEQ ID NO: 4247408 - DNA, 16 bp, Homo sapiens
actacgcacagctgcc

SEQ ID NO: 4247409 - DNA, 20 bp, Homo sapiens
actcaactgggctctgtccc

SEQ ID NO: 4247410 - DNA, 21 bp, Homo sapiens
actcagaattctctagtttga

SEQ ID NO: 4247411 - DNA, 12 bp, Homo sapiens
actcccaagcca

SEQ ID NO: 4247412 - DNA, 19 bp, Homo sapiens
actccccagttggcccttc

SEQ ID NO: 4247413 - DNA, 17 bp, Homo sapiens
actcctatttttgtaaa

SEQ ID NO: 4247414 - DNA, 20 bp, Homo sapiens
actcctatttttgtaaactg

SEQ ID NO: 4247415 - DNA, 13 bp, Homo sapiens
actcctcttccca

SEQ ID NO: 4247416 - DNA, 12 bp, Homo sapiens
actcctggagca

SEQ ID NO: 4247417 - DNA, 12 bp, Homo sapiens
actctaggactt

SEQ ID NO: 4247418 - DNA, 15 bp, Homo sapiens
actctcagcccagaa

SEQ ID NO: 4247419 - DNA, 21 bp, Homo sapiens
actctcagcccagaagaaaat

SEQ ID NO: 4247420 - DNA, 18 bp, Homo sapiens
actcttaatctgtgtgta

SEQ ID NO: 4247421 - DNA, 22 bp, Homo sapiens
actcttaatctgtgtgtatatt

SEQ ID NO: 4247422 - DNA, 13 bp, Homo sapiens
actgaagccgtgt

SEQ ID NO: 4247423 - DNA, 23 bp, Homo sapiens
actgaagggaacagcctgagccg

SEQ ID NO: 4247424 - DNA, 14 bp, Homo sapiens
actgaatattttgg

SEQ ID NO: 4247425 - DNA, 15 bp, Homo sapiens
actgaatattttgga

SEQ ID NO: 4247426 - DNA, 18 bp, Homo sapiens
actgaatattttggaaac

SEQ ID NO: 4247427 - DNA, 20 bp, Homo sapiens
actgaatattttggaaactg

SEQ ID NO: 4247428 - DNA, 18 bp, Homo sapiens
actgcaaacttttttata

SEQ ID NO: 4247429 - DNA, 16 bp, Homo sapiens
actgcacagcgtcctg

SEQ ID NO: 4247430 - DNA, 16 bp, Homo sapiens
actgcatgtttgtgat

SEQ ID NO: 4247431 - DNA, 14 bp, Homo sapiens
actgccagtggaga

SEQ ID NO: 4247432 - DNA, 15 bp, Homo sapiens
actgctaaattctat

SEQ ID NO: 4247433 - DNA, 15 bp, Homo sapiens
actgcttgattttaa

SEQ ID NO: 4247434 - DNA, 23 bp, Homo sapiens
actgcttgattttaatacattga

SEQ ID NO: 4247435 - DNA, 13 bp, Homo sapiens
actggaattaaaa

SEQ ID NO: 4247436 - DNA, 14 bp, Homo sapiens
actggtattgttta

SEQ ID NO: 4247437 - DNA, 19 bp, Homo sapiens
actgtaatttgtgatacaa

SEQ ID NO: 4247438 - DNA, 21 bp, Homo sapiens
actgtacatgaaaacacattt

SEQ ID NO: 4247439 - DNA, 21 bp, Homo sapiens
actgtaccacagacacaatat

SEQ ID NO: 4247440 - DNA, 13 bp, Homo sapiens
actgtccagctgg

SEQ ID NO: 4247441 - DNA, 20 bp, Homo sapiens
actgtgggaaggccagctgc

SEQ ID NO: 4247442 - DNA, 21 bp, Homo sapiens
actgttgatgaagtatacttt

SEQ ID NO: 4247443 - DNA, 19 bp, Homo sapiens
actgtttcaaactttacta

SEQ ID NO: 4247444 - DNA, 20 bp, Homo sapiens
acttaaataatgtgaaactg

SEQ ID NO: 4247445 - DNA, 13 bp, Homo sapiens
acttaatctaaat

SEQ ID NO: 4247446 - DNA, 19 bp, Homo sapiens
acttaatctaaatggaacc

SEQ ID NO: 4247447 - DNA, 22 bp, Homo sapiens
acttaatctaaatggaaccact

SEQ ID NO: 4247448 - DNA, 14 bp, Homo sapiens
acttaccatttgct

SEQ ID NO: 4247449 - DNA, 21 bp, Homo sapiens
acttactgtacatgaaaacac

SEQ ID NO: 4247450 - DNA, 23 bp, Homo sapiens
acttcacatattgatttccgtta

SEQ ID NO: 4247451 - DNA, 15 bp, Homo sapiens
acttgagacaatgtt

SEQ ID NO: 4247452 - DNA, 15 bp, Homo sapiens
acttgatttgatgtg

SEQ ID NO: 4247453 - DNA, 13 bp, Homo sapiens
acttgtgaatgct

SEQ ID NO: 4247454 - DNA, 12 bp, Homo sapiens
actttacctctt

SEQ ID NO: 4247455 - DNA, 18 bp, Homo sapiens
actttaccttttttatac

SEQ ID NO: 4247456 - DNA, 14 bp, Homo sapiens
actttgacctctgc

SEQ ID NO: 4247457 - DNA, 15 bp, Homo sapiens
actttgacctctgca

SEQ ID NO: 4247458 - DNA, 16 bp, Homo sapiens
agttatgtatttaaag

SEQ ID NO: 4247459 - DNA, 21 bp, Homo sapiens
agttatttcatcttttattca

SEQ ID NO: 4247460 - DNA, 18 bp, Homo sapiens
agttgaggaactgtacag

SEQ ID NO: 4247461 - DNA, 15 bp, Homo sapiens
agttgcagatgtatt

SEQ ID NO: 4247462 - DNA, 20 bp, Homo sapiens
agtttgattaaattcttgca

SEQ ID NO: 4247463 - DNA, 23 bp, Homo sapiens
agtttgattaaattcttgcaaag

SEQ ID NO: 4247464 - DNA, 20 bp, Homo sapiens
agtttggatatttttgtact

SEQ ID NO: 4247465 - DNA, 21 bp, Homo sapiens
agtttggatatttttgtactt

SEQ ID NO: 4247466 - DNA, 14 bp, Homo sapiens
agttttaactttaa

SEQ ID NO: 4247467 - DNA, 19 bp, Homo sapiens
agttttaactttaatacag

SEQ ID NO: 4247468 - DNA, 20 bp, Homo sapiens
agttttaactttaatacagc

SEQ ID NO: 4247469 - DNA, 17 bp, Homo sapiens
ataaaaacaagtcattt

SEQ ID NO: 4247470 - DNA, 14 bp, Homo sapiens
ataaaactgaatct

SEQ ID NO: 4247471 - DNA, 18 bp, Homo sapiens
ataaaacttaaaaacaag

SEQ ID NO: 4247472 - DNA, 15 bp, Homo sapiens
ataaaataaataatt

SEQ ID NO: 4247473 - DNA, 20 bp, Homo sapiens
ataaaataaataattttaat

SEQ ID NO: 4247474 - DNA, 22 bp, Homo sapiens
ataaacaagaccacgtttctaa

SEQ ID NO: 4247475 - DNA, 21 bp, Homo sapiens
ataaacagacaaaaacaagta

SEQ ID NO: 4247476 - DNA, 12 bp, Homo sapiens
ataaactgaata

SEQ ID NO: 4247477 - DNA, 19 bp, Homo sapiens
ataaactgaatattttgga

SEQ ID NO: 4247478 - DNA, 21 bp, Homo sapiens
ataaactgaatattttggaaa

SEQ ID NO: 4247479 - DNA, 22 bp, Homo sapiens
ataaactgaatattttggaaac

SEQ ID NO: 4247480 - DNA, 12 bp, Homo sapiens
ataaagaatata

SEQ ID NO: 4247481 - DNA, 21 bp, Homo sapiens
ataaagatgagtgagcatgcc

SEQ ID NO: 4247482 - DNA, 13 bp, Homo sapiens
ataaagcagcgtt

SEQ ID NO: 4247483 - DNA, 20 bp, Homo sapiens
ataaagtatagagagaagtt

SEQ ID NO: 4247484 - DNA, 16 bp, Homo sapiens
ataaagttgtattgca

SEQ ID NO: 4247485 - DNA, 15 bp, Homo sapiens
ataaataaaaatgca

SEQ ID NO: 4247486 - DNA, 16 bp, Homo sapiens
ataaataaaaatgcat

SEQ ID NO: 4247487 - DNA, 17 bp, Homo sapiens
ataaataaaaatgcatt

SEQ ID NO: 4247488 - DNA, 13 bp, Homo sapiens
ataaataaaactg

SEQ ID NO: 4247489 - DNA, 19 bp, Homo sapiens
ataaataaaactgaatctc

SEQ ID NO: 4247490 - DNA, 15 bp, Homo sapiens
ataaatagaaaagta

SEQ ID NO: 4247491 - DNA, 18 bp, Homo sapiens
ataaatagaaaagtagac

SEQ ID NO: 4247492 - DNA, 16 bp, Homo sapiens
ataaatatatataaag

SEQ ID NO: 4247493 - DNA, 19 bp, Homo sapiens
ataaatatatataaagaat

SEQ ID NO: 4247494 - DNA, 21 bp, Homo sapiens
ataaatatatataaagaatat

SEQ ID NO: 4247495 - DNA, 13 bp, Homo sapiens
ataacactgtatt

SEQ ID NO: 4247496 - DNA, 12 bp, Homo sapiens
ataatacaccac

SEQ ID NO: 4247497 - DNA, 18 bp, Homo sapiens
ataatacaccactacatt

SEQ ID NO: 4247498 - DNA, 16 bp, Homo sapiens
ataatgaataaactga

SEQ ID NO: 4247499 - DNA, 18 bp, Homo sapiens
ataatgaataaactgaat

SEQ ID NO: 4247500 - DNA, 15 bp, Homo sapiens
ataatgataaaataa

SEQ ID NO: 4247501 - DNA, 22 bp, Homo sapiens
ataatgataaaataaataattt

SEQ ID NO: 4247502 - DNA, 15 bp, Homo sapiens
ataatgcgtgcatac

SEQ ID NO: 4247503 - DNA, 20 bp, Homo sapiens
ataatgcgtgcataccactt

SEQ ID NO: 4247504 - DNA, 21 bp, Homo sapiens
ataatgcgtgcataccacttt

SEQ ID NO: 4247505 - DNA, 14 bp, Homo sapiens
ataatggaaacatt

SEQ ID NO: 4247506 - DNA, 12 bp, Homo sapiens
ataatgtttaaa

SEQ ID NO: 4247507 - DNA, 16 bp, Homo sapiens
ataatttacaagatat

SEQ ID NO: 4247508 - DNA, 20 bp, Homo sapiens
ataatttacaagatattatt

SEQ ID NO: 4247509 - DNA, 18 bp, Homo sapiens
ataattttaatattcttt

SEQ ID NO: 4247510 - DNA, 13 bp, Homo sapiens
atacaaaagcatg

SEQ ID NO: 4247511 - DNA, 23 bp, Homo sapiens
atacaatgctgtgccctaaagtg

SEQ ID NO: 4247512 - DNA, 17 bp, Homo sapiens
atacaccactacattct

SEQ ID NO: 4247513 - DNA, 18 bp, Homo sapiens
atacaccactacattctg

SEQ ID NO: 4247514 - DNA, 20 bp, Homo sapiens
atacataaacaagaccacgt

SEQ ID NO: 4247515 - DNA, 22 bp, Homo sapiens
atacatattgtatatatattca

SEQ ID NO: 4247516 - DNA, 17 bp, Homo sapiens
atacattataacaacta

SEQ ID NO: 4247517 - DNA, 20 bp, Homo sapiens
atacattccctctaatttga

SEQ ID NO: 4247518 - DNA, 18 bp, Homo sapiens
ataccaaggtacaactgt

SEQ ID NO: 4247519 - DNA, 17 bp, Homo sapiens
ataccacttttgttctt

SEQ ID NO: 4247520 - DNA, 18 bp, Homo sapiens
ataccagcttagatttta

SEQ ID NO: 4247521 - DNA, 16 bp, Homo sapiens
atacgtacacatttta

SEQ ID NO: 4247522 - DNA, 19 bp, Homo sapiens
atactaaccagcagaaatg

SEQ ID NO: 4247523 - DNA, 20 bp, Homo sapiens
atactaaccagcagaaatgc

SEQ ID NO: 4247524 - DNA, 13 bp, Homo sapiens
atactacagtttg

SEQ ID NO: 4247525 - DNA, 15 bp, Homo sapiens
atactacagtttgtt

SEQ ID NO: 4247526 - DNA, 16 bp, Homo sapiens
atactacagtttgtta

SEQ ID NO: 4247527 - DNA, 13 bp, Homo sapiens
atactgtgcagaa

SEQ ID NO: 4247528 - DNA, 14 bp, Homo sapiens
atactgtgcagaat

SEQ ID NO: 4247529 - DNA, 21 bp, Homo sapiens
atactgtgcagaataatggaa

SEQ ID NO: 4247530 - DNA, 16 bp, Homo sapiens
atactttgtggaccaa

SEQ ID NO: 4247531 - DNA, 21 bp, Homo sapiens
atacttttcccctgttaaaca

SEQ ID NO: 4247532 - DNA, 22 bp, Homo sapiens
atacttttcccctgttaaacag

SEQ ID NO: 4247533 - DNA, 14 bp, Homo sapiens
atagagaatttaag

SEQ ID NO: 4247534 - DNA, 19 bp, Homo sapiens
ataggaacttaaataatgt

SEQ ID NO: 4247535 - DNA, 16 bp, Homo sapiens
ataggaagcgtctggc

SEQ ID NO: 4247536 - DNA, 15 bp, Homo sapiens
ataggtagtttggat

SEQ ID NO: 4247537 - DNA, 20 bp, Homo sapiens
ataggtcctgtgttaaacac

SEQ ID NO: 4247538 - DNA, 13 bp, Homo sapiens
ataggttatatgc

SEQ ID NO: 4247539 - DNA, 14 bp, Homo sapiens
ataggttatatgca

SEQ ID NO: 4247540 - DNA, 13 bp, Homo sapiens
atataaagaatat

SEQ ID NO: 4247541 - DNA, 15 bp, Homo sapiens
atataaagaatatat

SEQ ID NO: 4247542 - DNA, 18 bp, Homo sapiens
atataagtgacttgaaca

SEQ ID NO: 4247543 - DNA, 21 bp, Homo sapiens
atataggtcctgtgttaaaca

SEQ ID NO: 4247544 - DNA, 15 bp, Homo sapiens
atatataaagaatat

SEQ ID NO: 4247545 - DNA, 16 bp, Homo sapiens
atatataaagaatata

SEQ ID NO: 4247546 - DNA, 17 bp, Homo sapiens
atatataaagaatatat

SEQ ID NO: 4247547 - DNA, 12 bp, Homo sapiens
atatataaccag

SEQ ID NO: 4247548 - DNA, 13 bp, Homo sapiens
atatatataaaga

SEQ ID NO: 4247549 - DNA, 15 bp, Homo sapiens
atatatatagtcaaa

SEQ ID NO: 4247550 - DNA, 11 bp, Homo sapiens
atatatatata

SEQ ID NO: 4247551 - DNA, 13 bp, Homo sapiens
atatatatataaa

SEQ ID NO: 4247552 - DNA, 19 bp, Homo sapiens
atatatattataaatatat

SEQ ID NO: 4247553 - DNA, 19 bp, Homo sapiens
atatatgaagacaataatt

SEQ ID NO: 4247554 - DNA, 20 bp, Homo sapiens
atatatgaagacaataattc

SEQ ID NO: 4247555 - DNA, 13 bp, Homo sapiens
atatattaaaaca

SEQ ID NO: 4247556 - DNA, 17 bp, Homo sapiens
atatattaaaacaataa

SEQ ID NO: 4247557 - DNA, 16 bp, Homo sapiens
atatattcatatacaa

SEQ ID NO: 4247558 - DNA, 23 bp, Homo sapiens
atatatttcacttttgttctgct

SEQ ID NO: 4247559 - DNA, 19 bp, Homo sapiens
atatcagctttgataattg

SEQ ID NO: 4247560 - DNA, 13 bp, Homo sapiens
atatcttttggtt

SEQ ID NO: 4247561 - DNA, 16 bp, Homo sapiens
atatcttttggttatt

SEQ ID NO: 4247562 - DNA, 18 bp, Homo sapiens
atatggagaattgctgaa

SEQ ID NO: 4247563 - DNA, 21 bp, Homo sapiens
atatggagaattgctgaaggg

SEQ ID NO: 4247564 - DNA, 22 bp, Homo sapiens
atatgtatatcattctacagaa

SEQ ID NO: 4247565 - DNA, 14 bp, Homo sapiens
atattcaatgtatt

SEQ ID NO: 4247566 - DNA, 13 bp, Homo sapiens
atattcttataaa

SEQ ID NO: 4247567 - DNA, 17 bp, Homo sapiens
atattcttttgtttcca

SEQ ID NO: 4247568 - DNA, 19 bp, Homo sapiens
atattgatttccgttaaaa

SEQ ID NO: 4247569 - DNA, 19 bp, Homo sapiens
atattgtttaaaattcagt

SEQ ID NO: 4247570 - DNA, 17 bp, Homo sapiens
atattgtttttctttct

SEQ ID NO: 4247571 - DNA, 18 bp, Homo sapiens
atatttcacttttgttct

SEQ ID NO: 4247572 - DNA, 19 bp, Homo sapiens
atatttcacttttgttctg

SEQ ID NO: 4247573 - DNA, 13 bp, Homo sapiens
atattttggaaac

SEQ ID NO: 4247574 - DNA, 23 bp, Homo sapiens
atattttggaaactgctaaattc

SEQ ID NO: 4247575 - DNA, 19 bp, Homo sapiens
atatttttagactatttct

SEQ ID NO: 4247576 - DNA, 14 bp, Homo sapiens
atatttttgtactt

SEQ ID NO: 4247577 - DNA, 18 bp, Homo sapiens
atatttttttcttttctt

SEQ ID NO: 4247578 - DNA, 13 bp, Homo sapiens
atcaaaagaaaat

SEQ ID NO: 4247579 - DNA, 13 bp, Homo sapiens
atcaaacttatgg

SEQ ID NO: 4247580 - DNA, 13 bp, Homo sapiens
atcaagtattata

SEQ ID NO: 4247581 - DNA, 18 bp, Homo sapiens
atcaagtattataccttt

SEQ ID NO: 4247582 - DNA, 17 bp, Homo sapiens
atcaattagatctaaac

SEQ ID NO: 4247583 - DNA, 18 bp, Homo sapiens
atcaattagatctaaaca

SEQ ID NO: 4247584 - DNA, 19 bp, Homo sapiens
atcaattggcagtgacttt

SEQ ID NO: 4247585 - DNA, 23 bp, Homo sapiens
atcactgcattcattctgagccc

SEQ ID NO: 4247586 - DNA, 20 bp, Homo sapiens
atcagcacgatttctgttta

SEQ ID NO: 4247587 - DNA, 21 bp, Homo sapiens
atcagctttgataattgtgta

SEQ ID NO: 4247588 - DNA, 16 bp, Homo sapiens
atcatcctcagcagca

SEQ ID NO: 4247589 - DNA, 16 bp, Homo sapiens
atcatgtatgttatga

SEQ ID NO: 4247590 - DNA, 23 bp, Homo sapiens
atccaaattgtgcttctccccag

SEQ ID NO: 4247591 - DNA, 13 bp, Homo sapiens
atccacctgtctc

SEQ ID NO: 4247592 - DNA, 18 bp, Homo sapiens
atccacctgtctcagcct

SEQ ID NO: 4247593 - DNA, 15 bp, Homo sapiens
atccatgcattatat

SEQ ID NO: 4247594 - DNA, 13 bp, Homo sapiens
atcccttaaaatt

SEQ ID NO: 4247595 - DNA, 15 bp, Homo sapiens
atcgatatgtatatc

SEQ ID NO: 4247596 - DNA, 16 bp, Homo sapiens
atcggattactgaatt

SEQ ID NO: 4247597 - DNA, 18 bp, Homo sapiens
atcgtcactgcttaactt

SEQ ID NO: 4247598 - DNA, 19 bp, Homo sapiens
atctaaatggaaccactct

SEQ ID NO: 4247599 - DNA, 18 bp, Homo sapiens
atctagatactgtatcat

SEQ ID NO: 4247600 - DNA, 14 bp, Homo sapiens
atctcaatcttggt

SEQ ID NO: 4247601 - DNA, 17 bp, Homo sapiens
atctcaattgaaagctt

SEQ ID NO: 4247602 - DNA, 18 bp, Homo sapiens
atctcaattgaaagcttt

SEQ ID NO: 4247603 - DNA, 16 bp, Homo sapiens
atctcaccccatccca

SEQ ID NO: 4247604 - DNA, 22 bp, Homo sapiens
atctcaccccatcccacaccct

SEQ ID NO: 4247605 - DNA, 23 bp, Homo sapiens
atctcaccccatcccacaccctg

SEQ ID NO: 4247606 - DNA, 17 bp, Homo sapiens
atctccaaaataaaact

SEQ ID NO: 4247607 - DNA, 20 bp, Homo sapiens
atctccaaaataaaactttt

SEQ ID NO: 4247608 - DNA, 19 bp, Homo sapiens
atctcttattttacaataa

SEQ ID NO: 4247609 - DNA, 15 bp, Homo sapiens
atctgacccactttg

SEQ ID NO: 4247610 - DNA, 19 bp, Homo sapiens
atctgacccactttgtaat

SEQ ID NO: 4247611 - DNA, 22 bp, Homo sapiens
atctgcagaacatcgatatgta

SEQ ID NO: 4247612 - DNA, 18 bp, Homo sapiens
atctgccgctttgtctgt

SEQ ID NO: 4247613 - DNA, 21 bp, Homo sapiens
atctggcacgtggccaggagc

SEQ ID NO: 4247614 - DNA, 20 bp, Homo sapiens
atctgtcacacctgtgcctc

SEQ ID NO: 4247615 - DNA, 21 bp, Homo sapiens
atctgttattcaaatttgatg

SEQ ID NO: 4247616 - DNA, 23 bp, Homo sapiens
atctgttattcaaatttgatgat

SEQ ID NO: 4247617 - DNA, 22 bp, Homo sapiens
atcttggtttgtcagtttatct

SEQ ID NO: 4247618 - DNA, 20 bp, Homo sapiens
atcttgtgaaatggccagga

SEQ ID NO: 4247619 - DNA, 16 bp, Homo sapiens
atctttgtaaatgcat

SEQ ID NO: 4247620 - DNA, 11 bp, Homo sapiens
atcttttacat

SEQ ID NO: 4247621 - DNA, 12 bp, Homo sapiens
atcttttcataa

SEQ ID NO: 4247622 - DNA, 17 bp, Homo sapiens
atgaaggaatcattcca

SEQ ID NO: 4247623 - DNA, 15 bp, Homo sapiens
atgaagtatactttt

SEQ ID NO: 4247624 - DNA, 18 bp, Homo sapiens
atgaataaactgaatatt

SEQ ID NO: 4247625 - DNA, 14 bp, Homo sapiens
atgaatattttgat

SEQ ID NO: 4247626 - DNA, 19 bp, Homo sapiens
atgaatattttgataataa

SEQ ID NO: 4247627 - DNA, 20 bp, Homo sapiens
atgaatattttgataataat

SEQ ID NO: 4247628 - DNA, 13 bp, Homo sapiens
atgacagatttct

SEQ ID NO: 4247629 - DNA, 14 bp, Homo sapiens
atgacagatttctg

SEQ ID NO: 4247630 - DNA, 23 bp, Homo sapiens
atgacaggcctgaagatattact

SEQ ID NO: 4247631 - DNA, 17 bp, Homo sapiens
atgacttactgtacatg

SEQ ID NO: 4247632 - DNA, 14 bp, Homo sapiens
atgagcctgtccaa

SEQ ID NO: 4247633 - DNA, 13 bp, Homo sapiens
atgaggcatttgt

SEQ ID NO: 4247634 - DNA, 14 bp, Homo sapiens
atgaggcatttgtt

SEQ ID NO: 4247635 - DNA, 12 bp, Homo sapiens
atgataaaataa

SEQ ID NO: 4247636 - DNA, 20 bp, Homo sapiens
atgatattgtttaaaattca

SEQ ID NO: 4247637 - DNA, 19 bp, Homo sapiens
atgatgccctgctccaggg

SEQ ID NO: 4247638 - DNA, 20 bp, Homo sapiens
atgatgttaaatgtaatata

SEQ ID NO: 4247639 - DNA, 15 bp, Homo sapiens
atgcaaagtacaatg

SEQ ID NO: 4247640 - DNA, 12 bp, Homo sapiens
atgcaataattt

SEQ ID NO: 4247641 - DNA, 14 bp, Homo sapiens
atgcaatttgaagt

SEQ ID NO: 4247642 - DNA, 23 bp, Homo sapiens
atgcaatttgaagtaacttattt

SEQ ID NO: 4247643 - DNA, 13 bp, Homo sapiens
atgcacacatttt

SEQ ID NO: 4247644 - DNA, 19 bp, Homo sapiens
atgcacacattttttaaat

SEQ ID NO: 4247645 - DNA, 19 bp, Homo sapiens
atgcacagatatactttgt

SEQ ID NO: 4247646 - DNA, 15 bp, Homo sapiens
atgcagcaaatatat

SEQ ID NO: 4247647 - DNA, 16 bp, Homo sapiens
atgcagcaaatatatg

SEQ ID NO: 4247648 - DNA, 17 bp, Homo sapiens
atgcagcaaatatatga

SEQ ID NO: 4247649 - DNA, 19 bp, Homo sapiens
atgcataaatgcataattt

SEQ ID NO: 4247650 - DNA, 17 bp, Homo sapiens
atgcatattcaatgtat

SEQ ID NO: 4247651 - DNA, 16 bp, Homo sapiens
atgcatgaagtaatat

SEQ ID NO: 4247652 - DNA, 20 bp, Homo sapiens
atgcatgaagtaatatgcac

SEQ ID NO: 4247653 - DNA, 12 bp, Homo sapiens
atgcatttgaaa

SEQ ID NO: 4247654 - DNA, 16 bp, Homo sapiens
atgcccaatatattct

SEQ ID NO: 4247655 - DNA, 22 bp, Homo sapiens
atgcccttacacgtgcgtgtga

SEQ ID NO: 4247656 - DNA, 17 bp, Homo sapiens
atgcctgttttgagacc

SEQ ID NO: 4247657 - DNA, 17 bp, Homo sapiens
atgctaaacctttgagt

SEQ ID NO: 4247658 - DNA, 22 bp, Homo sapiens
atgctatggaacataaagttgt

SEQ ID NO: 4247659 - DNA, 15 bp, Homo sapiens
atgctccaaatataa

SEQ ID NO: 4247660 - DNA, 17 bp, Homo sapiens
atgctgtccgtgcttgc

SEQ ID NO: 4247661 - DNA, 19 bp, Homo sapiens
atgctgtgccctaaagtgt

SEQ ID NO: 4247662 - DNA, 18 bp, Homo sapiens
atgcttaaaaaataatac

SEQ ID NO: 4247663 - DNA, 17 bp, Homo sapiens
atgcttaaactaaataa

SEQ ID NO: 4247664 - DNA, 19 bp, Homo sapiens
atgcttaaactaaataatg

SEQ ID NO: 4247665 - DNA, 20 bp, Homo sapiens
atgcttctcatcttgtgaaa

SEQ ID NO: 4247666 - DNA, 12 bp, Homo sapiens
atgcttgtacat

SEQ ID NO: 4247667 - DNA, 13 bp, Homo sapiens
atgcttgtacata

SEQ ID NO: 4247668 - DNA, 15 bp, Homo sapiens
atgcttgtacataat

SEQ ID NO: 4247669 - DNA, 16 bp, Homo sapiens
atgcttgtacataatg

SEQ ID NO: 4247670 - DNA, 18 bp, Homo sapiens
atggacgctgccgggaga

SEQ ID NO: 4247671 - DNA, 16 bp, Homo sapiens
atggaggcctacctct

SEQ ID NO: 4247672 - DNA, 15 bp, Homo sapiens
atggcagctagtgcc

SEQ ID NO: 4247673 - DNA, 16 bp, Homo sapiens
atggcatggagactct

SEQ ID NO: 4247674 - DNA, 18 bp, Homo sapiens
atggccaggatcctctcc

SEQ ID NO: 4247675 - DNA, 19 bp, Homo sapiens
atggccaggatcctctcct

SEQ ID NO: 4247676 - DNA, 22 bp, Homo sapiens
atttacaagatattattaattt

SEQ ID NO: 4247677 - DNA, 18 bp, Homo sapiens
atttagccctttaaaacg

SEQ ID NO: 4247678 - DNA, 17 bp, Homo sapiens
cctctggagcaccaggt

SEQ ID NO: 4247679 - DNA, 13 bp, Homo sapiens
cctctgtggccag

SEQ ID NO: 4247680 - DNA, 13 bp, Homo sapiens
cctcttgagcctt

SEQ ID NO: 4247681 - DNA, 13 bp, Homo sapiens
cctctttgccctg

SEQ ID NO: 4247682 - DNA, 19 bp, Homo sapiens
cctgagcctgttcccactc

SEQ ID NO: 4247683 - DNA, 16 bp, Homo sapiens
cctgaggcaaggagtt

SEQ ID NO: 4247684 - DNA, 15 bp, Homo sapiens
cctgatgatgctggc

SEQ ID NO: 4247685 - DNA, 15 bp, Homo sapiens
cctgcagcagaacct

SEQ ID NO: 4247686 - DNA, 15 bp, Homo sapiens
cctgcagcccgtgtc

SEQ ID NO: 4247687 - DNA, 18 bp, Homo sapiens
cctgcagcccgtgtccag

SEQ ID NO: 4247688 - DNA, 14 bp, Homo sapiens
cctgctgggtgcca

SEQ ID NO: 4247689 - DNA, 20 bp, Homo sapiens
cctgctgggtgccaggtgct

SEQ ID NO: 4247690 - DNA, 13 bp, Homo sapiens
cctggagctttcc

SEQ ID NO: 4247691 - DNA, 16 bp, Homo sapiens
cctggaggatttcatc

SEQ ID NO: 4247692 - DNA, 22 bp, Homo sapiens
cctggcccgcaagagggacaga

SEQ ID NO: 4247693 - DNA, 22 bp, Homo sapiens
cctggcctagcatacgtacaca

SEQ ID NO: 4247694 - DNA, 17 bp, Homo sapiens
cctggggtttagaaccc

SEQ ID NO: 4247695 - DNA, 19 bp, Homo sapiens
cctggtgcccttccctgga

SEQ ID NO: 4247696 - DNA, 21 bp, Homo sapiens
cctggtgcccttccctggagg

SEQ ID NO: 4247697 - DNA, 14 bp, Homo sapiens
cctggttcgtgcca

SEQ ID NO: 4247698 - DNA, 12 bp, Homo sapiens
cctgtacctctt

SEQ ID NO: 4247699 - DNA, 18 bp, Homo sapiens
cctgtccacacccagctc

SEQ ID NO: 4247700 - DNA, 16 bp, Homo sapiens
cctgtctcagcctccc

SEQ ID NO: 4247701 - DNA, 19 bp, Homo sapiens
cctgtttataatctgaaga

SEQ ID NO: 4247702 - DNA, 13 bp, Homo sapiens
ccttctgttgctg

SEQ ID NO: 4247703 - DNA, 21 bp, Homo sapiens
ccttgagggtgcttgttccct

SEQ ID NO: 4247704 - DNA, 14 bp, Homo sapiens
ccttgcacatagta

SEQ ID NO: 4247705 - DNA, 16 bp, Homo sapiens
ccttgcacctgagcct

SEQ ID NO: 4247706 - DNA, 18 bp, Homo sapiens
ccttgcacctgagcctgt

SEQ ID NO: 4247707 - DNA, 18 bp, Homo sapiens
ccttgctcctagcagaca

SEQ ID NO: 4247708 - DNA, 23 bp, Homo sapiens
cctttgtattctctcctgtacct

SEQ ID NO: 4247709 - DNA, 15 bp, Homo sapiens
ccttttgagcctaga

SEQ ID NO: 4247710 - DNA, 18 bp, Homo sapiens
ccttttttatacataaac

SEQ ID NO: 4247711 - DNA, 21 bp, Homo sapiens
cgaactggttgtagtgggaag

SEQ ID NO: 4247712 - DNA, 18 bp, Homo sapiens
cgaattgtgtggagaact

SEQ ID NO: 4247713 - DNA, 17 bp, Homo sapiens
cgaccacgccccaggac

SEQ ID NO: 4247714 - DNA, 16 bp, Homo sapiens
cgaggaagggccgagg

SEQ ID NO: 4247715 - DNA, 15 bp, Homo sapiens
cgatccacctgtctc

SEQ ID NO: 4247716 - DNA, 18 bp, Homo sapiens
cgatggaggcctacctct

SEQ ID NO: 4247717 - DNA, 20 bp, Homo sapiens
cgatttctgtttagataata

SEQ ID NO: 4247718 - DNA, 14 bp, Homo sapiens
cgcaagagggacag

SEQ ID NO: 4247719 - DNA, 17 bp, Homo sapiens
cgcaagagggacagagc

SEQ ID NO: 4247720 - DNA, 19 bp, Homo sapiens
cgcaagagggacagagccc

SEQ ID NO: 4247721 - DNA, 19 bp, Homo sapiens
cgcacttacctgcttgagc

SEQ ID NO: 4247722 - DNA, 15 bp, Homo sapiens
cgcagaccagctggc

SEQ ID NO: 4247723 - DNA, 16 bp, Homo sapiens
cgccctgcagggccgg

SEQ ID NO: 4247724 - DNA, 16 bp, Homo sapiens
cgcgccaggccctcag

SEQ ID NO: 4247725 - DNA, 15 bp, Homo sapiens
cgctcgtgtgttcta

SEQ ID NO: 4247726 - DNA, 18 bp, Homo sapiens
cgctctcgggtcaccctg

SEQ ID NO: 4247727 - DNA, 15 bp, Homo sapiens
cgcttctgccttttc

SEQ ID NO: 4247728 - DNA, 15 bp, Homo sapiens
cgctttgtctgtcca

SEQ ID NO: 4247729 - DNA, 17 bp, Homo sapiens
cgctttgtctgtccagc

SEQ ID NO: 4247730 - DNA, 15 bp, Homo sapiens
cggaaaacatgctac

SEQ ID NO: 4247731 - DNA, 13 bp, Homo sapiens
cggagctcctggc

SEQ ID NO: 4247732 - DNA, 22 bp, Homo sapiens
cggagggtgccgtgcgggcgag

SEQ ID NO: 4247733 - DNA, 23 bp, Homo sapiens
cggccgcctttgcgctctcgggt

SEQ ID NO: 4247734 - DNA, 14 bp, Homo sapiens
cgggagactgccag

SEQ ID NO: 4247735 - DNA, 18 bp, Homo sapiens
cgggcagggggacagcag

SEQ ID NO: 4247736 - DNA, 20 bp, Homo sapiens
cgggcatggtggctcatgcc

SEQ ID NO: 4247737 - DNA, 12 bp, Homo sapiens
cgggcgggcgtg

SEQ ID NO: 4247738 - DNA, 14 bp, Homo sapiens
cggtgcatctggca

SEQ ID NO: 4247739 - DNA, 17 bp, Homo sapiens
cgtctttacccctgctg

SEQ ID NO: 4247740 - DNA, 13 bp, Homo sapiens
cgtgatcttggct

SEQ ID NO: 4247741 - DNA, 19 bp, Homo sapiens
cgtgcataccacttttgtt

SEQ ID NO: 4247742 - DNA, 23 bp, Homo sapiens
cgtgcataccacttttgttcttg

SEQ ID NO: 4247743 - DNA, 16 bp, Homo sapiens
cgtgctccgcagggcg

SEQ ID NO: 4247744 - DNA, 13 bp, Homo sapiens
cgtggccaggagc

SEQ ID NO: 4247745 - DNA, 13 bp, Homo sapiens
cgttaaaatacca

SEQ ID NO: 4247746 - DNA, 21 bp, Homo sapiens
cgtttctaaaggctacctttg

SEQ ID NO: 4247747 - DNA, 17 bp, Homo sapiens
ctaaaggctacctttgt

SEQ ID NO: 4247748 - DNA, 15 bp, Homo sapiens
ctaaagtcctggccc

SEQ ID NO: 4247749 - DNA, 16 bp, Homo sapiens
ctaaataatgaataaa

SEQ ID NO: 4247750 - DNA, 17 bp, Homo sapiens
ctaaattctatgttaaa

SEQ ID NO: 4247751 - DNA, 16 bp, Homo sapiens
ctaaccagcagaaatg

SEQ ID NO: 4247752 - DNA, 17 bp, Homo sapiens
ctaaccagcagaaatgc

SEQ ID NO: 4247753 - DNA, 14 bp, Homo sapiens
ctaaccatttatat

SEQ ID NO: 4247754 - DNA, 11 bp, Homo sapiens
ctaagcccttt

SEQ ID NO: 4247755 - DNA, 22 bp, Homo sapiens
ctaagcgcacattcatgtgggc

SEQ ID NO: 4247756 - DNA, 19 bp, Homo sapiens
ctaattattattttaaaat

SEQ ID NO: 4247757 - DNA, 21 bp, Homo sapiens
ctacacactgcatgtttgtga

SEQ ID NO: 4247758 - DNA, 12 bp, Homo sapiens
ctacagaataat

SEQ ID NO: 4247759 - DNA, 13 bp, Homo sapiens
ctacattctgtta

SEQ ID NO: 4247760 - DNA, 17 bp, Homo sapiens
ctaccctcctgcactgt

SEQ ID NO: 4247761 - DNA, 17 bp, Homo sapiens
ctacctgcacctctgga

SEQ ID NO: 4247762 - DNA, 17 bp, Homo sapiens
ctacctttgtattctct

SEQ ID NO: 4247763 - DNA, 12 bp, Homo sapiens
ctactcctggag

SEQ ID NO: 4247764 - DNA, 17 bp, Homo sapiens
ctactgtaatttgtgat

SEQ ID NO: 4247765 - DNA, 20 bp, Homo sapiens
ctactgtacataaacaatga

SEQ ID NO: 4247766 - DNA, 21 bp, Homo sapiens
ctagaaaatttagccctttaa

SEQ ID NO: 4247767 - DNA, 14 bp, Homo sapiens
ctagaatgtaaagt

SEQ ID NO: 4247768 - DNA, 17 bp, Homo sapiens
ctagaggttcaaagata

SEQ ID NO: 4247769 - DNA, 16 bp, Homo sapiens
ctagcagacagaaact

SEQ ID NO: 4247770 - DNA, 16 bp, Homo sapiens
ctagcatacgtacaca

SEQ ID NO: 4247771 - DNA, 20 bp, Homo sapiens
ctagcatacgtacacatttt

SEQ ID NO: 4247772 - DNA, 15 bp, Homo sapiens
ctgcatgtttgtgat

SEQ ID NO: 4247773 - DNA, 17 bp, Homo sapiens
ctgcattcattctgagc

SEQ ID NO: 4247774 - DNA, 17 bp, Homo sapiens
ctgcatttaaaagatac

SEQ ID NO: 4247775 - DNA, 20 bp, Homo sapiens
ctgcatttaaaagatacagt

SEQ ID NO: 4247776 - DNA, 18 bp, Homo sapiens
ctgcattttcaccccacc

SEQ ID NO: 4247777 - DNA, 19 bp, Homo sapiens
ctgccgctttgtctgtcca

SEQ ID NO: 4247778 - DNA, 22 bp, Homo sapiens
ctgccgctttgtctgtccagcc

SEQ ID NO: 4247779 - DNA, 18 bp, Homo sapiens
ctgcctccaacccagcag

SEQ ID NO: 4247780 - DNA, 19 bp, Homo sapiens
ctgcctccaacccagcagt

SEQ ID NO: 4247781 - DNA, 12 bp, Homo sapiens
ctgcctggcagg

SEQ ID NO: 4247782 - DNA, 12 bp, Homo sapiens
ctgccttgctcc

SEQ ID NO: 4247783 - DNA, 23 bp, Homo sapiens
ctgcgctcttgggaccccagaga

SEQ ID NO: 4247784 - DNA, 17 bp, Homo sapiens
ctgctaaccatttatat

SEQ ID NO: 4247785 - DNA, 16 bp, Homo sapiens
ctgctagcaaatggca

SEQ ID NO: 4247786 - DNA, 15 bp, Homo sapiens
ctgctgggtggcagg

SEQ ID NO: 4247787 - DNA, 13 bp, Homo sapiens
ctgcttaacttca

SEQ ID NO: 4247788 - DNA, 19 bp, Homo sapiens
ctgcttcaatcccagccta

SEQ ID NO: 4247789 - DNA, 22 bp, Homo sapiens
ctgcttgagctttctgtgcatg

SEQ ID NO: 4247790 - DNA, 13 bp, Homo sapiens
ctggagcactgta

SEQ ID NO: 4247791 - DNA, 14 bp, Homo sapiens
ctggattaaaacaa

SEQ ID NO: 4247792 - DNA, 17 bp, Homo sapiens
ctggcccagccaaaccc

SEQ ID NO: 4247793 - DNA, 22 bp, Homo sapiens
ctggcccttctatttatttgac

SEQ ID NO: 4247794 - DNA, 23 bp, Homo sapiens
ctggcctagcatacgtacacatt

SEQ ID NO: 4247795 - DNA, 15 bp, Homo sapiens
ctgggaatacatctg

SEQ ID NO: 4247796 - DNA, 14 bp, Homo sapiens
ctggggcaggctgc

SEQ ID NO: 4247797 - DNA, 17 bp, Homo sapiens
ctggggtttagaacccc

SEQ ID NO: 4247798 - DNA, 20 bp, Homo sapiens
ctggggtttagaaccccagg

SEQ ID NO: 4247799 - DNA, 24 bp, Homo sapiens
ctggggtttagaaccccaggtgag

SEQ ID NO: 4247800 - DNA, 22 bp, Homo sapiens
ctgggtctcgctttgttgccca

SEQ ID NO: 4247801 - DNA, 22 bp, Homo sapiens
ccaattattgatatatattata

SEQ ID NO: 4247802 - DNA, 20 bp, Homo sapiens
ccaattccttgcacatagta

SEQ ID NO: 4247803 - DNA, 15 bp, Homo sapiens
ccacaaagagaccag

SEQ ID NO: 4247804 - DNA, 14 bp, Homo sapiens
ccacaccaagcagc

SEQ ID NO: 4247805 - DNA, 18 bp, Homo sapiens
ccacacccacctctgcca

SEQ ID NO: 4247806 - DNA, 14 bp, Homo sapiens
ccacccttcccctc

SEQ ID NO: 4247807 - DNA, 12 bp, Homo sapiens
ccacctctgcca

SEQ ID NO: 4247808 - DNA, 13 bp, Homo sapiens
ccacctctgccac

SEQ ID NO: 4247809 - DNA, 16 bp, Homo sapiens
ccacctgtctcagcct

SEQ ID NO: 4247810 - DNA, 20 bp, Homo sapiens
ccacctgtctcagcctccca

SEQ ID NO: 4247811 - DNA, 13 bp, Homo sapiens
ccacgtttctaaa

SEQ ID NO: 4247812 - DNA, 15 bp, Homo sapiens
ccacttcaggagccc

SEQ ID NO: 4247813 - DNA, 15 bp, Homo sapiens
ccactttgtaatttt

SEQ ID NO: 4247814 - DNA, 10 bp, Homo sapiens
ccagagcccc

SEQ ID NO: 4247815 - DNA, 21 bp, Homo sapiens
ccagagtcacaagtagcctct

SEQ ID NO: 4247816 - DNA, 12 bp, Homo sapiens
ccagagtggctg

SEQ ID NO: 4247817 - DNA, 22 bp, Homo sapiens
ccagcagaaatgccttaccctc

SEQ ID NO: 4247818 - DNA, 22 bp, Homo sapiens
ccagccctctgtggccaggagc

SEQ ID NO: 4247819 - DNA, 18 bp, Homo sapiens
ccagccgtgtgtgcatgt

SEQ ID NO: 4247820 - DNA, 17 bp, Homo sapiens
ccagctaatttttgtat

SEQ ID NO: 4247821 - DNA, 15 bp, Homo sapiens
ccaggagccatgaca

SEQ ID NO: 4247822 - DNA, 16 bp, Homo sapiens
ccaggagccctggccc

SEQ ID NO: 4247823 - DNA, 15 bp, Homo sapiens
ccagggagattttga

SEQ ID NO: 4247824 - DNA, 16 bp, Homo sapiens
ccaggtatcaaatcaa

SEQ ID NO: 4247825 - DNA, 15 bp, Homo sapiens
ccaggtgagacctca

SEQ ID NO: 4247826 - DNA, 23 bp, Homo sapiens
ccagtaaatgggggtgcatttga

SEQ ID NO: 4247827 - DNA, 22 bp, Homo sapiens
ccagtcccaatggtcctgactt

SEQ ID NO: 4247828 - DNA, 19 bp, Homo sapiens
ccagtgagtctctggggca

SEQ ID NO: 4247829 - DNA, 19 bp, Homo sapiens
ccagtgctaagctgccctg

SEQ ID NO: 4247830 - DNA, 22 bp, Homo sapiens
ccagtgctaagctgccctgagg

SEQ ID NO: 4247831 - DNA, 14 bp, Homo sapiens
ccagtgctcctggc

SEQ ID NO: 4247832 - DNA, 22 bp, Homo sapiens
ccagtgctgtccatgcttctca

SEQ ID NO: 4247833 - DNA, 22 bp, Homo sapiens
ccagtgttgtggatttaacaga

SEQ ID NO: 4247834 - DNA, 19 bp, Homo sapiens
ccagttggcccttctgccc

SEQ ID NO: 4247835 - DNA, 17 bp, Homo sapiens
ccatctctccctcccct

SEQ ID NO: 4247836 - DNA, 18 bp, Homo sapiens
ccatgggaaatgagccag

SEQ ID NO: 4247837 - DNA, 17 bp, Homo sapiens
ccattaaatgaatattt

SEQ ID NO: 4247838 - DNA, 19 bp, Homo sapiens
ccattaaatgaatattttg

SEQ ID NO: 4247839 - DNA, 14 bp, Homo sapiens
ccattctacacaga

SEQ ID NO: 4247840 - DNA, 22 bp, Homo sapiens
ccattttattaataatatttat

SEQ ID NO: 4247841 - DNA, 23 bp, Homo sapiens
cccaaattagggcaattggaaca

SEQ ID NO: 4247842 - DNA, 20 bp, Homo sapiens
cccaagccactagcccactc

SEQ ID NO: 4247843 - DNA, 14 bp, Homo sapiens
cccacacccacctc

SEQ ID NO: 4247844 - DNA, 12 bp, Homo sapiens
cccacccccatc

SEQ ID NO: 4247845 - DNA, 22 bp, Homo sapiens
cccacctatccgccctgcagca

SEQ ID NO: 4247846 - DNA, 21 bp, Homo sapiens
cccagagcccctcatgccaca

SEQ ID NO: 4247847 - DNA, 21 bp, Homo sapiens
cccagccctctgtggccagga

SEQ ID NO: 4247848 - DNA, 23 bp, Homo sapiens
cccagccctctgtggccaggagc

SEQ ID NO: 4247849 - DNA, 14 bp, Homo sapiens
cccagctaattttt

SEQ ID NO: 4247850 - DNA, 16 bp, Homo sapiens
cccaggctggtctcaa

SEQ ID NO: 4247851 - DNA, 22 bp, Homo sapiens
cccaggggaggtgtattgtgta

SEQ ID NO: 4247852 - DNA, 21 bp, Homo sapiens
cccagttggcccttctgccct

SEQ ID NO: 4247853 - DNA, 15 bp, Homo sapiens
cccatcccacaccct

SEQ ID NO: 4247854 - DNA, 13 bp, Homo sapiens
cccatctctccct

SEQ ID NO: 4247855 - DNA, 12 bp, Homo sapiens
ccccagagcccc

SEQ ID NO: 4247856 - DNA, 23 bp, Homo sapiens
ccccagccagatggactccagcc

SEQ ID NO: 4247857 - DNA, 17 bp, Homo sapiens
ccccagttggcccttct

SEQ ID NO: 4247858 - DNA, 16 bp, Homo sapiens
ccccatcccacaccct

SEQ ID NO: 4247859 - DNA, 19 bp, Homo sapiens
ccccatctctccctcccct

SEQ ID NO: 4247860 - DNA, 16 bp, Homo sapiens
cccccaaggccactgc

SEQ ID NO: 4247861 - DNA, 14 bp, Homo sapiens
ccccgttgtgcctg

SEQ ID NO: 4247862 - DNA, 18 bp, Homo sapiens
cccctctcacaggcagct

SEQ ID NO: 4247863 - DNA, 14 bp, Homo sapiens
cccgagctgtttat

SEQ ID NO: 4247864 - DNA, 18 bp, Homo sapiens
cccgcaagagggacagag

SEQ ID NO: 4247865 - DNA, 15 bp, Homo sapiens
cccgcgccaggccct

SEQ ID NO: 4247866 - DNA, 14 bp, Homo sapiens
cccggagcaagcag

SEQ ID NO: 4247867 - DNA, 13 bp, Homo sapiens
cccggcagtgcac

SEQ ID NO: 4247868 - DNA, 14 bp, Homo sapiens
cccggtgcatctgg

SEQ ID NO: 4247869 - DNA, 17 bp, Homo sapiens
ccctctgtggccaggag

SEQ ID NO: 4247870 - DNA, 18 bp, Homo sapiens
ccctctgtggccaggagc

SEQ ID NO: 4247871 - DNA, 19 bp, Homo sapiens
ccctctgtggccaggagcc

SEQ ID NO: 4247872 - DNA, 23 bp, Homo sapiens
ccctctgtggccaggagccctgg

SEQ ID NO: 4247873 - DNA, 16 bp, Homo sapiens
ccctgcagcagaacct

SEQ ID NO: 4247874 - DNA, 14 bp, Homo sapiens
ccctgcagggccgg

SEQ ID NO: 4247875 - DNA, 17 bp, Homo sapiens
ccctgctgacctcccac

SEQ ID NO: 4247876 - DNA, 14 bp, Homo sapiens
cccttccctggagg

SEQ ID NO: 4247877 - DNA, 20 bp, Homo sapiens
cccttcctgtccccagggga

SEQ ID NO: 4247878 - DNA, 19 bp, Homo sapiens
ccgaggaatgtgaagccag

SEQ ID NO: 4247879 - DNA, 18 bp, Homo sapiens
ccgaggtgttgccagtgc

SEQ ID NO: 4247880 - DNA, 20 bp, Homo sapiens
ccgcagggcgcccagcgccg

SEQ ID NO: 4247881 - DNA, 22 bp, Homo sapiens
ccgcgaaacccggtgcatctgg

SEQ ID NO: 4247882 - DNA, 22 bp, Homo sapiens
ccgctttggttttttgtttggt

SEQ ID NO: 4247883 - DNA, 16 bp, Homo sapiens
ccgctttgtctgtcca

SEQ ID NO: 4247884 - DNA, 17 bp, Homo sapiens
ccgctttgtctgtccag

SEQ ID NO: 4247885 - DNA, 21 bp, Homo sapiens
ccggaagaaccagaagtgcag

SEQ ID NO: 4247886 - DNA, 15 bp, Homo sapiens
ccggagaggtggccg

SEQ ID NO: 4247887 - DNA, 14 bp, Homo sapiens
ccggagcgccctgc

SEQ ID NO: 4247888 - DNA, 17 bp, Homo sapiens
ccggagcgccctgcagg

SEQ ID NO: 4247889 - DNA, 20 bp, Homo sapiens
ccggagcgccctgcagggcc

SEQ ID NO: 4247890 - DNA, 17 bp, Homo sapiens
ccggagggcaggaccct

SEQ ID NO: 4247891 - DNA, 23 bp, Homo sapiens
ccggctcgagcagtcctgcctca

SEQ ID NO: 4247892 - DNA, 17 bp, Homo sapiens
ccgggagactgccagtg

SEQ ID NO: 4247893 - DNA, 14 bp, Homo sapiens
ccgggcgcagccct

SEQ ID NO: 4247894 - DNA, 12 bp, Homo sapiens
ccgtgcttgctg

SEQ ID NO: 4247895 - DNA, 14 bp, Homo sapiens
ccgtgtgtgcatgt

SEQ ID NO: 4247896 - DNA, 12 bp, Homo sapiens
ccgttattaaaa

SEQ ID NO: 4247897 - DNA, 14 bp, Homo sapiens
cctaaagtgtattt

SEQ ID NO: 4247898 - DNA, 22 bp, Homo sapiens
cctaatggcatggagactctga

SEQ ID NO: 4247899 - DNA, 23 bp, Homo sapiens
cttgctcctagcagacagaaact

SEQ ID NO: 4247900 - DNA, 15 bp, Homo sapiens
cttgctggtgcctct

SEQ ID NO: 4247901 - DNA, 20 bp, Homo sapiens
cttgggtcctactcctggag

SEQ ID NO: 4247902 - DNA, 19 bp, Homo sapiens
cttgtacataatgcgtgca

SEQ ID NO: 4247903 - DNA, 18 bp, Homo sapiens
cttgtcaggcatggctca

SEQ ID NO: 4247904 - DNA, 15 bp, Homo sapiens
cttgtgaatgcttct

SEQ ID NO: 4247905 - DNA, 22 bp, Homo sapiens
cttgtggaggagggagagccct

SEQ ID NO: 4247906 - DNA, 14 bp, Homo sapiens
cttgttccctctcc

SEQ ID NO: 4247907 - DNA, 19 bp, Homo sapiens
cttgtttattgagtttgta

SEQ ID NO: 4247908 - DNA, 12 bp, Homo sapiens
ctttaatacagc

SEQ ID NO: 4247909 - DNA, 20 bp, Homo sapiens
ctttaccttttttatacata

SEQ ID NO: 4247910 - DNA, 17 bp, Homo sapiens
ctttactctgtgtttaa

SEQ ID NO: 4247911 - DNA, 13 bp, Homo sapiens
ctttatcttttca

SEQ ID NO: 4247912 - DNA, 13 bp, Homo sapiens
ctttcatctccca

SEQ ID NO: 4247913 - DNA, 22 bp, Homo sapiens
ctttccaaagtacactgtttca

SEQ ID NO: 4247914 - DNA, 19 bp, Homo sapiens
ctttcctgatgatgctggc

SEQ ID NO: 4247915 - DNA, 23 bp, Homo sapiens
ctttctacaaagcactagagaat

SEQ ID NO: 4247916 - DNA, 17 bp, Homo sapiens
ctttctggctatgcatt

SEQ ID NO: 4247917 - DNA, 19 bp, Homo sapiens
ctttctggctatgcatttg

SEQ ID NO: 4247918 - DNA, 20 bp, Homo sapiens
ctttgaaacctgctctgtag

SEQ ID NO: 4247919 - DNA, 14 bp, Homo sapiens
ctttgacctctgca

SEQ ID NO: 4247920 - DNA, 18 bp, Homo sapiens
ctttgacctctgcagcaa

SEQ ID NO: 4247921 - DNA, 20 bp, Homo sapiens
ctttgacctctgcagcaata

SEQ ID NO: 4247922 - DNA, 24 bp, Homo sapiens
ctttgacctctgcagcaataaagc

SEQ ID NO: 4247923 - DNA, 13 bp, Homo sapiens
ctttgattctcct

SEQ ID NO: 4247924 - DNA, 22 bp, Homo sapiens
ctttgattctccttttatgtgt

SEQ ID NO: 4247925 - DNA, 21 bp, Homo sapiens
ctttgtaaatgcatattaaat

SEQ ID NO: 4247926 - DNA, 17 bp, Homo sapiens
ctttgtattctctcctg

SEQ ID NO: 4247927 - DNA, 14 bp, Homo sapiens
ctttgtgatttttg

SEQ ID NO: 4247928 - DNA, 19 bp, Homo sapiens
ctttgtgatttttgtaatt

SEQ ID NO: 4247929 - DNA, 15 bp, Homo sapiens
ctttgtttcttgttt

SEQ ID NO: 4247930 - DNA, 22 bp, Homo sapiens
cttttaccgttggggcccttaa

SEQ ID NO: 4247931 - DNA, 23 bp, Homo sapiens
cttttaccgttggggcccttaac

SEQ ID NO: 4247932 - DNA, 22 bp, Homo sapiens
ttaaaacaataatgcaattaga

SEQ ID NO: 4247933 - DNA, 21 bp, Homo sapiens
ttaaaacaattttttttttcc

SEQ ID NO: 4247934 - DNA, 15 bp, Homo sapiens
ttaaaacactaaaag

SEQ ID NO: 4247935 - DNA, 17 bp, Homo sapiens
ttaaaagatacagttac

SEQ ID NO: 4247936 - DNA, 20 bp, Homo sapiens
ttaaaatatatgaagacaat

SEQ ID NO: 4247937 - DNA, 13 bp, Homo sapiens
ttaaaattcagtt

SEQ ID NO: 4247938 - DNA, 21 bp, Homo sapiens
ttaaaattcagtttttgtatc

SEQ ID NO: 4247939 - DNA, 20 bp, Homo sapiens
ttaaactaaataatgaataa

SEQ ID NO: 4247940 - DNA, 18 bp, Homo sapiens
ttaaataatgtgaaactg

SEQ ID NO: 4247941 - DNA, 20 bp, Homo sapiens
ttaaataatgtgaaactgga

SEQ ID NO: 4247942 - DNA, 18 bp, Homo sapiens
ttaaatactgtgcagaat

SEQ ID NO: 4247943 - DNA, 19 bp, Homo sapiens
ttaaatactgtgcagaata

SEQ ID NO: 4247944 - DNA, 20 bp, Homo sapiens
ttaaatactgtgcagaataa

SEQ ID NO: 4247945 - DNA, 23 bp, Homo sapiens
ttaaatcacagcccaaaatttga

SEQ ID NO: 4247946 - DNA, 13 bp, Homo sapiens
ttaaatcatgtat

SEQ ID NO: 4247947 - DNA, 15 bp, Homo sapiens
ttaaatcatgtatgt

SEQ ID NO: 4247948 - DNA, 21 bp, Homo sapiens
ttaaatcatgtatgttatgat

SEQ ID NO: 4247949 - DNA, 17 bp, Homo sapiens
ttaaatgcaataatttt

SEQ ID NO: 4247950 - DNA, 19 bp, Homo sapiens
ttaaatgcaataattttac

SEQ ID NO: 4247951 - DNA, 23 bp, Homo sapiens
ttaaatgtaatataatgtatttt

SEQ ID NO: 4247952 - DNA, 13 bp, Homo sapiens
ttaaattcttgca

SEQ ID NO: 4247953 - DNA, 16 bp, Homo sapiens
ttaaattcttgcaaag

SEQ ID NO: 4247954 - DNA, 23 bp, Homo sapiens
ttaaccttaaaattaagatttcc

SEQ ID NO: 4247955 - DNA, 15 bp, Homo sapiens
ttaaccttaaaattg

SEQ ID NO: 4247956 - DNA, 16 bp, Homo sapiens
ttaacttcacatattg

SEQ ID NO: 4247957 - DNA, 12 bp, Homo sapiens
ttaacttttata

SEQ ID NO: 4247958 - DNA, 13 bp, Homo sapiens
ttaacttttataa

SEQ ID NO: 4247959 - DNA, 16 bp, Homo sapiens
ttaacttttataaact

SEQ ID NO: 4247960 - DNA, 23 bp, Homo sapiens
ttaacttttataaactttacctt

SEQ ID NO: 4247961 - DNA, 19 bp, Homo sapiens
ttaagaaaaaggatgcaca

SEQ ID NO: 4247962 - DNA, 21 bp, Homo sapiens
ttaagaaaaaggatgcacaga

SEQ ID NO: 4247963 - DNA, 13 bp, Homo sapiens
ttaagatattgaa

SEQ ID NO: 4247964 - DNA, 14 bp, Homo sapiens
ttaaggaatttgat

SEQ ID NO: 4247965 - DNA, 20 bp, Homo sapiens
ttaaggatgcttgtacataa

SEQ ID NO: 4247966 - DNA, 21 bp, Homo sapiens
ttaagtcagatttttatttat

SEQ ID NO: 4247967 - DNA, 14 bp, Homo sapiens
ttaagtgctgcatt

SEQ ID NO: 4247968 - DNA, 16 bp, Homo sapiens
ttaagtgctgcattta

SEQ ID NO: 4247969 - DNA, 19 bp, Homo sapiens
ttaagtgctgcatttaaaa

SEQ ID NO: 4247970 - DNA, 13 bp, Homo sapiens
ttaataatgtatt

SEQ ID NO: 4247971 - DNA, 14 bp, Homo sapiens
ttaataatgtattg

SEQ ID NO: 4247972 - DNA, 22 bp, Homo sapiens
ttaataatgtattgtaatcttt

SEQ ID NO: 4247973 - DNA, 22 bp, Homo sapiens
ttaatatcaaaagaaaattgat

SEQ ID NO: 4247974 - DNA, 23 bp, Homo sapiens
ttaatcattaggtgtgactgaat

SEQ ID NO: 4247975 - DNA, 18 bp, Homo sapiens
ttaatctgtgtgtatatt

SEQ ID NO: 4247976 - DNA, 21 bp, Homo sapiens
ttaattcacagaatagcacaa

SEQ ID NO: 4247977 - DNA, 15 bp, Homo sapiens
ttacaagatattatt

SEQ ID NO: 4247978 - DNA, 12 bp, Homo sapiens
ttacatttttaa

SEQ ID NO: 4247979 - DNA, 17 bp, Homo sapiens
ttacatttttaagtgct

SEQ ID NO: 4247980 - DNA, 23 bp, Homo sapiens
ttacatttttaagtgctgcattt

SEQ ID NO: 4247981 - DNA, 14 bp, Homo sapiens
ttaccaagagtaac

SEQ ID NO: 4247982 - DNA, 21 bp, Homo sapiens
ttaccatttgctactgtacat

SEQ ID NO: 4247983 - DNA, 23 bp, Homo sapiens
ttacctcctaatggcatggagac

SEQ ID NO: 4247984 - DNA, 20 bp, Homo sapiens
ttaccttttttatacataaa

SEQ ID NO: 4247985 - DNA, 14 bp, Homo sapiens
ttactaagttttta

SEQ ID NO: 4247986 - DNA, 14 bp, Homo sapiens
ttactgaattgtat

SEQ ID NO: 4247987 - DNA, 16 bp, Homo sapiens
ttactggactgtctga

SEQ ID NO: 4247988 - DNA, 16 bp, Homo sapiens
ttagaccgctctcttt

SEQ ID NO: 4247989 - DNA, 22 bp, Homo sapiens
ttagaccgctctcttttctgta

SEQ ID NO: 4247990 - DNA, 16 bp, Homo sapiens
ttagagcatctctgcc

SEQ ID NO: 4247991 - DNA, 22 bp, Homo sapiens
ttagataatacaccactacatt

SEQ ID NO: 4247992 - DNA, 16 bp, Homo sapiens
ttaggaaaggagatca

SEQ ID NO: 4247993 - DNA, 20 bp, Homo sapiens
ttagggaaggatacaaaagc

SEQ ID NO: 4247994 - DNA, 21 bp, Homo sapiens
ttaggtgtgactgaatttctt

SEQ ID NO: 4247995 - DNA, 17 bp, Homo sapiens
ttataaactttaccttt

SEQ ID NO: 4247996 - DNA, 19 bp, Homo sapiens
ttataaatatatataaaga

SEQ ID NO: 4247997 - DNA, 12 bp, Homo sapiens
ttatatcttttg

SEQ ID NO: 4247998 - DNA, 17 bp, Homo sapiens
ttatattagtgaagatg

SEQ ID NO: 4247999 - DNA, 23 bp, Homo sapiens
ttatattagtgaagatggtttca

SEQ ID NO: 4248000 - DNA, 17 bp, Homo sapiens
ttatcacccagaagaaa

SEQ ID NO: 4248001 - DNA, 12 bp, Homo sapiens
ttatctgtcaca

SEQ ID NO: 4248002 - DNA, 21 bp, Homo sapiens
ttatggagacctctccttcct

SEQ ID NO: 4248003 - DNA, 16 bp, Homo sapiens
ttatggcttttgtgca

SEQ ID NO: 4248004 - DNA, 18 bp, Homo sapiens
ttatggcttttgtgcatt

SEQ ID NO: 4248005 - DNA, 19 bp, Homo sapiens
ttatgttgggtcaagtgtt

SEQ ID NO: 4248006 - DNA, 23 bp, Homo sapiens
ttattaaaaatctcaaatttcta

SEQ ID NO: 4248007 - DNA, 12 bp, Homo sapiens
ttattatgcatg

SEQ ID NO: 4248008 - DNA, 15 bp, Homo sapiens
ttattcaaatttgat

SEQ ID NO: 4248009 - DNA, 23 bp, Homo sapiens
ttattcaaatttgatgatgttaa

SEQ ID NO: 4248010 - DNA, 17 bp, Homo sapiens
ttattgcttattgctta

SEQ ID NO: 4248011 - DNA, 12 bp, Homo sapiens
ttattgttgaac

SEQ ID NO: 4248012 - DNA, 14 bp, Homo sapiens
ttattgttgaacat

SEQ ID NO: 4248013 - DNA, 19 bp, Homo sapiens
ttatttgactatgaatgtt

SEQ ID NO: 4248014 - DNA, 18 bp, Homo sapiens
ttattttaaaatatatga

SEQ ID NO: 4248015 - DNA, 20 bp, Homo sapiens
ttattttaaaatatatgaag

SEQ ID NO: 4248016 - DNA, 12 bp, Homo sapiens
ttatttttgcca

SEQ ID NO: 4248017 - DNA, 15 bp, Homo sapiens
ttcaaaaaaatctat

SEQ ID NO: 4248018 - DNA, 23 bp, Homo sapiens
ttcaactgtgctcttgttttgtc

SEQ ID NO: 4248019 - DNA, 22 bp, Homo sapiens
ttcaagtaagtagatgcctgtt

SEQ ID NO: 4248020 - DNA, 16 bp, Homo sapiens
ttcaatgtgcataatg

SEQ ID NO: 4248021 - DNA, 21 bp, Homo sapiens
ttcaattcagattgtcttgca

SEQ ID NO: 4248022 - DNA, 22 bp, Homo sapiens
ttcacagaccaagtccaagccc

SEQ ID NO: 4248023 - DNA, 13 bp, Homo sapiens
ttcacaggcactc

SEQ ID NO: 4248024 - DNA, 13 bp, Homo sapiens
ttcagaaatgtgt

SEQ ID NO: 4248025 - DNA, 13 bp, Homo sapiens
ttcagtttttgta

SEQ ID NO: 4248026 - DNA, 14 bp, Homo sapiens
ttcattcattcact

SEQ ID NO: 4248027 - DNA, 15 bp, Homo sapiens
ttccaatatttctgc

SEQ ID NO: 4248028 - DNA, 14 bp, Homo sapiens
ttcccccactaccg

SEQ ID NO: 4248029 - DNA, 18 bp, Homo sapiens
ttcccctccttctccctt

SEQ ID NO: 4248030 - DNA, 14 bp, Homo sapiens
ttccctctccctgt

SEQ ID NO: 4248031 - DNA, 16 bp, Homo sapiens
ttccgttaaaatacca

SEQ ID NO: 4248032 - DNA, 15 bp, Homo sapiens
ttcctgatgatgctg

SEQ ID NO: 4248033 - DNA, 15 bp, Homo sapiens
ttccttcattcatag

SEQ ID NO: 4248034 - DNA, 16 bp, Homo sapiens
ttccttcattcatagg

SEQ ID NO: 4248035 - DNA, 20 bp, Homo sapiens
ttcgcccgagctgtttatgt

SEQ ID NO: 4248036 - DNA, 16 bp, Homo sapiens
ttctaaaggctacctt

SEQ ID NO: 4248037 - DNA, 18 bp, Homo sapiens
ttctaaaggctacctttg

SEQ ID NO: 4248038 - DNA, 15 bp, Homo sapiens
ttctacacagagcag

SEQ ID NO: 4248039 - DNA, 13 bp, Homo sapiens
ttctacagaataa

SEQ ID NO: 4248040 - DNA, 23 bp, Homo sapiens
ttctaggcacaaggttggttgct

SEQ ID NO: 4248041 - DNA, 17 bp, Homo sapiens
ttctatgacacatgcaa

SEQ ID NO: 4248042 - DNA, 15 bp, Homo sapiens
ttctatgttaaatac

SEQ ID NO: 4248043 - DNA, 19 bp, Homo sapiens
ttctatgttaaatactgtg

SEQ ID NO: 4248044 - DNA, 18 bp, Homo sapiens
ttctcaaagttaattcac

SEQ ID NO: 4248045 - DNA, 13 bp, Homo sapiens
ttctcctgaatat

SEQ ID NO: 4248046 - DNA, 14 bp, Homo sapiens
ttctctcctgtacc

SEQ ID NO: 4248047 - DNA, 22 bp, Homo sapiens
ttctctcctgtacctcttgagc

SEQ ID NO: 4248048 - DNA, 19 bp, Homo sapiens
gctcttatgtgtgcctttg

SEQ ID NO: 4248049 - DNA, 20 bp, Homo sapiens
gctgaagtcaaaatatgtaa

SEQ ID NO: 4248050 - DNA, 15 bp, Homo sapiens
gctgagtaaacataa

SEQ ID NO: 4248051 - DNA, 14 bp, Homo sapiens
gctgccccagccag

SEQ ID NO: 4248052 - DNA, 19 bp, Homo sapiens
gctgccgggagactgccag

SEQ ID NO: 4248053 - DNA, 13 bp, Homo sapiens
gctgctgggtggc

SEQ ID NO: 4248054 - DNA, 19 bp, Homo sapiens
gctgctgggtggcaggggg

SEQ ID NO: 4248055 - DNA, 19 bp, Homo sapiens
gctggccgcctgcagcccg

SEQ ID NO: 4248056 - DNA, 20 bp, Homo sapiens
gctgggaatacatctgtgga

SEQ ID NO: 4248057 - DNA, 18 bp, Homo sapiens
gctggtaacagtggctgc

SEQ ID NO: 4248058 - DNA, 23 bp, Homo sapiens
gctggtgcctcttttcagtagtg

SEQ ID NO: 4248059 - DNA, 15 bp, Homo sapiens
gctgtccgtgcttgc

SEQ ID NO: 4248060 - DNA, 12 bp, Homo sapiens
gcttaaactaaa

SEQ ID NO: 4248061 - DNA, 18 bp, Homo sapiens
gcttattgcttagtaaaa

SEQ ID NO: 4248062 - DNA, 18 bp, Homo sapiens
gcttctcatcttgtgaaa

SEQ ID NO: 4248063 - DNA, 13 bp, Homo sapiens
gcttctccccaga

SEQ ID NO: 4248064 - DNA, 18 bp, Homo sapiens
gcttcttcacaggcactc

SEQ ID NO: 4248065 - DNA, 13 bp, Homo sapiens
gcttgattttaat

SEQ ID NO: 4248066 - DNA, 19 bp, Homo sapiens
gcttgggaggggccggagg

SEQ ID NO: 4248067 - DNA, 22 bp, Homo sapiens
gcttgggtcctactcctggagc

SEQ ID NO: 4248068 - DNA, 12 bp, Homo sapiens
gcttgtacataa

SEQ ID NO: 4248069 - DNA, 14 bp, Homo sapiens
gcttgtacataatg

SEQ ID NO: 4248070 - DNA, 16 bp, Homo sapiens
gctttatcttttcata

SEQ ID NO: 4248071 - DNA, 20 bp, Homo sapiens
gctttcccagtcccattcct

SEQ ID NO: 4248072 - DNA, 14 bp, Homo sapiens
gctttctgtgcatg

SEQ ID NO: 4248073 - DNA, 19 bp, Homo sapiens
gctttctgtgcatgtgcag

SEQ ID NO: 4248074 - DNA, 17 bp, Homo sapiens
gctttctttgattctcc

SEQ ID NO: 4248075 - DNA, 16 bp, Homo sapiens
gctttgagaggctgag

SEQ ID NO: 4248076 - DNA, 18 bp, Homo sapiens
ggaaaaccatctctgtga

SEQ ID NO: 4248077 - DNA, 18 bp, Homo sapiens
ggaaacattacagttcat

SEQ ID NO: 4248078 - DNA, 14 bp, Homo sapiens
ggaaaggttttgta

SEQ ID NO: 4248079 - DNA, 11 bp, Homo sapiens
ggaaatacagt

SEQ ID NO: 4248080 - DNA, 14 bp, Homo sapiens
ggaacagcctgagc

SEQ ID NO: 4248081 - DNA, 15 bp, Homo sapiens
ggaacagcctgagcc

SEQ ID NO: 4248082 - DNA, 16 bp, Homo sapiens
ggaacagcctgagccg

SEQ ID NO: 4248083 - DNA, 19 bp, Homo sapiens
ggaaccaaagctggcccag

SEQ ID NO: 4248084 - DNA, 15 bp, Homo sapiens
ggaagaaccagaagt

SEQ ID NO: 4248085 - DNA, 12 bp, Homo sapiens
ggaagccgcgcg

SEQ ID NO: 4248086 - DNA, 17 bp, Homo sapiens
ggaagggcgggcaagga

SEQ ID NO: 4248087 - DNA, 22 bp, Homo sapiens
ggaatctaatatccccaaatta

SEQ ID NO: 4248088 - DNA, 23 bp, Homo sapiens
ggaatttcttttccttcattcat

SEQ ID NO: 4248089 - DNA, 13 bp, Homo sapiens
ggacagagcccgg

SEQ ID NO: 4248090 - DNA, 14 bp, Homo sapiens
ggaccgggcgcagc

SEQ ID NO: 4248091 - DNA, 18 bp, Homo sapiens
ggggtgtttgggagctgc

SEQ ID NO: 4248092 - DNA, 15 bp, Homo sapiens
gggtgaagtgcctgc

SEQ ID NO: 4248093 - DNA, 17 bp, Homo sapiens
gggtgaagtgcctgctg

SEQ ID NO: 4248094 - DNA, 16 bp, Homo sapiens
gggtgatgagacctgg

SEQ ID NO: 4248095 - DNA, 17 bp, Homo sapiens
gggtggagggaaggtga

SEQ ID NO: 4248096 - DNA, 19 bp, Homo sapiens
gggtgtggagaccaggctc

SEQ ID NO: 4248097 - DNA, 20 bp, Homo sapiens
gggtttagaaccccaggtga

SEQ ID NO: 4248098 - DNA, 12 bp, Homo sapiens
gggtttgagaca

SEQ ID NO: 4248099 - DNA, 15 bp, Homo sapiens
ggtaaaatgtatttt

SEQ ID NO: 4248100 - DNA, 17 bp, Homo sapiens
ggtaaaatgtatttttc

SEQ ID NO: 4248101 - DNA, 18 bp, Homo sapiens
ggtacaactgtatttatt

SEQ ID NO: 4248102 - DNA, 12 bp, Homo sapiens
ggtactctgtgt

SEQ ID NO: 4248103 - DNA, 20 bp, Homo sapiens
ggtagatgcatgacttgtgt

SEQ ID NO: 4248104 - DNA, 18 bp, Homo sapiens
ggtcctactcctggagca

SEQ ID NO: 4248105 - DNA, 19 bp, Homo sapiens
ggtctcacagtgttgccca

SEQ ID NO: 4248106 - DNA, 19 bp, Homo sapiens
ggtctcgctttgttgccca

SEQ ID NO: 4248107 - DNA, 21 bp, Homo sapiens
ggtctcgctttgttgcccagg

SEQ ID NO: 4248108 - DNA, 17 bp, Homo sapiens
ggtctgttctttccaaa

SEQ ID NO: 4248109 - DNA, 18 bp, Homo sapiens
ggtgaagtgaagacaatg

SEQ ID NO: 4248110 - DNA, 17 bp, Homo sapiens
ggtgaagtgcctgctgg

SEQ ID NO: 4248111 - DNA, 15 bp, Homo sapiens
ggtgatgagacctgg

SEQ ID NO: 4248112 - DNA, 13 bp, Homo sapiens
ggtgcagacgcgg

SEQ ID NO: 4248113 - DNA, 18 bp, Homo sapiens
ggtgcagacgcggcgggg

SEQ ID NO: 4248114 - DNA, 13 bp, Homo sapiens
ggtgcatctggca

SEQ ID NO: 4248115 - DNA, 22 bp, Homo sapiens
ggtgcccgcgccaggccctcag

SEQ ID NO: 4248116 - DNA, 19 bp, Homo sapiens
ggtgcgcacttacctgctt

SEQ ID NO: 4248117 - DNA, 17 bp, Homo sapiens
ggtggcaatgcttaaac

SEQ ID NO: 4248118 - DNA, 23 bp, Homo sapiens
ggtggcccggaagaaccagaagt

SEQ ID NO: 4248119 - DNA, 18 bp, Homo sapiens
ggtggtttcagaaatgtg

SEQ ID NO: 4248120 - DNA, 18 bp, Homo sapiens
ggtgtactctaggacttc

SEQ ID NO: 4248121 - DNA, 23 bp, Homo sapiens
ggtgtactctaggacttcaaagt

SEQ ID NO: 4248122 - DNA, 15 bp, Homo sapiens
ggtgtatataatttt

SEQ ID NO: 4248123 - DNA, 17 bp, Homo sapiens
ggtgtattgtgtatgta

SEQ ID NO: 4248124 - DNA, 10 bp, Homo sapiens
ggtgtatttt

SEQ ID NO: 4248125 - DNA, 18 bp, Homo sapiens
ggttgaaaatgtgtttgc

SEQ ID NO: 4248126 - DNA, 20 bp, Homo sapiens
ggttgaaaatgtgtttgctg

SEQ ID NO: 4248127 - DNA, 21 bp, Homo sapiens
ggtttcaattcagattgtctt

SEQ ID NO: 4248128 - DNA, 15 bp, Homo sapiens
ggtttcagaaatgtg

SEQ ID NO: 4248129 - DNA, 13 bp, Homo sapiens
ggtttgagacaga

SEQ ID NO: 4248130 - DNA, 22 bp, Homo sapiens
ggtttgagattgccccaggtct

SEQ ID NO: 4248131 - DNA, 18 bp, Homo sapiens
gtaaaatgtatttttcta

SEQ ID NO: 4248132 - DNA, 17 bp, Homo sapiens
gtaaactggaattaaaa

SEQ ID NO: 4248133 - DNA, 18 bp, Homo sapiens
gtaaactggaattaaaag

SEQ ID NO: 4248134 - DNA, 14 bp, Homo sapiens
gtaaatatatatgg

SEQ ID NO: 4248135 - DNA, 18 bp, Homo sapiens
gtaaatgggggtgcattt

SEQ ID NO: 4248136 - DNA, 10 bp, Homo sapiens
aaaaaataca

SEQ ID NO: 4248137 - DNA, 22 bp, Homo sapiens
aaaaagctaatccctaaaatag

SEQ ID NO: 4248138 - DNA, 21 bp, Homo sapiens
aaaaaggatgcacagagttgt

SEQ ID NO: 4248139 - DNA, 19 bp, Homo sapiens
aaaaatctcaaatttctaa

SEQ ID NO: 4248140 - DNA, 20 bp, Homo sapiens
aaaacaagtcatttttgtat

SEQ ID NO: 4248141 - DNA, 20 bp, Homo sapiens
aaaacaattttctgtaatct

SEQ ID NO: 4248142 - DNA, 12 bp, Homo sapiens
aaaacacatttt

SEQ ID NO: 4248143 - DNA, 15 bp, Homo sapiens
aaaacacatttttct

SEQ ID NO: 4248144 - DNA, 17 bp, Homo sapiens
aaaacacatttttctta

SEQ ID NO: 4248145 - DNA, 13 bp, Homo sapiens
aaaacatgctaca

SEQ ID NO: 4248146 - DNA, 15 bp, Homo sapiens
aaaactaagcacaaa

SEQ ID NO: 4248147 - DNA, 16 bp, Homo sapiens
aaaactcttaatctgt

SEQ ID NO: 4248148 - DNA, 18 bp, Homo sapiens
aaatattttttgcaagtt

SEQ ID NO: 4248149 - DNA, 19 bp, Homo sapiens
aaatctcaaatttctaaat

SEQ ID NO: 4248150 - DNA, 14 bp, Homo sapiens
aaatgaatattttg

SEQ ID NO: 4248151 - DNA, 15 bp, Homo sapiens
aaatgaatattttga

SEQ ID NO: 4248152 - DNA, 19 bp, Homo sapiens
aaatgaatattttgataat

SEQ ID NO: 4248153 - DNA, 19 bp, Homo sapiens
aaatgaattgaaaaacaat

SEQ ID NO: 4248154 - DNA, 14 bp, Homo sapiens
aaatgcaataattt

SEQ ID NO: 4248155 - DNA, 15 bp, Homo sapiens
aaatgcaataatttt

SEQ ID NO: 4248156 - DNA, 22 bp, Homo sapiens
aaatgcacctggaatatataac

SEQ ID NO: 4248157 - DNA, 19 bp, Homo sapiens
aaatgcttaaaaaataata

SEQ ID NO: 4248158 - DNA, 15 bp, Homo sapiens
aaatgggaaaaaact

SEQ ID NO: 4248159 - DNA, 16 bp, Homo sapiens
aaatgggggtgcattt

SEQ ID NO: 4248160 - DNA, 17 bp, Homo sapiens
aaatgggggtgcatttg

SEQ ID NO: 4248161 - DNA, 18 bp, Homo sapiens
aaatgggggtgcatttga

SEQ ID NO: 4248162 - DNA, 21 bp, Homo sapiens
aaatgggtgtatataatttta

SEQ ID NO: 4248163 - DNA, 10 bp, Homo sapiens
aaatgtattt

SEQ ID NO: 4248164 - DNA, 15 bp, Homo sapiens
aaatgtatttttcta

SEQ ID NO: 4248165 - DNA, 12 bp, Homo sapiens
aaattaactttt

SEQ ID NO: 4248166 - DNA, 18 bp, Homo sapiens
aaattcagtttttgtatc

SEQ ID NO: 4248167 - DNA, 19 bp, Homo sapiens
aaattcagtttttgtatct

SEQ ID NO: 4248168 - DNA, 20 bp, Homo sapiens
aaattcagtttttgtatctt

SEQ ID NO: 4248169 - DNA, 12 bp, Homo sapiens
aaattctatgtt

SEQ ID NO: 4248170 - DNA, 15 bp, Homo sapiens
aaattctatgttaaa

SEQ ID NO: 4248171 - DNA, 20 bp, Homo sapiens
aaattctatgttaaatactg

SEQ ID NO: 4248172 - DNA, 21 bp, Homo sapiens
aaattctatgttaaatactgt

SEQ ID NO: 4248173 - DNA, 15 bp, Homo sapiens
aaattcttgcaaagt

SEQ ID NO: 4248174 - DNA, 15 bp, Homo sapiens
aaattgaaataaata

SEQ ID NO: 4248175 - DNA, 22 bp, Homo sapiens
aaattgtgcttctccccagaat

SEQ ID NO: 4248176 - DNA, 12 bp, Homo sapiens
aaatttaaaatt

SEQ ID NO: 4248177 - DNA, 13 bp, Homo sapiens
aaatttaaaatta

SEQ ID NO: 4248178 - DNA, 15 bp, Homo sapiens
aaatttgatgatgtt

SEQ ID NO: 4248179 - DNA, 18 bp, Homo sapiens
aaattttgatgttttaag

SEQ ID NO: 4248180 - DNA, 16 bp, Homo sapiens
aacaagaccacgtttc

SEQ ID NO: 4248181 - DNA, 19 bp, Homo sapiens
aacaagaccacgtttctaa

SEQ ID NO: 4248182 - DNA, 22 bp, Homo sapiens
aacaagagaaaagaaaaatcaa

SEQ ID NO: 4248183 - DNA, 20 bp, Homo sapiens
aacaattttctgtaatcttt

SEQ ID NO: 4248184 - DNA, 14 bp, Homo sapiens
acattttttaaatg

SEQ ID NO: 4248185 - DNA, 15 bp, Homo sapiens
accaagagtaacttt

SEQ ID NO: 4248186 - DNA, 14 bp, Homo sapiens
accaattattgata

SEQ ID NO: 4248187 - DNA, 17 bp, Homo sapiens
accaccttttattacat

SEQ ID NO: 4248188 - DNA, 14 bp, Homo sapiens
accacgtccagctg

SEQ ID NO: 4248189 - DNA, 15 bp, Homo sapiens
accacgtttctaaag

SEQ ID NO: 4248190 - DNA, 14 bp, Homo sapiens
accactacattctg

SEQ ID NO: 4248191 - DNA, 11 bp, Homo sapiens
accacttttgg

SEQ ID NO: 4248192 - DNA, 12 bp, Homo sapiens
accacttttgtt

SEQ ID NO: 4248193 - DNA, 16 bp, Homo sapiens
accagaggtgcttctg

SEQ ID NO: 4248194 - DNA, 13 bp, Homo sapiens
accagcagaaatg

SEQ ID NO: 4248195 - DNA, 17 bp, Homo sapiens
accagccagtaaatggg

SEQ ID NO: 4248196 - DNA, 22 bp, Homo sapiens
accagccttcctgtgggcccct

SEQ ID NO: 4248197 - DNA, 16 bp, Homo sapiens
accagctaccctgtgt

SEQ ID NO: 4248198 - DNA, 16 bp, Homo sapiens
accaggtatcaaatca

SEQ ID NO: 4248199 - DNA, 21 bp, Homo sapiens
accagtgttgtggatttaaca

SEQ ID NO: 4248200 - DNA, 22 bp, Homo sapiens
accatggtcggaaaacatgcta

SEQ ID NO: 4248201 - DNA, 15 bp, Homo sapiens
acccacattactttt

SEQ ID NO: 4248202 - DNA, 18 bp, Homo sapiens
acccacattactttttat

SEQ ID NO: 4248203 - DNA, 12 bp, Homo sapiens
acccacctctgc

SEQ ID NO: 4248204 - DNA, 17 bp, Homo sapiens
acccagcagttctctgc

SEQ ID NO: 4248205 - DNA, 17 bp, Homo sapiens
acccccatctctccctc

SEQ ID NO: 4248206 - DNA, 23 bp, Homo sapiens
actttgacctctgcagcaataaa

SEQ ID NO: 4248207 - DNA, 22 bp, Homo sapiens
actttgtggaccaattattgat

SEQ ID NO: 4248208 - DNA, 22 bp, Homo sapiens
acttttataaactttacctttt

SEQ ID NO: 4248209 - DNA, 17 bp, Homo sapiens
acttttcccctgttaaa

SEQ ID NO: 4248210 - DNA, 21 bp, Homo sapiens
acttttgttctgctttatctt

SEQ ID NO: 4248211 - DNA, 15 bp, Homo sapiens
acttttgttcttggt

SEQ ID NO: 4248212 - DNA, 22 bp, Homo sapiens
actttttatgggtgaaaataag

SEQ ID NO: 4248213 - DNA, 23 bp, Homo sapiens
agaaaagtagacaatcattgttt

SEQ ID NO: 4248214 - DNA, 23 bp, Homo sapiens
agaaaatatttaatatcaaaaga

SEQ ID NO: 4248215 - DNA, 23 bp, Homo sapiens
agaaaattgatatttttatacaa

SEQ ID NO: 4248216 - DNA, 15 bp, Homo sapiens
agaaaatttagccct

SEQ ID NO: 4248217 - DNA, 21 bp, Homo sapiens
agaaaatttagccctttaaaa

SEQ ID NO: 4248218 - DNA, 18 bp, Homo sapiens
agaaactggattaaaaca

SEQ ID NO: 4248219 - DNA, 19 bp, Homo sapiens
agaaactggattaaaacaa

SEQ ID NO: 4248220 - DNA, 15 bp, Homo sapiens
agaaatgccttaccc

SEQ ID NO: 4248221 - DNA, 17 bp, Homo sapiens
agaaccaaagctcaaat

SEQ ID NO: 4248222 - DNA, 23 bp, Homo sapiens
ctcactgtgggaaggccagctgc

SEQ ID NO: 4248223 - DNA, 21 bp, Homo sapiens
ctcactttttttttttgtttg

SEQ ID NO: 4248224 - DNA, 16 bp, Homo sapiens
ctcagagcttgaagat

SEQ ID NO: 4248225 - DNA, 23 bp, Homo sapiens
ctcagattggaatgttacatctg

SEQ ID NO: 4248226 - DNA, 13 bp, Homo sapiens
ctcagcccagaag

SEQ ID NO: 4248227 - DNA, 21 bp, Homo sapiens
ctcaggcgatccacctgtctc

SEQ ID NO: 4248228 - DNA, 14 bp, Homo sapiens
ctcagtgccacacc

SEQ ID NO: 4248229 - DNA, 16 bp, Homo sapiens
ctcatcttgtgaaatg

SEQ ID NO: 4248230 - DNA, 18 bp, Homo sapiens
ctcatgttcttaattctt

SEQ ID NO: 4248231 - DNA, 18 bp, Homo sapiens
ctcattctccttgtgtta

SEQ ID NO: 4248232 - DNA, 19 bp, Homo sapiens
ctccagcctgcctggcagg

SEQ ID NO: 4248233 - DNA, 20 bp, Homo sapiens
ctcccacccccatctctccc

SEQ ID NO: 4248234 - DNA, 23 bp, Homo sapiens
ctcccacctatccgccctgcagc

SEQ ID NO: 4248235 - DNA, 24 bp, Homo sapiens
ctcccacctatccgccctgcagca

SEQ ID NO: 4248236 - DNA, 11 bp, Homo sapiens
ctccccagaat

SEQ ID NO: 4248237 - DNA, 12 bp, Homo sapiens
ctcccccagagc

SEQ ID NO: 4248238 - DNA, 14 bp, Homo sapiens
ctcccctgccattt

SEQ ID NO: 4248239 - DNA, 16 bp, Homo sapiens
ctcccggagaggtggc

SEQ ID NO: 4248240 - DNA, 19 bp, Homo sapiens
ctccctcccccagagcccc

SEQ ID NO: 4248241 - DNA, 16 bp, Homo sapiens
ctccctggatcacata

SEQ ID NO: 4248242 - DNA, 21 bp, Homo sapiens
ctccctttttatatcccattt

SEQ ID NO: 4248243 - DNA, 16 bp, Homo sapiens
ctccggagcgccctgc

SEQ ID NO: 4248244 - DNA, 17 bp, Homo sapiens
ctccggagcgccctgca

SEQ ID NO: 4248245 - DNA, 18 bp, Homo sapiens
ctccggagcgccctgcag

SEQ ID NO: 4248246 - DNA, 19 bp, Homo sapiens
ctccggagcgccctgcagg

SEQ ID NO: 4248247 - DNA, 22 bp, Homo sapiens
ctccggagcgccctgcagggcc

SEQ ID NO: 4248248 - DNA, 16 bp, Homo sapiens
ctcctagcagacagaa

SEQ ID NO: 4248249 - DNA, 19 bp, Homo sapiens
ctcctatttttgtaaactg

SEQ ID NO: 4248250 - DNA, 21 bp, Homo sapiens
ctcctccctgggatggacgct

SEQ ID NO: 4248251 - DNA, 15 bp, Homo sapiens
ctcctcttcccagag

SEQ ID NO: 4248252 - DNA, 17 bp, Homo sapiens
ctcctcttcccagagtc

SEQ ID NO: 4248253 - DNA, 14 bp, Homo sapiens
ctcctgaatatttt

SEQ ID NO: 4248254 - DNA, 11 bp, Homo sapiens
ctcctgacaat

SEQ ID NO: 4248255 - DNA, 14 bp, Homo sapiens
ctcctgcactgttt

SEQ ID NO: 4248256 - DNA, 15 bp, Homo sapiens
ctcctggagcactgt

SEQ ID NO: 4248257 - DNA, 14 bp, Homo sapiens
ctccttgtgttact

SEQ ID NO: 4248258 - DNA, 19 bp, Homo sapiens
ctcctttgaaacctgctct

SEQ ID NO: 4248259 - DNA, 23 bp, Homo sapiens
ctcgagcagtcctgcctcagcct

SEQ ID NO: 4248260 - DNA, 18 bp, Homo sapiens
ctcggccgcccggcagtg

SEQ ID NO: 4248261 - DNA, 14 bp, Homo sapiens
ctcgtttctgccca

SEQ ID NO: 4248262 - DNA, 14 bp, Homo sapiens
ctctaggacttcaa

SEQ ID NO: 4248263 - DNA, 20 bp, Homo sapiens
ctctagtttgattaaattct

SEQ ID NO: 4248264 - DNA, 18 bp, Homo sapiens
ctctcaagctagtgtttc

SEQ ID NO: 4248265 - DNA, 21 bp, Homo sapiens
ctctcaagctagtgtttctag

SEQ ID NO: 4248266 - DNA, 13 bp, Homo sapiens
ctctcagcccaga

SEQ ID NO: 4248267 - DNA, 14 bp, Homo sapiens
ctctcagcccagaa

SEQ ID NO: 4248268 - DNA, 18 bp, Homo sapiens
ctctcagcccagaagaaa

SEQ ID NO: 4248269 - DNA, 21 bp, Homo sapiens
ctctccacacggagctcctgg

SEQ ID NO: 4248270 - DNA, 21 bp, Homo sapiens
ctctcccccaaggccactgcg

SEQ ID NO: 4248271 - DNA, 22 bp, Homo sapiens
ctctcctgtacctcttgagcct

SEQ ID NO: 4248272 - DNA, 21 bp, Homo sapiens
ctctcctttgaaacctgctct

SEQ ID NO: 4248273 - DNA, 15 bp, Homo sapiens
ctctcttcagactct

SEQ ID NO: 4248274 - DNA, 13 bp, Homo sapiens
ctctgcagcaata

SEQ ID NO: 4248275 - DNA, 18 bp, Homo sapiens
ctctgctggcccagccaa

SEQ ID NO: 4248276 - DNA, 17 bp, Homo sapiens
ctctgggatctgccaac

SEQ ID NO: 4248277 - DNA, 13 bp, Homo sapiens
ctctgtgtttaaa

SEQ ID NO: 4248278 - DNA, 21 bp, Homo sapiens
ctcttaatctgtgtgtatatt

SEQ ID NO: 4248279 - DNA, 18 bp, Homo sapiens
ctcttcagatctctaact

SEQ ID NO: 4248280 - DNA, 14 bp, Homo sapiens
ctcttccacctctg

SEQ ID NO: 4248281 - DNA, 15 bp, Homo sapiens
ctcttccacctctgg

SEQ ID NO: 4248282 - DNA, 16 bp, Homo sapiens
ctcttccacctctggg

SEQ ID NO: 4248283 - DNA, 18 bp, Homo sapiens
ctcttccacctctgggga

SEQ ID NO: 4248284 - DNA, 22 bp, Homo sapiens
ctcttgaaatataggaacttaa

SEQ ID NO: 4248285 - DNA, 23 bp, Homo sapiens
ctcttgggaccccagagaaaacc

SEQ ID NO: 4248286 - DNA, 12 bp, Homo sapiens
ctctttgccctg

SEQ ID NO: 4248287 - DNA, 14 bp, Homo sapiens
ctgaagggaacagc

SEQ ID NO: 4248288 - DNA, 21 bp, Homo sapiens
ctgaagggaacagcctgagcc

SEQ ID NO: 4248289 - DNA, 22 bp, Homo sapiens
ctgaagggaacagcctgagccg

SEQ ID NO: 4248290 - DNA, 18 bp, Homo sapiens
ctgaagggcattctttcc

SEQ ID NO: 4248291 - DNA, 15 bp, Homo sapiens
ctgaagtcaaaatat

SEQ ID NO: 4248292 - DNA, 14 bp, Homo sapiens
ctgaatattttgga

SEQ ID NO: 4248293 - DNA, 17 bp, Homo sapiens
ctgaatattttggaaac

SEQ ID NO: 4248294 - DNA, 19 bp, Homo sapiens
ctgaatattttggaaactg

SEQ ID NO: 4248295 - DNA, 19 bp, Homo sapiens
ctgaattgtatcaatttgt

SEQ ID NO: 4248296 - DNA, 20 bp, Homo sapiens
ctgacatttgtttatttttt

SEQ ID NO: 4248297 - DNA, 20 bp, Homo sapiens
ctgagagcgaattgtgtgga

SEQ ID NO: 4248298 - DNA, 20 bp, Homo sapiens
ctgagtaaacataaaaactg

SEQ ID NO: 4248299 - DNA, 17 bp, Homo sapiens
ctgagtacgttgtgcat

SEQ ID NO: 4248300 - DNA, 19 bp, Homo sapiens
ctgagtacgttgtgcattt

SEQ ID NO: 4248301 - DNA, 20 bp, Homo sapiens
ctgagtacgttgtgcatttg

SEQ ID NO: 4248302 - DNA, 20 bp, Homo sapiens
ctgcaaaggtggcaatgctt

SEQ ID NO: 4248303 - DNA, 23 bp, Homo sapiens
ctgcaaaggtggcaatgcttaaa

SEQ ID NO: 4248304 - DNA, 23 bp, Homo sapiens
ctgcaacctcacctcccgggttc

SEQ ID NO: 4248305 - DNA, 12 bp, Homo sapiens
ctgcacctctgg

SEQ ID NO: 4248306 - DNA, 13 bp, Homo sapiens
ctgcacctctgga

SEQ ID NO: 4248307 - DNA, 22 bp, Homo sapiens
ctgcagaacatcgatatgtata

SEQ ID NO: 4248308 - DNA, 20 bp, Homo sapiens
ctgcagcccgtgtccaggag

SEQ ID NO: 4248309 - DNA, 15 bp, Homo sapiens
cagggtggagggaag

SEQ ID NO: 4248310 - DNA, 23 bp, Homo sapiens
caggtgcccgcgccaggccctca

SEQ ID NO: 4248311 - DNA, 18 bp, Homo sapiens
caggtggatgaggagaca

SEQ ID NO: 4248312 - DNA, 18 bp, Homo sapiens
cagtaaatgggggtgcat

SEQ ID NO: 4248313 - DNA, 23 bp, Homo sapiens
cagtaatgcagtttttaaaaacc

SEQ ID NO: 4248314 - DNA, 16 bp, Homo sapiens
cagtacctctcaagct

SEQ ID NO: 4248315 - DNA, 13 bp, Homo sapiens
cagtattgctgat

SEQ ID NO: 4248316 - DNA, 16 bp, Homo sapiens
cagtattgctgatttt

SEQ ID NO: 4248317 - DNA, 19 bp, Homo sapiens
cagtcctgcctcagcctcc

SEQ ID NO: 4248318 - DNA, 11 bp, Homo sapiens
cagtgactttg

SEQ ID NO: 4248319 - DNA, 15 bp, Homo sapiens
cagtgactttgtata

SEQ ID NO: 4248320 - DNA, 11 bp, Homo sapiens
cagtgccacac

SEQ ID NO: 4248321 - DNA, 19 bp, Homo sapiens
cagtgctaagctgccctga

SEQ ID NO: 4248322 - DNA, 20 bp, Homo sapiens
cagtgctaagctgccctgag

SEQ ID NO: 4248323 - DNA, 19 bp, Homo sapiens
cagtgttgtggatttaaca

SEQ ID NO: 4248324 - DNA, 20 bp, Homo sapiens
cagtgttgtggatttaacag

SEQ ID NO: 4248325 - DNA, 22 bp, Homo sapiens
cagtgttgtggatttaacagaa

SEQ ID NO: 4248326 - DNA, 14 bp, Homo sapiens
cagttatttctgtt

SEQ ID NO: 4248327 - DNA, 23 bp, Homo sapiens
cagttatttctgtttcctattta

SEQ ID NO: 4248328 - DNA, 17 bp, Homo sapiens
cagttctctgccaaagc

SEQ ID NO: 4248329 - DNA, 15 bp, Homo sapiens
cagttggcccttctg

SEQ ID NO: 4248330 - DNA, 19 bp, Homo sapiens
cagttggcccttctgccct

SEQ ID NO: 4248331 - DNA, 15 bp, Homo sapiens
cagtttttaaaaacc

SEQ ID NO: 4248332 - DNA, 15 bp, Homo sapiens
cagtttttgtatctt

SEQ ID NO: 4248333 - DNA, 22 bp, Homo sapiens
cataaacaagaccacgtttcta

SEQ ID NO: 4248334 - DNA, 20 bp, Homo sapiens
cataaagggttgaaaatgtg

SEQ ID NO: 4248335 - DNA, 19 bp, Homo sapiens
cataaatgcataatttatg

SEQ ID NO: 4248336 - DNA, 18 bp, Homo sapiens
cataatgataaaataaat

SEQ ID NO: 4248337 - DNA, 21 bp, Homo sapiens
cataatgcgtgcataccactt

SEQ ID NO: 4248338 - DNA, 23 bp, Homo sapiens
cataatgcgtgcataccactttt

SEQ ID NO: 4248339 - DNA, 19 bp, Homo sapiens
cataccacttttgttcttg

SEQ ID NO: 4248340 - DNA, 22 bp, Homo sapiens
catagtgctacctgcacctctg

SEQ ID NO: 4248341 - DNA, 17 bp, Homo sapiens
catattaccacagacat

SEQ ID NO: 4248342 - DNA, 17 bp, Homo sapiens
catattgatttccgtta

SEQ ID NO: 4248343 - DNA, 17 bp, Homo sapiens
catcagcacgatttctg

SEQ ID NO: 4248344 - DNA, 21 bp, Homo sapiens
catcagcacgatttctgttta

SEQ ID NO: 4248345 - DNA, 21 bp, Homo sapiens
catccaaaatattttttgcaa

SEQ ID NO: 4248346 - DNA, 14 bp, Homo sapiens
catcccacaccctg

SEQ ID NO: 4248347 - DNA, 14 bp, Homo sapiens
catcctcagcagca

SEQ ID NO: 4248348 - DNA, 17 bp, Homo sapiens
catctcccagatcctgg

SEQ ID NO: 4248349 - DNA, 18 bp, Homo sapiens
catctcccagatcctgga

SEQ ID NO: 4248350 - DNA, 12 bp, Homo sapiens
catctctccctc

SEQ ID NO: 4248351 - DNA, 15 bp, Homo sapiens
catctctccctcccc

SEQ ID NO: 4248352 - DNA, 13 bp, Homo sapiens
catctctgcctcc

SEQ ID NO: 4248353 - DNA, 20 bp, Homo sapiens
catctctgtgattacctctc

SEQ ID NO: 4248354 - DNA, 14 bp, Homo sapiens
catctggcacgtgg

SEQ ID NO: 4248355 - DNA, 19 bp, Homo sapiens
catctggcacgtggccagg

SEQ ID NO: 4248356 - DNA, 16 bp, Homo sapiens
catctgtggacaagac

SEQ ID NO: 4248357 - DNA, 17 bp, Homo sapiens
catgaaaacacattttt

SEQ ID NO: 4248358 - DNA, 21 bp, Homo sapiens
catgaaaacacatttttctta

SEQ ID NO: 4248359 - DNA, 14 bp, Homo sapiens
catgaaaatgacat

SEQ ID NO: 4248360 - DNA, 18 bp, Homo sapiens
catgacaggcctgaagat

SEQ ID NO: 4248361 - DNA, 16 bp, Homo sapiens
catgaggggattccct

SEQ ID NO: 4248362 - DNA, 17 bp, Homo sapiens
catgcaaggtcattttt

SEQ ID NO: 4248363 - DNA, 21 bp, Homo sapiens
catgcactttatgtggagact

SEQ ID NO: 4248364 - DNA, 12 bp, Homo sapiens
catgcagcgcca

SEQ ID NO: 4248365 - DNA, 15 bp, Homo sapiens
catgcattatatacc

SEQ ID NO: 4248366 - DNA, 20 bp, Homo sapiens
catgcccagctaatttttgt

SEQ ID NO: 4248367 - DNA, 12 bp, Homo sapiens
catgctccaaat

SEQ ID NO: 4248368 - DNA, 20 bp, Homo sapiens
catgcttctcatcttgtgaa

SEQ ID NO: 4248369 - DNA, 21 bp, Homo sapiens
catgcttctcatcttgtgaaa

SEQ ID NO: 4248370 - DNA, 18 bp, Homo sapiens
catggagactctgagagc

SEQ ID NO: 4248371 - DNA, 22 bp, Homo sapiens
catggcctcttcagatctctaa

SEQ ID NO: 4248372 - DNA, 15 bp, Homo sapiens
catggctcagagctt

SEQ ID NO: 4248373 - DNA, 13 bp, Homo sapiens
catggtttgatat

SEQ ID NO: 4248374 - DNA, 16 bp, Homo sapiens
catggtttgatatgta

SEQ ID NO: 4248375 - DNA, 13 bp, Homo sapiens
catgtatgttatg

SEQ ID NO: 4248376 - DNA, 17 bp, Homo sapiens
catgtatgttatgatat

SEQ ID NO: 4248377 - DNA, 18 bp, Homo sapiens
catgtatgttatgatatt

SEQ ID NO: 4248378 - DNA, 21 bp, Homo sapiens
catgtcaattcataaaaacaa

SEQ ID NO: 4248379 - DNA, 19 bp, Homo sapiens
catgttatttaacctgagt

SEQ ID NO: 4248380 - DNA, 13 bp, Homo sapiens
catgttcttaatt

SEQ ID NO: 4248381 - DNA, 18 bp, Homo sapiens
catgttgggtttgagaca

SEQ ID NO: 4248382 - DNA, 14 bp, Homo sapiens
cattaaatgaatat

SEQ ID NO: 4248383 - DNA, 22 bp, Homo sapiens
cattaaatgaatattttgataa

SEQ ID NO: 4248384 - DNA, 20 bp, Homo sapiens
cattaaatgcaataatttta

SEQ ID NO: 4248385 - DNA, 16 bp, Homo sapiens
cattatctagatactg

SEQ ID NO: 4248386 - DNA, 17 bp, Homo sapiens
cattatctagatactgt

SEQ ID NO: 4248387 - DNA, 13 bp, Homo sapiens
cattcacttctct

SEQ ID NO: 4248388 - DNA, 19 bp, Homo sapiens
cattccagtgctagaaaat

SEQ ID NO: 4248389 - DNA, 19 bp, Homo sapiens
cattctacacagagcagga

SEQ ID NO: 4248390 - DNA, 22 bp, Homo sapiens
cattctacacagagcaggactg

SEQ ID NO: 4248391 - DNA, 23 bp, Homo sapiens
cattctaggtaggggcccacttc

SEQ ID NO: 4248392 - DNA, 12 bp, Homo sapiens
cattgttttgaa

SEQ ID NO: 4248393 - DNA, 18 bp, Homo sapiens
cattgttttgaatattac

SEQ ID NO: 4248394 - DNA, 12 bp, Homo sapiens
catttaaaagat

SEQ ID NO: 4248395 - DNA, 22 bp, Homo sapiens
catttaatggcagctagtgcct

SEQ ID NO: 4248396 - DNA, 17 bp, Homo sapiens
catttatataaaactta

SEQ ID NO: 4248397 - DNA, 23 bp, Homo sapiens
catttatataaaacttaaaaaca

SEQ ID NO: 4248398 - DNA, 22 bp, Homo sapiens
catttatgtgaggtaattattg

SEQ ID NO: 4248399 - DNA, 19 bp, Homo sapiens
catttccacaccaagcagc

SEQ ID NO: 4248400 - DNA, 17 bp, Homo sapiens
catttgaaaattttgat

SEQ ID NO: 4248401 - DNA, 19 bp, Homo sapiens
catttgaaaattttgatgt

SEQ ID NO: 4248402 - DNA, 20 bp, Homo sapiens
catttgaaaattttgatgtt

SEQ ID NO: 4248403 - DNA, 17 bp, Homo sapiens
catttgaggtctgttct

SEQ ID NO: 4248404 - DNA, 22 bp, Homo sapiens
catttgtttattttttggaaga

SEQ ID NO: 4248405 - DNA, 22 bp, Homo sapiens
cattttattttattatgcatga

SEQ ID NO: 4248406 - DNA, 16 bp, Homo sapiens
cattttcaccccaccc

SEQ ID NO: 4248407 - DNA, 17 bp, Homo sapiens
cattttcaccccaccct

SEQ ID NO: 4248408 - DNA, 14 bp, Homo sapiens
catttttgtatttt

SEQ ID NO: 4248409 - DNA, 22 bp, Homo sapiens
cattttttttaagaaaaaggat

SEQ ID NO: 4248410 - DNA, 19 bp, Homo sapiens
agcctaaatttgtgctttt

SEQ ID NO: 4248411 - DNA, 17 bp, Homo sapiens
agcctctgggatctgcc

SEQ ID NO: 4248412 - DNA, 19 bp, Homo sapiens
agcctctgggatctgccaa

SEQ ID NO: 4248413 - DNA, 16 bp, Homo sapiens
agcctggagctttcct

SEQ ID NO: 4248414 - DNA, 16 bp, Homo sapiens
agcctgttcccactca

SEQ ID NO: 4248415 - DNA, 20 bp, Homo sapiens
agccttagagcatctctgcc

SEQ ID NO: 4248416 - DNA, 15 bp, Homo sapiens
agcctttgcctcccc

SEQ ID NO: 4248417 - DNA, 14 bp, Homo sapiens
agccttttatctgc

SEQ ID NO: 4248418 - DNA, 16 bp, Homo sapiens
agcgccctgcagggcc

SEQ ID NO: 4248419 - DNA, 12 bp, Homo sapiens
agctaatttttg

SEQ ID NO: 4248420 - DNA, 22 bp, Homo sapiens
agctacccttttcctttgtggt

SEQ ID NO: 4248421 - DNA, 15 bp, Homo sapiens
agctataattctgtt

SEQ ID NO: 4248422 - DNA, 13 bp, Homo sapiens
atatgtatgcttt

SEQ ID NO: 4248423 - DNA, 20 bp, Homo sapiens
atattacaacatttatgtga

SEQ ID NO: 4248424 - DNA, 21 bp, Homo sapiens
atattacaacatttatgtgag

SEQ ID NO: 4248425 - DNA, 17 bp, Homo sapiens
atattaccacagacata

SEQ ID NO: 4248426 - DNA, 22 bp, Homo sapiens
atattactcctatttttgtaaa

SEQ ID NO: 4248427 - DNA, 15 bp, Homo sapiens
atattagtgaagatg

SEQ ID NO: 4248428 - DNA, 15 bp, Homo sapiens
caatgacttactgta

SEQ ID NO: 4248429 - DNA, 17 bp, Homo sapiens
caatgacttactgtaca

SEQ ID NO: 4248430 - DNA, 18 bp, Homo sapiens
caatgacttactgtacat

SEQ ID NO: 4248431 - DNA, 22 bp, Homo sapiens
caatgctgtgccctaaagtgta

SEQ ID NO: 4248432 - DNA, 11 bp, Homo sapiens
caatgcttaaa

SEQ ID NO: 4248433 - DNA, 20 bp, Homo sapiens
caatgcttaaactaaataat

SEQ ID NO: 4248434 - DNA, 17 bp, Homo sapiens
ttaaatgcacctggaat

SEQ ID NO: 4248435 - DNA, 18 bp, Homo sapiens
ttaaatgcacctggaata

SEQ ID NO: 4248436 - DNA, 15 bp, Homo sapiens
ttaaatgtaatataa

SEQ ID NO: 4248437 - DNA, 13 bp, Homo sapiens
ttaacagaaatgt

SEQ ID NO: 4248438 - DNA, 19 bp, Homo sapiens
ttaacagaaatgtacagca

SEQ ID NO: 4248439 - DNA, 21 bp, Homo sapiens
ttaaccttaaaattgatatta

SEQ ID NO: 4248440 - DNA, 17 bp, Homo sapiens
ttaacttttataaactt

SEQ ID NO: 4248441 - DNA, 22 bp, Homo sapiens
ttaacttttataaactttacct

SEQ ID NO: 4248442 - DNA, 20 bp, Homo sapiens
ttaagaaaaaggatgcacag

SEQ ID NO: 4248443 - DNA, 17 bp, Homo sapiens
ttaaggatgcttgtaca

SEQ ID NO: 4248444 - DNA, 18 bp, Homo sapiens
ttaaggatgcttgtacat

SEQ ID NO: 4248445 - DNA, 19 bp, Homo sapiens
ttaaggatgcttgtacata

SEQ ID NO: 4248446 - DNA, 22 bp, Homo sapiens
ttaaggatgcttgtacataatg

SEQ ID NO: 4248447 - DNA, 20 bp, Homo sapiens
ttaagtagaaaagttgcaga

SEQ ID NO: 4248448 - DNA, 15 bp, Homo sapiens
ttaagtgctgcattt

SEQ ID NO: 4248449 - DNA, 15 bp, Homo sapiens
ttaagtgggctcctg

SEQ ID NO: 4248450 - DNA, 16 bp, Homo sapiens
ttaagtgggctcctga

SEQ ID NO: 4248451 - DNA, 17 bp, Homo sapiens
ttaagtgggctcctgac

SEQ ID NO: 4248452 - DNA, 14 bp, Homo sapiens
ttaagtttgaagag

SEQ ID NO: 4248453 - DNA, 13 bp, Homo sapiens
ttaataatattta

SEQ ID NO: 4248454 - DNA, 17 bp, Homo sapiens
ttaatacagctcagtaa

SEQ ID NO: 4248455 - DNA, 18 bp, Homo sapiens
ttaatattcccattttat

SEQ ID NO: 4248456 - DNA, 21 bp, Homo sapiens
ttaatattcttttgtttccat

SEQ ID NO: 4248457 - DNA, 13 bp, Homo sapiens
ttaatcattaggt

SEQ ID NO: 4248458 - DNA, 18 bp, Homo sapiens
ttaattcttcacctgtta

SEQ ID NO: 4248459 - DNA, 21 bp, Homo sapiens
ttaattcttcacctgttatgt

SEQ ID NO: 4248460 - DNA, 22 bp, Homo sapiens
ttaattttaccaagagtaactt

SEQ ID NO: 4248461 - DNA, 21 bp, Homo sapiens
ttacaataaaactttgctgcc

SEQ ID NO: 4248462 - DNA, 21 bp, Homo sapiens
ttacatttttaagtgctgcat

SEQ ID NO: 4248463 - DNA, 16 bp, Homo sapiens
ttaccaagagtaactt

SEQ ID NO: 4248464 - DNA, 20 bp, Homo sapiens
ttacctcctaatggcatgga

SEQ ID NO: 4248465 - DNA, 23 bp, Homo sapiens
ttacctgcttgagctttctgtgc

SEQ ID NO: 4248466 - DNA, 19 bp, Homo sapiens
ttaccttttttatacataa

SEQ ID NO: 4248467 - DNA, 22 bp, Homo sapiens
ttaccttttttatacataaaca

SEQ ID NO: 4248468 - DNA, 19 bp, Homo sapiens
ttacgtttgttattcctag

SEQ ID NO: 4248469 - DNA, 13 bp, Homo sapiens
ttactaagttttt

SEQ ID NO: 4248470 - DNA, 19 bp, Homo sapiens
ttactatggccctggccta

SEQ ID NO: 4248471 - DNA, 22 bp, Homo sapiens
ttactgaattgtatcaatttgt

SEQ ID NO: 4248472 - DNA, 23 bp, Homo sapiens
tgtacctcttgagccttgaactt

SEQ ID NO: 4248473 - DNA, 18 bp, Homo sapiens
tgtacttgatttgatgtg

SEQ ID NO: 4248474 - DNA, 18 bp, Homo sapiens
tgtagaaacttaaacaca

SEQ ID NO: 4248475 - DNA, 20 bp, Homo sapiens
tgtagccactagtaagtaat

SEQ ID NO: 4248476 - DNA, 15 bp, Homo sapiens
tgtaggtaaaatgta

SEQ ID NO: 4248477 - DNA, 18 bp, Homo sapiens
tgtatatcattctacaga

SEQ ID NO: 4248478 - DNA, 21 bp, Homo sapiens
tgtatatcattctacagaata

SEQ ID NO: 4248479 - DNA, 23 bp, Homo sapiens
tgtatattgagaatcccttaaaa

SEQ ID NO: 4248480 - DNA, 16 bp, Homo sapiens
tgtatattttaatgtt

SEQ ID NO: 4248481 - DNA, 18 bp, Homo sapiens
tgtatattttaatgtttt

SEQ ID NO: 4248482 - DNA, 21 bp, Homo sapiens
tgtatctgacccactttgtaa

SEQ ID NO: 4248483 - DNA, 21 bp, Homo sapiens
tgtatcttggggcaagactgc

SEQ ID NO: 4248484 - DNA, 20 bp, Homo sapiens
tgtattctctcctgtacctc

SEQ ID NO: 4248485 - DNA, 14 bp, Homo sapiens
tgtatttaaagttg

SEQ ID NO: 4248486 - DNA, 21 bp, Homo sapiens
tgtattttttaaaacactaaa

SEQ ID NO: 4248487 - DNA, 14 bp, Homo sapiens
tgtatttttttact

SEQ ID NO: 4248488 - DNA, 18 bp, Homo sapiens
tgtcaagtctctgctggc

SEQ ID NO: 4248489 - DNA, 19 bp, Homo sapiens
tgtcaattcataaaaacaa

SEQ ID NO: 4248490 - DNA, 14 bp, Homo sapiens
tgtcaggcatggct

SEQ ID NO: 4248491 - DNA, 20 bp, Homo sapiens
tgtcaggcatggctcagagc

SEQ ID NO: 4248492 - DNA, 22 bp, Homo sapiens
tgtcaggcatggctcagagctt

SEQ ID NO: 4248493 - DNA, 15 bp, Homo sapiens
tgtccacacccagct

SEQ ID NO: 4248494 - DNA, 20 bp, Homo sapiens
tgtccagccgtgtgtgcatg

SEQ ID NO: 4248495 - DNA, 24 bp, Homo sapiens
tgtccagccgtgtgtgcatgtgcc

SEQ ID NO: 4248496 - DNA, 15 bp, Homo sapiens
tgtccagctggttgt

SEQ ID NO: 4248497 - DNA, 21 bp, Homo sapiens
tgtccctcactgttgaatttt

SEQ ID NO: 4248498 - DNA, 19 bp, Homo sapiens
tgtctcactgttctgcaaa

SEQ ID NO: 4248499 - DNA, 14 bp, Homo sapiens
tgtctcagcctccc

SEQ ID NO: 4248500 - DNA, 23 bp, Homo sapiens
tgtctggcaggctactctgccca

SEQ ID NO: 4248501 - DNA, 20 bp, Homo sapiens
tgtcttaagatggaaataca

SEQ ID NO: 4248502 - DNA, 22 bp, Homo sapiens
tgtcttaagatggaaatacagt

SEQ ID NO: 4248503 - DNA, 13 bp, Homo sapiens
tgtcttgcaactt

SEQ ID NO: 4248504 - DNA, 14 bp, Homo sapiens
tgtgaaatgctggc

SEQ ID NO: 4248505 - DNA, 19 bp, Homo sapiens
tgtgaataggttatatgca

SEQ ID NO: 4248506 - DNA, 17 bp, Homo sapiens
tgtgaatgcttctcact

SEQ ID NO: 4248507 - DNA, 16 bp, Homo sapiens
tgtgactgaatttctt

SEQ ID NO: 4248508 - DNA, 22 bp, Homo sapiens
tgtgaggagagtctgaatattt

SEQ ID NO: 4248509 - DNA, 14 bp, Homo sapiens
tgtgattacctctc

SEQ ID NO: 4248510 - DNA, 19 bp, Homo sapiens
tgtgcagaaaatatttaat

SEQ ID NO: 4248511 - DNA, 13 bp, Homo sapiens
tgtgcatgtgccg

SEQ ID NO: 4248512 - DNA, 12 bp, Homo sapiens
tgtgcctcctca

SEQ ID NO: 4248513 - DNA, 18 bp, Homo sapiens
tgtgcctggttcgtgcca

SEQ ID NO: 4248514 - DNA, 14 bp, Homo sapiens
cttttataaacttt

SEQ ID NO: 4248515 - DNA, 15 bp, Homo sapiens
cttttataaacttta

SEQ ID NO: 4248516 - DNA, 19 bp, Homo sapiens
cttttataaactttacctt

SEQ ID NO: 4248517 - DNA, 20 bp, Homo sapiens
cttttcataaagggttgaaa

SEQ ID NO: 4248518 - DNA, 16 bp, Homo sapiens
cttttcctttgtggtt

SEQ ID NO: 4248519 - DNA, 23 bp, Homo sapiens
cttttgaaaaaaaagtttttaat

SEQ ID NO: 4248520 - DNA, 16 bp, Homo sapiens
cttttgttctgcttta

SEQ ID NO: 4248521 - DNA, 20 bp, Homo sapiens
cttttgttcttggtttgtaa

SEQ ID NO: 4248522 - DNA, 13 bp, Homo sapiens
cttttgtttccat

SEQ ID NO: 4248523 - DNA, 17 bp, Homo sapiens
cttttttatacataaac

SEQ ID NO: 4248524 - DNA, 18 bp, Homo sapiens
ctttttttttttgtttga

SEQ ID NO: 4248525 - DNA, 21 bp, Homo sapiens
ctttttttttttttttgacaa

SEQ ID NO: 4248526 - DNA, 15 bp, Homo sapiens
gaaaaaaaagttttt

SEQ ID NO: 4248527 - DNA, 15 bp, Homo sapiens
gaaaaacaattttct

SEQ ID NO: 4248528 - DNA, 15 bp, Homo sapiens
gaaaaacacgagaaa

SEQ ID NO: 4248529 - DNA, 13 bp, Homo sapiens
gaaaaaggcagtg

SEQ ID NO: 4248530 - DNA, 17 bp, Homo sapiens
gaaaaatctcaattgaa

SEQ ID NO: 4248531 - DNA, 13 bp, Homo sapiens
gaaaacacatttt

SEQ ID NO: 4248532 - DNA, 15 bp, Homo sapiens
gaaaacatgctacac

SEQ ID NO: 4248533 - DNA, 16 bp, Homo sapiens
gaaaagtcgttttcca

SEQ ID NO: 4248534 - DNA, 14 bp, Homo sapiens
gaaaagttgcagat

SEQ ID NO: 4248535 - DNA, 18 bp, Homo sapiens
gaaaataaacagacaaaa

SEQ ID NO: 4248536 - DNA, 15 bp, Homo sapiens
gaaaatatttaatat

SEQ ID NO: 4248537 - DNA, 19 bp, Homo sapiens
gaaaatgtgtttgctgcct

SEQ ID NO: 4248538 - DNA, 17 bp, Homo sapiens
gaaacccggtgcatctg

SEQ ID NO: 4248539 - DNA, 14 bp, Homo sapiens
gaaactgctaaatt

SEQ ID NO: 4248540 - DNA, 12 bp, Homo sapiens
gaaatctcaccc

SEQ ID NO: 4248541 - DNA, 15 bp, Homo sapiens
gaacagcctgagccg

SEQ ID NO: 4248542 - DNA, 18 bp, Homo sapiens
gaaccagaagtgcagccc

SEQ ID NO: 4248543 - DNA, 22 bp, Homo sapiens
gaaccatggtcggaaaacatgc

SEQ ID NO: 4248544 - DNA, 19 bp, Homo sapiens
gaacccccacaaccccctc

SEQ ID NO: 4248545 - DNA, 21 bp, Homo sapiens
gaacccccacaaccccctcca

SEQ ID NO: 4248546 - DNA, 12 bp, Homo sapiens
gaaccctttgtt

SEQ ID NO: 4248547 - DNA, 16 bp, Homo sapiens
gaactagggaagctca

SEQ ID NO: 4248548 - DNA, 14 bp, Homo sapiens
gaacttaaataatg

SEQ ID NO: 4248549 - DNA, 22 bp, Homo sapiens
gaactttgacctctgcagcaat

SEQ ID NO: 4248550 - DNA, 16 bp, Homo sapiens
gaagacaatgacttac

SEQ ID NO: 4248551 - DNA, 17 bp, Homo sapiens
gaagatggtttcaattc

SEQ ID NO: 4248552 - DNA, 19 bp, Homo sapiens
gaagatggtttcaattcag

SEQ ID NO: 4248553 - DNA, 20 bp, Homo sapiens
gaaggaatcattccagtgct

SEQ ID NO: 4248554 - DNA, 22 bp, Homo sapiens
gaaggccagctgccccagccag

SEQ ID NO: 4248555 - DNA, 19 bp, Homo sapiens
gaagggaacagcctgagcc

SEQ ID NO: 4248556 - DNA, 15 bp, Homo sapiens
gaagtaaagccatta

SEQ ID NO: 4248557 - DNA, 18 bp, Homo sapiens
gaagtaacttatttgact

SEQ ID NO: 4248558 - DNA, 16 bp, Homo sapiens
gaagtgagggaggaag

SEQ ID NO: 4248559 - DNA, 20 bp, Homo sapiens
gaagttctcaaagttaattc

SEQ ID NO: 4248560 - DNA, 16 bp, Homo sapiens
gaataaactgaatatt

SEQ ID NO: 4248561 - DNA, 15 bp, Homo sapiens
gaataatggaaacat

SEQ ID NO: 4248562 - DNA, 15 bp, Homo sapiens
gaatatatatatata

SEQ ID NO: 4248563 - DNA, 21 bp, Homo sapiens
gaatatatcagtacctctcaa

SEQ ID NO: 4248564 - DNA, 19 bp, Homo sapiens
gaatattttggaaactgct

SEQ ID NO: 4248565 - DNA, 22 bp, Homo sapiens
gaatattttggaaactgctaaa

SEQ ID NO: 4248566 - DNA, 21 bp, Homo sapiens
gaatcattccagtgctagaaa

SEQ ID NO: 4248567 - DNA, 15 bp, Homo sapiens
gaatcccttaaaatt

SEQ ID NO: 4248568 - DNA, 17 bp, Homo sapiens
gaatgtgaagccagatc

SEQ ID NO: 4248569 - DNA, 17 bp, Homo sapiens
gaattctctagtttgat

SEQ ID NO: 4248570 - DNA, 14 bp, Homo sapiens
gacaaagatttctt

SEQ ID NO: 4248571 - DNA, 16 bp, Homo sapiens
gacaataattctacat

SEQ ID NO: 4248572 - DNA, 14 bp, Homo sapiens
gacaatcattgttt

SEQ ID NO: 4248573 - DNA, 17 bp, Homo sapiens
gacaatgacttactgta

SEQ ID NO: 4248574 - DNA, 17 bp, Homo sapiens
gacaatgttttcttcaa

SEQ ID NO: 4248575 - DNA, 18 bp, Homo sapiens
gacaatgttttcttcaac

SEQ ID NO: 4248576 - DNA, 19 bp, Homo sapiens
gacaatttattatggcaca

SEQ ID NO: 4248577 - DNA, 20 bp, Homo sapiens
gacacaatatgtatgctttt

SEQ ID NO: 4248578 - DNA, 22 bp, Homo sapiens
gacacaatatgtatgcttttta

SEQ ID NO: 4248579 - DNA, 14 bp, Homo sapiens
gacactttacctct

SEQ ID NO: 4248580 - DNA, 15 bp, Homo sapiens
gacactttacctctt

SEQ ID NO: 4248581 - DNA, 11 bp, Homo sapiens
gacagcctccc

SEQ ID NO: 4248582 - DNA, 16 bp, Homo sapiens
gacagcctcccacccc

SEQ ID NO: 4248583 - DNA, 15 bp, Homo sapiens
gacaggcctgaagat

SEQ ID NO: 4248584 - DNA, 20 bp, Homo sapiens
gacatacatattatctcatt

SEQ ID NO: 4248585 - DNA, 15 bp, Homo sapiens
gacatactaaccagc

SEQ ID NO: 4248586 - DNA, 21 bp, Homo sapiens
gacattaaatgcaataatttt

SEQ ID NO: 4248587 - DNA, 14 bp, Homo sapiens
gaccacgtttctaa

SEQ ID NO: 4248588 - DNA, 16 bp, Homo sapiens
gaccacgtttctaaag

SEQ ID NO: 4248589 - DNA, 13 bp, Homo sapiens
gaccccagagaaa

SEQ ID NO: 4248590 - DNA, 20 bp, Homo sapiens
gacctcaaatcactgcattc

SEQ ID NO: 4248591 - DNA, 14 bp, Homo sapiens
gacctctgcagcaa

SEQ ID NO: 4248592 - DNA, 22 bp, Homo sapiens
gacctctgcagcaataaagcag

SEQ ID NO: 4248593 - DNA, 14 bp, Homo sapiens
gacgctgccgggag

SEQ ID NO: 4248594 - DNA, 13 bp, Homo sapiens
gactatttgctaa

SEQ ID NO: 4248595 - DNA, 18 bp, Homo sapiens
gactcaaaaaaacaaaaa

SEQ ID NO: 4248596 - DNA, 16 bp, Homo sapiens
tctgcccagccctctg

SEQ ID NO: 4248597 - DNA, 19 bp, Homo sapiens
tctgcccagccctctgtgg

SEQ ID NO: 4248598 - DNA, 15 bp, Homo sapiens
tctgcccttacccca

SEQ ID NO: 4248599 - DNA, 20 bp, Homo sapiens
tctgccgctttgtctgtcca

SEQ ID NO: 4248600 - DNA, 20 bp, Homo sapiens
tctgctaaccatttatataa

SEQ ID NO: 4248601 - DNA, 12 bp, Homo sapiens
tctgctggccca

SEQ ID NO: 4248602 - DNA, 20 bp, Homo sapiens
tctgctttatcttttcataa

SEQ ID NO: 4248603 - DNA, 18 bp, Homo sapiens
tctggcacgtggccagga

SEQ ID NO: 4248604 - DNA, 17 bp, Homo sapiens
tctggctatgcatttga

SEQ ID NO: 4248605 - DNA, 15 bp, Homo sapiens
tctgggatctgccaa

SEQ ID NO: 4248606 - DNA, 19 bp, Homo sapiens
tctggtgtatattttaatg

SEQ ID NO: 4248607 - DNA, 15 bp, Homo sapiens
tctgtagccactagt

SEQ ID NO: 4248608 - DNA, 13 bp, Homo sapiens
tctgtatttctag

SEQ ID NO: 4248609 - DNA, 22 bp, Homo sapiens
tctgtccagccgtgtgtgcatg

SEQ ID NO: 4248610 - DNA, 12 bp, Homo sapiens
tctgtggccagg

SEQ ID NO: 4248611 - DNA, 13 bp, Homo sapiens
tctgtggccagga

SEQ ID NO: 4248612 - DNA, 16 bp, Homo sapiens
tctgtggccaggagcc

SEQ ID NO: 4248613 - DNA, 16 bp, Homo sapiens
tctgtgtctggcaggc

SEQ ID NO: 4248614 - DNA, 15 bp, Homo sapiens
tctgtgtgtatattg

SEQ ID NO: 4248615 - DNA, 12 bp, Homo sapiens
tctgtgtttaaa

SEQ ID NO: 4248616 - DNA, 12 bp, Homo sapiens
tctgttgctggt

SEQ ID NO: 4248617 - DNA, 19 bp, Homo sapiens
tctgtttagataatacacc

SEQ ID NO: 4248618 - DNA, 23 bp, Homo sapiens
tctgtttagataatacaccacta

SEQ ID NO: 4248619 - DNA, 16 bp, Homo sapiens
tcttaaacttgtgaat

SEQ ID NO: 4248620 - DNA, 20 bp, Homo sapiens
tcttaagatggaaatacagt

SEQ ID NO: 4248621 - DNA, 12 bp, Homo sapiens
tcttaatctgtg

SEQ ID NO: 4248622 - DNA, 21 bp, Homo sapiens
tcttagagccttttatctgca

SEQ ID NO: 4248623 - DNA, 19 bp, Homo sapiens
tcttatataagatcactga

SEQ ID NO: 4248624 - DNA, 18 bp, Homo sapiens
tcttcacctgttatgtat

SEQ ID NO: 4248625 - DNA, 14 bp, Homo sapiens
tcttcagatctcta

SEQ ID NO: 4248626 - DNA, 15 bp, Homo sapiens
tcttcagatctctaa

SEQ ID NO: 4248627 - DNA, 12 bp, Homo sapiens
tcttcccagagt

SEQ ID NO: 4248628 - DNA, 14 bp, Homo sapiens
tcttctgtatttct

SEQ ID NO: 4248629 - DNA, 16 bp, Homo sapiens
tcttctgtatttctag

SEQ ID NO: 4248630 - DNA, 22 bp, Homo sapiens
tcttctgtatttctaggcacaa

SEQ ID NO: 4248631 - DNA, 20 bp, Homo sapiens
tcttgagccttgaactttga

SEQ ID NO: 4248632 - DNA, 17 bp, Homo sapiens
tcttgcaacttcagttt

SEQ ID NO: 4248633 - DNA, 15 bp, Homo sapiens
tcttgcactgtccag

SEQ ID NO: 4248634 - DNA, 17 bp, Homo sapiens
tcttgcattcaaaatct

SEQ ID NO: 4248635 - DNA, 23 bp, Homo sapiens
tcttggggcaagactgcaaactt

SEQ ID NO: 4248636 - DNA, 22 bp, Homo sapiens
tcttggtttgtcagtttatctt

SEQ ID NO: 4248637 - DNA, 21 bp, Homo sapiens
tctttaagaatgcttaaaaaa

SEQ ID NO: 4248638 - DNA, 21 bp, Homo sapiens
tctttctggctatgcatttga

SEQ ID NO: 4248639 - DNA, 14 bp, Homo sapiens
tcttttacattctg

SEQ ID NO: 4248640 - DNA, 16 bp, Homo sapiens
tcttttctgtacttcc

SEQ ID NO: 4248641 - DNA, 18 bp, Homo sapiens
tcttttctgtacttcctg

SEQ ID NO: 4248642 - DNA, 19 bp, Homo sapiens
tcttttgccgttattaaaa

SEQ ID NO: 4248643 - DNA, 18 bp, Homo sapiens
tcttttggttattctaag

SEQ ID NO: 4248644 - DNA, 15 bp, Homo sapiens
tgaaaaaaattgaaa

SEQ ID NO: 4248645 - DNA, 14 bp, Homo sapiens
tgaaaaacaatttt

SEQ ID NO: 4248646 - DNA, 19 bp, Homo sapiens
tgaaaaatctcaattgaaa

SEQ ID NO: 4248647 - DNA, 20 bp, Homo sapiens
tgaaaaatgtttttattttt

SEQ ID NO: 4248648 - DNA, 17 bp, Homo sapiens
tgaaaagtcgttttcca

SEQ ID NO: 4248649 - DNA, 22 bp, Homo sapiens
tgaaaagtcgttttccaaactg

SEQ ID NO: 4248650 - DNA, 17 bp, Homo sapiens
tgaaaatgtgtttgctg

SEQ ID NO: 4248651 - DNA, 19 bp, Homo sapiens
tgaaaattttgatgtttta

SEQ ID NO: 4248652 - DNA, 16 bp, Homo sapiens
tgaaatgctggcattt

SEQ ID NO: 4248653 - DNA, 16 bp, Homo sapiens
tgaacatacttcaaaa

SEQ ID NO: 4248654 - DNA, 15 bp, Homo sapiens
tgaactgataaagat

SEQ ID NO: 4248655 - DNA, 20 bp, Homo sapiens
tgaactttgacctctgcagc

SEQ ID NO: 4248656 - DNA, 14 bp, Homo sapiens
tgaagacaataatt

SEQ ID NO: 4248657 - DNA, 13 bp, Homo sapiens
tgaagacaatgac

SEQ ID NO: 4248658 - DNA, 17 bp, Homo sapiens
tgaagacaatgacttac

SEQ ID NO: 4248659 - DNA, 22 bp, Homo sapiens
tgaagacaatgacttactgtac

SEQ ID NO: 4248660 - DNA, 16 bp, Homo sapiens
tgaagatatatttcac

SEQ ID NO: 4248661 - DNA, 18 bp, Homo sapiens
tgaagatggtttcaattc

SEQ ID NO: 4248662 - DNA, 21 bp, Homo sapiens
tgaagatggtttcaattcaga

SEQ ID NO: 4248663 - DNA, 21 bp, Homo sapiens
tgaagattaggagaaacacat

SEQ ID NO: 4248664 - DNA, 20 bp, Homo sapiens
tgaagcctggagctttcctg

SEQ ID NO: 4248665 - DNA, 19 bp, Homo sapiens
tgaaggaatcattccagtg

SEQ ID NO: 4248666 - DNA, 20 bp, Homo sapiens
tgaaggaatcattccagtgc

SEQ ID NO: 4248667 - DNA, 20 bp, Homo sapiens
tgaagggaacagcctgagcc

SEQ ID NO: 4248668 - DNA, 19 bp, Homo sapiens
tgaagtaaagccattaaat

SEQ ID NO: 4248669 - DNA, 17 bp, Homo sapiens
tgaagtaacttatttga

SEQ ID NO: 4248670 - DNA, 21 bp, Homo sapiens
tgaagtaatatgcacacattt

SEQ ID NO: 4248671 - DNA, 12 bp, Homo sapiens
tgaataaactga

SEQ ID NO: 4248672 - DNA, 13 bp, Homo sapiens
tgaataaactgaa

SEQ ID NO: 4248673 - DNA, 19 bp, Homo sapiens
tgaatattactcctatttt

SEQ ID NO: 4248674 - DNA, 15 bp, Homo sapiens
tgaatattttgataa

SEQ ID NO: 4248675 - DNA, 18 bp, Homo sapiens
tgaatattttggaaactg

SEQ ID NO: 4248676 - DNA, 20 bp, Homo sapiens
tgaatattttggaaactgct

SEQ ID NO: 4248677 - DNA, 19 bp, Homo sapiens
tgacaaagactgagtacgt

SEQ ID NO: 4248678 - DNA, 16 bp, Homo sapiens
tgacagactatttgct

SEQ ID NO: 4248679 - DNA, 19 bp, Homo sapiens
tgacagactatttgctaat

SEQ ID NO: 4248680 - DNA, 11 bp, Homo sapiens
tgacagcctcc

SEQ ID NO: 4248681 - DNA, 19 bp, Homo sapiens
tgacagcctcccaccccca

SEQ ID NO: 4248682 - DNA, 22 bp, Homo sapiens
tgacagcctcccacccccatct

SEQ ID NO: 4248683 - DNA, 12 bp, Homo sapiens
tgacatttgttt

SEQ ID NO: 4248684 - DNA, 18 bp, Homo sapiens
tgacctctgcagcaataa

SEQ ID NO: 4248685 - DNA, 13 bp, Homo sapiens
tgactgaatttct

SEQ ID NO: 4248686 - DNA, 15 bp, Homo sapiens
tgactgaatttcttt

SEQ ID NO: 4248687 - DNA, 22 bp, Homo sapiens
tgactgttgatgaagtatactt

SEQ ID NO: 4248688 - DNA, 13 bp, Homo sapiens
tgacttactgtac

SEQ ID NO: 4248689 - DNA, 18 bp, Homo sapiens
tgacttcgcagccccggg

SEQ ID NO: 4248690 - DNA, 22 bp, Homo sapiens
tgacttcgcagccccgggcgga

SEQ ID NO: 4248691 - DNA, 20 bp, Homo sapiens
tgacttgtacaaacagtatt

SEQ ID NO: 4248692 - DNA, 23 bp, Homo sapiens
tgacttgtacaaacagtatttct

SEQ ID NO: 4248693 - DNA, 12 bp, Homo sapiens
tgactttgtata

SEQ ID NO: 4248694 - DNA, 17 bp, Homo sapiens
tgactttttttggtata

SEQ ID NO: 4248695 - DNA, 22 bp, Homo sapiens
tgagacctggggtttagaaccc

SEQ ID NO: 4248696 - DNA, 16 bp, Homo sapiens
tgagagaatggagaca

SEQ ID NO: 4248697 - DNA, 17 bp, Homo sapiens
tgagaggtttgcatcca

SEQ ID NO: 4248698 - DNA, 12 bp, Homo sapiens
tgagccaccacg

SEQ ID NO: 4248699 - DNA, 14 bp, Homo sapiens
tgagccttgaactt

SEQ ID NO: 4248700 - DNA, 15 bp, Homo sapiens
tgagccttgaacttt

SEQ ID NO: 4248701 - DNA, 12 bp, Homo sapiens
tgagctgcaggt

SEQ ID NO: 4248702 - DNA, 21 bp, Homo sapiens
tgagctttctgtgcatgtgca

SEQ ID NO: 4248703 - DNA, 19 bp, Homo sapiens
tgaggaactgtacagaaaa

SEQ ID NO: 4248704 - DNA, 19 bp, Homo sapiens
tgaggcatttgtttgaact

SEQ ID NO: 4248705 - DNA, 15 bp, Homo sapiens
tgaggtctgttcttt

SEQ ID NO: 4248706 - DNA, 14 bp, Homo sapiens
tgagtctctggggc

SEQ ID NO: 4248707 - DNA, 14 bp, Homo sapiens
tgagtggccaggga

SEQ ID NO: 4248708 - DNA, 20 bp, Homo sapiens
tgagtgtgtgtgtgtgtctg

SEQ ID NO: 4248709 - DNA, 16 bp, Homo sapiens
tgagtttgtaggtaaa

SEQ ID NO: 4248710 - DNA, 19 bp, Homo sapiens
tgataaaataaataatttt

SEQ ID NO: 4248711 - DNA, 18 bp, Homo sapiens
tgataataatattgtttt

SEQ ID NO: 4248712 - DNA, 14 bp, Homo sapiens
tgatattgtttaaa

SEQ ID NO: 4248713 - DNA, 16 bp, Homo sapiens
tgatattgtttaaaat

SEQ ID NO: 4248714 - DNA, 17 bp, Homo sapiens
tgatattgtttaaaatt

SEQ ID NO: 4248715 - DNA, 20 bp, Homo sapiens
tgatccatagtgctacctgc

SEQ ID NO: 4248716 - DNA, 15 bp, Homo sapiens
tgatgaagtatactt

SEQ ID NO: 4248717 - DNA, 21 bp, Homo sapiens
tgatgattttcatttcatgaa

SEQ ID NO: 4248718 - DNA, 21 bp, Homo sapiens
tgatgcaggcacttattgtaa

SEQ ID NO: 4248719 - DNA, 15 bp, Homo sapiens
tgatgcccaatatat

SEQ ID NO: 4248720 - DNA, 18 bp, Homo sapiens
tgatgccctgctccaggg

SEQ ID NO: 4248721 - DNA, 19 bp, Homo sapiens
tgatgccctgctccaggga

SEQ ID NO: 4248722 - DNA, 18 bp, Homo sapiens
tgatgtgtcctgtacaca

SEQ ID NO: 4248723 - DNA, 17 bp, Homo sapiens
tgatgttttaaggatgc

SEQ ID NO: 4248724 - DNA, 21 bp, Homo sapiens
tgatgttttaaggatgcttgt

SEQ ID NO: 4248725 - DNA, 13 bp, Homo sapiens
tgattaaattctt

SEQ ID NO: 4248726 - DNA, 16 bp, Homo sapiens
tgattaaattcttgca

SEQ ID NO: 4248727 - DNA, 17 bp, Homo sapiens
tgattaaattcttgcaa

SEQ ID NO: 4248728 - DNA, 20 bp, Homo sapiens
tgattaaattcttgcaaagt

SEQ ID NO: 4248729 - DNA, 19 bp, Homo sapiens
tgattctccttttatgtgt

SEQ ID NO: 4248730 - DNA, 15 bp, Homo sapiens
tgatttccttcaatg

SEQ ID NO: 4248731 - DNA, 16 bp, Homo sapiens
tgatttccttcaatgt

SEQ ID NO: 4248732 - DNA, 15 bp, Homo sapiens
tgatttgatgtgact

SEQ ID NO: 4248733 - DNA, 17 bp, Homo sapiens
tgatttgatgtgacttt

SEQ ID NO: 4248734 - DNA, 21 bp, Homo sapiens
tgcaaaggtggcaatgcttaa

SEQ ID NO: 4248735 - DNA, 15 bp, Homo sapiens
tgcaatccatttatt

SEQ ID NO: 4248736 - DNA, 12 bp, Homo sapiens
tgcacaaggatt

SEQ ID NO: 4248737 - DNA, 19 bp, Homo sapiens
tgcacaaggattgaaaatt

SEQ ID NO: 4248738 - DNA, 10 bp, Homo sapiens
tgcacacatt

SEQ ID NO: 4248739 - DNA, 15 bp, Homo sapiens
tgcacacatttttta

SEQ ID NO: 4248740 - DNA, 20 bp, Homo sapiens
tgcacacattttttaaatgc

SEQ ID NO: 4248741 - DNA, 18 bp, Homo sapiens
tgcacagagttgttacat

SEQ ID NO: 4248742 - DNA, 23 bp, Homo sapiens
tgcacagagttgttacattttta

SEQ ID NO: 4248743 - DNA, 19 bp, Homo sapiens
tgcacagatatactttgtg

SEQ ID NO: 4248744 - DNA, 14 bp, Homo sapiens
tgcacctgagcctg

SEQ ID NO: 4248745 - DNA, 18 bp, Homo sapiens
tgcacctgagcctgttcc

SEQ ID NO: 4248746 - DNA, 20 bp, Homo sapiens
tgcacctggaatatataacc

SEQ ID NO: 4248747 - DNA, 12 bp, Homo sapiens
tgcactctgtaa

SEQ ID NO: 4248748 - DNA, 14 bp, Homo sapiens
tgcagaataatgga

SEQ ID NO: 4248749 - DNA, 15 bp, Homo sapiens
tgcagaataatggaa

SEQ ID NO: 4248750 - DNA, 21 bp, Homo sapiens
tgcagaataatggaaacatta

SEQ ID NO: 4248751 - DNA, 14 bp, Homo sapiens
tgcagcaataaagc

SEQ ID NO: 4248752 - DNA, 20 bp, Homo sapiens
tgcagcaataaagcagcgtt

SEQ ID NO: 4248753 - DNA, 20 bp, Homo sapiens
tgcagcccgtgtccaggagc

SEQ ID NO: 4248754 - DNA, 23 bp, Homo sapiens
tgcagcctttgcctccccggctc

SEQ ID NO: 4248755 - DNA, 9 bp, Homo sapiens
tgcagggcc

SEQ ID NO: 4248756 - DNA, 13 bp, Homo sapiens
tgcagggccgggc

SEQ ID NO: 4248757 - DNA, 18 bp, Homo sapiens
tgcagggccgggcagggg

SEQ ID NO: 4248758 - DNA, 20 bp, Homo sapiens
tgcataccacttttgttctt

SEQ ID NO: 4248759 - DNA, 21 bp, Homo sapiens
tgcataccacttttgttcttg

SEQ ID NO: 4248760 - DNA, 20 bp, Homo sapiens
tgcatgaagtaatatgcaca

SEQ ID NO: 4248761 - DNA, 17 bp, Homo sapiens
tgcatgtgccgaggtgc

SEQ ID NO: 4248762 - DNA, 15 bp, Homo sapiens
tgcatgtttgtgatt

SEQ ID NO: 4248763 - DNA, 17 bp, Homo sapiens
tgcattatctagatact

SEQ ID NO: 4248764 - DNA, 18 bp, Homo sapiens
tgcattcattctgagccc

SEQ ID NO: 4248765 - DNA, 21 bp, Homo sapiens
tgcatttgaggtctgttcttt

SEQ ID NO: 4248766 - DNA, 23 bp, Homo sapiens
tgccagtctcactgtgggaaggc

SEQ ID NO: 4248767 - DNA, 21 bp, Homo sapiens
tgccagtgctaagctgccctg

SEQ ID NO: 4248768 - DNA, 23 bp, Homo sapiens
tgccagtgctaagctgccctgag

SEQ ID NO: 4248769 - DNA, 13 bp, Homo sapiens
tgccagtggagac

SEQ ID NO: 4248770 - DNA, 16 bp, Homo sapiens
tgccagtggagacgga

SEQ ID NO: 4248771 - DNA, 20 bp, Homo sapiens
tgccatgcccttacacgtgc

SEQ ID NO: 4248772 - DNA, 14 bp, Homo sapiens
tgcccagccctctg

SEQ ID NO: 4248773 - DNA, 15 bp, Homo sapiens
tgcccagctaatttt

SEQ ID NO: 4248774 - DNA, 19 bp, Homo sapiens
tgccctaaagtgtattttt

SEQ ID NO: 4248775 - DNA, 21 bp, Homo sapiens
tgcccttacacgtgcgtgtga

SEQ ID NO: 4248776 - DNA, 15 bp, Homo sapiens
tgccgctttgtctgt

SEQ ID NO: 4248777 - DNA, 18 bp, Homo sapiens
tgccgctttgtctgtcca

SEQ ID NO: 4248778 - DNA, 20 bp, Homo sapiens
tgccgctttgtctgtccagc

SEQ ID NO: 4248779 - DNA, 14 bp, Homo sapiens
tgcctccaacccag

SEQ ID NO: 4248780 - DNA, 18 bp, Homo sapiens
tgcctccccggctcgagc

SEQ ID NO: 4248781 - DNA, 23 bp, Homo sapiens
tgcctggcaggctgtctggccag

SEQ ID NO: 4248782 - DNA, 20 bp, Homo sapiens
tgccttaccctcatgttctt

SEQ ID NO: 4248783 - DNA, 21 bp, Homo sapiens
tgccttaccctcatgttctta

SEQ ID NO: 4248784 - DNA, 18 bp, Homo sapiens
tgccttgctcctagcaga

SEQ ID NO: 4248785 - DNA, 16 bp, Homo sapiens
tgcgcacttacctgct

SEQ ID NO: 4248786 - DNA, 21 bp, Homo sapiens
tgcgcacttacctgcttgagc

SEQ ID NO: 4248787 - DNA, 16 bp, Homo sapiens
tgctaaattctatgtt

SEQ ID NO: 4248788 - DNA, 13 bp, Homo sapiens
tgctaatgtataa

SEQ ID NO: 4248789 - DNA, 16 bp, Homo sapiens
tgctaatgtataatgt

SEQ ID NO: 4248790 - DNA, 20 bp, Homo sapiens
tgctagcaaatggcagaacc

SEQ ID NO: 4248791 - DNA, 14 bp, Homo sapiens
tgctccaaatataa

SEQ ID NO: 4248792 - DNA, 13 bp, Homo sapiens
tgctgaagggcat

SEQ ID NO: 4248793 - DNA, 18 bp, Homo sapiens
tgctgaagggcattcttt

SEQ ID NO: 4248794 - DNA, 16 bp, Homo sapiens
tgctgagtaaacataa

SEQ ID NO: 4248795 - DNA, 19 bp, Homo sapiens
tgctgcatttaaaagatac

SEQ ID NO: 4248796 - DNA, 20 bp, Homo sapiens
tgctgccttgctcctagcag

SEQ ID NO: 4248797 - DNA, 17 bp, Homo sapiens
tgctgggaatacatctg

SEQ ID NO: 4248798 - DNA, 13 bp, Homo sapiens
tgctgggtgccag

SEQ ID NO: 4248799 - DNA, 17 bp, Homo sapiens
tgctgggtgccaggtgc

SEQ ID NO: 4248800 - DNA, 14 bp, Homo sapiens
tgctgggtggcagg

SEQ ID NO: 4248801 - DNA, 16 bp, Homo sapiens
tgctgggtggcagggg

SEQ ID NO: 4248802 - DNA, 19 bp, Homo sapiens
tgctgtccgtgcttgctgg

SEQ ID NO: 4248803 - DNA, 15 bp, Homo sapiens
tgcttaaaaaataat

SEQ ID NO: 4248804 - DNA, 16 bp, Homo sapiens
tgcttagtaaaattta

SEQ ID NO: 4248805 - DNA, 15 bp, Homo sapiens
tgcttcaatcccagc

SEQ ID NO: 4248806 - DNA, 14 bp, Homo sapiens
tgcttcattgaaag

SEQ ID NO: 4248807 - DNA, 16 bp, Homo sapiens
tgcttcattgaaagct

SEQ ID NO: 4248808 - DNA, 15 bp, Homo sapiens
tgcttctcacttttt

SEQ ID NO: 4248809 - DNA, 16 bp, Homo sapiens
tgcttctccccagaat

SEQ ID NO: 4248810 - DNA, 17 bp, Homo sapiens
tgcttgggtcctactcc

SEQ ID NO: 4248811 - DNA, 21 bp, Homo sapiens
tgcttgggtcctactcctgga

SEQ ID NO: 4248812 - DNA, 12 bp, Homo sapiens
tgcttgtacata

SEQ ID NO: 4248813 - DNA, 16 bp, Homo sapiens
tgcttgtacataatgc

SEQ ID NO: 4248814 - DNA, 19 bp, Homo sapiens
tgcttgttccctctccctg

SEQ ID NO: 4248815 - DNA, 16 bp, Homo sapiens
tgctttgtgatttttg

SEQ ID NO: 4248816 - DNA, 14 bp, Homo sapiens
tggaaactgctaaa

SEQ ID NO: 4248817 - DNA, 17 bp, Homo sapiens
tggaaactgctaaattc

SEQ ID NO: 4248818 - DNA, 19 bp, Homo sapiens
tggaaactgctaaattcta

SEQ ID NO: 4248819 - DNA, 15 bp, Homo sapiens
tggaacataaagttg

SEQ ID NO: 4248820 - DNA, 16 bp, Homo sapiens
tggaatatataaccag

SEQ ID NO: 4248821 - DNA, 15 bp, Homo sapiens
tggaatgttacatct

SEQ ID NO: 4248822 - DNA, 19 bp, Homo sapiens
tggaatgttacatctgtct

SEQ ID NO: 4248823 - DNA, 17 bp, Homo sapiens
tggaattaaaaggatag

SEQ ID NO: 4248824 - DNA, 20 bp, Homo sapiens
tggactccagcctgcctggc

SEQ ID NO: 4248825 - DNA, 16 bp, Homo sapiens
tggactgtctgatcag

SEQ ID NO: 4248826 - DNA, 19 bp, Homo sapiens
tggagacctctccttccta

SEQ ID NO: 4248827 - DNA, 19 bp, Homo sapiens
tggagacggaatctgccgc

SEQ ID NO: 4248828 - DNA, 13 bp, Homo sapiens
tggatgcaaagta

SEQ ID NO: 4248829 - DNA, 21 bp, Homo sapiens
tggcaataaataaagcttggg

SEQ ID NO: 4248830 - DNA, 13 bp, Homo sapiens
tggcaattccaat

SEQ ID NO: 4248831 - DNA, 23 bp, Homo sapiens
tggcacatcagcacgatttctgt

SEQ ID NO: 4248832 - DNA, 14 bp, Homo sapiens
tggcagctagtgcc

SEQ ID NO: 4248833 - DNA, 15 bp, Homo sapiens
tggcagctagtgcct

SEQ ID NO: 4248834 - DNA, 13 bp, Homo sapiens
tggcagtgacttt

SEQ ID NO: 4248835 - DNA, 20 bp, Homo sapiens
tggcagtgactttgtataga

SEQ ID NO: 4248836 - DNA, 13 bp, Homo sapiens
tggcatggagact

SEQ ID NO: 4248837 - DNA, 14 bp, Homo sapiens
tggcatggagactc

SEQ ID NO: 4248838 - DNA, 16 bp, Homo sapiens
tggcatggagactctg

SEQ ID NO: 4248839 - DNA, 21 bp, Homo sapiens
tggccagccaacttttgcatg

SEQ ID NO: 4248840 - DNA, 12 bp, Homo sapiens
tggccaggagcc

SEQ ID NO: 4248841 - DNA, 17 bp, Homo sapiens
tggccaggagccctggc

SEQ ID NO: 4248842 - DNA, 21 bp, Homo sapiens
tggcccgcaagagggacagag

SEQ ID NO: 4248843 - DNA, 18 bp, Homo sapiens
tggcccggaagaaccaga

SEQ ID NO: 4248844 - DNA, 15 bp, Homo sapiens
tggcccttctgccct

SEQ ID NO: 4248845 - DNA, 23 bp, Homo sapiens
tggcctagcatacgtacacattt

SEQ ID NO: 4248846 - DNA, 19 bp, Homo sapiens
tggcctcgtgctccgcagg

SEQ ID NO: 4248847 - DNA, 22 bp, Homo sapiens
tggcggcccggccggagggcag

SEQ ID NO: 4248848 - DNA, 21 bp, Homo sapiens
tggcgtaagatgatggatttg

SEQ ID NO: 4248849 - DNA, 17 bp, Homo sapiens
tggctatgcatttgaaa

SEQ ID NO: 4248850 - DNA, 18 bp, Homo sapiens
tggctcagagcttgaaga

SEQ ID NO: 4248851 - DNA, 14 bp, Homo sapiens
tggcttttgtgcat

SEQ ID NO: 4248852 - DNA, 14 bp, Homo sapiens
tgggaccccagaga

SEQ ID NO: 4248853 - DNA, 23 bp, Homo sapiens
tgggagctgctgggtggcagggg

SEQ ID NO: 4248854 - DNA, 23 bp, Homo sapiens
tgggaggagggaggcggcctcca

SEQ ID NO: 4248855 - DNA, 18 bp, Homo sapiens
tgggagggaggcatctgc

SEQ ID NO: 4248856 - DNA, 22 bp, Homo sapiens
tgggatggacgctgccgggaga

SEQ ID NO: 4248857 - DNA, 15 bp, Homo sapiens
tgggctgctgcaggc

SEQ ID NO: 4248858 - DNA, 19 bp, Homo sapiens
tgggctgctgcaggccgtg

SEQ ID NO: 4248859 - DNA, 19 bp, Homo sapiens
tggggagtaggacatacca

SEQ ID NO: 4248860 - DNA, 21 bp, Homo sapiens
tggggtctcacagtgttgccc

SEQ ID NO: 4248861 - DNA, 23 bp, Homo sapiens
tggggtctcacagtgttgcccag

SEQ ID NO: 4248862 - DNA, 18 bp, Homo sapiens
tgggtcctactcctggag

SEQ ID NO: 4248863 - DNA, 16 bp, Homo sapiens
tgggtgaagtgcctgc

SEQ ID NO: 4248864 - DNA, 15 bp, Homo sapiens
tgggtgccaggtgct

SEQ ID NO: 4248865 - DNA, 20 bp, Homo sapiens
tggtactctgtgtctggcag

SEQ ID NO: 4248866 - DNA, 22 bp, Homo sapiens
tggtagcataaataaaactgaa

SEQ ID NO: 4248867 - DNA, 22 bp, Homo sapiens
tggtataatgtttaaatcatgt

SEQ ID NO: 4248868 - DNA, 15 bp, Homo sapiens
tggtcatatacatat

SEQ ID NO: 4248869 - DNA, 14 bp, Homo sapiens
tggtcggaaaacat

SEQ ID NO: 4248870 - DNA, 17 bp, Homo sapiens
tggtggctcatgcctgt

SEQ ID NO: 4248871 - DNA, 17 bp, Homo sapiens
tggtggtttcagaaatg

SEQ ID NO: 4248872 - DNA, 18 bp, Homo sapiens
tggtggtttcagaaatgt

SEQ ID NO: 4248873 - DNA, 22 bp, Homo sapiens
tggtgtactctaggacttcaaa

SEQ ID NO: 4248874 - DNA, 11 bp, Homo sapiens
tggtgtatttt

SEQ ID NO: 4248875 - DNA, 16 bp, Homo sapiens
tggtgttgacatacat

SEQ ID NO: 4248876 - DNA, 13 bp, Homo sapiens
tggttattctaag

SEQ ID NO: 4248877 - DNA, 19 bp, Homo sapiens
tggttgggtggcaattcca

SEQ ID NO: 4248878 - DNA, 14 bp, Homo sapiens
tggtttcagaaatg

SEQ ID NO: 4248879 - DNA, 15 bp, Homo sapiens
tggtttcagaaatgt

SEQ ID NO: 4248880 - DNA, 15 bp, Homo sapiens
tggtttgtaaattaa

SEQ ID NO: 4248881 - DNA, 15 bp, Homo sapiens
tggttttctgttctt

SEQ ID NO: 4248882 - DNA, 21 bp, Homo sapiens
tgtaaagttatgtatttaaag

SEQ ID NO: 4248883 - DNA, 13 bp, Homo sapiens
tgtaaattaactt

SEQ ID NO: 4248884 - DNA, 16 bp, Homo sapiens
tgtaagaacacatttt

SEQ ID NO: 4248885 - DNA, 19 bp, Homo sapiens
tgtaagaacacattttaaa

SEQ ID NO: 4248886 - DNA, 14 bp, Homo sapiens
tgtaatttgtgata

SEQ ID NO: 4248887 - DNA, 17 bp, Homo sapiens
tgtaatttgtgatacaa

SEQ ID NO: 4248888 - DNA, 15 bp, Homo sapiens
tgtacaagttgttat

SEQ ID NO: 4248889 - DNA, 21 bp, Homo sapiens
tgtacacagtgggaagatttt

SEQ ID NO: 4248890 - DNA, 14 bp, Homo sapiens
tgtacataaacaat

SEQ ID NO: 4248891 - DNA, 14 bp, Homo sapiens
tgtacatctggcct

SEQ ID NO: 4248892 - DNA, 16 bp, Homo sapiens
tgtacatgaaaacaca

SEQ ID NO: 4248893 - DNA, 19 bp, Homo sapiens
tgtacatgaaaacacattt

SEQ ID NO: 4248894 - DNA, 23 bp, Homo sapiens
tgtaccacagacacaatatgtat

SEQ ID NO: 4248895 - DNA, 22 bp, Homo sapiens
tgtacctcttgagccttgaact

SEQ ID NO: 4248896 - DNA, 13 bp, Homo sapiens
acatactaaccag

SEQ ID NO: 4248897 - DNA, 13 bp, Homo sapiens
acatactgcttga

SEQ ID NO: 4248898 - DNA, 20 bp, Homo sapiens
acatactgcttgattttaat

SEQ ID NO: 4248899 - DNA, 21 bp, Homo sapiens
acatagaggtatattggaaga

SEQ ID NO: 4248900 - DNA, 20 bp, Homo sapiens
acatcagcacgatttctgtt

SEQ ID NO: 4248901 - DNA, 21 bp, Homo sapiens
acatcagcacgatttctgttt

SEQ ID NO: 4248902 - DNA, 23 bp, Homo sapiens
acatctcttcctccgaggccagt

SEQ ID NO: 4248903 - DNA, 21 bp, Homo sapiens
acatctgtctttcatctccca

SEQ ID NO: 4248904 - DNA, 22 bp, Homo sapiens
acatctgtctttcatctcccag

SEQ ID NO: 4248905 - DNA, 16 bp, Homo sapiens
acatgaaaacacattt

SEQ ID NO: 4248906 - DNA, 22 bp, Homo sapiens
acatgaaaacacatttttctta

SEQ ID NO: 4248907 - DNA, 18 bp, Homo sapiens
acatgcaaggtcattttt

SEQ ID NO: 4248908 - DNA, 21 bp, Homo sapiens
acatgctacacactgcatgtt

SEQ ID NO: 4248909 - DNA, 18 bp, Homo sapiens
acatgtatttatgtaatg

SEQ ID NO: 4248910 - DNA, 14 bp, Homo sapiens
acattataacaact

SEQ ID NO: 4248911 - DNA, 19 bp, Homo sapiens
acattataacaactattta

SEQ ID NO: 4248912 - DNA, 21 bp, Homo sapiens
acattatctcacttagtcctt

SEQ ID NO: 4248913 - DNA, 18 bp, Homo sapiens
acattccctctaatttga

SEQ ID NO: 4248914 - DNA, 19 bp, Homo sapiens
acattccctctaatttgaa

SEQ ID NO: 4248915 - DNA, 12 bp, Homo sapiens
acattctgttaa

SEQ ID NO: 4248916 - DNA, 19 bp, Homo sapiens
acatttatgtgaggtaatt

SEQ ID NO: 4248917 - DNA, 16 bp, Homo sapiens
acattttaaatactct

SEQ ID NO: 4248918 - DNA, 21 bp, Homo sapiens
acattttaaatactctactta

SEQ ID NO: 4248919 - DNA, 14 bp, Homo sapiens
acattttattttat

SEQ ID NO: 4248920 - DNA, 15 bp, Homo sapiens
acatttttaagtgct

SEQ ID NO: 4248921 - DNA, 22 bp, Homo sapiens
accaaggacggaaaatgcttaa

SEQ ID NO: 4248922 - DNA, 16 bp, Homo sapiens
accacaaatgcataaa

SEQ ID NO: 4248923 - DNA, 23 bp, Homo sapiens
accacagacacaatatgtatgct

SEQ ID NO: 4248924 - DNA, 17 bp, Homo sapiens
accacgccccaggacct

SEQ ID NO: 4248925 - DNA, 16 bp, Homo sapiens
accactacattctgtt

SEQ ID NO: 4248926 - DNA, 20 bp, Homo sapiens
accactctatcaagtattat

SEQ ID NO: 4248927 - DNA, 19 bp, Homo sapiens
accagacaaaaaaatttaa

SEQ ID NO: 4248928 - DNA, 21 bp, Homo sapiens
accagacaaaaaaatttaaaa

SEQ ID NO: 4248929 - DNA, 14 bp, Homo sapiens
accagcccacagca

SEQ ID NO: 4248930 - DNA, 16 bp, Homo sapiens
accagcttagatttta

SEQ ID NO: 4248931 - DNA, 16 bp, Homo sapiens
accaggtgagaagtga

SEQ ID NO: 4248932 - DNA, 14 bp, Homo sapiens
accatattaccaca

SEQ ID NO: 4248933 - DNA, 16 bp, Homo sapiens
accatattaccacaga

SEQ ID NO: 4248934 - DNA, 20 bp, Homo sapiens
accatattaccacagacata

SEQ ID NO: 4248935 - DNA, 22 bp, Homo sapiens
accatctctgtgattacctctc

SEQ ID NO: 4248936 - DNA, 16 bp, Homo sapiens
accatttgctactgta

SEQ ID NO: 4248937 - DNA, 11 bp, Homo sapiens
accatttttca

SEQ ID NO: 4248938 - DNA, 17 bp, Homo sapiens
acccactttgtaatttt

SEQ ID NO: 4248939 - DNA, 19 bp, Homo sapiens
acccactttgtaatttttg

SEQ ID NO: 4248940 - DNA, 20 bp, Homo sapiens
acccactttgtaatttttgc

SEQ ID NO: 4248941 - DNA, 15 bp, Homo sapiens
accccatcccacacc

SEQ ID NO: 4248942 - DNA, 16 bp, Homo sapiens
acccggtgcatctggc

SEQ ID NO: 4248943 - DNA, 21 bp, Homo sapiens
accctcacctctcccccaagg

SEQ ID NO: 4248944 - DNA, 17 bp, Homo sapiens
acccttttcctttgtgg

SEQ ID NO: 4248945 - DNA, 16 bp, Homo sapiens
accgaggtgttgccag

SEQ ID NO: 4248946 - DNA, 15 bp, Homo sapiens
accgcttctgccttt

SEQ ID NO: 4248947 - DNA, 16 bp, Homo sapiens
accgttggggccctta

SEQ ID NO: 4248948 - DNA, 18 bp, Homo sapiens
acctaatgtctcactgtt

SEQ ID NO: 4248949 - DNA, 23 bp, Homo sapiens
acctaatgtctcactgttctgca

SEQ ID NO: 4248950 - DNA, 16 bp, Homo sapiens
acctcctaatggcatg

SEQ ID NO: 4248951 - DNA, 17 bp, Homo sapiens
acctcctaatggcatgg

SEQ ID NO: 4248952 - DNA, 21 bp, Homo sapiens
acctctcgtttctgcccagcc

SEQ ID NO: 4248953 - DNA, 21 bp, Homo sapiens
acctcttgagccttgaacttt

SEQ ID NO: 4248954 - DNA, 20 bp, Homo sapiens
acctgagggggaaaaaacag

SEQ ID NO: 4248955 - DNA, 14 bp, Homo sapiens
acctgcacctctgg

SEQ ID NO: 4248956 - DNA, 15 bp, Homo sapiens
acctgcacctctgga

SEQ ID NO: 4248957 - DNA, 14 bp, Homo sapiens
acctgtctcagcct

SEQ ID NO: 4248958 - DNA, 14 bp, Homo sapiens
acctgttatgtatg

SEQ ID NO: 4248959 - DNA, 15 bp, Homo sapiens
acctgttatgtatga

SEQ ID NO: 4248960 - DNA, 17 bp, Homo sapiens
acctgttatgtatgaag

SEQ ID NO: 4248961 - DNA, 14 bp, Homo sapiens
accttttattacat

SEQ ID NO: 4248962 - DNA, 17 bp, Homo sapiens
accttttttatacataa

SEQ ID NO: 4248963 - DNA, 21 bp, Homo sapiens
accttttttatacataaacaa

SEQ ID NO: 4248964 - DNA, 19 bp, Homo sapiens
acgatttctgtttagataa

SEQ ID NO: 4248965 - DNA, 20 bp, Homo sapiens
acgatttctgtttagataat

SEQ ID NO: 4248966 - DNA, 23 bp, Homo sapiens
acgcaatgaaaagtcgttttcca

SEQ ID NO: 4248967 - DNA, 21 bp, Homo sapiens
acgcagtccgcccaggtcccc

SEQ ID NO: 4248968 - DNA, 12 bp, Homo sapiens
acgccccaggac

SEQ ID NO: 4248969 - DNA, 23 bp, Homo sapiens
acgcctctccctaggagaagagt

SEQ ID NO: 4248970 - DNA, 13 bp, Homo sapiens
acggaaaatgctt

SEQ ID NO: 4248971 - DNA, 16 bp, Homo sapiens
acggaaaatgcttaaa

SEQ ID NO: 4248972 - DNA, 17 bp, Homo sapiens
acgtccactcccaagcc

SEQ ID NO: 4248973 - DNA, 19 bp, Homo sapiens
acgtcgccataaaggcccc

SEQ ID NO: 4248974 - DNA, 20 bp, Homo sapiens
acgtgcgtgtgagtgtgtgt

SEQ ID NO: 4248975 - DNA, 14 bp, Homo sapiens
acgtggccaggagc

SEQ ID NO: 4248976 - DNA, 15 bp, Homo sapiens
acgttgtgcatttgg

SEQ ID NO: 4248977 - DNA, 15 bp, Homo sapiens
acgtttctaaaggct

SEQ ID NO: 4248978 - DNA, 16 bp, Homo sapiens
acgtttctaaaggcta

SEQ ID NO: 4248979 - DNA, 22 bp, Homo sapiens
acgtttctaaaggctacctttg

SEQ ID NO: 4248980 - DNA, 15 bp, Homo sapiens
acgtttgatacaaca

SEQ ID NO: 4248981 - DNA, 15 bp, Homo sapiens
actaaataatgaata

SEQ ID NO: 4248982 - DNA, 23 bp, Homo sapiens
actaaataatgaataaactgaat

SEQ ID NO: 4248983 - DNA, 12 bp, Homo sapiens
actacacatttg

SEQ ID NO: 4248984 - DNA, 14 bp, Homo sapiens
actacattctgtta

SEQ ID NO: 4248985 - DNA, 15 bp, Homo sapiens
actacattctgttaa

SEQ ID NO: 4248986 - DNA, 16 bp, Homo sapiens
actagagaatgcacag

SEQ ID NO: 4248987 - DNA, 20 bp, Homo sapiens
actagagaatgcacagatat

SEQ ID NO: 4248988 - DNA, 22 bp, Homo sapiens
actaggctcttatgtgtgcctt

SEQ ID NO: 4248989 - DNA, 20 bp, Homo sapiens
actcaaaaaaacaaaaaaga

SEQ ID NO: 4248990 - DNA, 22 bp, Homo sapiens
actcccatgttgggtttgagac

SEQ ID NO: 4248991 - DNA, 19 bp, Homo sapiens
actcctcttcccagagtca

SEQ ID NO: 4248992 - DNA, 14 bp, Homo sapiens
actcctggagcact

SEQ ID NO: 4248993 - DNA, 15 bp, Homo sapiens
actcctggagcactg

SEQ ID NO: 4248994 - DNA, 14 bp, Homo sapiens
actctaggacttca

SEQ ID NO: 4248995 - DNA, 18 bp, Homo sapiens
actctaggacttcaaagt

SEQ ID NO: 4248996 - DNA, 21 bp, Homo sapiens
actctatcaagtattatacct

SEQ ID NO: 4248997 - DNA, 22 bp, Homo sapiens
actctcagcccagaagaaaatt

SEQ ID NO: 4248998 - DNA, 20 bp, Homo sapiens
actctgcccaccccagcatc

SEQ ID NO: 4248999 - DNA, 13 bp, Homo sapiens
actctgtaattgc

SEQ ID NO: 4249000 - DNA, 22 bp, Homo sapiens
actctgtaattgcactttttaa

SEQ ID NO: 4249001 - DNA, 23 bp, Homo sapiens
actctgtaattgcactttttaag

SEQ ID NO: 4249002 - DNA, 14 bp, Homo sapiens
actctgtgtttaaa

SEQ ID NO: 4249003 - DNA, 15 bp, Homo sapiens
actcttccacctctg

SEQ ID NO: 4249004 - DNA, 14 bp, Homo sapiens
actgaattgtatca

SEQ ID NO: 4249005 - DNA, 18 bp, Homo sapiens
actgacagcctcccaccc

SEQ ID NO: 4249006 - DNA, 18 bp, Homo sapiens
actgagtacgttgtgcat

SEQ ID NO: 4249007 - DNA, 21 bp, Homo sapiens
actgagtacgttgtgcatttg

SEQ ID NO: 4249008 - DNA, 22 bp, Homo sapiens
actgagtacgttgtgcatttgg

SEQ ID NO: 4249009 - DNA, 23 bp, Homo sapiens
actgagtacgttgtgcatttggt

SEQ ID NO: 4249010 - DNA, 23 bp, Homo sapiens
aggtcattttttttaagaaaaag

SEQ ID NO: 4249011 - DNA, 16 bp, Homo sapiens
aggtcctacagggcca

SEQ ID NO: 4249012 - DNA, 15 bp, Homo sapiens
aggtctgttctttcc

SEQ ID NO: 4249013 - DNA, 19 bp, Homo sapiens
aggtgcccgcgccaggccc

SEQ ID NO: 4249014 - DNA, 20 bp, Homo sapiens
aggtgcccgcgccaggccct

SEQ ID NO: 4249015 - DNA, 22 bp, Homo sapiens
aggtggcaatgcttaaactaaa

SEQ ID NO: 4249016 - DNA, 18 bp, Homo sapiens
aggtgtgactgaatttct

SEQ ID NO: 4249017 - DNA, 14 bp, Homo sapiens
aggttcaaagatat

SEQ ID NO: 4249018 - DNA, 17 bp, Homo sapiens
aggttcaaagatatttt

SEQ ID NO: 4249019 - DNA, 22 bp, Homo sapiens
aggttttgtattttttaaaaca

SEQ ID NO: 4249020 - DNA, 13 bp, Homo sapiens
agtaaaatttatt

SEQ ID NO: 4249021 - DNA, 17 bp, Homo sapiens
agtaaaatttatttcat

SEQ ID NO: 4249022 - DNA, 20 bp, Homo sapiens
agtaaacataaaaactgatt

SEQ ID NO: 4249023 - DNA, 13 bp, Homo sapiens
agtaaagccatta

SEQ ID NO: 4249024 - DNA, 23 bp, Homo sapiens
agtaaagccattaaatgaatatt

SEQ ID NO: 4249025 - DNA, 18 bp, Homo sapiens
agtaaatgggggtgcatt

SEQ ID NO: 4249026 - DNA, 16 bp, Homo sapiens
agtaacttatttgact

SEQ ID NO: 4249027 - DNA, 20 bp, Homo sapiens
agtaactttactctgtgttt

SEQ ID NO: 4249028 - DNA, 14 bp, Homo sapiens
agtaagttaataat

SEQ ID NO: 4249029 - DNA, 15 bp, Homo sapiens
agtaagttaataatg

SEQ ID NO: 4249030 - DNA, 15 bp, Homo sapiens
agtaatatgcacaca

SEQ ID NO: 4249031 - DNA, 16 bp, Homo sapiens
agtaatgcagttttta

SEQ ID NO: 4249032 - DNA, 14 bp, Homo sapiens
agtaatttcattta

SEQ ID NO: 4249033 - DNA, 17 bp, Homo sapiens
agtacaatgtgtttttc

SEQ ID NO: 4249034 - DNA, 20 bp, Homo sapiens
agtacaatgtgtttttctcc

SEQ ID NO: 4249035 - DNA, 16 bp, Homo sapiens
agtacactgtttcaaa

SEQ ID NO: 4249036 - DNA, 14 bp, Homo sapiens
agtaccttgaactc

SEQ ID NO: 4249037 - DNA, 17 bp, Homo sapiens
agtaccttgaactctta

SEQ ID NO: 4249038 - DNA, 14 bp, Homo sapiens
agtacgttgtgcat

SEQ ID NO: 4249039 - DNA, 15 bp, Homo sapiens
agtacgttgtgcatt

SEQ ID NO: 4249040 - DNA, 16 bp, Homo sapiens
agtacgttgtgcattt

SEQ ID NO: 4249041 - DNA, 18 bp, Homo sapiens
agtacgttgtgcatttgg

SEQ ID NO: 4249042 - DNA, 17 bp, Homo sapiens
agtagaaaagttgcaga

SEQ ID NO: 4249043 - DNA, 13 bp, Homo sapiens
agtagcctctggg

SEQ ID NO: 4249044 - DNA, 22 bp, Homo sapiens
agtagcctctgggatctgccaa

SEQ ID NO: 4249045 - DNA, 14 bp, Homo sapiens
agtagttgtattct

SEQ ID NO: 4249046 - DNA, 23 bp, Homo sapiens
agtatacttttcccctgttaaac

SEQ ID NO: 4249047 - DNA, 16 bp, Homo sapiens
agtatagagagaagtt

SEQ ID NO: 4249048 - DNA, 23 bp, Homo sapiens
agtatgaggcatttgtttgaact

SEQ ID NO: 4249049 - DNA, 14 bp, Homo sapiens
agtatttttatcca

SEQ ID NO: 4249050 - DNA, 20 bp, Homo sapiens
agtatttttgggctattgca

SEQ ID NO: 4249051 - DNA, 16 bp, Homo sapiens
agtcacactgctagca

SEQ ID NO: 4249052 - DNA, 14 bp, Homo sapiens
agtcacatctcttc

SEQ ID NO: 4249053 - DNA, 19 bp, Homo sapiens
agtcagatttttatttatg

SEQ ID NO: 4249054 - DNA, 23 bp, Homo sapiens
agtccaactcttccacctctggg

SEQ ID NO: 4249055 - DNA, 19 bp, Homo sapiens
agtcctgagtgtggacttg

SEQ ID NO: 4249056 - DNA, 13 bp, Homo sapiens
agtcgttttccaa

SEQ ID NO: 4249057 - DNA, 16 bp, Homo sapiens
agtctggggtgggagg

SEQ ID NO: 4249058 - DNA, 19 bp, Homo sapiens
agtctttgagactaaattc

SEQ ID NO: 4249059 - DNA, 23 bp, Homo sapiens
agtgaagatggtttcaattcaga

SEQ ID NO: 4249060 - DNA, 19 bp, Homo sapiens
agtgatcttggctgtttca

SEQ ID NO: 4249061 - DNA, 16 bp, Homo sapiens
agtgcctttagagggt

SEQ ID NO: 4249062 - DNA, 15 bp, Homo sapiens
agtgctacctgcacc

SEQ ID NO: 4249063 - DNA, 22 bp, Homo sapiens
agtgctgtccatgcttctcatc

SEQ ID NO: 4249064 - DNA, 16 bp, Homo sapiens
agtggatgactgttga

SEQ ID NO: 4249065 - DNA, 14 bp, Homo sapiens
agtgggctcctgac

SEQ ID NO: 4249066 - DNA, 18 bp, Homo sapiens
agtggtggttttctgttc

SEQ ID NO: 4249067 - DNA, 16 bp, Homo sapiens
agtgtgtgtgtgtgtc

SEQ ID NO: 4249068 - DNA, 19 bp, Homo sapiens
agtgtgtgtgtgtgtctgt

SEQ ID NO: 4249069 - DNA, 20 bp, Homo sapiens
agtgttgtggatttaacaga

SEQ ID NO: 4249070 - DNA, 11 bp, Homo sapiens
agttaataatg

SEQ ID NO: 4249071 - DNA, 13 bp, Homo sapiens
agttaataatgta

SEQ ID NO: 4249072 - DNA, 20 bp, Homo sapiens
agttaataggagtatttttg

SEQ ID NO: 4249073 - DNA, 22 bp, Homo sapiens
agttatattagtgaagatggtt

SEQ ID NO: 4249074 - DNA, 13 bp, Homo sapiens
agttatgtattta

SEQ ID NO: 4249075 - DNA, 14 bp, Homo sapiens
agttatttctgttt

SEQ ID NO: 4249076 - DNA, 18 bp, Homo sapiens
agttgtattcttctgtat

SEQ ID NO: 4249077 - DNA, 21 bp, Homo sapiens
agttgtctctcttcagactct

SEQ ID NO: 4249078 - DNA, 16 bp, Homo sapiens
agttgttacattttta

SEQ ID NO: 4249079 - DNA, 20 bp, Homo sapiens
agttgttacatttttaagtg

SEQ ID NO: 4249080 - DNA, 18 bp, Homo sapiens
agttgttattgttgaaca

SEQ ID NO: 4249081 - DNA, 15 bp, Homo sapiens
agtttatcttaagca

SEQ ID NO: 4249082 - DNA, 15 bp, Homo sapiens
agtttccctggtgcc

SEQ ID NO: 4249083 - DNA, 17 bp, Homo sapiens
agtttgattaaattctt

SEQ ID NO: 4249084 - DNA, 22 bp, Homo sapiens
agtttggatatttttgtacttg

SEQ ID NO: 4249085 - DNA, 17 bp, Homo sapiens
agtttgtaggtaaaatg

SEQ ID NO: 4249086 - DNA, 19 bp, Homo sapiens
agtttgtaggtaaaatgta

SEQ ID NO: 4249087 - DNA, 21 bp, Homo sapiens
agttttcatttagaaaataga

SEQ ID NO: 4249088 - DNA, 22 bp, Homo sapiens
agtttttaaaaacctgtatctg

SEQ ID NO: 4249089 - DNA, 16 bp, Homo sapiens
agtttttaatttgatg

SEQ ID NO: 4249090 - DNA, 23 bp, Homo sapiens
agtttttatggcttttgtgcatt

SEQ ID NO: 4249091 - DNA, 12 bp, Homo sapiens
agtttttgtatc

SEQ ID NO: 4249092 - DNA, 15 bp, Homo sapiens
agtttttgtatcttg

SEQ ID NO: 4249093 - DNA, 23 bp, Homo sapiens
agtttttgtatcttggggcaaga

SEQ ID NO: 4249094 - DNA, 14 bp, Homo sapiens
ataaaaactgattt

SEQ ID NO: 4249095 - DNA, 15 bp, Homo sapiens
ataaaaataaataga

SEQ ID NO: 4249096 - DNA, 13 bp, Homo sapiens
ataaaaatgcatt

SEQ ID NO: 4249097 - DNA, 12 bp, Homo sapiens
ataaaactgaat

SEQ ID NO: 4249098 - DNA, 15 bp, Homo sapiens
ataaaactttttaaa

SEQ ID NO: 4249099 - DNA, 14 bp, Homo sapiens
ataaaataaataat

SEQ ID NO: 4249100 - DNA, 14 bp, Homo sapiens
ataaacaatgatgc

SEQ ID NO: 4249101 - DNA, 18 bp, Homo sapiens
ataaacaatgatgccctg

SEQ ID NO: 4249102 - DNA, 20 bp, Homo sapiens
ataaactgaatattttggaa

SEQ ID NO: 4249103 - DNA, 21 bp, Homo sapiens
ataaactttaccttttttata

SEQ ID NO: 4249104 - DNA, 14 bp, Homo sapiens
ataaagcagcgttt

SEQ ID NO: 4249105 - DNA, 20 bp, Homo sapiens
ataaagcagcgtttctatga

SEQ ID NO: 4249106 - DNA, 17 bp, Homo sapiens
ataaagttgtattgcat

SEQ ID NO: 4249107 - DNA, 14 bp, Homo sapiens
ataaataaaactga

SEQ ID NO: 4249108 - DNA, 15 bp, Homo sapiens
ataaataaaactgaa

SEQ ID NO: 4249109 - DNA, 11 bp, Homo sapiens
ataaataattt

SEQ ID NO: 4249110 - DNA, 13 bp, Homo sapiens
ataaataatttta

SEQ ID NO: 4249111 - DNA, 17 bp, Homo sapiens
ataaatatatataaaga

SEQ ID NO: 4249112 - DNA, 15 bp, Homo sapiens
ataaatgcataattt

SEQ ID NO: 4249113 - DNA, 18 bp, Homo sapiens
ataaatgcataatttatg

SEQ ID NO: 4249114 - DNA, 22 bp, Homo sapiens
ataaattgtagggctttagctt

SEQ ID NO: 4249115 - DNA, 21 bp, Homo sapiens
ataacactgtattttaatgta

SEQ ID NO: 4249116 - DNA, 16 bp, Homo sapiens
ataagaatgagcctgt

SEQ ID NO: 4249117 - DNA, 18 bp, Homo sapiens
ataagacatttgtttgct

SEQ ID NO: 4249118 - DNA, 15 bp, Homo sapiens
ataataatattgttt

SEQ ID NO: 4249119 - DNA, 18 bp, Homo sapiens
ataataatattgtttttc

SEQ ID NO: 4249120 - DNA, 20 bp, Homo sapiens
ataatacaccactacattct

SEQ ID NO: 4249121 - DNA, 23 bp, Homo sapiens
ataatacaccactacattctgtt

SEQ ID NO: 4249122 - DNA, 21 bp, Homo sapiens
ataataggtagtttggatatt

SEQ ID NO: 4249123 - DNA, 17 bp, Homo sapiens
ataatctgaagatatat

SEQ ID NO: 4249124 - DNA, 17 bp, Homo sapiens
ataatgaataaactgaa

SEQ ID NO: 4249125 - DNA, 12 bp, Homo sapiens
caaatgcataaa

SEQ ID NO: 4249126 - DNA, 14 bp, Homo sapiens
caaattagggcaat

SEQ ID NO: 4249127 - DNA, 14 bp, Homo sapiens
caaattgtgcttct

SEQ ID NO: 4249128 - DNA, 21 bp, Homo sapiens
caaattgtgcttctccccaga

SEQ ID NO: 4249129 - DNA, 14 bp, Homo sapiens
caaatttctaaatc

SEQ ID NO: 4249130 - DNA, 11 bp, Homo sapiens
caaatttgatg

SEQ ID NO: 4249131 - DNA, 19 bp, Homo sapiens
caaatttgatgatgttaaa

SEQ ID NO: 4249132 - DNA, 16 bp, Homo sapiens
caacaaatgtgggtga

SEQ ID NO: 4249133 - DNA, 22 bp, Homo sapiens
caacaacaaaaaatacattata

SEQ ID NO: 4249134 - DNA, 18 bp, Homo sapiens
caacagctcgatccaaat

SEQ ID NO: 4249135 - DNA, 18 bp, Homo sapiens
caacctcacctcccgggt

SEQ ID NO: 4249136 - DNA, 23 bp, Homo sapiens
caactcttccacctctggggaag

SEQ ID NO: 4249137 - DNA, 15 bp, Homo sapiens
caacttcagttttat

SEQ ID NO: 4249138 - DNA, 14 bp, Homo sapiens
caagaccacgtttc

SEQ ID NO: 4249139 - DNA, 17 bp, Homo sapiens
caagagggacagagccc

SEQ ID NO: 4249140 - DNA, 16 bp, Homo sapiens
caagagtaactttact

SEQ ID NO: 4249141 - DNA, 21 bp, Homo sapiens
caagatattattaatttttat

SEQ ID NO: 4249142 - DNA, 14 bp, Homo sapiens
caagccactagccc

SEQ ID NO: 4249143 - DNA, 16 bp, Homo sapiens
caagctagtgtttcta

SEQ ID NO: 4249144 - DNA, 24 bp, Homo sapiens
caaggagtttgagaccagcttagc

SEQ ID NO: 4249145 - DNA, 15 bp, Homo sapiens
caaggattgaaaatt

SEQ ID NO: 4249146 - DNA, 23 bp, Homo sapiens
caagggcatcatcctcagcagca

SEQ ID NO: 4249147 - DNA, 20 bp, Homo sapiens
caaggtcattttttttaaga

SEQ ID NO: 4249148 - DNA, 21 bp, Homo sapiens
caagtagcctctgggatctgc

SEQ ID NO: 4249149 - DNA, 14 bp, Homo sapiens
caagtcatttttgt

SEQ ID NO: 4249150 - DNA, 17 bp, Homo sapiens
caagtcatttttgtatt

SEQ ID NO: 4249151 - DNA, 19 bp, Homo sapiens
caagtcatttttgtatttt

SEQ ID NO: 4249152 - DNA, 16 bp, Homo sapiens
caataacactgtattt

SEQ ID NO: 4249153 - DNA, 17 bp, Homo sapiens
caatatcagctttgata

SEQ ID NO: 4249154 - DNA, 17 bp, Homo sapiens
caatatccattctgtag

SEQ ID NO: 4249155 - DNA, 19 bp, Homo sapiens
caatcattgttttgaatat

SEQ ID NO: 4249156 - DNA, 22 bp, Homo sapiens
caatcctgtttataatctgaag

SEQ ID NO: 4249157 - DNA, 16 bp, Homo sapiens
caatggtcctgacttt

SEQ ID NO: 4249158 - DNA, 22 bp, Homo sapiens
caatgtgcataatgataaaata

SEQ ID NO: 4249159 - DNA, 20 bp, Homo sapiens
caattattgatatatattat

SEQ ID NO: 4249160 - DNA, 22 bp, Homo sapiens
caattattgatatatattataa

SEQ ID NO: 4249161 - DNA, 21 bp, Homo sapiens
caattggcagtgactttgtat

SEQ ID NO: 4249162 - DNA, 21 bp, Homo sapiens
caattgtgagccaccacgtcc

SEQ ID NO: 4249163 - DNA, 20 bp, Homo sapiens
caatttattatggcacatca

SEQ ID NO: 4249164 - DNA, 13 bp, Homo sapiens
caattttctgtaa

SEQ ID NO: 4249165 - DNA, 14 bp, Homo sapiens
cacaaagagaccag

SEQ ID NO: 4249166 - DNA, 14 bp, Homo sapiens
cacaatatgtatgc

SEQ ID NO: 4249167 - DNA, 16 bp, Homo sapiens
cacacattttttaaat

SEQ ID NO: 4249168 - DNA, 20 bp, Homo sapiens
cacagacacaatatgtatgc

SEQ ID NO: 4249169 - DNA, 21 bp, Homo sapiens
cacagacatactaaccagcag

SEQ ID NO: 4249170 - DNA, 14 bp, Homo sapiens
cacagagcaggact

SEQ ID NO: 4249171 - DNA, 22 bp, Homo sapiens
cacagagttgttacatttttaa

SEQ ID NO: 4249172 - DNA, 17 bp, Homo sapiens
cacagcccaaaatttga

SEQ ID NO: 4249173 - DNA, 18 bp, Homo sapiens
cacagcccaaaatttgat

SEQ ID NO: 4249174 - DNA, 19 bp, Homo sapiens
cacagcgtcctgtccacac

SEQ ID NO: 4249175 - DNA, 21 bp, Homo sapiens
cacagtccaactcttccacct

SEQ ID NO: 4249176 - DNA, 17 bp, Homo sapiens
cacagtgggaagatttt

SEQ ID NO: 4249177 - DNA, 19 bp, Homo sapiens
cacattttattttattatg

SEQ ID NO: 4249178 - DNA, 20 bp, Homo sapiens
cacattttattttattatgc

SEQ ID NO: 4249179 - DNA, 16 bp, Homo sapiens
caccactacattctgt

SEQ ID NO: 4249180 - DNA, 16 bp, Homo sapiens
caccatggccagccaa

SEQ ID NO: 4249181 - DNA, 23 bp, Homo sapiens
cacccttcccctccttctccctt

SEQ ID NO: 4249182 - DNA, 18 bp, Homo sapiens
caccgcttctgccttttc

SEQ ID NO: 4249183 - DNA, 16 bp, Homo sapiens
cacctatgttattttg

SEQ ID NO: 4249184 - DNA, 13 bp, Homo sapiens
cacctctgccact

SEQ ID NO: 4249185 - DNA, 14 bp, Homo sapiens
cacctctgccactc

SEQ ID NO: 4249186 - DNA, 11 bp, Homo sapiens
cacctgagcct

SEQ ID NO: 4249187 - DNA, 18 bp, Homo sapiens
cacctgagggggaaaaaa

SEQ ID NO: 4249188 - DNA, 20 bp, Homo sapiens
cacctggaatatataaccag

SEQ ID NO: 4249189 - DNA, 15 bp, Homo sapiens
cacggagctcctggc

SEQ ID NO: 4249190 - DNA, 21 bp, Homo sapiens
cacgtgcgtgtgagtgtgtgt

SEQ ID NO: 4249191 - DNA, 17 bp, Homo sapiens
cacgtggccaggagcca

SEQ ID NO: 4249192 - DNA, 15 bp, Homo sapiens
cactacacatttgaa

SEQ ID NO: 4249193 - DNA, 13 bp, Homo sapiens
cactacattctgt

SEQ ID NO: 4249194 - DNA, 21 bp, Homo sapiens
cactagtaagtaattatgcac

SEQ ID NO: 4249195 - DNA, 16 bp, Homo sapiens
cactatatatatttct

SEQ ID NO: 4249196 - DNA, 14 bp, Homo sapiens
cactcccaagccac

SEQ ID NO: 4249197 - DNA, 11 bp, Homo sapiens
cactctaccta

SEQ ID NO: 4249198 - DNA, 22 bp, Homo sapiens
cactctgtaattgcacttttta

SEQ ID NO: 4249199 - DNA, 23 bp, Homo sapiens
cactctgtaattgcactttttaa

SEQ ID NO: 4249200 - DNA, 14 bp, Homo sapiens
cactgacagcctcc

SEQ ID NO: 4249201 - DNA, 15 bp, Homo sapiens
cactgacagcctccc

SEQ ID NO: 4249202 - DNA, 17 bp, Homo sapiens
cactgacagcctcccac

SEQ ID NO: 4249203 - DNA, 20 bp, Homo sapiens
cactgacagcctcccacccc

SEQ ID NO: 4249204 - DNA, 20 bp, Homo sapiens
cactgcaacctcacctcccg

SEQ ID NO: 4249205 - DNA, 16 bp, Homo sapiens
cactgcatgtttgtga

SEQ ID NO: 4249206 - DNA, 19 bp, Homo sapiens
cactgcattcattctgagc

SEQ ID NO: 4249207 - DNA, 16 bp, Homo sapiens
cactgtattttaatgt

SEQ ID NO: 4249208 - DNA, 13 bp, Homo sapiens
cactgttgaattt

SEQ ID NO: 4249209 - DNA, 16 bp, Homo sapiens
cacttacctgcttgag

SEQ ID NO: 4249210 - DNA, 21 bp, Homo sapiens
cacttagacactttacctctt

SEQ ID NO: 4249211 - DNA, 16 bp, Homo sapiens
cacttattgtaaattt

SEQ ID NO: 4249212 - DNA, 20 bp, Homo sapiens
cacttcaggagccctactga

SEQ ID NO: 4249213 - DNA, 13 bp, Homo sapiens
cacttccagggtt

SEQ ID NO: 4249214 - DNA, 19 bp, Homo sapiens
cacttgaagcctaaatttg

SEQ ID NO: 4249215 - DNA, 18 bp, Homo sapiens
cactttgtaatttttgct

SEQ ID NO: 4249216 - DNA, 16 bp, Homo sapiens
cagaaaatatttaata

SEQ ID NO: 4249217 - DNA, 19 bp, Homo sapiens
cagaaactggattaaaaca

SEQ ID NO: 4249218 - DNA, 22 bp, Homo sapiens
cagaaactggattaaaacaatt

SEQ ID NO: 4249219 - DNA, 16 bp, Homo sapiens
cagaaatgtacagcaa

SEQ ID NO: 4249220 - DNA, 18 bp, Homo sapiens
cagaacatcgatatgtat

SEQ ID NO: 4249221 - DNA, 20 bp, Homo sapiens
cagaacatcgatatgtatat

SEQ ID NO: 4249222 - DNA, 22 bp, Homo sapiens
cagaataatccagtattgctga

SEQ ID NO: 4249223 - DNA, 12 bp, Homo sapiens
cagaataatgga

SEQ ID NO: 4249224 - DNA, 19 bp, Homo sapiens
cagacaaaaaaatttaaaa

SEQ ID NO: 4249225 - DNA, 13 bp, Homo sapiens
cagacaaaaacaa

SEQ ID NO: 4249226 - DNA, 17 bp, Homo sapiens
cagacacaatatgtatg

SEQ ID NO: 4249227 - DNA, 14 bp, Homo sapiens
cagacagaaactgg

SEQ ID NO: 4249228 - DNA, 19 bp, Homo sapiens
cagacatactaaccagcag

SEQ ID NO: 4249229 - DNA, 16 bp, Homo sapiens
cagaccaagtccaagc

SEQ ID NO: 4249230 - DNA, 19 bp, Homo sapiens
cagactctcagcccagaag

SEQ ID NO: 4249231 - DNA, 21 bp, Homo sapiens
cagagaaaacccggagcaagc

SEQ ID NO: 4249232 - DNA, 23 bp, Homo sapiens
cagagaagttctcaaagttaatt

SEQ ID NO: 4249233 - DNA, 14 bp, Homo sapiens
cagagcaggactgc

SEQ ID NO: 4249234 - DNA, 15 bp, Homo sapiens
cagagcttgaagatt

SEQ ID NO: 4249235 - DNA, 12 bp, Homo sapiens
cagagtggctgc

SEQ ID NO: 4249236 - DNA, 15 bp, Homo sapiens
cagatatactttgtg

SEQ ID NO: 4249237 - DNA, 18 bp, Homo sapiens
cagatatactttgtggac

SEQ ID NO: 4249238 - DNA, 12 bp, Homo sapiens
cagatcctggaa

SEQ ID NO: 4249239 - DNA, 15 bp, Homo sapiens
cagatctcgggactc

SEQ ID NO: 4249240 - DNA, 20 bp, Homo sapiens
cattctacagaataatccag

SEQ ID NO: 4249241 - DNA, 16 bp, Homo sapiens
cattctccttgtgtta

SEQ ID NO: 4249242 - DNA, 13 bp, Homo sapiens
cattctttcccag

SEQ ID NO: 4249243 - DNA, 13 bp, Homo sapiens
cattgttttgaat

SEQ ID NO: 4249244 - DNA, 16 bp, Homo sapiens
cattgttttgaatatt

SEQ ID NO: 4249245 - DNA, 15 bp, Homo sapiens
catttaaaagataca

SEQ ID NO: 4249246 - DNA, 16 bp, Homo sapiens
catttaaatatctgtt

SEQ ID NO: 4249247 - DNA, 18 bp, Homo sapiens
catttacaaaagatttat

SEQ ID NO: 4249248 - DNA, 24 bp, Homo sapiens
catttacattaggtattacaagta

SEQ ID NO: 4249249 - DNA, 12 bp, Homo sapiens
catttagaaaat

SEQ ID NO: 4249250 - DNA, 15 bp, Homo sapiens
catttagaaaataga

SEQ ID NO: 4249251 - DNA, 22 bp, Homo sapiens
catttagaaaatagagctttta

SEQ ID NO: 4249252 - DNA, 22 bp, Homo sapiens
catttgaggtctgttctttcca

SEQ ID NO: 4249253 - DNA, 21 bp, Homo sapiens
catttggtggtttcagaaatg

SEQ ID NO: 4249254 - DNA, 17 bp, Homo sapiens
catttgtttgaactgat

SEQ ID NO: 4249255 - DNA, 20 bp, Homo sapiens
catttgtttgaactgataaa

SEQ ID NO: 4249256 - DNA, 20 bp, Homo sapiens
cattttcctgacatttgttt

SEQ ID NO: 4249257 - DNA, 21 bp, Homo sapiens
catttttcattcacttctctt

SEQ ID NO: 4249258 - DNA, 23 bp, Homo sapiens
catttttcttagggaaggataca

SEQ ID NO: 4249259 - DNA, 23 bp, Homo sapiens
catttttgtatttttcatcttta

SEQ ID NO: 4249260 - DNA, 15 bp, Homo sapiens
cattttttaaatgca

SEQ ID NO: 4249261 - DNA, 18 bp, Homo sapiens
ccaaaatattttttgcaa

SEQ ID NO: 4249262 - DNA, 13 bp, Homo sapiens
ccaaaatttgatg

SEQ ID NO: 4249263 - DNA, 18 bp, Homo sapiens
ccaaacatgtatttatgt

SEQ ID NO: 4249264 - DNA, 21 bp, Homo sapiens
ccaaactgactcaacagtcat

SEQ ID NO: 4249265 - DNA, 12 bp, Homo sapiens
ccaaagtacctt

SEQ ID NO: 4249266 - DNA, 14 bp, Homo sapiens
ccaaattgtgcttc

SEQ ID NO: 4249267 - DNA, 19 bp, Homo sapiens
ccaacacacgtccactccc

SEQ ID NO: 4249268 - DNA, 22 bp, Homo sapiens
ccaaggtggcccggaagaacca

SEQ ID NO: 4249269 - DNA, 12 bp, Homo sapiens
ccaatatttctg

SEQ ID NO: 4249270 - DNA, 18 bp, Homo sapiens
ccaatatttctgctttct

SEQ ID NO: 4249271 - DNA, 20 bp, Homo sapiens
ccaattattgatatatatta

SEQ ID NO: 4249272 - DNA, 21 bp, Homo sapiens
ccaattattgatatatattat

SEQ ID NO: 4249273 - DNA, 16 bp, Homo sapiens
ccaatttactggccac

SEQ ID NO: 4249274 - DNA, 16 bp, Homo sapiens
ccacacccagctcagc

SEQ ID NO: 4249275 - DNA, 15 bp, Homo sapiens
ccacacggagctcct

SEQ ID NO: 4249276 - DNA, 16 bp, Homo sapiens
ccacattactttttat

SEQ ID NO: 4249277 - DNA, 21 bp, Homo sapiens
ccaccatggccagccaacttt

SEQ ID NO: 4249278 - DNA, 16 bp, Homo sapiens
ccacctggaagccgcg

SEQ ID NO: 4249279 - DNA, 13 bp, Homo sapiens
ccacgattctccc

SEQ ID NO: 4249280 - DNA, 15 bp, Homo sapiens
ccactacattctgtt

SEQ ID NO: 4249281 - DNA, 16 bp, Homo sapiens
ccactacattctgtta

SEQ ID NO: 4249282 - DNA, 18 bp, Homo sapiens
ccactacattctgttaat

SEQ ID NO: 4249283 - DNA, 14 bp, Homo sapiens
ccactcccaagcca

SEQ ID NO: 4249284 - DNA, 15 bp, Homo sapiens
ccactgacagcctcc

SEQ ID NO: 4249285 - DNA, 17 bp, Homo sapiens
ccactgacagcctccca

SEQ ID NO: 4249286 - DNA, 19 bp, Homo sapiens
ccactgacagcctcccacc

SEQ ID NO: 4249287 - DNA, 18 bp, Homo sapiens
ccactttgtaatttttgc

SEQ ID NO: 4249288 - DNA, 15 bp, Homo sapiens
ccacttttgttcttg

SEQ ID NO: 4249289 - DNA, 22 bp, Homo sapiens
ccagaagaaaatagtggtgtga

SEQ ID NO: 4249290 - DNA, 18 bp, Homo sapiens
ccagagtcacaagtagcc

SEQ ID NO: 4249291 - DNA, 17 bp, Homo sapiens
ccagatggactccagcc

SEQ ID NO: 4249292 - DNA, 16 bp, Homo sapiens
ccagcagaaatgcctt

SEQ ID NO: 4249293 - DNA, 18 bp, Homo sapiens
ccagcagttctctgccaa

SEQ ID NO: 4249294 - DNA, 22 bp, Homo sapiens
ccagccaacttttgcatgtttt

SEQ ID NO: 4249295 - DNA, 13 bp, Homo sapiens
ccagccctctgtg

SEQ ID NO: 4249296 - DNA, 17 bp, Homo sapiens
ccagccgtgtgtgcatg

SEQ ID NO: 4249297 - DNA, 19 bp, Homo sapiens
ccagccgtgtgtgcatgtg

SEQ ID NO: 4249298 - DNA, 21 bp, Homo sapiens
ccagccgtgtgtgcatgtgcc

SEQ ID NO: 4249299 - DNA, 15 bp, Homo sapiens
ccagctaccctgtgt

SEQ ID NO: 4249300 - DNA, 14 bp, Homo sapiens
ccaggaatattaag

SEQ ID NO: 4249301 - DNA, 16 bp, Homo sapiens
ccaggacctccggagc

SEQ ID NO: 4249302 - DNA, 21 bp, Homo sapiens
ccaggacctccggagcgccct

SEQ ID NO: 4249303 - DNA, 18 bp, Homo sapiens
ccaggagccatgacaggg

SEQ ID NO: 4249304 - DNA, 14 bp, Homo sapiens
ccaggctggtctca

SEQ ID NO: 4249305 - DNA, 22 bp, Homo sapiens
ccaggtgcccgcgccaggccct

SEQ ID NO: 4249306 - DNA, 19 bp, Homo sapiens
ccagtcccagacaattcca

SEQ ID NO: 4249307 - DNA, 14 bp, Homo sapiens
ccagtcccattcct

SEQ ID NO: 4249308 - DNA, 16 bp, Homo sapiens
ccagtgctcctggccc

SEQ ID NO: 4249309 - DNA, 17 bp, Homo sapiens
ccagtgctcctggccct

SEQ ID NO: 4249310 - DNA, 21 bp, Homo sapiens
ccagtgctgtccatgcttctc

SEQ ID NO: 4249311 - DNA, 12 bp, Homo sapiens
ccagtggagacg

SEQ ID NO: 4249312 - DNA, 21 bp, Homo sapiens
ccatgacaggcctgaagatat

SEQ ID NO: 4249313 - DNA, 21 bp, Homo sapiens
ccatgaggggattcccttcct

SEQ ID NO: 4249314 - DNA, 18 bp, Homo sapiens
ccatgcccttacacgtgc

SEQ ID NO: 4249315 - DNA, 20 bp, Homo sapiens
ccatttgctactgtacataa

SEQ ID NO: 4249316 - DNA, 17 bp, Homo sapiens
ccattttacagatttct

SEQ ID NO: 4249317 - DNA, 24 bp, Homo sapiens
cccaaggccactgcgctcttggga

SEQ ID NO: 4249318 - DNA, 20 bp, Homo sapiens
cccaagggcatcatcctcag

SEQ ID NO: 4249319 - DNA, 12 bp, Homo sapiens
cccaatatattc

SEQ ID NO: 4249320 - DNA, 16 bp, Homo sapiens
cccactcagcagtgag

SEQ ID NO: 4249321 - DNA, 12 bp, Homo sapiens
cccactttgtaa

SEQ ID NO: 4249322 - DNA, 11 bp, Homo sapiens
cccagagcccc

SEQ ID NO: 4249323 - DNA, 17 bp, Homo sapiens
cccagcagttctctgcc

SEQ ID NO: 4249324 - DNA, 21 bp, Homo sapiens
cccagctaatttttgtatttt

SEQ ID NO: 4249325 - DNA, 16 bp, Homo sapiens
cccaggggaggtgtat

SEQ ID NO: 4249326 - DNA, 15 bp, Homo sapiens
cccaggtgagacctc

SEQ ID NO: 4249327 - DNA, 23 bp, Homo sapiens
cccagtgagtctctggggcaggc

SEQ ID NO: 4249328 - DNA, 21 bp, Homo sapiens
cccatctctccctcccctgcc

SEQ ID NO: 4249329 - DNA, 18 bp, Homo sapiens
cccattctacacagagca

SEQ ID NO: 4249330 - DNA, 20 bp, Homo sapiens
cccatttttatatcgatctc

SEQ ID NO: 4249331 - DNA, 22 bp, Homo sapiens
ccccagtgctcctggcccttct

SEQ ID NO: 4249332 - DNA, 12 bp, Homo sapiens
ccccatctctcc

SEQ ID NO: 4249333 - DNA, 16 bp, Homo sapiens
ccccatctctccctcc

SEQ ID NO: 4249334 - DNA, 13 bp, Homo sapiens
ccccgttgtgcct

SEQ ID NO: 4249335 - DNA, 19 bp, Homo sapiens
cccctccacaaagagacca

SEQ ID NO: 4249336 - DNA, 12 bp, Homo sapiens
cccctccttctc

SEQ ID NO: 4249337 - DNA, 15 bp, Homo sapiens
cccggaagaaccaga

SEQ ID NO: 4249338 - DNA, 22 bp, Homo sapiens
cccggctcgagcagtcctgcct

SEQ ID NO: 4249339 - DNA, 19 bp, Homo sapiens
cccgggcgggcgtgggagg

SEQ ID NO: 4249340 - DNA, 15 bp, Homo sapiens
cccgttgtgcctggt

SEQ ID NO: 4249341 - DNA, 23 bp, Homo sapiens
ccctccacaaagagaccaggggc

SEQ ID NO: 4249342 - DNA, 19 bp, Homo sapiens
ccctcccccctcggccgcc

SEQ ID NO: 4249343 - DNA, 11 bp, Homo sapiens
ccctctccctg

SEQ ID NO: 4249344 - DNA, 20 bp, Homo sapiens
ccctggatcacataccaggt

SEQ ID NO: 4249345 - DNA, 22 bp, Homo sapiens
ccctgggatggacgctgccggg

SEQ ID NO: 4249346 - DNA, 15 bp, Homo sapiens
ccctggtgcccttcc

SEQ ID NO: 4249347 - DNA, 20 bp, Homo sapiens
ccctggttgggtggcaattc

SEQ ID NO: 4249348 - DNA, 19 bp, Homo sapiens
ccctgtgtatacagccctg

SEQ ID NO: 4249349 - DNA, 19 bp, Homo sapiens
ccctttcttgcactgtcca

SEQ ID NO: 4249350 - DNA, 23 bp, Homo sapiens
ccgaggaatgtgaagccagatct

SEQ ID NO: 4249351 - DNA, 19 bp, Homo sapiens
ccgcaagagggacagagcc

SEQ ID NO: 4249352 - DNA, 20 bp, Homo sapiens
ccgccgcagaccagctggcg

SEQ ID NO: 4249353 - DNA, 16 bp, Homo sapiens
ccgcgccaggccctca

SEQ ID NO: 4249354 - DNA, 19 bp, Homo sapiens
cttaagatggaaatacagt

SEQ ID NO: 4249355 - DNA, 20 bp, Homo sapiens
cttaattcttagctcattct

SEQ ID NO: 4249356 - DNA, 23 bp, Homo sapiens
cttaccatttgctactgtacata

SEQ ID NO: 4249357 - DNA, 23 bp, Homo sapiens
cttaccccacacacagtccaact

SEQ ID NO: 4249358 - DNA, 18 bp, Homo sapiens
cttaccctcatgttctta

SEQ ID NO: 4249359 - DNA, 16 bp, Homo sapiens
cttacctgcttgagct

SEQ ID NO: 4249360 - DNA, 18 bp, Homo sapiens
cttagactcctcttccca

SEQ ID NO: 4249361 - DNA, 18 bp, Homo sapiens
cttagagcatctctgcct

SEQ ID NO: 4249362 - DNA, 22 bp, Homo sapiens
cttagctcattctccttgtgtt

SEQ ID NO: 4249363 - DNA, 23 bp, Homo sapiens
cttcacatattgatttccgttaa

SEQ ID NO: 4249364 - DNA, 14 bp, Homo sapiens
cttcaggagcccta

SEQ ID NO: 4249365 - DNA, 13 bp, Homo sapiens
cttccacctctgg

SEQ ID NO: 4249366 - DNA, 22 bp, Homo sapiens
cttcccgggcgggcgtgggagg

SEQ ID NO: 4249367 - DNA, 17 bp, Homo sapiens
cttcctccgaggccagt

SEQ ID NO: 4249368 - DNA, 20 bp, Homo sapiens
cttcctccgaggccagtacc

SEQ ID NO: 4249369 - DNA, 18 bp, Homo sapiens
cttctccctattccctct

SEQ ID NO: 4249370 - DNA, 20 bp, Homo sapiens
cttctcttaaacttgtgaat

SEQ ID NO: 4249371 - DNA, 19 bp, Homo sapiens
cttgaaatataggaactta

SEQ ID NO: 4249372 - DNA, 18 bp, Homo sapiens
cttgaagcctaaatttgt

SEQ ID NO: 4249373 - DNA, 16 bp, Homo sapiens
cttgagctttctgtgc

SEQ ID NO: 4249374 - DNA, 22 bp, Homo sapiens
cttgagctttctgtgcatgtgc

SEQ ID NO: 4249375 - DNA, 19 bp, Homo sapiens
cttgatttgatgtgacttt

SEQ ID NO: 4249376 - DNA, 20 bp, Homo sapiens
cttgctcctagcagacagaa

SEQ ID NO: 4249377 - DNA, 12 bp, Homo sapiens
cttgctggtgcc

SEQ ID NO: 4249378 - DNA, 13 bp, Homo sapiens
cttgctggtgcct

SEQ ID NO: 4249379 - DNA, 23 bp, Homo sapiens
cttggctcgatgctgtgggggac

SEQ ID NO: 4249380 - DNA, 18 bp, Homo sapiens
cttgggaggggccggagg

SEQ ID NO: 4249381 - DNA, 14 bp, Homo sapiens
cttggggcaagact

SEQ ID NO: 4249382 - DNA, 21 bp, Homo sapiens
cttgggtcctactcctggagc

SEQ ID NO: 4249383 - DNA, 14 bp, Homo sapiens
cttggtttgtaaat

SEQ ID NO: 4249384 - DNA, 12 bp, Homo sapiens
cttgtacataat

SEQ ID NO: 4249385 - DNA, 21 bp, Homo sapiens
cttgtacataatgcgtgcata

SEQ ID NO: 4249386 - DNA, 23 bp, Homo sapiens
cttgtggaggagggagagccctg

SEQ ID NO: 4249387 - DNA, 15 bp, Homo sapiens
ctttacccctgctga

SEQ ID NO: 4249388 - DNA, 22 bp, Homo sapiens
ctttaccttttttatacataaa

SEQ ID NO: 4249389 - DNA, 14 bp, Homo sapiens
ctttactctgtgtt

SEQ ID NO: 4249390 - DNA, 14 bp, Homo sapiens
ctttcatctcccag

SEQ ID NO: 4249391 - DNA, 14 bp, Homo sapiens
ctttcctgatgatg

SEQ ID NO: 4249392 - DNA, 14 bp, Homo sapiens
ctttctgtgcatgt

SEQ ID NO: 4249393 - DNA, 15 bp, Homo sapiens
ctttctgtgcatgtg

SEQ ID NO: 4249394 - DNA, 16 bp, Homo sapiens
ctttctgtgcatgtgc

SEQ ID NO: 4249395 - DNA, 13 bp, Homo sapiens
ctttcttgcactg

SEQ ID NO: 4249396 - DNA, 14 bp, Homo sapiens
ctttcttgcactgt

SEQ ID NO: 4249397 - DNA, 17 bp, Homo sapiens
ctttgaaacctgctctg

SEQ ID NO: 4249398 - DNA, 15 bp, Homo sapiens
ctttgacctctgcag

SEQ ID NO: 4249399 - DNA, 17 bp, Homo sapiens
ctttgagactgggtctc

SEQ ID NO: 4249400 - DNA, 11 bp, Homo sapiens
ctttgctgcca

SEQ ID NO: 4249401 - DNA, 17 bp, Homo sapiens
ctttgggaggctgaggc

SEQ ID NO: 4249402 - DNA, 24 bp, Homo sapiens
ctttgggccaatttactggccact

SEQ ID NO: 4249403 - DNA, 22 bp, Homo sapiens
ctttgtattctctcctgtacct

SEQ ID NO: 4249404 - DNA, 12 bp, Homo sapiens
ctttgtgatttt

SEQ ID NO: 4249405 - DNA, 16 bp, Homo sapiens
ctttgttgcccaggct

SEQ ID NO: 4249406 - DNA, 21 bp, Homo sapiens
cttttataaactttacctttt

SEQ ID NO: 4249407 - DNA, 23 bp, Homo sapiens
cttttcataaagggttgaaaatg

SEQ ID NO: 4249408 - DNA, 15 bp, Homo sapiens
cttttccttcattca

SEQ ID NO: 4249409 - DNA, 13 bp, Homo sapiens
cttttcttttctt

SEQ ID NO: 4249410 - DNA, 17 bp, Homo sapiens
cttttgaaaaaaaagtt

SEQ ID NO: 4249411 - DNA, 18 bp, Homo sapiens
cttttgccgttattaaaa

SEQ ID NO: 4249412 - DNA, 14 bp, Homo sapiens
cttttgtgcattat

SEQ ID NO: 4249413 - DNA, 18 bp, Homo sapiens
cttttgtgcattatctag

SEQ ID NO: 4249414 - DNA, 11 bp, Homo sapiens
cttttgttctt

SEQ ID NO: 4249415 - DNA, 12 bp, Homo sapiens
cttttgttcttg

SEQ ID NO: 4249416 - DNA, 13 bp, Homo sapiens
gaaaaaaattgaa

SEQ ID NO: 4249417 - DNA, 14 bp, Homo sapiens
gaaaaaaattgaaa

SEQ ID NO: 4249418 - DNA, 17 bp, Homo sapiens
gaaaaacaattttctgt

SEQ ID NO: 4249419 - DNA, 23 bp, Homo sapiens
gaaaaaggatgcacagagttgtt

SEQ ID NO: 4249420 - DNA, 14 bp, Homo sapiens
gaaaacacattttt

SEQ ID NO: 4249421 - DNA, 23 bp, Homo sapiens
gaaaagtagacaatcattgtttt

SEQ ID NO: 4249422 - DNA, 19 bp, Homo sapiens
gaaaatgcttaaaaaataa

SEQ ID NO: 4249423 - DNA, 15 bp, Homo sapiens
gaaaattgatatttt

SEQ ID NO: 4249424 - DNA, 18 bp, Homo sapiens
gaaaatttagccctttaa

SEQ ID NO: 4249425 - DNA, 16 bp, Homo sapiens
gaaacattacagttca

SEQ ID NO: 4249426 - DNA, 23 bp, Homo sapiens
gaaacccggtgcatctggcacgt

SEQ ID NO: 4249427 - DNA, 13 bp, Homo sapiens
gaaactgctaaat

SEQ ID NO: 4249428 - DNA, 17 bp, Homo sapiens
gaaactgctaaattcta

SEQ ID NO: 4249429 - DNA, 21 bp, Homo sapiens
gaaactgctaaattctatgtt

SEQ ID NO: 4249430 - DNA, 20 bp, Homo sapiens
gaaactggattaaaacaatt

SEQ ID NO: 4249431 - DNA, 18 bp, Homo sapiens
gaaagaggttaggagtag

SEQ ID NO: 4249432 - DNA, 19 bp, Homo sapiens
gaaataaataaaaatgcat

SEQ ID NO: 4249433 - DNA, 14 bp, Homo sapiens
gaaatacagttatt

SEQ ID NO: 4249434 - DNA, 17 bp, Homo sapiens
gaaatgtacagcaagga

SEQ ID NO: 4249435 - DNA, 14 bp, Homo sapiens
gaacagcctgagcc

SEQ ID NO: 4249436 - DNA, 19 bp, Homo sapiens
gaacatcgatatgtatatc

SEQ ID NO: 4249437 - DNA, 17 bp, Homo sapiens
gaaccagaagtgcagcc

SEQ ID NO: 4249438 - DNA, 20 bp, Homo sapiens
gaaccctttgtttcttgttt

SEQ ID NO: 4249439 - DNA, 15 bp, Homo sapiens
gaacgcacatagctc

SEQ ID NO: 4249440 - DNA, 22 bp, Homo sapiens
gaagacaatgacttactgtaca

SEQ ID NO: 4249441 - DNA, 14 bp, Homo sapiens
gaagagttgaggaa

SEQ ID NO: 4249442 - DNA, 23 bp, Homo sapiens
gaagagttgaggaactgtacaga

SEQ ID NO: 4249443 - DNA, 17 bp, Homo sapiens
gaagatatatttcactt

SEQ ID NO: 4249444 - DNA, 22 bp, Homo sapiens
gaagatggtttcaattcagatt

SEQ ID NO: 4249445 - DNA, 17 bp, Homo sapiens
gaagcctggagctttcc

SEQ ID NO: 4249446 - DNA, 21 bp, Homo sapiens
gaaggatacaaaagcatgtga

SEQ ID NO: 4249447 - DNA, 20 bp, Homo sapiens
gaagggaacagcctgagccg

SEQ ID NO: 4249448 - DNA, 16 bp, Homo sapiens
gaagggcattctttcc

SEQ ID NO: 4249449 - DNA, 19 bp, Homo sapiens
gaagtaatatgcacacatt

SEQ ID NO: 4249450 - DNA, 20 bp, Homo sapiens
gaagtcaaaatatgtaagaa

SEQ ID NO: 4249451 - DNA, 14 bp, Homo sapiens
gaataaactgaata

SEQ ID NO: 4249452 - DNA, 13 bp, Homo sapiens
gaataatggaaac

SEQ ID NO: 4249453 - DNA, 22 bp, Homo sapiens
gaatatttttagactatttctt

SEQ ID NO: 4249454 - DNA, 17 bp, Homo sapiens
gaatctgagctgcaggt

SEQ ID NO: 4249455 - DNA, 21 bp, Homo sapiens
gaatctgccgctttgtctgtc

SEQ ID NO: 4249456 - DNA, 15 bp, Homo sapiens
gaatgcacagatata

SEQ ID NO: 4249457 - DNA, 16 bp, Homo sapiens
gaatgcacagatatac

SEQ ID NO: 4249458 - DNA, 22 bp, Homo sapiens
gaatgcacagatatactttgtg

SEQ ID NO: 4249459 - DNA, 13 bp, Homo sapiens
gaatgtgaagcca

SEQ ID NO: 4249460 - DNA, 21 bp, Homo sapiens
gaattaaaaggatagtatttt

SEQ ID NO: 4249461 - DNA, 12 bp, Homo sapiens
gaattgtgtgga

SEQ ID NO: 4249462 - DNA, 14 bp, Homo sapiens
gaatttcttttcct

SEQ ID NO: 4249463 - DNA, 22 bp, Homo sapiens
gaatttgatgattttcatttca

SEQ ID NO: 4249464 - DNA, 19 bp, Homo sapiens
gacaaaaaaatttaaaatt

SEQ ID NO: 4249465 - DNA, 19 bp, Homo sapiens
gacaaaaataatagtttta

SEQ ID NO: 4249466 - DNA, 19 bp, Homo sapiens
gacaatactgtatcagatg

SEQ ID NO: 4249467 - DNA, 22 bp, Homo sapiens
gacaatactgtatcagatgtga

SEQ ID NO: 4249468 - DNA, 13 bp, Homo sapiens
gggaaggatacaa

SEQ ID NO: 4249469 - DNA, 21 bp, Homo sapiens
gggaaggatacaaaagcatgt

SEQ ID NO: 4249470 - DNA, 23 bp, Homo sapiens
gggaaggatacaaaagcatgtga

SEQ ID NO: 4249471 - DNA, 20 bp, Homo sapiens
gggaagtcgggcatggtggc

SEQ ID NO: 4249472 - DNA, 21 bp, Homo sapiens
gggactcggagggtgccgtgc

SEQ ID NO: 4249473 - DNA, 22 bp, Homo sapiens
gggagctgctgggtggcagggg

SEQ ID NO: 4249474 - DNA, 20 bp, Homo sapiens
gggaggagggaggcggcctc

SEQ ID NO: 4249475 - DNA, 12 bp, Homo sapiens
gggaggcggcct

SEQ ID NO: 4249476 - DNA, 16 bp, Homo sapiens
gggagggaggcatctg

SEQ ID NO: 4249477 - DNA, 17 bp, Homo sapiens
gggcaattggaacaaag

SEQ ID NO: 4249478 - DNA, 22 bp, Homo sapiens
gggcagggaaggaatcctggtg

SEQ ID NO: 4249479 - DNA, 16 bp, Homo sapiens
gggccgaggaatgtga

SEQ ID NO: 4249480 - DNA, 22 bp, Homo sapiens
gggccgaggaatgtgaagccag

SEQ ID NO: 4249481 - DNA, 12 bp, Homo sapiens
gggccgggcagg

SEQ ID NO: 4249482 - DNA, 14 bp, Homo sapiens
gggccgggcagggg

SEQ ID NO: 4249483 - DNA, 13 bp, Homo sapiens
gggcgggcgtggg

SEQ ID NO: 4249484 - DNA, 18 bp, Homo sapiens
ggggaccgtctttacccc

SEQ ID NO: 4249485 - DNA, 21 bp, Homo sapiens
ggggcgggtgatgagacctgg

SEQ ID NO: 4249486 - DNA, 22 bp, Homo sapiens
gggtcctactcctggagcactg

SEQ ID NO: 4249487 - DNA, 20 bp, Homo sapiens
gggtcttcttttactggact

SEQ ID NO: 4249488 - DNA, 17 bp, Homo sapiens
gggtgaagtgaagacaa

SEQ ID NO: 4249489 - DNA, 13 bp, Homo sapiens
gggtgccaggtgc

SEQ ID NO: 4249490 - DNA, 16 bp, Homo sapiens
gggtgccaggtgctgg

SEQ ID NO: 4249491 - DNA, 13 bp, Homo sapiens
gggtggtgggtgg

SEQ ID NO: 4249492 - DNA, 16 bp, Homo sapiens
ggtacaactgtattta

SEQ ID NO: 4249493 - DNA, 18 bp, Homo sapiens
ggtatgtagccagctgtg

SEQ ID NO: 4249494 - DNA, 23 bp, Homo sapiens
ggtattggctagaggttcaaaga

SEQ ID NO: 4249495 - DNA, 18 bp, Homo sapiens
ggtcaataacactgtatt

SEQ ID NO: 4249496 - DNA, 19 bp, Homo sapiens
ggtcaataacactgtattt

SEQ ID NO: 4249497 - DNA, 23 bp, Homo sapiens
ggtcatatacatattgtatatat

SEQ ID NO: 4249498 - DNA, 13 bp, Homo sapiens
ggtcggaaaacat

SEQ ID NO: 4249499 - DNA, 14 bp, Homo sapiens
ggtcgtcatgctgt

SEQ ID NO: 4249500 - DNA, 21 bp, Homo sapiens
ggtctcaaactcctgggctca

SEQ ID NO: 4249501 - DNA, 20 bp, Homo sapiens
ggtctcacagtgttgcccag

SEQ ID NO: 4249502 - DNA, 20 bp, Homo sapiens
ggtctcgctttgttgcccag

SEQ ID NO: 4249503 - DNA, 20 bp, Homo sapiens
ggtgcatctggcacgtggcc

SEQ ID NO: 4249504 - DNA, 22 bp, Homo sapiens
ggtgcatctggcacgtggccag

SEQ ID NO: 4249505 - DNA, 23 bp, Homo sapiens
ggtgcgcacttacctgcttgagc

SEQ ID NO: 4249506 - DNA, 19 bp, Homo sapiens
ggtgctgggaatacatctg

SEQ ID NO: 4249507 - DNA, 19 bp, Homo sapiens
ggtgtactctaggacttca

SEQ ID NO: 4249508 - DNA, 20 bp, Homo sapiens
ggtgtactctaggacttcaa

SEQ ID NO: 4249509 - DNA, 16 bp, Homo sapiens
ggtgtgactgaatttc

SEQ ID NO: 4249510 - DNA, 21 bp, Homo sapiens
ggtgtggtcgtcatgctgtcc

SEQ ID NO: 4249511 - DNA, 23 bp, Homo sapiens
ggtgtggtcgtcatgctgtccgt

SEQ ID NO: 4249512 - DNA, 13 bp, Homo sapiens
ggtttagaacccc

SEQ ID NO: 4249513 - DNA, 16 bp, Homo sapiens
ggtttagaaccccagg

SEQ ID NO: 4249514 - DNA, 14 bp, Homo sapiens
ggtttatgactctt

SEQ ID NO: 4249515 - DNA, 15 bp, Homo sapiens
ggtttgagacagaca

SEQ ID NO: 4249516 - DNA, 20 bp, Homo sapiens
ggtttgtaaattaactttta

SEQ ID NO: 4249517 - DNA, 13 bp, Homo sapiens
ggttttctgttct

SEQ ID NO: 4249518 - DNA, 15 bp, Homo sapiens
ggttttctgttcttt

SEQ ID NO: 4249519 - DNA, 16 bp, Homo sapiens
gtaaaatgaattgaaa

SEQ ID NO: 4249520 - DNA, 17 bp, Homo sapiens
gtaaacgaaggcataat

SEQ ID NO: 4249521 - DNA, 15 bp, Homo sapiens
gtaaagccattaaat

SEQ ID NO: 4249522 - DNA, 19 bp, Homo sapiens
gtaaagttatgtatttaaa

SEQ ID NO: 4249523 - DNA, 15 bp, Homo sapiens
gtaaatgcatattaa

SEQ ID NO: 4249524 - DNA, 20 bp, Homo sapiens
gtaaatgggggtgcatttga

SEQ ID NO: 4249525 - DNA, 15 bp, Homo sapiens
gtaaattaactttta

SEQ ID NO: 4249526 - DNA, 17 bp, Homo sapiens
gtaactttactctgtgt

SEQ ID NO: 4249527 - DNA, 21 bp, Homo sapiens
gtaactttactctgtgtttaa

SEQ ID NO: 4249528 - DNA, 17 bp, Homo sapiens
gtaagcatctcaatctt

SEQ ID NO: 4249529 - DNA, 18 bp, Homo sapiens
gtaagtaattatgcacta

SEQ ID NO: 4249530 - DNA, 18 bp, Homo sapiens
gtaagttaataatgtatt

SEQ ID NO: 4249531 - DNA, 16 bp, Homo sapiens
gtaatatgcacacatt

SEQ ID NO: 4249532 - DNA, 18 bp, Homo sapiens
gtaatatgcacacatttt

SEQ ID NO: 4249533 - DNA, 13 bp, Homo sapiens
gtaatgaagtaaa

SEQ ID NO: 4249534 - DNA, 22 bp, Homo sapiens
gtaatttgtgatacaatgctgt

SEQ ID NO: 4249535 - DNA, 21 bp, Homo sapiens
gtacaagttgttattgttgaa

SEQ ID NO: 4249536 - DNA, 15 bp, Homo sapiens
gtacataaacaatga

SEQ ID NO: 4249537 - DNA, 14 bp, Homo sapiens
gtacatgaaaacac

SEQ ID NO: 4249538 - DNA, 15 bp, Homo sapiens
gtacatgaaaacaca

SEQ ID NO: 4249539 - DNA, 20 bp, Homo sapiens
gtacatgaaaacacattttt

SEQ ID NO: 4249540 - DNA, 15 bp, Homo sapiens
gtaccacagacacaa

SEQ ID NO: 4249541 - DNA, 12 bp, Homo sapiens
gtacctctcaag

SEQ ID NO: 4249542 - DNA, 13 bp, Homo sapiens
gtacctcttgagc

SEQ ID NO: 4249543 - DNA, 22 bp, Homo sapiens
gtacctcttgagccttgaactt

SEQ ID NO: 4249544 - DNA, 17 bp, Homo sapiens
gtactctaggacttcaa

SEQ ID NO: 4249545 - DNA, 18 bp, Homo sapiens
gtactctaggacttcaaa

SEQ ID NO: 4249546 - DNA, 11 bp, Homo sapiens
gtactctgtgt

SEQ ID NO: 4249547 - DNA, 18 bp, Homo sapiens
gtactctgtgtctggcag

SEQ ID NO: 4249548 - DNA, 20 bp, Homo sapiens
gtactctgtgtctggcaggc

SEQ ID NO: 4249549 - DNA, 19 bp, Homo sapiens
gtactgtctgttatgattt

SEQ ID NO: 4249550 - DNA, 20 bp, Homo sapiens
gtactgtttaccatttttca

SEQ ID NO: 4249551 - DNA, 23 bp, Homo sapiens
gtacttgatttgatgtgactttt

SEQ ID NO: 4249552 - DNA, 16 bp, Homo sapiens
gtagaaaagttgcaga

SEQ ID NO: 4249553 - DNA, 18 bp, Homo sapiens
gtagcataaataaaactg

SEQ ID NO: 4249554 - DNA, 13 bp, Homo sapiens
gtagccagctgtg

SEQ ID NO: 4249555 - DNA, 18 bp, Homo sapiens
gtaggtaaaatgtatttt

SEQ ID NO: 4249556 - DNA, 20 bp, Homo sapiens
gtaggtaaaatgtatttttc

SEQ ID NO: 4249557 - DNA, 22 bp, Homo sapiens
gtaggtgcgcacttacctgctt

SEQ ID NO: 4249558 - DNA, 20 bp, Homo sapiens
gtagttgtattcttctgtat

SEQ ID NO: 4249559 - DNA, 22 bp, Homo sapiens
gtagttgtattcttctgtattt

SEQ ID NO: 4249560 - DNA, 18 bp, Homo sapiens
gtataatgtgcagaaaat

SEQ ID NO: 4249561 - DNA, 16 bp, Homo sapiens
gtataatgtttaaatc

SEQ ID NO: 4249562 - DNA, 18 bp, Homo sapiens
gtataatgtttaaatcat

SEQ ID NO: 4249563 - DNA, 12 bp, Homo sapiens
gtatataatttt

SEQ ID NO: 4249564 - DNA, 14 bp, Homo sapiens
gtatatatattcat

SEQ ID NO: 4249565 - DNA, 22 bp, Homo sapiens
gtatatcattctacagaataat

SEQ ID NO: 4249566 - DNA, 11 bp, Homo sapiens
gtatcaaatca

SEQ ID NO: 4249567 - DNA, 13 bp, Homo sapiens
gtatcagatgtga

SEQ ID NO: 4249568 - DNA, 18 bp, Homo sapiens
gtatcatatattaaaaca

SEQ ID NO: 4249569 - DNA, 19 bp, Homo sapiens
gtatcatatattaaaacaa

SEQ ID NO: 4249570 - DNA, 18 bp, Homo sapiens
gtatgaaggaatcattcc

SEQ ID NO: 4249571 - DNA, 17 bp, Homo sapiens
gtatgaggcatttgttt

SEQ ID NO: 4249572 - DNA, 20 bp, Homo sapiens
gtatgaggcatttgtttgaa

SEQ ID NO: 4249573 - DNA, 21 bp, Homo sapiens
gtattctctcctgtacctctt

SEQ ID NO: 4249574 - DNA, 15 bp, Homo sapiens
gtattgactgtacca

SEQ ID NO: 4249575 - DNA, 19 bp, Homo sapiens
gtatttctggtgtatattt

SEQ ID NO: 4249576 - DNA, 20 bp, Homo sapiens
gtattttttaaaacactaaa

SEQ ID NO: 4249577 - DNA, 22 bp, Homo sapiens
gtattttttaaaacactaaaag

SEQ ID NO: 4249578 - DNA, 17 bp, Homo sapiens
gtatttttttactaata

SEQ ID NO: 4249579 - DNA, 14 bp, Homo sapiens
gtcaaaatatgtaa

SEQ ID NO: 4249580 - DNA, 21 bp, Homo sapiens
gtcaagtctctgctggcccag

SEQ ID NO: 4249581 - DNA, 18 bp, Homo sapiens
gtcaattcataaaaacaa

SEQ ID NO: 4249582 - DNA, 23 bp, Homo sapiens
gttgtgcctggttcgtgccatgc

SEQ ID NO: 4249583 - DNA, 14 bp, Homo sapiens
gttgttacattttt

SEQ ID NO: 4249584 - DNA, 23 bp, Homo sapiens
gtttaaaaagtaagttaataatg

SEQ ID NO: 4249585 - DNA, 14 bp, Homo sapiens
gtttaaaattcagt

SEQ ID NO: 4249586 - DNA, 20 bp, Homo sapiens
gtttaaaattcagtttttgt

SEQ ID NO: 4249587 - DNA, 13 bp, Homo sapiens
gtttaaccttaaa

SEQ ID NO: 4249588 - DNA, 16 bp, Homo sapiens
gtttaccatttttcat

SEQ ID NO: 4249589 - DNA, 13 bp, Homo sapiens
gtttataatctga

SEQ ID NO: 4249590 - DNA, 16 bp, Homo sapiens
gtttataatctgaaga

SEQ ID NO: 4249591 - DNA, 14 bp, Homo sapiens
gtttcaaactttac

SEQ ID NO: 4249592 - DNA, 13 bp, Homo sapiens
gtttcagaaatgt

SEQ ID NO: 4249593 - DNA, 14 bp, Homo sapiens
gtttcagaaatgtg

SEQ ID NO: 4249594 - DNA, 18 bp, Homo sapiens
gtttcctatttaatacag

SEQ ID NO: 4249595 - DNA, 22 bp, Homo sapiens
gtttctaaaggctacctttgta

SEQ ID NO: 4249596 - DNA, 23 bp, Homo sapiens
gtttctaaaggctacctttgtat

SEQ ID NO: 4249597 - DNA, 13 bp, Homo sapiens
gtttcttgtttat

SEQ ID NO: 4249598 - DNA, 22 bp, Homo sapiens
gtttgaagagccattttggtaa

SEQ ID NO: 4249599 - DNA, 13 bp, Homo sapiens
gtttgagacagac

SEQ ID NO: 4249600 - DNA, 22 bp, Homo sapiens
gtttgtccttgcacctgagcct

SEQ ID NO: 4249601 - DNA, 11 bp, Homo sapiens
gttttccaaac

SEQ ID NO: 4249602 - DNA, 11 bp, Homo sapiens
gttttctgttc

SEQ ID NO: 4249603 - DNA, 12 bp, Homo sapiens
gttttctgttct

SEQ ID NO: 4249604 - DNA, 16 bp, Homo sapiens
gttttctgttctttct

SEQ ID NO: 4249605 - DNA, 19 bp, Homo sapiens
gtttttaaaaagagtaatt

SEQ ID NO: 4249606 - DNA, 13 bp, Homo sapiens
gtttttaatttga

SEQ ID NO: 4249607 - DNA, 19 bp, Homo sapiens
gtttttatggcttttgtgc

SEQ ID NO: 4249608 - DNA, 13 bp, Homo sapiens
gtttttgtatctt

SEQ ID NO: 4249609 - DNA, 14 bp, Homo sapiens
gtttttgtatcttg

SEQ ID NO: 4249610 - DNA, 15 bp, Homo sapiens
taaaaagagtaattt

SEQ ID NO: 4249611 - DNA, 18 bp, Homo sapiens
taaaaagagtaatttcat

SEQ ID NO: 4249612 - DNA, 19 bp, Homo sapiens
taaaaagagtaatttcatt

SEQ ID NO: 4249613 - DNA, 15 bp, Homo sapiens
taaaaagtaagttaa

SEQ ID NO: 4249614 - DNA, 15 bp, Homo sapiens
taaaaatctcaaatt

SEQ ID NO: 4249615 - DNA, 19 bp, Homo sapiens
taaaaatctcaaatttcta

SEQ ID NO: 4249616 - DNA, 21 bp, Homo sapiens
taaaaatctcaaatttctaaa

SEQ ID NO: 4249617 - DNA, 23 bp, Homo sapiens
taaaaatctcaaatttctaaatc

SEQ ID NO: 4249618 - DNA, 16 bp, Homo sapiens
taaaacaacagctcga

SEQ ID NO: 4249619 - DNA, 10 bp, Homo sapiens
taaaacacta

SEQ ID NO: 4249620 - DNA, 14 bp, Homo sapiens
taaaacactaaaag

SEQ ID NO: 4249621 - DNA, 16 bp, Homo sapiens
taaaacttaaaaacaa

SEQ ID NO: 4249622 - DNA, 20 bp, Homo sapiens
taaaagatacagttactcag

SEQ ID NO: 4249623 - DNA, 23 bp, Homo sapiens
taaaaggatagtatttttatcca

SEQ ID NO: 4249624 - DNA, 13 bp, Homo sapiens
taaaataaataat

SEQ ID NO: 4249625 - DNA, 16 bp, Homo sapiens
taaaataaataatttt

SEQ ID NO: 4249626 - DNA, 21 bp, Homo sapiens
taaaataccagccagtaaatg

SEQ ID NO: 4249627 - DNA, 14 bp, Homo sapiens
taaaatgtattttt

SEQ ID NO: 4249628 - DNA, 16 bp, Homo sapiens
taaaattacgtttgtt

SEQ ID NO: 4249629 - DNA, 21 bp, Homo sapiens
taaaattcagtttttgtatct

SEQ ID NO: 4249630 - DNA, 23 bp, Homo sapiens
taaaattcagtttttgtatcttg

SEQ ID NO: 4249631 - DNA, 15 bp, Homo sapiens
taaaatttatttcat

SEQ ID NO: 4249632 - DNA, 20 bp, Homo sapiens
taaacaagaccacgtttcta

SEQ ID NO: 4249633 - DNA, 21 bp, Homo sapiens
taaacaagaccacgtttctaa

SEQ ID NO: 4249634 - DNA, 16 bp, Homo sapiens
taaacactacacattt

SEQ ID NO: 4249635 - DNA, 20 bp, Homo sapiens
taaacactacacatttgaaa

SEQ ID NO: 4249636 - DNA, 18 bp, Homo sapiens
taaactaaataatgaata

SEQ ID NO: 4249637 - DNA, 22 bp, Homo sapiens
taaactggaattaaaaggatag

SEQ ID NO: 4249638 - DNA, 19 bp, Homo sapiens
taaacttaatctaaatgga

SEQ ID NO: 4249639 - DNA, 14 bp, Homo sapiens
taaacttcacctac

SEQ ID NO: 4249640 - DNA, 20 bp, Homo sapiens
taaagatatggagaattgct

SEQ ID NO: 4249641 - DNA, 21 bp, Homo sapiens
taaagggttgaaaatgtgttt

SEQ ID NO: 4249642 - DNA, 19 bp, Homo sapiens
taaagtatagagagaagtt

SEQ ID NO: 4249643 - DNA, 20 bp, Homo sapiens
taaagtatagagagaagttc

SEQ ID NO: 4249644 - DNA, 14 bp, Homo sapiens
taaagtgtattttt

SEQ ID NO: 4249645 - DNA, 20 bp, Homo sapiens
taaagtgtatttttttacta

SEQ ID NO: 4249646 - DNA, 22 bp, Homo sapiens
taaagtgtatttttttactaat

SEQ ID NO: 4249647 - DNA, 21 bp, Homo sapiens
taaataaaaatgcattgaaca

SEQ ID NO: 4249648 - DNA, 12 bp, Homo sapiens
taaataaaactg

SEQ ID NO: 4249649 - DNA, 13 bp, Homo sapiens
taaataaaactga

SEQ ID NO: 4249650 - DNA, 14 bp, Homo sapiens
taaataaaactgaa

SEQ ID NO: 4249651 - DNA, 16 bp, Homo sapiens
taaataaatgggtgta

SEQ ID NO: 4249652 - DNA, 15 bp, Homo sapiens
taaatactgtgcaga

SEQ ID NO: 4249653 - DNA, 22 bp, Homo sapiens
taaatactgtgcagaataatgg

SEQ ID NO: 4249654 - DNA, 14 bp, Homo sapiens
taaatatatataaa

SEQ ID NO: 4249655 - DNA, 15 bp, Homo sapiens
taaatatatataaag

SEQ ID NO: 4249656 - DNA, 23 bp, Homo sapiens
taaatatgaaccctttgtttctt

SEQ ID NO: 4249657 - DNA, 15 bp, Homo sapiens
taaatctccaaaata

SEQ ID NO: 4249658 - DNA, 18 bp, Homo sapiens
taaatctccaaaataaaa

SEQ ID NO: 4249659 - DNA, 22 bp, Homo sapiens
taaatctccaaaataaaacttt

SEQ ID NO: 4249660 - DNA, 14 bp, Homo sapiens
taaatgaatatttt

SEQ ID NO: 4249661 - DNA, 16 bp, Homo sapiens
taaatggaaccactct

SEQ ID NO: 4249662 - DNA, 18 bp, Homo sapiens
taaatgggggtgcatttg

SEQ ID NO: 4249663 - DNA, 15 bp, Homo sapiens
taaattaacttttat

SEQ ID NO: 4249664 - DNA, 22 bp, Homo sapiens
taaattaacttttataaacttt

SEQ ID NO: 4249665 - DNA, 13 bp, Homo sapiens
taaattctatgtt

SEQ ID NO: 4249666 - DNA, 14 bp, Homo sapiens
taaattctatgtta

SEQ ID NO: 4249667 - DNA, 23 bp, Homo sapiens
taaattctatgttaaatactgtg

SEQ ID NO: 4249668 - DNA, 16 bp, Homo sapiens
taaattcttgcaaagt

SEQ ID NO: 4249669 - DNA, 18 bp, Homo sapiens
taaattcttgcaaagtat

SEQ ID NO: 4249670 - DNA, 22 bp, Homo sapiens
taaattcttgcaaagtatccct

SEQ ID NO: 4249671 - DNA, 15 bp, Homo sapiens
taacagaaatgtaca

SEQ ID NO: 4249672 - DNA, 12 bp, Homo sapiens
taacagtggctg

SEQ ID NO: 4249673 - DNA, 18 bp, Homo sapiens
taacagtggctgcttctc

SEQ ID NO: 4249674 - DNA, 16 bp, Homo sapiens
taaccagcagaaatgc

SEQ ID NO: 4249675 - DNA, 19 bp, Homo sapiens
taaccagcagaaatgcctt

SEQ ID NO: 4249676 - DNA, 23 bp, Homo sapiens
taaccagtgttgtggatttaaca

SEQ ID NO: 4249677 - DNA, 19 bp, Homo sapiens
taaccttaaccttaaaatt

SEQ ID NO: 4249678 - DNA, 20 bp, Homo sapiens
taaccttaaccttaaaattg

SEQ ID NO: 4249679 - DNA, 21 bp, Homo sapiens
taactttactctgtgtttaaa

SEQ ID NO: 4249680 - DNA, 21 bp, Homo sapiens
taacttttataaactttacct

SEQ ID NO: 4249681 - DNA, 22 bp, Homo sapiens
taacttttataaactttacctt

SEQ ID NO: 4249682 - DNA, 16 bp, Homo sapiens
taagaaaaaggatgca

SEQ ID NO: 4249683 - DNA, 16 bp, Homo sapiens
taagaatatttttaga

SEQ ID NO: 4249684 - DNA, 17 bp, Homo sapiens
taagacatttgtttgct

SEQ ID NO: 4249685 - DNA, 23 bp, Homo sapiens
taaggatgcttgtacataatgcg

SEQ ID NO: 4249686 - DNA, 12 bp, Homo sapiens
taagtaattatg

SEQ ID NO: 4249687 - DNA, 18 bp, Homo sapiens
taagtgctgcatttaaaa

SEQ ID NO: 4249688 - DNA, 22 bp, Homo sapiens
taagtgctgcatttaaaagata

SEQ ID NO: 4249689 - DNA, 13 bp, Homo sapiens
taagtgggctcct

SEQ ID NO: 4249690 - DNA, 14 bp, Homo sapiens
taataatgtattgt

SEQ ID NO: 4249691 - DNA, 17 bp, Homo sapiens
taatatgcacacatttt

SEQ ID NO: 4249692 - DNA, 23 bp, Homo sapiens
taatattaatattcccattttat

SEQ ID NO: 4249693 - DNA, 19 bp, Homo sapiens
taatattgtttttctttct

SEQ ID NO: 4249694 - DNA, 13 bp, Homo sapiens
taatatttatgtt

SEQ ID NO: 4249695 - DNA, 12 bp, Homo sapiens
taatctaaatgg

SEQ ID NO: 4249696 - DNA, 23 bp, Homo sapiens
taatctgaagatatatttcactt

SEQ ID NO: 4249697 - DNA, 21 bp, Homo sapiens
tctcactgtgggaaggccagc

SEQ ID NO: 4249698 - DNA, 15 bp, Homo sapiens
tctcacttagtcctt

SEQ ID NO: 4249699 - DNA, 13 bp, Homo sapiens
tctcagcccagaa

SEQ ID NO: 4249700 - DNA, 18 bp, Homo sapiens
tctcagcccagaagaaaa

SEQ ID NO: 4249701 - DNA, 20 bp, Homo sapiens
tctcagcccagaagaaaatt

SEQ ID NO: 4249702 - DNA, 12 bp, Homo sapiens
tctcagcctccc

SEQ ID NO: 4249703 - DNA, 14 bp, Homo sapiens
tctcatcttgtgaa

SEQ ID NO: 4249704 - DNA, 15 bp, Homo sapiens
tctcatcttgtgaaa

SEQ ID NO: 4249705 - DNA, 19 bp, Homo sapiens
tctccaaaataaaactttt

SEQ ID NO: 4249706 - DNA, 15 bp, Homo sapiens
tctcccagatcctgg

SEQ ID NO: 4249707 - DNA, 19 bp, Homo sapiens
tctccctcccccagagccc

SEQ ID NO: 4249708 - DNA, 18 bp, Homo sapiens
tctccctcccctgccatt

SEQ ID NO: 4249709 - DNA, 14 bp, Homo sapiens
tctcctgaatattt

SEQ ID NO: 4249710 - DNA, 15 bp, Homo sapiens
tctcctgaatatttt

SEQ ID NO: 4249711 - DNA, 17 bp, Homo sapiens
tctcctgtacctcttga

SEQ ID NO: 4249712 - DNA, 13 bp, Homo sapiens
tctccttgtgtta

SEQ ID NO: 4249713 - DNA, 15 bp, Homo sapiens
tctctagtttgatta

SEQ ID NO: 4249714 - DNA, 16 bp, Homo sapiens
tctctagtttgattaa

SEQ ID NO: 4249715 - DNA, 18 bp, Homo sapiens
tctctagtttgattaaat

SEQ ID NO: 4249716 - DNA, 19 bp, Homo sapiens
tctctagtttgattaaatt

SEQ ID NO: 4249717 - DNA, 14 bp, Homo sapiens
tctctccctcccct

SEQ ID NO: 4249718 - DNA, 17 bp, Homo sapiens
tctctcctgtacctctt

SEQ ID NO: 4249719 - DNA, 22 bp, Homo sapiens
tctctcctgtacctcttgagcc

SEQ ID NO: 4249720 - DNA, 18 bp, Homo sapiens
tctctcttcagactctca

SEQ ID NO: 4249721 - DNA, 13 bp, Homo sapiens
tctctgccaaagc

SEQ ID NO: 4249722 - DNA, 15 bp, Homo sapiens
tctctgctggcccag

SEQ ID NO: 4249723 - DNA, 19 bp, Homo sapiens
tctctgctggcccagccaa

SEQ ID NO: 4249724 - DNA, 19 bp, Homo sapiens
tctcttcagactctcagcc

SEQ ID NO: 4249725 - DNA, 22 bp, Homo sapiens
tctcttcagactctcagcccag

SEQ ID NO: 4249726 - DNA, 18 bp, Homo sapiens
tctgaagatatatttcac

SEQ ID NO: 4249727 - DNA, 20 bp, Homo sapiens
tctgcaagcacatctgcatt

SEQ ID NO: 4249728 - DNA, 18 bp, Homo sapiens
tctgcagcaataaagcag

SEQ ID NO: 4249729 - DNA, 19 bp, Homo sapiens
tctgctttctttgattctc

SEQ ID NO: 4249730 - DNA, 16 bp, Homo sapiens
tctggattcacagacc

SEQ ID NO: 4249731 - DNA, 19 bp, Homo sapiens
tctggcacgtggccaggag

SEQ ID NO: 4249732 - DNA, 21 bp, Homo sapiens
tctggcacgtggccaggagcc

SEQ ID NO: 4249733 - DNA, 22 bp, Homo sapiens
tctggcacgtggccaggagcca

SEQ ID NO: 4249734 - DNA, 21 bp, Homo sapiens
tctggcaggctactctgccca

SEQ ID NO: 4249735 - DNA, 14 bp, Homo sapiens
tctgtacttcctga

SEQ ID NO: 4249736 - DNA, 14 bp, Homo sapiens
tctgtatttctagg

SEQ ID NO: 4249737 - DNA, 19 bp, Homo sapiens
tctgtctttcatctcccag

SEQ ID NO: 4249738 - DNA, 17 bp, Homo sapiens
tctgtgaaatgctggca

SEQ ID NO: 4249739 - DNA, 20 bp, Homo sapiens
tctgtgaaatgctggcattt

SEQ ID NO: 4249740 - DNA, 17 bp, Homo sapiens
tctgtgattacctctca

SEQ ID NO: 4249741 - DNA, 13 bp, Homo sapiens
tctgtgcatgtgc

SEQ ID NO: 4249742 - DNA, 17 bp, Homo sapiens
tctgtggacaagacatg

SEQ ID NO: 4249743 - DNA, 14 bp, Homo sapiens
tctgtgtctggcag

SEQ ID NO: 4249744 - DNA, 21 bp, Homo sapiens
tctgtgtgtatattgagaatc

SEQ ID NO: 4249745 - DNA, 23 bp, Homo sapiens
tctgttatgatttccttcaatgt

SEQ ID NO: 4249746 - DNA, 16 bp, Homo sapiens
tctgtttagataatac

SEQ ID NO: 4249747 - DNA, 13 bp, Homo sapiens
tcttagagccttt

SEQ ID NO: 4249748 - DNA, 23 bp, Homo sapiens
tcttagagccttttatctgcaga

SEQ ID NO: 4249749 - DNA, 19 bp, Homo sapiens
tcttattaattcttcacct

SEQ ID NO: 4249750 - DNA, 17 bp, Homo sapiens
tcttcaaccaaggccac

SEQ ID NO: 4249751 - DNA, 12 bp, Homo sapiens
tcttcacctgtt

SEQ ID NO: 4249752 - DNA, 14 bp, Homo sapiens
tcttcacctgttat

SEQ ID NO: 4249753 - DNA, 16 bp, Homo sapiens
tcttcacctgttatgt

SEQ ID NO: 4249754 - DNA, 23 bp, Homo sapiens
tcttcagactctcagcccagaag

SEQ ID NO: 4249755 - DNA, 14 bp, Homo sapiens
tcttccacctctgg

SEQ ID NO: 4249756 - DNA, 13 bp, Homo sapiens
tcttcccagagtc

SEQ ID NO: 4249757 - DNA, 14 bp, Homo sapiens
tcttcccagagtca

SEQ ID NO: 4249758 - DNA, 17 bp, Homo sapiens
tcttcctccgaggccag

SEQ ID NO: 4249759 - DNA, 18 bp, Homo sapiens
tcttcctccgaggccagt

SEQ ID NO: 4249760 - DNA, 18 bp, Homo sapiens
tcttgagccttgaacttt

SEQ ID NO: 4249761 - DNA, 19 bp, Homo sapiens
tcttgcactgtccagctgg

SEQ ID NO: 4249762 - DNA, 19 bp, Homo sapiens
tcttgcattcaaaatcttc

SEQ ID NO: 4249763 - DNA, 13 bp, Homo sapiens
tcttggcagtcac

SEQ ID NO: 4249764 - DNA, 17 bp, Homo sapiens
tcttggggcaagactgc

SEQ ID NO: 4249765 - DNA, 20 bp, Homo sapiens
tcttggggcaagactgcaaa

SEQ ID NO: 4249766 - DNA, 14 bp, Homo sapiens
tcttggtttgtaaa

SEQ ID NO: 4249767 - DNA, 13 bp, Homo sapiens
tcttgtttattga

SEQ ID NO: 4249768 - DNA, 13 bp, Homo sapiens
tcttgttttgtct

SEQ ID NO: 4249769 - DNA, 18 bp, Homo sapiens
tctttaaccaggaatatt

SEQ ID NO: 4249770 - DNA, 18 bp, Homo sapiens
tctttctggctatgcatt

SEQ ID NO: 4249771 - DNA, 20 bp, Homo sapiens
tctttgattctccttttatg

SEQ ID NO: 4249772 - DNA, 21 bp, Homo sapiens
tctttgattctccttttatgt

SEQ ID NO: 4249773 - DNA, 22 bp, Homo sapiens
tctttgattctccttttatgtg

SEQ ID NO: 4249774 - DNA, 18 bp, Homo sapiens
tctttgtaaatgcatatt

SEQ ID NO: 4249775 - DNA, 12 bp, Homo sapiens
tcttttgtttcc

SEQ ID NO: 4249776 - DNA, 13 bp, Homo sapiens
tgaaaacacattt

SEQ ID NO: 4249777 - DNA, 15 bp, Homo sapiens
tgaaaacacattttt

SEQ ID NO: 4249778 - DNA, 21 bp, Homo sapiens
tgaaaacacatttttcttagg

SEQ ID NO: 4249779 - DNA, 12 bp, Homo sapiens
tgaaaatgtgtt

SEQ ID NO: 4249780 - DNA, 16 bp, Homo sapiens
tgaaaatgtgtttgct

SEQ ID NO: 4249781 - DNA, 21 bp, Homo sapiens
tgaaaattcgcccgagctgtt

SEQ ID NO: 4249782 - DNA, 21 bp, Homo sapiens
tgaaaattttgatgttttaag

SEQ ID NO: 4249783 - DNA, 18 bp, Homo sapiens
tgaacatacttcaaaaat

SEQ ID NO: 4249784 - DNA, 22 bp, Homo sapiens
tgaacatacttcaaaaataatg

SEQ ID NO: 4249785 - DNA, 22 bp, Homo sapiens
tgaactcttagtgattgagact

SEQ ID NO: 4249786 - DNA, 17 bp, Homo sapiens
tgaactttgacctctgc

SEQ ID NO: 4249787 - DNA, 19 bp, Homo sapiens
tgaactttgacctctgcag

SEQ ID NO: 4249788 - DNA, 22 bp, Homo sapiens
tgaactttgacctctgcagcaa

SEQ ID NO: 4249789 - DNA, 11 bp, Homo sapiens
tgaagacaatg

SEQ ID NO: 4249790 - DNA, 15 bp, Homo sapiens
tgaagatggtttcaa

SEQ ID NO: 4249791 - DNA, 23 bp, Homo sapiens
tgaagatggtttcaattcagatt

SEQ ID NO: 4249792 - DNA, 20 bp, Homo sapiens
tgaagattaggagaaacaca

SEQ ID NO: 4249793 - DNA, 23 bp, Homo sapiens
tgaaggagaaaatagataattta

SEQ ID NO: 4249794 - DNA, 21 bp, Homo sapiens
tgaagggaacagcctgagccg

SEQ ID NO: 4249795 - DNA, 15 bp, Homo sapiens
tgaagtaatatgcac

SEQ ID NO: 4249796 - DNA, 13 bp, Homo sapiens
tgaagtatacttt

SEQ ID NO: 4249797 - DNA, 14 bp, Homo sapiens
tgaagtcaaaatat

SEQ ID NO: 4249798 - DNA, 14 bp, Homo sapiens
tgaataaactgaat

SEQ ID NO: 4249799 - DNA, 15 bp, Homo sapiens
tgaataaactgaata

SEQ ID NO: 4249800 - DNA, 17 bp, Homo sapiens
tgaataaactgaatatt

SEQ ID NO: 4249801 - DNA, 15 bp, Homo sapiens
tgaatattactccta

SEQ ID NO: 4249802 - DNA, 15 bp, Homo sapiens
tgaatattttggaaa

SEQ ID NO: 4249803 - DNA, 15 bp, Homo sapiens
tgaattgaaaaacaa

SEQ ID NO: 4249804 - DNA, 16 bp, Homo sapiens
tgaattgaaaaacaat

SEQ ID NO: 4249805 - DNA, 17 bp, Homo sapiens
tgaattgtatcaatttg

SEQ ID NO: 4249806 - DNA, 16 bp, Homo sapiens
tgacagatttctgtaa

SEQ ID NO: 4249807 - DNA, 17 bp, Homo sapiens
tgacagcctcccacccc

SEQ ID NO: 4249808 - DNA, 15 bp, Homo sapiens
tgaccccgccatgca

SEQ ID NO: 4249809 - DNA, 14 bp, Homo sapiens
tgaccgttaaaaaa

SEQ ID NO: 4249810 - DNA, 20 bp, Homo sapiens
tgacctcccacctatccgcc

SEQ ID NO: 4249811 - DNA, 23 bp, Homo sapiens
tgacctctgcagcaataaagcag

SEQ ID NO: 4249812 - DNA, 20 bp, Homo sapiens
ttaccagacaaaaaaattta

SEQ ID NO: 4249813 - DNA, 21 bp, Homo sapiens
ttactattaggaaaataaaca

SEQ ID NO: 4249814 - DNA, 18 bp, Homo sapiens
ttactcagaattctctag

SEQ ID NO: 4249815 - DNA, 23 bp, Homo sapiens
ttactcagaattctctagtttga

SEQ ID NO: 4249816 - DNA, 22 bp, Homo sapiens
ttactcctatttttgtaaactg

SEQ ID NO: 4249817 - DNA, 22 bp, Homo sapiens
ttactgcagcctttgcctcccc

SEQ ID NO: 4249818 - DNA, 14 bp, Homo sapiens
ttactgtacatgaa

SEQ ID NO: 4249819 - DNA, 13 bp, Homo sapiens
ttactttttatgg

SEQ ID NO: 4249820 - DNA, 15 bp, Homo sapiens
ttagaaccccaggtg

SEQ ID NO: 4249821 - DNA, 15 bp, Homo sapiens
ttagagccttttatc

SEQ ID NO: 4249822 - DNA, 22 bp, Homo sapiens
ttaggtcaataacactgtattt

SEQ ID NO: 4249823 - DNA, 20 bp, Homo sapiens
ttataaaaataaatagaaaa

SEQ ID NO: 4249824 - DNA, 21 bp, Homo sapiens
ttataaaaataaatagaaaag

SEQ ID NO: 4249825 - DNA, 13 bp, Homo sapiens
ttataaactttac

SEQ ID NO: 4249826 - DNA, 18 bp, Homo sapiens
ttataaactttacctttt

SEQ ID NO: 4249827 - DNA, 16 bp, Homo sapiens
ttataaatatatataa

SEQ ID NO: 4249828 - DNA, 19 bp, Homo sapiens
ttatacaagtaatttcctg

SEQ ID NO: 4249829 - DNA, 16 bp, Homo sapiens
ttatctagatactgta

SEQ ID NO: 4249830 - DNA, 12 bp, Homo sapiens
ttatcttttcat

SEQ ID NO: 4249831 - DNA, 16 bp, Homo sapiens
ttatgagtctttgaga

SEQ ID NO: 4249832 - DNA, 19 bp, Homo sapiens
ttatgcactaaatatgaac

SEQ ID NO: 4249833 - DNA, 22 bp, Homo sapiens
ttatgcactaaatatgaaccct

SEQ ID NO: 4249834 - DNA, 20 bp, Homo sapiens
ttatgcagcaaatatatgat

SEQ ID NO: 4249835 - DNA, 22 bp, Homo sapiens
ttatgcatgaagtaatatgcac

SEQ ID NO: 4249836 - DNA, 14 bp, Homo sapiens
ttatggagacctct

SEQ ID NO: 4249837 - DNA, 14 bp, Homo sapiens
ttatggcacatcag

SEQ ID NO: 4249838 - DNA, 17 bp, Homo sapiens
ttatggcttttgtgcat

SEQ ID NO: 4249839 - DNA, 19 bp, Homo sapiens
ttatggcttttgtgcatta

SEQ ID NO: 4249840 - DNA, 23 bp, Homo sapiens
ttatgtatgaaggaatcattcca

SEQ ID NO: 4249841 - DNA, 11 bp, Homo sapiens
ttatgtattta

SEQ ID NO: 4249842 - DNA, 12 bp, Homo sapiens
ttatgtggagac

SEQ ID NO: 4249843 - DNA, 22 bp, Homo sapiens
ttatgtgtagttgtctctcttc

SEQ ID NO: 4249844 - DNA, 14 bp, Homo sapiens
ttattcaaatttga

SEQ ID NO: 4249845 - DNA, 21 bp, Homo sapiens
ttattctaagccctttgccat

SEQ ID NO: 4249846 - DNA, 14 bp, Homo sapiens
ttattgatatatat

SEQ ID NO: 4249847 - DNA, 18 bp, Homo sapiens
ttattttattatgcatga

SEQ ID NO: 4249848 - DNA, 16 bp, Homo sapiens
ttatttttgacagact

SEQ ID NO: 4249849 - DNA, 22 bp, Homo sapiens
ttattttttaagtgggctcctg

SEQ ID NO: 4249850 - DNA, 15 bp, Homo sapiens
ttcaatgtgcataat

SEQ ID NO: 4249851 - DNA, 14 bp, Homo sapiens
ttcaccccaccctt

SEQ ID NO: 4249852 - DNA, 13 bp, Homo sapiens
ttcacttttgttc

SEQ ID NO: 4249853 - DNA, 13 bp, Homo sapiens
ttcagattgtctt

SEQ ID NO: 4249854 - DNA, 19 bp, Homo sapiens
ttcagttttatttttgcca

SEQ ID NO: 4249855 - DNA, 17 bp, Homo sapiens
ttcagtttttgtatctt

SEQ ID NO: 4249856 - DNA, 21 bp, Homo sapiens
ttcataataggtagtttggat

SEQ ID NO: 4249857 - DNA, 22 bp, Homo sapiens
ttcatagggaaaggttttgtat

SEQ ID NO: 4249858 - DNA, 16 bp, Homo sapiens
ttcatctcccagatcc

SEQ ID NO: 4249859 - DNA, 17 bp, Homo sapiens
ttcatctcccagatcct

SEQ ID NO: 4249860 - DNA, 22 bp, Homo sapiens
ttcatgccaccatggccagcca

SEQ ID NO: 4249861 - DNA, 15 bp, Homo sapiens
ttcattcacttctct

SEQ ID NO: 4249862 - DNA, 17 bp, Homo sapiens
ttcattcacttctctta

SEQ ID NO: 4249863 - DNA, 14 bp, Homo sapiens
ttcattctgagccc

SEQ ID NO: 4249864 - DNA, 16 bp, Homo sapiens
ttccaaagtacactgt

SEQ ID NO: 4249865 - DNA, 13 bp, Homo sapiens
ttccaatatttct

SEQ ID NO: 4249866 - DNA, 11 bp, Homo sapiens
ttccagtgcta

SEQ ID NO: 4249867 - DNA, 12 bp, Homo sapiens
ttcccttccttc

SEQ ID NO: 4249868 - DNA, 14 bp, Homo sapiens
ttccgttaaaatac

SEQ ID NO: 4249869 - DNA, 20 bp, Homo sapiens
ttcctagtggatgactgttg

SEQ ID NO: 4249870 - DNA, 21 bp, Homo sapiens
ttcctagtggatgactgttga

SEQ ID NO: 4249871 - DNA, 20 bp, Homo sapiens
ttcctcaaatcagtgataat

SEQ ID NO: 4249872 - DNA, 17 bp, Homo sapiens
ttcctgatgatgctggc

SEQ ID NO: 4249873 - DNA, 17 bp, Homo sapiens
ttcctgtccccagggga

SEQ ID NO: 4249874 - DNA, 17 bp, Homo sapiens
ttccttctgttgctggt

SEQ ID NO: 4249875 - DNA, 16 bp, Homo sapiens
ttcgttagaccgctct

SEQ ID NO: 4249876 - DNA, 19 bp, Homo sapiens
ttctaaaggctacctttgt

SEQ ID NO: 4249877 - DNA, 20 bp, Homo sapiens
ttctatccaaacatgtattt

SEQ ID NO: 4249878 - DNA, 16 bp, Homo sapiens
ttctatgttaaatact

SEQ ID NO: 4249879 - DNA, 21 bp, Homo sapiens
ttctatgttaaatactgtgca

SEQ ID NO: 4249880 - DNA, 14 bp, Homo sapiens
ttctcaaagttaat

SEQ ID NO: 4249881 - DNA, 22 bp, Homo sapiens
ttctcaaagttaattcacctat

SEQ ID NO: 4249882 - DNA, 18 bp, Homo sapiens
ttctcatcttgtgaaatg

SEQ ID NO: 4249883 - DNA, 13 bp, Homo sapiens
ttctccccagaat

SEQ ID NO: 4249884 - DNA, 21 bp, Homo sapiens
ttctccttgtgttactaagtt

SEQ ID NO: 4249885 - DNA, 15 bp, Homo sapiens
ttctctagtttgatt

SEQ ID NO: 4249886 - DNA, 18 bp, Homo sapiens
ttctctcctgtacctctt

SEQ ID NO: 4249887 - DNA, 18 bp, Homo sapiens
ttctcttaaacttgtgaa

SEQ ID NO: 4249888 - DNA, 22 bp, Homo sapiens
ttctgcaaaggtggcaatgctt

SEQ ID NO: 4249889 - DNA, 16 bp, Homo sapiens
ttctgccttttcactg

SEQ ID NO: 4249890 - DNA, 19 bp, Homo sapiens
ttctgctttatcttttcat

SEQ ID NO: 4249891 - DNA, 16 bp, Homo sapiens
ttctgtagacttttga

SEQ ID NO: 4249892 - DNA, 12 bp, Homo sapiens
ttctgtgcatgt

SEQ ID NO: 4249893 - DNA, 13 bp, Homo sapiens
ttctgtttagata

SEQ ID NO: 4249894 - DNA, 18 bp, Homo sapiens
ttctgtttagataataca

SEQ ID NO: 4249895 - DNA, 18 bp, Homo sapiens
ttctgtttcctatttaat

SEQ ID NO: 4249896 - DNA, 22 bp, Homo sapiens
ttcttattaattcttcacctgt

SEQ ID NO: 4249897 - DNA, 21 bp, Homo sapiens
ttcttcaacatgctccaaata

SEQ ID NO: 4249898 - DNA, 21 bp, Homo sapiens
ttcttcacctgttatgtatga

SEQ ID NO: 4249899 - DNA, 17 bp, Homo sapiens
ttcttgggaattgaaaa

SEQ ID NO: 4249900 - DNA, 17 bp, Homo sapiens
ttcttggtttgtaaatt

SEQ ID NO: 4249901 - DNA, 18 bp, Homo sapiens
ttcttggtttgtaaatta

SEQ ID NO: 4249902 - DNA, 23 bp, Homo sapiens
ttcttggtttgtaaattaacttt

SEQ ID NO: 4249903 - DNA, 16 bp, Homo sapiens
ttctttcccagtgagt

SEQ ID NO: 4249904 - DNA, 20 bp, Homo sapiens
ttctttctggctatgcattt

SEQ ID NO: 4249905 - DNA, 13 bp, Homo sapiens
ttctttgattctc

SEQ ID NO: 4249906 - DNA, 20 bp, Homo sapiens
ttcttttgccgttattaaaa

SEQ ID NO: 4249907 - DNA, 16 bp, Homo sapiens
ttgaaaaaaaagtttt

SEQ ID NO: 4249908 - DNA, 16 bp, Homo sapiens
ttgaaacctgctctgt

SEQ ID NO: 4249909 - DNA, 15 bp, Homo sapiens
ttgacctctgcagca

SEQ ID NO: 4249910 - DNA, 16 bp, Homo sapiens
ttgacctctgcagcaa

SEQ ID NO: 4249911 - DNA, 20 bp, Homo sapiens
ttgagaatcccttaaaatta

SEQ ID NO: 4249912 - DNA, 17 bp, Homo sapiens
ttgagctttctgtgcat

SEQ ID NO: 4249913 - DNA, 21 bp, Homo sapiens
ttgagctttctgtgcatgtgc

SEQ ID NO: 4249914 - DNA, 15 bp, Homo sapiens
ttgatactacagttt

SEQ ID NO: 4249915 - DNA, 14 bp, Homo sapiens
ttgatatatattat

SEQ ID NO: 4249916 - DNA, 14 bp, Homo sapiens
ttgatgtgactttt

SEQ ID NO: 4249917 - DNA, 20 bp, Homo sapiens
ttgattaaattcttgcaaag

SEQ ID NO: 4249918 - DNA, 21 bp, Homo sapiens
ttgattaaattcttgcaaagt

SEQ ID NO: 4249919 - DNA, 20 bp, Homo sapiens
ttgattctccttttatgtgt

SEQ ID NO: 4249920 - DNA, 23 bp, Homo sapiens
ttgattctccttttatgtgtagt

SEQ ID NO: 4249921 - DNA, 14 bp, Homo sapiens
ttgattttaataca

SEQ ID NO: 4249922 - DNA, 20 bp, Homo sapiens
ttgcactttttaagtttgaa

SEQ ID NO: 4249923 - DNA, 17 bp, Homo sapiens
ttgccatcaatgatcat

SEQ ID NO: 4249924 - DNA, 15 bp, Homo sapiens
ttgctaagaagccta

SEQ ID NO: 4249925 - DNA, 18 bp, Homo sapiens
ttgctcaacagacaatta

SEQ ID NO: 4249926 - DNA, 11 bp, Homo sapiens
ttctctgccaa

SEQ ID NO: 4249927 - DNA, 23 bp, Homo sapiens
ttctgcccagccctctgtggcca

SEQ ID NO: 4249928 - DNA, 20 bp, Homo sapiens
ttctggctatgcatttgaaa

SEQ ID NO: 4249929 - DNA, 17 bp, Homo sapiens
ttctgtacttcctgagt

SEQ ID NO: 4249930 - DNA, 15 bp, Homo sapiens
ttctgtatttctagg

SEQ ID NO: 4249931 - DNA, 17 bp, Homo sapiens
ttctgtgcatgtgcagg

SEQ ID NO: 4249932 - DNA, 23 bp, Homo sapiens
ttctgtttcctatttaatacagc

SEQ ID NO: 4249933 - DNA, 15 bp, Homo sapiens
ttcttcacaggcact

SEQ ID NO: 4249934 - DNA, 21 bp, Homo sapiens
ttcttctagaatgtaaagtta

SEQ ID NO: 4249935 - DNA, 12 bp, Homo sapiens
ttcttgcaaagt

SEQ ID NO: 4249936 - DNA, 16 bp, Homo sapiens
ttcttggtttgtaaat

SEQ ID NO: 4249937 - DNA, 17 bp, Homo sapiens
ttctttctggctatgca

SEQ ID NO: 4249938 - DNA, 22 bp, Homo sapiens
ttctttctggctatgcatttga

SEQ ID NO: 4249939 - DNA, 20 bp, Homo sapiens
ttgaaaaaaattgaaataaa

SEQ ID NO: 4249940 - DNA, 17 bp, Homo sapiens
ttgaaaatgtgtttgct

SEQ ID NO: 4249941 - DNA, 14 bp, Homo sapiens
ttgaaacctgctct

SEQ ID NO: 4249942 - DNA, 16 bp, Homo sapiens
ttgaactgataaagat

SEQ ID NO: 4249943 - DNA, 22 bp, Homo sapiens
ttgaactttgacctctgcagca

SEQ ID NO: 4249944 - DNA, 19 bp, Homo sapiens
ttgaagcctaaatttgtgc

SEQ ID NO: 4249945 - DNA, 20 bp, Homo sapiens
ttgaagtaacttatttgact

SEQ ID NO: 4249946 - DNA, 23 bp, Homo sapiens
ttgaatattactcctatttttgt

SEQ ID NO: 4249947 - DNA, 17 bp, Homo sapiens
ttgacagactatttgct

SEQ ID NO: 4249948 - DNA, 14 bp, Homo sapiens
ttgacctctgcagc

SEQ ID NO: 4249949 - DNA, 22 bp, Homo sapiens
ttgagaatcccttaaaattacc

SEQ ID NO: 4249950 - DNA, 17 bp, Homo sapiens
ttgagattgccccaggt

SEQ ID NO: 4249951 - DNA, 15 bp, Homo sapiens
ttgagccttgaactt

SEQ ID NO: 4249952 - DNA, 16 bp, Homo sapiens
ttgagctttctgtgca

SEQ ID NO: 4249953 - DNA, 14 bp, Homo sapiens
ttgaggaactgtac

SEQ ID NO: 4249954 - DNA, 19 bp, Homo sapiens
ttgaggaactgtacagaaa

SEQ ID NO: 4249955 - DNA, 15 bp, Homo sapiens
ttgatattatattaa

SEQ ID NO: 4249956 - DNA, 17 bp, Homo sapiens
ttgatgaagtatacttt

SEQ ID NO: 4249957 - DNA, 17 bp, Homo sapiens
ttgatgcccaatatatt

SEQ ID NO: 4249958 - DNA, 21 bp, Homo sapiens
ttgatgtgactttttttggta

SEQ ID NO: 4249959 - DNA, 16 bp, Homo sapiens
ttgattaaattcttgc

SEQ ID NO: 4249960 - DNA, 23 bp, Homo sapiens
ttgattttaatacattgatcagg

SEQ ID NO: 4249961 - DNA, 18 bp, Homo sapiens
ttgcaagttatattagtg

SEQ ID NO: 4249962 - DNA, 17 bp, Homo sapiens
ttgcacctacctcacag

SEQ ID NO: 4249963 - DNA, 13 bp, Homo sapiens
ttgcacctgagcc

SEQ ID NO: 4249964 - DNA, 14 bp, Homo sapiens
ttgcacctgagcct

SEQ ID NO: 4249965 - DNA, 16 bp, Homo sapiens
ttgcacctgagcctgt

SEQ ID NO: 4249966 - DNA, 13 bp, Homo sapiens
ttgcactgtccag

SEQ ID NO: 4249967 - DNA, 15 bp, Homo sapiens
ttgcagatgtattga

SEQ ID NO: 4249968 - DNA, 20 bp, Homo sapiens
ttgcatccacttcaggagcc

SEQ ID NO: 4249969 - DNA, 15 bp, Homo sapiens
ttgcatgcaatttga

SEQ ID NO: 4249970 - DNA, 18 bp, Homo sapiens
ttgccaaggcaaaaaact

SEQ ID NO: 4249971 - DNA, 19 bp, Homo sapiens
ttgctggtgtactctagga

SEQ ID NO: 4249972 - DNA, 21 bp, Homo sapiens
ttggaaatggatgcaaagtac

SEQ ID NO: 4249973 - DNA, 23 bp, Homo sapiens
ttggaagagacaaagatttcttc

SEQ ID NO: 4249974 - DNA, 21 bp, Homo sapiens
ttggctagaggttcaaagata

SEQ ID NO: 4249975 - DNA, 19 bp, Homo sapiens
ttggtagatgcatgacttg

SEQ ID NO: 4249976 - DNA, 21 bp, Homo sapiens
ttggtataatgtttaaatcat

SEQ ID NO: 4249977 - DNA, 19 bp, Homo sapiens
ttggttattctaagccctt

SEQ ID NO: 4249978 - DNA, 15 bp, Homo sapiens
ttgtaaattaacttt

SEQ ID NO: 4249979 - DNA, 23 bp, Homo sapiens
ttgtaaattaacttttataaact

SEQ ID NO: 4249980 - DNA, 11 bp, Homo sapiens
ttgtaatttat

SEQ ID NO: 4249981 - DNA, 18 bp, Homo sapiens
ttgtacataatgcgtgca

SEQ ID NO: 4249982 - DNA, 13 bp, Homo sapiens
ttgtaggtaaaat

SEQ ID NO: 4249983 - DNA, 21 bp, Homo sapiens
ttgtattctctcctgtacctc

SEQ ID NO: 4249984 - DNA, 18 bp, Homo sapiens
ttgtattcttctgtattt

SEQ ID NO: 4249985 - DNA, 17 bp, Homo sapiens
ttgtattttttaaaaca

SEQ ID NO: 4249986 - DNA, 20 bp, Homo sapiens
ttgtattttttaaaacacta

SEQ ID NO: 4249987 - DNA, 22 bp, Homo sapiens
ttgtctgtccagccgtgtgtgc

SEQ ID NO: 4249988 - DNA, 23 bp, Homo sapiens
ttgtcttaagatggaaatacagt

SEQ ID NO: 4249989 - DNA, 17 bp, Homo sapiens
ttgtgatttttgtaatt

SEQ ID NO: 4249990 - DNA, 12 bp, Homo sapiens
ttgtgcatttgg

SEQ ID NO: 4249991 - DNA, 18 bp, Homo sapiens
ttgtgcctggttcgtgcc

SEQ ID NO: 4249992 - DNA, 18 bp, Homo sapiens
ttgtgcttctccccagaa

SEQ ID NO: 4249993 - DNA, 18 bp, Homo sapiens
ttgtggaccaattattga

SEQ ID NO: 4249994 - DNA, 20 bp, Homo sapiens
ttgtggatttaacagaaatg

SEQ ID NO: 4249995 - DNA, 22 bp, Homo sapiens
ttgtggatttaacagaaatgta

SEQ ID NO: 4249996 - DNA, 15 bp, Homo sapiens
ttgtgtacaagttgt

SEQ ID NO: 4249997 - DNA, 15 bp, Homo sapiens
ttgtgttactaagtt

SEQ ID NO: 4249998 - DNA, 21 bp, Homo sapiens
ttgttagtatgaggcatttgt

SEQ ID NO: 4249999 - DNA, 19 bp, Homo sapiens
ttgttgaacatacttcaaa

SEQ ID NO: 4250000 - DNA, 15 bp, Homo sapiens
ttgtttttctttcta

SEQ ID NO: 4250001 - DNA, 13 bp, Homo sapiens
tttaaaagataca

SEQ ID NO: 4250002 - DNA, 12 bp, Homo sapiens
tttaaaatatat

SEQ ID NO: 4250003 - DNA, 13 bp, Homo sapiens
tttaaaggcagag

SEQ ID NO: 4250004 - DNA, 17 bp, Homo sapiens
tttaaatcatgtatgtt

SEQ ID NO: 4250005 - DNA, 20 bp, Homo sapiens
tttaaatcatgtatgttatg

SEQ ID NO: 4250006 - DNA, 21 bp, Homo sapiens
tttaaatcatgtatgttatga

SEQ ID NO: 4250007 - DNA, 14 bp, Homo sapiens
tttaacagaaatgt

SEQ ID NO: 4250008 - DNA, 15 bp, Homo sapiens
tttaagtgctgcatt

SEQ ID NO: 4250009 - DNA, 21 bp, Homo sapiens
tttaatataagaatgagcctg

SEQ ID NO: 4250010 - DNA, 11 bp, Homo sapiens
tttaatttgat

SEQ ID NO: 4250011 - DNA, 21 bp, Homo sapiens
tttacaaaagatttattgtaa

SEQ ID NO: 4250012 - DNA, 21 bp, Homo sapiens
tttacaatcagccacattcta

SEQ ID NO: 4250013 - DNA, 15 bp, Homo sapiens
tttacagatttctca

SEQ ID NO: 4250014 - DNA, 14 bp, Homo sapiens
tttacccctgctga

SEQ ID NO: 4250015 - DNA, 17 bp, Homo sapiens
tttactaatagacaatt

SEQ ID NO: 4250016 - DNA, 18 bp, Homo sapiens
tttactaatagacaattt

SEQ ID NO: 4250017 - DNA, 12 bp, Homo sapiens
tttactctgtgt

SEQ ID NO: 4250018 - DNA, 19 bp, Homo sapiens
tttacttttttttttttct

SEQ ID NO: 4250019 - DNA, 16 bp, Homo sapiens
tttataaactttacct

SEQ ID NO: 4250020 - DNA, 15 bp, Homo sapiens
tttctacattattgc

SEQ ID NO: 4250021 - DNA, 20 bp, Homo sapiens
tttctacattattgcttatt

SEQ ID NO: 4250022 - DNA, 21 bp, Homo sapiens
tttctatgacacatgcaaggt

SEQ ID NO: 4250023 - DNA, 15 bp, Homo sapiens
tttctatttacctcc

SEQ ID NO: 4250024 - DNA, 15 bp, Homo sapiens
tttctggctatgcat

SEQ ID NO: 4250025 - DNA, 16 bp, Homo sapiens
tttctggctatgcatt

SEQ ID NO: 4250026 - DNA, 18 bp, Homo sapiens
tttctggctatgcatttg

SEQ ID NO: 4250027 - DNA, 13 bp, Homo sapiens
tttcttgtttatt

SEQ ID NO: 4250028 - DNA, 22 bp, Homo sapiens
tttcttttccttcattcatagg

SEQ ID NO: 4250029 - DNA, 21 bp, Homo sapiens
tttgaaaaaaaagtttttaat

SEQ ID NO: 4250030 - DNA, 17 bp, Homo sapiens
tttgaactgataaagat

SEQ ID NO: 4250031 - DNA, 14 bp, Homo sapiens
tttgacaaggggca

SEQ ID NO: 4250032 - DNA, 20 bp, Homo sapiens
tttgagattgccccaggtct

SEQ ID NO: 4250033 - DNA, 17 bp, Homo sapiens
tttgaggtctgttcttt

SEQ ID NO: 4250034 - DNA, 22 bp, Homo sapiens
tttgaggtctgttctttccaaa

SEQ ID NO: 4250035 - DNA, 14 bp, Homo sapiens
tttgatgtgacttt

SEQ ID NO: 4250036 - DNA, 13 bp, Homo sapiens
tttgattaaattc

SEQ ID NO: 4250037 - DNA, 21 bp, Homo sapiens
tttgcatccacttcaggagcc

SEQ ID NO: 4250038 - DNA, 17 bp, Homo sapiens
tttgccaaggcaaaaaa

SEQ ID NO: 4250039 - DNA, 13 bp, Homo sapiens
tttgccctgaggc

SEQ ID NO: 4250040 - DNA, 16 bp, Homo sapiens
tttggattttaacttt

SEQ ID NO: 4250041 - DNA, 23 bp, Homo sapiens
tttgggccaatttactggccact

SEQ ID NO: 4250042 - DNA, 14 bp, Homo sapiens
tttggggatatttt

SEQ ID NO: 4250043 - DNA, 21 bp, Homo sapiens
tttgggggctcatttttgctg

SEQ ID NO: 4250044 - DNA, 19 bp, Homo sapiens
tttggtggtttcagaaatg

SEQ ID NO: 4250045 - DNA, 16 bp, Homo sapiens
tttgtaaactggaatt

SEQ ID NO: 4250046 - DNA, 14 bp, Homo sapiens
tttgtaggtaaaat

SEQ ID NO: 4250047 - DNA, 23 bp, Homo sapiens
tttgtatttttcatctttaagaa

SEQ ID NO: 4250048 - DNA, 23 bp, Homo sapiens
tttgtcaaaagttggtgttgaca

SEQ ID NO: 4250049 - DNA, 15 bp, Homo sapiens
tttgtgatacaatgc

SEQ ID NO: 4250050 - DNA, 19 bp, Homo sapiens
tttgttaaattcagtaatg

SEQ ID NO: 4250051 - DNA, 13 bp, Homo sapiens
tttgtttgaactg

SEQ ID NO: 4250052 - DNA, 14 bp, Homo sapiens
tttgtttgaactga

SEQ ID NO: 4250053 - DNA, 19 bp, Homo sapiens
ttttaaaaacctgtatctg

SEQ ID NO: 4250054 - DNA, 18 bp, Homo sapiens
ttttaaaaagagtaattt

SEQ ID NO: 4250055 - DNA, 15 bp, Homo sapiens
ttttaaaacactaaa

SEQ ID NO: 4250056 - DNA, 19 bp, Homo sapiens
ttttaaaacactaaaagca

SEQ ID NO: 4250057 - DNA, 13 bp, Homo sapiens
ttttaactttaat

SEQ ID NO: 4250058 - DNA, 20 bp, Homo sapiens
ttttaagaaaaaataaaagg

SEQ ID NO: 4250059 - DNA, 12 bp, Homo sapiens
ttttaagaagac

SEQ ID NO: 4250060 - DNA, 22 bp, Homo sapiens
ttttaatattcttttgtttcca

SEQ ID NO: 4250061 - DNA, 20 bp, Homo sapiens
ttttaatgtacttgaaaaat

SEQ ID NO: 4250062 - DNA, 22 bp, Homo sapiens
ttttaccgttggggcccttaac

SEQ ID NO: 4250063 - DNA, 23 bp, Homo sapiens
ttttacctagctggtagcataaa

SEQ ID NO: 4250064 - DNA, 15 bp, Homo sapiens
ttttactaatagaca

SEQ ID NO: 4250065 - DNA, 12 bp, Homo sapiens
ttttataaactt

SEQ ID NO: 4250066 - DNA, 13 bp, Homo sapiens
ttttataaacttt

SEQ ID NO: 4250067 - DNA, 13 bp, Homo sapiens
ttttatatctttt

SEQ ID NO: 4250068 - DNA, 19 bp, Homo sapiens
ttttatcgtcactgcttaa

SEQ ID NO: 4250069 - DNA, 13 bp, Homo sapiens
ttttccaaactga

SEQ ID NO: 4250070 - DNA, 13 bp, Homo sapiens
ttttctgttcttt

SEQ ID NO: 4250071 - DNA, 19 bp, Homo sapiens
ttttgacagactatttgct

SEQ ID NO: 4250072 - DNA, 23 bp, Homo sapiens
ttttgacagactatttgctaatg

SEQ ID NO: 4250073 - DNA, 11 bp, Homo sapiens
ttttggaaact

SEQ ID NO: 4250074 - DNA, 13 bp, Homo sapiens
ttttggaaactgc

SEQ ID NO: 4250075 - DNA, 22 bp, Homo sapiens
ttttggaagagacaaagatttc

SEQ ID NO: 4250076 - DNA, 23 bp, Homo sapiens
ttttgtgcattatctagatactg

SEQ ID NO: 4250077 - DNA, 20 bp, Homo sapiens
ttttgtttgatgcaggcact

SEQ ID NO: 4250078 - DNA, 14 bp, Homo sapiens
tttttaagaatatt

SEQ ID NO: 4250079 - DNA, 17 bp, Homo sapiens
tttttaagtgctgcatt

SEQ ID NO: 4250080 - DNA, 19 bp, Homo sapiens
tttttaagtgctgcattta

SEQ ID NO: 4250081 - DNA, 17 bp, Homo sapiens
tttttaagtgggctcct

SEQ ID NO: 4250082 - DNA, 16 bp, Homo sapiens
tttttagactatttct

SEQ ID NO: 4250083 - DNA, 16 bp, Homo sapiens
tttttcctcttcagaa

SEQ ID NO: 4250084 - DNA, 15 bp, Homo sapiens
tttttggtataatgt

SEQ ID NO: 4250085 - DNA, 23 bp, Homo sapiens
tttttgtaaactggaattaaaag

SEQ ID NO: 4250086 - DNA, 13 bp, Homo sapiens
tttttgtacttga

SEQ ID NO: 4250087 - DNA, 15 bp, Homo sapiens
tttttgtatattaca

SEQ ID NO: 4250088 - DNA, 21 bp, Homo sapiens
aaaaaagtttttaatttgatg

SEQ ID NO: 4250089 - DNA, 23 bp, Homo sapiens
aaaaacaagtcatttttgtattt

SEQ ID NO: 4250090 - DNA, 20 bp, Homo sapiens
aaaaagacttgagacaatgt

SEQ ID NO: 4250091 - DNA, 17 bp, Homo sapiens
aaaaagagtaatttcat

SEQ ID NO: 4250092 - DNA, 21 bp, Homo sapiens
aaaaagtaagttaataatgta

SEQ ID NO: 4250093 - DNA, 17 bp, Homo sapiens
aaaaatctcaaatttct

SEQ ID NO: 4250094 - DNA, 13 bp, Homo sapiens
aaaaattgaaata

SEQ ID NO: 4250095 - DNA, 15 bp, Homo sapiens
aaaacaataatgcaa

SEQ ID NO: 4250096 - DNA, 21 bp, Homo sapiens
aaaacaccgcttctgcctttt

SEQ ID NO: 4250097 - DNA, 15 bp, Homo sapiens
aaaacatgctacaca

SEQ ID NO: 4250098 - DNA, 13 bp, Homo sapiens
aaaactgaatctc

SEQ ID NO: 4250099 - DNA, 17 bp, Homo sapiens
aaaacttaaaaattaat

SEQ ID NO: 4250100 - DNA, 14 bp, Homo sapiens
aaaagaaaattgat

SEQ ID NO: 4250101 - DNA, 12 bp, Homo sapiens
aaaagagtaatt

SEQ ID NO: 4250102 - DNA, 16 bp, Homo sapiens
aaaaggatagtatttt

SEQ ID NO: 4250103 - DNA, 14 bp, Homo sapiens
aaaaggatgcacag

SEQ ID NO: 4250104 - DNA, 15 bp, Homo sapiens
aaaaggatgcacaga

SEQ ID NO: 4250105 - DNA, 19 bp, Homo sapiens
aaaaggatgcacagagttg

SEQ ID NO: 4250106 - DNA, 16 bp, Homo sapiens
aaaagtcgttttccaa

SEQ ID NO: 4250107 - DNA, 23 bp, Homo sapiens
aaaagtcgttttccaaactgact

SEQ ID NO: 4250108 - DNA, 19 bp, Homo sapiens
aaaagtttttaatttgatg

SEQ ID NO: 4250109 - DNA, 16 bp, Homo sapiens
aaaataaaacttttta

SEQ ID NO: 4250110 - DNA, 15 bp, Homo sapiens
aaaataaatagaaaa

SEQ ID NO: 4250111 - DNA, 12 bp, Homo sapiens
aaaataagacaa

SEQ ID NO: 4250112 - DNA, 12 bp, Homo sapiens
aaaataatacaa

SEQ ID NO: 4250113 - DNA, 16 bp, Homo sapiens
aaaataatagttttag

SEQ ID NO: 4250114 - DNA, 17 bp, Homo sapiens
aaaatacaatcctgttt

SEQ ID NO: 4250115 - DNA, 19 bp, Homo sapiens
aaaatacaatcctgtttat

SEQ ID NO: 4250116 - DNA, 16 bp, Homo sapiens
aaaatagagcttttaa

SEQ ID NO: 4250117 - DNA, 18 bp, Homo sapiens
aaaatagtggtgtgattt

SEQ ID NO: 4250118 - DNA, 12 bp, Homo sapiens
aaaatatatgaa

SEQ ID NO: 4250119 - DNA, 20 bp, Homo sapiens
aaaatatgtaagaacacatt

SEQ ID NO: 4250120 - DNA, 17 bp, Homo sapiens
aaaatatttaatatcaa

SEQ ID NO: 4250121 - DNA, 13 bp, Homo sapiens
aaaatattttttg

SEQ ID NO: 4250122 - DNA, 16 bp, Homo sapiens
aaaatattttttgcaa

SEQ ID NO: 4250123 - DNA, 22 bp, Homo sapiens
aaaatctcaaatttctaaatct

SEQ ID NO: 4250124 - DNA, 15 bp, Homo sapiens
aaaatctcaattgaa

SEQ ID NO: 4250125 - DNA, 22 bp, Homo sapiens
aaaatgcttaaaaaataataca

SEQ ID NO: 4250126 - DNA, 20 bp, Homo sapiens
aaaattaatatggtgtattt

SEQ ID NO: 4250127 - DNA, 17 bp, Homo sapiens
aaaattacgtttgttat

SEQ ID NO: 4250128 - DNA, 17 bp, Homo sapiens
aaaattcagtttttgta

SEQ ID NO: 4250129 - DNA, 22 bp, Homo sapiens
aaaattcgcccgagctgtttat

SEQ ID NO: 4250130 - DNA, 13 bp, Homo sapiens
aaaattctcctga

SEQ ID NO: 4250131 - DNA, 13 bp, Homo sapiens
aaaattgatatta

SEQ ID NO: 4250132 - DNA, 15 bp, Homo sapiens
aaaattgatattata

SEQ ID NO: 4250133 - DNA, 23 bp, Homo sapiens
aaaattgatattatattaaacat

SEQ ID NO: 4250134 - DNA, 13 bp, Homo sapiens
aaaattgatattt

SEQ ID NO: 4250135 - DNA, 13 bp, Homo sapiens
aaaatttatttca

SEQ ID NO: 4250136 - DNA, 23 bp, Homo sapiens
aaacacattcttattaattcttc

SEQ ID NO: 4250137 - DNA, 16 bp, Homo sapiens
aaacacatttttctta

SEQ ID NO: 4250138 - DNA, 19 bp, Homo sapiens
aaacactacacatttgaaa

SEQ ID NO: 4250139 - DNA, 13 bp, Homo sapiens
aaacataaaaact

SEQ ID NO: 4250140 - DNA, 12 bp, Homo sapiens
aaacatgtatgt

SEQ ID NO: 4250141 - DNA, 15 bp, Homo sapiens
aaactcttaatctgt

SEQ ID NO: 4250142 - DNA, 19 bp, Homo sapiens
aaactggattaaaacaatt

SEQ ID NO: 4250143 - DNA, 21 bp, Homo sapiens
aaactggattaaaacaatttt

SEQ ID NO: 4250144 - DNA, 16 bp, Homo sapiens
aaactggattaaactt

SEQ ID NO: 4250145 - DNA, 13 bp, Homo sapiens
aaacttaaaaaca

SEQ ID NO: 4250146 - DNA, 14 bp, Homo sapiens
aaacttaatctaaa

SEQ ID NO: 4250147 - DNA, 19 bp, Homo sapiens
aaacttaatctaaatggaa

SEQ ID NO: 4250148 - DNA, 12 bp, Homo sapiens
aaacttgtgaat

SEQ ID NO: 4250149 - DNA, 14 bp, Homo sapiens
aaactttacctttt

SEQ ID NO: 4250150 - DNA, 17 bp, Homo sapiens
aaacttttttatatctt

SEQ ID NO: 4250151 - DNA, 18 bp, Homo sapiens
aaacttttttatatcttt

SEQ ID NO: 4250152 - DNA, 14 bp, Homo sapiens
aaagaactgtactg

SEQ ID NO: 4250153 - DNA, 16 bp, Homo sapiens
aaagagtaatttcatt

SEQ ID NO: 4250154 - DNA, 20 bp, Homo sapiens
aaagagtaatttcatttaaa

SEQ ID NO: 4250155 - DNA, 14 bp, Homo sapiens
aaagatatggagaa

SEQ ID NO: 4250156 - DNA, 15 bp, Homo sapiens
aaagatgagtgagca

SEQ ID NO: 4250157 - DNA, 14 bp, Homo sapiens
aaagatttattgta

SEQ ID NO: 4250158 - DNA, 12 bp, Homo sapiens
aaagatttcttc

SEQ ID NO: 4250159 - DNA, 19 bp, Homo sapiens
aaagcaaccacaaatgcat

SEQ ID NO: 4250160 - DNA, 15 bp, Homo sapiens
aaagcactagagaat

SEQ ID NO: 4250161 - DNA, 16 bp, Homo sapiens
aaagcttcaaagttta

SEQ ID NO: 4250162 - DNA, 14 bp, Homo sapiens
aaagcttttaaaat

SEQ ID NO: 4250163 - DNA, 23 bp, Homo sapiens
aaaggaaatctcaccccatccca

SEQ ID NO: 4250164 - DNA, 20 bp, Homo sapiens
aaagggttgaaaatgtgttt

SEQ ID NO: 4250165 - DNA, 12 bp, Homo sapiens
aaaggttttgta

SEQ ID NO: 4250166 - DNA, 23 bp, Homo sapiens
aaagtaagttaataatgtattgt

SEQ ID NO: 4250167 - DNA, 20 bp, Homo sapiens
aaagtagacaatcattgttt

SEQ ID NO: 4250168 - DNA, 21 bp, Homo sapiens
aaagtgtatttttttactaat

SEQ ID NO: 4250169 - DNA, 18 bp, Homo sapiens
aaagtgtgtctgggattt

SEQ ID NO: 4250170 - DNA, 22 bp, Homo sapiens
aaagttgcagatgtattgactg

SEQ ID NO: 4250171 - DNA, 19 bp, Homo sapiens
aaagtttttaatttgatgc

SEQ ID NO: 4250172 - DNA, 14 bp, Homo sapiens
aaataaataatttt

SEQ ID NO: 4250173 - DNA, 15 bp, Homo sapiens
aaataaatagaaaag

SEQ ID NO: 4250174 - DNA, 12 bp, Homo sapiens
aaataatgaata

SEQ ID NO: 4250175 - DNA, 12 bp, Homo sapiens
aaataatgtgaa

SEQ ID NO: 4250176 - DNA, 18 bp, Homo sapiens
aaatacagttatttcatc

SEQ ID NO: 4250177 - DNA, 19 bp, Homo sapiens
aaatacattataacaacta

SEQ ID NO: 4250178 - DNA, 18 bp, Homo sapiens
aaataccagccagtaaat

SEQ ID NO: 4250179 - DNA, 20 bp, Homo sapiens
aaataccagccagtaaatgg

SEQ ID NO: 4250180 - DNA, 13 bp, Homo sapiens
aaatactgtgcag

SEQ ID NO: 4250181 - DNA, 21 bp, Homo sapiens
aaatactgtgcagaataatgg

SEQ ID NO: 4250182 - DNA, 23 bp, Homo sapiens
aaatactgtgcagaataatggaa

SEQ ID NO: 4250183 - DNA, 13 bp, Homo sapiens
aaatagataattt

SEQ ID NO: 4250184 - DNA, 19 bp, Homo sapiens
aaatagtggtgtgatttgg

SEQ ID NO: 4250185 - DNA, 21 bp, Homo sapiens
aaatataagacatttgtttgc

SEQ ID NO: 4250186 - DNA, 13 bp, Homo sapiens
aaatatatataaa

SEQ ID NO: 4250187 - DNA, 13 bp, Homo sapiens
aaatatctgttat

SEQ ID NO: 4250188 - DNA, 18 bp, Homo sapiens
aaatatgaaccctttgtt

SEQ ID NO: 4250189 - DNA, 15 bp, Homo sapiens
aaatattttttgcaa

SEQ ID NO: 4250190 - DNA, 13 bp, Homo sapiens
aaatcatgtatgt

SEQ ID NO: 4250191 - DNA, 18 bp, Homo sapiens
aaatcatgtatgttatga

SEQ ID NO: 4250192 - DNA, 14 bp, Homo sapiens
aaggggcagtggtg

SEQ ID NO: 4250193 - DNA, 17 bp, Homo sapiens
aaggggcagtggtggtt

SEQ ID NO: 4250194 - DNA, 18 bp, Homo sapiens
aaggtcattttttttaag

SEQ ID NO: 4250195 - DNA, 12 bp, Homo sapiens
aaggttttgtat

SEQ ID NO: 4250196 - DNA, 20 bp, Homo sapiens
aaggttttgtattttttaaa

SEQ ID NO: 4250197 - DNA, 19 bp, Homo sapiens
aagtaagttaataatgtat

SEQ ID NO: 4250198 - DNA, 12 bp, Homo sapiens
aagtaatatgca

SEQ ID NO: 4250199 - DNA, 18 bp, Homo sapiens
aagtaatatgcacacatt

SEQ ID NO: 4250200 - DNA, 21 bp, Homo sapiens
aagtaatatgcacacattttt

SEQ ID NO: 4250201 - DNA, 13 bp, Homo sapiens
aagtaattatgca

SEQ ID NO: 4250202 - DNA, 18 bp, Homo sapiens
aagtacaatgtgtttttc

SEQ ID NO: 4250203 - DNA, 18 bp, Homo sapiens
aagtacactgtttcaaac

SEQ ID NO: 4250204 - DNA, 20 bp, Homo sapiens
aagtagaaaagttgcagatg

SEQ ID NO: 4250205 - DNA, 17 bp, Homo sapiens
aagtagacaatcattgt

SEQ ID NO: 4250206 - DNA, 19 bp, Homo sapiens
aagtagacaatcattgttt

SEQ ID NO: 4250207 - DNA, 22 bp, Homo sapiens
aagtagcctctgggatctgcca

SEQ ID NO: 4250208 - DNA, 12 bp, Homo sapiens
aagtatactttt

SEQ ID NO: 4250209 - DNA, 14 bp, Homo sapiens
aagtatacttttcc

SEQ ID NO: 4250210 - DNA, 14 bp, Homo sapiens
aagtatagagagaa

SEQ ID NO: 4250211 - DNA, 17 bp, Homo sapiens
aagtatagagagaagtt

SEQ ID NO: 4250212 - DNA, 17 bp, Homo sapiens
aagtcatttttgtattt

SEQ ID NO: 4250213 - DNA, 20 bp, Homo sapiens
aagtcatttttgtatttttc

SEQ ID NO: 4250214 - DNA, 22 bp, Homo sapiens
aagtcatttttgtatttttcat

SEQ ID NO: 4250215 - DNA, 19 bp, Homo sapiens
aagtcgttttccaaactga

SEQ ID NO: 4250216 - DNA, 17 bp, Homo sapiens
aagtgagagttggggag

SEQ ID NO: 4250217 - DNA, 18 bp, Homo sapiens
aagtgtatttttttacta

SEQ ID NO: 4250218 - DNA, 21 bp, Homo sapiens
aagtgtatttttttactaata

SEQ ID NO: 4250219 - DNA, 13 bp, Homo sapiens
aagtgtgtctggg

SEQ ID NO: 4250220 - DNA, 16 bp, Homo sapiens
aagttaataatgtatt

SEQ ID NO: 4250221 - DNA, 12 bp, Homo sapiens
aagttctcaaag

SEQ ID NO: 4250222 - DNA, 17 bp, Homo sapiens
aagttttaactttaata

SEQ ID NO: 4250223 - DNA, 16 bp, Homo sapiens
aataaacagacaaaaa

SEQ ID NO: 4250224 - DNA, 14 bp, Homo sapiens
aataaataatttta

SEQ ID NO: 4250225 - DNA, 16 bp, Homo sapiens
aataacactgtatttt

SEQ ID NO: 4250226 - DNA, 22 bp, Homo sapiens
aataacactgtattttaatgta

SEQ ID NO: 4250227 - DNA, 23 bp, Homo sapiens
aataacactgtattttaatgtac

SEQ ID NO: 4250228 - DNA, 15 bp, Homo sapiens
aataagacaaaaata

SEQ ID NO: 4250229 - DNA, 12 bp, Homo sapiens
aataatattgtt

SEQ ID NO: 4250230 - DNA, 17 bp, Homo sapiens
aataatattgtttttct

SEQ ID NO: 4250231 - DNA, 21 bp, Homo sapiens
aataatattgtttttctttct

SEQ ID NO: 4250232 - DNA, 19 bp, Homo sapiens
aataatccagtattgctga

SEQ ID NO: 4250233 - DNA, 18 bp, Homo sapiens
aataatgaataaactgaa

SEQ ID NO: 4250234 - DNA, 12 bp, Homo sapiens
aataatgtattg

SEQ ID NO: 4250235 - DNA, 17 bp, Homo sapiens
aataatgtgaaactgga

SEQ ID NO: 4250236 - DNA, 15 bp, Homo sapiens
aataattctacatgt

SEQ ID NO: 4250237 - DNA, 17 bp, Homo sapiens
aataattttaatattct

SEQ ID NO: 4250238 - DNA, 19 bp, Homo sapiens
aatacaatcctgtttataa

SEQ ID NO: 4250239 - DNA, 16 bp, Homo sapiens
aatacaccactacatt

SEQ ID NO: 4250240 - DNA, 14 bp, Homo sapiens
aatacagttatttc

SEQ ID NO: 4250241 - DNA, 16 bp, Homo sapiens
aatacagttatttcat

SEQ ID NO: 4250242 - DNA, 11 bp, Homo sapiens
aatacatctgt

SEQ ID NO: 4250243 - DNA, 19 bp, Homo sapiens
aataccagccagtaaatgg

SEQ ID NO: 4250244 - DNA, 19 bp, Homo sapiens
aatactgtatcagatgtga

SEQ ID NO: 4250245 - DNA, 13 bp, Homo sapiens
aatagacaattta

SEQ ID NO: 4250246 - DNA, 16 bp, Homo sapiens
aataggagtatttttg

SEQ ID NO: 4250247 - DNA, 14 bp, Homo sapiens
aataggtagtttgg

SEQ ID NO: 4250248 - DNA, 18 bp, Homo sapiens
aataggtagtttggatat

SEQ ID NO: 4250249 - DNA, 21 bp, Homo sapiens
aataggtagtttggatatttt

SEQ ID NO: 4250250 - DNA, 22 bp, Homo sapiens
aatagtggtgtgatttggggat

SEQ ID NO: 4250251 - DNA, 13 bp, Homo sapiens
aatataatgtatt

SEQ ID NO: 4250252 - DNA, 15 bp, Homo sapiens
aatataatgtatttt

SEQ ID NO: 4250253 - DNA, 18 bp, Homo sapiens
aatataatgtattttctt

SEQ ID NO: 4250254 - DNA, 23 bp, Homo sapiens
aatataatgtattttctttttat

SEQ ID NO: 4250255 - DNA, 16 bp, Homo sapiens
aatataggaacttaaa

SEQ ID NO: 4250256 - DNA, 22 bp, Homo sapiens
aatataggtcctgtgttaaaca

SEQ ID NO: 4250257 - DNA, 12 bp, Homo sapiens
aatatatataaa

SEQ ID NO: 4250258 - DNA, 16 bp, Homo sapiens
aatatgcacacatttt

SEQ ID NO: 4250259 - DNA, 17 bp, Homo sapiens
aatatgcacacattttt

SEQ ID NO: 4250260 - DNA, 22 bp, Homo sapiens
aatatgcacacattttttaaat

SEQ ID NO: 4250261 - DNA, 15 bp, Homo sapiens
aatatggtgtatttt

SEQ ID NO: 4250262 - DNA, 15 bp, Homo sapiens
aatatttaatatcaa

SEQ ID NO: 4250263 - DNA, 16 bp, Homo sapiens
aatattttgataataa

SEQ ID NO: 4250264 - DNA, 18 bp, Homo sapiens
aatattttgataataata

SEQ ID NO: 4250265 - DNA, 22 bp, Homo sapiens
aatattttgataataatattgt

SEQ ID NO: 4250266 - DNA, 14 bp, Homo sapiens
aatattttggaaac

SEQ ID NO: 4250267 - DNA, 15 bp, Homo sapiens
aatattttggaaact

SEQ ID NO: 4250268 - DNA, 14 bp, Homo sapiens
aatattttttgcaa

SEQ ID NO: 4250269 - DNA, 17 bp, Homo sapiens
aatattttttgcaagtt

SEQ ID NO: 4250270 - DNA, 16 bp, Homo sapiens
aatcaacttttatgca

SEQ ID NO: 4250271 - DNA, 20 bp, Homo sapiens
aatcacagcccaaaatttga

SEQ ID NO: 4250272 - DNA, 23 bp, Homo sapiens
aatcatgtatgttatgatattgt

SEQ ID NO: 4250273 - DNA, 23 bp, Homo sapiens
aatcattaggtgtgactgaattt

SEQ ID NO: 4250274 - DNA, 12 bp, Homo sapiens
aatcattccagt

SEQ ID NO: 4250275 - DNA, 18 bp, Homo sapiens
aatcattccagtgctaga

SEQ ID NO: 4250276 - DNA, 14 bp, Homo sapiens
aatcattgttttga

SEQ ID NO: 4250277 - DNA, 18 bp, Homo sapiens
aatcattgttttgaatat

SEQ ID NO: 4250278 - DNA, 19 bp, Homo sapiens
aatcattgttttgaatatt

SEQ ID NO: 4250279 - DNA, 21 bp, Homo sapiens
aatccagtattgctgatttta

SEQ ID NO: 4250280 - DNA, 14 bp, Homo sapiens
aatcccttaaaatt

SEQ ID NO: 4250281 - DNA, 15 bp, Homo sapiens
aatcccttaaaatta

SEQ ID NO: 4250282 - DNA, 17 bp, Homo sapiens
aatctcaaatttctaaa

SEQ ID NO: 4250283 - DNA, 18 bp, Homo sapiens
aatctcaaatttctaaat

SEQ ID NO: 4250284 - DNA, 13 bp, Homo sapiens
aatctcaccccat

SEQ ID NO: 4250285 - DNA, 18 bp, Homo sapiens
aatctccaaaataaaact

SEQ ID NO: 4250286 - DNA, 17 bp, Homo sapiens
aatgaatattttgataa

SEQ ID NO: 4250287 - DNA, 13 bp, Homo sapiens
aatgacagatttc

SEQ ID NO: 4250288 - DNA, 16 bp, Homo sapiens
aatgacagatttctgt

SEQ ID NO: 4250289 - DNA, 23 bp, Homo sapiens
aatgacattaaatgcaataattt

SEQ ID NO: 4250290 - DNA, 14 bp, Homo sapiens
aatgacttactgta

SEQ ID NO: 4250291 - DNA, 21 bp, Homo sapiens
aatgacttgtacaaacagtat

SEQ ID NO: 4250292 - DNA, 23 bp, Homo sapiens
aatgacttgtacaaacagtattt

SEQ ID NO: 4250293 - DNA, 23 bp, Homo sapiens
aatgataaaataaataattttaa

SEQ ID NO: 4250294 - DNA, 17 bp, Homo sapiens
aatgatgccctgctcca

SEQ ID NO: 4250295 - DNA, 17 bp, Homo sapiens
aatgcaataattttact

SEQ ID NO: 4250296 - DNA, 13 bp, Homo sapiens
aatgcacctggaa

SEQ ID NO: 4250297 - DNA, 21 bp, Homo sapiens
aatgcgtgcataccacttttg

SEQ ID NO: 4250298 - DNA, 13 bp, Homo sapiens
aatgctgtgccct

SEQ ID NO: 4250299 - DNA, 18 bp, Homo sapiens
aatgcttaaaaaataata

SEQ ID NO: 4250300 - DNA, 17 bp, Homo sapiens
aatgcttcattgaaagc

SEQ ID NO: 4250301 - DNA, 17 bp, Homo sapiens
aatggaaacattacagt

SEQ ID NO: 4250302 - DNA, 17 bp, Homo sapiens
aatggactggtttgaga

SEQ ID NO: 4250303 - DNA, 13 bp, Homo sapiens
aatggcatggaga

SEQ ID NO: 4250304 - DNA, 21 bp, Homo sapiens
aatgggaaaaaacttaaaaat

SEQ ID NO: 4250305 - DNA, 12 bp, Homo sapiens
aatgtaaaaaag

SEQ ID NO: 4250306 - DNA, 15 bp, Homo sapiens
aatgtaatataatgt

SEQ ID NO: 4250307 - DNA, 11 bp, Homo sapiens
agatactgtat

SEQ ID NO: 4250308 - DNA, 16 bp, Homo sapiens
agatactgtatcatga

SEQ ID NO: 4250309 - DNA, 17 bp, Homo sapiens
agatatactttgtggac

SEQ ID NO: 4250310 - DNA, 23 bp, Homo sapiens
agatatactttgtggaccaatta

SEQ ID NO: 4250311 - DNA, 22 bp, Homo sapiens
agatatatttcacttttgttct

SEQ ID NO: 4250312 - DNA, 20 bp, Homo sapiens
agatatggagaattgctgaa

SEQ ID NO: 4250313 - DNA, 21 bp, Homo sapiens
agatattgaaggagaaaatag

SEQ ID NO: 4250314 - DNA, 21 bp, Homo sapiens
agatattttgctttgtgattt

SEQ ID NO: 4250315 - DNA, 22 bp, Homo sapiens
agatcttcccctaacctttggg

SEQ ID NO: 4250316 - DNA, 13 bp, Homo sapiens
agatgctatggaa

SEQ ID NO: 4250317 - DNA, 16 bp, Homo sapiens
agatgtattgactgta

SEQ ID NO: 4250318 - DNA, 17 bp, Homo sapiens
agattaggagaaacaca

SEQ ID NO: 4250319 - DNA, 13 bp, Homo sapiens
agatttattgtaa

SEQ ID NO: 4250320 - DNA, 17 bp, Homo sapiens
agatttctcactatata

SEQ ID NO: 4250321 - DNA, 19 bp, Homo sapiens
agattttgaggtaaagata

SEQ ID NO: 4250322 - DNA, 24 bp, Homo sapiens
agcaaatataggtcctgtgttaaa

SEQ ID NO: 4250323 - DNA, 14 bp, Homo sapiens
agcaaatatatgat

SEQ ID NO: 4250324 - DNA, 15 bp, Homo sapiens
agcaaatgacagatt

SEQ ID NO: 4250325 - DNA, 13 bp, Homo sapiens
agcaacatttgta

SEQ ID NO: 4250326 - DNA, 17 bp, Homo sapiens
agcaaggagatttacaa

SEQ ID NO: 4250327 - DNA, 17 bp, Homo sapiens
agcacgatttctgttta

SEQ ID NO: 4250328 - DNA, 19 bp, Homo sapiens
agcacgatttctgtttaga

SEQ ID NO: 4250329 - DNA, 13 bp, Homo sapiens
agcactagagaat

SEQ ID NO: 4250330 - DNA, 16 bp, Homo sapiens
agcactagagaatgca

SEQ ID NO: 4250331 - DNA, 20 bp, Homo sapiens
agcactagagaatgcacaga

SEQ ID NO: 4250332 - DNA, 12 bp, Homo sapiens
agcagaaatgcc

SEQ ID NO: 4250333 - DNA, 17 bp, Homo sapiens
agcagacagaaactgga

SEQ ID NO: 4250334 - DNA, 13 bp, Homo sapiens
agcagcgtttcta

SEQ ID NO: 4250335 - DNA, 19 bp, Homo sapiens
agcagcgtttctatgacac

SEQ ID NO: 4250336 - DNA, 18 bp, Homo sapiens
agcagggaccgggcgcag

SEQ ID NO: 4250337 - DNA, 23 bp, Homo sapiens
agcagggaccgggcgcagccctc

SEQ ID NO: 4250338 - DNA, 19 bp, Homo sapiens
agcataaataaaactgaat

SEQ ID NO: 4250339 - DNA, 19 bp, Homo sapiens
agcatacgtacacatttta

SEQ ID NO: 4250340 - DNA, 22 bp, Homo sapiens
agcatgtcaattcataaaaaca

SEQ ID NO: 4250341 - DNA, 22 bp, Homo sapiens
agcatttaatggcagctagtgc

SEQ ID NO: 4250342 - DNA, 14 bp, Homo sapiens
agccaaaccctgtc

SEQ ID NO: 4250343 - DNA, 15 bp, Homo sapiens
agccaacttttgcat

SEQ ID NO: 4250344 - DNA, 14 bp, Homo sapiens
agccattaaatgaa

SEQ ID NO: 4250345 - DNA, 17 bp, Homo sapiens
agccattaaatgaatat

SEQ ID NO: 4250346 - DNA, 14 bp, Homo sapiens
agcccctctcacag

SEQ ID NO: 4250347 - DNA, 20 bp, Homo sapiens
agcccctctcacaggcagct

SEQ ID NO: 4250348 - DNA, 23 bp, Homo sapiens
agcccgtgtccaggagccccgcc

SEQ ID NO: 4250349 - DNA, 12 bp, Homo sapiens
agccctctgtgg

SEQ ID NO: 4250350 - DNA, 22 bp, Homo sapiens
agccctctgtggccaggagccc

SEQ ID NO: 4250351 - DNA, 18 bp, Homo sapiens
agccctggcccgcaagag

SEQ ID NO: 4250352 - DNA, 14 bp, Homo sapiens
agccgtgtgtgcat

SEQ ID NO: 4250353 - DNA, 18 bp, Homo sapiens
agccgtgtgtgcatgtgc

SEQ ID NO: 4250354 - DNA, 13 bp, Homo sapiens
agcctaaatttgt

SEQ ID NO: 4250355 - DNA, 21 bp, Homo sapiens
agcctaaatttgtgcttttta

SEQ ID NO: 4250356 - DNA, 13 bp, Homo sapiens
agcctcccacccc

SEQ ID NO: 4250357 - DNA, 15 bp, Homo sapiens
agcctccggaagctg

SEQ ID NO: 4250358 - DNA, 18 bp, Homo sapiens
agcctctgggatctgcca

SEQ ID NO: 4250359 - DNA, 13 bp, Homo sapiens
agccttgaacttt

SEQ ID NO: 4250360 - DNA, 16 bp, Homo sapiens
agccttgaactttgac

SEQ ID NO: 4250361 - DNA, 17 bp, Homo sapiens
agcctttttgtaattta

SEQ ID NO: 4250362 - DNA, 12 bp, Homo sapiens
agcgccctgcag

SEQ ID NO: 4250363 - DNA, 13 bp, Homo sapiens
agcgccctgcagg

SEQ ID NO: 4250364 - DNA, 15 bp, Homo sapiens
agcgccctgcagggc

SEQ ID NO: 4250365 - DNA, 19 bp, Homo sapiens
agctacccttttcctttgt

SEQ ID NO: 4250366 - DNA, 21 bp, Homo sapiens
agctacccttttcctttgtgg

SEQ ID NO: 4250367 - DNA, 17 bp, Homo sapiens
agctagtgcctttagag

SEQ ID NO: 4250368 - DNA, 21 bp, Homo sapiens
agctagtgcctttagagggta

SEQ ID NO: 4250369 - DNA, 14 bp, Homo sapiens
agctagtgtttcta

SEQ ID NO: 4250370 - DNA, 23 bp, Homo sapiens
agctcaagaattgttagcaaatg

SEQ ID NO: 4250371 - DNA, 18 bp, Homo sapiens
agctcaatcacactggaa

SEQ ID NO: 4250372 - DNA, 20 bp, Homo sapiens
agctcattctccttgtgtta

SEQ ID NO: 4250373 - DNA, 12 bp, Homo sapiens
agctctgagccg

SEQ ID NO: 4250374 - DNA, 18 bp, Homo sapiens
agctgaagtcaaaatatg

SEQ ID NO: 4250375 - DNA, 14 bp, Homo sapiens
agctgccccagcca

SEQ ID NO: 4250376 - DNA, 19 bp, Homo sapiens
agctgctgggtggcagggg

SEQ ID NO: 4250377 - DNA, 19 bp, Homo sapiens
agctggcccagttgtccat

SEQ ID NO: 4250378 - DNA, 22 bp, Homo sapiens
agctggttgtaccctctccagg

SEQ ID NO: 4250379 - DNA, 14 bp, Homo sapiens
agcttcaaagttta

SEQ ID NO: 4250380 - DNA, 15 bp, Homo sapiens
agctttctgtgcatg

SEQ ID NO: 4250381 - DNA, 18 bp, Homo sapiens
agctttctgtgcatgtgc

SEQ ID NO: 4250382 - DNA, 12 bp, Homo sapiens
agcttttaaaaa

SEQ ID NO: 4250383 - DNA, 14 bp, Homo sapiens
aggaaatctcaccc

SEQ ID NO: 4250384 - DNA, 20 bp, Homo sapiens
aggaatttgatgattttcat

SEQ ID NO: 4250385 - DNA, 22 bp, Homo sapiens
aggacatagaggtatattggaa

SEQ ID NO: 4250386 - DNA, 23 bp, Homo sapiens
aggacctccggagcgccctgcag

SEQ ID NO: 4250387 - DNA, 22 bp, Homo sapiens
aggacttcaaagtgtgtctggg

SEQ ID NO: 4250388 - DNA, 21 bp, Homo sapiens
aggacttgtctccatgtgtat

SEQ ID NO: 4250389 - DNA, 15 bp, Homo sapiens
aggagaagagttgag

SEQ ID NO: 4250390 - DNA, 19 bp, Homo sapiens
aggagagtctgaatatttt

SEQ ID NO: 4250391 - DNA, 15 bp, Homo sapiens
aggagatcttcccct

SEQ ID NO: 4250392 - DNA, 18 bp, Homo sapiens
aggagccctactgaaggg

SEQ ID NO: 4250393 - DNA, 12 bp, Homo sapiens
aggagtattttt

SEQ ID NO: 4250394 - DNA, 13 bp, Homo sapiens
aggagtatttttg

SEQ ID NO: 4250395 - DNA, 21 bp, Homo sapiens
aggagtttgagaccagcttag

SEQ ID NO: 4250396 - DNA, 22 bp, Homo sapiens
aggatgcacagagttgttacat

SEQ ID NO: 4250397 - DNA, 18 bp, Homo sapiens
aggatgcttgtacataat

SEQ ID NO: 4250398 - DNA, 21 bp, Homo sapiens
aggatgcttgtacataatgcg

SEQ ID NO: 4250399 - DNA, 15 bp, Homo sapiens
aggcaaaaaactctt

SEQ ID NO: 4250400 - DNA, 17 bp, Homo sapiens
aggcacttattgtaaat

SEQ ID NO: 4250401 - DNA, 21 bp, Homo sapiens
aggcacttattgtaaatttta

SEQ ID NO: 4250402 - DNA, 14 bp, Homo sapiens
aggcagctctgagc

SEQ ID NO: 4250403 - DNA, 15 bp, Homo sapiens
aggcagctctgagcc

SEQ ID NO: 4250404 - DNA, 23 bp, Homo sapiens
aggcctacctctcgtttctgccc

SEQ ID NO: 4250405 - DNA, 23 bp, Homo sapiens
aggcgatccacctgtctcagcct

SEQ ID NO: 4250406 - DNA, 18 bp, Homo sapiens
aggctaaccctgatccat

SEQ ID NO: 4250407 - DNA, 23 bp, Homo sapiens
aggctcctgaccccgccatgcat

SEQ ID NO: 4250408 - DNA, 16 bp, Homo sapiens
aggcttttgggccaaa

SEQ ID NO: 4250409 - DNA, 16 bp, Homo sapiens
agggaacagcctgagc

SEQ ID NO: 4250410 - DNA, 12 bp, Homo sapiens
agggagagccct

SEQ ID NO: 4250411 - DNA, 14 bp, Homo sapiens
agggagagccctgt

SEQ ID NO: 4250412 - DNA, 14 bp, Homo sapiens
agggagattttgag

SEQ ID NO: 4250413 - DNA, 19 bp, Homo sapiens
agggcattctttcccagtg

SEQ ID NO: 4250414 - DNA, 15 bp, Homo sapiens
agggcgcccagcgcc

SEQ ID NO: 4250415 - DNA, 14 bp, Homo sapiens
agggcgggcaagga

SEQ ID NO: 4250416 - DNA, 20 bp, Homo sapiens
aggggcgggtgatgagacct

SEQ ID NO: 4250417 - DNA, 14 bp, Homo sapiens
aggtaaaatgtatt

SEQ ID NO: 4250418 - DNA, 16 bp, Homo sapiens
aggtaaaatgtatttt

SEQ ID NO: 4250419 - DNA, 22 bp, Homo sapiens
aggtattacaagtaatgtaaag

SEQ ID NO: 4250420 - DNA, 20 bp, Homo sapiens
aggtcaataacactgtattt

SEQ ID NO: 4250421 - DNA, 17 bp, Homo sapiens
aggtcattttttttaag

SEQ ID NO: 4250422 - DNA, 17 bp, Homo sapiens
atgaataaactgaatat

SEQ ID NO: 4250423 - DNA, 13 bp, Homo sapiens
atgaatattttga

SEQ ID NO: 4250424 - DNA, 22 bp, Homo sapiens
atgaattgaaaaacaattttct

SEQ ID NO: 4250425 - DNA, 17 bp, Homo sapiens
atgacagatttctgtaa

SEQ ID NO: 4250426 - DNA, 17 bp, Homo sapiens
atgacattaaatgcaat

SEQ ID NO: 4250427 - DNA, 23 bp, Homo sapiens
atgacattaaatgcaataatttt

SEQ ID NO: 4250428 - DNA, 16 bp, Homo sapiens
atgacttactgtacat

SEQ ID NO: 4250429 - DNA, 22 bp, Homo sapiens
atgaggcatttgtttgaactga

SEQ ID NO: 4250430 - DNA, 21 bp, Homo sapiens
atgagtctttgagactaaatt

SEQ ID NO: 4250431 - DNA, 22 bp, Homo sapiens
atgatattgtttaaaattcagt

SEQ ID NO: 4250432 - DNA, 19 bp, Homo sapiens
atgatggaacttagactcc

SEQ ID NO: 4250433 - DNA, 19 bp, Homo sapiens
atgatttccttcaatgtgc

SEQ ID NO: 4250434 - DNA, 20 bp, Homo sapiens
atgatttccttcaatgtgca

SEQ ID NO: 4250435 - DNA, 14 bp, Homo sapiens
atgcaaagtacaat

SEQ ID NO: 4250436 - DNA, 14 bp, Homo sapiens
atgcaataatttta

SEQ ID NO: 4250437 - DNA, 19 bp, Homo sapiens
atgcaatttgaagtaactt

SEQ ID NO: 4250438 - DNA, 15 bp, Homo sapiens
atgcacacatttttt

SEQ ID NO: 4250439 - DNA, 22 bp, Homo sapiens
atgcacacattttttaaatgca

SEQ ID NO: 4250440 - DNA, 23 bp, Homo sapiens
atgcacacattttttaaatgcac

SEQ ID NO: 4250441 - DNA, 16 bp, Homo sapiens
atgcacagagttgtta

SEQ ID NO: 4250442 - DNA, 17 bp, Homo sapiens
atgcacagagttgttac

SEQ ID NO: 4250443 - DNA, 18 bp, Homo sapiens
atgcacagagttgttaca

SEQ ID NO: 4250444 - DNA, 19 bp, Homo sapiens
atgcacagagttgttacat

SEQ ID NO: 4250445 - DNA, 23 bp, Homo sapiens
atgcacagagttgttacattttt

SEQ ID NO: 4250446 - DNA, 13 bp, Homo sapiens
atgcacagatata

SEQ ID NO: 4250447 - DNA, 16 bp, Homo sapiens
atgcacagatatactt

SEQ ID NO: 4250448 - DNA, 22 bp, Homo sapiens
atgcacagatatactttgtgga

SEQ ID NO: 4250449 - DNA, 16 bp, Homo sapiens
atgcacctggaatata

SEQ ID NO: 4250450 - DNA, 22 bp, Homo sapiens
atgcaggcacttattgtaaatt

SEQ ID NO: 4250451 - DNA, 13 bp, Homo sapiens
atgcataaatgca

SEQ ID NO: 4250452 - DNA, 13 bp, Homo sapiens
atgcataatttat

SEQ ID NO: 4250453 - DNA, 16 bp, Homo sapiens
atgcatattaaataat

SEQ ID NO: 4250454 - DNA, 20 bp, Homo sapiens
atgcatattaaataataaag

SEQ ID NO: 4250455 - DNA, 23 bp, Homo sapiens
atgcatgaagtaatatgcacaca

SEQ ID NO: 4250456 - DNA, 10 bp, Homo sapiens
atgcatttga

SEQ ID NO: 4250457 - DNA, 18 bp, Homo sapiens
atgcatttgaaaattttg

SEQ ID NO: 4250458 - DNA, 15 bp, Homo sapiens
atgcccagctaattt

SEQ ID NO: 4250459 - DNA, 21 bp, Homo sapiens
atgcccagctaatttttgtat

SEQ ID NO: 4250460 - DNA, 14 bp, Homo sapiens
atgccctgctccag

SEQ ID NO: 4250461 - DNA, 20 bp, Homo sapiens
atgcgtgcataccacttttg

SEQ ID NO: 4250462 - DNA, 22 bp, Homo sapiens
atgcgtgcataccacttttgtt

SEQ ID NO: 4250463 - DNA, 14 bp, Homo sapiens
atgctgtccgtgct

SEQ ID NO: 4250464 - DNA, 20 bp, Homo sapiens
atgcttaaactaaataatga

SEQ ID NO: 4250465 - DNA, 19 bp, Homo sapiens
atgcttctcatcttgtgaa

SEQ ID NO: 4250466 - DNA, 21 bp, Homo sapiens
atgcttctcatcttgtgaaat

SEQ ID NO: 4250467 - DNA, 16 bp, Homo sapiens
atggaaacattacagt

SEQ ID NO: 4250468 - DNA, 17 bp, Homo sapiens
atggaaatacagttatt

SEQ ID NO: 4250469 - DNA, 20 bp, Homo sapiens
atggaacataaagttgtatt

SEQ ID NO: 4250470 - DNA, 21 bp, Homo sapiens
atggaacataaagttgtattg

SEQ ID NO: 4250471 - DNA, 19 bp, Homo sapiens
atggaacttagactcctct

SEQ ID NO: 4250472 - DNA, 21 bp, Homo sapiens
atggactccagcctgcctggc

SEQ ID NO: 4250473 - DNA, 15 bp, Homo sapiens
atggactggtttgag

SEQ ID NO: 4250474 - DNA, 17 bp, Homo sapiens
atggagaattgctgaag

SEQ ID NO: 4250475 - DNA, 16 bp, Homo sapiens
atggagactctgagag

SEQ ID NO: 4250476 - DNA, 17 bp, Homo sapiens
atggcacatcagcacga

SEQ ID NO: 4250477 - DNA, 23 bp, Homo sapiens
atggcacatcagcacgatttctg

SEQ ID NO: 4250478 - DNA, 21 bp, Homo sapiens
atggcatggagactctgagag

SEQ ID NO: 4250479 - DNA, 19 bp, Homo sapiens
atgggaaaaaacttaaaaa

SEQ ID NO: 4250480 - DNA, 14 bp, Homo sapiens
atgggcagggaagg

SEQ ID NO: 4250481 - DNA, 19 bp, Homo sapiens
atggtcatatacatattgt

SEQ ID NO: 4250482 - DNA, 19 bp, Homo sapiens
atgtaaaaaagaaaaacac

SEQ ID NO: 4250483 - DNA, 16 bp, Homo sapiens
atgtaaaatgaattga

SEQ ID NO: 4250484 - DNA, 22 bp, Homo sapiens
atgtaaaatgaattgaaaaaca

SEQ ID NO: 4250485 - DNA, 16 bp, Homo sapiens
atgtaaagatgattta

SEQ ID NO: 4250486 - DNA, 16 bp, Homo sapiens
atgtaagaacacattt

SEQ ID NO: 4250487 - DNA, 19 bp, Homo sapiens
atgtaatataatgtatttt

SEQ ID NO: 4250488 - DNA, 21 bp, Homo sapiens
atgtaatataatgtattttct

SEQ ID NO: 4250489 - DNA, 20 bp, Homo sapiens
atgtataatgtgcagaaaat

SEQ ID NO: 4250490 - DNA, 17 bp, Homo sapiens
atgtatgttatgatatt

SEQ ID NO: 4250491 - DNA, 14 bp, Homo sapiens
atgtattgactgta

SEQ ID NO: 4250492 - DNA, 14 bp, Homo sapiens
atgtattgtaatct

SEQ ID NO: 4250493 - DNA, 17 bp, Homo sapiens
atgtattgtaatctttc

SEQ ID NO: 4250494 - DNA, 19 bp, Homo sapiens
atgtattgtaatctttcat

SEQ ID NO: 4250495 - DNA, 14 bp, Homo sapiens
atgtatttaaagtt

SEQ ID NO: 4250496 - DNA, 15 bp, Homo sapiens
atgtatttaaagttg

SEQ ID NO: 4250497 - DNA, 19 bp, Homo sapiens
atgtatttaaagttgtatc

SEQ ID NO: 4250498 - DNA, 15 bp, Homo sapiens
atgtcctgcctttta

SEQ ID NO: 4250499 - DNA, 13 bp, Homo sapiens
atgtctcactgtt

SEQ ID NO: 4250500 - DNA, 21 bp, Homo sapiens
atgtctcactgttctgcaaag

SEQ ID NO: 4250501 - DNA, 19 bp, Homo sapiens
atgtgaataggttatatgc

SEQ ID NO: 4250502 - DNA, 18 bp, Homo sapiens
atgtgcagaaaatattta

SEQ ID NO: 4250503 - DNA, 23 bp, Homo sapiens
atgtgcagaaaatatttaatatc

SEQ ID NO: 4250504 - DNA, 22 bp, Homo sapiens
atgtgtagttgtctctcttcag

SEQ ID NO: 4250505 - DNA, 23 bp, Homo sapiens
atgtgtagttgtctctcttcaga

SEQ ID NO: 4250506 - DNA, 13 bp, Homo sapiens
atgttaaatactg

SEQ ID NO: 4250507 - DNA, 15 bp, Homo sapiens
atgttaaatactgtg

SEQ ID NO: 4250508 - DNA, 22 bp, Homo sapiens
atgttatcggattactgaattg

SEQ ID NO: 4250509 - DNA, 17 bp, Homo sapiens
atgttatgatattgttt

SEQ ID NO: 4250510 - DNA, 22 bp, Homo sapiens
atgttatgatattgtttaaaat

SEQ ID NO: 4250511 - DNA, 12 bp, Homo sapiens
atgttattttgt

SEQ ID NO: 4250512 - DNA, 17 bp, Homo sapiens
atgttccttttttgtat

SEQ ID NO: 4250513 - DNA, 15 bp, Homo sapiens
atgttcttaattctt

SEQ ID NO: 4250514 - DNA, 14 bp, Homo sapiens
atgtttaaatcatg

SEQ ID NO: 4250515 - DNA, 19 bp, Homo sapiens
atgtttaaatcatgtatgt

SEQ ID NO: 4250516 - DNA, 20 bp, Homo sapiens
atgtttttataaaaataaat

SEQ ID NO: 4250517 - DNA, 15 bp, Homo sapiens
attaaaaatctcaaa

SEQ ID NO: 4250518 - DNA, 12 bp, Homo sapiens
attaaaacaata

SEQ ID NO: 4250519 - DNA, 19 bp, Homo sapiens
attaaacttaatctaaatg

SEQ ID NO: 4250520 - DNA, 22 bp, Homo sapiens
attaaatgaatattttgataat

SEQ ID NO: 4250521 - DNA, 13 bp, Homo sapiens
attaaattcttgc

SEQ ID NO: 4250522 - DNA, 14 bp, Homo sapiens
attaaattcttgca

SEQ ID NO: 4250523 - DNA, 12 bp, Homo sapiens
attaacttttat

SEQ ID NO: 4250524 - DNA, 15 bp, Homo sapiens
attaataatatttat

SEQ ID NO: 4250525 - DNA, 20 bp, Homo sapiens
attaatattcccattttatt

SEQ ID NO: 4250526 - DNA, 16 bp, Homo sapiens
attaattcttcacctg

SEQ ID NO: 4250527 - DNA, 15 bp, Homo sapiens
attacagttcataat

SEQ ID NO: 4250528 - DNA, 19 bp, Homo sapiens
attaccacagacatactaa

SEQ ID NO: 4250529 - DNA, 15 bp, Homo sapiens
attacgtttgttatt

SEQ ID NO: 4250530 - DNA, 22 bp, Homo sapiens
attaggagaaacacattcttat

SEQ ID NO: 4250531 - DNA, 23 bp, Homo sapiens
attagggcaattggaacaaagtg

SEQ ID NO: 4250532 - DNA, 13 bp, Homo sapiens
attagtgaagatg

SEQ ID NO: 4250533 - DNA, 19 bp, Homo sapiens
attataacaactatttact

SEQ ID NO: 4250534 - DNA, 15 bp, Homo sapiens
attatattaaacata

SEQ ID NO: 4250535 - DNA, 13 bp, Homo sapiens
attcaatgtattg

SEQ ID NO: 4250536 - DNA, 18 bp, Homo sapiens
cagatggactccagcctg

SEQ ID NO: 4250537 - DNA, 19 bp, Homo sapiens
cagatgtattgactgtacc

SEQ ID NO: 4250538 - DNA, 23 bp, Homo sapiens
cagattggaatgttacatctgtc

SEQ ID NO: 4250539 - DNA, 12 bp, Homo sapiens
cagcaaatatat

SEQ ID NO: 4250540 - DNA, 17 bp, Homo sapiens
cagcaaggagatttaca

SEQ ID NO: 4250541 - DNA, 18 bp, Homo sapiens
cagcaaggagatttacaa

SEQ ID NO: 4250542 - DNA, 13 bp, Homo sapiens
cagcaataaagca

SEQ ID NO: 4250543 - DNA, 18 bp, Homo sapiens
cagcacagctctcctcct

SEQ ID NO: 4250544 - DNA, 14 bp, Homo sapiens
cagcacgatttctg

SEQ ID NO: 4250545 - DNA, 16 bp, Homo sapiens
cagcacgatttctgtt

SEQ ID NO: 4250546 - DNA, 17 bp, Homo sapiens
cagcactttgggaggct

SEQ ID NO: 4250547 - DNA, 17 bp, Homo sapiens
cagcagaaatgccttac

SEQ ID NO: 4250548 - DNA, 15 bp, Homo sapiens
cagcagttctctgcc

SEQ ID NO: 4250549 - DNA, 14 bp, Homo sapiens
cagcatcagcacag

SEQ ID NO: 4250550 - DNA, 20 bp, Homo sapiens
cagcatttccacaccaagca

SEQ ID NO: 4250551 - DNA, 17 bp, Homo sapiens
cagccaaaccctgtctg

SEQ ID NO: 4250552 - DNA, 22 bp, Homo sapiens
cagccagtaaatgggggtgcat

SEQ ID NO: 4250553 - DNA, 20 bp, Homo sapiens
cagccatgggaaatgagcca

SEQ ID NO: 4250554 - DNA, 21 bp, Homo sapiens
cagccatgggaaatgagccag

SEQ ID NO: 4250555 - DNA, 16 bp, Homo sapiens
cagcccaaaatttgat

SEQ ID NO: 4250556 - DNA, 19 bp, Homo sapiens
cagcccagaagaaaattct

SEQ ID NO: 4250557 - DNA, 16 bp, Homo sapiens
cagcctcccaccccca

SEQ ID NO: 4250558 - DNA, 12 bp, Homo sapiens
cagcctgagccg

SEQ ID NO: 4250559 - DNA, 15 bp, Homo sapiens
cagcctgcctggcag

SEQ ID NO: 4250560 - DNA, 19 bp, Homo sapiens
cagcctgcctggcaggctg

SEQ ID NO: 4250561 - DNA, 15 bp, Homo sapiens
cagcgtcctgtccac

SEQ ID NO: 4250562 - DNA, 18 bp, Homo sapiens
cagctataattctgttat

SEQ ID NO: 4250563 - DNA, 14 bp, Homo sapiens
cagctcgatccaaa

SEQ ID NO: 4250564 - DNA, 20 bp, Homo sapiens
cagctcgatccaaattgtgc

SEQ ID NO: 4250565 - DNA, 20 bp, Homo sapiens
cagctgaagtcaaaatatgt

SEQ ID NO: 4250566 - DNA, 22 bp, Homo sapiens
cagctggttgtaccctctccag

SEQ ID NO: 4250567 - DNA, 12 bp, Homo sapiens
cagctttgataa

SEQ ID NO: 4250568 - DNA, 20 bp, Homo sapiens
cagctttgataattgtgtac

SEQ ID NO: 4250569 - DNA, 21 bp, Homo sapiens
caggacaccacgattctccca

SEQ ID NO: 4250570 - DNA, 18 bp, Homo sapiens
caggagccctactgaagg

SEQ ID NO: 4250571 - DNA, 24 bp, Homo sapiens
caggagccctactgaagggaacag

SEQ ID NO: 4250572 - DNA, 21 bp, Homo sapiens
caggagccctggcccgcaaga

SEQ ID NO: 4250573 - DNA, 15 bp, Homo sapiens
caggcctcttggcag

SEQ ID NO: 4250574 - DNA, 19 bp, Homo sapiens
caggcgatccacctgtctc

SEQ ID NO: 4250575 - DNA, 22 bp, Homo sapiens
caggctgcttcaatcccagcct

SEQ ID NO: 4250576 - DNA, 16 bp, Homo sapiens
caggctgtctggccag

SEQ ID NO: 4250577 - DNA, 20 bp, Homo sapiens
cagggaaggaatcctggtgg

SEQ ID NO: 4250578 - DNA, 14 bp, Homo sapiens
cagggccgggcagg

SEQ ID NO: 4250579 - DNA, 15 bp, Homo sapiens
cagggccgggcaggg

SEQ ID NO: 4250580 - DNA, 16 bp, Homo sapiens
cagggccgggcagggg

SEQ ID NO: 4250581 - DNA, 22 bp, Homo sapiens
caggggcgggtgatgagacctg

SEQ ID NO: 4250582 - DNA, 21 bp, Homo sapiens
caggtgcccgcgccaggccct

SEQ ID NO: 4250583 - DNA, 14 bp, Homo sapiens
caggtgctgggaat

SEQ ID NO: 4250584 - DNA, 17 bp, Homo sapiens
caggtggatgaggagac

SEQ ID NO: 4250585 - DNA, 23 bp, Homo sapiens
cagtattgctgattttaaaggca

SEQ ID NO: 4250586 - DNA, 17 bp, Homo sapiens
cagtcctgcctcagcct

SEQ ID NO: 4250587 - DNA, 19 bp, Homo sapiens
cagtctcactgtgggaagg

SEQ ID NO: 4250588 - DNA, 23 bp, Homo sapiens
cagtctcactgtgggaaggccag

SEQ ID NO: 4250589 - DNA, 14 bp, Homo sapiens
cagtcttcctgccg

SEQ ID NO: 4250590 - DNA, 22 bp, Homo sapiens
cagtgactttgtatagagaatt

SEQ ID NO: 4250591 - DNA, 21 bp, Homo sapiens
cagtgctaagctgccctgagg

SEQ ID NO: 4250592 - DNA, 14 bp, Homo sapiens
cagtgctagaaaat

SEQ ID NO: 4250593 - DNA, 16 bp, Homo sapiens
cagtggtactctgtgt

SEQ ID NO: 4250594 - DNA, 20 bp, Homo sapiens
cagtggtactctgtgtctgg

SEQ ID NO: 4250595 - DNA, 20 bp, Homo sapiens
cagtggtggttttctgttct

SEQ ID NO: 4250596 - DNA, 20 bp, Homo sapiens
cagttactcagaattctcta

SEQ ID NO: 4250597 - DNA, 12 bp, Homo sapiens
cagttatttctg

SEQ ID NO: 4250598 - DNA, 21 bp, Homo sapiens
cagtttgttagtatgaggcat

SEQ ID NO: 4250599 - DNA, 22 bp, Homo sapiens
cagtttttaaaaacctgtatct

SEQ ID NO: 4250600 - DNA, 18 bp, Homo sapiens
cataaaaactgatttgct

SEQ ID NO: 4250601 - DNA, 21 bp, Homo sapiens
cataaacaagaccacgtttct

SEQ ID NO: 4250602 - DNA, 18 bp, Homo sapiens
cataaacaatgatgccct

SEQ ID NO: 4250603 - DNA, 17 bp, Homo sapiens
cataatgcgtgcatacc

SEQ ID NO: 4250604 - DNA, 18 bp, Homo sapiens
cataattcagcacttaac

SEQ ID NO: 4250605 - DNA, 18 bp, Homo sapiens
catacaaagcgtgcacaa

SEQ ID NO: 4250606 - DNA, 14 bp, Homo sapiens
cataccacttttgt

SEQ ID NO: 4250607 - DNA, 18 bp, Homo sapiens
catacgtacacattttat

SEQ ID NO: 4250608 - DNA, 14 bp, Homo sapiens
catactaaccagca

SEQ ID NO: 4250609 - DNA, 18 bp, Homo sapiens
catagctcaagaattgtt

SEQ ID NO: 4250610 - DNA, 16 bp, Homo sapiens
catatacatattgtat

SEQ ID NO: 4250611 - DNA, 22 bp, Homo sapiens
catatcaattggcagtgacttt

SEQ ID NO: 4250612 - DNA, 20 bp, Homo sapiens
catattaccacagacatact

SEQ ID NO: 4250613 - DNA, 21 bp, Homo sapiens
catattaccacagacatacta

SEQ ID NO: 4250614 - DNA, 19 bp, Homo sapiens
catccacttcaggagccct

SEQ ID NO: 4250615 - DNA, 18 bp, Homo sapiens
catcgcgggatggtgcag

SEQ ID NO: 4250616 - DNA, 22 bp, Homo sapiens
catctcccagatcctggaaaca

SEQ ID NO: 4250617 - DNA, 20 bp, Homo sapiens
catctctccctcccctgcca

SEQ ID NO: 4250618 - DNA, 11 bp, Homo sapiens
catctctgtga

SEQ ID NO: 4250619 - DNA, 20 bp, Homo sapiens
catctgcattttcaccccac

SEQ ID NO: 4250620 - DNA, 23 bp, Homo sapiens
catctggcacgtggccaggagcc

SEQ ID NO: 4250621 - DNA, 13 bp, Homo sapiens
catcttgtgaaat

SEQ ID NO: 4250622 - DNA, 19 bp, Homo sapiens
catgaaaacacatttttct

SEQ ID NO: 4250623 - DNA, 23 bp, Homo sapiens
catgaggggattcccttccttct

SEQ ID NO: 4250624 - DNA, 15 bp, Homo sapiens
catgcaaggtcattt

SEQ ID NO: 4250625 - DNA, 15 bp, Homo sapiens
catgccacagtggta

SEQ ID NO: 4250626 - DNA, 20 bp, Homo sapiens
catgctacacactgcatgtt

SEQ ID NO: 4250627 - DNA, 17 bp, Homo sapiens
catgctgtccgtgcttg

SEQ ID NO: 4250628 - DNA, 21 bp, Homo sapiens
catgctgtccgtgcttgctgg

SEQ ID NO: 4250629 - DNA, 23 bp, Homo sapiens
catgcttctcatcttgtgaaatg

SEQ ID NO: 4250630 - DNA, 15 bp, Homo sapiens
catgcttctgtgccg

SEQ ID NO: 4250631 - DNA, 13 bp, Homo sapiens
catggagactctg

SEQ ID NO: 4250632 - DNA, 16 bp, Homo sapiens
catggagactctgaga

SEQ ID NO: 4250633 - DNA, 21 bp, Homo sapiens
catggcctcttcagatctcta

SEQ ID NO: 4250634 - DNA, 20 bp, Homo sapiens
catggctcagagcttgaaga

SEQ ID NO: 4250635 - DNA, 16 bp, Homo sapiens
catggtcggaaaacat

SEQ ID NO: 4250636 - DNA, 17 bp, Homo sapiens
catggtcggaaaacatg

SEQ ID NO: 4250637 - DNA, 23 bp, Homo sapiens
catggtcggaaaacatgctacac

SEQ ID NO: 4250638 - DNA, 22 bp, Homo sapiens
catgtatgttatgatattgttt

SEQ ID NO: 4250639 - DNA, 23 bp, Homo sapiens
catgtatgttatgatattgttta

SEQ ID NO: 4250640 - DNA, 15 bp, Homo sapiens
catgtgggtgagtta

SEQ ID NO: 4250641 - DNA, 20 bp, Homo sapiens
catgttcaaattttatcatg

SEQ ID NO: 4250642 - DNA, 21 bp, Homo sapiens
catgttgggtttgagacagac

SEQ ID NO: 4250643 - DNA, 12 bp, Homo sapiens
catgtttgtgat

SEQ ID NO: 4250644 - DNA, 15 bp, Homo sapiens
catgtttgtgattga

SEQ ID NO: 4250645 - DNA, 22 bp, Homo sapiens
cattaggtgtgactgaatttct

SEQ ID NO: 4250646 - DNA, 12 bp, Homo sapiens
cattatctagat

SEQ ID NO: 4250647 - DNA, 16 bp, Homo sapiens
cattatctcacttagt

SEQ ID NO: 4250648 - DNA, 16 bp, Homo sapiens
cattattgcttattgc

SEQ ID NO: 4250649 - DNA, 17 bp, Homo sapiens
cattcaatctttggagg

SEQ ID NO: 4250650 - DNA, 19 bp, Homo sapiens
ctctttgccctgaggctca

SEQ ID NO: 4250651 - DNA, 14 bp, Homo sapiens
ctgaagatatattt

SEQ ID NO: 4250652 - DNA, 18 bp, Homo sapiens
ctgaagggaacagcctga

SEQ ID NO: 4250653 - DNA, 19 bp, Homo sapiens
ctgaagggaacagcctgag

SEQ ID NO: 4250654 - DNA, 15 bp, Homo sapiens
ctgaatattttggaa

SEQ ID NO: 4250655 - DNA, 18 bp, Homo sapiens
ctgaatattttggaaact

SEQ ID NO: 4250656 - DNA, 13 bp, Homo sapiens
ctgaatatttttt

SEQ ID NO: 4250657 - DNA, 21 bp, Homo sapiens
ctgaattgtatcaatttgttt

SEQ ID NO: 4250658 - DNA, 12 bp, Homo sapiens
ctgacagcctcc

SEQ ID NO: 4250659 - DNA, 17 bp, Homo sapiens
ctgacagcctcccaccc

SEQ ID NO: 4250660 - DNA, 20 bp, Homo sapiens
ctgacagcctcccaccccca

SEQ ID NO: 4250661 - DNA, 23 bp, Homo sapiens
ctgacccactttgtaatttttgc

SEQ ID NO: 4250662 - DNA, 15 bp, Homo sapiens
ctgaccccgccatgc

SEQ ID NO: 4250663 - DNA, 18 bp, Homo sapiens
ctgagcccccttcctgtc

SEQ ID NO: 4250664 - DNA, 12 bp, Homo sapiens
ctgagggcaaat

SEQ ID NO: 4250665 - DNA, 13 bp, Homo sapiens
ctgataaagatga

SEQ ID NO: 4250666 - DNA, 20 bp, Homo sapiens
ctgcaagcacatctgcattt

SEQ ID NO: 4250667 - DNA, 15 bp, Homo sapiens
ctgcagcaataaagc

SEQ ID NO: 4250668 - DNA, 17 bp, Homo sapiens
ctgcagcaataaagcag

SEQ ID NO: 4250669 - DNA, 13 bp, Homo sapiens
ctgcagggccggg

SEQ ID NO: 4250670 - DNA, 19 bp, Homo sapiens
ctgcattcattctgagccc

SEQ ID NO: 4250671 - DNA, 19 bp, Homo sapiens
ctgccaaagcttgtggagg

SEQ ID NO: 4250672 - DNA, 18 bp, Homo sapiens
ctgcccagccctctgtgg

SEQ ID NO: 4250673 - DNA, 14 bp, Homo sapiens
ctgccccagccaga

SEQ ID NO: 4250674 - DNA, 22 bp, Homo sapiens
ctgccctcaggctccccagtgc

SEQ ID NO: 4250675 - DNA, 18 bp, Homo sapiens
ctgccggttccgcccgcc

SEQ ID NO: 4250676 - DNA, 18 bp, Homo sapiens
ctgccttgctcctagcag

SEQ ID NO: 4250677 - DNA, 22 bp, Homo sapiens
ctgcgctcttgggaccccagag

SEQ ID NO: 4250678 - DNA, 17 bp, Homo sapiens
ctgctaaattctatgtt

SEQ ID NO: 4250679 - DNA, 20 bp, Homo sapiens
ctgctaaattctatgttaaa

SEQ ID NO: 4250680 - DNA, 12 bp, Homo sapiens
ctgctccaggga

SEQ ID NO: 4250681 - DNA, 20 bp, Homo sapiens
ctgctccctgtggcactcag

SEQ ID NO: 4250682 - DNA, 16 bp, Homo sapiens
ctgctgacctcccacc

SEQ ID NO: 4250683 - DNA, 22 bp, Homo sapiens
ctgctgcaggccgtgtgtctgt

SEQ ID NO: 4250684 - DNA, 17 bp, Homo sapiens
ctgctgggtgccaggtg

SEQ ID NO: 4250685 - DNA, 21 bp, Homo sapiens
ctgctgggtgccaggtgctgg

SEQ ID NO: 4250686 - DNA, 15 bp, Homo sapiens
ctgcttaacttcaca

SEQ ID NO: 4250687 - DNA, 20 bp, Homo sapiens
ctgcttaacttcacatattg

SEQ ID NO: 4250688 - DNA, 20 bp, Homo sapiens
ctgcttgagctttctgtgca

SEQ ID NO: 4250689 - DNA, 16 bp, Homo sapiens
ctgctttatcttttca

SEQ ID NO: 4250690 - DNA, 19 bp, Homo sapiens
ctggacctcatgttgttga

SEQ ID NO: 4250691 - DNA, 15 bp, Homo sapiens
ctggagcaccaggtg

SEQ ID NO: 4250692 - DNA, 13 bp, Homo sapiens
ctggagctttcct

SEQ ID NO: 4250693 - DNA, 16 bp, Homo sapiens
ctggagtgagcactca

SEQ ID NO: 4250694 - DNA, 15 bp, Homo sapiens
ctggcacgtggccag

SEQ ID NO: 4250695 - DNA, 16 bp, Homo sapiens
ctggcacgtggccagg

SEQ ID NO: 4250696 - DNA, 17 bp, Homo sapiens
ctggcacgtggccagga

SEQ ID NO: 4250697 - DNA, 20 bp, Homo sapiens
ctggcacgtggccaggagcc

SEQ ID NO: 4250698 - DNA, 20 bp, Homo sapiens
ctggcaggctactctgccca

SEQ ID NO: 4250699 - DNA, 21 bp, Homo sapiens
ctggcaggctactctgcccac

SEQ ID NO: 4250700 - DNA, 13 bp, Homo sapiens
ctggcccagccaa

SEQ ID NO: 4250701 - DNA, 20 bp, Homo sapiens
ctggcccagccaaaccctgt

SEQ ID NO: 4250702 - DNA, 23 bp, Homo sapiens
ctggcccagccaaaccctgtctg

SEQ ID NO: 4250703 - DNA, 17 bp, Homo sapiens
ctggcctagcatacgta

SEQ ID NO: 4250704 - DNA, 22 bp, Homo sapiens
ctggctatgcatttgaaaattt

SEQ ID NO: 4250705 - DNA, 19 bp, Homo sapiens
ctgggaatacatctgtgga

SEQ ID NO: 4250706 - DNA, 22 bp, Homo sapiens
ctgggaccacaggttcatgcca

SEQ ID NO: 4250707 - DNA, 18 bp, Homo sapiens
ctggggcaggctgcttca

SEQ ID NO: 4250708 - DNA, 15 bp, Homo sapiens
ctgggtattggaaat

SEQ ID NO: 4250709 - DNA, 13 bp, Homo sapiens
ctgggtgccaggt

SEQ ID NO: 4250710 - DNA, 20 bp, Homo sapiens
ctggtagcataaataaaact

SEQ ID NO: 4250711 - DNA, 21 bp, Homo sapiens
ctggtagcataaataaaactg

SEQ ID NO: 4250712 - DNA, 17 bp, Homo sapiens
ctggtgtactctaggac

SEQ ID NO: 4250713 - DNA, 21 bp, Homo sapiens
ctggtgtactctaggacttca

SEQ ID NO: 4250714 - DNA, 19 bp, Homo sapiens
ctggtgtatattttaatgt

SEQ ID NO: 4250715 - DNA, 16 bp, Homo sapiens
ctggttccatggcctc

SEQ ID NO: 4250716 - DNA, 16 bp, Homo sapiens
ctggttcgtgccatgc

SEQ ID NO: 4250717 - DNA, 14 bp, Homo sapiens
ctgtaatttgtgat

SEQ ID NO: 4250718 - DNA, 17 bp, Homo sapiens
ctgtaatttgtgataca

SEQ ID NO: 4250719 - DNA, 18 bp, Homo sapiens
ctgtaatttgtgatacaa

SEQ ID NO: 4250720 - DNA, 20 bp, Homo sapiens
ctgtacatgaaaacacattt

SEQ ID NO: 4250721 - DNA, 22 bp, Homo sapiens
ctgtacatgaaaacacattttt

SEQ ID NO: 4250722 - DNA, 16 bp, Homo sapiens
ctgtaccacagacaca

SEQ ID NO: 4250723 - DNA, 15 bp, Homo sapiens
ctgtatcagatgtga

SEQ ID NO: 4250724 - DNA, 15 bp, Homo sapiens
ctgtatttctaggca

SEQ ID NO: 4250725 - DNA, 16 bp, Homo sapiens
ctgtccaatttctgct

SEQ ID NO: 4250726 - DNA, 15 bp, Homo sapiens
ctgtccacacccagc

SEQ ID NO: 4250727 - DNA, 21 bp, Homo sapiens
ctgtccagccgtgtgtgcatg

SEQ ID NO: 4250728 - DNA, 23 bp, Homo sapiens
ctgtccagccgtgtgtgcatgtg

SEQ ID NO: 4250729 - DNA, 14 bp, Homo sapiens
ctgtccatgcttct

SEQ ID NO: 4250730 - DNA, 12 bp, Homo sapiens
ctgtccctcact

SEQ ID NO: 4250731 - DNA, 14 bp, Homo sapiens
ctgtctcagcctcc

SEQ ID NO: 4250732 - DNA, 16 bp, Homo sapiens
ctgtctcagcctccca

SEQ ID NO: 4250733 - DNA, 16 bp, Homo sapiens
ctgtctgatcagggtg

SEQ ID NO: 4250734 - DNA, 16 bp, Homo sapiens
ctgtctgttatgattt

SEQ ID NO: 4250735 - DNA, 17 bp, Homo sapiens
ctgtctgttatgatttc

SEQ ID NO: 4250736 - DNA, 15 bp, Homo sapiens
ctgtgattacctctc

SEQ ID NO: 4250737 - DNA, 14 bp, Homo sapiens
ctgtgcagaataat

SEQ ID NO: 4250738 - DNA, 18 bp, Homo sapiens
ctgtgcagaataatggaa

SEQ ID NO: 4250739 - DNA, 11 bp, Homo sapiens
ctgtgcatgtg

SEQ ID NO: 4250740 - DNA, 14 bp, Homo sapiens
ctgtggccaggagc

SEQ ID NO: 4250741 - DNA, 19 bp, Homo sapiens
ctgtggccaggagccctgg

SEQ ID NO: 4250742 - DNA, 16 bp, Homo sapiens
ctgtgggaaggccagc

SEQ ID NO: 4250743 - DNA, 18 bp, Homo sapiens
ctgtgggaaggccagctg

SEQ ID NO: 4250744 - DNA, 13 bp, Homo sapiens
ctgtgtctggcag

SEQ ID NO: 4250745 - DNA, 14 bp, Homo sapiens
ctgtgtctggcagg

SEQ ID NO: 4250746 - DNA, 15 bp, Homo sapiens
ctgtgtctggcaggc

SEQ ID NO: 4250747 - DNA, 13 bp, Homo sapiens
ctgtgttaaacac

SEQ ID NO: 4250748 - DNA, 22 bp, Homo sapiens
ctgttaaacagtagttgtattc

SEQ ID NO: 4250749 - DNA, 18 bp, Homo sapiens
ctgttattcaaatttgat

SEQ ID NO: 4250750 - DNA, 16 bp, Homo sapiens
ctgttctttccaaagt

SEQ ID NO: 4250751 - DNA, 21 bp, Homo sapiens
ctgttctttccaaagtacact

SEQ ID NO: 4250752 - DNA, 14 bp, Homo sapiens
ctgttctttctggc

SEQ ID NO: 4250753 - DNA, 21 bp, Homo sapiens
ctgttgctggtgtactctagg

SEQ ID NO: 4250754 - DNA, 23 bp, Homo sapiens
ctgttgctggtgtactctaggac

SEQ ID NO: 4250755 - DNA, 12 bp, Homo sapiens
ctgtttagataa

SEQ ID NO: 4250756 - DNA, 14 bp, Homo sapiens
ctgtttagataata

SEQ ID NO: 4250757 - DNA, 20 bp, Homo sapiens
ctgtttataatctgaagata

SEQ ID NO: 4250758 - DNA, 17 bp, Homo sapiens
cttaaaaaataatacaa

SEQ ID NO: 4250759 - DNA, 19 bp, Homo sapiens
cttaaaattgatattatat

SEQ ID NO: 4250760 - DNA, 21 bp, Homo sapiens
cttaaaattgatattatatta

SEQ ID NO: 4250761 - DNA, 17 bp, Homo sapiens
cttaaactaaataatga

SEQ ID NO: 4250762 - DNA, 12 bp, Homo sapiens
cttaaccttaaa

SEQ ID NO: 4250763 - DNA, 18 bp, Homo sapiens
cttaaccttaaccttaaa

SEQ ID NO: 4250764 - DNA, 15 bp, Homo sapiens
cttaacttcacatat

SEQ ID NO: 4250765 - DNA, 16 bp, Homo sapiens
gcaaagtacaatgtgt

SEQ ID NO: 4250766 - DNA, 19 bp, Homo sapiens
gcaaagtacaatgtgtttt

SEQ ID NO: 4250767 - DNA, 12 bp, Homo sapiens
gcaaatatatga

SEQ ID NO: 4250768 - DNA, 19 bp, Homo sapiens
gcaaatgacagatttctgt

SEQ ID NO: 4250769 - DNA, 21 bp, Homo sapiens
gcaaatgacagatttctgtaa

SEQ ID NO: 4250770 - DNA, 23 bp, Homo sapiens
gcaagagggacagagcccgggag

SEQ ID NO: 4250771 - DNA, 14 bp, Homo sapiens
gcaagcacatctgc

SEQ ID NO: 4250772 - DNA, 13 bp, Homo sapiens
gcaagcaggagtg

SEQ ID NO: 4250773 - DNA, 15 bp, Homo sapiens
gcaagcaggagtgtg

SEQ ID NO: 4250774 - DNA, 21 bp, Homo sapiens
gcaaggagtggggagggagtc

SEQ ID NO: 4250775 - DNA, 15 bp, Homo sapiens
gcacaaggattgaaa

SEQ ID NO: 4250776 - DNA, 11 bp, Homo sapiens
gcacacatttt

SEQ ID NO: 4250777 - DNA, 12 bp, Homo sapiens
gcacacattttt

SEQ ID NO: 4250778 - DNA, 20 bp, Homo sapiens
gcacatcagcacgatttctg

SEQ ID NO: 4250779 - DNA, 22 bp, Homo sapiens
gcaccatggtatcatatattaa

SEQ ID NO: 4250780 - DNA, 11 bp, Homo sapiens
gcacctgagcc

SEQ ID NO: 4250781 - DNA, 12 bp, Homo sapiens
gcacctgagcct

SEQ ID NO: 4250782 - DNA, 18 bp, Homo sapiens
gcacctgagggggaaaaa

SEQ ID NO: 4250783 - DNA, 12 bp, Homo sapiens
gcacgatttctg

SEQ ID NO: 4250784 - DNA, 16 bp, Homo sapiens
gcacgtggccaggagc

SEQ ID NO: 4250785 - DNA, 18 bp, Homo sapiens
gcacgtggccaggagcca

SEQ ID NO: 4250786 - DNA, 16 bp, Homo sapiens
gcactagagaatgcac

SEQ ID NO: 4250787 - DNA, 15 bp, Homo sapiens
gcactgtccagctgg

SEQ ID NO: 4250788 - DNA, 17 bp, Homo sapiens
gcactgtccagctggtt

SEQ ID NO: 4250789 - DNA, 17 bp, Homo sapiens
gcacttacctgcttgag

SEQ ID NO: 4250790 - DNA, 14 bp, Homo sapiens
gcacttattgtaaa

SEQ ID NO: 4250791 - DNA, 17 bp, Homo sapiens
gcagaaaatatttaata

SEQ ID NO: 4250792 - DNA, 18 bp, Homo sapiens
gcagaacatcgatatgta

SEQ ID NO: 4250793 - DNA, 16 bp, Homo sapiens
gcagacagaaactgga

SEQ ID NO: 4250794 - DNA, 23 bp, Homo sapiens
gcagcaataaagcagcgtttcta

SEQ ID NO: 4250795 - DNA, 16 bp, Homo sapiens
gcagcagaaccttggc

SEQ ID NO: 4250796 - DNA, 19 bp, Homo sapiens
gcagcccgtgtccaggagc

SEQ ID NO: 4250797 - DNA, 14 bp, Homo sapiens
gcagctagtgcctt

SEQ ID NO: 4250798 - DNA, 12 bp, Homo sapiens
gcagctctgagc

SEQ ID NO: 4250799 - DNA, 19 bp, Homo sapiens
gcaggcacttattgtaaat

SEQ ID NO: 4250800 - DNA, 16 bp, Homo sapiens
gcagggaccgggcgca

SEQ ID NO: 4250801 - DNA, 15 bp, Homo sapiens
gcagggccgggcagg

SEQ ID NO: 4250802 - DNA, 19 bp, Homo sapiens
gcagggggacagcagggac

SEQ ID NO: 4250803 - DNA, 17 bp, Homo sapiens
gcagtcctgcctcagcc

SEQ ID NO: 4250804 - DNA, 18 bp, Homo sapiens
gcagtcctgcctcagcct

SEQ ID NO: 4250805 - DNA, 12 bp, Homo sapiens
gcagtgactttg

SEQ ID NO: 4250806 - DNA, 14 bp, Homo sapiens
gcagtgactttgta

SEQ ID NO: 4250807 - DNA, 15 bp, Homo sapiens
gcagtgcacgcggct

SEQ ID NO: 4250808 - DNA, 14 bp, Homo sapiens
gcagttctctgcca

SEQ ID NO: 4250809 - DNA, 20 bp, Homo sapiens
gcataatgataaaataaata

SEQ ID NO: 4250810 - DNA, 22 bp, Homo sapiens
gcataatgataaaataaataat

SEQ ID NO: 4250811 - DNA, 17 bp, Homo sapiens
gcatacgtacacatttt

SEQ ID NO: 4250812 - DNA, 16 bp, Homo sapiens
gcatattcaatgtatt

SEQ ID NO: 4250813 - DNA, 15 bp, Homo sapiens
gcatccacttcagga

SEQ ID NO: 4250814 - DNA, 21 bp, Homo sapiens
gcatctagtttccctggtgcc

SEQ ID NO: 4250815 - DNA, 11 bp, Homo sapiens
gcatctgcatg

SEQ ID NO: 4250816 - DNA, 21 bp, Homo sapiens
gcatctggcacgtggccagga

SEQ ID NO: 4250817 - DNA, 22 bp, Homo sapiens
gcatctggcacgtggccaggag

SEQ ID NO: 4250818 - DNA, 21 bp, Homo sapiens
gcatgaagtaatatgcacaca

SEQ ID NO: 4250819 - DNA, 23 bp, Homo sapiens
gcatgaagtaatatgcacacatt

SEQ ID NO: 4250820 - DNA, 22 bp, Homo sapiens
gcatgacttgtgtgtgatgaga

SEQ ID NO: 4250821 - DNA, 14 bp, Homo sapiens
gcatgcaatttgaa

SEQ ID NO: 4250822 - DNA, 17 bp, Homo sapiens
gcatggagactctgaga

SEQ ID NO: 4250823 - DNA, 21 bp, Homo sapiens
gcatggtggctcatgcctgta

SEQ ID NO: 4250824 - DNA, 17 bp, Homo sapiens
gcatgtttgtgattgac

SEQ ID NO: 4250825 - DNA, 18 bp, Homo sapiens
gcattatataccctggtg

SEQ ID NO: 4250826 - DNA, 11 bp, Homo sapiens
gcattctttcc

SEQ ID NO: 4250827 - DNA, 13 bp, Homo sapiens
gcattctttccca

SEQ ID NO: 4250828 - DNA, 18 bp, Homo sapiens
gcattctttcccagtgag

SEQ ID NO: 4250829 - DNA, 17 bp, Homo sapiens
gcatttaatggcagcta

SEQ ID NO: 4250830 - DNA, 23 bp, Homo sapiens
gcatttaatggcagctagtgcct

SEQ ID NO: 4250831 - DNA, 21 bp, Homo sapiens
gcatttggtggtttcagaaat

SEQ ID NO: 4250832 - DNA, 22 bp, Homo sapiens
gcatttggtggtttcagaaatg

SEQ ID NO: 4250833 - DNA, 23 bp, Homo sapiens
gcatttggtggtttcagaaatgt

SEQ ID NO: 4250834 - DNA, 16 bp, Homo sapiens
gcatttgtttgaactg

SEQ ID NO: 4250835 - DNA, 15 bp, Homo sapiens
gccaaaccctgtctg

SEQ ID NO: 4250836 - DNA, 21 bp, Homo sapiens
gccaacacacgtccactccca

SEQ ID NO: 4250837 - DNA, 19 bp, Homo sapiens
gccacagtggtactctgtg

SEQ ID NO: 4250838 - DNA, 15 bp, Homo sapiens
gccaccacgtccagc

SEQ ID NO: 4250839 - DNA, 23 bp, Homo sapiens
gccacctggaagccgcgcggccg

SEQ ID NO: 4250840 - DNA, 16 bp, Homo sapiens
gccactagtaagtaat

SEQ ID NO: 4250841 - DNA, 17 bp, Homo sapiens
gccactgcgctcttggg

SEQ ID NO: 4250842 - DNA, 22 bp, Homo sapiens
gccacttagacactttacctct

SEQ ID NO: 4250843 - DNA, 13 bp, Homo sapiens
gccaggagccctg

SEQ ID NO: 4250844 - DNA, 23 bp, Homo sapiens
gccaggtgcccgcgccaggccct

SEQ ID NO: 4250845 - DNA, 12 bp, Homo sapiens
gccagtaaatgg

SEQ ID NO: 4250846 - DNA, 16 bp, Homo sapiens
gccagtaggagaaatc

SEQ ID NO: 4250847 - DNA, 13 bp, Homo sapiens
gccagtggagacg

SEQ ID NO: 4250848 - DNA, 15 bp, Homo sapiens
gccattaaatgaata

SEQ ID NO: 4250849 - DNA, 20 bp, Homo sapiens
gcccagccctctgtggccag

SEQ ID NO: 4250850 - DNA, 11 bp, Homo sapiens
gccccagccag

SEQ ID NO: 4250851 - DNA, 23 bp, Homo sapiens
gccccccgaggctaaccctgatc

SEQ ID NO: 4250852 - DNA, 15 bp, Homo sapiens
gcccctctcacaggc

SEQ ID NO: 4250853 - DNA, 20 bp, Homo sapiens
gcccgcaagagggacagagc

SEQ ID NO: 4250854 - DNA, 16 bp, Homo sapiens
gcccggaagaaccaga

SEQ ID NO: 4250855 - DNA, 14 bp, Homo sapiens
gcccgggagagact

SEQ ID NO: 4250856 - DNA, 16 bp, Homo sapiens
gccctctgtggccagg

SEQ ID NO: 4250857 - DNA, 19 bp, Homo sapiens
gccctctgtggccaggagc

SEQ ID NO: 4250858 - DNA, 20 bp, Homo sapiens
gccctctgtggccaggagcc

SEQ ID NO: 4250859 - DNA, 24 bp, Homo sapiens
gccctctgtggccaggagccctgg

SEQ ID NO: 4250860 - DNA, 11 bp, Homo sapiens
gccctgcagca

SEQ ID NO: 4250861 - DNA, 20 bp, Homo sapiens
gccctgcagggccgggcagg

SEQ ID NO: 4250862 - DNA, 13 bp, Homo sapiens
gcccttctgccct

SEQ ID NO: 4250863 - DNA, 20 bp, Homo sapiens
gccctttcttgcactgtcca

SEQ ID NO: 4250864 - DNA, 21 bp, Homo sapiens
gccctttcttgcactgtccag

SEQ ID NO: 4250865 - DNA, 19 bp, Homo sapiens
gccgaccacgccccaggac

SEQ ID NO: 4250866 - DNA, 19 bp, Homo sapiens
gccgggagactgccagtgg

SEQ ID NO: 4250867 - DNA, 18 bp, Homo sapiens
gccgtccggcggccccgc

SEQ ID NO: 4250868 - DNA, 23 bp, Homo sapiens
gcctacctctcgtttctgcccag

SEQ ID NO: 4250869 - DNA, 12 bp, Homo sapiens
gcctagcatacg

SEQ ID NO: 4250870 - DNA, 23 bp, Homo sapiens
gcctagcatacgtacacatttta

SEQ ID NO: 4250871 - DNA, 17 bp, Homo sapiens
gcctcccacccccatct

SEQ ID NO: 4250872 - DNA, 21 bp, Homo sapiens
gcctcgtgctccgcagggcgc

SEQ ID NO: 4250873 - DNA, 15 bp, Homo sapiens
gcctgcctggcaggc

SEQ ID NO: 4250874 - DNA, 16 bp, Homo sapiens
gcctgctgggtgccag

SEQ ID NO: 4250875 - DNA, 19 bp, Homo sapiens
gcctggttcgtgccatgcc

SEQ ID NO: 4250876 - DNA, 18 bp, Homo sapiens
gccttaccctcatgttct

SEQ ID NO: 4250877 - DNA, 22 bp, Homo sapiens
gcgaaacccggtgcatctggca

SEQ ID NO: 4250878 - DNA, 17 bp, Homo sapiens
gcgcacttacctgcttg

SEQ ID NO: 4250879 - DNA, 17 bp, Homo sapiens
gcgctgggtattggaaa

SEQ ID NO: 4250880 - DNA, 13 bp, Homo sapiens
gtcacacctgtgc

SEQ ID NO: 4250881 - DNA, 21 bp, Homo sapiens
gtcactgcttaacttcacata

SEQ ID NO: 4250882 - DNA, 17 bp, Homo sapiens
gtcatagagctgcaggg

SEQ ID NO: 4250883 - DNA, 20 bp, Homo sapiens
gtcatttggtgctctgctaa

SEQ ID NO: 4250884 - DNA, 16 bp, Homo sapiens
gtcatttttgtatttt

SEQ ID NO: 4250885 - DNA, 15 bp, Homo sapiens
gtccactcccaagcc

SEQ ID NO: 4250886 - DNA, 21 bp, Homo sapiens
gtccagccgtgtgtgcatgtg

SEQ ID NO: 4250887 - DNA, 15 bp, Homo sapiens
gtccaggagccccgc

SEQ ID NO: 4250888 - DNA, 22 bp, Homo sapiens
gtccaggagccccgccaggtgc

SEQ ID NO: 4250889 - DNA, 20 bp, Homo sapiens
gtcccaatggtcctgacttt

SEQ ID NO: 4250890 - DNA, 15 bp, Homo sapiens
gtcccagagtggctg

SEQ ID NO: 4250891 - DNA, 18 bp, Homo sapiens
gtcccccgttgtgcctgg

SEQ ID NO: 4250892 - DNA, 12 bp, Homo sapiens
gtccctgccctc

SEQ ID NO: 4250893 - DNA, 13 bp, Homo sapiens
gtcccttttgcta

SEQ ID NO: 4250894 - DNA, 15 bp, Homo sapiens
gtcctactcctggag

SEQ ID NO: 4250895 - DNA, 21 bp, Homo sapiens
gtcggaaaacatgctacacac

SEQ ID NO: 4250896 - DNA, 22 bp, Homo sapiens
gtcgggcatggtggctcatgcc

SEQ ID NO: 4250897 - DNA, 19 bp, Homo sapiens
gtctcacagtgttgcccag

SEQ ID NO: 4250898 - DNA, 13 bp, Homo sapiens
gtctcactgttct

SEQ ID NO: 4250899 - DNA, 16 bp, Homo sapiens
gtctcagagagttaat

SEQ ID NO: 4250900 - DNA, 23 bp, Homo sapiens
gtctcgctttgttgcccaggctg

SEQ ID NO: 4250901 - DNA, 20 bp, Homo sapiens
gtctctccctcccccagagc

SEQ ID NO: 4250902 - DNA, 23 bp, Homo sapiens
gtctctccctcccccagagcccc

SEQ ID NO: 4250903 - DNA, 20 bp, Homo sapiens
gtctctcttcagactctcag

SEQ ID NO: 4250904 - DNA, 22 bp, Homo sapiens
gtctctcttcagactctcagcc

SEQ ID NO: 4250905 - DNA, 17 bp, Homo sapiens
gtctctgctggcccagc

SEQ ID NO: 4250906 - DNA, 22 bp, Homo sapiens
gtctggcaggctactctgccca

SEQ ID NO: 4250907 - DNA, 14 bp, Homo sapiens
gtctgttctttcca

SEQ ID NO: 4250908 - DNA, 12 bp, Homo sapiens
gtgaaactggat

SEQ ID NO: 4250909 - DNA, 17 bp, Homo sapiens
gtgaactagggaagctc

SEQ ID NO: 4250910 - DNA, 13 bp, Homo sapiens
gtgaagtgcctgc

SEQ ID NO: 4250911 - DNA, 16 bp, Homo sapiens
gtgaagtgcctgctgg

SEQ ID NO: 4250912 - DNA, 17 bp, Homo sapiens
gtgaataggttatatgc

SEQ ID NO: 4250913 - DNA, 19 bp, Homo sapiens
gtgaataggttatatgcaa

SEQ ID NO: 4250914 - DNA, 14 bp, Homo sapiens
gtgagggtggtggg

SEQ ID NO: 4250915 - DNA, 21 bp, Homo sapiens
gtgagtgtgtgtgtgtgtctg

SEQ ID NO: 4250916 - DNA, 15 bp, Homo sapiens
gtgatacaatgctgt

SEQ ID NO: 4250917 - DNA, 22 bp, Homo sapiens
gtgatcttggcttactgcagcc

SEQ ID NO: 4250918 - DNA, 13 bp, Homo sapiens
gtgcacaaggatt

SEQ ID NO: 4250919 - DNA, 20 bp, Homo sapiens
gtgcagaataatggaaacat

SEQ ID NO: 4250920 - DNA, 24 bp, Homo sapiens
gtgcagcccctctcacaggcagct

SEQ ID NO: 4250921 - DNA, 13 bp, Homo sapiens
gtgcataccactt

SEQ ID NO: 4250922 - DNA, 21 bp, Homo sapiens
gtgcataccacttttgttctt

SEQ ID NO: 4250923 - DNA, 12 bp, Homo sapiens
gtgcatgtgcag

SEQ ID NO: 4250924 - DNA, 15 bp, Homo sapiens
gtgcatgtgccgagg

SEQ ID NO: 4250925 - DNA, 15 bp, Homo sapiens
gtgcattatctagat

SEQ ID NO: 4250926 - DNA, 21 bp, Homo sapiens
gtgcatttgaggtctgttctt

SEQ ID NO: 4250927 - DNA, 22 bp, Homo sapiens
gtgcatttgaggtctgttcttt

SEQ ID NO: 4250928 - DNA, 13 bp, Homo sapiens
gtgccaggtgctg

SEQ ID NO: 4250929 - DNA, 17 bp, Homo sapiens
gtgcccttccctggagg

SEQ ID NO: 4250930 - DNA, 18 bp, Homo sapiens
gtgcctgctgggtgccag

SEQ ID NO: 4250931 - DNA, 19 bp, Homo sapiens
gtgcctggttcgtgccatg

SEQ ID NO: 4250932 - DNA, 20 bp, Homo sapiens
gtgcgcacttacctgcttga

SEQ ID NO: 4250933 - DNA, 23 bp, Homo sapiens
gtgcgcacttacctgcttgagct

SEQ ID NO: 4250934 - DNA, 19 bp, Homo sapiens
gtgcgtcccccgttgtgcc

SEQ ID NO: 4250935 - DNA, 18 bp, Homo sapiens
gtgctaagctgccctgag

SEQ ID NO: 4250936 - DNA, 21 bp, Homo sapiens
gtgctagaaaatttagccctt

SEQ ID NO: 4250937 - DNA, 15 bp, Homo sapiens
gtgcttgctggtgcc

SEQ ID NO: 4250938 - DNA, 18 bp, Homo sapiens
gtgcttgctggtgcctct

SEQ ID NO: 4250939 - DNA, 23 bp, Homo sapiens
gtgctttttaagaatatttttag

SEQ ID NO: 4250940 - DNA, 13 bp, Homo sapiens
gtggaagtcttgg

SEQ ID NO: 4250941 - DNA, 22 bp, Homo sapiens
gtggagaactcagtgccacacc

SEQ ID NO: 4250942 - DNA, 19 bp, Homo sapiens
gtggaggagggagagccct

SEQ ID NO: 4250943 - DNA, 23 bp, Homo sapiens
gtggatttaacagaaatgtacag

SEQ ID NO: 4250944 - DNA, 21 bp, Homo sapiens
gtggcaatgcttaaactaaat

SEQ ID NO: 4250945 - DNA, 19 bp, Homo sapiens
gtggcaccagaggtgcttc

SEQ ID NO: 4250946 - DNA, 16 bp, Homo sapiens
gtggccaggagccctg

SEQ ID NO: 4250947 - DNA, 23 bp, Homo sapiens
gtggcccggaagaaccagaagtg

SEQ ID NO: 4250948 - DNA, 14 bp, Homo sapiens
gtggccgccatgct

SEQ ID NO: 4250949 - DNA, 19 bp, Homo sapiens
gtggcctcgtgctccgcag

SEQ ID NO: 4250950 - DNA, 14 bp, Homo sapiens
gtgggaaggccagc

SEQ ID NO: 4250951 - DNA, 10 bp, Homo sapiens
gtgggctcct

SEQ ID NO: 4250952 - DNA, 22 bp, Homo sapiens
gtggtactctgtgtctggcagg

SEQ ID NO: 4250953 - DNA, 20 bp, Homo sapiens
gtgtactctaggacttcaaa

SEQ ID NO: 4250954 - DNA, 15 bp, Homo sapiens
gtgtatataatttta

SEQ ID NO: 4250955 - DNA, 17 bp, Homo sapiens
gtgtatataattttatg

SEQ ID NO: 4250956 - DNA, 13 bp, Homo sapiens
gtgtctgggattt

SEQ ID NO: 4250957 - DNA, 19 bp, Homo sapiens
gtgtgtgcatgtgccgagg

SEQ ID NO: 4250958 - DNA, 14 bp, Homo sapiens
gtgttaggtcaata

SEQ ID NO: 4250959 - DNA, 20 bp, Homo sapiens
gtgttgcccaggctggtctc

SEQ ID NO: 4250960 - DNA, 22 bp, Homo sapiens
gtgtttaaaaagtaagttaata

SEQ ID NO: 4250961 - DNA, 20 bp, Homo sapiens
gtgtttgctgccttgctcct

SEQ ID NO: 4250962 - DNA, 14 bp, Homo sapiens
gtgtttttctccag

SEQ ID NO: 4250963 - DNA, 22 bp, Homo sapiens
gttaaaataccagccagtaaat

SEQ ID NO: 4250964 - DNA, 21 bp, Homo sapiens
gttaaatactgtgcagaataa

SEQ ID NO: 4250965 - DNA, 15 bp, Homo sapiens
gttaaattcagtaat

SEQ ID NO: 4250966 - DNA, 15 bp, Homo sapiens
gttactcagaattct

SEQ ID NO: 4250967 - DNA, 22 bp, Homo sapiens
gttagaccgctctcttttctgt

SEQ ID NO: 4250968 - DNA, 23 bp, Homo sapiens
gttagaccgctctcttttctgta

SEQ ID NO: 4250969 - DNA, 21 bp, Homo sapiens
gttaggtagagggagttgtca

SEQ ID NO: 4250970 - DNA, 17 bp, Homo sapiens
gttagtatgaggcattt

SEQ ID NO: 4250971 - DNA, 11 bp, Homo sapiens
gttatgtatga

SEQ ID NO: 4250972 - DNA, 20 bp, Homo sapiens
gttatgtatgaaggaatcat

SEQ ID NO: 4250973 - DNA, 12 bp, Homo sapiens
gttatgtattta

SEQ ID NO: 4250974 - DNA, 15 bp, Homo sapiens
gttatgtatttaaag

SEQ ID NO: 4250975 - DNA, 19 bp, Homo sapiens
gttattaaaaatctcaaat

SEQ ID NO: 4250976 - DNA, 12 bp, Homo sapiens
gttattgttgaa

SEQ ID NO: 4250977 - DNA, 21 bp, Homo sapiens
gttattgttgaacatacttca

SEQ ID NO: 4250978 - DNA, 20 bp, Homo sapiens
gttcaaagatattttgcttt

SEQ ID NO: 4250979 - DNA, 22 bp, Homo sapiens
gttcaaagatattttgctttgt

SEQ ID NO: 4250980 - DNA, 21 bp, Homo sapiens
gttcaatatcagctttgataa

SEQ ID NO: 4250981 - DNA, 16 bp, Homo sapiens
gttcatgccaccatgg

SEQ ID NO: 4250982 - DNA, 18 bp, Homo sapiens
gttcctctttgccctgag

SEQ ID NO: 4250983 - DNA, 19 bp, Homo sapiens
gttcctctttgccctgagg

SEQ ID NO: 4250984 - DNA, 14 bp, Homo sapiens
gttcttggtttgta

SEQ ID NO: 4250985 - DNA, 15 bp, Homo sapiens
gttcttggtttgtaa

SEQ ID NO: 4250986 - DNA, 18 bp, Homo sapiens
gttcttggtttgtaaatt

SEQ ID NO: 4250987 - DNA, 21 bp, Homo sapiens
gttcttggtttgtaaattaac

SEQ ID NO: 4250988 - DNA, 18 bp, Homo sapiens
gttctttccaaagtacac

SEQ ID NO: 4250989 - DNA, 20 bp, Homo sapiens
gttctttccaaagtacactg

SEQ ID NO: 4250990 - DNA, 23 bp, Homo sapiens
gttgagcgtacgatggaggccta

SEQ ID NO: 4250991 - DNA, 19 bp, Homo sapiens
gttgggtggcaattccaat

SEQ ID NO: 4250992 - DNA, 13 bp, Homo sapiens
gttggtagtttct

SEQ ID NO: 4250993 - DNA, 16 bp, Homo sapiens
gttggtcggtgggttg

SEQ ID NO: 4250994 - DNA, 13 bp, Homo sapiens
tcaccccatccca

SEQ ID NO: 4250995 - DNA, 23 bp, Homo sapiens
tcacctatgttattttgtgtaca

SEQ ID NO: 4250996 - DNA, 12 bp, Homo sapiens
tcactgttctgc

SEQ ID NO: 4250997 - DNA, 22 bp, Homo sapiens
tcacttctcttaaacttgtgaa

SEQ ID NO: 4250998 - DNA, 13 bp, Homo sapiens
tcacttttgttct

SEQ ID NO: 4250999 - DNA, 22 bp, Homo sapiens
tcactttttttttttgtttgat

SEQ ID NO: 4251000 - DNA, 10 bp, Homo sapiens
tcagaaatgt

SEQ ID NO: 4251001 - DNA, 15 bp, Homo sapiens
tcagaaatgtgttat

SEQ ID NO: 4251002 - DNA, 23 bp, Homo sapiens
tcagaattctctagtttgattaa

SEQ ID NO: 4251003 - DNA, 21 bp, Homo sapiens
tcagactctcagcccagaaga

SEQ ID NO: 4251004 - DNA, 16 bp, Homo sapiens
tcagatctctaacttc

SEQ ID NO: 4251005 - DNA, 18 bp, Homo sapiens
tcagcacgatttctgttt

SEQ ID NO: 4251006 - DNA, 20 bp, Homo sapiens
tcagcacttaactatgagcc

SEQ ID NO: 4251007 - DNA, 12 bp, Homo sapiens
tcagcccagaag

SEQ ID NO: 4251008 - DNA, 13 bp, Homo sapiens
tcagcccagaaga

SEQ ID NO: 4251009 - DNA, 15 bp, Homo sapiens
tcagctttgataatt

SEQ ID NO: 4251010 - DNA, 13 bp, Homo sapiens
tcaggctccccag

SEQ ID NO: 4251011 - DNA, 17 bp, Homo sapiens
tcaggctccccagtgct

SEQ ID NO: 4251012 - DNA, 14 bp, Homo sapiens
tcatatacaaacat

SEQ ID NO: 4251013 - DNA, 17 bp, Homo sapiens
tcatatattaaaacaat

SEQ ID NO: 4251014 - DNA, 14 bp, Homo sapiens
tcatccagaaaaga

SEQ ID NO: 4251015 - DNA, 16 bp, Homo sapiens
tcatcctcagcagcat

SEQ ID NO: 4251016 - DNA, 14 bp, Homo sapiens
tcatcttgtgaaat

SEQ ID NO: 4251017 - DNA, 22 bp, Homo sapiens
tcatcttgtgaaatggccagga

SEQ ID NO: 4251018 - DNA, 13 bp, Homo sapiens
tcatctttaagaa

SEQ ID NO: 4251019 - DNA, 16 bp, Homo sapiens
tcatgctgtccgtgct

SEQ ID NO: 4251020 - DNA, 11 bp, Homo sapiens
tcatgttctta

SEQ ID NO: 4251021 - DNA, 17 bp, Homo sapiens
tcatgttcttaattctt

SEQ ID NO: 4251022 - DNA, 18 bp, Homo sapiens
tcattccagtgctagaaa

SEQ ID NO: 4251023 - DNA, 20 bp, Homo sapiens
tcattccagtgctagaaaat

SEQ ID NO: 4251024 - DNA, 14 bp, Homo sapiens
tcattctacagaat

SEQ ID NO: 4251025 - DNA, 17 bp, Homo sapiens
tcattctacagaataat

SEQ ID NO: 4251026 - DNA, 20 bp, Homo sapiens
tcattgaaagcttcaaagtt

SEQ ID NO: 4251027 - DNA, 12 bp, Homo sapiens
tcattgttttga

SEQ ID NO: 4251028 - DNA, 18 bp, Homo sapiens
tccaaaataaaacttttt

SEQ ID NO: 4251029 - DNA, 15 bp, Homo sapiens
tccaaacatgtattt

SEQ ID NO: 4251030 - DNA, 20 bp, Homo sapiens
tccaaacatgtatttatgta

SEQ ID NO: 4251031 - DNA, 14 bp, Homo sapiens
tccaaagtacactg

SEQ ID NO: 4251032 - DNA, 23 bp, Homo sapiens
tccaatatttctgctttctttga

SEQ ID NO: 4251033 - DNA, 18 bp, Homo sapiens
tccagccgtgtgtgcatg

SEQ ID NO: 4251034 - DNA, 21 bp, Homo sapiens
tccagccgtgtgtgcatgtgc

SEQ ID NO: 4251035 - DNA, 14 bp, Homo sapiens
tccaggagccccgc

SEQ ID NO: 4251036 - DNA, 15 bp, Homo sapiens
tccagtattgctgat

SEQ ID NO: 4251037 - DNA, 23 bp, Homo sapiens
tcccaaaacagcctttttgtaat

SEQ ID NO: 4251038 - DNA, 20 bp, Homo sapiens
tcccacacccacctctgcca

SEQ ID NO: 4251039 - DNA, 15 bp, Homo sapiens
tcccagagtgctggg

SEQ ID NO: 4251040 - DNA, 19 bp, Homo sapiens
tccccactgacagcctccc

SEQ ID NO: 4251041 - DNA, 15 bp, Homo sapiens
tcccctcctccctgg

SEQ ID NO: 4251042 - DNA, 14 bp, Homo sapiens
tcccctccttctcc

SEQ ID NO: 4251043 - DNA, 14 bp, Homo sapiens
tcccggggctccac

SEQ ID NO: 4251044 - DNA, 17 bp, Homo sapiens
tccctcccccagagccc

SEQ ID NO: 4251045 - DNA, 15 bp, Homo sapiens
tccctctctccacac

SEQ ID NO: 4251046 - DNA, 21 bp, Homo sapiens
tccctctctccacacggagct

SEQ ID NO: 4251047 - DNA, 19 bp, Homo sapiens
tccctggaggtctctccct

SEQ ID NO: 4251048 - DNA, 22 bp, Homo sapiens
tccctggatcacataccaggtc

SEQ ID NO: 4251049 - DNA, 22 bp, Homo sapiens
tccctggtgcccttccctggag

SEQ ID NO: 4251050 - DNA, 21 bp, Homo sapiens
tccctgtggcactcagggagc

SEQ ID NO: 4251051 - DNA, 18 bp, Homo sapiens
tccctgttggtcggtggg

SEQ ID NO: 4251052 - DNA, 19 bp, Homo sapiens
tccgcagggcgcccagcgc

SEQ ID NO: 4251053 - DNA, 14 bp, Homo sapiens
tccggagcgccctg

SEQ ID NO: 4251054 - DNA, 17 bp, Homo sapiens
tccggagcgccctgcag

SEQ ID NO: 4251055 - DNA, 18 bp, Homo sapiens
tccggagcgccctgcagg

SEQ ID NO: 4251056 - DNA, 15 bp, Homo sapiens
tccggagtagctggg

SEQ ID NO: 4251057 - DNA, 13 bp, Homo sapiens
tccgttaaaatac

SEQ ID NO: 4251058 - DNA, 14 bp, Homo sapiens
tcctactcctggag

SEQ ID NO: 4251059 - DNA, 15 bp, Homo sapiens
tcctactcctggagc

SEQ ID NO: 4251060 - DNA, 14 bp, Homo sapiens
tcctatttttgtaa

SEQ ID NO: 4251061 - DNA, 15 bp, Homo sapiens
tcctcctccatctca

SEQ ID NO: 4251062 - DNA, 11 bp, Homo sapiens
tcctcttcaga

SEQ ID NO: 4251063 - DNA, 19 bp, Homo sapiens
tcctcttcagaacttgtca

SEQ ID NO: 4251064 - DNA, 14 bp, Homo sapiens
tcctcttcccagag

SEQ ID NO: 4251065 - DNA, 17 bp, Homo sapiens
tcctgagctaaatgctt

SEQ ID NO: 4251066 - DNA, 16 bp, Homo sapiens
tcctgagtggccaggg

SEQ ID NO: 4251067 - DNA, 17 bp, Homo sapiens
tcctgagtggccaggga

SEQ ID NO: 4251068 - DNA, 16 bp, Homo sapiens
tcctgcctcagcctcc

SEQ ID NO: 4251069 - DNA, 17 bp, Homo sapiens
tcctgtccacacccagc

SEQ ID NO: 4251070 - DNA, 13 bp, Homo sapiens
tcctgtccccagg

SEQ ID NO: 4251071 - DNA, 15 bp, Homo sapiens
tccttcattcatagg

SEQ ID NO: 4251072 - DNA, 18 bp, Homo sapiens
tccttcggggaccagccc

SEQ ID NO: 4251073 - DNA, 12 bp, Homo sapiens
tccttctccctt

SEQ ID NO: 4251074 - DNA, 15 bp, Homo sapiens
tccttctgttgctgg

SEQ ID NO: 4251075 - DNA, 14 bp, Homo sapiens
tccttgcacctgag

SEQ ID NO: 4251076 - DNA, 17 bp, Homo sapiens
tcctttgtggttttatg

SEQ ID NO: 4251077 - DNA, 21 bp, Homo sapiens
tcgagcagtcctgcctcagcc

SEQ ID NO: 4251078 - DNA, 17 bp, Homo sapiens
tcgcagccccgggcgga

SEQ ID NO: 4251079 - DNA, 18 bp, Homo sapiens
tcggaaaacatgctacac

SEQ ID NO: 4251080 - DNA, 15 bp, Homo sapiens
tcggccgcccggcag

SEQ ID NO: 4251081 - DNA, 21 bp, Homo sapiens
tcgggactcagattggaatgt

SEQ ID NO: 4251082 - DNA, 23 bp, Homo sapiens
tcgttagaccgctctcttttctg

SEQ ID NO: 4251083 - DNA, 13 bp, Homo sapiens
tctaaaggctacc

SEQ ID NO: 4251084 - DNA, 22 bp, Homo sapiens
tctaacttcaccatattaccac

SEQ ID NO: 4251085 - DNA, 20 bp, Homo sapiens
tctaatatccccaaattagg

SEQ ID NO: 4251086 - DNA, 15 bp, Homo sapiens
tctaatttgaactgg

SEQ ID NO: 4251087 - DNA, 14 bp, Homo sapiens
tctacacagagcag

SEQ ID NO: 4251088 - DNA, 18 bp, Homo sapiens
tctacagaataatccagt

SEQ ID NO: 4251089 - DNA, 23 bp, Homo sapiens
tctaccagattctgcctatgtaa

SEQ ID NO: 4251090 - DNA, 20 bp, Homo sapiens
tctacctaatgtctcactgt

SEQ ID NO: 4251091 - DNA, 18 bp, Homo sapiens
tctagaacttgaccccct

SEQ ID NO: 4251092 - DNA, 18 bp, Homo sapiens
tctagaatgtaaagttat

SEQ ID NO: 4251093 - DNA, 13 bp, Homo sapiens
tctaggacttcaa

SEQ ID NO: 4251094 - DNA, 14 bp, Homo sapiens
tctaggacttcaaa

SEQ ID NO: 4251095 - DNA, 15 bp, Homo sapiens
tctatcaagtattat

SEQ ID NO: 4251096 - DNA, 15 bp, Homo sapiens
tctatccaaacatgt

SEQ ID NO: 4251097 - DNA, 22 bp, Homo sapiens
tctatccaaacatgtatttatg

SEQ ID NO: 4251098 - DNA, 16 bp, Homo sapiens
tctatgttaaatactg

SEQ ID NO: 4251099 - DNA, 18 bp, Homo sapiens
tctatgttaaatactgtg

SEQ ID NO: 4251100 - DNA, 22 bp, Homo sapiens
tctatgttaaatactgtgcaga

SEQ ID NO: 4251101 - DNA, 14 bp, Homo sapiens
tctcaaatttctaa

SEQ ID NO: 4251102 - DNA, 18 bp, Homo sapiens
tctcaaatttctaaatct

SEQ ID NO: 4251103 - DNA, 18 bp, Homo sapiens
tctcaagctagtgtttct

SEQ ID NO: 4251104 - DNA, 23 bp, Homo sapiens
tctcaagctagtgtttctagcta

SEQ ID NO: 4251105 - DNA, 18 bp, Homo sapiens
tctcaattgaaagctttt

SEQ ID NO: 4251106 - DNA, 14 bp, Homo sapiens
tctcacaggcagct

SEQ ID NO: 4251107 - DNA, 17 bp, Homo sapiens
tctcactatatatattt

SEQ ID NO: 4251108 - DNA, 20 bp, Homo sapiens
tctcactgtgggaaggccag

SEQ ID NO: 4251109 - DNA, 18 bp, Homo sapiens
tgtccagccgtgtgtgca

SEQ ID NO: 4251110 - DNA, 15 bp, Homo sapiens
tgtccatgcttctca

SEQ ID NO: 4251111 - DNA, 14 bp, Homo sapiens
tgtcccttttgcta

SEQ ID NO: 4251112 - DNA, 19 bp, Homo sapiens
tgtccgtgcttgctggtgc

SEQ ID NO: 4251113 - DNA, 17 bp, Homo sapiens
tgtctcactgttctgca

SEQ ID NO: 4251114 - DNA, 13 bp, Homo sapiens
tgtctcagcctcc

SEQ ID NO: 4251115 - DNA, 16 bp, Homo sapiens
tgtctgacttttgtta

SEQ ID NO: 4251116 - DNA, 22 bp, Homo sapiens
tgtctggcaggctactctgccc

SEQ ID NO: 4251117 - DNA, 15 bp, Homo sapiens
tgtgaagccagatct

SEQ ID NO: 4251118 - DNA, 15 bp, Homo sapiens
tgtgaatgcttctca

SEQ ID NO: 4251119 - DNA, 15 bp, Homo sapiens
tgtgactgaatttct

SEQ ID NO: 4251120 - DNA, 15 bp, Homo sapiens
tgtgagtgtgtgtgt

SEQ ID NO: 4251121 - DNA, 18 bp, Homo sapiens
tgtgcagaaaatatttaa

SEQ ID NO: 4251122 - DNA, 13 bp, Homo sapiens
tgtgcagaataat

SEQ ID NO: 4251123 - DNA, 17 bp, Homo sapiens
tgtgcagaataatggaa

SEQ ID NO: 4251124 - DNA, 22 bp, Homo sapiens
tgtgcagaataatggaaacatt

SEQ ID NO: 4251125 - DNA, 18 bp, Homo sapiens
tgtgcataatgataaaat

SEQ ID NO: 4251126 - DNA, 13 bp, Homo sapiens
tgtgcatgtgcag

SEQ ID NO: 4251127 - DNA, 15 bp, Homo sapiens
tgtgcatgtgccgag

SEQ ID NO: 4251128 - DNA, 21 bp, Homo sapiens
tgtgccctaaagtgtattttt

SEQ ID NO: 4251129 - DNA, 20 bp, Homo sapiens
tgtgcttctccccagaattc

SEQ ID NO: 4251130 - DNA, 21 bp, Homo sapiens
tgtggaaccaaagctggccca

SEQ ID NO: 4251131 - DNA, 20 bp, Homo sapiens
tgtggagaactcagtgccac

SEQ ID NO: 4251132 - DNA, 22 bp, Homo sapiens
tgtggaggagggagagccctgt

SEQ ID NO: 4251133 - DNA, 12 bp, Homo sapiens
tgtggccaggag

SEQ ID NO: 4251134 - DNA, 13 bp, Homo sapiens
tgtggccaggagc

SEQ ID NO: 4251135 - DNA, 15 bp, Homo sapiens
tgtggccaggagccc

SEQ ID NO: 4251136 - DNA, 16 bp, Homo sapiens
tgtggccaggagccct

SEQ ID NO: 4251137 - DNA, 20 bp, Homo sapiens
tgtggccaggagccctggcc

SEQ ID NO: 4251138 - DNA, 21 bp, Homo sapiens
tgtgggcatttcttgcgagcc

SEQ ID NO: 4251139 - DNA, 17 bp, Homo sapiens
tgtgtacaagttgttat

SEQ ID NO: 4251140 - DNA, 18 bp, Homo sapiens
tgtgtaccttaagatatt

SEQ ID NO: 4251141 - DNA, 16 bp, Homo sapiens
tgtgtatacagccctg

SEQ ID NO: 4251142 - DNA, 17 bp, Homo sapiens
tgtgtgcatgtgccgag

SEQ ID NO: 4251143 - DNA, 18 bp, Homo sapiens
tgtgtgcatgtgccgagg

SEQ ID NO: 4251144 - DNA, 14 bp, Homo sapiens
tgtgtgtgtgtgtc

SEQ ID NO: 4251145 - DNA, 23 bp, Homo sapiens
tgtgttatcacccagaagaaaat

SEQ ID NO: 4251146 - DNA, 13 bp, Homo sapiens
tgtgttctatcca

SEQ ID NO: 4251147 - DNA, 20 bp, Homo sapiens
tgtgttctatccaaacatgt

SEQ ID NO: 4251148 - DNA, 12 bp, Homo sapiens
tgttaaatactg

SEQ ID NO: 4251149 - DNA, 12 bp, Homo sapiens
tgttaaattcag

SEQ ID NO: 4251150 - DNA, 17 bp, Homo sapiens
tgttagtatgaggcatt

SEQ ID NO: 4251151 - DNA, 20 bp, Homo sapiens
tgttagtatgaggcatttgt

SEQ ID NO: 4251152 - DNA, 18 bp, Homo sapiens
tgttatgatattgtttaa

SEQ ID NO: 4251153 - DNA, 17 bp, Homo sapiens
tgttatgtatgaaggaa

SEQ ID NO: 4251154 - DNA, 15 bp, Homo sapiens
tgttattcaaatttg

SEQ ID NO: 4251155 - DNA, 23 bp, Homo sapiens
tgttattcctagtggatgactgt

SEQ ID NO: 4251156 - DNA, 21 bp, Homo sapiens
tgttcccactcagcagtgaga

SEQ ID NO: 4251157 - DNA, 18 bp, Homo sapiens
tgttctatccaaacatgt

SEQ ID NO: 4251158 - DNA, 17 bp, Homo sapiens
tgttctcctgaatattt

SEQ ID NO: 4251159 - DNA, 17 bp, Homo sapiens
tgttcttggtttgtaaa

SEQ ID NO: 4251160 - DNA, 19 bp, Homo sapiens
tgttcttggtttgtaaatt

SEQ ID NO: 4251161 - DNA, 20 bp, Homo sapiens
tgttctttccaaagtacact

SEQ ID NO: 4251162 - DNA, 11 bp, Homo sapiens
tgttgttgtgt

SEQ ID NO: 4251163 - DNA, 19 bp, Homo sapiens
tgtttaaaaagtaagttaa

SEQ ID NO: 4251164 - DNA, 17 bp, Homo sapiens
tgtttaaaattcagttt

SEQ ID NO: 4251165 - DNA, 14 bp, Homo sapiens
tgtttaaatcatgt

SEQ ID NO: 4251166 - DNA, 14 bp, Homo sapiens
tgtttaccattttt

SEQ ID NO: 4251167 - DNA, 16 bp, Homo sapiens
tgtttataatctgaag

SEQ ID NO: 4251168 - DNA, 18 bp, Homo sapiens
tgtttcctatttaataca

SEQ ID NO: 4251169 - DNA, 17 bp, Homo sapiens
tgtttctagctaaataa

SEQ ID NO: 4251170 - DNA, 18 bp, Homo sapiens
tgtttctagctaaataaa

SEQ ID NO: 4251171 - DNA, 14 bp, Homo sapiens
tgtttcttgtttat

SEQ ID NO: 4251172 - DNA, 12 bp, Homo sapiens
tgtttgatgcag

SEQ ID NO: 4251173 - DNA, 23 bp, Homo sapiens
tgtttgtccttgcacctgagcct

SEQ ID NO: 4251174 - DNA, 18 bp, Homo sapiens
tgttttaaggatgcttgt

SEQ ID NO: 4251175 - DNA, 23 bp, Homo sapiens
tgttttaaggatgcttgtacata

SEQ ID NO: 4251176 - DNA, 15 bp, Homo sapiens
tgttttgaatattac

SEQ ID NO: 4251177 - DNA, 12 bp, Homo sapiens
tgtttttctcca

SEQ ID NO: 4251178 - DNA, 14 bp, Homo sapiens
ttaaaaatctcaaa

SEQ ID NO: 4251179 - DNA, 16 bp, Homo sapiens
ttaaaaatctcaaatt

SEQ ID NO: 4251180 - DNA, 13 bp, Homo sapiens
ttaaaacaatttt

SEQ ID NO: 4251181 - DNA, 14 bp, Homo sapiens
ttaaaagatacagt

SEQ ID NO: 4251182 - DNA, 14 bp, Homo sapiens
ttaaaatatatgaa

SEQ ID NO: 4251183 - DNA, 12 bp, Homo sapiens
ttaaaattcagt

SEQ ID NO: 4251184 - DNA, 14 bp, Homo sapiens
ttaaacactacaca

SEQ ID NO: 4251185 - DNA, 23 bp, Homo sapiens
ttaaacagtagttgtattcttct

SEQ ID NO: 4251186 - DNA, 19 bp, Homo sapiens
ttaaacatacataatacaa

SEQ ID NO: 4251187 - DNA, 15 bp, Homo sapiens
ttaaactaaataatg

SEQ ID NO: 4251188 - DNA, 16 bp, Homo sapiens
ttaaacttaatctaaa

SEQ ID NO: 4251189 - DNA, 22 bp, Homo sapiens
ttaaacttaatctaaatggaac

SEQ ID NO: 4251190 - DNA, 15 bp, Homo sapiens
ttaaacttgtgaatg

SEQ ID NO: 4251191 - DNA, 21 bp, Homo sapiens
ttaaagaaaaaaaatttctag

SEQ ID NO: 4251192 - DNA, 17 bp, Homo sapiens
ttaaagatgctatggaa

SEQ ID NO: 4251193 - DNA, 15 bp, Homo sapiens
ttaaataatgtgaaa

SEQ ID NO: 4251194 - DNA, 16 bp, Homo sapiens
ttaaataatgtgaaac

SEQ ID NO: 4251195 - DNA, 16 bp, Homo sapiens
ttaaatactgtgcaga

SEQ ID NO: 4251196 - DNA, 21 bp, Homo sapiens
ttaaatactgtgcagaataat

SEQ ID NO: 4251197 - DNA, 12 bp, Homo sapiens
ttaaatcatgta

SEQ ID NO: 4251198 - DNA, 14 bp, Homo sapiens
ttaaattcagtaat

SEQ ID NO: 4251199 - DNA, 13 bp, Homo sapiens
ttaacaacatggc

SEQ ID NO: 4251200 - DNA, 12 bp, Homo sapiens
ttaacagaaatg

SEQ ID NO: 4251201 - DNA, 20 bp, Homo sapiens
ttaacagaaatgtacagcaa

SEQ ID NO: 4251202 - DNA, 15 bp, Homo sapiens
ttaaccttaaaatta

SEQ ID NO: 4251203 - DNA, 14 bp, Homo sapiens
ttaacttttataaa

SEQ ID NO: 4251204 - DNA, 22 bp, Homo sapiens
ttaagtagaaaagttgcagatg

SEQ ID NO: 4251205 - DNA, 14 bp, Homo sapiens
ttaagtcagatttt

SEQ ID NO: 4251206 - DNA, 17 bp, Homo sapiens
ttaagtcagatttttat

SEQ ID NO: 4251207 - DNA, 14 bp, Homo sapiens
ttaagtgggctcct

SEQ ID NO: 4251208 - DNA, 17 bp, Homo sapiens
ttaatatggtgtatttt

SEQ ID NO: 4251209 - DNA, 20 bp, Homo sapiens
ttaatattcttttgtttcca

SEQ ID NO: 4251210 - DNA, 15 bp, Homo sapiens
ttaatctaaatggaa

SEQ ID NO: 4251211 - DNA, 13 bp, Homo sapiens
ttaatctgtgtgt

SEQ ID NO: 4251212 - DNA, 20 bp, Homo sapiens
ttaatctgtgtgtatattga

SEQ ID NO: 4251213 - DNA, 12 bp, Homo sapiens
ttaatgttttta

SEQ ID NO: 4251214 - DNA, 17 bp, Homo sapiens
ttaattcacctatgtta

SEQ ID NO: 4251215 - DNA, 19 bp, Homo sapiens
ttaattcacctatgttatt

SEQ ID NO: 4251216 - DNA, 15 bp, Homo sapiens
ttaattcttagctca

SEQ ID NO: 4251217 - DNA, 22 bp, Homo sapiens
ttacaagatattattaattttt

SEQ ID NO: 4251218 - DNA, 17 bp, Homo sapiens
ttacaagtaatgtaaag

SEQ ID NO: 4251219 - DNA, 16 bp, Homo sapiens
ttacacgtgcgtgtga

SEQ ID NO: 4251220 - DNA, 11 bp, Homo sapiens
ttacagatttc

SEQ ID NO: 4251221 - DNA, 20 bp, Homo sapiens
ttacatttttaagtgctgca

SEQ ID NO: 4251222 - DNA, 17 bp, Homo sapiens
ttaccaagagtaacttt

SEQ ID NO: 4251223 - DNA, 17 bp, Homo sapiens
ttaccacagacatacta

SEQ ID NO: 4251224 - DNA, 15 bp, Homo sapiens
ttaccagacaaaaaa

SEQ ID NO: 4251225 - DNA, 12 bp, Homo sapiens
ttttaaatgcac

SEQ ID NO: 4251226 - DNA, 18 bp, Homo sapiens
ttttaagaaaaaataaaa

SEQ ID NO: 4251227 - DNA, 15 bp, Homo sapiens
ttttaagtgctgcat

SEQ ID NO: 4251228 - DNA, 16 bp, Homo sapiens
ttttaagtgctgcatt

SEQ ID NO: 4251229 - DNA, 21 bp, Homo sapiens
ttttaagtgctgcatttaaaa

SEQ ID NO: 4251230 - DNA, 22 bp, Homo sapiens
ttttaagtgggctcctgacaat

SEQ ID NO: 4251231 - DNA, 18 bp, Homo sapiens
ttttaatattcttttgtt

SEQ ID NO: 4251232 - DNA, 15 bp, Homo sapiens
ttttaccaagagtaa

SEQ ID NO: 4251233 - DNA, 17 bp, Homo sapiens
ttttagagttgatacta

SEQ ID NO: 4251234 - DNA, 23 bp, Homo sapiens
ttttagagttgatactacagttt

SEQ ID NO: 4251235 - DNA, 16 bp, Homo sapiens
ttttatacaagtaatt

SEQ ID NO: 4251236 - DNA, 21 bp, Homo sapiens
ttttatacataaacaagacca

SEQ ID NO: 4251237 - DNA, 13 bp, Homo sapiens
ttttatctgcaga

SEQ ID NO: 4251238 - DNA, 19 bp, Homo sapiens
ttttatggcttttgtgcat

SEQ ID NO: 4251239 - DNA, 22 bp, Homo sapiens
ttttatggtggaaaagaactgt

SEQ ID NO: 4251240 - DNA, 13 bp, Homo sapiens
ttttattaaagat

SEQ ID NO: 4251241 - DNA, 16 bp, Homo sapiens
ttttcaataaatcagc

SEQ ID NO: 4251242 - DNA, 20 bp, Homo sapiens
ttttcaccccacccttcccc

SEQ ID NO: 4251243 - DNA, 22 bp, Homo sapiens
ttttcatctttaagaatgctta

SEQ ID NO: 4251244 - DNA, 16 bp, Homo sapiens
ttttccttcattcata

SEQ ID NO: 4251245 - DNA, 11 bp, Homo sapiens
ttttctgtact

SEQ ID NO: 4251246 - DNA, 18 bp, Homo sapiens
ttttgaaaaaaaagtttt

SEQ ID NO: 4251247 - DNA, 20 bp, Homo sapiens
ttttgacaaggggcagtggt

SEQ ID NO: 4251248 - DNA, 20 bp, Homo sapiens
ttttgacagactatttgcta

SEQ ID NO: 4251249 - DNA, 19 bp, Homo sapiens
ttttggtataatgtttaaa

SEQ ID NO: 4251250 - DNA, 14 bp, Homo sapiens
ttttgtatcttggg

SEQ ID NO: 4251251 - DNA, 18 bp, Homo sapiens
ttttgtattttttaaaac

SEQ ID NO: 4251252 - DNA, 16 bp, Homo sapiens
tttttaaaacactaaa

SEQ ID NO: 4251253 - DNA, 23 bp, Homo sapiens
tttttaagaaaaaggatgcacag

SEQ ID NO: 4251254 - DNA, 22 bp, Homo sapiens
tttttaagtgctgcatttaaaa

SEQ ID NO: 4251255 - DNA, 22 bp, Homo sapiens
tttttaagtgggctcctgacaa

SEQ ID NO: 4251256 - DNA, 11 bp, Homo sapiens
tttttactaat

SEQ ID NO: 4251257 - DNA, 23 bp, Homo sapiens
tttttatacataaacaagaccac

SEQ ID NO: 4251258 - DNA, 22 bp, Homo sapiens
tttttatggcttttgtgcatta

SEQ ID NO: 4251259 - DNA, 23 bp, Homo sapiens
tttttatgggtgaaaataagaca

SEQ ID NO: 4251260 - DNA, 15 bp, Homo sapiens
tttttctccagtgct

SEQ ID NO: 4251261 - DNA, 19 bp, Homo sapiens
tttttggtataatgtttaa

SEQ ID NO: 4251262 - DNA, 14 bp, Homo sapiens
ttttttatgttcct

SEQ ID NO: 4251263 - DNA, 13 bp, Homo sapiens
ttttttgtatatt

SEQ ID NO: 4251264 - DNA, 13 bp, Homo sapiens
ttttttttgacaa

SEQ ID NO: 4251265 - DNA, 14 bp, Homo sapiens
agaaccccaggtga

SEQ ID NO: 4251266 - DNA, 14 bp, Homo sapiens
agaactcagtgcca

SEQ ID NO: 4251267 - DNA, 19 bp, Homo sapiens
agaactcagtgccacacct

SEQ ID NO: 4251268 - DNA, 16 bp, Homo sapiens
agaagaaaattctcct

SEQ ID NO: 4251269 - DNA, 16 bp, Homo sapiens
agaagagttgaggaac

SEQ ID NO: 4251270 - DNA, 13 bp, Homo sapiens
agaagtgcagccc

SEQ ID NO: 4251271 - DNA, 20 bp, Homo sapiens
agaataatccagtattgctg

SEQ ID NO: 4251272 - DNA, 14 bp, Homo sapiens
agaataatggaaac

SEQ ID NO: 4251273 - DNA, 15 bp, Homo sapiens
agaatatatatatat

SEQ ID NO: 4251274 - DNA, 17 bp, Homo sapiens
agaatgcacagatatac

SEQ ID NO: 4251275 - DNA, 13 bp, Homo sapiens
agaatggagacag

SEQ ID NO: 4251276 - DNA, 18 bp, Homo sapiens
agaattctctagtttgat

SEQ ID NO: 4251277 - DNA, 23 bp, Homo sapiens
agaattgctgaagggcattcttt

SEQ ID NO: 4251278 - DNA, 21 bp, Homo sapiens
agaattgttagcaaatgacag

SEQ ID NO: 4251279 - DNA, 14 bp, Homo sapiens
agacaaagatttct

SEQ ID NO: 4251280 - DNA, 14 bp, Homo sapiens
agacaataattcta

SEQ ID NO: 4251281 - DNA, 15 bp, Homo sapiens
agacaataattctac

SEQ ID NO: 4251282 - DNA, 14 bp, Homo sapiens
agacaatcattgtt

SEQ ID NO: 4251283 - DNA, 16 bp, Homo sapiens
agacaatcattgtttt

SEQ ID NO: 4251284 - DNA, 13 bp, Homo sapiens
agacaatgactta

SEQ ID NO: 4251285 - DNA, 21 bp, Homo sapiens
agacaatttattatggcacat

SEQ ID NO: 4251286 - DNA, 13 bp, Homo sapiens
agacagaaactgg

SEQ ID NO: 4251287 - DNA, 13 bp, Homo sapiens
agacatgcttggg

SEQ ID NO: 4251288 - DNA, 17 bp, Homo sapiens
agaccaagtccaagccc

SEQ ID NO: 4251289 - DNA, 15 bp, Homo sapiens
agaccacgtttctaa

SEQ ID NO: 4251290 - DNA, 17 bp, Homo sapiens
agaccgctctcttttct

SEQ ID NO: 4251291 - DNA, 15 bp, Homo sapiens
agacctctccttcct

SEQ ID NO: 4251292 - DNA, 12 bp, Homo sapiens
agactatttgct

SEQ ID NO: 4251293 - DNA, 15 bp, Homo sapiens
agactatttgctaat

SEQ ID NO: 4251294 - DNA, 18 bp, Homo sapiens
agactatttgctaatgta

SEQ ID NO: 4251295 - DNA, 19 bp, Homo sapiens
agactatttgctaatgtat

SEQ ID NO: 4251296 - DNA, 16 bp, Homo sapiens
agactctcagcccaga

SEQ ID NO: 4251297 - DNA, 23 bp, Homo sapiens
agactgagtacgttgtgcatttg

SEQ ID NO: 4251298 - DNA, 15 bp, Homo sapiens
agactgcaaactttt

SEQ ID NO: 4251299 - DNA, 18 bp, Homo sapiens
agacttgagacaatgttt

SEQ ID NO: 4251300 - DNA, 18 bp, Homo sapiens
agagaagttctcaaagtt

SEQ ID NO: 4251301 - DNA, 19 bp, Homo sapiens
agagaatgcacagatatac

SEQ ID NO: 4251302 - DNA, 14 bp, Homo sapiens
agagaatggagaca

SEQ ID NO: 4251303 - DNA, 13 bp, Homo sapiens
agagacaaagatt

SEQ ID NO: 4251304 - DNA, 19 bp, Homo sapiens
agagccttttatctgcaga

SEQ ID NO: 4251305 - DNA, 14 bp, Homo sapiens
agagcttgaagatt

SEQ ID NO: 4251306 - DNA, 13 bp, Homo sapiens
agagggacagagc

SEQ ID NO: 4251307 - DNA, 19 bp, Homo sapiens
agaggttcaaagatatttt

SEQ ID NO: 4251308 - DNA, 22 bp, Homo sapiens
agagtcacaagtagcctctggg

SEQ ID NO: 4251309 - DNA, 18 bp, Homo sapiens
agagtgcattgtgagggt

SEQ ID NO: 4251310 - DNA, 20 bp, Homo sapiens
agagttgatactacagtttg

SEQ ID NO: 4251311 - DNA, 19 bp, Homo sapiens
agagttgttacatttttaa

SEQ ID NO: 4251312 - DNA, 21 bp, Homo sapiens
agagttgttacatttttaagt

SEQ ID NO: 4251313 - DNA, 18 bp, Homo sapiens
agataatttacaagatat

SEQ ID NO: 4251314 - DNA, 19 bp, Homo sapiens
agataatttacaagatatt

SEQ ID NO: 4251315 - DNA, 20 bp, Homo sapiens
agataatttacaagatatta

SEQ ID NO: 4251316 - DNA, 15 bp, Homo sapiens
agatactgtatcatg

SEQ ID NO: 4251317 - DNA, 21 bp, Homo sapiens
agatattactacttaccattt

SEQ ID NO: 4251318 - DNA, 18 bp, Homo sapiens
agatattattaattttta

SEQ ID NO: 4251319 - DNA, 19 bp, Homo sapiens
agatattgaaggagaaaat

SEQ ID NO: 4251320 - DNA, 14 bp, Homo sapiens
agatctaaacagtt

SEQ ID NO: 4251321 - DNA, 20 bp, Homo sapiens
agatctaaacagttatttct

SEQ ID NO: 4251322 - DNA, 14 bp, Homo sapiens
agatctttgtaaat

SEQ ID NO: 4251323 - DNA, 17 bp, Homo sapiens
agatctttgtaaatgca

SEQ ID NO: 4251324 - DNA, 13 bp, Homo sapiens
agatgaaaactag

SEQ ID NO: 4251325 - DNA, 14 bp, Homo sapiens
agatgagtgagcat

SEQ ID NO: 4251326 - DNA, 17 bp, Homo sapiens
agatgcatgacttgtgt

SEQ ID NO: 4251327 - DNA, 18 bp, Homo sapiens
agatgcctgttttgagac

SEQ ID NO: 4251328 - DNA, 14 bp, Homo sapiens
agatggaaatacag

SEQ ID NO: 4251329 - DNA, 15 bp, Homo sapiens
agatggaaatacagt

SEQ ID NO: 4251330 - DNA, 18 bp, Homo sapiens
agatggtttcaattcaga

SEQ ID NO: 4251331 - DNA, 18 bp, Homo sapiens
agattctgcctatgtaaa

SEQ ID NO: 4251332 - DNA, 22 bp, Homo sapiens
agattgtcttgcaacttcagtt

SEQ ID NO: 4251333 - DNA, 17 bp, Homo sapiens
agatttccttaacctta

SEQ ID NO: 4251334 - DNA, 14 bp, Homo sapiens
agcaaggagattta

SEQ ID NO: 4251335 - DNA, 15 bp, Homo sapiens
agcacatctgcattt

SEQ ID NO: 4251336 - DNA, 13 bp, Homo sapiens
agcacgatttctg

SEQ ID NO: 4251337 - DNA, 14 bp, Homo sapiens
agcacgatttctgt

SEQ ID NO: 4251338 - DNA, 21 bp, Homo sapiens
agcacgatttctgtttagata

SEQ ID NO: 4251339 - DNA, 15 bp, Homo sapiens
agcactagagaatgc

SEQ ID NO: 4251340 - DNA, 17 bp, Homo sapiens
agcactagagaatgcac

SEQ ID NO: 4251341 - DNA, 13 bp, Homo sapiens
agcagaaatgcct

SEQ ID NO: 4251342 - DNA, 12 bp, Homo sapiens
agcagacagaaa

SEQ ID NO: 4251343 - DNA, 13 bp, Homo sapiens
agcagacagaaac

SEQ ID NO: 4251344 - DNA, 15 bp, Homo sapiens
agcagacagaaactg

SEQ ID NO: 4251345 - DNA, 18 bp, Homo sapiens
agcagacagaaactggat

SEQ ID NO: 4251346 - DNA, 18 bp, Homo sapiens
agcagcgtttctatgaca

SEQ ID NO: 4251347 - DNA, 19 bp, Homo sapiens
agcagtcctgcctcagcct

SEQ ID NO: 4251348 - DNA, 18 bp, Homo sapiens
agcataaataaaactgaa

SEQ ID NO: 4251349 - DNA, 18 bp, Homo sapiens
agcatacgtacacatttt

SEQ ID NO: 4251350 - DNA, 21 bp, Homo sapiens
agcatcagcacagctctcctc

SEQ ID NO: 4251351 - DNA, 18 bp, Homo sapiens
agcatctagtttccctgg

SEQ ID NO: 4251352 - DNA, 14 bp, Homo sapiens
agcatctctgcctc

SEQ ID NO: 4251353 - DNA, 15 bp, Homo sapiens
agccaaaccctgtct

SEQ ID NO: 4251354 - DNA, 17 bp, Homo sapiens
agccaccacgtccagct

SEQ ID NO: 4251355 - DNA, 22 bp, Homo sapiens
agccagatggactccagcctgc

SEQ ID NO: 4251356 - DNA, 13 bp, Homo sapiens
agccagtaaatgg

SEQ ID NO: 4251357 - DNA, 21 bp, Homo sapiens
agccagtaaatgggggtgcat

SEQ ID NO: 4251358 - DNA, 18 bp, Homo sapiens
agccatgggaaatgagcc

SEQ ID NO: 4251359 - DNA, 20 bp, Homo sapiens
agccatgggaaatgagccag

SEQ ID NO: 4251360 - DNA, 14 bp, Homo sapiens
agcccaaaatttga

SEQ ID NO: 4251361 - DNA, 21 bp, Homo sapiens
agccctctgtggccaggagcc

SEQ ID NO: 4251362 - DNA, 16 bp, Homo sapiens
agccgcgcggccgctt

SEQ ID NO: 4251363 - DNA, 15 bp, Homo sapiens
agccgtgtgtgcatg

SEQ ID NO: 4251364 - DNA, 21 bp, Homo sapiens
agccgtgtgtgcatgtgccga

SEQ ID NO: 4251365 - DNA, 23 bp, Homo sapiens
agccgtgtgtgcatgtgccgagg

SEQ ID NO: 4251366 - DNA, 16 bp, Homo sapiens
agctctcctcctccat

SEQ ID NO: 4251367 - DNA, 16 bp, Homo sapiens
agctgccccagccaga

SEQ ID NO: 4251368 - DNA, 17 bp, Homo sapiens
agctgctgggtggcagg

SEQ ID NO: 4251369 - DNA, 13 bp, Homo sapiens
agctgtttatgtt

SEQ ID NO: 4251370 - DNA, 13 bp, Homo sapiens
agcttcttcacag

SEQ ID NO: 4251371 - DNA, 21 bp, Homo sapiens
agctttcctgatgatgctggc

SEQ ID NO: 4251372 - DNA, 14 bp, Homo sapiens
agctttctgtgcat

SEQ ID NO: 4251373 - DNA, 17 bp, Homo sapiens
agctttctgtgcatgtg

SEQ ID NO: 4251374 - DNA, 16 bp, Homo sapiens
agcttttaaaatgtag

SEQ ID NO: 4251375 - DNA, 16 bp, Homo sapiens
aggaaatctcacccca

SEQ ID NO: 4251376 - DNA, 23 bp, Homo sapiens
aggaacttaaataatgtgaaact

SEQ ID NO: 4251377 - DNA, 18 bp, Homo sapiens
aggaatcattccagtgct

SEQ ID NO: 4251378 - DNA, 16 bp, Homo sapiens
aggacagtttttttgt

SEQ ID NO: 4251379 - DNA, 21 bp, Homo sapiens
aggacatagaggtatattgga

SEQ ID NO: 4251380 - DNA, 22 bp, Homo sapiens
aggacctccggagcgccctgca

SEQ ID NO: 4251381 - DNA, 21 bp, Homo sapiens
aggacggaaaatgcttaaaaa

SEQ ID NO: 4251382 - DNA, 11 bp, Homo sapiens
aggacttcaaa

SEQ ID NO: 4251383 - DNA, 18 bp, Homo sapiens
aggagaaacacattctta

SEQ ID NO: 4251384 - DNA, 22 bp, Homo sapiens
aggagctacccttttcctttgt

SEQ ID NO: 4251385 - DNA, 14 bp, Homo sapiens
aggatagtattttt

SEQ ID NO: 4251386 - DNA, 14 bp, Homo sapiens
aggcacttattgta

SEQ ID NO: 4251387 - DNA, 16 bp, Homo sapiens
aggcacttattgtaaa

SEQ ID NO: 4251388 - DNA, 18 bp, Homo sapiens
aggcacttattgtaaatt

SEQ ID NO: 4251389 - DNA, 16 bp, Homo sapiens
aggcagctctgagccg

SEQ ID NO: 4251390 - DNA, 10 bp, Homo sapiens
aggcatctgc

SEQ ID NO: 4251391 - DNA, 11 bp, Homo sapiens
aggcatctgca

SEQ ID NO: 4251392 - DNA, 17 bp, Homo sapiens
aggcatggctcagagct

SEQ ID NO: 4251393 - DNA, 18 bp, Homo sapiens
aggcatggctcagagctt

SEQ ID NO: 4251394 - DNA, 23 bp, Homo sapiens
aggcatggctcagagcttgaaga

SEQ ID NO: 4251395 - DNA, 13 bp, Homo sapiens
aggcctacctctc

SEQ ID NO: 4251396 - DNA, 13 bp, Homo sapiens
aggctacctttgt

SEQ ID NO: 4251397 - DNA, 14 bp, Homo sapiens
aggctacctttgta

SEQ ID NO: 4251398 - DNA, 13 bp, Homo sapiens
aggctactctgcc

SEQ ID NO: 4251399 - DNA, 15 bp, Homo sapiens
aggctactctgccca

SEQ ID NO: 4251400 - DNA, 14 bp, Homo sapiens
aggcttttgggcca

SEQ ID NO: 4251401 - DNA, 15 bp, Homo sapiens
agggaaaggttttgt

SEQ ID NO: 4251402 - DNA, 18 bp, Homo sapiens
agggaacagcctgagccg

SEQ ID NO: 4251403 - DNA, 22 bp, Homo sapiens
agggaaggatacaaaagcatgt

SEQ ID NO: 4251404 - DNA, 13 bp, Homo sapiens
agggacagagccc

SEQ ID NO: 4251405 - DNA, 14 bp, Homo sapiens
agggacagagcccg

SEQ ID NO: 4251406 - DNA, 13 bp, Homo sapiens
agggagagccctg

SEQ ID NO: 4251407 - DNA, 19 bp, Homo sapiens
agggaggaagaaggcagtg

SEQ ID NO: 4251408 - DNA, 14 bp, Homo sapiens
agggaggcatctgc

SEQ ID NO: 4251409 - DNA, 15 bp, Homo sapiens
agggaggcatctgca

SEQ ID NO: 4251410 - DNA, 14 bp, Homo sapiens
agggaggcggcctc

SEQ ID NO: 4251411 - DNA, 21 bp, Homo sapiens
agggcaaatccagtcccaatg

SEQ ID NO: 4251412 - DNA, 21 bp, Homo sapiens
agggcatcatcctcagcagca

SEQ ID NO: 4251413 - DNA, 17 bp, Homo sapiens
aggggcgcttgggaggg

SEQ ID NO: 4251414 - DNA, 21 bp, Homo sapiens
aggggcgggtgatgagacctg

SEQ ID NO: 4251415 - DNA, 18 bp, Homo sapiens
agggttgaaaatgtgttt

SEQ ID NO: 4251416 - DNA, 15 bp, Homo sapiens
aggtaaaatgtattt

SEQ ID NO: 4251417 - DNA, 12 bp, Homo sapiens
aggtaaagatat

SEQ ID NO: 4251418 - DNA, 19 bp, Homo sapiens
aggtagtttggatattttt

SEQ ID NO: 4251419 - DNA, 21 bp, Homo sapiens
aggtagtttggatatttttgt

SEQ ID NO: 4251420 - DNA, 22 bp, Homo sapiens
aggtagtttggatatttttgta

SEQ ID NO: 4251421 - DNA, 23 bp, Homo sapiens
aggtagtttggatatttttgtac

SEQ ID NO: 4251422 - DNA, 20 bp, Homo sapiens
aggtcattttttttaagaaa

SEQ ID NO: 4251423 - DNA, 15 bp, Homo sapiens
aggtctctccctccc

SEQ ID NO: 4251424 - DNA, 18 bp, Homo sapiens
aggtctgttctttccaaa

SEQ ID NO: 4251425 - DNA, 22 bp, Homo sapiens
aggtctgttctttccaaagtac

SEQ ID NO: 4251426 - DNA, 16 bp, Homo sapiens
aggtggcaatgcttaa

SEQ ID NO: 4251427 - DNA, 20 bp, Homo sapiens
aggtggcaatgcttaaacta

SEQ ID NO: 4251428 - DNA, 21 bp, Homo sapiens
aggtggcaatgcttaaactaa

SEQ ID NO: 4251429 - DNA, 15 bp, Homo sapiens
aggtggccgccatgc

SEQ ID NO: 4251430 - DNA, 20 bp, Homo sapiens
aggtgtgactgaatttcttt

SEQ ID NO: 4251431 - DNA, 17 bp, Homo sapiens
aggtttaaccttaaaat

SEQ ID NO: 4251432 - DNA, 15 bp, Homo sapiens
agtaaaatttatttc

SEQ ID NO: 4251433 - DNA, 16 bp, Homo sapiens
agtaaacataaaaact

SEQ ID NO: 4251434 - DNA, 20 bp, Homo sapiens
agtaaagccattaaatgaat

SEQ ID NO: 4251435 - DNA, 21 bp, Homo sapiens
agtaaagccattaaatgaata

SEQ ID NO: 4251436 - DNA, 14 bp, Homo sapiens
agtaatatgcacac

SEQ ID NO: 4251437 - DNA, 20 bp, Homo sapiens
agtaatgcagtttttaaaaa

SEQ ID NO: 4251438 - DNA, 13 bp, Homo sapiens
agtaatgtaaaga

SEQ ID NO: 4251439 - DNA, 15 bp, Homo sapiens
agtaattatgcacta

SEQ ID NO: 4251440 - DNA, 19 bp, Homo sapiens
agtaattatgcactaaata

SEQ ID NO: 4251441 - DNA, 21 bp, Homo sapiens
agtaattatgcactaaatatg

SEQ ID NO: 4251442 - DNA, 22 bp, Homo sapiens
agtaatttcatttaaatatctg

SEQ ID NO: 4251443 - DNA, 20 bp, Homo sapiens
agtacactgtttcaaacttt

SEQ ID NO: 4251444 - DNA, 23 bp, Homo sapiens
agtacactgtttcaaactttact

SEQ ID NO: 4251445 - DNA, 23 bp, Homo sapiens
agtacctctcaagctagtgtttc

SEQ ID NO: 4251446 - DNA, 17 bp, Homo sapiens
agtacgttgtgcatttg

SEQ ID NO: 4251447 - DNA, 14 bp, Homo sapiens
agtagatgcctgtt

SEQ ID NO: 4251448 - DNA, 16 bp, Homo sapiens
agtatgaggcatttgt

SEQ ID NO: 4251449 - DNA, 21 bp, Homo sapiens
agtatgaggcatttgtttgaa

SEQ ID NO: 4251450 - DNA, 12 bp, Homo sapiens
agtattgctgat

SEQ ID NO: 4251451 - DNA, 12 bp, Homo sapiens
agtcatttttgt

SEQ ID NO: 4251452 - DNA, 13 bp, Homo sapiens
agtcatttttgta

SEQ ID NO: 4251453 - DNA, 22 bp, Homo sapiens
agtccaactcttccacctctgg

SEQ ID NO: 4251454 - DNA, 14 bp, Homo sapiens
agtcgttttccaaa

SEQ ID NO: 4251455 - DNA, 16 bp, Homo sapiens
agtctctggggcaggc

SEQ ID NO: 4251456 - DNA, 21 bp, Homo sapiens
agtctctggggcaggctgctt

SEQ ID NO: 4251457 - DNA, 20 bp, Homo sapiens
agtgaatgtgtctggacctc

SEQ ID NO: 4251458 - DNA, 20 bp, Homo sapiens
agtgatgggagaattggtat

SEQ ID NO: 4251459 - DNA, 19 bp, Homo sapiens
agtgcctgctgggtgccag

SEQ ID NO: 4251460 - DNA, 21 bp, Homo sapiens
agtgcctgctgggtgccaggt

SEQ ID NO: 4251461 - DNA, 24 bp, Homo sapiens
agtgctagaaaatttagcccttta

SEQ ID NO: 4251462 - DNA, 13 bp, Homo sapiens
agtgctcctggcc

SEQ ID NO: 4251463 - DNA, 12 bp, Homo sapiens
agtgctgcattt

SEQ ID NO: 4251464 - DNA, 17 bp, Homo sapiens
agtgctgcatttaaaag

SEQ ID NO: 4251465 - DNA, 20 bp, Homo sapiens
agtgctgcatttaaaagata

SEQ ID NO: 4251466 - DNA, 16 bp, Homo sapiens
agtgggctcctgacaa

SEQ ID NO: 4251467 - DNA, 22 bp, Homo sapiens
agtggtctccttcacatcagaa

SEQ ID NO: 4251468 - DNA, 17 bp, Homo sapiens
agtggtggttttctgtt

SEQ ID NO: 4251469 - DNA, 20 bp, Homo sapiens
agtggtggttttctgttctt

SEQ ID NO: 4251470 - DNA, 21 bp, Homo sapiens
agtggtggttttctgttcttt

SEQ ID NO: 4251471 - DNA, 23 bp, Homo sapiens
agtggtggttttctgttctttct

SEQ ID NO: 4251472 - DNA, 23 bp, Homo sapiens
agtggtttttgctctagggccct

SEQ ID NO: 4251473 - DNA, 17 bp, Homo sapiens
agtgtatttttttacta

SEQ ID NO: 4251474 - DNA, 12 bp, Homo sapiens
agtgtgtctggg

SEQ ID NO: 4251475 - DNA, 14 bp, Homo sapiens
agtgtgtctgggat

SEQ ID NO: 4251476 - DNA, 22 bp, Homo sapiens
agtgtgtgtgtgtgtctgtagg

SEQ ID NO: 4251477 - DNA, 21 bp, Homo sapiens
agtgtttctagctaaataaat

SEQ ID NO: 4251478 - DNA, 21 bp, Homo sapiens
agttaataggagtatttttgg

SEQ ID NO: 4251479 - DNA, 16 bp, Homo sapiens
agttagatctttgtaa

SEQ ID NO: 4251480 - DNA, 22 bp, Homo sapiens
agttagatctttgtaaatgcat

SEQ ID NO: 4251481 - DNA, 20 bp, Homo sapiens
atttatataaaacttaaaaa

SEQ ID NO: 4251482 - DNA, 22 bp, Homo sapiens
atttatgtgaggtaattattgc

SEQ ID NO: 4251483 - DNA, 19 bp, Homo sapiens
atttcacttttgttctgct

SEQ ID NO: 4251484 - DNA, 14 bp, Homo sapiens
atttccacaccaag

SEQ ID NO: 4251485 - DNA, 22 bp, Homo sapiens
atttcctgagctaaatgcttca

SEQ ID NO: 4251486 - DNA, 22 bp, Homo sapiens
atttctcactatatatatttct

SEQ ID NO: 4251487 - DNA, 14 bp, Homo sapiens
atttctgtttagat

SEQ ID NO: 4251488 - DNA, 16 bp, Homo sapiens
atttctgtttagataa

SEQ ID NO: 4251489 - DNA, 22 bp, Homo sapiens
atttctgtttcctatttaatac

SEQ ID NO: 4251490 - DNA, 17 bp, Homo sapiens
atttgaagtaacttatt

SEQ ID NO: 4251491 - DNA, 22 bp, Homo sapiens
atttgaagtaacttatttgact

SEQ ID NO: 4251492 - DNA, 13 bp, Homo sapiens
atttgactatgaa

SEQ ID NO: 4251493 - DNA, 22 bp, Homo sapiens
atttgaggtctgttctttccaa

SEQ ID NO: 4251494 - DNA, 20 bp, Homo sapiens
atttgattcgccctcctccc

SEQ ID NO: 4251495 - DNA, 15 bp, Homo sapiens
atttgctactgtaca

SEQ ID NO: 4251496 - DNA, 17 bp, Homo sapiens
atttggtggtttcagaa

SEQ ID NO: 4251497 - DNA, 15 bp, Homo sapiens
atttgtgatacaatg

SEQ ID NO: 4251498 - DNA, 20 bp, Homo sapiens
atttgtgatacaatgctgtg

SEQ ID NO: 4251499 - DNA, 22 bp, Homo sapiens
atttgtgctttttaagaatatt

SEQ ID NO: 4251500 - DNA, 16 bp, Homo sapiens
atttgtttattttttg

SEQ ID NO: 4251501 - DNA, 20 bp, Homo sapiens
atttgtttgaactgataaag

SEQ ID NO: 4251502 - DNA, 22 bp, Homo sapiens
atttgtttgaactgataaagat

SEQ ID NO: 4251503 - DNA, 16 bp, Homo sapiens
attttaaaatatatga

SEQ ID NO: 4251504 - DNA, 15 bp, Homo sapiens
attttaagaagacat

SEQ ID NO: 4251505 - DNA, 18 bp, Homo sapiens
attttaagaagacatact

SEQ ID NO: 4251506 - DNA, 15 bp, Homo sapiens
attttacagatttct

SEQ ID NO: 4251507 - DNA, 13 bp, Homo sapiens
attttattaataa

SEQ ID NO: 4251508 - DNA, 15 bp, Homo sapiens
attttattaataata

SEQ ID NO: 4251509 - DNA, 18 bp, Homo sapiens
attttattttattatgca

SEQ ID NO: 4251510 - DNA, 14 bp, Homo sapiens
attttcatttcatg

SEQ ID NO: 4251511 - DNA, 18 bp, Homo sapiens
attttgaggtaaagatat

SEQ ID NO: 4251512 - DNA, 16 bp, Homo sapiens
attttgataataatat

SEQ ID NO: 4251513 - DNA, 21 bp, Homo sapiens
attttgataataatattgttt

SEQ ID NO: 4251514 - DNA, 18 bp, Homo sapiens
attttgcactctgtaatt

SEQ ID NO: 4251515 - DNA, 19 bp, Homo sapiens
attttgggttttgggtctt

SEQ ID NO: 4251516 - DNA, 23 bp, Homo sapiens
attttgtgtacaagttgttattg

SEQ ID NO: 4251517 - DNA, 13 bp, Homo sapiens
atttttaagtgct

SEQ ID NO: 4251518 - DNA, 16 bp, Homo sapiens
atttttaagtgctgca

SEQ ID NO: 4251519 - DNA, 19 bp, Homo sapiens
atttttaagtgctgcattt

SEQ ID NO: 4251520 - DNA, 23 bp, Homo sapiens
atttttatacaagtaatttcctg

SEQ ID NO: 4251521 - DNA, 21 bp, Homo sapiens
atttttcttagggaaggatac

SEQ ID NO: 4251522 - DNA, 20 bp, Homo sapiens
atttttgctccaatatccat

SEQ ID NO: 4251523 - DNA, 19 bp, Homo sapiens
atttttgtaaactggaatt

SEQ ID NO: 4251524 - DNA, 12 bp, Homo sapiens
atttttgtattt

SEQ ID NO: 4251525 - DNA, 13 bp, Homo sapiens
atttttgtatttt

SEQ ID NO: 4251526 - DNA, 21 bp, Homo sapiens
caaaaaagacttgagacaatg

SEQ ID NO: 4251527 - DNA, 19 bp, Homo sapiens
caaaaacaagtaaatatat

SEQ ID NO: 4251528 - DNA, 14 bp, Homo sapiens
caaaagatttattg

SEQ ID NO: 4251529 - DNA, 13 bp, Homo sapiens
caaaagcatgtga

SEQ ID NO: 4251530 - DNA, 14 bp, Homo sapiens
caaaataaaacttt

SEQ ID NO: 4251531 - DNA, 12 bp, Homo sapiens
caaaatacaatc

SEQ ID NO: 4251532 - DNA, 16 bp, Homo sapiens
caaaatacaatcctgt

SEQ ID NO: 4251533 - DNA, 15 bp, Homo sapiens
caaaatattttttgc

SEQ ID NO: 4251534 - DNA, 12 bp, Homo sapiens
caaacagtattt

SEQ ID NO: 4251535 - DNA, 15 bp, Homo sapiens
caaacatgtatttat

SEQ ID NO: 4251536 - DNA, 19 bp, Homo sapiens
caaacttttttatatcttt

SEQ ID NO: 4251537 - DNA, 15 bp, Homo sapiens
caaagagaccagggg

SEQ ID NO: 4251538 - DNA, 16 bp, Homo sapiens
caaagatattttgctt

SEQ ID NO: 4251539 - DNA, 22 bp, Homo sapiens
caaagatattttgctttgtgat

SEQ ID NO: 4251540 - DNA, 16 bp, Homo sapiens
caaagtacactgtttc

SEQ ID NO: 4251541 - DNA, 15 bp, Homo sapiens
caaatataagacatt

SEQ ID NO: 4251542 - DNA, 21 bp, Homo sapiens
caaatataggtcctgtgttaa

SEQ ID NO: 4251543 - DNA, 17 bp, Homo sapiens
caaatcaacttttatgc

SEQ ID NO: 4251544 - DNA, 15 bp, Homo sapiens
caaatcactgcattc

SEQ ID NO: 4251545 - DNA, 17 bp, Homo sapiens
caaatcagtgataattg

SEQ ID NO: 4251546 - DNA, 16 bp, Homo sapiens
caaatcgatttagtaa

SEQ ID NO: 4251547 - DNA, 22 bp, Homo sapiens
caaatcgatttagtaagtatgt

SEQ ID NO: 4251548 - DNA, 15 bp, Homo sapiens
caaattagggcaatt

SEQ ID NO: 4251549 - DNA, 22 bp, Homo sapiens
caaattgtgcttctccccagaa

SEQ ID NO: 4251550 - DNA, 12 bp, Homo sapiens
caaatttctaaa

SEQ ID NO: 4251551 - DNA, 22 bp, Homo sapiens
caaatttctaaatctccaaaat

SEQ ID NO: 4251552 - DNA, 17 bp, Homo sapiens
caacaaaaaatacatta

SEQ ID NO: 4251553 - DNA, 17 bp, Homo sapiens
caactcttccacctctg

SEQ ID NO: 4251554 - DNA, 18 bp, Homo sapiens
caagaccacgtttctaaa

SEQ ID NO: 4251555 - DNA, 20 bp, Homo sapiens
caagagaaaagaaaaatcaa

SEQ ID NO: 4251556 - DNA, 12 bp, Homo sapiens
caagagggacag

SEQ ID NO: 4251557 - DNA, 13 bp, Homo sapiens
caagagggacaga

SEQ ID NO: 4251558 - DNA, 16 bp, Homo sapiens
caagagggacagagcc

SEQ ID NO: 4251559 - DNA, 18 bp, Homo sapiens
caagagggacagagcccg

SEQ ID NO: 4251560 - DNA, 15 bp, Homo sapiens
caagcaacatttgta

SEQ ID NO: 4251561 - DNA, 22 bp, Homo sapiens
caagcaacatttgtatggattt

SEQ ID NO: 4251562 - DNA, 17 bp, Homo sapiens
caagcacatctgcattt

SEQ ID NO: 4251563 - DNA, 20 bp, Homo sapiens
caagcacatctgcattttca

SEQ ID NO: 4251564 - DNA, 20 bp, Homo sapiens
caagcactatgcccttttat

SEQ ID NO: 4251565 - DNA, 21 bp, Homo sapiens
caagcaggagtgtgcggtcaa

SEQ ID NO: 4251566 - DNA, 22 bp, Homo sapiens
caaggaagttttaactttaata

SEQ ID NO: 4251567 - DNA, 16 bp, Homo sapiens
caaggagatttacaac

SEQ ID NO: 4251568 - DNA, 14 bp, Homo sapiens
caaggtggcccgga

SEQ ID NO: 4251569 - DNA, 13 bp, Homo sapiens
caagtaaatatat

SEQ ID NO: 4251570 - DNA, 15 bp, Homo sapiens
caagtagcctctggg

SEQ ID NO: 4251571 - DNA, 17 bp, Homo sapiens
caagtattatacctttt

SEQ ID NO: 4251572 - DNA, 22 bp, Homo sapiens
caagtattataccttttttaga

SEQ ID NO: 4251573 - DNA, 16 bp, Homo sapiens
caagtcatttttgtat

SEQ ID NO: 4251574 - DNA, 14 bp, Homo sapiens
caagtccaagcccg

SEQ ID NO: 4251575 - DNA, 18 bp, Homo sapiens
caagtctctgctggccca

SEQ ID NO: 4251576 - DNA, 16 bp, Homo sapiens
caagttgttattgttg

SEQ ID NO: 4251577 - DNA, 17 bp, Homo sapiens
caagttgttattgttga

SEQ ID NO: 4251578 - DNA, 18 bp, Homo sapiens
caagttgttattgttgaa

SEQ ID NO: 4251579 - DNA, 19 bp, Homo sapiens
caataaagcagcgtttcta

SEQ ID NO: 4251580 - DNA, 22 bp, Homo sapiens
caataacactgtattttaatgt

SEQ ID NO: 4251581 - DNA, 20 bp, Homo sapiens
caatactgtatcagatgtga

SEQ ID NO: 4251582 - DNA, 12 bp, Homo sapiens
caatatgtatgc

SEQ ID NO: 4251583 - DNA, 15 bp, Homo sapiens
caatatgtatgcttt

SEQ ID NO: 4251584 - DNA, 21 bp, Homo sapiens
caatatgtatgctttttacct

SEQ ID NO: 4251585 - DNA, 22 bp, Homo sapiens
caatatttctgctttctttgat

SEQ ID NO: 4251586 - DNA, 12 bp, Homo sapiens
caatcattgttt

SEQ ID NO: 4251587 - DNA, 15 bp, Homo sapiens
caatcctgtttataa

SEQ ID NO: 4251588 - DNA, 19 bp, Homo sapiens
caatctctgttgcacctga

SEQ ID NO: 4251589 - DNA, 22 bp, Homo sapiens
caatcttggtttgtcagtttat

SEQ ID NO: 4251590 - DNA, 20 bp, Homo sapiens
caatgaaaagtcgttttcca

SEQ ID NO: 4251591 - DNA, 15 bp, Homo sapiens
caggcagctctgagc

SEQ ID NO: 4251592 - DNA, 17 bp, Homo sapiens
caggcatggctcagagc

SEQ ID NO: 4251593 - DNA, 18 bp, Homo sapiens
caggcctcttggcagtca

SEQ ID NO: 4251594 - DNA, 16 bp, Homo sapiens
caggctactctgccca

SEQ ID NO: 4251595 - DNA, 17 bp, Homo sapiens
caggctactctgcccac

SEQ ID NO: 4251596 - DNA, 19 bp, Homo sapiens
cagggaaggaatcctggtg

SEQ ID NO: 4251597 - DNA, 16 bp, Homo sapiens
cagggaccgggcgcag

SEQ ID NO: 4251598 - DNA, 21 bp, Homo sapiens
cagggccgggcagggggacag

SEQ ID NO: 4251599 - DNA, 20 bp, Homo sapiens
caggggcgggtgatgagacc

SEQ ID NO: 4251600 - DNA, 16 bp, Homo sapiens
cagggggacagcaggg

SEQ ID NO: 4251601 - DNA, 13 bp, Homo sapiens
caggggggctgtg

SEQ ID NO: 4251602 - DNA, 18 bp, Homo sapiens
atggcctcttcagatctc

SEQ ID NO: 4251603 - DNA, 19 bp, Homo sapiens
atggctcagagcttgaaga

SEQ ID NO: 4251604 - DNA, 22 bp, Homo sapiens
atggcttcttctagaatgtaaa

SEQ ID NO: 4251605 - DNA, 16 bp, Homo sapiens
atggcttttgtgcatt

SEQ ID NO: 4251606 - DNA, 18 bp, Homo sapiens
atggcttttgtgcattat

SEQ ID NO: 4251607 - DNA, 23 bp, Homo sapiens
atggtatcatatattaaaacaat

SEQ ID NO: 4251608 - DNA, 14 bp, Homo sapiens
atggtctcaatctc

SEQ ID NO: 4251609 - DNA, 12 bp, Homo sapiens
atggtgtatttt

SEQ ID NO: 4251610 - DNA, 13 bp, Homo sapiens
atgtaaaaaagaa

SEQ ID NO: 4251611 - DNA, 14 bp, Homo sapiens
atgtaaaatgaatt

SEQ ID NO: 4251612 - DNA, 22 bp, Homo sapiens
atgtaagaacacattttaaata

SEQ ID NO: 4251613 - DNA, 14 bp, Homo sapiens
atgtaatataatgt

SEQ ID NO: 4251614 - DNA, 17 bp, Homo sapiens
atgtaatgaagtaaagc

SEQ ID NO: 4251615 - DNA, 22 bp, Homo sapiens
atgtaatgaagtaaagccatta

SEQ ID NO: 4251616 - DNA, 20 bp, Homo sapiens
atgtacttgaaaaatgtttt

SEQ ID NO: 4251617 - DNA, 14 bp, Homo sapiens
atgtagaaacttaa

SEQ ID NO: 4251618 - DNA, 19 bp, Homo sapiens
atgtagccttagagcatct

SEQ ID NO: 4251619 - DNA, 19 bp, Homo sapiens
atgtccatttatatcattt

SEQ ID NO: 4251620 - DNA, 14 bp, Homo sapiens
atgtctcactgttc

SEQ ID NO: 4251621 - DNA, 16 bp, Homo sapiens
atgtctcactgttctg

SEQ ID NO: 4251622 - DNA, 18 bp, Homo sapiens
atgtctcactgttctgca

SEQ ID NO: 4251623 - DNA, 20 bp, Homo sapiens
atgtctcactgttctgcaaa

SEQ ID NO: 4251624 - DNA, 20 bp, Homo sapiens
atgtgaataggttatatgca

SEQ ID NO: 4251625 - DNA, 16 bp, Homo sapiens
atgtgactttttttgg

SEQ ID NO: 4251626 - DNA, 20 bp, Homo sapiens
atgtgcagaaaatatttaat

SEQ ID NO: 4251627 - DNA, 22 bp, Homo sapiens
atgtgcagaaaatatttaatat

SEQ ID NO: 4251628 - DNA, 22 bp, Homo sapiens
atgtgtatccatgcattatata

SEQ ID NO: 4251629 - DNA, 13 bp, Homo sapiens
atgtgtttttctc

SEQ ID NO: 4251630 - DNA, 17 bp, Homo sapiens
atgtgtttttctccagt

SEQ ID NO: 4251631 - DNA, 16 bp, Homo sapiens
atgttcctcaaatcag

SEQ ID NO: 4251632 - DNA, 20 bp, Homo sapiens
atgttgttgaggctgtcaca

SEQ ID NO: 4251633 - DNA, 14 bp, Homo sapiens
atgttttcttcaac

SEQ ID NO: 4251634 - DNA, 20 bp, Homo sapiens
attaaaaatctcaaatttct

SEQ ID NO: 4251635 - DNA, 22 bp, Homo sapiens
attaaaaatctcaaatttctaa

SEQ ID NO: 4251636 - DNA, 16 bp, Homo sapiens
attaaacttaatctaa

SEQ ID NO: 4251637 - DNA, 13 bp, Homo sapiens
attaaatgaatat

SEQ ID NO: 4251638 - DNA, 18 bp, Homo sapiens
attaaatgaatattttga

SEQ ID NO: 4251639 - DNA, 20 bp, Homo sapiens
attaaattcttgcaaagtat

SEQ ID NO: 4251640 - DNA, 17 bp, Homo sapiens
attaacttttataaact

SEQ ID NO: 4251641 - DNA, 20 bp, Homo sapiens
attaacttttataaacttta

SEQ ID NO: 4251642 - DNA, 13 bp, Homo sapiens
attaataatattt

SEQ ID NO: 4251643 - DNA, 16 bp, Homo sapiens
attaataatatttatg

SEQ ID NO: 4251644 - DNA, 17 bp, Homo sapiens
attaataatatttatgt

SEQ ID NO: 4251645 - DNA, 19 bp, Homo sapiens
attaatattcccattttat

SEQ ID NO: 4251646 - DNA, 12 bp, Homo sapiens
attaattcttca

SEQ ID NO: 4251647 - DNA, 17 bp, Homo sapiens
attaattcttcacctgt

SEQ ID NO: 4251648 - DNA, 17 bp, Homo sapiens
attaatttttatttatt

SEQ ID NO: 4251649 - DNA, 22 bp, Homo sapiens
attaatttttatttatttttct

SEQ ID NO: 4251650 - DNA, 14 bp, Homo sapiens
attacaacatttat

SEQ ID NO: 4251651 - DNA, 17 bp, Homo sapiens
attacaagtaatgtaaa

SEQ ID NO: 4251652 - DNA, 20 bp, Homo sapiens
attactcctatttttgtaaa

SEQ ID NO: 4251653 - DNA, 13 bp, Homo sapiens
attaggaaaataa

SEQ ID NO: 4251654 - DNA, 14 bp, Homo sapiens
attaggaaaataaa

SEQ ID NO: 4251655 - DNA, 15 bp, Homo sapiens
attataacaactatt

SEQ ID NO: 4251656 - DNA, 13 bp, Homo sapiens
attatattaaaca

SEQ ID NO: 4251657 - DNA, 14 bp, Homo sapiens
attatctagatact

SEQ ID NO: 4251658 - DNA, 20 bp, Homo sapiens
attattattttaaaatatat

SEQ ID NO: 4251659 - DNA, 15 bp, Homo sapiens
attattgatatatat

SEQ ID NO: 4251660 - DNA, 14 bp, Homo sapiens
attcaaatttgatg

SEQ ID NO: 4251661 - DNA, 15 bp, Homo sapiens
attcagattgtcttg

SEQ ID NO: 4251662 - DNA, 22 bp, Homo sapiens
attcagtaatgcagtttttaaa

SEQ ID NO: 4251663 - DNA, 15 bp, Homo sapiens
attcagtttttgtat

SEQ ID NO: 4251664 - DNA, 18 bp, Homo sapiens
attcagtttttgtatctt

SEQ ID NO: 4251665 - DNA, 21 bp, Homo sapiens
attcatagggaaaggttttgt

SEQ ID NO: 4251666 - DNA, 22 bp, Homo sapiens
attcatagggaaaggttttgta

SEQ ID NO: 4251667 - DNA, 21 bp, Homo sapiens
attcatatacaaacatgtatg

SEQ ID NO: 4251668 - DNA, 20 bp, Homo sapiens
attccagtgctagaaaattt

SEQ ID NO: 4251669 - DNA, 13 bp, Homo sapiens
attcccttccttc

SEQ ID NO: 4251670 - DNA, 19 bp, Homo sapiens
attcctagtggatgactgt

SEQ ID NO: 4251671 - DNA, 19 bp, Homo sapiens
attctaagccctttgccat

SEQ ID NO: 4251672 - DNA, 23 bp, Homo sapiens
attctagtgtctgacttttgtta

SEQ ID NO: 4251673 - DNA, 18 bp, Homo sapiens
attctccttgtgttacta

SEQ ID NO: 4251674 - DNA, 17 bp, Homo sapiens
attctctagtttgatta

SEQ ID NO: 4251675 - DNA, 18 bp, Homo sapiens
attctctagtttgattaa

SEQ ID NO: 4251676 - DNA, 20 bp, Homo sapiens
attctctagtttgattaaat

SEQ ID NO: 4251677 - DNA, 16 bp, Homo sapiens
attctgcctatgtaaa

SEQ ID NO: 4251678 - DNA, 13 bp, Homo sapiens
attctgttatatg

SEQ ID NO: 4251679 - DNA, 14 bp, Homo sapiens
attcttattaattc

SEQ ID NO: 4251680 - DNA, 16 bp, Homo sapiens
attcttctgtatttct

SEQ ID NO: 4251681 - DNA, 18 bp, Homo sapiens
attcttctgtatttctag

SEQ ID NO: 4251682 - DNA, 19 bp, Homo sapiens
attcttctgtatttctagg

SEQ ID NO: 4251683 - DNA, 20 bp, Homo sapiens
attctttcccagtgagtctc

SEQ ID NO: 4251684 - DNA, 16 bp, Homo sapiens
attcttttgtttccat

SEQ ID NO: 4251685 - DNA, 13 bp, Homo sapiens
attgaaaaacaat

SEQ ID NO: 4251686 - DNA, 15 bp, Homo sapiens
attgaaaaacaattt

SEQ ID NO: 4251687 - DNA, 22 bp, Homo sapiens
attgaaaaacaattttctgtaa

SEQ ID NO: 4251688 - DNA, 19 bp, Homo sapiens
attgaaagcttttaaaatg

SEQ ID NO: 4251689 - DNA, 20 bp, Homo sapiens
attgaaagcttttaaaatgt

SEQ ID NO: 4251690 - DNA, 19 bp, Homo sapiens
attgaaataaataaaaatg

SEQ ID NO: 4251691 - DNA, 22 bp, Homo sapiens
attgaaataaataaaaatgcat

SEQ ID NO: 4251692 - DNA, 14 bp, Homo sapiens
attgagtttgtagg

SEQ ID NO: 4251693 - DNA, 20 bp, Homo sapiens
attgcactttttaagtttga

SEQ ID NO: 4251694 - DNA, 21 bp, Homo sapiens
attgctgaagggcattctttc

SEQ ID NO: 4251695 - DNA, 16 bp, Homo sapiens
attgctgattttaaag

SEQ ID NO: 4251696 - DNA, 15 bp, Homo sapiens
attgcttagtaaaat

SEQ ID NO: 4251697 - DNA, 23 bp, Homo sapiens
attggaaatggatgcaaagtaca

SEQ ID NO: 4251698 - DNA, 13 bp, Homo sapiens
attgtaatctttc

SEQ ID NO: 4251699 - DNA, 15 bp, Homo sapiens
attgtaatctttcat

SEQ ID NO: 4251700 - DNA, 14 bp, Homo sapiens
attgtgcttctccc

SEQ ID NO: 4251701 - DNA, 19 bp, Homo sapiens
attgtgcttctccccagaa

SEQ ID NO: 4251702 - DNA, 18 bp, Homo sapiens
attgttgaacatacttca

SEQ ID NO: 4251703 - DNA, 20 bp, Homo sapiens
attgtttacgtttgatacaa

SEQ ID NO: 4251704 - DNA, 14 bp, Homo sapiens
attgttttgaatat

SEQ ID NO: 4251705 - DNA, 15 bp, Homo sapiens
attgtttttctttct

SEQ ID NO: 4251706 - DNA, 14 bp, Homo sapiens
atttaaaagataca

SEQ ID NO: 4251707 - DNA, 16 bp, Homo sapiens
atttaaaagatacagt

SEQ ID NO: 4251708 - DNA, 17 bp, Homo sapiens
atttaaaagatacagtt

SEQ ID NO: 4251709 - DNA, 10 bp, Homo sapiens
atttaaaatt

SEQ ID NO: 4251710 - DNA, 16 bp, Homo sapiens
atttaaaattacgttt

SEQ ID NO: 4251711 - DNA, 14 bp, Homo sapiens
atttaacagaaatg

SEQ ID NO: 4251712 - DNA, 15 bp, Homo sapiens
atttaacagaaatgt

SEQ ID NO: 4251713 - DNA, 16 bp, Homo sapiens
atttaacagaaatgta

SEQ ID NO: 4251714 - DNA, 15 bp, Homo sapiens
atttacaaaagattt

SEQ ID NO: 4251715 - DNA, 17 bp, Homo sapiens
atttacaagatattatt

SEQ ID NO: 4251716 - DNA, 20 bp, Homo sapiens
atttacaagatattattaat

SEQ ID NO: 4251717 - DNA, 19 bp, Homo sapiens
cctaatgtctcactgttct

SEQ ID NO: 4251718 - DNA, 14 bp, Homo sapiens
cctactcctggagc

SEQ ID NO: 4251719 - DNA, 14 bp, Homo sapiens
cctcaaatcactgc

SEQ ID NO: 4251720 - DNA, 12 bp, Homo sapiens
cctcagcctccg

SEQ ID NO: 4251721 - DNA, 15 bp, Homo sapiens
cctcatgccacagtg

SEQ ID NO: 4251722 - DNA, 19 bp, Homo sapiens
cctcatgttcttaattctt

SEQ ID NO: 4251723 - DNA, 15 bp, Homo sapiens
cctccaacccagcag

SEQ ID NO: 4251724 - DNA, 17 bp, Homo sapiens
cctccacaaagagacca

SEQ ID NO: 4251725 - DNA, 23 bp, Homo sapiens
cctccatgcactttatgtggaga

SEQ ID NO: 4251726 - DNA, 14 bp, Homo sapiens
cctcccccagagcc

SEQ ID NO: 4251727 - DNA, 16 bp, Homo sapiens
cctcccccagagcccc

SEQ ID NO: 4251728 - DNA, 23 bp, Homo sapiens
cctccccggctcgagcagtcctg

SEQ ID NO: 4251729 - DNA, 14 bp, Homo sapiens
cctcccctgccatt

SEQ ID NO: 4251730 - DNA, 13 bp, Homo sapiens
cctccctgggatg

SEQ ID NO: 4251731 - DNA, 14 bp, Homo sapiens
cctccgaggccagt

SEQ ID NO: 4251732 - DNA, 15 bp, Homo sapiens
cctccttctcccttt

SEQ ID NO: 4251733 - DNA, 17 bp, Homo sapiens
cctctcgtttctgccca

SEQ ID NO: 4251734 - DNA, 14 bp, Homo sapiens
cctctgcagcaata

SEQ ID NO: 4251735 - DNA, 19 bp, Homo sapiens
cctctgcagcaataaagca

SEQ ID NO: 4251736 - DNA, 17 bp, Homo sapiens
gcagctcccgcagggct

SEQ ID NO: 4251737 - DNA, 14 bp, Homo sapiens
gcagctctgagccg

SEQ ID NO: 4251738 - DNA, 19 bp, Homo sapiens
gcaggactgcacagcgtcc

SEQ ID NO: 4251739 - DNA, 16 bp, Homo sapiens
gcaggctactctgccc

SEQ ID NO: 4251740 - DNA, 17 bp, Homo sapiens
gcaggctactctgccca

SEQ ID NO: 4251741 - DNA, 17 bp, Homo sapiens
gcaggctgtctggccag

SEQ ID NO: 4251742 - DNA, 18 bp, Homo sapiens
gcagggaaggaatcctgg

SEQ ID NO: 4251743 - DNA, 22 bp, Homo sapiens
gcagggccgggcagggggacag

SEQ ID NO: 4251744 - DNA, 18 bp, Homo sapiens
gcagggggacagcaggga

SEQ ID NO: 4251745 - DNA, 21 bp, Homo sapiens
gcaggtgcctgttgaatctga

SEQ ID NO: 4251746 - DNA, 17 bp, Homo sapiens
gcagtcacatctcttcc

SEQ ID NO: 4251747 - DNA, 19 bp, Homo sapiens
gcagtggtggttttctgtt

SEQ ID NO: 4251748 - DNA, 13 bp, Homo sapiens
gcagttctctgcc

SEQ ID NO: 4251749 - DNA, 17 bp, Homo sapiens
gcataaataaaactgaa

SEQ ID NO: 4251750 - DNA, 19 bp, Homo sapiens
gcataataagccatggctg

SEQ ID NO: 4251751 - DNA, 16 bp, Homo sapiens
gcataccacttttgtt

SEQ ID NO: 4251752 - DNA, 18 bp, Homo sapiens
gcatacgtacacatttta

SEQ ID NO: 4251753 - DNA, 21 bp, Homo sapiens
gcatattcaatgtattgagaa

SEQ ID NO: 4251754 - DNA, 18 bp, Homo sapiens
gcatccacttcaggagcc

SEQ ID NO: 4251755 - DNA, 21 bp, Homo sapiens
gcatccacttcaggagcccta

SEQ ID NO: 4251756 - DNA, 20 bp, Homo sapiens
gcatctagtttccctggtgc

SEQ ID NO: 4251757 - DNA, 19 bp, Homo sapiens
gcatctggcacgtggccag

SEQ ID NO: 4251758 - DNA, 20 bp, Homo sapiens
gcatctggcacgtggccagg

SEQ ID NO: 4251759 - DNA, 22 bp, Homo sapiens
gcatgaagtaatatgcacacat

SEQ ID NO: 4251760 - DNA, 15 bp, Homo sapiens
gcatgcaatttgaag

SEQ ID NO: 4251761 - DNA, 19 bp, Homo sapiens
gcatggagactctgagagc

SEQ ID NO: 4251762 - DNA, 23 bp, Homo sapiens
gcatggctcagagcttgaagatt

SEQ ID NO: 4251763 - DNA, 17 bp, Homo sapiens
gcatggtggctcatgcc

SEQ ID NO: 4251764 - DNA, 14 bp, Homo sapiens
gcatgtgccgaggt

SEQ ID NO: 4251765 - DNA, 17 bp, Homo sapiens
gcatttaaaagatacag

SEQ ID NO: 4251766 - DNA, 22 bp, Homo sapiens
gcatttaaaagatacagttact

SEQ ID NO: 4251767 - DNA, 23 bp, Homo sapiens
gcatttcatagcttcacaatgtt

SEQ ID NO: 4251768 - DNA, 18 bp, Homo sapiens
gcatttgaggtctgttct

SEQ ID NO: 4251769 - DNA, 21 bp, Homo sapiens
gcatttgaggtctgttctttc

SEQ ID NO: 4251770 - DNA, 18 bp, Homo sapiens
gcatttgtttgaactgat

SEQ ID NO: 4251771 - DNA, 18 bp, Homo sapiens
gcattttcaccccaccct

SEQ ID NO: 4251772 - DNA, 16 bp, Homo sapiens
gccaccacgtccagct

SEQ ID NO: 4251773 - DNA, 15 bp, Homo sapiens
gtgtttttctccagt

SEQ ID NO: 4251774 - DNA, 15 bp, Homo sapiens
gttaaatactgtgca

SEQ ID NO: 4251775 - DNA, 19 bp, Homo sapiens
gttaaatactgtgcagaat

SEQ ID NO: 4251776 - DNA, 20 bp, Homo sapiens
gttaaatactgtgcagaata

SEQ ID NO: 4251777 - DNA, 18 bp, Homo sapiens
gttaaatgtaatataatg

SEQ ID NO: 4251778 - DNA, 14 bp, Homo sapiens
gttaaattcagtaa

SEQ ID NO: 4251779 - DNA, 15 bp, Homo sapiens
gttacagcttcgctg

SEQ ID NO: 4251780 - DNA, 22 bp, Homo sapiens
gttactaagtttttatggcttt

SEQ ID NO: 4251781 - DNA, 20 bp, Homo sapiens
gttatgatttccttcaatgt

SEQ ID NO: 4251782 - DNA, 15 bp, Homo sapiens
gttattcaaatttga

SEQ ID NO: 4251783 - DNA, 16 bp, Homo sapiens
gttattcaaatttgat

SEQ ID NO: 4251784 - DNA, 21 bp, Homo sapiens
gttcaaagatattttgctttg

SEQ ID NO: 4251785 - DNA, 12 bp, Homo sapiens
gttcaatatcag

SEQ ID NO: 4251786 - DNA, 20 bp, Homo sapiens
gttccatggcctcttcagat

SEQ ID NO: 4251787 - DNA, 17 bp, Homo sapiens
gttccctctccctgttg

SEQ ID NO: 4251788 - DNA, 21 bp, Homo sapiens
gttccgcccgccctcccggag

SEQ ID NO: 4251789 - DNA, 14 bp, Homo sapiens
gttctcaaagttaa

SEQ ID NO: 4251790 - DNA, 20 bp, Homo sapiens
gttctcctgaatattttttg

SEQ ID NO: 4251791 - DNA, 12 bp, Homo sapiens
gttctctgccaa

SEQ ID NO: 4251792 - DNA, 17 bp, Homo sapiens
gttcttaattcttagct

SEQ ID NO: 4251793 - DNA, 20 bp, Homo sapiens
gttgaatctgagctgcaggt

SEQ ID NO: 4251794 - DNA, 16 bp, Homo sapiens
gttgaggaactgtaca

SEQ ID NO: 4251795 - DNA, 17 bp, Homo sapiens
gttgaggaactgtacag

SEQ ID NO: 4251796 - DNA, 21 bp, Homo sapiens
gttgcacctgagggggaaaaa

SEQ ID NO: 4251797 - DNA, 16 bp, Homo sapiens
gttgcagatgtattga

SEQ ID NO: 4251798 - DNA, 12 bp, Homo sapiens
gttgccagtgct

SEQ ID NO: 4251799 - DNA, 13 bp, Homo sapiens
gttgtattcttct

SEQ ID NO: 4251800 - DNA, 14 bp, Homo sapiens
gttgtattcttctg

SEQ ID NO: 4251801 - DNA, 21 bp, Homo sapiens
gttgtattcttctgtatttct

SEQ ID NO: 4251802 - DNA, 14 bp, Homo sapiens
gtttaaaaagtaag

SEQ ID NO: 4251803 - DNA, 16 bp, Homo sapiens
gtttaaaattcagttt

SEQ ID NO: 4251804 - DNA, 18 bp, Homo sapiens
gtttaaccttaaaattaa

SEQ ID NO: 4251805 - DNA, 17 bp, Homo sapiens
gtttaccatttttcatt

SEQ ID NO: 4251806 - DNA, 19 bp, Homo sapiens
gtttataatctgaagatat

SEQ ID NO: 4251807 - DNA, 21 bp, Homo sapiens
gtttattgagtttgtaggtaa

SEQ ID NO: 4251808 - DNA, 22 bp, Homo sapiens
gtttattgagtttgtaggtaaa

SEQ ID NO: 4251809 - DNA, 17 bp, Homo sapiens
gtttccctggtgccctt

SEQ ID NO: 4251810 - DNA, 19 bp, Homo sapiens
gtttcctatttaatacagc

SEQ ID NO: 4251811 - DNA, 19 bp, Homo sapiens
gtttctaaaggctaccttt

SEQ ID NO: 4251812 - DNA, 22 bp, Homo sapiens
gtttgggagctgctgggtggca

SEQ ID NO: 4251813 - DNA, 17 bp, Homo sapiens
gtttgtaaattaacttt

SEQ ID NO: 4251814 - DNA, 19 bp, Homo sapiens
gtttgtaaattaactttta

SEQ ID NO: 4251815 - DNA, 19 bp, Homo sapiens
gttttaactttaatacagc

SEQ ID NO: 4251816 - DNA, 13 bp, Homo sapiens
gttttatttttgc

SEQ ID NO: 4251817 - DNA, 15 bp, Homo sapiens
gttttctgttctttc

SEQ ID NO: 4251818 - DNA, 19 bp, Homo sapiens
gttttctgttctttctggc

SEQ ID NO: 4251819 - DNA, 13 bp, Homo sapiens
gtttttatttttg

SEQ ID NO: 4251820 - DNA, 14 bp, Homo sapiens
gtttttatttttgt

SEQ ID NO: 4251821 - DNA, 17 bp, Homo sapiens
taaaaacaagtcatttt

SEQ ID NO: 4251822 - DNA, 22 bp, Homo sapiens
taaaaagagtaatttcatttaa

SEQ ID NO: 4251823 - DNA, 17 bp, Homo sapiens
taaaacaacagctcgat

SEQ ID NO: 4251824 - DNA, 22 bp, Homo sapiens
taaaacaattttttttttcctc

SEQ ID NO: 4251825 - DNA, 21 bp, Homo sapiens
taaaacgtcttagagcctttt

SEQ ID NO: 4251826 - DNA, 15 bp, Homo sapiens
taaaactttttaaaa

SEQ ID NO: 4251827 - DNA, 17 bp, Homo sapiens
taaaagatacagttact

SEQ ID NO: 4251828 - DNA, 21 bp, Homo sapiens
taaaaggaaatctcaccccat

SEQ ID NO: 4251829 - DNA, 18 bp, Homo sapiens
taaaaggatagtattttt

SEQ ID NO: 4251830 - DNA, 14 bp, Homo sapiens
taaaataaataatt

SEQ ID NO: 4251831 - DNA, 17 bp, Homo sapiens
taaaatgtatttttcta

SEQ ID NO: 4251832 - DNA, 22 bp, Homo sapiens
taaaattgatattatattaaac

SEQ ID NO: 4251833 - DNA, 19 bp, Homo sapiens
taaacaagaccacgtttct

SEQ ID NO: 4251834 - DNA, 16 bp, Homo sapiens
taaacagacaaaaaca

SEQ ID NO: 4251835 - DNA, 17 bp, Homo sapiens
taaacagacaaaaacaa

SEQ ID NO: 4251836 - DNA, 17 bp, Homo sapiens
taaacagtagttgtatt

SEQ ID NO: 4251837 - DNA, 13 bp, Homo sapiens
taaactaaataat

SEQ ID NO: 4251838 - DNA, 14 bp, Homo sapiens
taaacttaatctaa

SEQ ID NO: 4251839 - DNA, 16 bp, Homo sapiens
taaactttaccttttt

SEQ ID NO: 4251840 - DNA, 14 bp, Homo sapiens
taaagaatatatat

SEQ ID NO: 4251841 - DNA, 17 bp, Homo sapiens
taaagatatggagaatt

SEQ ID NO: 4251842 - DNA, 16 bp, Homo sapiens
taaagcagcgtttcta

SEQ ID NO: 4251843 - DNA, 17 bp, Homo sapiens
taaagcagcgtttctat

SEQ ID NO: 4251844 - DNA, 18 bp, Homo sapiens
taaagtatagagagaagt

SEQ ID NO: 4251845 - DNA, 15 bp, Homo sapiens
taaagtgtatttttt

SEQ ID NO: 4251846 - DNA, 19 bp, Homo sapiens
taaagtgtatttttttact

SEQ ID NO: 4251847 - DNA, 13 bp, Homo sapiens
taaagttgtattg

SEQ ID NO: 4251848 - DNA, 15 bp, Homo sapiens
taaataaaaatgcat

SEQ ID NO: 4251849 - DNA, 20 bp, Homo sapiens
taaataaatgggtgtatata

SEQ ID NO: 4251850 - DNA, 12 bp, Homo sapiens
taaataatgaat

SEQ ID NO: 4251851 - DNA, 19 bp, Homo sapiens
taaataatgtgaaactgga

SEQ ID NO: 4251852 - DNA, 14 bp, Homo sapiens
taaataattttaat

SEQ ID NO: 4251853 - DNA, 17 bp, Homo sapiens
taaatactgtgcagaat

SEQ ID NO: 4251854 - DNA, 19 bp, Homo sapiens
taaatactgtgcagaataa

SEQ ID NO: 4251855 - DNA, 13 bp, Homo sapiens
taaatatatataa

SEQ ID NO: 4251856 - DNA, 22 bp, Homo sapiens
taaatatgaaccctttgtttct

SEQ ID NO: 4251857 - DNA, 14 bp, Homo sapiens
taaatcatgtatgt

SEQ ID NO: 4251858 - DNA, 14 bp, Homo sapiens
taaatctccaaaat

SEQ ID NO: 4251859 - DNA, 20 bp, Homo sapiens
taaatctccaaaataaaact

SEQ ID NO: 4251860 - DNA, 21 bp, Homo sapiens
taaatctccaaaataaaactt

SEQ ID NO: 4251861 - DNA, 21 bp, Homo sapiens
taaatgaatattttgataata

SEQ ID NO: 4251862 - DNA, 14 bp, Homo sapiens
taaatgcaataatt

SEQ ID NO: 4251863 - DNA, 19 bp, Homo sapiens
taaatggcttcttctagaa

SEQ ID NO: 4251864 - DNA, 19 bp, Homo sapiens
taaatgggtgtatataatt

SEQ ID NO: 4251865 - DNA, 12 bp, Homo sapiens
taaattaacttt

SEQ ID NO: 4251866 - DNA, 19 bp, Homo sapiens
taaattaacttttataaac

SEQ ID NO: 4251867 - DNA, 20 bp, Homo sapiens
taaattaacttttataaact

SEQ ID NO: 4251868 - DNA, 19 bp, Homo sapiens
taaattctatgttaaatac

SEQ ID NO: 4251869 - DNA, 11 bp, Homo sapiens
taacagaaatg

SEQ ID NO: 4251870 - DNA, 15 bp, Homo sapiens
taacattaaatcaca

SEQ ID NO: 4251871 - DNA, 13 bp, Homo sapiens
taacttcacatat

SEQ ID NO: 4251872 - DNA, 16 bp, Homo sapiens
taactttactctgtgt

SEQ ID NO: 4251873 - DNA, 15 bp, Homo sapiens
taacttttataaact

SEQ ID NO: 4251874 - DNA, 18 bp, Homo sapiens
taacttttataaacttta

SEQ ID NO: 4251875 - DNA, 19 bp, Homo sapiens
taagaaaaaggatgcacag

SEQ ID NO: 4251876 - DNA, 23 bp, Homo sapiens
taagaaaaaggatgcacagagtt

SEQ ID NO: 4251877 - DNA, 19 bp, Homo sapiens
taagacatttgtttgctgt

SEQ ID NO: 4251878 - DNA, 20 bp, Homo sapiens
taagacatttgtttgctgta

SEQ ID NO: 4251879 - DNA, 22 bp, Homo sapiens
taagcctatatatatagtcaaa

SEQ ID NO: 4251880 - DNA, 18 bp, Homo sapiens
taaggatgcttgtacata

SEQ ID NO: 4251881 - DNA, 19 bp, Homo sapiens
taaggatgcttgtacataa

SEQ ID NO: 4251882 - DNA, 22 bp, Homo sapiens
taaggatgcttgtacataatgc

SEQ ID NO: 4251883 - DNA, 20 bp, Homo sapiens
taagggttagtttacaatca

SEQ ID NO: 4251884 - DNA, 19 bp, Homo sapiens
taagtatgttttttatgtt

SEQ ID NO: 4251885 - DNA, 18 bp, Homo sapiens
taagtcagatttttattt

SEQ ID NO: 4251886 - DNA, 19 bp, Homo sapiens
taagtgggctcctgacaat

SEQ ID NO: 4251887 - DNA, 13 bp, Homo sapiens
taagttaataatg

SEQ ID NO: 4251888 - DNA, 10 bp, Homo sapiens
taataatatt

SEQ ID NO: 4251889 - DNA, 16 bp, Homo sapiens
taatacaccactacat

SEQ ID NO: 4251890 - DNA, 18 bp, Homo sapiens
taatacaccactacattc

SEQ ID NO: 4251891 - DNA, 19 bp, Homo sapiens
taatacaccactacattct

SEQ ID NO: 4251892 - DNA, 22 bp, Homo sapiens
taatacaccactacattctgtt

SEQ ID NO: 4251893 - DNA, 16 bp, Homo sapiens
taatagacaatttatt

SEQ ID NO: 4251894 - DNA, 16 bp, Homo sapiens
taatataatgtatttt

SEQ ID NO: 4251895 - DNA, 22 bp, Homo sapiens
taatatcaaaagaaaattgata

SEQ ID NO: 4251896 - DNA, 18 bp, Homo sapiens
taatatgcacacattttt

SEQ ID NO: 4251897 - DNA, 22 bp, Homo sapiens
taatattcttttgtttccatgg

SEQ ID NO: 4251898 - DNA, 15 bp, Homo sapiens
taatattgtttttct

SEQ ID NO: 4251899 - DNA, 18 bp, Homo sapiens
taatccagtattgctgat

SEQ ID NO: 4251900 - DNA, 14 bp, Homo sapiens
taatcttttattta

SEQ ID NO: 4251901 - DNA, 15 bp, Homo sapiens
taatgaataaactga

SEQ ID NO: 4251902 - DNA, 16 bp, Homo sapiens
taatgaataaactgaa

SEQ ID NO: 4251903 - DNA, 24 bp, Homo sapiens
taatgacttgtacaaacagtattt

SEQ ID NO: 4251904 - DNA, 18 bp, Homo sapiens
taatgcagtttttaaaaa

SEQ ID NO: 4251905 - DNA, 14 bp, Homo sapiens
taatgcgtgcatac

SEQ ID NO: 4251906 - DNA, 11 bp, Homo sapiens
taatggaaaca

SEQ ID NO: 4251907 - DNA, 12 bp, Homo sapiens
taatggaaacat

SEQ ID NO: 4251908 - DNA, 18 bp, Homo sapiens
taatgtgcagaaaatatt

SEQ ID NO: 4251909 - DNA, 12 bp, Homo sapiens
taatgtttaaat

SEQ ID NO: 4251910 - DNA, 19 bp, Homo sapiens
taatgtttaaatcatgtat

SEQ ID NO: 4251911 - DNA, 20 bp, Homo sapiens
taatgtttaaatcatgtatg

SEQ ID NO: 4251912 - DNA, 21 bp, Homo sapiens
taattcacagaatagcacaaa

SEQ ID NO: 4251913 - DNA, 12 bp, Homo sapiens
taattcagcact

SEQ ID NO: 4251914 - DNA, 17 bp, Homo sapiens
taattcttcacctgtta

SEQ ID NO: 4251915 - DNA, 15 bp, Homo sapiens
taattgcacttttta

SEQ ID NO: 4251916 - DNA, 12 bp, Homo sapiens
taatttgaactg

SEQ ID NO: 4251917 - DNA, 20 bp, Homo sapiens
taatttgatgcccaatatat

SEQ ID NO: 4251918 - DNA, 14 bp, Homo sapiens
taatttgtgataca

SEQ ID NO: 4251919 - DNA, 15 bp, Homo sapiens
taatttgtgatacaa

SEQ ID NO: 4251920 - DNA, 17 bp, Homo sapiens
taattttaatattcttt

SEQ ID NO: 4251921 - DNA, 20 bp, Homo sapiens
tacaaaatacaatcctgttt

SEQ ID NO: 4251922 - DNA, 15 bp, Homo sapiens
tacaacatttatgtg

SEQ ID NO: 4251923 - DNA, 14 bp, Homo sapiens
tacaactgtattta

SEQ ID NO: 4251924 - DNA, 13 bp, Homo sapiens
tacaatgctgtgc

SEQ ID NO: 4251925 - DNA, 13 bp, Homo sapiens
tacaatgtgtttt

SEQ ID NO: 4251926 - DNA, 22 bp, Homo sapiens
tacacactgcatgtttgtgatt

SEQ ID NO: 4251927 - DNA, 15 bp, Homo sapiens
tacaccactacattc

SEQ ID NO: 4251928 - DNA, 16 bp, Homo sapiens
tacaccactacattct

SEQ ID NO: 4251929 - DNA, 17 bp, Homo sapiens
tacactgtttcaaactt

SEQ ID NO: 4251930 - DNA, 16 bp, Homo sapiens
tacagaataatccagt

SEQ ID NO: 4251931 - DNA, 23 bp, Homo sapiens
tacagttactcagaattctctag

SEQ ID NO: 4251932 - DNA, 13 bp, Homo sapiens
tacagttatttca

SEQ ID NO: 4251933 - DNA, 19 bp, Homo sapiens
tacagtttgttagtatgag

SEQ ID NO: 4251934 - DNA, 19 bp, Homo sapiens
tacataatgcgtgcatacc

SEQ ID NO: 4251935 - DNA, 20 bp, Homo sapiens
tacataatgcgtgcatacca

SEQ ID NO: 4251936 - DNA, 21 bp, Homo sapiens
tacataatgcgtgcataccac

SEQ ID NO: 4251937 - DNA, 18 bp, Homo sapiens
tacatgaaaacacatttt

SEQ ID NO: 4251938 - DNA, 13 bp, Homo sapiens
tacattctgttaa

SEQ ID NO: 4251939 - DNA, 23 bp, Homo sapiens
tacatttttaagtgctgcattta

SEQ ID NO: 4251940 - DNA, 22 bp, Homo sapiens
taccagacaaaaaaatttaaaa

SEQ ID NO: 4251941 - DNA, 18 bp, Homo sapiens
taccagccagtaaatggg

SEQ ID NO: 4251942 - DNA, 14 bp, Homo sapiens
taccatttttcatt

SEQ ID NO: 4251943 - DNA, 21 bp, Homo sapiens
tacccttttcctttgtggttt

SEQ ID NO: 4251944 - DNA, 18 bp, Homo sapiens
tacctctcgtttctgccc

SEQ ID NO: 4251945 - DNA, 21 bp, Homo sapiens
tacctcttgagccttgaactt

SEQ ID NO: 4251946 - DNA, 23 bp, Homo sapiens
tacctcttgagccttgaactttg

SEQ ID NO: 4251947 - DNA, 20 bp, Homo sapiens
tacctttgtattctctcctg

SEQ ID NO: 4251948 - DNA, 19 bp, Homo sapiens
taccttttttagagttgat

SEQ ID NO: 4251949 - DNA, 22 bp, Homo sapiens
taccttttttagagttgatact

SEQ ID NO: 4251950 - DNA, 20 bp, Homo sapiens
taccttttttatacataaac

SEQ ID NO: 4251951 - DNA, 15 bp, Homo sapiens
tacgtacacatttta

SEQ ID NO: 4251952 - DNA, 20 bp, Homo sapiens
tactaatagacaatttatta

SEQ ID NO: 4251953 - DNA, 13 bp, Homo sapiens
tactacagtttgt

SEQ ID NO: 4251954 - DNA, 14 bp, Homo sapiens
tactacagtttgtt

SEQ ID NO: 4251955 - DNA, 22 bp, Homo sapiens
tactattaggaaaataaacaga

SEQ ID NO: 4251956 - DNA, 16 bp, Homo sapiens
tactcagaattctcta

SEQ ID NO: 4251957 - DNA, 22 bp, Homo sapiens
tactcagaattctctagtttga

SEQ ID NO: 4251958 - DNA, 18 bp, Homo sapiens
tactcctatttttgtaaa

SEQ ID NO: 4251959 - DNA, 20 bp, Homo sapiens
tactcctatttttgtaaact

SEQ ID NO: 4251960 - DNA, 16 bp, Homo sapiens
tactctaggacttcaa

SEQ ID NO: 4251961 - DNA, 20 bp, Homo sapiens
tactgcagcctttgcctccc

SEQ ID NO: 4251962 - DNA, 23 bp, Homo sapiens
tactgtaatttgtgatacaatgc

SEQ ID NO: 4251963 - DNA, 21 bp, Homo sapiens
tactgtacataaacaatgatg

SEQ ID NO: 4251964 - DNA, 18 bp, Homo sapiens
tactgtacatgaaaacac

SEQ ID NO: 4251965 - DNA, 21 bp, Homo sapiens
tactgtacatgaaaacacatt

SEQ ID NO: 4251966 - DNA, 15 bp, Homo sapiens
tactgtgcagaataa

SEQ ID NO: 4251967 - DNA, 16 bp, Homo sapiens
tactgtgcagaataat

SEQ ID NO: 4251968 - DNA, 16 bp, Homo sapiens
tacttcaaaaataatg

SEQ ID NO: 4251969 - DNA, 15 bp, Homo sapiens
tacttcctgagtggc

SEQ ID NO: 4251970 - DNA, 16 bp, Homo sapiens
tacttggaactaggct

SEQ ID NO: 4251971 - DNA, 21 bp, Homo sapiens
tactttgtggaccaattattg

SEQ ID NO: 4251972 - DNA, 17 bp, Homo sapiens
tagaaaagttgcagatg

SEQ ID NO: 4251973 - DNA, 21 bp, Homo sapiens
tagaaaagttgcagatgtatt

SEQ ID NO: 4251974 - DNA, 22 bp, Homo sapiens
tagaaaagttgcagatgtattg

SEQ ID NO: 4251975 - DNA, 23 bp, Homo sapiens
tagaaaagttgcagatgtattga

SEQ ID NO: 4251976 - DNA, 21 bp, Homo sapiens
tagaaaatagagcttttaaaa

SEQ ID NO: 4251977 - DNA, 15 bp, Homo sapiens
tagaaccccaggtga

SEQ ID NO: 4251978 - DNA, 16 bp, Homo sapiens
tagaacttgaccccct

SEQ ID NO: 4251979 - DNA, 16 bp, Homo sapiens
tagacaatcattgttt

SEQ ID NO: 4251980 - DNA, 23 bp, Homo sapiens
tagacaatcattgttttgaatat

SEQ ID NO: 4251981 - DNA, 18 bp, Homo sapiens
tagacaatttattatggc

SEQ ID NO: 4251982 - DNA, 16 bp, Homo sapiens
tagacactttacctct

SEQ ID NO: 4251983 - DNA, 22 bp, Homo sapiens
tagagaatgcacagatatactt

SEQ ID NO: 4251984 - DNA, 18 bp, Homo sapiens
tagataatacaccactac

SEQ ID NO: 4251985 - DNA, 15 bp, Homo sapiens
tagataatttacaag

SEQ ID NO: 4251986 - DNA, 22 bp, Homo sapiens
tagatgtttcaactgtgctctt

SEQ ID NO: 4251987 - DNA, 19 bp, Homo sapiens
tagcagacagaaactggat

SEQ ID NO: 4251988 - DNA, 16 bp, Homo sapiens
tagcataaataaaact

SEQ ID NO: 4251989 - DNA, 17 bp, Homo sapiens
tagcataaataaaactg

SEQ ID NO: 4251990 - DNA, 20 bp, Homo sapiens
tagcctctgggatctgccaa

SEQ ID NO: 4251991 - DNA, 22 bp, Homo sapiens
tagcctctgggatctgccaaca

SEQ ID NO: 4251992 - DNA, 20 bp, Homo sapiens
tagccttagagcatctctgc

SEQ ID NO: 4251993 - DNA, 14 bp, Homo sapiens
taggagaaacacat

SEQ ID NO: 4251994 - DNA, 15 bp, Homo sapiens
taggagtatttttgg

SEQ ID NO: 4251995 - DNA, 14 bp, Homo sapiens
taggcacaaggttg

SEQ ID NO: 4251996 - DNA, 20 bp, Homo sapiens
taggctcttatgtgtgcctt

SEQ ID NO: 4251997 - DNA, 15 bp, Homo sapiens
tagggcaattggaac

SEQ ID NO: 4251998 - DNA, 18 bp, Homo sapiens
taggtattacaagtaatg

SEQ ID NO: 4251999 - DNA, 23 bp, Homo sapiens
taggtcaataacactgtatttta

SEQ ID NO: 4252000 - DNA, 21 bp, Homo sapiens
tagtaagtaattatgcactaa

SEQ ID NO: 4252001 - DNA, 18 bp, Homo sapiens
tagtatgaggcatttgtt

SEQ ID NO: 4252002 - DNA, 13 bp, Homo sapiens
tagtatttttatc

SEQ ID NO: 4252003 - DNA, 22 bp, Homo sapiens
tagtgtttctagctaaataaat

SEQ ID NO: 4252004 - DNA, 16 bp, Homo sapiens
tagttagatctttgta

SEQ ID NO: 4252005 - DNA, 16 bp, Homo sapiens
tagtttccctggtgcc

SEQ ID NO: 4252006 - DNA, 15 bp, Homo sapiens
tagtttgattaaatt

SEQ ID NO: 4252007 - DNA, 23 bp, Homo sapiens
tagtttgattaaattcttgcaaa

SEQ ID NO: 4252008 - DNA, 15 bp, Homo sapiens
tagtttggatatttt

SEQ ID NO: 4252009 - DNA, 21 bp, Homo sapiens
tagtttggatatttttgtact

SEQ ID NO: 4252010 - DNA, 22 bp, Homo sapiens
tagtttggatatttttgtactt

SEQ ID NO: 4252011 - DNA, 22 bp, Homo sapiens
tataaccagtgttgtggattta

SEQ ID NO: 4252012 - DNA, 19 bp, Homo sapiens
tataagacatttgtttgct

SEQ ID NO: 4252013 - DNA, 13 bp, Homo sapiens
tataatgtttaaa

SEQ ID NO: 4252014 - DNA, 17 bp, Homo sapiens
tataatgtttaaatcat

SEQ ID NO: 4252015 - DNA, 19 bp, Homo sapiens
tataatgtttaaatcatgt

SEQ ID NO: 4252016 - DNA, 14 bp, Homo sapiens
tatactttgtggac

SEQ ID NO: 4252017 - DNA, 20 bp, Homo sapiens
tatactttgtggaccaatta

SEQ ID NO: 4252018 - DNA, 13 bp, Homo sapiens
tatagtcaaatcg

SEQ ID NO: 4252019 - DNA, 17 bp, Homo sapiens
tatataaaacttaaaaa

SEQ ID NO: 4252020 - DNA, 19 bp, Homo sapiens
tatataaaacttaaaaaca

SEQ ID NO: 4252021 - DNA, 15 bp, Homo sapiens
tatataaagaatata

SEQ ID NO: 4252022 - DNA, 12 bp, Homo sapiens
tatataaagtat

SEQ ID NO: 4252023 - DNA, 12 bp, Homo sapiens
tatatataaaga

SEQ ID NO: 4252024 - DNA, 14 bp, Homo sapiens
tatatataaagaat

SEQ ID NO: 4252025 - DNA, 15 bp, Homo sapiens
tatatataaagtata

SEQ ID NO: 4252026 - DNA, 14 bp, Homo sapiens
tatatatatataaa

SEQ ID NO: 4252027 - DNA, 15 bp, Homo sapiens
tatatatatataaag

SEQ ID NO: 4252028 - DNA, 15 bp, Homo sapiens
tatatatatatataa

SEQ ID NO: 4252029 - DNA, 15 bp, Homo sapiens
tatatatatttctag

SEQ ID NO: 4252030 - DNA, 16 bp, Homo sapiens
tatatcagtacctctc

SEQ ID NO: 4252031 - DNA, 18 bp, Homo sapiens
tatatcattctacagaat

SEQ ID NO: 4252032 - DNA, 20 bp, Homo sapiens
tatatcattctacagaataa

SEQ ID NO: 4252033 - DNA, 13 bp, Homo sapiens
tatattaaaacaa

SEQ ID NO: 4252034 - DNA, 15 bp, Homo sapiens
tatattaaaacaata

SEQ ID NO: 4252035 - DNA, 20 bp, Homo sapiens
tatattaaaacaataatgca

SEQ ID NO: 4252036 - DNA, 13 bp, Homo sapiens
tatattaaacata

SEQ ID NO: 4252037 - DNA, 20 bp, Homo sapiens
tatattataaatatatataa

SEQ ID NO: 4252038 - DNA, 21 bp, Homo sapiens
tatattataaatatatataaa

SEQ ID NO: 4252039 - DNA, 22 bp, Homo sapiens
tatattataaatatatataaag

SEQ ID NO: 4252040 - DNA, 21 bp, Homo sapiens
tatatttcacttttgttctgc

SEQ ID NO: 4252041 - DNA, 22 bp, Homo sapiens
tatcaaaagaaaattgatattt

SEQ ID NO: 4252042 - DNA, 15 bp, Homo sapiens
tatcatatattaaaa

SEQ ID NO: 4252043 - DNA, 17 bp, Homo sapiens
tatcatgacaaagactg

SEQ ID NO: 4252044 - DNA, 20 bp, Homo sapiens
tatccctactgtaatttgtg

SEQ ID NO: 4252045 - DNA, 16 bp, Homo sapiens
tatccgccctgcagca

SEQ ID NO: 4252046 - DNA, 22 bp, Homo sapiens
tatccgccctgcagcagaacct

SEQ ID NO: 4252047 - DNA, 19 bp, Homo sapiens
tatcgtcactgcttaactt

SEQ ID NO: 4252048 - DNA, 23 bp, Homo sapiens
tatctgacccactttgtaatttt

SEQ ID NO: 4252049 - DNA, 12 bp, Homo sapiens
tatctgcagaac

SEQ ID NO: 4252050 - DNA, 14 bp, Homo sapiens
tatctgcagaacat

SEQ ID NO: 4252051 - DNA, 19 bp, Homo sapiens
tatcttggggcaagactgc

SEQ ID NO: 4252052 - DNA, 22 bp, Homo sapiens
tatcttggggcaagactgcaaa

SEQ ID NO: 4252053 - DNA, 16 bp, Homo sapiens
tatgaaccctttgttt

SEQ ID NO: 4252054 - DNA, 21 bp, Homo sapiens
tatgaaccctttgtttcttgt

SEQ ID NO: 4252055 - DNA, 22 bp, Homo sapiens
tatgacacatgcaaggtcattt

SEQ ID NO: 4252056 - DNA, 22 bp, Homo sapiens
tatgacccacattactttttat

SEQ ID NO: 4252057 - DNA, 13 bp, Homo sapiens
tatgaggcatttg

SEQ ID NO: 4252058 - DNA, 13 bp, Homo sapiens
tatgatattgttt

SEQ ID NO: 4252059 - DNA, 15 bp, Homo sapiens
tatgatattgtttaa

SEQ ID NO: 4252060 - DNA, 18 bp, Homo sapiens
tatgatttccttcaatgt

SEQ ID NO: 4252061 - DNA, 22 bp, Homo sapiens
tatgcatgaagtaatatgcaca

SEQ ID NO: 4252062 - DNA, 11 bp, Homo sapiens
tatgcatttga

SEQ ID NO: 4252063 - DNA, 24 bp, Homo sapiens
tatgcatttgaaaattttgatgtt

SEQ ID NO: 4252064 - DNA, 17 bp, Homo sapiens
tatggagaattgctgaa

SEQ ID NO: 4252065 - DNA, 21 bp, Homo sapiens
tatggcttttgtgcattatct

SEQ ID NO: 4252066 - DNA, 23 bp, Homo sapiens
tatggcttttgtgcattatctag

SEQ ID NO: 4252067 - DNA, 22 bp, Homo sapiens
tatgggagaagggggagtaatg

SEQ ID NO: 4252068 - DNA, 22 bp, Homo sapiens
tttcaattcagattgtcttgca

SEQ ID NO: 4252069 - DNA, 17 bp, Homo sapiens
tttcacttttgttctgc

SEQ ID NO: 4252070 - DNA, 11 bp, Homo sapiens
tttcagaaatg

SEQ ID NO: 4252071 - DNA, 15 bp, Homo sapiens
tttcataaagggttg

SEQ ID NO: 4252072 - DNA, 16 bp, Homo sapiens
tttccaaactgactca

SEQ ID NO: 4252073 - DNA, 13 bp, Homo sapiens
tttcccctgttaa

SEQ ID NO: 4252074 - DNA, 17 bp, Homo sapiens
tttccgttaaaatacca

SEQ ID NO: 4252075 - DNA, 18 bp, Homo sapiens
tttcctatttaatacagc

SEQ ID NO: 4252076 - DNA, 16 bp, Homo sapiens
tttccttcattcatag

SEQ ID NO: 4252077 - DNA, 21 bp, Homo sapiens
tttcctttgtggttttatgga

SEQ ID NO: 4252078 - DNA, 18 bp, Homo sapiens
tttctaaaggctaccttt

SEQ ID NO: 4252079 - DNA, 17 bp, Homo sapiens
tttctacattattgctt

SEQ ID NO: 4252080 - DNA, 22 bp, Homo sapiens
tttctgctttctttgattctcc

SEQ ID NO: 4252081 - DNA, 17 bp, Homo sapiens
tttctgtgcatgtgcag

SEQ ID NO: 4252082 - DNA, 20 bp, Homo sapiens
tttctgttctttctggctat

SEQ ID NO: 4252083 - DNA, 18 bp, Homo sapiens
tttcttcaacatgctcca

SEQ ID NO: 4252084 - DNA, 15 bp, Homo sapiens
tttgaaacctgctct

SEQ ID NO: 4252085 - DNA, 15 bp, Homo sapiens
tttgaactgataaag

SEQ ID NO: 4252086 - DNA, 19 bp, Homo sapiens
tttgaactgataaagatga

SEQ ID NO: 4252087 - DNA, 20 bp, Homo sapiens
tttgaagtaacttatttgac

SEQ ID NO: 4252088 - DNA, 16 bp, Homo sapiens
tttgaatattactcct

SEQ ID NO: 4252089 - DNA, 15 bp, Homo sapiens
tttgacagactattt

SEQ ID NO: 4252090 - DNA, 21 bp, Homo sapiens
tttgacctctgcagcaataaa

SEQ ID NO: 4252091 - DNA, 15 bp, Homo sapiens
tttgactatgaatgt

SEQ ID NO: 4252092 - DNA, 15 bp, Homo sapiens
tttgaggtaaagata

SEQ ID NO: 4252093 - DNA, 13 bp, Homo sapiens
tttgatatgtagt

SEQ ID NO: 4252094 - DNA, 13 bp, Homo sapiens
tttgatgtgactt

SEQ ID NO: 4252095 - DNA, 18 bp, Homo sapiens
tttgattaaattcttgca

SEQ ID NO: 4252096 - DNA, 21 bp, Homo sapiens
tttgattaaattcttgcaaag

SEQ ID NO: 4252097 - DNA, 14 bp, Homo sapiens
tttgcactctgtaa

SEQ ID NO: 4252098 - DNA, 18 bp, Homo sapiens
tttgctaatgtataatgt

SEQ ID NO: 4252099 - DNA, 16 bp, Homo sapiens
tttgctttgtgatttt

SEQ ID NO: 4252100 - DNA, 19 bp, Homo sapiens
tttggatatttttgtactt

SEQ ID NO: 4252101 - DNA, 21 bp, Homo sapiens
tttggatatttttgtacttga

SEQ ID NO: 4252102 - DNA, 16 bp, Homo sapiens
tcacctatgttatttt

SEQ ID NO: 4252103 - DNA, 17 bp, Homo sapiens
tcacctgttatgtatga

SEQ ID NO: 4252104 - DNA, 21 bp, Homo sapiens
tcactatatatatttctagaa

SEQ ID NO: 4252105 - DNA, 19 bp, Homo sapiens
tcactgcattcattctgag

SEQ ID NO: 4252106 - DNA, 14 bp, Homo sapiens
tcactgcttaactt

SEQ ID NO: 4252107 - DNA, 18 bp, Homo sapiens
tcactgcttaacttcaca

SEQ ID NO: 4252108 - DNA, 18 bp, Homo sapiens
tcactgtgggaaggccag

SEQ ID NO: 4252109 - DNA, 14 bp, Homo sapiens
tcactgttctgcaa

SEQ ID NO: 4252110 - DNA, 16 bp, Homo sapiens
tcactgttctgcaaag

SEQ ID NO: 4252111 - DNA, 17 bp, Homo sapiens
tcacttagtcctttatc

SEQ ID NO: 4252112 - DNA, 18 bp, Homo sapiens
tcactttttttttttgtt

SEQ ID NO: 4252113 - DNA, 16 bp, Homo sapiens
tcagaattctctagtt

SEQ ID NO: 4252114 - DNA, 16 bp, Homo sapiens
tcagactctcagccca

SEQ ID NO: 4252115 - DNA, 17 bp, Homo sapiens
tcagactctcagcccag

SEQ ID NO: 4252116 - DNA, 14 bp, Homo sapiens
tcagagcttgaaga

SEQ ID NO: 4252117 - DNA, 16 bp, Homo sapiens
tcagagcttgaagatt

SEQ ID NO: 4252118 - DNA, 14 bp, Homo sapiens
tcagattgtcttgc

SEQ ID NO: 4252119 - DNA, 16 bp, Homo sapiens
tcagattgtcttgcaa

SEQ ID NO: 4252120 - DNA, 23 bp, Homo sapiens
tcagcacagctctcctcctccat

SEQ ID NO: 4252121 - DNA, 16 bp, Homo sapiens
tcagcacgatttctgt

SEQ ID NO: 4252122 - DNA, 23 bp, Homo sapiens
tcagcactttgggaggctgaggc

SEQ ID NO: 4252123 - DNA, 21 bp, Homo sapiens
tcagccatgggaaatgagcca

SEQ ID NO: 4252124 - DNA, 24 bp, Homo sapiens
tcagcccagaagaaaattctcctg

SEQ ID NO: 4252125 - DNA, 22 bp, Homo sapiens
tcagctgcaatccatttatttc

SEQ ID NO: 4252126 - DNA, 19 bp, Homo sapiens
tcaggcatggctcagagct

SEQ ID NO: 4252127 - DNA, 20 bp, Homo sapiens
tcaggcgatccacctgtctc

SEQ ID NO: 4252128 - DNA, 17 bp, Homo sapiens
tcagtagtgagcagcat

SEQ ID NO: 4252129 - DNA, 13 bp, Homo sapiens
tcagtttttgtat

SEQ ID NO: 4252130 - DNA, 14 bp, Homo sapiens
tcagtttttgtatc

SEQ ID NO: 4252131 - DNA, 20 bp, Homo sapiens
tcataataggtagtttggat

SEQ ID NO: 4252132 - DNA, 15 bp, Homo sapiens
tcatagaattgcagt

SEQ ID NO: 4252133 - DNA, 13 bp, Homo sapiens
tcatatacaaaca

SEQ ID NO: 4252134 - DNA, 20 bp, Homo sapiens
tcatatacaaacatgtatgt

SEQ ID NO: 4252135 - DNA, 18 bp, Homo sapiens
tcatatattaaaacaata

SEQ ID NO: 4252136 - DNA, 15 bp, Homo sapiens
tcatcctcagcagca

SEQ ID NO: 4252137 - DNA, 15 bp, Homo sapiens
tcatcgaatgctaaa

SEQ ID NO: 4252138 - DNA, 23 bp, Homo sapiens
tcatcgctcgtgtgttctatcca

SEQ ID NO: 4252139 - DNA, 15 bp, Homo sapiens
tcatcttgtgaaatg

SEQ ID NO: 4252140 - DNA, 15 bp, Homo sapiens
tcatgaaaatgacat

SEQ ID NO: 4252141 - DNA, 14 bp, Homo sapiens
tcatgccacagtgg

SEQ ID NO: 4252142 - DNA, 19 bp, Homo sapiens
tcatgccaccatggccagc

SEQ ID NO: 4252143 - DNA, 19 bp, Homo sapiens
tcatgtatgttatgatatt

SEQ ID NO: 4252144 - DNA, 18 bp, Homo sapiens
tcattaggtgtgactgaa

SEQ ID NO: 4252145 - DNA, 13 bp, Homo sapiens
tcattccagtgct

SEQ ID NO: 4252146 - DNA, 14 bp, Homo sapiens
tcattccagtgcta

SEQ ID NO: 4252147 - DNA, 16 bp, Homo sapiens
tcattctacagaataa

SEQ ID NO: 4252148 - DNA, 22 bp, Homo sapiens
tcattctacagaataatccagt

SEQ ID NO: 4252149 - DNA, 13 bp, Homo sapiens
tcattgttttgaa

SEQ ID NO: 4252150 - DNA, 16 bp, Homo sapiens
tcatttacaaaagatt

SEQ ID NO: 4252151 - DNA, 16 bp, Homo sapiens
tccaaaataaaacttt

SEQ ID NO: 4252152 - DNA, 17 bp, Homo sapiens
tccaaaataaaactttt

SEQ ID NO: 4252153 - DNA, 13 bp, Homo sapiens
tccaaagtacact

SEQ ID NO: 4252154 - DNA, 16 bp, Homo sapiens
tccaaagtacactgtt

SEQ ID NO: 4252155 - DNA, 14 bp, Homo sapiens
tccaaattgtgctt

SEQ ID NO: 4252156 - DNA, 13 bp, Homo sapiens
tccaatatttctg

SEQ ID NO: 4252157 - DNA, 15 bp, Homo sapiens
tccaatatttctgct

SEQ ID NO: 4252158 - DNA, 16 bp, Homo sapiens
tccaatatttctgctt

SEQ ID NO: 4252159 - DNA, 17 bp, Homo sapiens
tccacctgtctcagcct

SEQ ID NO: 4252160 - DNA, 14 bp, Homo sapiens
tccactcccaagcc

SEQ ID NO: 4252161 - DNA, 16 bp, Homo sapiens
ttactggcttctcttg

SEQ ID NO: 4252162 - DNA, 13 bp, Homo sapiens
ttactgtacatga

SEQ ID NO: 4252163 - DNA, 22 bp, Homo sapiens
ttactgtacatgaaaacacatt

SEQ ID NO: 4252164 - DNA, 23 bp, Homo sapiens
ttactgtacatgaaaacacattt

SEQ ID NO: 4252165 - DNA, 18 bp, Homo sapiens
ttagacactttacctctt

SEQ ID NO: 4252166 - DNA, 15 bp, Homo sapiens
ttagaccgctctctt

SEQ ID NO: 4252167 - DNA, 18 bp, Homo sapiens
ttagaccgctctcttttc

SEQ ID NO: 4252168 - DNA, 14 bp, Homo sapiens
ttagactatttctt

SEQ ID NO: 4252169 - DNA, 18 bp, Homo sapiens
ttagagcatctctgcctc

SEQ ID NO: 4252170 - DNA, 14 bp, Homo sapiens
ttagagttgatact

SEQ ID NO: 4252171 - DNA, 22 bp, Homo sapiens
ttagatctaaacagttatttct

SEQ ID NO: 4252172 - DNA, 20 bp, Homo sapiens
ttaggaaaataaacagacaa

SEQ ID NO: 4252173 - DNA, 23 bp, Homo sapiens
ttaggtcaataacactgtatttt

SEQ ID NO: 4252174 - DNA, 17 bp, Homo sapiens
ttagtttacaatcagcc

SEQ ID NO: 4252175 - DNA, 17 bp, Homo sapiens
ttataaaaataaataga

SEQ ID NO: 4252176 - DNA, 16 bp, Homo sapiens
ttataatctgaagata

SEQ ID NO: 4252177 - DNA, 13 bp, Homo sapiens
ttatacataaaca

SEQ ID NO: 4252178 - DNA, 21 bp, Homo sapiens
ttatataaaacttaaaaacaa

SEQ ID NO: 4252179 - DNA, 19 bp, Homo sapiens
ttatatcatccagaaaaga

SEQ ID NO: 4252180 - DNA, 14 bp, Homo sapiens
ttatatcttttggt

SEQ ID NO: 4252181 - DNA, 20 bp, Homo sapiens
ttatatcttttggttattct

SEQ ID NO: 4252182 - DNA, 18 bp, Homo sapiens
ttatcacccagaagaaaa

SEQ ID NO: 4252183 - DNA, 19 bp, Homo sapiens
ttatcacccagaagaaaat

SEQ ID NO: 4252184 - DNA, 21 bp, Homo sapiens
ttatcacccagaagaaaatag

SEQ ID NO: 4252185 - DNA, 17 bp, Homo sapiens
ttatcctggcatgtgct

SEQ ID NO: 4252186 - DNA, 17 bp, Homo sapiens
ttatctagatactgtat

SEQ ID NO: 4252187 - DNA, 17 bp, Homo sapiens
ttatgatattgtttaaa

SEQ ID NO: 4252188 - DNA, 19 bp, Homo sapiens
ttatgatattgtttaaaat

SEQ ID NO: 4252189 - DNA, 22 bp, Homo sapiens
ttatgatattgtttaaaattca

SEQ ID NO: 4252190 - DNA, 18 bp, Homo sapiens
ttatgcagcaaatatatg

SEQ ID NO: 4252191 - DNA, 14 bp, Homo sapiens
ttatgctcagggtc

SEQ ID NO: 4252192 - DNA, 20 bp, Homo sapiens
ttatgtatttaaagttgtat

SEQ ID NO: 4252193 - DNA, 18 bp, Homo sapiens
ttattattttaaaatata

SEQ ID NO: 4252194 - DNA, 21 bp, Homo sapiens
ttattcctagtggatgactgt

SEQ ID NO: 4252195 - DNA, 20 bp, Homo sapiens
ttattctaagccctttgcca

SEQ ID NO: 4252196 - DNA, 22 bp, Homo sapiens
ttattgtaagcatctcaatctt

SEQ ID NO: 4252197 - DNA, 21 bp, Homo sapiens
ttatttcatcttttattcaag

SEQ ID NO: 4252198 - DNA, 19 bp, Homo sapiens
ttcaaagtgtgtctgggat

SEQ ID NO: 4252199 - DNA, 12 bp, Homo sapiens
ttcaaatttgat

SEQ ID NO: 4252200 - DNA, 14 bp, Homo sapiens
ttcaaatttgatga

SEQ ID NO: 4252201 - DNA, 11 bp, Homo sapiens
ttcaatatcag

SEQ ID NO: 4252202 - DNA, 17 bp, Homo sapiens
ttcacatattgatttcc

SEQ ID NO: 4252203 - DNA, 13 bp, Homo sapiens
ttcaccccaccct

SEQ ID NO: 4252204 - DNA, 13 bp, Homo sapiens
ttcacctatgtta

SEQ ID NO: 4252205 - DNA, 12 bp, Homo sapiens
ttcacctgttat

SEQ ID NO: 4252206 - DNA, 15 bp, Homo sapiens
ttcacctgttatgta

SEQ ID NO: 4252207 - DNA, 18 bp, Homo sapiens
ttcacctgttatgtatga

SEQ ID NO: 4252208 - DNA, 23 bp, Homo sapiens
ttcacctgttatgtatgaaggaa

SEQ ID NO: 4252209 - DNA, 16 bp, Homo sapiens
ttcacttttgttctgc

SEQ ID NO: 4252210 - DNA, 16 bp, Homo sapiens
ttcagaaatgtgttat

SEQ ID NO: 4252211 - DNA, 14 bp, Homo sapiens
ttcagattgtcttg

SEQ ID NO: 4252212 - DNA, 15 bp, Homo sapiens
ttcagtagtgagcag

SEQ ID NO: 4252213 - DNA, 16 bp, Homo sapiens
ttcagtttttgtatct

SEQ ID NO: 4252214 - DNA, 21 bp, Homo sapiens
ttcatagggaaaggttttgta

SEQ ID NO: 4252215 - DNA, 24 bp, Homo sapiens
ttccaatatttctgctttctttga

SEQ ID NO: 4252216 - DNA, 12 bp, Homo sapiens
ttccatggcctc

SEQ ID NO: 4252217 - DNA, 16 bp, Homo sapiens
ttccatggcctcttca

SEQ ID NO: 4252218 - DNA, 17 bp, Homo sapiens
ttcccactcagcagtga

SEQ ID NO: 4252219 - DNA, 22 bp, Homo sapiens
ttcccagagtcacaagtagcct

SEQ ID NO: 4252220 - DNA, 17 bp, Homo sapiens
ttccccactgacagcct

SEQ ID NO: 4252221 - DNA, 21 bp, Homo sapiens
ttccccactgacagcctccca

SEQ ID NO: 4252222 - DNA, 23 bp, Homo sapiens
ttccccactgacagcctcccacc

SEQ ID NO: 4252223 - DNA, 17 bp, Homo sapiens
ttcctagtggatgactg

SEQ ID NO: 4252224 - DNA, 16 bp, Homo sapiens
ttcctgtccccagggg

SEQ ID NO: 4252225 - DNA, 19 bp, Homo sapiens
ttccttcaatgtgcataat

SEQ ID NO: 4252226 - DNA, 20 bp, Homo sapiens
ttcctttgtggttttatgga

SEQ ID NO: 4252227 - DNA, 13 bp, Homo sapiens
ttcggggaccagc

SEQ ID NO: 4252228 - DNA, 17 bp, Homo sapiens
ttctaaaggctaccttt

SEQ ID NO: 4252229 - DNA, 16 bp, Homo sapiens
ttctaacattaaatca

SEQ ID NO: 4252230 - DNA, 14 bp, Homo sapiens
ttctacaaagcact

SEQ ID NO: 4252231 - DNA, 21 bp, Homo sapiens
ttctacaaagcactagagaat

SEQ ID NO: 4252232 - DNA, 14 bp, Homo sapiens
ttctacagaataat

SEQ ID NO: 4252233 - DNA, 18 bp, Homo sapiens
ttctacattattgcttat

SEQ ID NO: 4252234 - DNA, 23 bp, Homo sapiens
ttctacgacccttttgagcctag

SEQ ID NO: 4252235 - DNA, 17 bp, Homo sapiens
ttctatccaaacatgta

SEQ ID NO: 4252236 - DNA, 17 bp, Homo sapiens
ttctatgttaaatactg

SEQ ID NO: 4252237 - DNA, 20 bp, Homo sapiens
ttctatgttaaatactgtgc

SEQ ID NO: 4252238 - DNA, 23 bp, Homo sapiens
ttctatgttaaatactgtgcaga

SEQ ID NO: 4252239 - DNA, 22 bp, Homo sapiens
gactgagtacgttgtgcatttg

SEQ ID NO: 4252240 - DNA, 16 bp, Homo sapiens
gactgcaaactttttt

SEQ ID NO: 4252241 - DNA, 21 bp, Homo sapiens
gactgcaaacttttttatatc

SEQ ID NO: 4252242 - DNA, 12 bp, Homo sapiens
gacttactgtac

SEQ ID NO: 4252243 - DNA, 15 bp, Homo sapiens
gacttttgaaaaaaa

SEQ ID NO: 4252244 - DNA, 16 bp, Homo sapiens
gacttttgttaaattc

SEQ ID NO: 4252245 - DNA, 15 bp, Homo sapiens
gagaaactgaagccg

SEQ ID NO: 4252246 - DNA, 21 bp, Homo sapiens
gagaactacgcacagctgccg

SEQ ID NO: 4252247 - DNA, 12 bp, Homo sapiens
gagaagttctca

SEQ ID NO: 4252248 - DNA, 12 bp, Homo sapiens
gagaatgcacag

SEQ ID NO: 4252249 - DNA, 16 bp, Homo sapiens
gagaatgcacagatat

SEQ ID NO: 4252250 - DNA, 16 bp, Homo sapiens
gagacaatgttttctt

SEQ ID NO: 4252251 - DNA, 21 bp, Homo sapiens
gagacctcaaatcactgcatt

SEQ ID NO: 4252252 - DNA, 21 bp, Homo sapiens
gagagacgcagtccgcccagg

SEQ ID NO: 4252253 - DNA, 16 bp, Homo sapiens
gagagccctgtccctg

SEQ ID NO: 4252254 - DNA, 21 bp, Homo sapiens
gagagccctgtccctgccctc

SEQ ID NO: 4252255 - DNA, 13 bp, Homo sapiens
gagcccccttcct

SEQ ID NO: 4252256 - DNA, 12 bp, Homo sapiens
gagcccctcatg

SEQ ID NO: 4252257 - DNA, 21 bp, Homo sapiens
gagccgcgctttcccctcctc

SEQ ID NO: 4252258 - DNA, 13 bp, Homo sapiens
gagccttgaactt

SEQ ID NO: 4252259 - DNA, 22 bp, Homo sapiens
gagccttgaactttgacctctg

SEQ ID NO: 4252260 - DNA, 17 bp, Homo sapiens
gagcgccctgcagggcc

SEQ ID NO: 4252261 - DNA, 11 bp, Homo sapiens
gagctgcaggg

SEQ ID NO: 4252262 - DNA, 19 bp, Homo sapiens
gagctgctgggtggcaggg

SEQ ID NO: 4252263 - DNA, 17 bp, Homo sapiens
gagctgtttatgttttt

SEQ ID NO: 4252264 - DNA, 13 bp, Homo sapiens
gagctttctgtgc

SEQ ID NO: 4252265 - DNA, 18 bp, Homo sapiens
gagctttctgtgcatgtg

SEQ ID NO: 4252266 - DNA, 16 bp, Homo sapiens
gaggagggagagccct

SEQ ID NO: 4252267 - DNA, 14 bp, Homo sapiens
gaggagggaggcgg

SEQ ID NO: 4252268 - DNA, 19 bp, Homo sapiens
gaggcatttgtttgaactg

SEQ ID NO: 4252269 - DNA, 15 bp, Homo sapiens
gagggacagagcccg

SEQ ID NO: 4252270 - DNA, 16 bp, Homo sapiens
gagggacagagcccgg

SEQ ID NO: 4252271 - DNA, 22 bp, Homo sapiens
gagggtgccgtgcgggcgaggc

SEQ ID NO: 4252272 - DNA, 15 bp, Homo sapiens
gaggtaaagatatgg

SEQ ID NO: 4252273 - DNA, 14 bp, Homo sapiens
gaggtatattggaa

SEQ ID NO: 4252274 - DNA, 13 bp, Homo sapiens
gaggtggccgcca

SEQ ID NO: 4252275 - DNA, 17 bp, Homo sapiens
ttctatttatttgactg

SEQ ID NO: 4252276 - DNA, 15 bp, Homo sapiens
ttctcatcttgtgaa

SEQ ID NO: 4252277 - DNA, 12 bp, Homo sapiens
ttctccccagaa

SEQ ID NO: 4252278 - DNA, 20 bp, Homo sapiens
ttctctagtttgattaaatt

SEQ ID NO: 4252279 - DNA, 21 bp, Homo sapiens
ttctgcaagcacatctgcatt

SEQ ID NO: 4252280 - DNA, 22 bp, Homo sapiens
ttctgcaagcacatctgcattt

SEQ ID NO: 4252281 - DNA, 15 bp, Homo sapiens
ttctgctttctttga

SEQ ID NO: 4252282 - DNA, 19 bp, Homo sapiens
ttctgctttctttgattct

SEQ ID NO: 4252283 - DNA, 18 bp, Homo sapiens
ttctggctatgcatttga

SEQ ID NO: 4252284 - DNA, 13 bp, Homo sapiens
ttctgtacttcct

SEQ ID NO: 4252285 - DNA, 14 bp, Homo sapiens
ttctgtatttctag

SEQ ID NO: 4252286 - DNA, 11 bp, Homo sapiens
ttctgttcttt

SEQ ID NO: 4252287 - DNA, 13 bp, Homo sapiens
ttcttaattctta

SEQ ID NO: 4252288 - DNA, 21 bp, Homo sapiens
ttcttattaattcttcacctg

SEQ ID NO: 4252289 - DNA, 17 bp, Homo sapiens
ttcttcacctgttatgt

SEQ ID NO: 4252290 - DNA, 22 bp, Homo sapiens
ttcttcacctgttatgtatgaa

SEQ ID NO: 4252291 - DNA, 15 bp, Homo sapiens
ttcttgcactgtcca

SEQ ID NO: 4252292 - DNA, 13 bp, Homo sapiens
ttcttggtttgta

SEQ ID NO: 4252293 - DNA, 15 bp, Homo sapiens
ttcttgtttattgag

SEQ ID NO: 4252294 - DNA, 14 bp, Homo sapiens
ttctttccaaagta

SEQ ID NO: 4252295 - DNA, 23 bp, Homo sapiens
ttctttgattctccttttatgtg

SEQ ID NO: 4252296 - DNA, 20 bp, Homo sapiens
ttctttttattttgcactct

SEQ ID NO: 4252297 - DNA, 15 bp, Homo sapiens
ttgaaaatgtgtttg

SEQ ID NO: 4252298 - DNA, 19 bp, Homo sapiens
ttgaaaccaccttttatta

SEQ ID NO: 4252299 - DNA, 21 bp, Homo sapiens
ttgaaagcttttaaaatgtag

SEQ ID NO: 4252300 - DNA, 22 bp, Homo sapiens
ttgaacgcacatagctcaatca

SEQ ID NO: 4252301 - DNA, 15 bp, Homo sapiens
ttgaactttgacctc

SEQ ID NO: 4252302 - DNA, 17 bp, Homo sapiens
ttgaactttgacctctg

SEQ ID NO: 4252303 - DNA, 17 bp, Homo sapiens
ttgaaggagaaaataga

SEQ ID NO: 4252304 - DNA, 17 bp, Homo sapiens
ttgacttttcaataaat

SEQ ID NO: 4252305 - DNA, 14 bp, Homo sapiens
ttgagacaatgttt

SEQ ID NO: 4252306 - DNA, 14 bp, Homo sapiens
ttgagaccagaagg

SEQ ID NO: 4252307 - DNA, 17 bp, Homo sapiens
ttgagactcaaaaaaac

SEQ ID NO: 4252308 - DNA, 19 bp, Homo sapiens
ttgagattgccccaggtct

SEQ ID NO: 4252309 - DNA, 14 bp, Homo sapiens
ttgagccttgaact

SEQ ID NO: 4252310 - DNA, 20 bp, Homo sapiens
ttgagcgtacgatggaggcc

SEQ ID NO: 4252311 - DNA, 15 bp, Homo sapiens
ttgaggaactgtaca

SEQ ID NO: 4252312 - DNA, 15 bp, Homo sapiens
aaaaatatatactaa

SEQ ID NO: 4252313 - DNA, 17 bp, Homo sapiens
aaaacaaggatgaatta

SEQ ID NO: 4252314 - DNA, 13 bp, Homo sapiens
aaaaggaaagaaa

SEQ ID NO: 4252315 - DNA, 14 bp, Homo sapiens
aaaaggaaagaaaa

SEQ ID NO: 4252316 - DNA, 11 bp, Homo sapiens
aaaataatttt

SEQ ID NO: 4252317 - DNA, 15 bp, Homo sapiens
aaaatggtctctaac

SEQ ID NO: 4252318 - DNA, 22 bp, Homo sapiens
aaaattttttctctaggaaata

SEQ ID NO: 4252319 - DNA, 17 bp, Homo sapiens
aaacaaggatgaattaa

SEQ ID NO: 4252320 - DNA, 14 bp, Homo sapiens
aaacacaactatat

SEQ ID NO: 4252321 - DNA, 21 bp, Homo sapiens
aaacatatataacaatgctgt

SEQ ID NO: 4252322 - DNA, 19 bp, Homo sapiens
aaacccttgccatgtgcta

SEQ ID NO: 4252323 - DNA, 15 bp, Homo sapiens
aaactcgttaatttg

SEQ ID NO: 4252324 - DNA, 19 bp, Homo sapiens
aaagaacggaagaagagat

SEQ ID NO: 4252325 - DNA, 17 bp, Homo sapiens
aaagcatccctcaccca

SEQ ID NO: 4252326 - DNA, 24 bp, Homo sapiens
aaagcatccctcacccatcctaga

SEQ ID NO: 4252327 - DNA, 16 bp, Homo sapiens
aaaggacatcagcaaa

SEQ ID NO: 4252328 - DNA, 15 bp, Homo sapiens
aaatccatacatttg

SEQ ID NO: 4252329 - DNA, 18 bp, Homo sapiens
aaatccatacatttgtgt

SEQ ID NO: 4252330 - DNA, 14 bp, Homo sapiens
aaatccttgaagat

SEQ ID NO: 4252331 - DNA, 18 bp, Homo sapiens
aaatggcttcctggcaat

SEQ ID NO: 4252332 - DNA, 23 bp, Homo sapiens
aaatgttgacatgggacatttgc

SEQ ID NO: 4252333 - DNA, 19 bp, Homo sapiens
aaattaaaccggaccatct

SEQ ID NO: 4252334 - DNA, 20 bp, Homo sapiens
aaatttttgtagtagcgttt

SEQ ID NO: 4252335 - DNA, 20 bp, Homo sapiens
aaattttttctctaggaaat

SEQ ID NO: 4252336 - DNA, 17 bp, Homo sapiens
aacaatgctgtatttta

SEQ ID NO: 4252337 - DNA, 17 bp, Homo sapiens
aacacaactatattgtt

SEQ ID NO: 4252338 - DNA, 12 bp, Homo sapiens
aacactcaccat

SEQ ID NO: 4252339 - DNA, 20 bp, Homo sapiens
aacataaaaaggacatcagc

SEQ ID NO: 4252340 - DNA, 12 bp, Homo sapiens
aacatatataac

SEQ ID NO: 4252341 - DNA, 12 bp, Homo sapiens
aacatctttaag

SEQ ID NO: 4252342 - DNA, 18 bp, Homo sapiens
aacatttggtaaggggaa

SEQ ID NO: 4252343 - DNA, 20 bp, Homo sapiens
aaccaaggttttgaaatccc

SEQ ID NO: 4252344 - DNA, 20 bp, Homo sapiens
aaccaagtgatcaaactaca

SEQ ID NO: 4252345 - DNA, 23 bp, Homo sapiens
aaccctaaataataaaaataaac

SEQ ID NO: 4252346 - DNA, 14 bp, Homo sapiens
aacctcatcctctc

SEQ ID NO: 4252347 - DNA, 13 bp, Homo sapiens
aaccttccaccca

SEQ ID NO: 4252348 - DNA, 15 bp, Homo sapiens
aaccttccacccagt

SEQ ID NO: 4252349 - DNA, 22 bp, Homo sapiens
aactacttctcttgttaggtaa

SEQ ID NO: 4252350 - DNA, 21 bp, Homo sapiens
aactagagtttagctggaaaa

SEQ ID NO: 4252351 - DNA, 15 bp, Homo sapiens
aactattgcatttat

SEQ ID NO: 4252352 - DNA, 21 bp, Homo sapiens
aactattgcatttatatgtac

SEQ ID NO: 4252353 - DNA, 19 bp, Homo sapiens
aactgactcttaagaagac

SEQ ID NO: 4252354 - DNA, 20 bp, Homo sapiens
aactgactcttaagaagact

SEQ ID NO: 4252355 - DNA, 19 bp, Homo sapiens
aacttaaattttagttctt

SEQ ID NO: 4252356 - DNA, 12 bp, Homo sapiens
aacttgaggaca

SEQ ID NO: 4252357 - DNA, 14 bp, Homo sapiens
aacttgaggacaca

SEQ ID NO: 4252358 - DNA, 19 bp, Homo sapiens
aacttgaggacacatgtcc

SEQ ID NO: 4252359 - DNA, 17 bp, Homo sapiens
aagaaacttgtccttcc

SEQ ID NO: 4252360 - DNA, 14 bp, Homo sapiens
aagaacggaagaag

SEQ ID NO: 4252361 - DNA, 17 bp, Homo sapiens
atgaggccagaccatgg

SEQ ID NO: 4252362 - DNA, 14 bp, Homo sapiens
atgattaagtaatg

SEQ ID NO: 4252363 - DNA, 18 bp, Homo sapiens
atgattaagtaatgataa

SEQ ID NO: 4252364 - DNA, 15 bp, Homo sapiens
atgcagaaagcatcc

SEQ ID NO: 4252365 - DNA, 16 bp, Homo sapiens
atgcagaaagcatccc

SEQ ID NO: 4252366 - DNA, 13 bp, Homo sapiens
atgcagttctgaa

SEQ ID NO: 4252367 - DNA, 15 bp, Homo sapiens
atgcagttctgaaga

SEQ ID NO: 4252368 - DNA, 19 bp, Homo sapiens
atgctctccaaaccacttt

SEQ ID NO: 4252369 - DNA, 22 bp, Homo sapiens
atgctgtattttaaaagaatga

SEQ ID NO: 4252370 - DNA, 14 bp, Homo sapiens
atgctgtgtgactc

SEQ ID NO: 4252371 - DNA, 15 bp, Homo sapiens
atggacactacaccc

SEQ ID NO: 4252372 - DNA, 16 bp, Homo sapiens
atggacactacaccca

SEQ ID NO: 4252373 - DNA, 19 bp, Homo sapiens
atggacactacacccagca

SEQ ID NO: 4252374 - DNA, 13 bp, Homo sapiens
atggagaaggaag

SEQ ID NO: 4252375 - DNA, 14 bp, Homo sapiens
atggagaaggaagg

SEQ ID NO: 4252376 - DNA, 12 bp, Homo sapiens
gaggccagacca

SEQ ID NO: 4252377 - DNA, 16 bp, Homo sapiens
gaggggcagagccagg

SEQ ID NO: 4252378 - DNA, 20 bp, Homo sapiens
gaggggcagagccaggaaga

SEQ ID NO: 4252379 - DNA, 15 bp, Homo sapiens
gaggtgagaccacct

SEQ ID NO: 4252380 - DNA, 16 bp, Homo sapiens
gaggtgagaccacctc

SEQ ID NO: 4252381 - DNA, 18 bp, Homo sapiens
gaggttgaaaaacaaaat

SEQ ID NO: 4252382 - DNA, 16 bp, Homo sapiens
gagtttagctggaaaa

SEQ ID NO: 4252383 - DNA, 15 bp, Homo sapiens
gataaatgatagaca

SEQ ID NO: 4252384 - DNA, 16 bp, Homo sapiens
gatcaggaagagaagg

SEQ ID NO: 4252385 - DNA, 14 bp, Homo sapiens
gatcctggaaatca

SEQ ID NO: 4252386 - DNA, 12 bp, Homo sapiens
gatctcagctca

SEQ ID NO: 4252387 - DNA, 16 bp, Homo sapiens
tattatgttaaaactg

SEQ ID NO: 4252388 - DNA, 11 bp, Homo sapiens
tattcaataaa

SEQ ID NO: 4252389 - DNA, 17 bp, Homo sapiens
tattgtctagtgaaact

SEQ ID NO: 4252390 - DNA, 15 bp, Homo sapiens
tattgttgaataaat

SEQ ID NO: 4252391 - DNA, 17 bp, Homo sapiens
tattgttgaataaatgt

SEQ ID NO: 4252392 - DNA, 13 bp, Homo sapiens
tatttattactgt

SEQ ID NO: 4252393 - DNA, 18 bp, Homo sapiens
tatttattttaataatgt

SEQ ID NO: 4252394 - DNA, 22 bp, Homo sapiens
tattttaataatgtttcaaaca

SEQ ID NO: 4252395 - DNA, 13 bp, Homo sapiens
tattttttgaaaa

SEQ ID NO: 4252396 - DNA, 21 bp, Homo sapiens
tcaaaatatgccccattcaac

SEQ ID NO: 4252397 - DNA, 16 bp, Homo sapiens
tcaaatccttgaagat

SEQ ID NO: 4252398 - DNA, 14 bp, Homo sapiens
tcaaattgtgtgaa

SEQ ID NO: 4252399 - DNA, 18 bp, Homo sapiens
tcaaattgtgtgaaaggt

SEQ ID NO: 4252400 - DNA, 22 bp, Homo sapiens
tcaactccaaactgactcttaa

SEQ ID NO: 4252401 - DNA, 22 bp, Homo sapiens
tcaagaacacagccctgcttct

SEQ ID NO: 4252402 - DNA, 21 bp, Homo sapiens
tcaataaaatccatacatttg

SEQ ID NO: 4252403 - DNA, 16 bp, Homo sapiens
tcacagacctttgaac

SEQ ID NO: 4252404 - DNA, 15 bp, Homo sapiens
tcaccagagacttta

SEQ ID NO: 4252405 - DNA, 23 bp, Homo sapiens
tcacccctaaaagaaaccctgca

SEQ ID NO: 4252406 - DNA, 12 bp, Homo sapiens
tcacctcatgga

SEQ ID NO: 4252407 - DNA, 13 bp, Homo sapiens
tcacctcatggaa

SEQ ID NO: 4252408 - DNA, 17 bp, Homo sapiens
tcacgtttggtgcttct

SEQ ID NO: 4252409 - DNA, 17 bp, Homo sapiens
tgacttatagtacatga

SEQ ID NO: 4252410 - DNA, 16 bp, Homo sapiens
tgagagacacactgaa

SEQ ID NO: 4252411 - DNA, 17 bp, Homo sapiens
tgagagacacactgaag

SEQ ID NO: 4252412 - DNA, 20 bp, Homo sapiens
tgagagacacactgaagaag

SEQ ID NO: 4252413 - DNA, 12 bp, Homo sapiens
tgaggacacatg

SEQ ID NO: 4252414 - DNA, 14 bp, Homo sapiens
tgaggacacatgtc

SEQ ID NO: 4252415 - DNA, 16 bp, Homo sapiens
tgaggacacatgtcca

SEQ ID NO: 4252416 - DNA, 16 bp, Homo sapiens
tgaggggctaccagga

SEQ ID NO: 4252417 - DNA, 17 bp, Homo sapiens
tgaggggctaccaggaa

SEQ ID NO: 4252418 - DNA, 17 bp, Homo sapiens
tgagtagagttgatcaa

SEQ ID NO: 4252419 - DNA, 12 bp, Homo sapiens
tgatatgggtct

SEQ ID NO: 4252420 - DNA, 19 bp, Homo sapiens
tgatctcagctcactgcaa

SEQ ID NO: 4252421 - DNA, 12 bp, Homo sapiens
tgatggagaagg

SEQ ID NO: 4252422 - DNA, 13 bp, Homo sapiens
tgatggagaagga

SEQ ID NO: 4252423 - DNA, 14 bp, Homo sapiens
tgatggagaaggaa

SEQ ID NO: 4252424 - DNA, 15 bp, Homo sapiens
tgatggagaaggaag

SEQ ID NO: 4252425 - DNA, 15 bp, Homo sapiens
tgatggtggtatgtt

SEQ ID NO: 4252426 - DNA, 22 bp, Homo sapiens
tgatgtttagaaacacaactat

SEQ ID NO: 4252427 - DNA, 15 bp, Homo sapiens
tgattaagtaatgat

SEQ ID NO: 4252428 - DNA, 12 bp, Homo sapiens
tgcaaatttcat

SEQ ID NO: 4252429 - DNA, 15 bp, Homo sapiens
tgcaacctccacctc

SEQ ID NO: 4252430 - DNA, 20 bp, Homo sapiens
tgcacacctactagtcacca

SEQ ID NO: 4252431 - DNA, 15 bp, Homo sapiens
tgcacatcaaaatat

SEQ ID NO: 4252432 - DNA, 16 bp, Homo sapiens
tgcactggccccaccc

SEQ ID NO: 4252433 - DNA, 17 bp, Homo sapiens
tgcactggccccaccct

SEQ ID NO: 4252434 - DNA, 13 bp, Homo sapiens
tgcagaaagcatc

SEQ ID NO: 4252435 - DNA, 16 bp, Homo sapiens
tgcagtctctatacca

SEQ ID NO: 4252436 - DNA, 18 bp, Homo sapiens
ttctccatggccctgcca

SEQ ID NO: 4252437 - DNA, 12 bp, Homo sapiens
ttctctaggaaa

SEQ ID NO: 4252438 - DNA, 12 bp, Homo sapiens
ttctgaagaaga

SEQ ID NO: 4252439 - DNA, 14 bp, Homo sapiens
ttctgaagaagatg

SEQ ID NO: 4252440 - DNA, 14 bp, Homo sapiens
ttctgaataaagca

SEQ ID NO: 4252441 - DNA, 16 bp, Homo sapiens
ttctgaataaagcaat

SEQ ID NO: 4252442 - DNA, 22 bp, Homo sapiens
ttctggtatgaacttgaggaca

SEQ ID NO: 4252443 - DNA, 16 bp, Homo sapiens
ttctgttttataattt

SEQ ID NO: 4252444 - DNA, 14 bp, Homo sapiens
ttcttactgcttaa

SEQ ID NO: 4252445 - DNA, 15 bp, Homo sapiens
ttctttaaaattaca

SEQ ID NO: 4252446 - DNA, 19 bp, Homo sapiens
ttgaaatattgacttttta

SEQ ID NO: 4252447 - DNA, 17 bp, Homo sapiens
ttgaaattatgtgacat

SEQ ID NO: 4252448 - DNA, 20 bp, Homo sapiens
ttgaaattatgtgacatttt

SEQ ID NO: 4252449 - DNA, 13 bp, Homo sapiens
ttgacatgggaca

SEQ ID NO: 4252450 - DNA, 21 bp, Homo sapiens
ttgacctgcctcccttcatgc

SEQ ID NO: 4252451 - DNA, 22 bp, Homo sapiens
ttgacctgcctcccttcatgca

SEQ ID NO: 4252452 - DNA, 18 bp, Homo sapiens
ttgacttatagtacatga

SEQ ID NO: 4252453 - DNA, 19 bp, Homo sapiens
ttgagaaaaatatatacta

SEQ ID NO: 4252454 - DNA, 12 bp, Homo sapiens
ttgatgaagaag

SEQ ID NO: 4252455 - DNA, 13 bp, Homo sapiens
ttgccttaaaata

SEQ ID NO: 4252456 - DNA, 18 bp, Homo sapiens
ttgctaagcattccaact

SEQ ID NO: 4252457 - DNA, 11 bp, Homo sapiens
ttgctgagcct

SEQ ID NO: 4252458 - DNA, 20 bp, Homo sapiens
ttgctttgtattgtatatta

SEQ ID NO: 4252459 - DNA, 15 bp, Homo sapiens
ttgtataaaataatt

SEQ ID NO: 4252460 - DNA, 19 bp, Homo sapiens
ttgtataaaataattttta

SEQ ID NO: 4252461 - DNA, 13 bp, Homo sapiens
ttgtatattacaa

SEQ ID NO: 4252462 - DNA, 18 bp, Homo sapiens
ttgtgaagcaaaattttt

SEQ ID NO: 4252463 - DNA, 18 bp, Homo sapiens
ttgttaatcttcaatagt

SEQ ID NO: 4252464 - DNA, 22 bp, Homo sapiens
ttgttgaataaatgtatctgaa

SEQ ID NO: 4252465 - DNA, 14 bp, Homo sapiens
tttaataatgtttc

SEQ ID NO: 4252466 - DNA, 17 bp, Homo sapiens
tttacaatagttctgtg

SEQ ID NO: 4252467 - DNA, 20 bp, Homo sapiens
tttagaaacacaactatatt

SEQ ID NO: 4252468 - DNA, 20 bp, Homo sapiens
tttagctggaaaagtatgtt

SEQ ID NO: 4252469 - DNA, 22 bp, Homo sapiens
tttaggaagttgacttatagta

SEQ ID NO: 4252470 - DNA, 21 bp, Homo sapiens
tttatatgtaccgtaggcttt

SEQ ID NO: 4252471 - DNA, 17 bp, Homo sapiens
tttatggcactagtatt

SEQ ID NO: 4252472 - DNA, 16 bp, Homo sapiens
tttattactgtaagaa

SEQ ID NO: 4252473 - DNA, 16 bp, Homo sapiens
tttattttaataatgt

SEQ ID NO: 4252474 - DNA, 15 bp, Homo sapiens
tttccacagaagctc

SEQ ID NO: 4252475 - DNA, 22 bp, Homo sapiens
tttgaaattatgtgacatttta

SEQ ID NO: 4252476 - DNA, 14 bp, Homo sapiens
tttgcaagccagat

SEQ ID NO: 4252477 - DNA, 13 bp, Homo sapiens
tttggcaggtgca

SEQ ID NO: 4252478 - DNA, 13 bp, Homo sapiens
tttgtataaaata

SEQ ID NO: 4252479 - DNA, 21 bp, Homo sapiens
tttgtataaaataatttttat

SEQ ID NO: 4252480 - DNA, 16 bp, Homo sapiens
ttttaaatgtatacta

SEQ ID NO: 4252481 - DNA, 21 bp, Homo sapiens
ttttataattttgtgaagcaa

SEQ ID NO: 4252482 - DNA, 18 bp, Homo sapiens
ttttatatttgaaatatt

SEQ ID NO: 4252483 - DNA, 14 bp, Homo sapiens
ttttcaaaagaaag

SEQ ID NO: 4252484 - DNA, 20 bp, Homo sapiens
ttttcaggctagatgtatgt

SEQ ID NO: 4252485 - DNA, 14 bp, Homo sapiens
ttttcctgaaaacc

SEQ ID NO: 4252486 - DNA, 16 bp, Homo sapiens
tttttgagacagagtc

SEQ ID NO: 4252487 - DNA, 20 bp, Homo sapiens
tttttgggcagcaatttaaa

SEQ ID NO: 4252488 - DNA, 11 bp, Homo sapiens
tttttgtagta

SEQ ID NO: 4252489 - DNA, 12 bp, Homo sapiens
ttttttacattt

SEQ ID NO: 4252490 - DNA, 12 bp, Homo sapiens
tttttttacatt

SEQ ID NO: 4252491 - DNA, 17 bp, Homo sapiens
aaaaagaatgaagcctc

SEQ ID NO: 4252492 - DNA, 14 bp, Homo sapiens
aaaacaaggatgaa

SEQ ID NO: 4252493 - DNA, 15 bp, Homo sapiens
aaaagaaaatttttg

SEQ ID NO: 4252494 - DNA, 11 bp, Homo sapiens
aaaagaatgat

SEQ ID NO: 4252495 - DNA, 19 bp, Homo sapiens
aaaaggacatcagcaaaca

SEQ ID NO: 4252496 - DNA, 21 bp, Homo sapiens
aaaataatttttatatttgaa

SEQ ID NO: 4252497 - DNA, 13 bp, Homo sapiens
aaaatatatacta

SEQ ID NO: 4252498 - DNA, 17 bp, Homo sapiens
aaaatatatactaaaca

SEQ ID NO: 4252499 - DNA, 19 bp, Homo sapiens
aaaatattgttttacaata

SEQ ID NO: 4252500 - DNA, 16 bp, Homo sapiens
aaaatctcaatatttc

SEQ ID NO: 4252501 - DNA, 20 bp, Homo sapiens
aaaattaaaccggaccatct

SEQ ID NO: 4252502 - DNA, 15 bp, Homo sapiens
aaacaccctcacact

SEQ ID NO: 4252503 - DNA, 18 bp, Homo sapiens
aaaccaaatcactgaact

SEQ ID NO: 4252504 - DNA, 16 bp, Homo sapiens
aaagaaaagaaaattt

SEQ ID NO: 4252505 - DNA, 19 bp, Homo sapiens
aaagaaaatttttgtagta

SEQ ID NO: 4252506 - DNA, 18 bp, Homo sapiens
aaagagaacttccagatc

SEQ ID NO: 4252507 - DNA, 15 bp, Homo sapiens
aaaggaaagaaaaca

SEQ ID NO: 4252508 - DNA, 14 bp, Homo sapiens
aaaggacatcagca

SEQ ID NO: 4252509 - DNA, 18 bp, Homo sapiens
aaagtatgttagtgcaaa

SEQ ID NO: 4252510 - DNA, 18 bp, Homo sapiens
aaataatttttatatttg

SEQ ID NO: 4252511 - DNA, 21 bp, Homo sapiens
aaataatttttatatttgaaa

SEQ ID NO: 4252512 - DNA, 23 bp, Homo sapiens
aaatagtctctttaaaaggaaag

SEQ ID NO: 4252513 - DNA, 22 bp, Homo sapiens
aaatattgttttacaatagttc

SEQ ID NO: 4252514 - DNA, 20 bp, Homo sapiens
aaatatttattttaataatg

SEQ ID NO: 4252515 - DNA, 13 bp, Homo sapiens
aaatggaaactat

SEQ ID NO: 4252516 - DNA, 19 bp, Homo sapiens
aaatggcttcctggcaata

SEQ ID NO: 4252517 - DNA, 15 bp, Homo sapiens
aaatgtatctgaata

SEQ ID NO: 4252518 - DNA, 22 bp, Homo sapiens
aaatgttgacatgggacatttg

SEQ ID NO: 4252519 - DNA, 17 bp, Homo sapiens
aaattatgtgacatttt

SEQ ID NO: 4252520 - DNA, 16 bp, Homo sapiens
aaattcccttcatctg

SEQ ID NO: 4252521 - DNA, 18 bp, Homo sapiens
aaattcccttcatctgga

SEQ ID NO: 4252522 - DNA, 18 bp, Homo sapiens
aaattgctttgtattgta

SEQ ID NO: 4252523 - DNA, 22 bp, Homo sapiens
aaatttatttcaatattagcaa

SEQ ID NO: 4252524 - DNA, 12 bp, Homo sapiens
aaatttgccaag

SEQ ID NO: 4252525 - DNA, 17 bp, Homo sapiens
aaatttttgtagtagcg

SEQ ID NO: 4252526 - DNA, 15 bp, Homo sapiens
aaattttttttacat

SEQ ID NO: 4252527 - DNA, 14 bp, Homo sapiens
aacaatgctgtatt

SEQ ID NO: 4252528 - DNA, 22 bp, Homo sapiens
aacaatgctgtattttaaaaga

SEQ ID NO: 4252529 - DNA, 17 bp, Homo sapiens
aacaccctcacactggg

SEQ ID NO: 4252530 - DNA, 18 bp, Homo sapiens
aacatctttaaggggagg

SEQ ID NO: 4252531 - DNA, 10 bp, Homo sapiens
aaccaagttc

SEQ ID NO: 4252532 - DNA, 14 bp, Homo sapiens
aaccctagcaaaag

SEQ ID NO: 4252533 - DNA, 12 bp, Homo sapiens
aacggagtcaaa

SEQ ID NO: 4252534 - DNA, 15 bp, Homo sapiens
aactaagaaacttaa

SEQ ID NO: 4252535 - DNA, 19 bp, Homo sapiens
aactaagaaacttaaattt

SEQ ID NO: 4252536 - DNA, 23 bp, Homo sapiens
aactatctcatttccaagcaagt

SEQ ID NO: 4252537 - DNA, 14 bp, Homo sapiens
aactccagaaagtg

SEQ ID NO: 4252538 - DNA, 16 bp, Homo sapiens
aactcttcaaggtctg

SEQ ID NO: 4252539 - DNA, 12 bp, Homo sapiens
aactgaaatcat

SEQ ID NO: 4252540 - DNA, 13 bp, Homo sapiens
aactgaaatcata

SEQ ID NO: 4252541 - DNA, 17 bp, Homo sapiens
aactgatccagcaatta

SEQ ID NO: 4252542 - DNA, 18 bp, Homo sapiens
aactgttgtagaagacaa

SEQ ID NO: 4252543 - DNA, 19 bp, Homo sapiens
aactgttgtagaagacaaa

SEQ ID NO: 4252544 - DNA, 18 bp, Homo sapiens
aacttcagcggtttatat

SEQ ID NO: 4252545 - DNA, 18 bp, Homo sapiens
aacttccagatcctggaa

SEQ ID NO: 4252546 - DNA, 15 bp, Homo sapiens
aactttgctgagcct

SEQ ID NO: 4252547 - DNA, 13 bp, Homo sapiens
aagaaaatatcac

SEQ ID NO: 4252548 - DNA, 21 bp, Homo sapiens
aagaaactggggctcctccag

SEQ ID NO: 4252549 - DNA, 14 bp, Homo sapiens
aagaaagaacggaa

SEQ ID NO: 4252550 - DNA, 11 bp, Homo sapiens
aagaactgaaa

SEQ ID NO: 4252551 - DNA, 12 bp, Homo sapiens
aagaactgaaat

SEQ ID NO: 4252552 - DNA, 13 bp, Homo sapiens
aagaactgaaatc

SEQ ID NO: 4252553 - DNA, 15 bp, Homo sapiens
aagaactgaaatcat

SEQ ID NO: 4252554 - DNA, 16 bp, Homo sapiens
aagagatcaggaagag

SEQ ID NO: 4252555 - DNA, 20 bp, Homo sapiens
aagcaagtaaaaaggctaaa

SEQ ID NO: 4252556 - DNA, 16 bp, Homo sapiens
aagcaagtattagaat

SEQ ID NO: 4252557 - DNA, 23 bp, Homo sapiens
aagcatccctcacccatcctaga

SEQ ID NO: 4252558 - DNA, 22 bp, Homo sapiens
aagccattctcctgcctcagcc

SEQ ID NO: 4252559 - DNA, 15 bp, Homo sapiens
aagcgcctccaaccc

SEQ ID NO: 4252560 - DNA, 16 bp, Homo sapiens
aagcgcctccaaccct

SEQ ID NO: 4252561 - DNA, 20 bp, Homo sapiens
aagcgcctccaaccctagca

SEQ ID NO: 4252562 - DNA, 21 bp, Homo sapiens
aagctgctgagaatctagcct

SEQ ID NO: 4252563 - DNA, 17 bp, Homo sapiens
aaggacatcagcaaaca

SEQ ID NO: 4252564 - DNA, 15 bp, Homo sapiens
aaggaggacccagga

SEQ ID NO: 4252565 - DNA, 17 bp, Homo sapiens
aaggaggacccaggaca

SEQ ID NO: 4252566 - DNA, 18 bp, Homo sapiens
aaggaggacccaggacag

SEQ ID NO: 4252567 - DNA, 14 bp, Homo sapiens
aaggcagggaggag

SEQ ID NO: 4252568 - DNA, 19 bp, Homo sapiens
aaggcattataaaaagaat

SEQ ID NO: 4252569 - DNA, 20 bp, Homo sapiens
aaggcctggtgtttcttgat

SEQ ID NO: 4252570 - DNA, 17 bp, Homo sapiens
aaggggaattgaggaca

SEQ ID NO: 4252571 - DNA, 23 bp, Homo sapiens
aagtaactgggattacaggcatg

SEQ ID NO: 4252572 - DNA, 23 bp, Homo sapiens
attaagtaatgataactggaaac

SEQ ID NO: 4252573 - DNA, 15 bp, Homo sapiens
attacaacggagtca

SEQ ID NO: 4252574 - DNA, 18 bp, Homo sapiens
attacatttgtataaaat

SEQ ID NO: 4252575 - DNA, 22 bp, Homo sapiens
attatctatagctaagtacaca

SEQ ID NO: 4252576 - DNA, 18 bp, Homo sapiens
attatgaattacatttgt

SEQ ID NO: 4252577 - DNA, 12 bp, Homo sapiens
attcaataaagc

SEQ ID NO: 4252578 - DNA, 12 bp, Homo sapiens
attcattccatt

SEQ ID NO: 4252579 - DNA, 11 bp, Homo sapiens
attccatcctt

SEQ ID NO: 4252580 - DNA, 20 bp, Homo sapiens
attctcctgcctcagcctcc

SEQ ID NO: 4252581 - DNA, 17 bp, Homo sapiens
attggagctcgtgggac

SEQ ID NO: 4252582 - DNA, 19 bp, Homo sapiens
attggagctcgtgggacag

SEQ ID NO: 4252583 - DNA, 15 bp, Homo sapiens
attgtatattacaat

SEQ ID NO: 4252584 - DNA, 17 bp, Homo sapiens
attgtatattacaatga

SEQ ID NO: 4252585 - DNA, 19 bp, Homo sapiens
attgtatattacaatgatc

SEQ ID NO: 4252586 - DNA, 13 bp, Homo sapiens
attgtctagtgaa

SEQ ID NO: 4252587 - DNA, 13 bp, Homo sapiens
attgttttacaat

SEQ ID NO: 4252588 - DNA, 17 bp, Homo sapiens
attgttttacaatagtt

SEQ ID NO: 4252589 - DNA, 13 bp, Homo sapiens
atttagatgtata

SEQ ID NO: 4252590 - DNA, 20 bp, Homo sapiens
atttattactgtaagaaaat

SEQ ID NO: 4252591 - DNA, 14 bp, Homo sapiens
atttattttaataa

SEQ ID NO: 4252592 - DNA, 17 bp, Homo sapiens
atttattttaataatgt

SEQ ID NO: 4252593 - DNA, 14 bp, Homo sapiens
atttccctctctca

SEQ ID NO: 4252594 - DNA, 14 bp, Homo sapiens
atttgaaatattga

SEQ ID NO: 4252595 - DNA, 17 bp, Homo sapiens
atttgctcatggaattg

SEQ ID NO: 4252596 - DNA, 16 bp, Homo sapiens
attttaaaaaatggtc

SEQ ID NO: 4252597 - DNA, 12 bp, Homo sapiens
attttaataatg

SEQ ID NO: 4252598 - DNA, 14 bp, Homo sapiens
attttaataatgtt

SEQ ID NO: 4252599 - DNA, 18 bp, Homo sapiens
attttaataatgtttcaa

SEQ ID NO: 4252600 - DNA, 15 bp, Homo sapiens
atttttgtagtagcg

SEQ ID NO: 4252601 - DNA, 20 bp, Homo sapiens
attttttctctaggaaatat

SEQ ID NO: 4252602 - DNA, 19 bp, Homo sapiens
attttttgaaaagcagaca

SEQ ID NO: 4252603 - DNA, 15 bp, Homo sapiens
caaaaaactacttct

SEQ ID NO: 4252604 - DNA, 19 bp, Homo sapiens
caaaaatctcaatatttca

SEQ ID NO: 4252605 - DNA, 17 bp, Homo sapiens
caaaaattatctatagc

SEQ ID NO: 4252606 - DNA, 19 bp, Homo sapiens
caaaaattatctatagcta

SEQ ID NO: 4252607 - DNA, 19 bp, Homo sapiens
caaaagcccattcattcca

SEQ ID NO: 4252608 - DNA, 21 bp, Homo sapiens
caaaattttttctctaggaaa

SEQ ID NO: 4252609 - DNA, 20 bp, Homo sapiens
caaacaggatcagttaacta

SEQ ID NO: 4252610 - DNA, 17 bp, Homo sapiens
caaacatatataacaat

SEQ ID NO: 4252611 - DNA, 17 bp, Homo sapiens
caaaccactttttgcag

SEQ ID NO: 4252612 - DNA, 19 bp, Homo sapiens
caaagtcctgggattacag

SEQ ID NO: 4252613 - DNA, 14 bp, Homo sapiens
caaatcactgaact

SEQ ID NO: 4252614 - DNA, 13 bp, Homo sapiens
caacggagtcaaa

SEQ ID NO: 4252615 - DNA, 19 bp, Homo sapiens
caactatattgtttgctaa

SEQ ID NO: 4252616 - DNA, 21 bp, Homo sapiens
caactatctcatttccaagca

SEQ ID NO: 4252617 - DNA, 15 bp, Homo sapiens
caactgctaatctac

SEQ ID NO: 4252618 - DNA, 16 bp, Homo sapiens
caagcatttagatgta

SEQ ID NO: 4252619 - DNA, 19 bp, Homo sapiens
caatagtcaaattgtgtga

SEQ ID NO: 4252620 - DNA, 16 bp, Homo sapiens
caatattcaataaagc

SEQ ID NO: 4252621 - DNA, 20 bp, Homo sapiens
caatatttcagataatcaca

SEQ ID NO: 4252622 - DNA, 15 bp, Homo sapiens
caatgctgtatttta

SEQ ID NO: 4252623 - DNA, 16 bp, Homo sapiens
caatgctgtattttaa

SEQ ID NO: 4252624 - DNA, 17 bp, Homo sapiens
caatgctgtattttaaa

SEQ ID NO: 4252625 - DNA, 14 bp, Homo sapiens
caattaattttaga

SEQ ID NO: 4252626 - DNA, 23 bp, Homo sapiens
caattgagaaaaatatatactaa

SEQ ID NO: 4252627 - DNA, 18 bp, Homo sapiens
cacaagactgcacatcaa

SEQ ID NO: 4252628 - DNA, 18 bp, Homo sapiens
cacacacatgcttccctt

SEQ ID NO: 4252629 - DNA, 17 bp, Homo sapiens
cacacatgaagtccaag

SEQ ID NO: 4252630 - DNA, 18 bp, Homo sapiens
cacacatgcttccctttc

SEQ ID NO: 4252631 - DNA, 15 bp, Homo sapiens
cacagctgcctcttc

SEQ ID NO: 4252632 - DNA, 20 bp, Homo sapiens
cacaggaaccacaagactgc

SEQ ID NO: 4252633 - DNA, 21 bp, Homo sapiens
cacagggcctttggcaggtgc

SEQ ID NO: 4252634 - DNA, 16 bp, Homo sapiens
cacatgaagtccaagc

SEQ ID NO: 4252635 - DNA, 12 bp, Homo sapiens
cacatgtccagt

SEQ ID NO: 4252636 - DNA, 13 bp, Homo sapiens
cacccagcaatag

SEQ ID NO: 4252637 - DNA, 20 bp, Homo sapiens
cacccaggttggagtgcagt

SEQ ID NO: 4252638 - DNA, 13 bp, Homo sapiens
caccctcatgctg

SEQ ID NO: 4252639 - DNA, 17 bp, Homo sapiens
caccctcgtggacacct

SEQ ID NO: 4252640 - DNA, 18 bp, Homo sapiens
caccctcgtggacacctg

SEQ ID NO: 4252641 - DNA, 21 bp, Homo sapiens
caccctcgtggacacctgccc

SEQ ID NO: 4252642 - DNA, 15 bp, Homo sapiens
caccgactgaaaata

SEQ ID NO: 4252643 - DNA, 13 bp, Homo sapiens
caccgcagaagga

SEQ ID NO: 4252644 - DNA, 11 bp, Homo sapiens
cacctcatgga

SEQ ID NO: 4252645 - DNA, 17 bp, Homo sapiens
cacctccctcaacctca

SEQ ID NO: 4252646 - DNA, 15 bp, Homo sapiens
cacctcctgcctcag

SEQ ID NO: 4252647 - DNA, 13 bp, Homo sapiens
cacctctcaatat

SEQ ID NO: 4252648 - DNA, 22 bp, Homo sapiens
cacctgccctgccctgccacct

SEQ ID NO: 4252649 - DNA, 23 bp, Homo sapiens
cacctgccctgccctgccacctg

SEQ ID NO: 4252650 - DNA, 11 bp, Homo sapiens
cacctgtctgt

SEQ ID NO: 4252651 - DNA, 16 bp, Homo sapiens
cacctgtctgtctgtc

SEQ ID NO: 4252652 - DNA, 22 bp, Homo sapiens
cacctgtggaacataaaaagga

SEQ ID NO: 4252653 - DNA, 15 bp, Homo sapiens
cactacacccagcaa

SEQ ID NO: 4252654 - DNA, 21 bp, Homo sapiens
cactacacccagcaatagaga

SEQ ID NO: 4252655 - DNA, 14 bp, Homo sapiens
cactagtatttcta

SEQ ID NO: 4252656 - DNA, 13 bp, Homo sapiens
cactgcaacctcc

SEQ ID NO: 4252657 - DNA, 14 bp, Homo sapiens
cactgcaacctcca

SEQ ID NO: 4252658 - DNA, 14 bp, Homo sapiens
cactgcaacctctg

SEQ ID NO: 4252659 - DNA, 12 bp, Homo sapiens
cactgcctttga

SEQ ID NO: 4252660 - DNA, 13 bp, Homo sapiens
cactggcgaggag

SEQ ID NO: 4252661 - DNA, 19 bp, Homo sapiens
cactgtgggtagacacaca

SEQ ID NO: 4252662 - DNA, 22 bp, Homo sapiens
cagaaagcatccctcacccatc

SEQ ID NO: 4252663 - DNA, 20 bp, Homo sapiens
cagaaggaaggcagggagga

SEQ ID NO: 4252664 - DNA, 21 bp, Homo sapiens
cagaatgagacatccagcaga

SEQ ID NO: 4252665 - DNA, 22 bp, Homo sapiens
cagaccatggacactacaccca

SEQ ID NO: 4252666 - DNA, 18 bp, Homo sapiens
cagagaagaaagaacgga

SEQ ID NO: 4252667 - DNA, 19 bp, Homo sapiens
cagagaagaaagaacggaa

SEQ ID NO: 4252668 - DNA, 15 bp, Homo sapiens
cagagccaggaagat

SEQ ID NO: 4252669 - DNA, 22 bp, Homo sapiens
cagagctggagatgaggccaga

SEQ ID NO: 4252670 - DNA, 12 bp, Homo sapiens
cagatcctggaa

SEQ ID NO: 4252671 - DNA, 13 bp, Homo sapiens
cagatcctggaaa

SEQ ID NO: 4252672 - DNA, 15 bp, Homo sapiens
cagatttctgaggaa

SEQ ID NO: 4252673 - DNA, 15 bp, Homo sapiens
cagattttcctgaaa

SEQ ID NO: 4252674 - DNA, 14 bp, Homo sapiens
cagcaacaataaat

SEQ ID NO: 4252675 - DNA, 15 bp, Homo sapiens
cagcccttctttcca

SEQ ID NO: 4252676 - DNA, 21 bp, Homo sapiens
cagcgagataccccacctccc

SEQ ID NO: 4252677 - DNA, 14 bp, Homo sapiens
cagctttagccaag

SEQ ID NO: 4252678 - DNA, 21 bp, Homo sapiens
cagctttatggagatataatt

SEQ ID NO: 4252679 - DNA, 20 bp, Homo sapiens
caggaaagcgcctccaaccc

SEQ ID NO: 4252680 - DNA, 15 bp, Homo sapiens
caggaagagaaggag

SEQ ID NO: 4252681 - DNA, 13 bp, Homo sapiens
caggatccaggcc

SEQ ID NO: 4252682 - DNA, 21 bp, Homo sapiens
caggatggttcccttgatgaa

SEQ ID NO: 4252683 - DNA, 19 bp, Homo sapiens
caggctagatgtatgtact

SEQ ID NO: 4252684 - DNA, 15 bp, Homo sapiens
cagggggcaagagga

SEQ ID NO: 4252685 - DNA, 12 bp, Homo sapiens
cagggtggcagc

SEQ ID NO: 4252686 - DNA, 20 bp, Homo sapiens
caggtgcagcccccactgcc

SEQ ID NO: 4252687 - DNA, 22 bp, Homo sapiens
cagtaggggcttataataaagg

SEQ ID NO: 4252688 - DNA, 21 bp, Homo sapiens
cagtatgggttagggaaaaca

SEQ ID NO: 4252689 - DNA, 15 bp, Homo sapiens
cagtcacctcatgga

SEQ ID NO: 4252690 - DNA, 19 bp, Homo sapiens
cagtcacctcatggaattg

SEQ ID NO: 4252691 - DNA, 13 bp, Homo sapiens
cagtccctccaca

SEQ ID NO: 4252692 - DNA, 17 bp, Homo sapiens
cagtctctataccaata

SEQ ID NO: 4252693 - DNA, 19 bp, Homo sapiens
cagtctctataccaataaa

SEQ ID NO: 4252694 - DNA, 22 bp, Homo sapiens
cagtctctataccaataaagtg

SEQ ID NO: 4252695 - DNA, 21 bp, Homo sapiens
cagtggcgcgatctcagctca

SEQ ID NO: 4252696 - DNA, 21 bp, Homo sapiens
cagtggcgtgatctcagctca

SEQ ID NO: 4252697 - DNA, 17 bp, Homo sapiens
gccggatctgagggaga

SEQ ID NO: 4252698 - DNA, 18 bp, Homo sapiens
gcctattgttgaataaat

SEQ ID NO: 4252699 - DNA, 16 bp, Homo sapiens
gcctccaaccctagca

SEQ ID NO: 4252700 - DNA, 14 bp, Homo sapiens
gcctcccatgttca

SEQ ID NO: 4252701 - DNA, 20 bp, Homo sapiens
gcctcccttcatgcatggaa

SEQ ID NO: 4252702 - DNA, 19 bp, Homo sapiens
gcctccttagaaaaaaaat

SEQ ID NO: 4252703 - DNA, 15 bp, Homo sapiens
gcctcttagatgcag

SEQ ID NO: 4252704 - DNA, 20 bp, Homo sapiens
gcctgagtgacagagcaaga

SEQ ID NO: 4252705 - DNA, 22 bp, Homo sapiens
gcctgcctcccctgcctcacca

SEQ ID NO: 4252706 - DNA, 19 bp, Homo sapiens
gccttctctaaacatttca

SEQ ID NO: 4252707 - DNA, 15 bp, Homo sapiens
gcctttggcaggtgc

SEQ ID NO: 4252708 - DNA, 23 bp, Homo sapiens
gcgaggcctattgttgaataaat

SEQ ID NO: 4252709 - DNA, 15 bp, Homo sapiens
gcgcgatctcagctc

SEQ ID NO: 4252710 - DNA, 23 bp, Homo sapiens
gcggaggaaggaggacccaggac

SEQ ID NO: 4252711 - DNA, 20 bp, Homo sapiens
gctcactgcaacctctgcct

SEQ ID NO: 4252712 - DNA, 21 bp, Homo sapiens
gctcctattcaacacacacat

SEQ ID NO: 4252713 - DNA, 22 bp, Homo sapiens
gctctccaaaccactttttgca

SEQ ID NO: 4252714 - DNA, 17 bp, Homo sapiens
gctctcctccacctcaa

SEQ ID NO: 4252715 - DNA, 17 bp, Homo sapiens
gctgaatttccctctct

SEQ ID NO: 4252716 - DNA, 21 bp, Homo sapiens
gctggagatgaggccagacca

SEQ ID NO: 4252717 - DNA, 20 bp, Homo sapiens
gctggagtgcagtggcgcga

SEQ ID NO: 4252718 - DNA, 20 bp, Homo sapiens
gctgtctacactaagagaga

SEQ ID NO: 4252719 - DNA, 13 bp, Homo sapiens
gctgtttttttgt

SEQ ID NO: 4252720 - DNA, 15 bp, Homo sapiens
gcttaattcaaataa

SEQ ID NO: 4252721 - DNA, 17 bp, Homo sapiens
gcttataataaaggact

SEQ ID NO: 4252722 - DNA, 21 bp, Homo sapiens
gcttctcagatttctgaggaa

SEQ ID NO: 4252723 - DNA, 19 bp, Homo sapiens
gcttctgttttataatttt

SEQ ID NO: 4252724 - DNA, 15 bp, Homo sapiens
ggaaaacattccatc

SEQ ID NO: 4252725 - DNA, 12 bp, Homo sapiens
ggaaatatttat

SEQ ID NO: 4252726 - DNA, 13 bp, Homo sapiens
ggaaatatttatt

SEQ ID NO: 4252727 - DNA, 20 bp, Homo sapiens
ggaagaagagatcaggaaga

SEQ ID NO: 4252728 - DNA, 21 bp, Homo sapiens
ggaagaagagatcaggaagag

SEQ ID NO: 4252729 - DNA, 18 bp, Homo sapiens
ggaagatcccccagaaaa

SEQ ID NO: 4252730 - DNA, 17 bp, Homo sapiens
ggaaggcagggaggagg

SEQ ID NO: 4252731 - DNA, 18 bp, Homo sapiens
ggaagttgacttatagta

SEQ ID NO: 4252732 - DNA, 19 bp, Homo sapiens
ggaattacgtgctctgtgg

SEQ ID NO: 4252733 - DNA, 10 bp, Homo sapiens
ggacacctgc

SEQ ID NO: 4252734 - DNA, 16 bp, Homo sapiens
ggacactacacccagc

SEQ ID NO: 4252735 - DNA, 17 bp, Homo sapiens
ggacactacacccagca

SEQ ID NO: 4252736 - DNA, 21 bp, Homo sapiens
ggacagtcacctcatggaatt

SEQ ID NO: 4252737 - DNA, 14 bp, Homo sapiens
ggacatcagcaaac

SEQ ID NO: 4252738 - DNA, 16 bp, Homo sapiens
ggacatttgctcatgg

SEQ ID NO: 4252739 - DNA, 17 bp, Homo sapiens
ggacatttgctcatgga

SEQ ID NO: 4252740 - DNA, 15 bp, Homo sapiens
ggaccagcttttccc

SEQ ID NO: 4252741 - DNA, 13 bp, Homo sapiens
ggacccaggacag

SEQ ID NO: 4252742 - DNA, 19 bp, Homo sapiens
ggacttgcaaaaagggtca

SEQ ID NO: 4252743 - DNA, 18 bp, Homo sapiens
ggagatgaggccagacca

SEQ ID NO: 4252744 - DNA, 12 bp, Homo sapiens
ggaggacccagg

SEQ ID NO: 4252745 - DNA, 14 bp, Homo sapiens
ggaggacccaggac

SEQ ID NO: 4252746 - DNA, 15 bp, Homo sapiens
ggaggacccaggaca

SEQ ID NO: 4252747 - DNA, 16 bp, Homo sapiens
ggaggggcagagccag

SEQ ID NO: 4252748 - DNA, 17 bp, Homo sapiens
ggaggtgagaccacctc

SEQ ID NO: 4252749 - DNA, 21 bp, Homo sapiens
ggatcagttaactattgcatt

SEQ ID NO: 4252750 - DNA, 22 bp, Homo sapiens
ggatggttcccttgatgaagaa

SEQ ID NO: 4252751 - DNA, 12 bp, Homo sapiens
ggcagagccagg

SEQ ID NO: 4252752 - DNA, 14 bp, Homo sapiens
ggcagagccaggaa

SEQ ID NO: 4252753 - DNA, 15 bp, Homo sapiens
ggcagcaatttaaat

SEQ ID NO: 4252754 - DNA, 16 bp, Homo sapiens
ggcagcaatttaaatg

SEQ ID NO: 4252755 - DNA, 23 bp, Homo sapiens
ggcatcatctcagctcactgcaa

SEQ ID NO: 4252756 - DNA, 16 bp, Homo sapiens
ggccagaccatggaca

SEQ ID NO: 4252757 - DNA, 18 bp, Homo sapiens
ggccaggcttgtctcgaa

SEQ ID NO: 4252758 - DNA, 23 bp, Homo sapiens
ggcgtgatctcagctcactgcaa

SEQ ID NO: 4252759 - DNA, 23 bp, Homo sapiens
ggctcctccagggtggcagcaac

SEQ ID NO: 4252760 - DNA, 20 bp, Homo sapiens
ggctggagtgcagtggcgcg

SEQ ID NO: 4252761 - DNA, 21 bp, Homo sapiens
ggctgggaatggaggggcaga

SEQ ID NO: 4252762 - DNA, 15 bp, Homo sapiens
ggcttgccacacccc

SEQ ID NO: 4252763 - DNA, 20 bp, Homo sapiens
gggacagtcacctcatggaa

SEQ ID NO: 4252764 - DNA, 12 bp, Homo sapiens
gggactcagccc

SEQ ID NO: 4252765 - DNA, 17 bp, Homo sapiens
gggactgcggaggaagg

SEQ ID NO: 4252766 - DNA, 18 bp, Homo sapiens
gggaggtgagaccacctc

SEQ ID NO: 4252767 - DNA, 14 bp, Homo sapiens
gggcagagccagga

SEQ ID NO: 4252768 - DNA, 16 bp, Homo sapiens
gggcagagccaggaag

SEQ ID NO: 4252769 - DNA, 22 bp, Homo sapiens
gggctcctccagggtggcagca

SEQ ID NO: 4252770 - DNA, 23 bp, Homo sapiens
gggctcctccagggtggcagcaa

SEQ ID NO: 4252771 - DNA, 19 bp, Homo sapiens
ggggaattgaggacactga

SEQ ID NO: 4252772 - DNA, 14 bp, Homo sapiens
ggggcagagccagg

SEQ ID NO: 4252773 - DNA, 22 bp, Homo sapiens
ggtacttcaaatccttgaagat

SEQ ID NO: 4252774 - DNA, 22 bp, Homo sapiens
ggtatgaacttgaggacacatg

SEQ ID NO: 4252775 - DNA, 23 bp, Homo sapiens
ggtatgaacttgaggacacatgt

SEQ ID NO: 4252776 - DNA, 19 bp, Homo sapiens
gtaatgataactggaaact

SEQ ID NO: 4252777 - DNA, 23 bp, Homo sapiens
gtaattctaccaaggtcttctta

SEQ ID NO: 4252778 - DNA, 15 bp, Homo sapiens
gtaattggaaaggca

SEQ ID NO: 4252779 - DNA, 15 bp, Homo sapiens
gtaatttttttcacc

SEQ ID NO: 4252780 - DNA, 13 bp, Homo sapiens
gtagcgtttttta

SEQ ID NO: 4252781 - DNA, 16 bp, Homo sapiens
gtaggaaagaggaagc

SEQ ID NO: 4252782 - DNA, 17 bp, Homo sapiens
gtagtgttggagaagaa

SEQ ID NO: 4252783 - DNA, 21 bp, Homo sapiens
gtataaaataatttttatatt

SEQ ID NO: 4252784 - DNA, 15 bp, Homo sapiens
gtatactatagtacc

SEQ ID NO: 4252785 - DNA, 18 bp, Homo sapiens
gtatattacaatgatcac

SEQ ID NO: 4252786 - DNA, 17 bp, Homo sapiens
gtatctcttcagtctct

SEQ ID NO: 4252787 - DNA, 15 bp, Homo sapiens
gtatgaacttgagga

SEQ ID NO: 4252788 - DNA, 17 bp, Homo sapiens
gtatgttagtgcaaatt

SEQ ID NO: 4252789 - DNA, 18 bp, Homo sapiens
gtattttaaaagaatgat

SEQ ID NO: 4252790 - DNA, 16 bp, Homo sapiens
gtcaaattgtgtgaaa

SEQ ID NO: 4252791 - DNA, 15 bp, Homo sapiens
gtcaataaaatccat

SEQ ID NO: 4252792 - DNA, 13 bp, Homo sapiens
gtcaccagagact

SEQ ID NO: 4252793 - DNA, 20 bp, Homo sapiens
gtcacccaggctggactgca

SEQ ID NO: 4252794 - DNA, 21 bp, Homo sapiens
gtccaagcatttagatgtata

SEQ ID NO: 4252795 - DNA, 19 bp, Homo sapiens
gtctctataccaataaagt

SEQ ID NO: 4252796 - DNA, 21 bp, Homo sapiens
gtctctataccaataaagtga

SEQ ID NO: 4252797 - DNA, 19 bp, Homo sapiens
gtgacattttacattaaat

SEQ ID NO: 4252798 - DNA, 13 bp, Homo sapiens
gtgagaccacctc

SEQ ID NO: 4252799 - DNA, 14 bp, Homo sapiens
gtgatctcagctca

SEQ ID NO: 4252800 - DNA, 13 bp, Homo sapiens
gtgcactggcccc

SEQ ID NO: 4252801 - DNA, 24 bp, Homo sapiens
gtgcagtggcatcatctcagctca

SEQ ID NO: 4252802 - DNA, 13 bp, Homo sapiens
gtggacacctgcc

SEQ ID NO: 4252803 - DNA, 17 bp, Homo sapiens
gtggacacctgccctgc

SEQ ID NO: 4252804 - DNA, 18 bp, Homo sapiens
gtggacacctgccctgcc

SEQ ID NO: 4252805 - DNA, 13 bp, Homo sapiens
gtggcagcaacaa

SEQ ID NO: 4252806 - DNA, 19 bp, Homo sapiens
gtggcgtgatctcagctca

SEQ ID NO: 4252807 - DNA, 23 bp, Homo sapiens
gttagggaaaacattccatcctt

SEQ ID NO: 4252808 - DNA, 18 bp, Homo sapiens
gttccttggccatgcaga

SEQ ID NO: 4252809 - DNA, 13 bp, Homo sapiens
gttgacatgggac

SEQ ID NO: 4252810 - DNA, 20 bp, Homo sapiens
gttgatggtggtatgttttc

SEQ ID NO: 4252811 - DNA, 21 bp, Homo sapiens
gtttcaaacatatataacaat

SEQ ID NO: 4252812 - DNA, 13 bp, Homo sapiens
gtttggtgcttct

SEQ ID NO: 4252813 - DNA, 11 bp, Homo sapiens
gttttacaata

SEQ ID NO: 4252814 - DNA, 20 bp, Homo sapiens
gttttacaatagttctgtgg

SEQ ID NO: 4252815 - DNA, 18 bp, Homo sapiens
gttttcaggctagatgta

SEQ ID NO: 4252816 - DNA, 18 bp, Homo sapiens
gttttgaaatcccatcag

SEQ ID NO: 4252817 - DNA, 11 bp, Homo sapiens
taaaaaggaca

SEQ ID NO: 4252818 - DNA, 19 bp, Homo sapiens
taaaaaggacatcagcaaa

SEQ ID NO: 4252819 - DNA, 22 bp, Homo sapiens
taaaaatggaaactatattgac

SEQ ID NO: 4252820 - DNA, 18 bp, Homo sapiens
taaaacgcagttgcaaac

SEQ ID NO: 4252821 - DNA, 19 bp, Homo sapiens
tttcaaacatatataacaa

SEQ ID NO: 4252822 - DNA, 16 bp, Homo sapiens
tttcacctagattttt

SEQ ID NO: 4252823 - DNA, 15 bp, Homo sapiens
tttcagataatcaca

SEQ ID NO: 4252824 - DNA, 17 bp, Homo sapiens
tttcatgaccagtaaag

SEQ ID NO: 4252825 - DNA, 24 bp, Homo sapiens
tttcatgaccagtaaaggctgctg

SEQ ID NO: 4252826 - DNA, 18 bp, Homo sapiens
tttccccctagcctgcct

SEQ ID NO: 4252827 - DNA, 14 bp, Homo sapiens
tttctatgaaatat

SEQ ID NO: 4252828 - DNA, 20 bp, Homo sapiens
tttctatgaaatattatgtt

SEQ ID NO: 4252829 - DNA, 12 bp, Homo sapiens
tttctctaggaa

SEQ ID NO: 4252830 - DNA, 16 bp, Homo sapiens
tttgaaaagcagacat

SEQ ID NO: 4252831 - DNA, 15 bp, Homo sapiens
tttgaaatattgact

SEQ ID NO: 4252832 - DNA, 11 bp, Homo sapiens
tttgaaatccc

SEQ ID NO: 4252833 - DNA, 11 bp, Homo sapiens
tttgcagcttt

SEQ ID NO: 4252834 - DNA, 19 bp, Homo sapiens
tttgccaccctcatgctgt

SEQ ID NO: 4252835 - DNA, 19 bp, Homo sapiens
tttgctaagcattccaact

SEQ ID NO: 4252836 - DNA, 11 bp, Homo sapiens
tttgctcatgg

SEQ ID NO: 4252837 - DNA, 13 bp, Homo sapiens
tttgctcatggaa

SEQ ID NO: 4252838 - DNA, 21 bp, Homo sapiens
tttgggcagcaatttaaatgt

SEQ ID NO: 4252839 - DNA, 18 bp, Homo sapiens
tttggtaaggggaattga

SEQ ID NO: 4252840 - DNA, 15 bp, Homo sapiens
tttgtagtagcgttt

SEQ ID NO: 4252841 - DNA, 16 bp, Homo sapiens
tttgtataaaataatt

SEQ ID NO: 4252842 - DNA, 18 bp, Homo sapiens
tttgtataaaataatttt

SEQ ID NO: 4252843 - DNA, 13 bp, Homo sapiens
ttttaaaaaagaa

SEQ ID NO: 4252844 - DNA, 16 bp, Homo sapiens
ttttaaaaaatggtca

SEQ ID NO: 4252845 - DNA, 17 bp, Homo sapiens
ttttaaaaaatggtcac

SEQ ID NO: 4252846 - DNA, 21 bp, Homo sapiens
ttttaaaagaatgattatgaa

SEQ ID NO: 4252847 - DNA, 13 bp, Homo sapiens
ttttaataatgtt

SEQ ID NO: 4252848 - DNA, 16 bp, Homo sapiens
ttttaataatgtttca

SEQ ID NO: 4252849 - DNA, 14 bp, Homo sapiens
ttttataattttgt

SEQ ID NO: 4252850 - DNA, 23 bp, Homo sapiens
ttttataattttgtgaagcaaaa

SEQ ID NO: 4252851 - DNA, 10 bp, Homo sapiens
ttttatattt

SEQ ID NO: 4252852 - DNA, 14 bp, Homo sapiens
ttttctctaggaaa

SEQ ID NO: 4252853 - DNA, 20 bp, Homo sapiens
ttttgaaattatgtgacatt

SEQ ID NO: 4252854 - DNA, 14 bp, Homo sapiens
ttttgtgaagcaaa

SEQ ID NO: 4252855 - DNA, 12 bp, Homo sapiens
tttttacatttt

SEQ ID NO: 4252856 - DNA, 13 bp, Homo sapiens
tttttcaaaagaa

SEQ ID NO: 4252857 - DNA, 19 bp, Homo sapiens
tttttctctaggaaatatt

SEQ ID NO: 4252858 - DNA, 11 bp, Homo sapiens
ttttttacatt

SEQ ID NO: 4252859 - DNA, 16 bp, Homo sapiens
ttttttgggcagcaat

SEQ ID NO: 4252860 - DNA, 19 bp, Homo sapiens
aagtacacaataagcaaaa

SEQ ID NO: 4252861 - DNA, 19 bp, Homo sapiens
aagtgactttggctgcatg

SEQ ID NO: 4252862 - DNA, 21 bp, Homo sapiens
aagttcaccagactctataaa

SEQ ID NO: 4252863 - DNA, 19 bp, Homo sapiens
aagttgacttatagtacat

SEQ ID NO: 4252864 - DNA, 23 bp, Homo sapiens
aagttgacttatagtacatgata

SEQ ID NO: 4252865 - DNA, 22 bp, Homo sapiens
aagttgatatgccttttcccaa

SEQ ID NO: 4252866 - DNA, 12 bp, Homo sapiens
aataaagcaatt

SEQ ID NO: 4252867 - DNA, 11 bp, Homo sapiens
aataaaggact

SEQ ID NO: 4252868 - DNA, 17 bp, Homo sapiens
aataaatgtatctgaat

SEQ ID NO: 4252869 - DNA, 19 bp, Homo sapiens
aataatgtttcaaacatat

SEQ ID NO: 4252870 - DNA, 20 bp, Homo sapiens
aataatttttatatttgaaa

SEQ ID NO: 4252871 - DNA, 24 bp, Homo sapiens
aatatgccccattcaacatctagt

SEQ ID NO: 4252872 - DNA, 16 bp, Homo sapiens
aatattcaataaagct

SEQ ID NO: 4252873 - DNA, 18 bp, Homo sapiens
aatatttattttaataat

SEQ ID NO: 4252874 - DNA, 15 bp, Homo sapiens
aatatttcagataat

SEQ ID NO: 4252875 - DNA, 16 bp, Homo sapiens
aatcagcctagttgat

SEQ ID NO: 4252876 - DNA, 22 bp, Homo sapiens
aatcagggttagtattgtccag

SEQ ID NO: 4252877 - DNA, 12 bp, Homo sapiens
aatcatgaatta

SEQ ID NO: 4252878 - DNA, 23 bp, Homo sapiens
aatcatgaattagttttatatgc

SEQ ID NO: 4252879 - DNA, 16 bp, Homo sapiens
aatccatacatttgtg

SEQ ID NO: 4252880 - DNA, 11 bp, Homo sapiens
aatctgtaaaa

SEQ ID NO: 4252881 - DNA, 14 bp, Homo sapiens
aatgagacatccag

SEQ ID NO: 4252882 - DNA, 15 bp, Homo sapiens
aatgagacatccagc

SEQ ID NO: 4252883 - DNA, 21 bp, Homo sapiens
aatgagagacacactgaagaa

SEQ ID NO: 4252884 - DNA, 22 bp, Homo sapiens
aatgagagacacactgaagaag

SEQ ID NO: 4252885 - DNA, 18 bp, Homo sapiens
aattacaacggagtcaaa

SEQ ID NO: 4252886 - DNA, 20 bp, Homo sapiens
aattagttttatatgcttct

SEQ ID NO: 4252887 - DNA, 23 bp, Homo sapiens
aattatctatagctaagtacaca

SEQ ID NO: 4252888 - DNA, 22 bp, Homo sapiens
aattatgtgacattttacatta

SEQ ID NO: 4252889 - DNA, 17 bp, Homo sapiens
aattctttaaaattaca

SEQ ID NO: 4252890 - DNA, 23 bp, Homo sapiens
aattgagaaaaatatatactaaa

SEQ ID NO: 4252891 - DNA, 17 bp, Homo sapiens
aattttgtgaagcaaaa

SEQ ID NO: 4252892 - DNA, 22 bp, Homo sapiens
aattttttctctaggaaatatt

SEQ ID NO: 4252893 - DNA, 13 bp, Homo sapiens
aatttttttcacc

SEQ ID NO: 4252894 - DNA, 13 bp, Homo sapiens
acaaataatttag

SEQ ID NO: 4252895 - DNA, 14 bp, Homo sapiens
acaaataatttaga

SEQ ID NO: 4252896 - DNA, 14 bp, Homo sapiens
acaacggagtcaaa

SEQ ID NO: 4252897 - DNA, 20 bp, Homo sapiens
acaacggagtcaaaaattaa

SEQ ID NO: 4252898 - DNA, 22 bp, Homo sapiens
acaacggagtcaaaaattaaac

SEQ ID NO: 4252899 - DNA, 13 bp, Homo sapiens
acaagactgcaca

SEQ ID NO: 4252900 - DNA, 14 bp, Homo sapiens
acaagactgcacat

SEQ ID NO: 4252901 - DNA, 21 bp, Homo sapiens
acaaggatgaattaagttttt

SEQ ID NO: 4252902 - DNA, 23 bp, Homo sapiens
acaatacatcccttacctgggaa

SEQ ID NO: 4252903 - DNA, 18 bp, Homo sapiens
acaatgctgtattttaaa

SEQ ID NO: 4252904 - DNA, 22 bp, Homo sapiens
acaattgaggtaagttttttga

SEQ ID NO: 4252905 - DNA, 13 bp, Homo sapiens
acacaataagcaa

SEQ ID NO: 4252906 - DNA, 17 bp, Homo sapiens
acacaccaccacgcctg

SEQ ID NO: 4252907 - DNA, 15 bp, Homo sapiens
acacatgaagtccaa

SEQ ID NO: 4252908 - DNA, 12 bp, Homo sapiens
acacctgccctg

SEQ ID NO: 4252909 - DNA, 13 bp, Homo sapiens
acacctgccctgc

SEQ ID NO: 4252910 - DNA, 23 bp, Homo sapiens
acacctgccctgccctgccacct

SEQ ID NO: 4252911 - DNA, 17 bp, Homo sapiens
acactaagagagaatga

SEQ ID NO: 4252912 - DNA, 17 bp, Homo sapiens
acactacacccagcaat

SEQ ID NO: 4252913 - DNA, 18 bp, Homo sapiens
acactgggacttgcaaaa

SEQ ID NO: 4252914 - DNA, 19 bp, Homo sapiens
acagcccttctttccacag

SEQ ID NO: 4252915 - DNA, 14 bp, Homo sapiens
acagctgcctcttc

SEQ ID NO: 4252916 - DNA, 19 bp, Homo sapiens
acagctgtatgattcccag

SEQ ID NO: 4252917 - DNA, 23 bp, Homo sapiens
acagctgtatgattcccagccag

SEQ ID NO: 4252918 - DNA, 19 bp, Homo sapiens
acaggatcagttaactatt

SEQ ID NO: 4252919 - DNA, 18 bp, Homo sapiens
acaggatccaggccggct

SEQ ID NO: 4252920 - DNA, 17 bp, Homo sapiens
acaggcacacaccacca

SEQ ID NO: 4252921 - DNA, 21 bp, Homo sapiens
acagttacctctgcctcagaa

SEQ ID NO: 4252922 - DNA, 20 bp, Homo sapiens
acataaaaaggacatcagca

SEQ ID NO: 4252923 - DNA, 20 bp, Homo sapiens
acatcccttacctgggaaag

SEQ ID NO: 4252924 - DNA, 16 bp, Homo sapiens
acatgcttccctttcc

SEQ ID NO: 4252925 - DNA, 18 bp, Homo sapiens
acatgcttccctttcctg

SEQ ID NO: 4252926 - DNA, 13 bp, Homo sapiens
acattccatcctt

SEQ ID NO: 4252927 - DNA, 16 bp, Homo sapiens
acatttgctcatggaa

SEQ ID NO: 4252928 - DNA, 14 bp, Homo sapiens
acattttacattaa

SEQ ID NO: 4252929 - DNA, 15 bp, Homo sapiens
acattttacattaaa

SEQ ID NO: 4252930 - DNA, 17 bp, Homo sapiens
accaataaagtgaccct

SEQ ID NO: 4252931 - DNA, 18 bp, Homo sapiens
accacttgtgttttgcaa

SEQ ID NO: 4252932 - DNA, 13 bp, Homo sapiens
accactttttgca

SEQ ID NO: 4252933 - DNA, 14 bp, Homo sapiens
accactttttgcag

SEQ ID NO: 4252934 - DNA, 22 bp, Homo sapiens
accagagtgctgaaggaatgga

SEQ ID NO: 4252935 - DNA, 20 bp, Homo sapiens
accatcagaaacaccctcac

SEQ ID NO: 4252936 - DNA, 22 bp, Homo sapiens
accatggacactacacccagca

SEQ ID NO: 4252937 - DNA, 23 bp, Homo sapiens
accatgttggccaggcttgtctc

SEQ ID NO: 4252938 - DNA, 14 bp, Homo sapiens
acccagcaatagag

SEQ ID NO: 4252939 - DNA, 20 bp, Homo sapiens
acccaggacaggatccaggc

SEQ ID NO: 4252940 - DNA, 12 bp, Homo sapiens
acccctaggact

SEQ ID NO: 4252941 - DNA, 16 bp, Homo sapiens
accctaaataataaaa

SEQ ID NO: 4252942 - DNA, 13 bp, Homo sapiens
accctaaccaagt

SEQ ID NO: 4252943 - DNA, 14 bp, Homo sapiens
accctaaccaagtt

SEQ ID NO: 4252944 - DNA, 20 bp, Homo sapiens
accctcatgctgtgtgactc

SEQ ID NO: 4252945 - DNA, 21 bp, Homo sapiens
accctccaccgcagaaggaag

SEQ ID NO: 4252946 - DNA, 11 bp, Homo sapiens
accctccctcc

SEQ ID NO: 4252947 - DNA, 15 bp, Homo sapiens
accctcgtggacacc

SEQ ID NO: 4252948 - DNA, 17 bp, Homo sapiens
accctcgtggacacctg

SEQ ID NO: 4252949 - DNA, 18 bp, Homo sapiens
accctcgtggacacctgc

SEQ ID NO: 4252950 - DNA, 22 bp, Homo sapiens
accctcgtggacacctgccctg

SEQ ID NO: 4252951 - DNA, 12 bp, Homo sapiens
accgcagaagga

SEQ ID NO: 4252952 - DNA, 13 bp, Homo sapiens
accgcagaaggaa

SEQ ID NO: 4252953 - DNA, 23 bp, Homo sapiens
accggcggaccccagccatccag

SEQ ID NO: 4252954 - DNA, 12 bp, Homo sapiens
acctagattttt

SEQ ID NO: 4252955 - DNA, 12 bp, Homo sapiens
acctctcaatat

SEQ ID NO: 4252956 - DNA, 18 bp, Homo sapiens
acctctccagcctcagct

SEQ ID NO: 4252957 - DNA, 22 bp, Homo sapiens
acctctccagcctcagctctca

SEQ ID NO: 4252958 - DNA, 17 bp, Homo sapiens
acctctgcctcagaaaa

SEQ ID NO: 4252959 - DNA, 16 bp, Homo sapiens
acctgccctgccctgc

SEQ ID NO: 4252960 - DNA, 20 bp, Homo sapiens
acctgccctgccctgccacc

SEQ ID NO: 4252961 - DNA, 21 bp, Homo sapiens
acctgccctgccctgccacct

SEQ ID NO: 4252962 - DNA, 22 bp, Homo sapiens
acctgccctgccctgccacctg

SEQ ID NO: 4252963 - DNA, 23 bp, Homo sapiens
acctgccctgccctgccacctgt

SEQ ID NO: 4252964 - DNA, 22 bp, Homo sapiens
acctgcctcccttcatgcatgg

SEQ ID NO: 4252965 - DNA, 23 bp, Homo sapiens
acctgcctcccttcatgcatgga

SEQ ID NO: 4252966 - DNA, 14 bp, Homo sapiens
acctgtctgtctgt

SEQ ID NO: 4252967 - DNA, 20 bp, Homo sapiens
acctgtggaacataaaaagg

SEQ ID NO: 4252968 - DNA, 23 bp, Homo sapiens
acctgtggaacataaaaaggaca

SEQ ID NO: 4252969 - DNA, 14 bp, Homo sapiens
accttagaatacag

SEQ ID NO: 4252970 - DNA, 22 bp, Homo sapiens
acggaagaagagatcaggaaga

SEQ ID NO: 4252971 - DNA, 18 bp, Homo sapiens
acgggactgcggaggaag

SEQ ID NO: 4252972 - DNA, 15 bp, Homo sapiens
acggggactcagccc

SEQ ID NO: 4252973 - DNA, 18 bp, Homo sapiens
acgtgctctgtgggtctc

SEQ ID NO: 4252974 - DNA, 16 bp, Homo sapiens
actaagagagaatgag

SEQ ID NO: 4252975 - DNA, 13 bp, Homo sapiens
actacacccagca

SEQ ID NO: 4252976 - DNA, 19 bp, Homo sapiens
actagtatttctatgaaat

SEQ ID NO: 4252977 - DNA, 17 bp, Homo sapiens
actatattgtttgctaa

SEQ ID NO: 4252978 - DNA, 16 bp, Homo sapiens
actatctcatttccaa

SEQ ID NO: 4252979 - DNA, 12 bp, Homo sapiens
actatgtaaact

SEQ ID NO: 4252980 - DNA, 14 bp, Homo sapiens
actatgtaaactac

SEQ ID NO: 4252981 - DNA, 20 bp, Homo sapiens
actcaaaccaaatcactgaa

SEQ ID NO: 4252982 - DNA, 15 bp, Homo sapiens
actcgtgtgtttcta

SEQ ID NO: 4252983 - DNA, 14 bp, Homo sapiens
cagttctgaagaag

SEQ ID NO: 4252984 - DNA, 18 bp, Homo sapiens
cataagcttatgcttaaa

SEQ ID NO: 4252985 - DNA, 18 bp, Homo sapiens
cataatccagtaaaataa

SEQ ID NO: 4252986 - DNA, 13 bp, Homo sapiens
catatataacaat

SEQ ID NO: 4252987 - DNA, 19 bp, Homo sapiens
catcagaaacaccctcaca

SEQ ID NO: 4252988 - DNA, 14 bp, Homo sapiens
catcatctcagctc

SEQ ID NO: 4252989 - DNA, 13 bp, Homo sapiens
catccctcaccca

SEQ ID NO: 4252990 - DNA, 14 bp, Homo sapiens
catccttgagtcaa

SEQ ID NO: 4252991 - DNA, 19 bp, Homo sapiens
catctggaaccatcagaaa

SEQ ID NO: 4252992 - DNA, 16 bp, Homo sapiens
catctggattccagag

SEQ ID NO: 4252993 - DNA, 21 bp, Homo sapiens
catgattggtttctaggcagt

SEQ ID NO: 4252994 - DNA, 15 bp, Homo sapiens
catgcttccctttcc

SEQ ID NO: 4252995 - DNA, 21 bp, Homo sapiens
catggaaattcccttcatctg

SEQ ID NO: 4252996 - DNA, 17 bp, Homo sapiens
catggacactacaccca

SEQ ID NO: 4252997 - DNA, 19 bp, Homo sapiens
catggacactacacccagc

SEQ ID NO: 4252998 - DNA, 20 bp, Homo sapiens
catgtgctagtaattggaaa

SEQ ID NO: 4252999 - DNA, 19 bp, Homo sapiens
cattatatttattactgta

SEQ ID NO: 4253000 - DNA, 22 bp, Homo sapiens
cattccaactatctcatttcca

SEQ ID NO: 4253001 - DNA, 14 bp, Homo sapiens
cattccatccttga

SEQ ID NO: 4253002 - DNA, 16 bp, Homo sapiens
cattctggaagtgact

SEQ ID NO: 4253003 - DNA, 13 bp, Homo sapiens
catttatatgtac

SEQ ID NO: 4253004 - DNA, 13 bp, Homo sapiens
catttgctcatgg

SEQ ID NO: 4253005 - DNA, 15 bp, Homo sapiens
catttgctcatggaa

SEQ ID NO: 4253006 - DNA, 16 bp, Homo sapiens
catttgctcatggaat

SEQ ID NO: 4253007 - DNA, 16 bp, Homo sapiens
catttgtataaaataa

SEQ ID NO: 4253008 - DNA, 18 bp, Homo sapiens
cattttttgggcagcaat

SEQ ID NO: 4253009 - DNA, 19 bp, Homo sapiens
ccaaagtcctgggattaca

SEQ ID NO: 4253010 - DNA, 18 bp, Homo sapiens
ccaaagtgctgggattaa

SEQ ID NO: 4253011 - DNA, 20 bp, Homo sapiens
ccaagtagctgagactacag

SEQ ID NO: 4253012 - DNA, 16 bp, Homo sapiens
ccacagaagctccagg

SEQ ID NO: 4253013 - DNA, 20 bp, Homo sapiens
ccacaggaaccacaagactg

SEQ ID NO: 4253014 - DNA, 18 bp, Homo sapiens
ccaccctcgtggacacct

SEQ ID NO: 4253015 - DNA, 20 bp, Homo sapiens
ccaccctcgtggacacctgc

SEQ ID NO: 4253016 - DNA, 22 bp, Homo sapiens
ccaccctcgtggacacctgccc

SEQ ID NO: 4253017 - DNA, 18 bp, Homo sapiens
ccacctccctcaacctca

SEQ ID NO: 4253018 - DNA, 20 bp, Homo sapiens
ccacctcgcaggttcaagca

SEQ ID NO: 4253019 - DNA, 21 bp, Homo sapiens
ccacctcgcaggttcaagcaa

SEQ ID NO: 4253020 - DNA, 13 bp, Homo sapiens
ccacctctcaata

SEQ ID NO: 4253021 - DNA, 16 bp, Homo sapiens
ccacctgtctgtctgt

SEQ ID NO: 4253022 - DNA, 22 bp, Homo sapiens
ccacctgtctgtctgtctgtcc

SEQ ID NO: 4253023 - DNA, 14 bp, Homo sapiens
ccacttcagcctcc

SEQ ID NO: 4253024 - DNA, 15 bp, Homo sapiens
ccagaccatggacac

SEQ ID NO: 4253025 - DNA, 15 bp, Homo sapiens
ccaggacaggatcca

SEQ ID NO: 4253026 - DNA, 17 bp, Homo sapiens
ccaggacaggatccagg

SEQ ID NO: 4253027 - DNA, 18 bp, Homo sapiens
ccaggctggagtgcagtg

SEQ ID NO: 4253028 - DNA, 15 bp, Homo sapiens
ccagggggcaagagg

SEQ ID NO: 4253029 - DNA, 14 bp, Homo sapiens
ccagggtggcagca

SEQ ID NO: 4253030 - DNA, 18 bp, Homo sapiens
ccaggttggagtgcagtg

SEQ ID NO: 4253031 - DNA, 20 bp, Homo sapiens
ccagtaggggcttataataa

SEQ ID NO: 4253032 - DNA, 12 bp, Homo sapiens
ccagtgctgaat

SEQ ID NO: 4253033 - DNA, 22 bp, Homo sapiens
ccatcagaaacaccctcacact

SEQ ID NO: 4253034 - DNA, 13 bp, Homo sapiens
ccatcaggtcacc

SEQ ID NO: 4253035 - DNA, 21 bp, Homo sapiens
ccatcaggtcaccgcgaggcc

SEQ ID NO: 4253036 - DNA, 12 bp, Homo sapiens
ccatccctgcgt

SEQ ID NO: 4253037 - DNA, 16 bp, Homo sapiens
ccatgatgtttagaaa

SEQ ID NO: 4253038 - DNA, 22 bp, Homo sapiens
ccatggacactacacccagcaa

SEQ ID NO: 4253039 - DNA, 13 bp, Homo sapiens
ccatggccctgcc

SEQ ID NO: 4253040 - DNA, 20 bp, Homo sapiens
ccatgttaacccctccactc

SEQ ID NO: 4253041 - DNA, 20 bp, Homo sapiens
ccattgtgcctaagtccagt

SEQ ID NO: 4253042 - DNA, 14 bp, Homo sapiens
cccactgcctttga

SEQ ID NO: 4253043 - DNA, 13 bp, Homo sapiens
cccagaaaagaaa

SEQ ID NO: 4253044 - DNA, 12 bp, Homo sapiens
cccagaatgaga

SEQ ID NO: 4253045 - DNA, 18 bp, Homo sapiens
cccaggttggagtgcagt

SEQ ID NO: 4253046 - DNA, 14 bp, Homo sapiens
cccatcctagaggc

SEQ ID NO: 4253047 - DNA, 23 bp, Homo sapiens
ccccaccctcgtggacacctgcc

SEQ ID NO: 4253048 - DNA, 12 bp, Homo sapiens
cccctccactct

SEQ ID NO: 4253049 - DNA, 17 bp, Homo sapiens
cccctgccacctcctgc

SEQ ID NO: 4253050 - DNA, 17 bp, Homo sapiens
cccctggtccctctgca

SEQ ID NO: 4253051 - DNA, 20 bp, Homo sapiens
ccctaaaagaaaccctgcac

SEQ ID NO: 4253052 - DNA, 21 bp, Homo sapiens
ccctatctttgccaccctcat

SEQ ID NO: 4253053 - DNA, 14 bp, Homo sapiens
ccctcacactggga

SEQ ID NO: 4253054 - DNA, 11 bp, Homo sapiens
ccctcacccat

SEQ ID NO: 4253055 - DNA, 22 bp, Homo sapiens
ccctcgtggacacctgccctgc

SEQ ID NO: 4253056 - DNA, 17 bp, Homo sapiens
ccctgccacctcctgcc

SEQ ID NO: 4253057 - DNA, 20 bp, Homo sapiens
ccctgccacctcctgcctca

SEQ ID NO: 4253058 - DNA, 13 bp, Homo sapiens
ccctgccacctgt

SEQ ID NO: 4253059 - DNA, 15 bp, Homo sapiens
ccctgccacctgtct

SEQ ID NO: 4253060 - DNA, 16 bp, Homo sapiens
ccctgccacctgtctg

SEQ ID NO: 4253061 - DNA, 16 bp, Homo sapiens
ccctgctgctgcctgc

SEQ ID NO: 4253062 - DNA, 16 bp, Homo sapiens
ccctggaaaccttcca

SEQ ID NO: 4253063 - DNA, 19 bp, Homo sapiens
ccctggaaaccttccaccc

SEQ ID NO: 4253064 - DNA, 18 bp, Homo sapiens
ccctggtccctctgcagt

SEQ ID NO: 4253065 - DNA, 16 bp, Homo sapiens
cccttcatgcatggaa

SEQ ID NO: 4253066 - DNA, 20 bp, Homo sapiens
ccgactgaaaatattgtttt

SEQ ID NO: 4253067 - DNA, 20 bp, Homo sapiens
ccgcctcgacctctctcaaa

SEQ ID NO: 4253068 - DNA, 16 bp, Homo sapiens
ccggatctgagggaga

SEQ ID NO: 4253069 - DNA, 18 bp, Homo sapiens
cctaaaagaaaccctgca

SEQ ID NO: 4253070 - DNA, 18 bp, Homo sapiens
cctaagctggagtgcagt

SEQ ID NO: 4253071 - DNA, 19 bp, Homo sapiens
cctaagctggagtgcagtg

SEQ ID NO: 4253072 - DNA, 15 bp, Homo sapiens
cctatctttgccacc

SEQ ID NO: 4253073 - DNA, 17 bp, Homo sapiens
cctattgttgaataaat

SEQ ID NO: 4253074 - DNA, 23 bp, Homo sapiens
cctcatggaattggagctcgtgg

SEQ ID NO: 4253075 - DNA, 18 bp, Homo sapiens
cctccaaccctagcaaaa

SEQ ID NO: 4253076 - DNA, 18 bp, Homo sapiens
cctccaccgcagaaggaa

SEQ ID NO: 4253077 - DNA, 12 bp, Homo sapiens
cctccacctcaa

SEQ ID NO: 4253078 - DNA, 20 bp, Homo sapiens
cctccagggtggcagcaaca

SEQ ID NO: 4253079 - DNA, 18 bp, Homo sapiens
cctcccatgttcaagcga

SEQ ID NO: 4253080 - DNA, 18 bp, Homo sapiens
cctctcaatattcaataa

SEQ ID NO: 4253081 - DNA, 22 bp, Homo sapiens
cctctcaatattcaataaagct

SEQ ID NO: 4253082 - DNA, 17 bp, Homo sapiens
cctctgcagtctctata

SEQ ID NO: 4253083 - DNA, 16 bp, Homo sapiens
cctgagtcccatccct

SEQ ID NO: 4253084 - DNA, 12 bp, Homo sapiens
cctgccacctgt

SEQ ID NO: 4253085 - DNA, 11 bp, Homo sapiens
cctgccctgcc

SEQ ID NO: 4253086 - DNA, 14 bp, Homo sapiens
cctgccctgccacc

SEQ ID NO: 4253087 - DNA, 16 bp, Homo sapiens
cctgccctgccctgcc

SEQ ID NO: 4253088 - DNA, 17 bp, Homo sapiens
cctgctgctgcctgcct

SEQ ID NO: 4253089 - DNA, 17 bp, Homo sapiens
cctggaaaccttccacc

SEQ ID NO: 4253090 - DNA, 13 bp, Homo sapiens
cctgggattacag

SEQ ID NO: 4253091 - DNA, 17 bp, Homo sapiens
cctggtgcactggcccc

SEQ ID NO: 4253092 - DNA, 19 bp, Homo sapiens
cctgtggaacataaaaagg

SEQ ID NO: 4253093 - DNA, 17 bp, Homo sapiens
ccttaagagtcatccag

SEQ ID NO: 4253094 - DNA, 20 bp, Homo sapiens
ccttcatctggattccagag

SEQ ID NO: 4253095 - DNA, 19 bp, Homo sapiens
ccttctatacccacccaga

SEQ ID NO: 4253096 - DNA, 17 bp, Homo sapiens
ccttggccatgcagaaa

SEQ ID NO: 4253097 - DNA, 18 bp, Homo sapiens
cctttggcaggtgcagcc

SEQ ID NO: 4253098 - DNA, 13 bp, Homo sapiens
cgagataccccac

SEQ ID NO: 4253099 - DNA, 22 bp, Homo sapiens
cgaggcctattgttgaataaat

SEQ ID NO: 4253100 - DNA, 13 bp, Homo sapiens
cgcagaaggaagg

SEQ ID NO: 4253101 - DNA, 16 bp, Homo sapiens
cgcctccaaccctagc

SEQ ID NO: 4253102 - DNA, 21 bp, Homo sapiens
cggaagaagagatcaggaaga

SEQ ID NO: 4253103 - DNA, 15 bp, Homo sapiens
cggaccccagccatc

SEQ ID NO: 4253104 - DNA, 21 bp, Homo sapiens
cggaggaaggaggacccagga

SEQ ID NO: 4253105 - DNA, 14 bp, Homo sapiens
cggggactcagccc

SEQ ID NO: 4253106 - DNA, 13 bp, Homo sapiens
cgtgatccacccg

SEQ ID NO: 4253107 - DNA, 17 bp, Homo sapiens
cgttttttaaatgtata

SEQ ID NO: 4253108 - DNA, 17 bp, Homo sapiens
taaaagaaaccctgcac

SEQ ID NO: 4253109 - DNA, 12 bp, Homo sapiens
taaaagaatgat

SEQ ID NO: 4253110 - DNA, 13 bp, Homo sapiens
taaaattacaact

SEQ ID NO: 4253111 - DNA, 15 bp, Homo sapiens
taaaattacaactaa

SEQ ID NO: 4253112 - DNA, 17 bp, Homo sapiens
taaaattacaactaagt

SEQ ID NO: 4253113 - DNA, 12 bp, Homo sapiens
taaaggactgta

SEQ ID NO: 4253114 - DNA, 20 bp, Homo sapiens
taaagtgaccctgctctcac

SEQ ID NO: 4253115 - DNA, 15 bp, Homo sapiens
taaatagacacgcac

SEQ ID NO: 4253116 - DNA, 20 bp, Homo sapiens
taaatgtatactatagtacc

SEQ ID NO: 4253117 - DNA, 13 bp, Homo sapiens
taacaatgctgta

SEQ ID NO: 4253118 - DNA, 12 bp, Homo sapiens
taaccaagttcc

SEQ ID NO: 4253119 - DNA, 23 bp, Homo sapiens
taactattgcatttatatgtacc

SEQ ID NO: 4253120 - DNA, 15 bp, Homo sapiens
taactggaaacttca

SEQ ID NO: 4253121 - DNA, 18 bp, Homo sapiens
taagcattccaactatct

SEQ ID NO: 4253122 - DNA, 15 bp, Homo sapiens
taagcttatgcttaa

SEQ ID NO: 4253123 - DNA, 16 bp, Homo sapiens
taagcttgtattcctt

SEQ ID NO: 4253124 - DNA, 19 bp, Homo sapiens
taaggggaggaaccagagt

SEQ ID NO: 4253125 - DNA, 14 bp, Homo sapiens
taataatgtttcaa

SEQ ID NO: 4253126 - DNA, 16 bp, Homo sapiens
taatgataactggaaa

SEQ ID NO: 4253127 - DNA, 17 bp, Homo sapiens
taatgataactggaaac

SEQ ID NO: 4253128 - DNA, 22 bp, Homo sapiens
taattggaaaggcagctctaaa

SEQ ID NO: 4253129 - DNA, 14 bp, Homo sapiens
tacacaataagcaa

SEQ ID NO: 4253130 - DNA, 12 bp, Homo sapiens
tacacccagcaa

SEQ ID NO: 4253131 - DNA, 14 bp, Homo sapiens
tacacccagcaata

SEQ ID NO: 4253132 - DNA, 14 bp, Homo sapiens
tacagaagaaactg

SEQ ID NO: 4253133 - DNA, 15 bp, Homo sapiens
tacattgtatatatg

SEQ ID NO: 4253134 - DNA, 17 bp, Homo sapiens
tacatttgtataaaata

SEQ ID NO: 4253135 - DNA, 20 bp, Homo sapiens
tacattttttgggcagcaat

SEQ ID NO: 4253136 - DNA, 18 bp, Homo sapiens
taccaaggtcttcttaat

SEQ ID NO: 4253137 - DNA, 13 bp, Homo sapiens
taccaataaagtg

SEQ ID NO: 4253138 - DNA, 23 bp, Homo sapiens
taccccacctccctcaacctcat

SEQ ID NO: 4253139 - DNA, 17 bp, Homo sapiens
taccctaaccaagttcc

SEQ ID NO: 4253140 - DNA, 21 bp, Homo sapiens
tactagtcaccagagacttta

SEQ ID NO: 4253141 - DNA, 22 bp, Homo sapiens
tactagtcaccagagactttag

SEQ ID NO: 4253142 - DNA, 13 bp, Homo sapiens
tactatagtacca

SEQ ID NO: 4253143 - DNA, 16 bp, Homo sapiens
tactatagtaccagta

SEQ ID NO: 4253144 - DNA, 20 bp, Homo sapiens
tactgcttaattcaaataat

SEQ ID NO: 4253145 - DNA, 22 bp, Homo sapiens
tacttcttttttcaaaagaaag

SEQ ID NO: 4253146 - DNA, 15 bp, Homo sapiens
tagaaaaaaaattat

SEQ ID NO: 4253147 - DNA, 22 bp, Homo sapiens
tagaagagagaggttgaaaaac

SEQ ID NO: 4253148 - DNA, 23 bp, Homo sapiens
tagaatacagttttgagtagagt

SEQ ID NO: 4253149 - DNA, 16 bp, Homo sapiens
tagagaagcaagtaaa

SEQ ID NO: 4253150 - DNA, 17 bp, Homo sapiens
tagagtttagctggaaa

SEQ ID NO: 4253151 - DNA, 15 bp, Homo sapiens
tagatgcagttctga

SEQ ID NO: 4253152 - DNA, 17 bp, Homo sapiens
tagatgcagttctgaag

SEQ ID NO: 4253153 - DNA, 19 bp, Homo sapiens
tagatgcagttctgaagaa

SEQ ID NO: 4253154 - DNA, 16 bp, Homo sapiens
tagatgtatgtacttc

SEQ ID NO: 4253155 - DNA, 14 bp, Homo sapiens
tagccaagtgcagg

SEQ ID NO: 4253156 - DNA, 22 bp, Homo sapiens
taggaagttgacttatagtaca

SEQ ID NO: 4253157 - DNA, 22 bp, Homo sapiens
taggggcttataataaaggact

SEQ ID NO: 4253158 - DNA, 21 bp, Homo sapiens
tagtagcgttttttaaatgta

SEQ ID NO: 4253159 - DNA, 23 bp, Homo sapiens
tagtagcgttttttaaatgtata

SEQ ID NO: 4253160 - DNA, 14 bp, Homo sapiens
tagtcaaattgtgt

SEQ ID NO: 4253161 - DNA, 18 bp, Homo sapiens
tagtcaaattgtgtgaaa

SEQ ID NO: 4253162 - DNA, 22 bp, Homo sapiens
tagtgagcagtcaggaaagaga

SEQ ID NO: 4253163 - DNA, 17 bp, Homo sapiens
tagtgttggagaagaac

SEQ ID NO: 4253164 - DNA, 15 bp, Homo sapiens
tagttttatatgctt

SEQ ID NO: 4253165 - DNA, 22 bp, Homo sapiens
tataaaataatttttatatttg

SEQ ID NO: 4253166 - DNA, 12 bp, Homo sapiens
tataccaataaa

SEQ ID NO: 4253167 - DNA, 14 bp, Homo sapiens
tatacccacccaga

SEQ ID NO: 4253168 - DNA, 20 bp, Homo sapiens
tatactatagtaccagtagg

SEQ ID NO: 4253169 - DNA, 14 bp, Homo sapiens
tatagctaagtaca

SEQ ID NO: 4253170 - DNA, 16 bp, Homo sapiens
tatagtacatgataaa

SEQ ID NO: 4253171 - DNA, 17 bp, Homo sapiens
tatataacaatgctgta

SEQ ID NO: 4253172 - DNA, 13 bp, Homo sapiens
tatatgcttctgt

SEQ ID NO: 4253173 - DNA, 14 bp, Homo sapiens
tatatgcttctgtt

SEQ ID NO: 4253174 - DNA, 16 bp, Homo sapiens
tatatgcttctgtttt

SEQ ID NO: 4253175 - DNA, 15 bp, Homo sapiens
tatattgtttgctaa

SEQ ID NO: 4253176 - DNA, 20 bp, Homo sapiens
tatatttattactgtaagaa

SEQ ID NO: 4253177 - DNA, 14 bp, Homo sapiens
tatctcttcagtct

SEQ ID NO: 4253178 - DNA, 11 bp, Homo sapiens
tatctttgcca

SEQ ID NO: 4253179 - DNA, 21 bp, Homo sapiens
tatgaaatattatgttaaaac

SEQ ID NO: 4253180 - DNA, 18 bp, Homo sapiens
tatgaacttgaggacaca

SEQ ID NO: 4253181 - DNA, 20 bp, Homo sapiens
tatgaacttgaggacacatg

SEQ ID NO: 4253182 - DNA, 23 bp, Homo sapiens
tatgaacttgaggacacatgtcc

SEQ ID NO: 4253183 - DNA, 23 bp, Homo sapiens
tatgaattacatttgtataaaat

SEQ ID NO: 4253184 - DNA, 15 bp, Homo sapiens
tatgccccattcaac

SEQ ID NO: 4253185 - DNA, 16 bp, Homo sapiens
tatgcttctgttttat

SEQ ID NO: 4253186 - DNA, 18 bp, Homo sapiens
tatgtgacattttacatt

SEQ ID NO: 4253187 - DNA, 19 bp, Homo sapiens
tatgtgacattttacatta

SEQ ID NO: 4253188 - DNA, 16 bp, Homo sapiens
tatgttcagattattg

SEQ ID NO: 4253189 - DNA, 15 bp, Homo sapiens
tattacaatgatcac

SEQ ID NO: 4253190 - DNA, 22 bp, Homo sapiens
tattagcccttctccatggccc

SEQ ID NO: 4253191 - DNA, 23 bp, Homo sapiens
tattcaaaaattatctatagcta

SEQ ID NO: 4253192 - DNA, 12 bp, Homo sapiens
tattcaataaag

SEQ ID NO: 4253193 - DNA, 17 bp, Homo sapiens
tattgcatttatatgta

SEQ ID NO: 4253194 - DNA, 22 bp, Homo sapiens
tattgttttacaatagttctgt

SEQ ID NO: 4253195 - DNA, 16 bp, Homo sapiens
tatttattttaataat

SEQ ID NO: 4253196 - DNA, 13 bp, Homo sapiens
tatttctatgaaa

SEQ ID NO: 4253197 - DNA, 14 bp, Homo sapiens
tatttctatgaaat

SEQ ID NO: 4253198 - DNA, 23 bp, Homo sapiens
tcaaaaattaaaccggaccatct

SEQ ID NO: 4253199 - DNA, 20 bp, Homo sapiens
tcaaatcaatctgtaaaact

SEQ ID NO: 4253200 - DNA, 15 bp, Homo sapiens
tcaaatccttgaaga

SEQ ID NO: 4253201 - DNA, 11 bp, Homo sapiens
tcaacctcatc

SEQ ID NO: 4253202 - DNA, 15 bp, Homo sapiens
tcaatattcaataaa

SEQ ID NO: 4253203 - DNA, 15 bp, Homo sapiens
tcaatatttcagata

SEQ ID NO: 4253204 - DNA, 23 bp, Homo sapiens
tcaatatttcagataatcacaat

SEQ ID NO: 4253205 - DNA, 23 bp, Homo sapiens
tcaattaaaatagtctctttaaa

SEQ ID NO: 4253206 - DNA, 17 bp, Homo sapiens
tcaattcttccctatct

SEQ ID NO: 4253207 - DNA, 11 bp, Homo sapiens
tcacactggga

SEQ ID NO: 4253208 - DNA, 14 bp, Homo sapiens
tcaccagagacttt

SEQ ID NO: 4253209 - DNA, 19 bp, Homo sapiens
tcaccagagactttagggg

SEQ ID NO: 4253210 - DNA, 19 bp, Homo sapiens
tcacccaggctggactgca

SEQ ID NO: 4253211 - DNA, 22 bp, Homo sapiens
tcaccgactgaaaatattgttt

SEQ ID NO: 4253212 - DNA, 15 bp, Homo sapiens
tcagatttctgagga

SEQ ID NO: 4253213 - DNA, 19 bp, Homo sapiens
tcaggaaagagaacttcca

SEQ ID NO: 4253214 - DNA, 22 bp, Homo sapiens
tcagtctctataccaataaagt

SEQ ID NO: 4253215 - DNA, 23 bp, Homo sapiens
tcagtctctataccaataaagtg

SEQ ID NO: 4253216 - DNA, 22 bp, Homo sapiens
tcatcctctccacagctgcctc

SEQ ID NO: 4253217 - DNA, 22 bp, Homo sapiens
tcatgaattagttttatatgct

SEQ ID NO: 4253218 - DNA, 15 bp, Homo sapiens
tcatgaccagtaaag

SEQ ID NO: 4253219 - DNA, 19 bp, Homo sapiens
tcatggaattggagctcgt

SEQ ID NO: 4253220 - DNA, 12 bp, Homo sapiens
tcatttcaggat

SEQ ID NO: 4253221 - DNA, 13 bp, Homo sapiens
tcatttccaagca

SEQ ID NO: 4253222 - DNA, 22 bp, Homo sapiens
tccaaaccactttttgcagctt

SEQ ID NO: 4253223 - DNA, 20 bp, Homo sapiens
tccaagcatttagatgtata

SEQ ID NO: 4253224 - DNA, 23 bp, Homo sapiens
tccacagctgcctcttccctctt

SEQ ID NO: 4253225 - DNA, 18 bp, Homo sapiens
tccacatttccccctagc

SEQ ID NO: 4253226 - DNA, 14 bp, Homo sapiens
tccacctcaactcc

SEQ ID NO: 4253227 - DNA, 15 bp, Homo sapiens
tccactcgtgtgttt

SEQ ID NO: 4253228 - DNA, 16 bp, Homo sapiens
tccactctttctttca

SEQ ID NO: 4253229 - DNA, 16 bp, Homo sapiens
tccagatcctggaaat

SEQ ID NO: 4253230 - DNA, 12 bp, Homo sapiens
tccatacatttg

SEQ ID NO: 4253231 - DNA, 21 bp, Homo sapiens
tcccacttcagcctcccaagc

SEQ ID NO: 4253232 - DNA, 22 bp, Homo sapiens
aagaagcaccaatcatgaatta

SEQ ID NO: 4253233 - DNA, 18 bp, Homo sapiens
aagaatgattatgaatta

SEQ ID NO: 4253234 - DNA, 22 bp, Homo sapiens
aagacaagaactcccctttttt

SEQ ID NO: 4253235 - DNA, 16 bp, Homo sapiens
aagactgcacatcaaa

SEQ ID NO: 4253236 - DNA, 15 bp, Homo sapiens
aagagaacttccaga

SEQ ID NO: 4253237 - DNA, 13 bp, Homo sapiens
aagaggaagcaaa

SEQ ID NO: 4253238 - DNA, 19 bp, Homo sapiens
aagattgcttaataaattg

SEQ ID NO: 4253239 - DNA, 14 bp, Homo sapiens
aagcatccctcacc

SEQ ID NO: 4253240 - DNA, 16 bp, Homo sapiens
aagcccattcattcca

SEQ ID NO: 4253241 - DNA, 13 bp, Homo sapiens
aagctccaggtag

SEQ ID NO: 4253242 - DNA, 14 bp, Homo sapiens
aagctccaggtaga

SEQ ID NO: 4253243 - DNA, 17 bp, Homo sapiens
aagctggagtgcagtgg

SEQ ID NO: 4253244 - DNA, 18 bp, Homo sapiens
aagcttatgcttaaattc

SEQ ID NO: 4253245 - DNA, 12 bp, Homo sapiens
aaggaaagaaaa

SEQ ID NO: 4253246 - DNA, 17 bp, Homo sapiens
aaggaaggcagggagga

SEQ ID NO: 4253247 - DNA, 15 bp, Homo sapiens
aaggacatcagcaaa

SEQ ID NO: 4253248 - DNA, 15 bp, Homo sapiens
aagggctgttataat

SEQ ID NO: 4253249 - DNA, 17 bp, Homo sapiens
aagggctgttataatct

SEQ ID NO: 4253250 - DNA, 14 bp, Homo sapiens
aagtaatgataact

SEQ ID NO: 4253251 - DNA, 16 bp, Homo sapiens
aagtacacaataagca

SEQ ID NO: 4253252 - DNA, 19 bp, Homo sapiens
aagtatgttagtgcaaatt

SEQ ID NO: 4253253 - DNA, 20 bp, Homo sapiens
aagtccagtgtttctttttt

SEQ ID NO: 4253254 - DNA, 20 bp, Homo sapiens
aagttccttggccatgcaga

SEQ ID NO: 4253255 - DNA, 20 bp, Homo sapiens
aagttgacttatagtacatg

SEQ ID NO: 4253256 - DNA, 22 bp, Homo sapiens
aagtttagtttgaggaattctt

SEQ ID NO: 4253257 - DNA, 11 bp, Homo sapiens
aataaagcaat

SEQ ID NO: 4253258 - DNA, 22 bp, Homo sapiens
aataaaggactgtaatcttatt

SEQ ID NO: 4253259 - DNA, 11 bp, Homo sapiens
aataattttat

SEQ ID NO: 4253260 - DNA, 17 bp, Homo sapiens
aataatttttatatttg

SEQ ID NO: 4253261 - DNA, 19 bp, Homo sapiens
aataatttttatatttgaa

SEQ ID NO: 4253262 - DNA, 19 bp, Homo sapiens
aatagtcaaattgtgtgaa

SEQ ID NO: 4253263 - DNA, 20 bp, Homo sapiens
aatatcacttgtcaataaaa

SEQ ID NO: 4253264 - DNA, 22 bp, Homo sapiens
aatatcacttgtcaataaaatc

SEQ ID NO: 4253265 - DNA, 16 bp, Homo sapiens
aatattatgttaaaac

SEQ ID NO: 4253266 - DNA, 14 bp, Homo sapiens
aatattcaataaag

SEQ ID NO: 4253267 - DNA, 18 bp, Homo sapiens
aatattgttttacaatag

SEQ ID NO: 4253268 - DNA, 19 bp, Homo sapiens
aatatttattttaataatg

SEQ ID NO: 4253269 - DNA, 13 bp, Homo sapiens
aatcacaatacat

SEQ ID NO: 4253270 - DNA, 16 bp, Homo sapiens
aatcagggttagtatt

SEQ ID NO: 4253271 - DNA, 15 bp, Homo sapiens
aatcatgaattagtt

SEQ ID NO: 4253272 - DNA, 17 bp, Homo sapiens
aatccatacatttgtgt

SEQ ID NO: 4253273 - DNA, 13 bp, Homo sapiens
aatgagacatcca

SEQ ID NO: 4253274 - DNA, 15 bp, Homo sapiens
aatgataactggaaa

SEQ ID NO: 4253275 - DNA, 15 bp, Homo sapiens
aatgattatgaatta

SEQ ID NO: 4253276 - DNA, 21 bp, Homo sapiens
aatgattatgaattacatttg

SEQ ID NO: 4253277 - DNA, 23 bp, Homo sapiens
aatgattatgaattacatttgta

SEQ ID NO: 4253278 - DNA, 20 bp, Homo sapiens
aatgctgtattttaaaagaa

SEQ ID NO: 4253279 - DNA, 19 bp, Homo sapiens
aatggaggggcagagccag

SEQ ID NO: 4253280 - DNA, 22 bp, Homo sapiens
aatggaggggcagagccaggaa

SEQ ID NO: 4253281 - DNA, 15 bp, Homo sapiens
aatgggttacttgat

SEQ ID NO: 4253282 - DNA, 23 bp, Homo sapiens
aatggtcacgtttggtgcttctc

SEQ ID NO: 4253283 - DNA, 16 bp, Homo sapiens
aattacaactaagtga

SEQ ID NO: 4253284 - DNA, 14 bp, Homo sapiens
aattacgtgctctg

SEQ ID NO: 4253285 - DNA, 14 bp, Homo sapiens
aattagttttatat

SEQ ID NO: 4253286 - DNA, 20 bp, Homo sapiens
aattatgtgacattttacat

SEQ ID NO: 4253287 - DNA, 23 bp, Homo sapiens
aattctaccaaggtcttcttaat

SEQ ID NO: 4253288 - DNA, 19 bp, Homo sapiens
aattcttatgccatataat

SEQ ID NO: 4253289 - DNA, 11 bp, Homo sapiens
aattcttccct

SEQ ID NO: 4253290 - DNA, 21 bp, Homo sapiens
aattcttccctatctttgcca

SEQ ID NO: 4253291 - DNA, 19 bp, Homo sapiens
aattttttctctaggaaat

SEQ ID NO: 4253292 - DNA, 19 bp, Homo sapiens
acaaaaaaaaaatttgcca

SEQ ID NO: 4253293 - DNA, 14 bp, Homo sapiens
acaaaaagaaaaga

SEQ ID NO: 4253294 - DNA, 18 bp, Homo sapiens
acaaaaagaaaagaaaat

SEQ ID NO: 4253295 - DNA, 13 bp, Homo sapiens
acaataaatagac

SEQ ID NO: 4253296 - DNA, 16 bp, Homo sapiens
acaataagcaaaaaca

SEQ ID NO: 4253297 - DNA, 13 bp, Homo sapiens
acacaactatatt

SEQ ID NO: 4253298 - DNA, 14 bp, Homo sapiens
acacaactatattg

SEQ ID NO: 4253299 - DNA, 14 bp, Homo sapiens
acacaataagcaaa

SEQ ID NO: 4253300 - DNA, 20 bp, Homo sapiens
acacaccaccacgcctggct

SEQ ID NO: 4253301 - DNA, 19 bp, Homo sapiens
acacatgcttccctttcct

SEQ ID NO: 4253302 - DNA, 21 bp, Homo sapiens
acacatgcttccctttcctga

SEQ ID NO: 4253303 - DNA, 13 bp, Homo sapiens
acacccagcaata

SEQ ID NO: 4253304 - DNA, 16 bp, Homo sapiens
acaccctcacactggg

SEQ ID NO: 4253305 - DNA, 17 bp, Homo sapiens
acacctgccctgccctg

SEQ ID NO: 4253306 - DNA, 18 bp, Homo sapiens
acacctgccctgccctgc

SEQ ID NO: 4253307 - DNA, 20 bp, Homo sapiens
acacctgccctgccctgcca

SEQ ID NO: 4253308 - DNA, 19 bp, Homo sapiens
acactaagagagaatgaga

SEQ ID NO: 4253309 - DNA, 19 bp, Homo sapiens
acactgggacttgcaaaaa

SEQ ID NO: 4253310 - DNA, 19 bp, Homo sapiens
acagagtcttcctctgtct

SEQ ID NO: 4253311 - DNA, 21 bp, Homo sapiens
acagcccttctttccacagaa

SEQ ID NO: 4253312 - DNA, 16 bp, Homo sapiens
acagcctcttagatgc

SEQ ID NO: 4253313 - DNA, 12 bp, Homo sapiens
acaggatccagg

SEQ ID NO: 4253314 - DNA, 17 bp, Homo sapiens
acagtcacctcatggaa

SEQ ID NO: 4253315 - DNA, 18 bp, Homo sapiens
acagtcacctcatggaat

SEQ ID NO: 4253316 - DNA, 15 bp, Homo sapiens
acataaaaaggacat

SEQ ID NO: 4253317 - DNA, 20 bp, Homo sapiens
acatagtgggaccctgtctc

SEQ ID NO: 4253318 - DNA, 12 bp, Homo sapiens
acatccagcaga

SEQ ID NO: 4253319 - DNA, 21 bp, Homo sapiens
acatgggacatttgctcatgg

SEQ ID NO: 4253320 - DNA, 22 bp, Homo sapiens
acattaaattttttttacattt

SEQ ID NO: 4253321 - DNA, 18 bp, Homo sapiens
acatttccttacagaact

SEQ ID NO: 4253322 - DNA, 16 bp, Homo sapiens
acatttgtataaaata

SEQ ID NO: 4253323 - DNA, 21 bp, Homo sapiens
acatttgtataaaataatttt

SEQ ID NO: 4253324 - DNA, 18 bp, Homo sapiens
acattttacattaaattt

SEQ ID NO: 4253325 - DNA, 17 bp, Homo sapiens
accaataaaataatttt

SEQ ID NO: 4253326 - DNA, 22 bp, Homo sapiens
actatattgtttgctaagcatt

SEQ ID NO: 4253327 - DNA, 15 bp, Homo sapiens
actatctcatttcca

SEQ ID NO: 4253328 - DNA, 16 bp, Homo sapiens
actatgtaaactactt

SEQ ID NO: 4253329 - DNA, 19 bp, Homo sapiens
actcaaaccaaatcactga

SEQ ID NO: 4253330 - DNA, 20 bp, Homo sapiens
actccgtgcttaaccaaaga

SEQ ID NO: 4253331 - DNA, 20 bp, Homo sapiens
actcttcaaggtctgctttt

SEQ ID NO: 4253332 - DNA, 19 bp, Homo sapiens
actctttctttcaataaaa

SEQ ID NO: 4253333 - DNA, 18 bp, Homo sapiens
actgaaaatattgtttta

SEQ ID NO: 4253334 - DNA, 18 bp, Homo sapiens
actgactcttaagaagac

SEQ ID NO: 4253335 - DNA, 17 bp, Homo sapiens
actgcaacctccacctc

SEQ ID NO: 4253336 - DNA, 13 bp, Homo sapiens
actgcctttgacc

SEQ ID NO: 4253337 - DNA, 21 bp, Homo sapiens
actgctctcctccacctcaac

SEQ ID NO: 4253338 - DNA, 13 bp, Homo sapiens
actgtaagaaaat

SEQ ID NO: 4253339 - DNA, 19 bp, Homo sapiens
actgtaagaaaatatcact

SEQ ID NO: 4253340 - DNA, 19 bp, Homo sapiens
actgtaatcttatttagga

SEQ ID NO: 4253341 - DNA, 13 bp, Homo sapiens
actgtgggtagac

SEQ ID NO: 4253342 - DNA, 18 bp, Homo sapiens
actgtgggtagacacaca

SEQ ID NO: 4253343 - DNA, 13 bp, Homo sapiens
acttaaattttag

SEQ ID NO: 4253344 - DNA, 14 bp, Homo sapiens
acttatagtacatg

SEQ ID NO: 4253345 - DNA, 15 bp, Homo sapiens
acttatagtacatga

SEQ ID NO: 4253346 - DNA, 19 bp, Homo sapiens
acttcaaatccttgaagat

SEQ ID NO: 4253347 - DNA, 11 bp, Homo sapiens
acttgaggaca

SEQ ID NO: 4253348 - DNA, 14 bp, Homo sapiens
acttgaggacacat

SEQ ID NO: 4253349 - DNA, 19 bp, Homo sapiens
acttgaggacacatgtcca

SEQ ID NO: 4253350 - DNA, 16 bp, Homo sapiens
acttgtcaataaaatc

SEQ ID NO: 4253351 - DNA, 19 bp, Homo sapiens
actttagggggtgggattc

SEQ ID NO: 4253352 - DNA, 13 bp, Homo sapiens
actttggctgcat

SEQ ID NO: 4253353 - DNA, 17 bp, Homo sapiens
actttggctgcatgcga

SEQ ID NO: 4253354 - DNA, 16 bp, Homo sapiens
agaaaacaaggatgaa

SEQ ID NO: 4253355 - DNA, 20 bp, Homo sapiens
agaaagaacggaagaagaga

SEQ ID NO: 4253356 - DNA, 19 bp, Homo sapiens
agaaagcatccctcaccca

SEQ ID NO: 4253357 - DNA, 16 bp, Homo sapiens
agaagaaagaacggaa

SEQ ID NO: 4253358 - DNA, 13 bp, Homo sapiens
agaagaactgaaa

SEQ ID NO: 4253359 - DNA, 17 bp, Homo sapiens
agaagagatcaggaaga

SEQ ID NO: 4253360 - DNA, 13 bp, Homo sapiens
agaagcaagtaaa

SEQ ID NO: 4253361 - DNA, 19 bp, Homo sapiens
agaagcaccaatcatgaat

SEQ ID NO: 4253362 - DNA, 21 bp, Homo sapiens
agaaggaaggcagggaggagg

SEQ ID NO: 4253363 - DNA, 23 bp, Homo sapiens
agacaattgaggtaagttttttg

SEQ ID NO: 4253364 - DNA, 17 bp, Homo sapiens
agacacactgaagaagc

SEQ ID NO: 4253365 - DNA, 13 bp, Homo sapiens
agacacgcacggc

SEQ ID NO: 4253366 - DNA, 15 bp, Homo sapiens
agacacgcacggcag

SEQ ID NO: 4253367 - DNA, 22 bp, Homo sapiens
agacacgcacggcagccacagc

SEQ ID NO: 4253368 - DNA, 19 bp, Homo sapiens
agacagagtcttactctgt

SEQ ID NO: 4253369 - DNA, 20 bp, Homo sapiens
agacagagtcttactctgtt

SEQ ID NO: 4253370 - DNA, 19 bp, Homo sapiens
agacattttaaaaaatggt

SEQ ID NO: 4253371 - DNA, 22 bp, Homo sapiens
agacattttaaaaaatggtcac

SEQ ID NO: 4253372 - DNA, 17 bp, Homo sapiens
agaccacctctcaatat

SEQ ID NO: 4253373 - DNA, 22 bp, Homo sapiens
agactgggtaggaaagaggaag

SEQ ID NO: 4253374 - DNA, 15 bp, Homo sapiens
agagaagcaagtaaa

SEQ ID NO: 4253375 - DNA, 15 bp, Homo sapiens
agagaatgagagaca

SEQ ID NO: 4253376 - DNA, 18 bp, Homo sapiens
agagacacactgaagaag

SEQ ID NO: 4253377 - DNA, 14 bp, Homo sapiens
agagatcaggaaga

SEQ ID NO: 4253378 - DNA, 21 bp, Homo sapiens
agagctgatggagaaggaagg

SEQ ID NO: 4253379 - DNA, 18 bp, Homo sapiens
agaggaattacgtgctct

SEQ ID NO: 4253380 - DNA, 17 bp, Homo sapiens
agagtttagctggaaaa

SEQ ID NO: 4253381 - DNA, 13 bp, Homo sapiens
agatcaggaagag

SEQ ID NO: 4253382 - DNA, 17 bp, Homo sapiens
agatcaggaagagaagg

SEQ ID NO: 4253383 - DNA, 13 bp, Homo sapiens
agatcccccagaa

SEQ ID NO: 4253384 - DNA, 15 bp, Homo sapiens
agatcccccagaaaa

SEQ ID NO: 4253385 - DNA, 13 bp, Homo sapiens
agatcctggaaat

SEQ ID NO: 4253386 - DNA, 20 bp, Homo sapiens
agatgcagttctgaagaaga

SEQ ID NO: 4253387 - DNA, 21 bp, Homo sapiens
agatgcagttctgaagaagat

SEQ ID NO: 4253388 - DNA, 24 bp, Homo sapiens
agcaaaattttttctctaggaaat

SEQ ID NO: 4253389 - DNA, 12 bp, Homo sapiens
agcaacaataaa

SEQ ID NO: 4253390 - DNA, 13 bp, Homo sapiens
agcaacaataaat

SEQ ID NO: 4253391 - DNA, 13 bp, Homo sapiens
agcaagtaaaaag

SEQ ID NO: 4253392 - DNA, 18 bp, Homo sapiens
agcaagtaaaaaggctaa

SEQ ID NO: 4253393 - DNA, 15 bp, Homo sapiens
agcaatcctcccact

SEQ ID NO: 4253394 - DNA, 12 bp, Homo sapiens
agcactgctcca

SEQ ID NO: 4253395 - DNA, 17 bp, Homo sapiens
agcagagctgatggaga

SEQ ID NO: 4253396 - DNA, 22 bp, Homo sapiens
agcagagctgatggagaaggaa

SEQ ID NO: 4253397 - DNA, 18 bp, Homo sapiens
agcagtcaggaaagagaa

SEQ ID NO: 4253398 - DNA, 19 bp, Homo sapiens
agcagtcaggaaagagaac

SEQ ID NO: 4253399 - DNA, 15 bp, Homo sapiens
agcatccctcaccca

SEQ ID NO: 4253400 - DNA, 15 bp, Homo sapiens
agcatgccttcaaat

SEQ ID NO: 4253401 - DNA, 19 bp, Homo sapiens
agccacggggactcagccc

SEQ ID NO: 4253402 - DNA, 15 bp, Homo sapiens
agccagattttcctg

SEQ ID NO: 4253403 - DNA, 20 bp, Homo sapiens
agccaggaagatcccccaga

SEQ ID NO: 4253404 - DNA, 14 bp, Homo sapiens
agcccattcattcc

SEQ ID NO: 4253405 - DNA, 17 bp, Homo sapiens
agcccattcattccatt

SEQ ID NO: 4253406 - DNA, 18 bp, Homo sapiens
agccctgctgctgcctgc

SEQ ID NO: 4253407 - DNA, 19 bp, Homo sapiens
agccctgctgctgcctgcc

SEQ ID NO: 4253408 - DNA, 17 bp, Homo sapiens
agcctccttagaaaaaa

SEQ ID NO: 4253409 - DNA, 20 bp, Homo sapiens
agccttggggctgatgcagt

SEQ ID NO: 4253410 - DNA, 19 bp, Homo sapiens
agcgcctccaaccctagca

SEQ ID NO: 4253411 - DNA, 23 bp, Homo sapiens
agcgcctccaaccctagcaaaag

SEQ ID NO: 4253412 - DNA, 17 bp, Homo sapiens
agcgttttttaaatgta

SEQ ID NO: 4253413 - DNA, 18 bp, Homo sapiens
agcgttttttaaatgtat

SEQ ID NO: 4253414 - DNA, 19 bp, Homo sapiens
agcgttttttaaatgtata

SEQ ID NO: 4253415 - DNA, 17 bp, Homo sapiens
agctatataagacaaga

SEQ ID NO: 4253416 - DNA, 17 bp, Homo sapiens
agctctcagttgcagcc

SEQ ID NO: 4253417 - DNA, 16 bp, Homo sapiens
agctgatggagaagga

SEQ ID NO: 4253418 - DNA, 17 bp, Homo sapiens
agctgatggagaaggaa

SEQ ID NO: 4253419 - DNA, 19 bp, Homo sapiens
agctgatggagaaggaagg

SEQ ID NO: 4253420 - DNA, 15 bp, Homo sapiens
agctgcctcttccct

SEQ ID NO: 4253421 - DNA, 19 bp, Homo sapiens
agctgcctcttccctcttc

SEQ ID NO: 4253422 - DNA, 18 bp, Homo sapiens
agctgtatgattcccagc

SEQ ID NO: 4253423 - DNA, 13 bp, Homo sapiens
aggaaagaaaaca

SEQ ID NO: 4253424 - DNA, 13 bp, Homo sapiens
aggaaagagaact

SEQ ID NO: 4253425 - DNA, 17 bp, Homo sapiens
aggaaagaggaagcaaa

SEQ ID NO: 4253426 - DNA, 14 bp, Homo sapiens
aggaagagaaggag

SEQ ID NO: 4253427 - DNA, 17 bp, Homo sapiens
aggaagagaaggagcag

SEQ ID NO: 4253428 - DNA, 17 bp, Homo sapiens
aggaagatcccccagaa

SEQ ID NO: 4253429 - DNA, 18 bp, Homo sapiens
aggaaggaggacccagga

SEQ ID NO: 4253430 - DNA, 23 bp, Homo sapiens
aggacagcccttctttccacaga

SEQ ID NO: 4253431 - DNA, 14 bp, Homo sapiens
aggacaggatccag

SEQ ID NO: 4253432 - DNA, 13 bp, Homo sapiens
aggacatcagcaa

SEQ ID NO: 4253433 - DNA, 13 bp, Homo sapiens
aggacccaggaca

SEQ ID NO: 4253434 - DNA, 14 bp, Homo sapiens
aggacccaggacag

SEQ ID NO: 4253435 - DNA, 23 bp, Homo sapiens
aggacccaggacaggatccaggc

SEQ ID NO: 4253436 - DNA, 20 bp, Homo sapiens
aggagagggcgctcctctct

SEQ ID NO: 4253437 - DNA, 12 bp, Homo sapiens
aggaggacccag

SEQ ID NO: 4253438 - DNA, 15 bp, Homo sapiens
aggaggacccaggac

SEQ ID NO: 4253439 - DNA, 17 bp, Homo sapiens
aggaggacccaggacag

SEQ ID NO: 4253440 - DNA, 18 bp, Homo sapiens
aggaggacccaggacagg

SEQ ID NO: 4253441 - DNA, 14 bp, Homo sapiens
aggaggcagagaag

SEQ ID NO: 4253442 - DNA, 23 bp, Homo sapiens
aggatcagttaactattgcattt

SEQ ID NO: 4253443 - DNA, 19 bp, Homo sapiens
aggcagttcaaagcaggat

SEQ ID NO: 4253444 - DNA, 16 bp, Homo sapiens
aggccagaccatggac

SEQ ID NO: 4253445 - DNA, 21 bp, Homo sapiens
aggccatgggcactgtgggta

SEQ ID NO: 4253446 - DNA, 23 bp, Homo sapiens
aggccatgggcactgtgggtaga

SEQ ID NO: 4253447 - DNA, 20 bp, Homo sapiens
aggcctattgttgaataaat

SEQ ID NO: 4253448 - DNA, 22 bp, Homo sapiens
agggaccggcggaccccagcca

SEQ ID NO: 4253449 - DNA, 16 bp, Homo sapiens
aggggaattgaggaca

SEQ ID NO: 4253450 - DNA, 19 bp, Homo sapiens
atgtatactatagtaccag

SEQ ID NO: 4253451 - DNA, 16 bp, Homo sapiens
atgtcaatcagcctag

SEQ ID NO: 4253452 - DNA, 18 bp, Homo sapiens
atgtgacattttacatta

SEQ ID NO: 4253453 - DNA, 19 bp, Homo sapiens
atgtgctagtaattggaaa

SEQ ID NO: 4253454 - DNA, 21 bp, Homo sapiens
atgtgctagtaattggaaagg

SEQ ID NO: 4253455 - DNA, 20 bp, Homo sapiens
atgtgtatgcacagtaaaaa

SEQ ID NO: 4253456 - DNA, 18 bp, Homo sapiens
attaaattttttttacat

SEQ ID NO: 4253457 - DNA, 13 bp, Homo sapiens
attaagtaatgat

SEQ ID NO: 4253458 - DNA, 13 bp, Homo sapiens
attacatttgtat

SEQ ID NO: 4253459 - DNA, 15 bp, Homo sapiens
attatatttattact

SEQ ID NO: 4253460 - DNA, 18 bp, Homo sapiens
attatatttattactgta

SEQ ID NO: 4253461 - DNA, 19 bp, Homo sapiens
attatctatagctaagtac

SEQ ID NO: 4253462 - DNA, 14 bp, Homo sapiens
attatgaattacat

SEQ ID NO: 4253463 - DNA, 17 bp, Homo sapiens
attatgaattacatttg

SEQ ID NO: 4253464 - DNA, 19 bp, Homo sapiens
attatgaattacatttgta

SEQ ID NO: 4253465 - DNA, 20 bp, Homo sapiens
attatgaattacatttgtat

SEQ ID NO: 4253466 - DNA, 13 bp, Homo sapiens
attatgtgacatt

SEQ ID NO: 4253467 - DNA, 16 bp, Homo sapiens
attcaaaaattatcta

SEQ ID NO: 4253468 - DNA, 23 bp, Homo sapiens
attcaaaaattatctatagctaa

SEQ ID NO: 4253469 - DNA, 13 bp, Homo sapiens
attcaataaagct

SEQ ID NO: 4253470 - DNA, 18 bp, Homo sapiens
attcattccattctggaa

SEQ ID NO: 4253471 - DNA, 19 bp, Homo sapiens
attcattccattctggaag

SEQ ID NO: 4253472 - DNA, 22 bp, Homo sapiens
attgaggacactgatatgggtc

SEQ ID NO: 4253473 - DNA, 14 bp, Homo sapiens
attgaggtaagttt

SEQ ID NO: 4253474 - DNA, 21 bp, Homo sapiens
attgctttgtattgtatatta

SEQ ID NO: 4253475 - DNA, 20 bp, Homo sapiens
attgtatattacaatgatca

SEQ ID NO: 4253476 - DNA, 15 bp, Homo sapiens
attgttgaataaatg

SEQ ID NO: 4253477 - DNA, 16 bp, Homo sapiens
attgttgaataaatgt

SEQ ID NO: 4253478 - DNA, 18 bp, Homo sapiens
attgttttacaatagttc

SEQ ID NO: 4253479 - DNA, 19 bp, Homo sapiens
attgttttacaatagttct

SEQ ID NO: 4253480 - DNA, 23 bp, Homo sapiens
atttaaatgttatgactatgtaa

SEQ ID NO: 4253481 - DNA, 22 bp, Homo sapiens
atttaccacttgtgttttgcaa

SEQ ID NO: 4253482 - DNA, 22 bp, Homo sapiens
atttattactgtaagaaaatat

SEQ ID NO: 4253483 - DNA, 20 bp, Homo sapiens
atttattttaataatgtttc

SEQ ID NO: 4253484 - DNA, 21 bp, Homo sapiens
atttattttaataatgtttca

SEQ ID NO: 4253485 - DNA, 15 bp, Homo sapiens
atttctatgaaatat

SEQ ID NO: 4253486 - DNA, 20 bp, Homo sapiens
atttctatgaaatattatgt

SEQ ID NO: 4253487 - DNA, 14 bp, Homo sapiens
atttgaaccaataa

SEQ ID NO: 4253488 - DNA, 14 bp, Homo sapiens
atttgtataaaata

SEQ ID NO: 4253489 - DNA, 18 bp, Homo sapiens
atttgtataaaataattt

SEQ ID NO: 4253490 - DNA, 17 bp, Homo sapiens
attttaaaaaatggtca

SEQ ID NO: 4253491 - DNA, 18 bp, Homo sapiens
attttaaaagaatgatta

SEQ ID NO: 4253492 - DNA, 22 bp, Homo sapiens
attttaaaagaatgattatgaa

SEQ ID NO: 4253493 - DNA, 15 bp, Homo sapiens
attttaataatgttt

SEQ ID NO: 4253494 - DNA, 16 bp, Homo sapiens
attttaataatgtttc

SEQ ID NO: 4253495 - DNA, 13 bp, Homo sapiens
attttcctgaaaa

SEQ ID NO: 4253496 - DNA, 16 bp, Homo sapiens
atttttatatttgaaa

SEQ ID NO: 4253497 - DNA, 20 bp, Homo sapiens
caaaaagaaaagaaaatttt

SEQ ID NO: 4253498 - DNA, 15 bp, Homo sapiens
caaaagcccattcat

SEQ ID NO: 4253499 - DNA, 20 bp, Homo sapiens
caaaagcccattcattccat

SEQ ID NO: 4253500 - DNA, 16 bp, Homo sapiens
caaaatcaattaaaat

SEQ ID NO: 4253501 - DNA, 16 bp, Homo sapiens
caaactgactcttaag

SEQ ID NO: 4253502 - DNA, 20 bp, Homo sapiens
caaatcaatctgtaaaacta

SEQ ID NO: 4253503 - DNA, 15 bp, Homo sapiens
caaatcactgaactt

SEQ ID NO: 4253504 - DNA, 15 bp, Homo sapiens
caaattgtgtgaaag

SEQ ID NO: 4253505 - DNA, 18 bp, Homo sapiens
caacacacacatgcttcc

SEQ ID NO: 4253506 - DNA, 20 bp, Homo sapiens
caacctctgcctcccaggtt

SEQ ID NO: 4253507 - DNA, 12 bp, Homo sapiens
caactccagaaa

SEQ ID NO: 4253508 - DNA, 22 bp, Homo sapiens
caagtgcagggcctgtaatccc

SEQ ID NO: 4253509 - DNA, 20 bp, Homo sapiens
caataaaatccatacatttg

SEQ ID NO: 4253510 - DNA, 22 bp, Homo sapiens
caataaagctgctgagaatcta

SEQ ID NO: 4253511 - DNA, 23 bp, Homo sapiens
caataaagctgctgagaatctag

SEQ ID NO: 4253512 - DNA, 13 bp, Homo sapiens
caataaatagaca

SEQ ID NO: 4253513 - DNA, 23 bp, Homo sapiens
caatacatcccttacctgggaaa

SEQ ID NO: 4253514 - DNA, 21 bp, Homo sapiens
caatatttcagataatcacaa

SEQ ID NO: 4253515 - DNA, 17 bp, Homo sapiens
caatcagcctagttgat

SEQ ID NO: 4253516 - DNA, 20 bp, Homo sapiens
caatgatcaccgactgaaaa

SEQ ID NO: 4253517 - DNA, 14 bp, Homo sapiens
caatgctgtatttt

SEQ ID NO: 4253518 - DNA, 23 bp, Homo sapiens
caatgctgtattttaaaagaatg

SEQ ID NO: 4253519 - DNA, 13 bp, Homo sapiens
cacaactatattg

SEQ ID NO: 4253520 - DNA, 22 bp, Homo sapiens
cacacctactagtcaccagaga

SEQ ID NO: 4253521 - DNA, 17 bp, Homo sapiens
cacatgaagtccaagca

SEQ ID NO: 4253522 - DNA, 20 bp, Homo sapiens
cacatgaagtccaagcattt

SEQ ID NO: 4253523 - DNA, 20 bp, Homo sapiens
caccatgttggccaggcttg

SEQ ID NO: 4253524 - DNA, 16 bp, Homo sapiens
cacccagcaatagaga

SEQ ID NO: 4253525 - DNA, 23 bp, Homo sapiens
cacccctaaaagaaaccctgcac

SEQ ID NO: 4253526 - DNA, 12 bp, Homo sapiens
caccctcacact

SEQ ID NO: 4253527 - DNA, 16 bp, Homo sapiens
caccctcatgctgtgt

SEQ ID NO: 4253528 - DNA, 23 bp, Homo sapiens
caccctcgtggacacctgccctg

SEQ ID NO: 4253529 - DNA, 14 bp, Homo sapiens
cacctcatggaatt

SEQ ID NO: 4253530 - DNA, 21 bp, Homo sapiens
cacctccctcaacctcatcct

SEQ ID NO: 4253531 - DNA, 19 bp, Homo sapiens
cacctcgcaggttcaagca

SEQ ID NO: 4253532 - DNA, 23 bp, Homo sapiens
cacctctcaatattcaataaagc

SEQ ID NO: 4253533 - DNA, 17 bp, Homo sapiens
cacctgccctgccctgc

SEQ ID NO: 4253534 - DNA, 13 bp, Homo sapiens
cacctgtctgtct

SEQ ID NO: 4253535 - DNA, 14 bp, Homo sapiens
cacctgtctgtctg

SEQ ID NO: 4253536 - DNA, 13 bp, Homo sapiens
cacgcacggcagc

SEQ ID NO: 4253537 - DNA, 13 bp, Homo sapiens
cacggcagccaca

SEQ ID NO: 4253538 - DNA, 17 bp, Homo sapiens
cactaagagagaatgag

SEQ ID NO: 4253539 - DNA, 14 bp, Homo sapiens
cactacaacctccg

SEQ ID NO: 4253540 - DNA, 12 bp, Homo sapiens
cactacacccag

SEQ ID NO: 4253541 - DNA, 14 bp, Homo sapiens
cactacacccagca

SEQ ID NO: 4253542 - DNA, 16 bp, Homo sapiens
cactacacccagcaat

SEQ ID NO: 4253543 - DNA, 17 bp, Homo sapiens
cactacacccagcaata

SEQ ID NO: 4253544 - DNA, 23 bp, Homo sapiens
cactacgcctggctgatttttgt

SEQ ID NO: 4253545 - DNA, 14 bp, Homo sapiens
cactctttctttca

SEQ ID NO: 4253546 - DNA, 20 bp, Homo sapiens
cactgaactttgctgagcct

SEQ ID NO: 4253547 - DNA, 11 bp, Homo sapiens
cactgaagaag

SEQ ID NO: 4253548 - DNA, 19 bp, Homo sapiens
cactgcaacctccacctcg

SEQ ID NO: 4253549 - DNA, 20 bp, Homo sapiens
cactgccttctcaactccaa

SEQ ID NO: 4253550 - DNA, 22 bp, Homo sapiens
cactgtgggtagacacacatga

SEQ ID NO: 4253551 - DNA, 22 bp, Homo sapiens
cacttgtgttttgcaagccaga

SEQ ID NO: 4253552 - DNA, 15 bp, Homo sapiens
cactttttgcagctt

SEQ ID NO: 4253553 - DNA, 18 bp, Homo sapiens
cactttttgcagctttct

SEQ ID NO: 4253554 - DNA, 21 bp, Homo sapiens
cagaaacaccctcacactggg

SEQ ID NO: 4253555 - DNA, 23 bp, Homo sapiens
cagaaacaccctcacactgggac

SEQ ID NO: 4253556 - DNA, 14 bp, Homo sapiens
cagaaatacaattt

SEQ ID NO: 4253557 - DNA, 11 bp, Homo sapiens
cagaaggaagg

SEQ ID NO: 4253558 - DNA, 15 bp, Homo sapiens
cagaaggaaggcagg

SEQ ID NO: 4253559 - DNA, 15 bp, Homo sapiens
cagagcactgctcca

SEQ ID NO: 4253560 - DNA, 21 bp, Homo sapiens
cagagccaggaagatccccca

SEQ ID NO: 4253561 - DNA, 22 bp, Homo sapiens
cagagctgatggagaaggaagg

SEQ ID NO: 4253562 - DNA, 13 bp, Homo sapiens
cctcacactggga

SEQ ID NO: 4253563 - DNA, 15 bp, Homo sapiens
cctcacactgggact

SEQ ID NO: 4253564 - DNA, 18 bp, Homo sapiens
cctcaccagccctggcaa

SEQ ID NO: 4253565 - DNA, 20 bp, Homo sapiens
cctccactctttctttcaat

SEQ ID NO: 4253566 - DNA, 21 bp, Homo sapiens
cctccagggtggcagcaacaa

SEQ ID NO: 4253567 - DNA, 22 bp, Homo sapiens
cctccctaccctaaccaagttc

SEQ ID NO: 4253568 - DNA, 17 bp, Homo sapiens
cctccctcaacctcatc

SEQ ID NO: 4253569 - DNA, 18 bp, Homo sapiens
cctcgccggatctgaggg

SEQ ID NO: 4253570 - DNA, 19 bp, Homo sapiens
cctcgccggatctgaggga

SEQ ID NO: 4253571 - DNA, 18 bp, Homo sapiens
cctcgtggacacctgccc

SEQ ID NO: 4253572 - DNA, 21 bp, Homo sapiens
cctcgtggacacctgccctgc

SEQ ID NO: 4253573 - DNA, 22 bp, Homo sapiens
cctcgtggacacctgccctgcc

SEQ ID NO: 4253574 - DNA, 23 bp, Homo sapiens
cctctgcagtctctataccaata

SEQ ID NO: 4253575 - DNA, 23 bp, Homo sapiens
cctcttagatgcagttctgaaga

SEQ ID NO: 4253576 - DNA, 23 bp, Homo sapiens
cctgaccctccaccgcagaagga

SEQ ID NO: 4253577 - DNA, 11 bp, Homo sapiens
cctgagtccca

SEQ ID NO: 4253578 - DNA, 16 bp, Homo sapiens
cctgccacctgtctgt

SEQ ID NO: 4253579 - DNA, 17 bp, Homo sapiens
cctgccctgccacctgt

SEQ ID NO: 4253580 - DNA, 21 bp, Homo sapiens
cctgccctgccacctgtctgt

SEQ ID NO: 4253581 - DNA, 22 bp, Homo sapiens
cctgcctcaccagccctggcaa

SEQ ID NO: 4253582 - DNA, 16 bp, Homo sapiens
cctgcctcccttcatg

SEQ ID NO: 4253583 - DNA, 18 bp, Homo sapiens
cctgctgctgcctgcctg

SEQ ID NO: 4253584 - DNA, 19 bp, Homo sapiens
cctgctgtgaaagaagtaa

SEQ ID NO: 4253585 - DNA, 14 bp, Homo sapiens
cctggaaaccttcc

SEQ ID NO: 4253586 - DNA, 23 bp, Homo sapiens
cctggaaatcagggttagtattg

SEQ ID NO: 4253587 - DNA, 20 bp, Homo sapiens
cctgtctgtctgtctgtccc

SEQ ID NO: 4253588 - DNA, 24 bp, Homo sapiens
cctgtggaacataaaaaggacatc

SEQ ID NO: 4253589 - DNA, 13 bp, Homo sapiens
ccttccacccagt

SEQ ID NO: 4253590 - DNA, 20 bp, Homo sapiens
ccttctatacccacccagaa

SEQ ID NO: 4253591 - DNA, 14 bp, Homo sapiens
ccttgatgaagaag

SEQ ID NO: 4253592 - DNA, 19 bp, Homo sapiens
ccttggggctgatgcagtt

SEQ ID NO: 4253593 - DNA, 21 bp, Homo sapiens
ccttgtttctcttcctttctt

SEQ ID NO: 4253594 - DNA, 15 bp, Homo sapiens
cgagtgctcatttca

SEQ ID NO: 4253595 - DNA, 13 bp, Homo sapiens
cgatctcagctca

SEQ ID NO: 4253596 - DNA, 17 bp, Homo sapiens
cggagtcaaaaattaaa

SEQ ID NO: 4253597 - DNA, 13 bp, Homo sapiens
cgggactgcggag

SEQ ID NO: 4253598 - DNA, 14 bp, Homo sapiens
cgtgatctcagctc

SEQ ID NO: 4253599 - DNA, 15 bp, Homo sapiens
cgtgatctcagctca

SEQ ID NO: 4253600 - DNA, 12 bp, Homo sapiens
cgtggacacctg

SEQ ID NO: 4253601 - DNA, 14 bp, Homo sapiens
ctaagagagaatga

SEQ ID NO: 4253602 - DNA, 20 bp, Homo sapiens
ctaatttttgtatttttagt

SEQ ID NO: 4253603 - DNA, 15 bp, Homo sapiens
ctaccctaaccaagt

SEQ ID NO: 4253604 - DNA, 16 bp, Homo sapiens
ctaccctaaccaagtt

SEQ ID NO: 4253605 - DNA, 22 bp, Homo sapiens
ctactttctgtgtctatggatt

SEQ ID NO: 4253606 - DNA, 19 bp, Homo sapiens
ctagagtttagctggaaaa

SEQ ID NO: 4253607 - DNA, 14 bp, Homo sapiens
ctaggaaatattta

SEQ ID NO: 4253608 - DNA, 19 bp, Homo sapiens
ctaggaaatatttatttta

SEQ ID NO: 4253609 - DNA, 22 bp, Homo sapiens
ctaggaaatatttattttaata

SEQ ID NO: 4253610 - DNA, 16 bp, Homo sapiens
ctagtaattggaaagg

SEQ ID NO: 4253611 - DNA, 19 bp, Homo sapiens
ctagtatttctatgaaata

SEQ ID NO: 4253612 - DNA, 20 bp, Homo sapiens
ctagtatttctatgaaatat

SEQ ID NO: 4253613 - DNA, 21 bp, Homo sapiens
ctagtgagcagtcaggaaaga

SEQ ID NO: 4253614 - DNA, 20 bp, Homo sapiens
ctagtgtagaattgtgcaac

SEQ ID NO: 4253615 - DNA, 14 bp, Homo sapiens
ctataccaataaag

SEQ ID NO: 4253616 - DNA, 15 bp, Homo sapiens
ctataccaataaagt

SEQ ID NO: 4253617 - DNA, 18 bp, Homo sapiens
ctatattgtttgctaagc

SEQ ID NO: 4253618 - DNA, 19 bp, Homo sapiens
ctatattgtttgctaagca

SEQ ID NO: 4253619 - DNA, 18 bp, Homo sapiens
ctatctttgccaccctca

SEQ ID NO: 4253620 - DNA, 19 bp, Homo sapiens
ctatgaaatattatgttaa

SEQ ID NO: 4253621 - DNA, 13 bp, Homo sapiens
ctatgtaaactac

SEQ ID NO: 4253622 - DNA, 17 bp, Homo sapiens
ctattgcatttatatgt

SEQ ID NO: 4253623 - DNA, 16 bp, Homo sapiens
ctattgttgaataaat

SEQ ID NO: 4253624 - DNA, 18 bp, Homo sapiens
ctattgttgaataaatgt

SEQ ID NO: 4253625 - DNA, 23 bp, Homo sapiens
ctattgttgaataaatgtatctg

SEQ ID NO: 4253626 - DNA, 18 bp, Homo sapiens
ctcaaaccaaatcactga

SEQ ID NO: 4253627 - DNA, 23 bp, Homo sapiens
ctcaactccgtgcttaaccaaag

SEQ ID NO: 4253628 - DNA, 17 bp, Homo sapiens
ctcaatattcaataaag

SEQ ID NO: 4253629 - DNA, 19 bp, Homo sapiens
ctcaatattcaataaagct

SEQ ID NO: 4253630 - DNA, 17 bp, Homo sapiens
ctcacccatcctagagg

SEQ ID NO: 4253631 - DNA, 17 bp, Homo sapiens
ctcagatttctgaggaa

SEQ ID NO: 4253632 - DNA, 14 bp, Homo sapiens
ctcagctcactgca

SEQ ID NO: 4253633 - DNA, 17 bp, Homo sapiens
ctcataccctccctccc

SEQ ID NO: 4253634 - DNA, 12 bp, Homo sapiens
ctcatttcagga

SEQ ID NO: 4253635 - DNA, 12 bp, Homo sapiens
ctcatttccaag

SEQ ID NO: 4253636 - DNA, 13 bp, Homo sapiens
ctcatttccaagc

SEQ ID NO: 4253637 - DNA, 13 bp, Homo sapiens
ctccaaaccactt

SEQ ID NO: 4253638 - DNA, 18 bp, Homo sapiens
ctccaaccctagcaaaag

SEQ ID NO: 4253639 - DNA, 16 bp, Homo sapiens
ctccaccgcagaagga

SEQ ID NO: 4253640 - DNA, 17 bp, Homo sapiens
ctccaccgcagaaggaa

SEQ ID NO: 4253641 - DNA, 14 bp, Homo sapiens
ctccactctttctt

SEQ ID NO: 4253642 - DNA, 12 bp, Homo sapiens
ctccagcctcag

SEQ ID NO: 4253643 - DNA, 15 bp, Homo sapiens
ctccagcctcagcct

SEQ ID NO: 4253644 - DNA, 15 bp, Homo sapiens
ctccatggccctgcc

SEQ ID NO: 4253645 - DNA, 20 bp, Homo sapiens
ctccatggccctgccatgct

SEQ ID NO: 4253646 - DNA, 21 bp, Homo sapiens
ctcccaaagtgctgggattaa

SEQ ID NO: 4253647 - DNA, 13 bp, Homo sapiens
ctccctaccctaa

SEQ ID NO: 4253648 - DNA, 17 bp, Homo sapiens
ctccctcaacctcatcc

SEQ ID NO: 4253649 - DNA, 19 bp, Homo sapiens
ctcccttcatgcatggaaa

SEQ ID NO: 4253650 - DNA, 14 bp, Homo sapiens
ctcctccacctcaa

SEQ ID NO: 4253651 - DNA, 17 bp, Homo sapiens
ctcctgcctcagcctcc

SEQ ID NO: 4253652 - DNA, 13 bp, Homo sapiens
ctccttagaaaaa

SEQ ID NO: 4253653 - DNA, 14 bp, Homo sapiens
ctcgtggacacctg

SEQ ID NO: 4253654 - DNA, 16 bp, Homo sapiens
ctcgtggacacctgcc

SEQ ID NO: 4253655 - DNA, 19 bp, Homo sapiens
ctcgtggacacctgccctg

SEQ ID NO: 4253656 - DNA, 20 bp, Homo sapiens
ctcgtggacacctgccctgc

SEQ ID NO: 4253657 - DNA, 14 bp, Homo sapiens
ctcgtgtgtttcta

SEQ ID NO: 4253658 - DNA, 15 bp, Homo sapiens
ctctaggaaatattt

SEQ ID NO: 4253659 - DNA, 15 bp, Homo sapiens
ctctataccaataaa

SEQ ID NO: 4253660 - DNA, 17 bp, Homo sapiens
ctctataccaataaagt

SEQ ID NO: 4253661 - DNA, 18 bp, Homo sapiens
ctctataccaataaagtg

SEQ ID NO: 4253662 - DNA, 22 bp, Homo sapiens
ctctcagttgcagccctgctgc

SEQ ID NO: 4253663 - DNA, 17 bp, Homo sapiens
ctctccacagctgcctc

SEQ ID NO: 4253664 - DNA, 15 bp, Homo sapiens
ctctccccatgatgt

SEQ ID NO: 4253665 - DNA, 13 bp, Homo sapiens
ctcttcagtctct

SEQ ID NO: 4253666 - DNA, 14 bp, Homo sapiens
ctgaataaagcaat

SEQ ID NO: 4253667 - DNA, 15 bp, Homo sapiens
ctgaataaagcaatt

SEQ ID NO: 4253668 - DNA, 12 bp, Homo sapiens
ctgaggctgagg

SEQ ID NO: 4253669 - DNA, 13 bp, Homo sapiens
ctgatggagaagg

SEQ ID NO: 4253670 - DNA, 16 bp, Homo sapiens
ctgcaacctccacctc

SEQ ID NO: 4253671 - DNA, 21 bp, Homo sapiens
ctgcagtctctataccaataa

SEQ ID NO: 4253672 - DNA, 13 bp, Homo sapiens
ctgcatccagcct

SEQ ID NO: 4253673 - DNA, 12 bp, Homo sapiens
ctgccacctgtc

SEQ ID NO: 4253674 - DNA, 14 bp, Homo sapiens
ctgccacctgtctg

SEQ ID NO: 4253675 - DNA, 15 bp, Homo sapiens
ctgccacctgtctgt

SEQ ID NO: 4253676 - DNA, 18 bp, Homo sapiens
ctgccctgccacctgtct

SEQ ID NO: 4253677 - DNA, 19 bp, Homo sapiens
ctgcctcccttcatgcatg

SEQ ID NO: 4253678 - DNA, 22 bp, Homo sapiens
ctgcctggacttggcccctgcc

SEQ ID NO: 4253679 - DNA, 22 bp, Homo sapiens
ctgcgcccttaactgcatccag

SEQ ID NO: 4253680 - DNA, 17 bp, Homo sapiens
ctggaaaccttccaccc

SEQ ID NO: 4253681 - DNA, 18 bp, Homo sapiens
ctggaagtgactttggct

SEQ ID NO: 4253682 - DNA, 19 bp, Homo sapiens
ctggacttggcccctgcca

SEQ ID NO: 4253683 - DNA, 17 bp, Homo sapiens
ctggagatgaggccaga

SEQ ID NO: 4253684 - DNA, 20 bp, Homo sapiens
gggtttcaccatgttggcca

SEQ ID NO: 4253685 - DNA, 21 bp, Homo sapiens
ggtctcttctgaataaagcaa

SEQ ID NO: 4253686 - DNA, 22 bp, Homo sapiens
ggtctcttctgaataaagcaat

SEQ ID NO: 4253687 - DNA, 17 bp, Homo sapiens
ggtgcactggccccacc

SEQ ID NO: 4253688 - DNA, 13 bp, Homo sapiens
gtaagttttttga

SEQ ID NO: 4253689 - DNA, 15 bp, Homo sapiens
gtacttcatgctgtc

SEQ ID NO: 4253690 - DNA, 22 bp, Homo sapiens
gtagcgttttttaaatgtatac

SEQ ID NO: 4253691 - DNA, 22 bp, Homo sapiens
gtaggggcttataataaaggac

SEQ ID NO: 4253692 - DNA, 14 bp, Homo sapiens
gtagtgttggagaa

SEQ ID NO: 4253693 - DNA, 15 bp, Homo sapiens
gtagtgttggagaag

SEQ ID NO: 4253694 - DNA, 13 bp, Homo sapiens
gtatattacaatg

SEQ ID NO: 4253695 - DNA, 16 bp, Homo sapiens
gtatgaacttgaggac

SEQ ID NO: 4253696 - DNA, 22 bp, Homo sapiens
gtatgaacttgaggacacatgt

SEQ ID NO: 4253697 - DNA, 17 bp, Homo sapiens
gtatttctatgaaatat

SEQ ID NO: 4253698 - DNA, 22 bp, Homo sapiens
gtcaataaaatccatacatttg

SEQ ID NO: 4253699 - DNA, 16 bp, Homo sapiens
gtcaccagagacttta

SEQ ID NO: 4253700 - DNA, 19 bp, Homo sapiens
gtcacgtttggtgcttctc

SEQ ID NO: 4253701 - DNA, 14 bp, Homo sapiens
gtcaggaaagagaa

SEQ ID NO: 4253702 - DNA, 23 bp, Homo sapiens
gtctacactaagagagaatgaga

SEQ ID NO: 4253703 - DNA, 20 bp, Homo sapiens
gtctcctaagctggagtgca

SEQ ID NO: 4253704 - DNA, 20 bp, Homo sapiens
gtctctataccaataaagtg

SEQ ID NO: 4253705 - DNA, 19 bp, Homo sapiens
gtctcttctgaataaagca

SEQ ID NO: 4253706 - DNA, 23 bp, Homo sapiens
gtctcttctgaataaagcaatta

SEQ ID NO: 4253707 - DNA, 16 bp, Homo sapiens
gtctgtctgtctgtcc

SEQ ID NO: 4253708 - DNA, 14 bp, Homo sapiens
gtcttcctctgtct

SEQ ID NO: 4253709 - DNA, 20 bp, Homo sapiens
gtgactttggctgcatgcga

SEQ ID NO: 4253710 - DNA, 20 bp, Homo sapiens
gtgatccacccgcctcagcc

SEQ ID NO: 4253711 - DNA, 24 bp, Homo sapiens
gtgatccacccgcctcagcctccc

SEQ ID NO: 4253712 - DNA, 18 bp, Homo sapiens
gtgcaaattgtcacagga

SEQ ID NO: 4253713 - DNA, 16 bp, Homo sapiens
gtgcactggccccacc

SEQ ID NO: 4253714 - DNA, 17 bp, Homo sapiens
gtgcactggccccaccc

SEQ ID NO: 4253715 - DNA, 18 bp, Homo sapiens
gtgcactggccccaccct

SEQ ID NO: 4253716 - DNA, 19 bp, Homo sapiens
gtgcagcccccactgcctt

SEQ ID NO: 4253717 - DNA, 21 bp, Homo sapiens
gtggaacataaaaaggacatc

SEQ ID NO: 4253718 - DNA, 19 bp, Homo sapiens
gtggcgcgatctcagctca

SEQ ID NO: 4253719 - DNA, 21 bp, Homo sapiens
gtgggacagtcacctcatgga

SEQ ID NO: 4253720 - DNA, 14 bp, Homo sapiens
gtgtatgcacagta

SEQ ID NO: 4253721 - DNA, 15 bp, Homo sapiens
gttagggaaaacatt

SEQ ID NO: 4253722 - DNA, 15 bp, Homo sapiens
gttatgactatgtaa

SEQ ID NO: 4253723 - DNA, 14 bp, Homo sapiens
gttctgaagaagat

SEQ ID NO: 4253724 - DNA, 16 bp, Homo sapiens
gttcttactgcttaat

SEQ ID NO: 4253725 - DNA, 22 bp, Homo sapiens
gttgaataaatgtatctgaata

SEQ ID NO: 4253726 - DNA, 19 bp, Homo sapiens
gttgacttatagtacatga

SEQ ID NO: 4253727 - DNA, 24 bp, Homo sapiens
gttgacttatagtacatgataaat

SEQ ID NO: 4253728 - DNA, 20 bp, Homo sapiens
gtttatataagcttgtattc

SEQ ID NO: 4253729 - DNA, 13 bp, Homo sapiens
gttttacaatagt

SEQ ID NO: 4253730 - DNA, 16 bp, Homo sapiens
gttttacaatagttct

SEQ ID NO: 4253731 - DNA, 22 bp, Homo sapiens
gttttataattttgtgaagcaa

SEQ ID NO: 4253732 - DNA, 23 bp, Homo sapiens
gtttttttttaaaaaagaaacat

SEQ ID NO: 4253733 - DNA, 14 bp, Homo sapiens
taaaaaatggtcac

SEQ ID NO: 4253734 - DNA, 18 bp, Homo sapiens
taaaaaggacatcagcaa

SEQ ID NO: 4253735 - DNA, 17 bp, Homo sapiens
taaaaaggctaaatgga

SEQ ID NO: 4253736 - DNA, 11 bp, Homo sapiens
taaaactaaga

SEQ ID NO: 4253737 - DNA, 21 bp, Homo sapiens
taaaaggaaagaaaacatctt

SEQ ID NO: 4253738 - DNA, 20 bp, Homo sapiens
taaaataatttttatatttg

SEQ ID NO: 4253739 - DNA, 15 bp, Homo sapiens
taaaatccatacatt

SEQ ID NO: 4253740 - DNA, 17 bp, Homo sapiens
taaaatccatacatttg

SEQ ID NO: 4253741 - DNA, 18 bp, Homo sapiens
taaaatccatacatttgt

SEQ ID NO: 4253742 - DNA, 19 bp, Homo sapiens
taaaattacaactaagtga

SEQ ID NO: 4253743 - DNA, 20 bp, Homo sapiens
taaatggcttcctggcaata

SEQ ID NO: 4253744 - DNA, 13 bp, Homo sapiens
taaatgtatacta

SEQ ID NO: 4253745 - DNA, 17 bp, Homo sapiens
taaatgtatactatagt

SEQ ID NO: 4253746 - DNA, 19 bp, Homo sapiens
taaatgttatgactatgta

SEQ ID NO: 4253747 - DNA, 20 bp, Homo sapiens
taaatgttatgactatgtaa

SEQ ID NO: 4253748 - DNA, 11 bp, Homo sapiens
taaccaagttc

SEQ ID NO: 4253749 - DNA, 15 bp, Homo sapiens
taactattgcattta

SEQ ID NO: 4253750 - DNA, 16 bp, Homo sapiens
taagcattccaactat

SEQ ID NO: 4253751 - DNA, 20 bp, Homo sapiens
taagcattccaactatctca

SEQ ID NO: 4253752 - DNA, 16 bp, Homo sapiens
taagctggagtgcagt

SEQ ID NO: 4253753 - DNA, 15 bp, Homo sapiens
taatcttatttagga

SEQ ID NO: 4253754 - DNA, 13 bp, Homo sapiens
taatctttcacag

SEQ ID NO: 4253755 - DNA, 23 bp, Homo sapiens
taatgataactggaaacttcagc

SEQ ID NO: 4253756 - DNA, 14 bp, Homo sapiens
taatgtttcaaaca

SEQ ID NO: 4253757 - DNA, 15 bp, Homo sapiens
taatgtttcaaacat

SEQ ID NO: 4253758 - DNA, 22 bp, Homo sapiens
taatgtttcaaacatatataac

SEQ ID NO: 4253759 - DNA, 23 bp, Homo sapiens
taatttgtagtgttggagaagaa

SEQ ID NO: 4253760 - DNA, 12 bp, Homo sapiens
taatttttatat

SEQ ID NO: 4253761 - DNA, 21 bp, Homo sapiens
taatttttttcacctagattt

SEQ ID NO: 4253762 - DNA, 15 bp, Homo sapiens
tacaacggagtcaaa

SEQ ID NO: 4253763 - DNA, 11 bp, Homo sapiens
tacacccagca

SEQ ID NO: 4253764 - DNA, 14 bp, Homo sapiens
tacactaagagaga

SEQ ID NO: 4253765 - DNA, 18 bp, Homo sapiens
tacactaagagagaatga

SEQ ID NO: 4253766 - DNA, 20 bp, Homo sapiens
tacatcccttacctgggaaa

SEQ ID NO: 4253767 - DNA, 14 bp, Homo sapiens
taccaataaagtga

SEQ ID NO: 4253768 - DNA, 17 bp, Homo sapiens
taccaataaagtgaccc

SEQ ID NO: 4253769 - DNA, 14 bp, Homo sapiens
taccctaaccaagt

SEQ ID NO: 4253770 - DNA, 16 bp, Homo sapiens
taccctaaccaagttc

SEQ ID NO: 4253771 - DNA, 20 bp, Homo sapiens
tactagtcaccagagacttt

SEQ ID NO: 4253772 - DNA, 15 bp, Homo sapiens
tactgctctcctcca

SEQ ID NO: 4253773 - DNA, 13 bp, Homo sapiens
tactgcttaattc

SEQ ID NO: 4253774 - DNA, 13 bp, Homo sapiens
tactgtaagaaaa

SEQ ID NO: 4253775 - DNA, 14 bp, Homo sapiens
tacttcaaatcctt

SEQ ID NO: 4253776 - DNA, 19 bp, Homo sapiens
tacttcttagggttatgat

SEQ ID NO: 4253777 - DNA, 14 bp, Homo sapiens
tagaagagagaggt

SEQ ID NO: 4253778 - DNA, 13 bp, Homo sapiens
tagacacacatga

SEQ ID NO: 4253779 - DNA, 13 bp, Homo sapiens
tagagaagcaagt

SEQ ID NO: 4253780 - DNA, 14 bp, Homo sapiens
tagagggtgtgtaa

SEQ ID NO: 4253781 - DNA, 16 bp, Homo sapiens
tagatgcagttctgaa

SEQ ID NO: 4253782 - DNA, 21 bp, Homo sapiens
tagatgcagttctgaagaaga

SEQ ID NO: 4253783 - DNA, 17 bp, Homo sapiens
tagcgttttttaaatgt

SEQ ID NO: 4253784 - DNA, 18 bp, Homo sapiens
tagcgttttttaaatgta

SEQ ID NO: 4253785 - DNA, 22 bp, Homo sapiens
tagcgttttttaaatgtatact

SEQ ID NO: 4253786 - DNA, 19 bp, Homo sapiens
tagtagcgttttttaaatg

SEQ ID NO: 4253787 - DNA, 15 bp, Homo sapiens
tagtcaccagagact

SEQ ID NO: 4253788 - DNA, 17 bp, Homo sapiens
tagttcttactgcttaa

SEQ ID NO: 4253789 - DNA, 18 bp, Homo sapiens
tagttgtaaaccaagtga

SEQ ID NO: 4253790 - DNA, 16 bp, Homo sapiens
tagttttatatgcttc

SEQ ID NO: 4253791 - DNA, 22 bp, Homo sapiens
tataataaaggactgtaatctt

SEQ ID NO: 4253792 - DNA, 15 bp, Homo sapiens
tataattcaccttct

SEQ ID NO: 4253793 - DNA, 14 bp, Homo sapiens
tataattttgtgaa

SEQ ID NO: 4253794 - DNA, 13 bp, Homo sapiens
tataccaataaag

SEQ ID NO: 4253795 - DNA, 22 bp, Homo sapiens
tatacccacccagaatgagaca

SEQ ID NO: 4253796 - DNA, 13 bp, Homo sapiens
tatataacaatgc

SEQ ID NO: 4253797 - DNA, 16 bp, Homo sapiens
tatatatagcagcttt

SEQ ID NO: 4253798 - DNA, 14 bp, Homo sapiens
tatatttgaaatat

SEQ ID NO: 4253799 - DNA, 17 bp, Homo sapiens
tatgactatgtaaacta

SEQ ID NO: 4253800 - DNA, 16 bp, Homo sapiens
tatgattcccagccag

SEQ ID NO: 4253801 - DNA, 14 bp, Homo sapiens
tatgcacagtaaaa

SEQ ID NO: 4253802 - DNA, 21 bp, Homo sapiens
tatgtgacattttacattaaa

SEQ ID NO: 4253803 - DNA, 20 bp, Homo sapiens
tatgtgtatgcacagtaaaa

SEQ ID NO: 4253804 - DNA, 15 bp, Homo sapiens
tattagaataccaca

SEQ ID NO: 4253805 - DNA, 21 bp, Homo sapiens
cagccacggggactcagccct

SEQ ID NO: 4253806 - DNA, 16 bp, Homo sapiens
cagcctagttgatcag

SEQ ID NO: 4253807 - DNA, 13 bp, Homo sapiens
cagctcactgcaa

SEQ ID NO: 4253808 - DNA, 15 bp, Homo sapiens
cagctcactgcaacc

SEQ ID NO: 4253809 - DNA, 18 bp, Homo sapiens
cagctgtatgattcccag

SEQ ID NO: 4253810 - DNA, 18 bp, Homo sapiens
cagcttttcccaaaagcc

SEQ ID NO: 4253811 - DNA, 16 bp, Homo sapiens
caggaaagagaacttc

SEQ ID NO: 4253812 - DNA, 20 bp, Homo sapiens
caggaaagagaacttccaga

SEQ ID NO: 4253813 - DNA, 17 bp, Homo sapiens
caggaagagaaggagca

SEQ ID NO: 4253814 - DNA, 17 bp, Homo sapiens
caggaagatcccccaga

SEQ ID NO: 4253815 - DNA, 24 bp, Homo sapiens
caggacagcccttctttccacaga

SEQ ID NO: 4253816 - DNA, 17 bp, Homo sapiens
caggatcagttaactat

SEQ ID NO: 4253817 - DNA, 13 bp, Homo sapiens
caggctagatgta

SEQ ID NO: 4253818 - DNA, 16 bp, Homo sapiens
caggggacaggatggt

SEQ ID NO: 4253819 - DNA, 15 bp, Homo sapiens
caggtcaccgcgagg

SEQ ID NO: 4253820 - DNA, 23 bp, Homo sapiens
caggtgcagcccccactgccttt

SEQ ID NO: 4253821 - DNA, 15 bp, Homo sapiens
cagtatctcttcagt

SEQ ID NO: 4253822 - DNA, 16 bp, Homo sapiens
cagtatgggttaggga

SEQ ID NO: 4253823 - DNA, 16 bp, Homo sapiens
cagtcacctcatggaa

SEQ ID NO: 4253824 - DNA, 20 bp, Homo sapiens
cagtctctataccaataaag

SEQ ID NO: 4253825 - DNA, 23 bp, Homo sapiens
cagtctctataccaataaagtga

SEQ ID NO: 4253826 - DNA, 20 bp, Homo sapiens
cagtctgactgtttccatca

SEQ ID NO: 4253827 - DNA, 22 bp, Homo sapiens
cagtgggaggtgagaccacctc

SEQ ID NO: 4253828 - DNA, 21 bp, Homo sapiens
cagttaactattgcatttata

SEQ ID NO: 4253829 - DNA, 24 bp, Homo sapiens
cagttaactattgcatttatatgt

SEQ ID NO: 4253830 - DNA, 15 bp, Homo sapiens
cagttcaaagcagga

SEQ ID NO: 4253831 - DNA, 13 bp, Homo sapiens
cagttctgaagaa

SEQ ID NO: 4253832 - DNA, 22 bp, Homo sapiens
cataaaaaggacatcagcaaac

SEQ ID NO: 4253833 - DNA, 15 bp, Homo sapiens
catatataacaatgc

SEQ ID NO: 4253834 - DNA, 14 bp, Homo sapiens
catcaggtcaccgc

SEQ ID NO: 4253835 - DNA, 18 bp, Homo sapiens
catcccttacctgggaaa

SEQ ID NO: 4253836 - DNA, 14 bp, Homo sapiens
catctagtgagcag

SEQ ID NO: 4253837 - DNA, 10 bp, Homo sapiens
catctttaag

SEQ ID NO: 4253838 - DNA, 14 bp, Homo sapiens
catgaccagtaaag

SEQ ID NO: 4253839 - DNA, 14 bp, Homo sapiens
catgcagaaagcat

SEQ ID NO: 4253840 - DNA, 17 bp, Homo sapiens
catgcatggaaattccc

SEQ ID NO: 4253841 - DNA, 23 bp, Homo sapiens
catgctgtctacactaagagaga

SEQ ID NO: 4253842 - DNA, 14 bp, Homo sapiens
catgctgtgtgact

SEQ ID NO: 4253843 - DNA, 20 bp, Homo sapiens
catggaattggagctcgtgg

SEQ ID NO: 4253844 - DNA, 16 bp, Homo sapiens
catggacactacaccc

SEQ ID NO: 4253845 - DNA, 22 bp, Homo sapiens
catggacactacacccagcaat

SEQ ID NO: 4253846 - DNA, 23 bp, Homo sapiens
catggacactacacccagcaata

SEQ ID NO: 4253847 - DNA, 16 bp, Homo sapiens
catggccagctaattt

SEQ ID NO: 4253848 - DNA, 13 bp, Homo sapiens
cattataaaaaga

SEQ ID NO: 4253849 - DNA, 14 bp, Homo sapiens
catttgtataaaat

SEQ ID NO: 4253850 - DNA, 20 bp, Homo sapiens
catttgtataaaataatttt

SEQ ID NO: 4253851 - DNA, 22 bp, Homo sapiens
cattttttgggcagcaatttaa

SEQ ID NO: 4253852 - DNA, 21 bp, Homo sapiens
ccaacaagattgcttaataaa

SEQ ID NO: 4253853 - DNA, 12 bp, Homo sapiens
ccaaccctagca

SEQ ID NO: 4253854 - DNA, 20 bp, Homo sapiens
ccaagcacctgggattacaa

SEQ ID NO: 4253855 - DNA, 17 bp, Homo sapiens
ccaagcatttagatgta

SEQ ID NO: 4253856 - DNA, 17 bp, Homo sapiens
ccaagctattcaattct

SEQ ID NO: 4253857 - DNA, 20 bp, Homo sapiens
ccaagtaactgggattacag

SEQ ID NO: 4253858 - DNA, 17 bp, Homo sapiens
ccaccctcgtggacacc

SEQ ID NO: 4253859 - DNA, 19 bp, Homo sapiens
ccaccctcgtggacacctg

SEQ ID NO: 4253860 - DNA, 15 bp, Homo sapiens
ccaccgcagaaggaa

SEQ ID NO: 4253861 - DNA, 16 bp, Homo sapiens
ccaccgcagaaggaag

SEQ ID NO: 4253862 - DNA, 20 bp, Homo sapiens
ccacctccctcaacctcatc

SEQ ID NO: 4253863 - DNA, 15 bp, Homo sapiens
ccactctttctttca

SEQ ID NO: 4253864 - DNA, 16 bp, Homo sapiens
ccactttttgcagctt

SEQ ID NO: 4253865 - DNA, 17 bp, Homo sapiens
ccactttttgcagcttt

SEQ ID NO: 4253866 - DNA, 16 bp, Homo sapiens
ccagaatgagacatcc

SEQ ID NO: 4253867 - DNA, 16 bp, Homo sapiens
ccagagcactgctcca

SEQ ID NO: 4253868 - DNA, 18 bp, Homo sapiens
ccagagtgctgaaggaat

SEQ ID NO: 4253869 - DNA, 15 bp, Homo sapiens
ccagatcctggaaat

SEQ ID NO: 4253870 - DNA, 21 bp, Homo sapiens
ccagcctggggctgaggctga

SEQ ID NO: 4253871 - DNA, 15 bp, Homo sapiens
ccagctaatttttgt

SEQ ID NO: 4253872 - DNA, 23 bp, Homo sapiens
ccagcttttcccaaaagcccatt

SEQ ID NO: 4253873 - DNA, 20 bp, Homo sapiens
ccaggaaagcgcctccaacc

SEQ ID NO: 4253874 - DNA, 18 bp, Homo sapiens
ccaggaagatcccccaga

SEQ ID NO: 4253875 - DNA, 19 bp, Homo sapiens
ccaggaagatcccccagaa

SEQ ID NO: 4253876 - DNA, 13 bp, Homo sapiens
ccaggacaggatc

SEQ ID NO: 4253877 - DNA, 19 bp, Homo sapiens
ccaggacaggatccaggcc

SEQ ID NO: 4253878 - DNA, 18 bp, Homo sapiens
ccaggcaggagcccttct

SEQ ID NO: 4253879 - DNA, 15 bp, Homo sapiens
ccaggggccatgaat

SEQ ID NO: 4253880 - DNA, 16 bp, Homo sapiens
ccagggtggcagcaac

SEQ ID NO: 4253881 - DNA, 20 bp, Homo sapiens
ccaggtagagggtgtgtaag

SEQ ID NO: 4253882 - DNA, 15 bp, Homo sapiens
ccagtatctcttcag

SEQ ID NO: 4253883 - DNA, 16 bp, Homo sapiens
ccagtatctcttcagt

SEQ ID NO: 4253884 - DNA, 18 bp, Homo sapiens
ccagtatctcttcagtct

SEQ ID NO: 4253885 - DNA, 18 bp, Homo sapiens
ccatcaagggtacactgc

SEQ ID NO: 4253886 - DNA, 11 bp, Homo sapiens
ccatgcagaaa

SEQ ID NO: 4253887 - DNA, 19 bp, Homo sapiens
ccatggacactacacccag

SEQ ID NO: 4253888 - DNA, 20 bp, Homo sapiens
ccattcattccattctggaa

SEQ ID NO: 4253889 - DNA, 15 bp, Homo sapiens
ccattctggaagtga

SEQ ID NO: 4253890 - DNA, 13 bp, Homo sapiens
cccaactccagaa

SEQ ID NO: 4253891 - DNA, 21 bp, Homo sapiens
cccacctccctcaacctcatc

SEQ ID NO: 4253892 - DNA, 13 bp, Homo sapiens
cccacttcagcct

SEQ ID NO: 4253893 - DNA, 10 bp, Homo sapiens
cccaggacag

SEQ ID NO: 4253894 - DNA, 19 bp, Homo sapiens
cccaggttggagtgcagtg

SEQ ID NO: 4253895 - DNA, 16 bp, Homo sapiens
cccagtatctcttcag

SEQ ID NO: 4253896 - DNA, 21 bp, Homo sapiens
cccattcattccattctggaa

SEQ ID NO: 4253897 - DNA, 22 bp, Homo sapiens
cccattcattccattctggaag

SEQ ID NO: 4253898 - DNA, 18 bp, Homo sapiens
ccccagtatctcttcagt

SEQ ID NO: 4253899 - DNA, 18 bp, Homo sapiens
cccccagtatctcttcag

SEQ ID NO: 4253900 - DNA, 23 bp, Homo sapiens
cccctggtgcactggccccaccc

SEQ ID NO: 4253901 - DNA, 14 bp, Homo sapiens
ccctatctttgcca

SEQ ID NO: 4253902 - DNA, 18 bp, Homo sapiens
ccctcaacctcatcctct

SEQ ID NO: 4253903 - DNA, 13 bp, Homo sapiens
ccctcacactggg

SEQ ID NO: 4253904 - DNA, 17 bp, Homo sapiens
ccctcacccatcctaga

SEQ ID NO: 4253905 - DNA, 19 bp, Homo sapiens
ccctccaccgcagaaggaa

SEQ ID NO: 4253906 - DNA, 16 bp, Homo sapiens
ccctccctaccctaac

SEQ ID NO: 4253907 - DNA, 17 bp, Homo sapiens
ccctcgtggacacctgc

SEQ ID NO: 4253908 - DNA, 20 bp, Homo sapiens
ccctctcccaaaaaactact

SEQ ID NO: 4253909 - DNA, 18 bp, Homo sapiens
ccctctctcataccctcc

SEQ ID NO: 4253910 - DNA, 22 bp, Homo sapiens
ccctctctcataccctccctcc

SEQ ID NO: 4253911 - DNA, 14 bp, Homo sapiens
ccctgccacctgtc

SEQ ID NO: 4253912 - DNA, 17 bp, Homo sapiens
ccctgccctgccacctg

SEQ ID NO: 4253913 - DNA, 18 bp, Homo sapiens
ccctgccctgccacctgt

SEQ ID NO: 4253914 - DNA, 17 bp, Homo sapiens
ccctgctgctgcctgcc

SEQ ID NO: 4253915 - DNA, 18 bp, Homo sapiens
ccctgctgctgcctgcct

SEQ ID NO: 4253916 - DNA, 22 bp, Homo sapiens
ccctggaaaccttccacccagt

SEQ ID NO: 4253917 - DNA, 14 bp, Homo sapiens
cccttcatctggaa

SEQ ID NO: 4253918 - DNA, 20 bp, Homo sapiens
cccttctatacccacccaga

SEQ ID NO: 4253919 - DNA, 16 bp, Homo sapiens
cccttgatgaagaagt

SEQ ID NO: 4253920 - DNA, 16 bp, Homo sapiens
ccctttcctgagtccc

SEQ ID NO: 4253921 - DNA, 16 bp, Homo sapiens
ccggggggtctcttct

SEQ ID NO: 4253922 - DNA, 11 bp, Homo sapiens
cctaaccaagt

SEQ ID NO: 4253923 - DNA, 16 bp, Homo sapiens
cctaccctaaccaagt

SEQ ID NO: 4253924 - DNA, 16 bp, Homo sapiens
cctactagtcaccaga

SEQ ID NO: 4253925 - DNA, 13 bp, Homo sapiens
cctatctttgcca

SEQ ID NO: 4253926 - DNA, 20 bp, Homo sapiens
cctatctttgccaccctcat

SEQ ID NO: 4253927 - DNA, 12 bp, Homo sapiens
cctcacactggg

SEQ ID NO: 4253928 - DNA, 14 bp, Homo sapiens
ctgggtaggaaaga

SEQ ID NO: 4253929 - DNA, 18 bp, Homo sapiens
ctggtatgaacttgagga

SEQ ID NO: 4253930 - DNA, 17 bp, Homo sapiens
ctgtaaaataaaaggtc

SEQ ID NO: 4253931 - DNA, 15 bp, Homo sapiens
ctgtatgattcccag

SEQ ID NO: 4253932 - DNA, 20 bp, Homo sapiens
ctgtattttaaaagaatgat

SEQ ID NO: 4253933 - DNA, 22 bp, Homo sapiens
ctgtcacccaggttggagtgca

SEQ ID NO: 4253934 - DNA, 22 bp, Homo sapiens
ctgtctcctaagctggagtgca

SEQ ID NO: 4253935 - DNA, 14 bp, Homo sapiens
ctgtctgtctgtcc

SEQ ID NO: 4253936 - DNA, 16 bp, Homo sapiens
ctgtctgtctgtccca

SEQ ID NO: 4253937 - DNA, 17 bp, Homo sapiens
ctgtctgtctgtcccaa

SEQ ID NO: 4253938 - DNA, 15 bp, Homo sapiens
ctgtctgtctgtctg

SEQ ID NO: 4253939 - DNA, 16 bp, Homo sapiens
ctgtgcaaggcctggt

SEQ ID NO: 4253940 - DNA, 13 bp, Homo sapiens
ctgttataatctt

SEQ ID NO: 4253941 - DNA, 15 bp, Homo sapiens
ctgttgtagaagaca

SEQ ID NO: 4253942 - DNA, 22 bp, Homo sapiens
cttaaaataatgaatacatttc

SEQ ID NO: 4253943 - DNA, 21 bp, Homo sapiens
cttaagaagactgcattatat

SEQ ID NO: 4253944 - DNA, 23 bp, Homo sapiens
cttaagaagactgcattatattt

SEQ ID NO: 4253945 - DNA, 20 bp, Homo sapiens
cttaataaattgtgtttcct

SEQ ID NO: 4253946 - DNA, 20 bp, Homo sapiens
cttagatgcagttctgaaga

SEQ ID NO: 4253947 - DNA, 22 bp, Homo sapiens
cttagatgcagttctgaagaag

SEQ ID NO: 4253948 - DNA, 14 bp, Homo sapiens
cttatgcttaaatt

SEQ ID NO: 4253949 - DNA, 19 bp, Homo sapiens
cttcatctggattccagag

SEQ ID NO: 4253950 - DNA, 13 bp, Homo sapiens
cttcatgcatgga

SEQ ID NO: 4253951 - DNA, 15 bp, Homo sapiens
cttcatgcatggaaa

SEQ ID NO: 4253952 - DNA, 23 bp, Homo sapiens
cttcccaaagtcctgggattaca

SEQ ID NO: 4253953 - DNA, 22 bp, Homo sapiens
cttccctcttccttccctgctg

SEQ ID NO: 4253954 - DNA, 22 bp, Homo sapiens
cttccctggaaaccttccaccc

SEQ ID NO: 4253955 - DNA, 17 bp, Homo sapiens
cttctatacccacccag

SEQ ID NO: 4253956 - DNA, 15 bp, Homo sapiens
cttctgaataaagca

SEQ ID NO: 4253957 - DNA, 15 bp, Homo sapiens
cttctgttttataat

SEQ ID NO: 4253958 - DNA, 13 bp, Homo sapiens
cttctttccacag

SEQ ID NO: 4253959 - DNA, 15 bp, Homo sapiens
cttgaggacacatgt

SEQ ID NO: 4253960 - DNA, 17 bp, Homo sapiens
cttgaggacacatgtcc

SEQ ID NO: 4253961 - DNA, 23 bp, Homo sapiens
cttgccacaccccccacccctag

SEQ ID NO: 4253962 - DNA, 23 bp, Homo sapiens
cttgtcaataaaatccatacatt

SEQ ID NO: 4253963 - DNA, 16 bp, Homo sapiens
ctttaaaaggaaagaa

SEQ ID NO: 4253964 - DNA, 17 bp, Homo sapiens
ctttaaaaggaaagaaa

SEQ ID NO: 4253965 - DNA, 19 bp, Homo sapiens
ctttaaaattacaactaag

SEQ ID NO: 4253966 - DNA, 20 bp, Homo sapiens
ctttaaaattacaactaagt

SEQ ID NO: 4253967 - DNA, 23 bp, Homo sapiens
ctttgacctgcctcccttcatgc

SEQ ID NO: 4253968 - DNA, 16 bp, Homo sapiens
ctttgccaccctcatg

SEQ ID NO: 4253969 - DNA, 18 bp, Homo sapiens
ctttgccaccctcatgct

SEQ ID NO: 4253970 - DNA, 22 bp, Homo sapiens
cttttaaatgattgaattatat

SEQ ID NO: 4253971 - DNA, 17 bp, Homo sapiens
gaaaacattccatcctt

SEQ ID NO: 4253972 - DNA, 21 bp, Homo sapiens
gaaaagaaaatttttgtagta

SEQ ID NO: 4253973 - DNA, 15 bp, Homo sapiens
gaaaagaaagctaca

SEQ ID NO: 4253974 - DNA, 15 bp, Homo sapiens
gaaaatattgtttta

SEQ ID NO: 4253975 - DNA, 15 bp, Homo sapiens
gaaaccttccaccca

SEQ ID NO: 4253976 - DNA, 17 bp, Homo sapiens
gaaagagaacttccaga

SEQ ID NO: 4253977 - DNA, 19 bp, Homo sapiens
gaaagctatataagacaag

SEQ ID NO: 4253978 - DNA, 16 bp, Homo sapiens
gaaatattatgttaaa

SEQ ID NO: 4253979 - DNA, 21 bp, Homo sapiens
gaaattcccttcatctggaac

SEQ ID NO: 4253980 - DNA, 18 bp, Homo sapiens
gaacataaaaaggacatc

SEQ ID NO: 4253981 - DNA, 22 bp, Homo sapiens
gaaccaaggttttgaaatccca

SEQ ID NO: 4253982 - DNA, 12 bp, Homo sapiens
gaaccatcagaa

SEQ ID NO: 4253983 - DNA, 13 bp, Homo sapiens
gaactgaaatcat

SEQ ID NO: 4253984 - DNA, 16 bp, Homo sapiens
gaagaaagaacggaag

SEQ ID NO: 4253985 - DNA, 13 bp, Homo sapiens
gaagagaaggagc

SEQ ID NO: 4253986 - DNA, 17 bp, Homo sapiens
gaagagatcaggaagag

SEQ ID NO: 4253987 - DNA, 21 bp, Homo sapiens
gaagccttggggctgatgcag

SEQ ID NO: 4253988 - DNA, 19 bp, Homo sapiens
gaaggaaggcagggaggag

SEQ ID NO: 4253989 - DNA, 22 bp, Homo sapiens
gaaggaaggctccatctccagt

SEQ ID NO: 4253990 - DNA, 15 bp, Homo sapiens
gaaggaggacccagg

SEQ ID NO: 4253991 - DNA, 16 bp, Homo sapiens
gaaggaggacccagga

SEQ ID NO: 4253992 - DNA, 18 bp, Homo sapiens
gaaggaggacccaggaca

SEQ ID NO: 4253993 - DNA, 14 bp, Homo sapiens
gaaggcagggagga

SEQ ID NO: 4253994 - DNA, 16 bp, Homo sapiens
gaaggcagggaggagg

SEQ ID NO: 4253995 - DNA, 18 bp, Homo sapiens
gaaggcagggaggaggca

SEQ ID NO: 4253996 - DNA, 20 bp, Homo sapiens
gaagtgactttggctgcatg

SEQ ID NO: 4253997 - DNA, 23 bp, Homo sapiens
gaagttgacttatagtacatgat

SEQ ID NO: 4253998 - DNA, 14 bp, Homo sapiens
gaataaatgtatct

SEQ ID NO: 4253999 - DNA, 16 bp, Homo sapiens
gaataaatgtatctga

SEQ ID NO: 4254000 - DNA, 18 bp, Homo sapiens
gaataaatgtatctgaat

SEQ ID NO: 4254001 - DNA, 13 bp, Homo sapiens
gaatgagacatcc

SEQ ID NO: 4254002 - DNA, 21 bp, Homo sapiens
gaatggaggggcagagccagg

SEQ ID NO: 4254003 - DNA, 15 bp, Homo sapiens
gaattacatttgtat

SEQ ID NO: 4254004 - DNA, 20 bp, Homo sapiens
gaattacatttgtataaaat

SEQ ID NO: 4254005 - DNA, 16 bp, Homo sapiens
gaattggagctcgtgg

SEQ ID NO: 4254006 - DNA, 15 bp, Homo sapiens
gacaagctcacagac

SEQ ID NO: 4254007 - DNA, 22 bp, Homo sapiens
gacaattgaggtaagttttttg

SEQ ID NO: 4254008 - DNA, 14 bp, Homo sapiens
gacacactgaagaa

SEQ ID NO: 4254009 - DNA, 10 bp, Homo sapiens
gacacctgcc

SEQ ID NO: 4254010 - DNA, 11 bp, Homo sapiens
gacacctgccc

SEQ ID NO: 4254011 - DNA, 21 bp, Homo sapiens
gacacgcacggcagccacagc

SEQ ID NO: 4254012 - DNA, 17 bp, Homo sapiens
gacagtcacctcatgga

SEQ ID NO: 4254013 - DNA, 14 bp, Homo sapiens
gacatcagcaaaca

SEQ ID NO: 4254014 - DNA, 23 bp, Homo sapiens
gacattgacctatttccagaaat

SEQ ID NO: 4254015 - DNA, 13 bp, Homo sapiens
gacattttacatt

SEQ ID NO: 4254016 - DNA, 21 bp, Homo sapiens
gacattttacattaaattttt

SEQ ID NO: 4254017 - DNA, 23 bp, Homo sapiens
gaccatggacactacacccagca

SEQ ID NO: 4254018 - DNA, 13 bp, Homo sapiens
gacccaggacagg

SEQ ID NO: 4254019 - DNA, 15 bp, Homo sapiens
gaccccagccatcca

SEQ ID NO: 4254020 - DNA, 21 bp, Homo sapiens
gaccctccaccgcagaaggaa

SEQ ID NO: 4254021 - DNA, 22 bp, Homo sapiens
gacctgcctcccttcatgcatg

SEQ ID NO: 4254022 - DNA, 14 bp, Homo sapiens
gactcaaaccaaat

SEQ ID NO: 4254023 - DNA, 19 bp, Homo sapiens
gactgaaaatattgtttta

SEQ ID NO: 4254024 - DNA, 15 bp, Homo sapiens
gactgcggaggaagg

SEQ ID NO: 4254025 - DNA, 21 bp, Homo sapiens
gactgggtaggaaagaggaag

SEQ ID NO: 4254026 - DNA, 17 bp, Homo sapiens
gacttatagtacatgat

SEQ ID NO: 4254027 - DNA, 18 bp, Homo sapiens
gacttatagtacatgata

SEQ ID NO: 4254028 - DNA, 21 bp, Homo sapiens
gagaacctagggtgatattaa

SEQ ID NO: 4254029 - DNA, 16 bp, Homo sapiens
gagaagaaagaacgga

SEQ ID NO: 4254030 - DNA, 17 bp, Homo sapiens
gagaatgagagacacac

SEQ ID NO: 4254031 - DNA, 18 bp, Homo sapiens
gagacacactgaagaagc

SEQ ID NO: 4254032 - DNA, 11 bp, Homo sapiens
gagacatccag

SEQ ID NO: 4254033 - DNA, 19 bp, Homo sapiens
gagagacacactgaagaag

SEQ ID NO: 4254034 - DNA, 13 bp, Homo sapiens
gagatgaggccag

SEQ ID NO: 4254035 - DNA, 14 bp, Homo sapiens
gagatgaggccaga

SEQ ID NO: 4254036 - DNA, 15 bp, Homo sapiens
gagatgaggccagac

SEQ ID NO: 4254037 - DNA, 14 bp, Homo sapiens
gagcagtcaggaaa

SEQ ID NO: 4254038 - DNA, 21 bp, Homo sapiens
gagcccttctatacccaccca

SEQ ID NO: 4254039 - DNA, 19 bp, Homo sapiens
gagctgatggagaaggaag

SEQ ID NO: 4254040 - DNA, 20 bp, Homo sapiens
gagctggagatgaggccaga

SEQ ID NO: 4254041 - DNA, 23 bp, Homo sapiens
gagctggagatgaggccagacca

SEQ ID NO: 4254042 - DNA, 14 bp, Homo sapiens
gaggacacatgtcc

SEQ ID NO: 4254043 - DNA, 16 bp, Homo sapiens
gaggaggcagagaaga

SEQ ID NO: 4254044 - DNA, 19 bp, Homo sapiens
tgcagtctctataccaata

SEQ ID NO: 4254045 - DNA, 21 bp, Homo sapiens
tgcagtctctataccaataaa

SEQ ID NO: 4254046 - DNA, 12 bp, Homo sapiens
tgcagttctgaa

SEQ ID NO: 4254047 - DNA, 19 bp, Homo sapiens
tgcagttctgaagaagatg

SEQ ID NO: 4254048 - DNA, 21 bp, Homo sapiens
tgcatccagcctggggctgag

SEQ ID NO: 4254049 - DNA, 14 bp, Homo sapiens
tgcattatatttat

SEQ ID NO: 4254050 - DNA, 20 bp, Homo sapiens
tgcattatatttattactgt

SEQ ID NO: 4254051 - DNA, 21 bp, Homo sapiens
tgccacaccccccacccctag

SEQ ID NO: 4254052 - DNA, 17 bp, Homo sapiens
tgccaccctcatgctgt

SEQ ID NO: 4254053 - DNA, 20 bp, Homo sapiens
tgccaggctggagtgcagtg

SEQ ID NO: 4254054 - DNA, 14 bp, Homo sapiens
tgccctgccacctg

SEQ ID NO: 4254055 - DNA, 16 bp, Homo sapiens
tgccctgccacctgtc

SEQ ID NO: 4254056 - DNA, 18 bp, Homo sapiens
tgccctgccctgccacct

SEQ ID NO: 4254057 - DNA, 14 bp, Homo sapiens
tgcctcttccctct

SEQ ID NO: 4254058 - DNA, 17 bp, Homo sapiens
tgccttctcaactccaa

SEQ ID NO: 4254059 - DNA, 21 bp, Homo sapiens
tgcgcccttaactgcatccag

SEQ ID NO: 4254060 - DNA, 20 bp, Homo sapiens
tgcttaattcaaataataat

SEQ ID NO: 4254061 - DNA, 22 bp, Homo sapiens
tgcttctcagatttctgaggaa

SEQ ID NO: 4254062 - DNA, 22 bp, Homo sapiens
tgcttctgttttataattttgt

SEQ ID NO: 4254063 - DNA, 19 bp, Homo sapiens
tggaaaccttccacccagt

SEQ ID NO: 4254064 - DNA, 13 bp, Homo sapiens
tggaaaggcagct

SEQ ID NO: 4254065 - DNA, 18 bp, Homo sapiens
tggaaattcccttcatct

SEQ ID NO: 4254066 - DNA, 17 bp, Homo sapiens
tggaagtgactttggct

SEQ ID NO: 4254067 - DNA, 10 bp, Homo sapiens
tggacacctg

SEQ ID NO: 4254068 - DNA, 12 bp, Homo sapiens
tggacacctgcc

SEQ ID NO: 4254069 - DNA, 13 bp, Homo sapiens
tggacacctgccc

SEQ ID NO: 4254070 - DNA, 14 bp, Homo sapiens
tggacacctgccct

SEQ ID NO: 4254071 - DNA, 16 bp, Homo sapiens
tggacacctgccctgc

SEQ ID NO: 4254072 - DNA, 18 bp, Homo sapiens
tggacactacacccagca

SEQ ID NO: 4254073 - DNA, 19 bp, Homo sapiens
tggacactacacccagcaa

SEQ ID NO: 4254074 - DNA, 12 bp, Homo sapiens
tggagaaggaag

SEQ ID NO: 4254075 - DNA, 13 bp, Homo sapiens
tggagaaggaagg

SEQ ID NO: 4254076 - DNA, 14 bp, Homo sapiens
tggagaaggaaggc

SEQ ID NO: 4254077 - DNA, 19 bp, Homo sapiens
tggagatgaggccagacca

SEQ ID NO: 4254078 - DNA, 22 bp, Homo sapiens
tggagatgaggccagaccatgg

SEQ ID NO: 4254079 - DNA, 21 bp, Homo sapiens
tggagctcgtggaacagttac

SEQ ID NO: 4254080 - DNA, 13 bp, Homo sapiens
tggaggggcagag

SEQ ID NO: 4254081 - DNA, 20 bp, Homo sapiens
tggcaatagtcaaattgtgt

SEQ ID NO: 4254082 - DNA, 16 bp, Homo sapiens
tggcttcctggcaata

SEQ ID NO: 4254083 - DNA, 18 bp, Homo sapiens
tgggacagtcacctcatg

SEQ ID NO: 4254084 - DNA, 19 bp, Homo sapiens
tgggaggtgagaccacctc

SEQ ID NO: 4254085 - DNA, 18 bp, Homo sapiens
tgggcagcaatttaaatg

SEQ ID NO: 4254086 - DNA, 21 bp, Homo sapiens
tgggcagcaatttaaatgtta

SEQ ID NO: 4254087 - DNA, 19 bp, Homo sapiens
tgggccccatgttaacccc

SEQ ID NO: 4254088 - DNA, 23 bp, Homo sapiens
tggggctcctccagggtggcagc

SEQ ID NO: 4254089 - DNA, 14 bp, Homo sapiens
tgggtagacacaca

SEQ ID NO: 4254090 - DNA, 16 bp, Homo sapiens
tgggtagacacacatg

SEQ ID NO: 4254091 - DNA, 19 bp, Homo sapiens
tgggttagggaaaacattc

SEQ ID NO: 4254092 - DNA, 13 bp, Homo sapiens
tggtatgttttca

SEQ ID NO: 4254093 - DNA, 14 bp, Homo sapiens
tggtggtagagaag

SEQ ID NO: 4254094 - DNA, 17 bp, Homo sapiens
tggttcccttgatgaag

SEQ ID NO: 4254095 - DNA, 20 bp, Homo sapiens
tggttcccttgatgaagaag

SEQ ID NO: 4254096 - DNA, 22 bp, Homo sapiens
tgtaccgtaggctttgtattca

SEQ ID NO: 4254097 - DNA, 15 bp, Homo sapiens
tgtagtgttggagaa

SEQ ID NO: 4254098 - DNA, 19 bp, Homo sapiens
tgtagtgttggagaagaac

SEQ ID NO: 4254099 - DNA, 20 bp, Homo sapiens
tgtagtgttggagaagaact

SEQ ID NO: 4254100 - DNA, 22 bp, Homo sapiens
tgtagtgttggagaagaactga

SEQ ID NO: 4254101 - DNA, 15 bp, Homo sapiens
tgtatactatagtac

SEQ ID NO: 4254102 - DNA, 14 bp, Homo sapiens
tgtatattacaatg

SEQ ID NO: 4254103 - DNA, 16 bp, Homo sapiens
tgtatgcacagtaaaa

SEQ ID NO: 4254104 - DNA, 18 bp, Homo sapiens
tgtattgtatattacaat

SEQ ID NO: 4254105 - DNA, 22 bp, Homo sapiens
tgtctacactaagagagaatga

SEQ ID NO: 4254106 - DNA, 20 bp, Homo sapiens
tgtctatggatttgccttct

SEQ ID NO: 4254107 - DNA, 15 bp, Homo sapiens
tgtctgtctgtccca

SEQ ID NO: 4254108 - DNA, 14 bp, Homo sapiens
tgtgaagcaaaatt

SEQ ID NO: 4254109 - DNA, 15 bp, Homo sapiens
tgtgacattttacat

SEQ ID NO: 4254110 - DNA, 17 bp, Homo sapiens
tgttatgactatgtaaa

SEQ ID NO: 4254111 - DNA, 21 bp, Homo sapiens
tgttcaagcgattctcctgcc

SEQ ID NO: 4254112 - DNA, 12 bp, Homo sapiens
tgttgaataaat

SEQ ID NO: 4254113 - DNA, 13 bp, Homo sapiens
tgttgaataaatg

SEQ ID NO: 4254114 - DNA, 20 bp, Homo sapiens
tgttgacatgggacatttgc

SEQ ID NO: 4254115 - DNA, 22 bp, Homo sapiens
tgttgcccacagctgtatgatt

SEQ ID NO: 4254116 - DNA, 14 bp, Homo sapiens
tgttggagaagaac

SEQ ID NO: 4254117 - DNA, 21 bp, Homo sapiens
tgtttcaaacatatataacaa

SEQ ID NO: 4254118 - DNA, 22 bp, Homo sapiens
tgtttcaaacatatataacaat

SEQ ID NO: 4254119 - DNA, 16 bp, Homo sapiens
tgtttctattttttga

SEQ ID NO: 4254120 - DNA, 13 bp, Homo sapiens
tgttttacaatag

SEQ ID NO: 4254121 - DNA, 13 bp, Homo sapiens
tgttttataattt

SEQ ID NO: 4254122 - DNA, 18 bp, Homo sapiens
tgtttttttgttattaaa

SEQ ID NO: 4254123 - DNA, 19 bp, Homo sapiens
ttaaaagaatgattatgaa

SEQ ID NO: 4254124 - DNA, 16 bp, Homo sapiens
ttaaaattacaactaa

SEQ ID NO: 4254125 - DNA, 19 bp, Homo sapiens
ttaaatgtatactatagta

SEQ ID NO: 4254126 - DNA, 16 bp, Homo sapiens
ttaaattttttttaca

SEQ ID NO: 4254127 - DNA, 14 bp, Homo sapiens
ttaactattgcatt

SEQ ID NO: 4254128 - DNA, 21 bp, Homo sapiens
ttaactattgcatttatatgt

SEQ ID NO: 4254129 - DNA, 20 bp, Homo sapiens
ttaagaagactgcattatat

SEQ ID NO: 4254130 - DNA, 15 bp, Homo sapiens
ttacaatagttctgt

SEQ ID NO: 4254131 - DNA, 20 bp, Homo sapiens
ttacatttgtataaaataat

SEQ ID NO: 4254132 - DNA, 12 bp, Homo sapiens
ttacctgggaaa

SEQ ID NO: 4254133 - DNA, 15 bp, Homo sapiens
ttactgtaagaaaat

SEQ ID NO: 4254134 - DNA, 14 bp, Homo sapiens
ttagggaaaacatt

SEQ ID NO: 4254135 - DNA, 19 bp, Homo sapiens
ttataataaaggactgtaa

SEQ ID NO: 4254136 - DNA, 15 bp, Homo sapiens
ttataattttgtgaa

SEQ ID NO: 4254137 - DNA, 16 bp, Homo sapiens
ttataattttgtgaag

SEQ ID NO: 4254138 - DNA, 13 bp, Homo sapiens
ttatagtacatga

SEQ ID NO: 4254139 - DNA, 16 bp, Homo sapiens
ttatatgtaccgtagg

SEQ ID NO: 4254140 - DNA, 20 bp, Homo sapiens
ttatatttattactgtaaga

SEQ ID NO: 4254141 - DNA, 13 bp, Homo sapiens
ttatatttgaaat

SEQ ID NO: 4254142 - DNA, 16 bp, Homo sapiens
ttatgaattacatttg

SEQ ID NO: 4254143 - DNA, 19 bp, Homo sapiens
ttatgattaagtaatgata

SEQ ID NO: 4254144 - DNA, 21 bp, Homo sapiens
ttatggcactagtatttctat

SEQ ID NO: 4254145 - DNA, 19 bp, Homo sapiens
ttatgtgacattttacatt

SEQ ID NO: 4254146 - DNA, 19 bp, Homo sapiens
ttatgttaaaactgggaca

SEQ ID NO: 4254147 - DNA, 17 bp, Homo sapiens
ttattactgtaagaaaa

SEQ ID NO: 4254148 - DNA, 12 bp, Homo sapiens
ttatttcaatat

SEQ ID NO: 4254149 - DNA, 16 bp, Homo sapiens
ttattttaataatgtt

SEQ ID NO: 4254150 - DNA, 17 bp, Homo sapiens
ttattttaataatgttt

SEQ ID NO: 4254151 - DNA, 20 bp, Homo sapiens
ttattttaataatgtttcaa

SEQ ID NO: 4254152 - DNA, 22 bp, Homo sapiens
ttcaaatcaatctgtaaaacta

SEQ ID NO: 4254153 - DNA, 16 bp, Homo sapiens
ttcaagcaatcctccc

SEQ ID NO: 4254154 - DNA, 17 bp, Homo sapiens
ttcaaggtctgcttttc

SEQ ID NO: 4254155 - DNA, 20 bp, Homo sapiens
ttcagataatcacaatacat

SEQ ID NO: 4254156 - DNA, 18 bp, Homo sapiens
ttcagtctctataccaat

SEQ ID NO: 4254157 - DNA, 22 bp, Homo sapiens
ttcagtctctataccaataaag

SEQ ID NO: 4254158 - DNA, 22 bp, Homo sapiens
ttcagtttatttgaaccaataa

SEQ ID NO: 4254159 - DNA, 15 bp, Homo sapiens
ttcatgcatggaaat

SEQ ID NO: 4254160 - DNA, 23 bp, Homo sapiens
ttccacccagtgctgaatttccc

SEQ ID NO: 4254161 - DNA, 19 bp, Homo sapiens
ttccactcgtgtgtttcta

SEQ ID NO: 4254162 - DNA, 13 bp, Homo sapiens
ttccattctggaa

SEQ ID NO: 4254163 - DNA, 15 bp, Homo sapiens
ttccattctggaagt

SEQ ID NO: 4254164 - DNA, 22 bp, Homo sapiens
ttccctggaaaccttccaccca

SEQ ID NO: 4254165 - DNA, 23 bp, Homo sapiens
ttccctggaaaccttccacccag

SEQ ID NO: 4254166 - DNA, 19 bp, Homo sapiens
ttccttccctgctgtgaaa

SEQ ID NO: 4254167 - DNA, 15 bp, Homo sapiens
ttctagtgtagaatt

SEQ ID NO: 4254168 - DNA, 21 bp, Homo sapiens
ttctatgaaatattatgttaa

SEQ ID NO: 4254169 - DNA, 15 bp, Homo sapiens
ttctcagatttctga

SEQ ID NO: 4254170 - DNA, 16 bp, Homo sapiens
ttctcagatttctgag

SEQ ID NO: 4254171 - DNA, 21 bp, Homo sapiens
tcacgtttggtgcttctcaga

SEQ ID NO: 4254172 - DNA, 22 bp, Homo sapiens
tcagaaacaccctcacactggg

SEQ ID NO: 4254173 - DNA, 21 bp, Homo sapiens
tcagcaaacaggatcagttaa

SEQ ID NO: 4254174 - DNA, 19 bp, Homo sapiens
tcagctctcagttgcagcc

SEQ ID NO: 4254175 - DNA, 15 bp, Homo sapiens
tcaggaagagaagga

SEQ ID NO: 4254176 - DNA, 16 bp, Homo sapiens
tcaggaagagaaggag

SEQ ID NO: 4254177 - DNA, 20 bp, Homo sapiens
tcaggaagagaaggagcaga

SEQ ID NO: 4254178 - DNA, 18 bp, Homo sapiens
tcagtctctataccaata

SEQ ID NO: 4254179 - DNA, 21 bp, Homo sapiens
tcagtctctataccaataaag

SEQ ID NO: 4254180 - DNA, 20 bp, Homo sapiens
tcagttaactattgcattta

SEQ ID NO: 4254181 - DNA, 12 bp, Homo sapiens
tcagttgcagcc

SEQ ID NO: 4254182 - DNA, 13 bp, Homo sapiens
tcatctcagctca

SEQ ID NO: 4254183 - DNA, 12 bp, Homo sapiens
tcatctggaacc

SEQ ID NO: 4254184 - DNA, 13 bp, Homo sapiens
tcatctggaacca

SEQ ID NO: 4254185 - DNA, 18 bp, Homo sapiens
tcatctggaaccatcaga

SEQ ID NO: 4254186 - DNA, 14 bp, Homo sapiens
tcatgaccagtaaa

SEQ ID NO: 4254187 - DNA, 14 bp, Homo sapiens
tcatgcatggaaat

SEQ ID NO: 4254188 - DNA, 16 bp, Homo sapiens
tcatttccaagcaagt

SEQ ID NO: 4254189 - DNA, 23 bp, Homo sapiens
tccaaactgactcttaagaagac

SEQ ID NO: 4254190 - DNA, 13 bp, Homo sapiens
tccaaccctagca

SEQ ID NO: 4254191 - DNA, 17 bp, Homo sapiens
tccaccgcagaaggaag

SEQ ID NO: 4254192 - DNA, 18 bp, Homo sapiens
tccaccgcagaaggaagg

SEQ ID NO: 4254193 - DNA, 14 bp, Homo sapiens
tccactcgtgtgtt

SEQ ID NO: 4254194 - DNA, 15 bp, Homo sapiens
tccactctttctttc

SEQ ID NO: 4254195 - DNA, 17 bp, Homo sapiens
tccagagcactgctcca

SEQ ID NO: 4254196 - DNA, 14 bp, Homo sapiens
tccagggtggcagc

SEQ ID NO: 4254197 - DNA, 15 bp, Homo sapiens
tccagggtggcagca

SEQ ID NO: 4254198 - DNA, 20 bp, Homo sapiens
tccagggtggcagcaacaat

SEQ ID NO: 4254199 - DNA, 19 bp, Homo sapiens
tccaggtagagggtgtgta

SEQ ID NO: 4254200 - DNA, 14 bp, Homo sapiens
tccatggccctgcc

SEQ ID NO: 4254201 - DNA, 12 bp, Homo sapiens
tccattctggaa

SEQ ID NO: 4254202 - DNA, 14 bp, Homo sapiens
tcccaaaaaactac

SEQ ID NO: 4254203 - DNA, 20 bp, Homo sapiens
tcccaaaagcccattcattc

SEQ ID NO: 4254204 - DNA, 21 bp, Homo sapiens
tcccaaagtcctgggattaca

SEQ ID NO: 4254205 - DNA, 21 bp, Homo sapiens
tcccaagcacctgggattaca

SEQ ID NO: 4254206 - DNA, 21 bp, Homo sapiens
tcccaagtaactgggattaca

SEQ ID NO: 4254207 - DNA, 19 bp, Homo sapiens
tcccatcaggtcaccgcga

SEQ ID NO: 4254208 - DNA, 14 bp, Homo sapiens
tcccatgttcaagc

SEQ ID NO: 4254209 - DNA, 12 bp, Homo sapiens
tccctcacccat

SEQ ID NO: 4254210 - DNA, 23 bp, Homo sapiens
tccctcttccttccctgctgtga

SEQ ID NO: 4254211 - DNA, 22 bp, Homo sapiens
tccctggaaaccttccacccag

SEQ ID NO: 4254212 - DNA, 18 bp, Homo sapiens
tcccttcatgcatggaaa

SEQ ID NO: 4254213 - DNA, 14 bp, Homo sapiens
tccgtgcttaacca

SEQ ID NO: 4254214 - DNA, 17 bp, Homo sapiens
tcctccacctcaactcc

SEQ ID NO: 4254215 - DNA, 14 bp, Homo sapiens
tcctgcctcagcct

SEQ ID NO: 4254216 - DNA, 17 bp, Homo sapiens
tcctggcaatagtcaaa

SEQ ID NO: 4254217 - DNA, 19 bp, Homo sapiens
tccttagaaaaaaaattat

SEQ ID NO: 4254218 - DNA, 17 bp, Homo sapiens
tcgccggatctgaggga

SEQ ID NO: 4254219 - DNA, 12 bp, Homo sapiens
tcgtggacacct

SEQ ID NO: 4254220 - DNA, 15 bp, Homo sapiens
tcgtggacacctgcc

SEQ ID NO: 4254221 - DNA, 16 bp, Homo sapiens
tctaggaaatatttat

SEQ ID NO: 4254222 - DNA, 15 bp, Homo sapiens
tctatacccacccag

SEQ ID NO: 4254223 - DNA, 13 bp, Homo sapiens
tctatgaaatatt

SEQ ID NO: 4254224 - DNA, 15 bp, Homo sapiens
tctcaactccaaact

SEQ ID NO: 4254225 - DNA, 17 bp, Homo sapiens
tctcaatattcaataaa

SEQ ID NO: 4254226 - DNA, 18 bp, Homo sapiens
tctcaatattcaataaag

SEQ ID NO: 4254227 - DNA, 17 bp, Homo sapiens
tctcagatttctgagga

SEQ ID NO: 4254228 - DNA, 18 bp, Homo sapiens
tctcagatttctgaggaa

SEQ ID NO: 4254229 - DNA, 16 bp, Homo sapiens
tctccagcctcagcct

SEQ ID NO: 4254230 - DNA, 17 bp, Homo sapiens
tctccatggccctgcca

SEQ ID NO: 4254231 - DNA, 24 bp, Homo sapiens
tctccatggccctgccatgctctc

SEQ ID NO: 4254232 - DNA, 19 bp, Homo sapiens
tctcctaagctggagtgca

SEQ ID NO: 4254233 - DNA, 22 bp, Homo sapiens
tctctgaggggctaccaggaaa

SEQ ID NO: 4254234 - DNA, 23 bp, Homo sapiens
tctctgaggggctaccaggaaag

SEQ ID NO: 4254235 - DNA, 17 bp, Homo sapiens
tctcttcagtctctata

SEQ ID NO: 4254236 - DNA, 21 bp, Homo sapiens
tctctttaaaaggaaagaaaa

SEQ ID NO: 4254237 - DNA, 17 bp, Homo sapiens
tctgaataaagcaatta

SEQ ID NO: 4254238 - DNA, 23 bp, Homo sapiens
tctgacataatccagtaaaataa

SEQ ID NO: 4254239 - DNA, 19 bp, Homo sapiens
tctgaggggctaccaggaa

SEQ ID NO: 4254240 - DNA, 18 bp, Homo sapiens
tctgcagtctctatacca

SEQ ID NO: 4254241 - DNA, 20 bp, Homo sapiens
tctgcagtctctataccaat

SEQ ID NO: 4254242 - DNA, 23 bp, Homo sapiens
tctggtatgaacttgaggacaca

SEQ ID NO: 4254243 - DNA, 14 bp, Homo sapiens
tctggtctcgaact

SEQ ID NO: 4254244 - DNA, 15 bp, Homo sapiens
tctgtctgtctgtcc

SEQ ID NO: 4254245 - DNA, 18 bp, Homo sapiens
tctgttttataattttgt

SEQ ID NO: 4254246 - DNA, 20 bp, Homo sapiens
tctgttttataattttgtga

SEQ ID NO: 4254247 - DNA, 18 bp, Homo sapiens
tcttaagaagactgcatt

SEQ ID NO: 4254248 - DNA, 22 bp, Homo sapiens
tcttagatgcagttctgaagaa

SEQ ID NO: 4254249 - DNA, 23 bp, Homo sapiens
tcttagatgcagttctgaagaag

SEQ ID NO: 4254250 - DNA, 16 bp, Homo sapiens
tctttaaaaggaaaga

SEQ ID NO: 4254251 - DNA, 18 bp, Homo sapiens
tctttaaaaggaaagaaa

SEQ ID NO: 4254252 - DNA, 17 bp, Homo sapiens
tctttccacagaagctc

SEQ ID NO: 4254253 - DNA, 16 bp, Homo sapiens
tctttgccaccctcat

SEQ ID NO: 4254254 - DNA, 17 bp, Homo sapiens
tctttgccaccctcatg

SEQ ID NO: 4254255 - DNA, 20 bp, Homo sapiens
tctttgccaccctcatgctg

SEQ ID NO: 4254256 - DNA, 22 bp, Homo sapiens
tctttgccaccctcatgctgtg

SEQ ID NO: 4254257 - DNA, 16 bp, Homo sapiens
tcttttttcaaaagaa

SEQ ID NO: 4254258 - DNA, 16 bp, Homo sapiens
tgaaatattgactttt

SEQ ID NO: 4254259 - DNA, 16 bp, Homo sapiens
tgaactttgctgagcc

SEQ ID NO: 4254260 - DNA, 17 bp, Homo sapiens
tgaagatttaccacttg

SEQ ID NO: 4254261 - DNA, 11 bp, Homo sapiens
tgaagtccaag

SEQ ID NO: 4254262 - DNA, 13 bp, Homo sapiens
tgaagtccaagca

SEQ ID NO: 4254263 - DNA, 14 bp, Homo sapiens
tgaataaagcaatt

SEQ ID NO: 4254264 - DNA, 14 bp, Homo sapiens
tgaattacatttgt

SEQ ID NO: 4254265 - DNA, 15 bp, Homo sapiens
tgaattacatttgta

SEQ ID NO: 4254266 - DNA, 16 bp, Homo sapiens
tgaattacatttgtat

SEQ ID NO: 4254267 - DNA, 18 bp, Homo sapiens
tgaattacatttgtataa

SEQ ID NO: 4254268 - DNA, 15 bp, Homo sapiens
tgacattttacatta

SEQ ID NO: 4254269 - DNA, 22 bp, Homo sapiens
tgaccctccaccgcagaaggaa

SEQ ID NO: 4254270 - DNA, 21 bp, Homo sapiens
tgacctgcctcccttcatgca

SEQ ID NO: 4254271 - DNA, 12 bp, Homo sapiens
tgactcttaaga

SEQ ID NO: 4254272 - DNA, 19 bp, Homo sapiens
actgaactttgctgagcct

SEQ ID NO: 4254273 - DNA, 21 bp, Homo sapiens
actgaactttgctgagcctgt

SEQ ID NO: 4254274 - DNA, 17 bp, Homo sapiens
actgactcttaagaaga

SEQ ID NO: 4254275 - DNA, 19 bp, Homo sapiens
actgatatgggtcttgata

SEQ ID NO: 4254276 - DNA, 16 bp, Homo sapiens
actgcaacctccacct

SEQ ID NO: 4254277 - DNA, 14 bp, Homo sapiens
actgcatccagcct

SEQ ID NO: 4254278 - DNA, 15 bp, Homo sapiens
actgcatccagcctg

SEQ ID NO: 4254279 - DNA, 13 bp, Homo sapiens
actgccttctcaa

SEQ ID NO: 4254280 - DNA, 20 bp, Homo sapiens
actgccttctcaactccaaa

SEQ ID NO: 4254281 - DNA, 22 bp, Homo sapiens
actgccttctcaactccaaact

SEQ ID NO: 4254282 - DNA, 15 bp, Homo sapiens
actgctctcctccac

SEQ ID NO: 4254283 - DNA, 12 bp, Homo sapiens
actggccccacc

SEQ ID NO: 4254284 - DNA, 18 bp, Homo sapiens
actgggacaggggagaac

SEQ ID NO: 4254285 - DNA, 15 bp, Homo sapiens
actgggtaggaaaga

SEQ ID NO: 4254286 - DNA, 21 bp, Homo sapiens
acttcttttttcaaaagaaag

SEQ ID NO: 4254287 - DNA, 15 bp, Homo sapiens
acttgaggacacatg

SEQ ID NO: 4254288 - DNA, 15 bp, Homo sapiens
acttgtcaataaaat

SEQ ID NO: 4254289 - DNA, 14 bp, Homo sapiens
actttggctgcatg

SEQ ID NO: 4254290 - DNA, 17 bp, Homo sapiens
actttttgcagctttct

SEQ ID NO: 4254291 - DNA, 17 bp, Homo sapiens
agaaaaatatatactaa

SEQ ID NO: 4254292 - DNA, 19 bp, Homo sapiens
agaaaacaaggatgaatta

SEQ ID NO: 4254293 - DNA, 16 bp, Homo sapiens
agaaaatttttgtagt

SEQ ID NO: 4254294 - DNA, 13 bp, Homo sapiens
agaaaccctgcac

SEQ ID NO: 4254295 - DNA, 17 bp, Homo sapiens
agaaagcatccctcacc

SEQ ID NO: 4254296 - DNA, 21 bp, Homo sapiens
agaagaactgaaatcatactt

SEQ ID NO: 4254297 - DNA, 18 bp, Homo sapiens
agaagactgcattatatt

SEQ ID NO: 4254298 - DNA, 18 bp, Homo sapiens
agaagatggtaccaccag

SEQ ID NO: 4254299 - DNA, 14 bp, Homo sapiens
agaagctccaggta

SEQ ID NO: 4254300 - DNA, 17 bp, Homo sapiens
agaatgattatgaatta

SEQ ID NO: 4254301 - DNA, 12 bp, Homo sapiens
agacacacatga

SEQ ID NO: 4254302 - DNA, 21 bp, Homo sapiens
agacacgcacggcagccacag

SEQ ID NO: 4254303 - DNA, 12 bp, Homo sapiens
agaccacctctc

SEQ ID NO: 4254304 - DNA, 21 bp, Homo sapiens
agaccatggacactacaccca

SEQ ID NO: 4254305 - DNA, 22 bp, Homo sapiens
agaccatggacactacacccag

SEQ ID NO: 4254306 - DNA, 23 bp, Homo sapiens
agaccatggacactacacccagc

SEQ ID NO: 4254307 - DNA, 15 bp, Homo sapiens
agaccgatcggcggc

SEQ ID NO: 4254308 - DNA, 23 bp, Homo sapiens
agactacaggcacacaccaccac

SEQ ID NO: 4254309 - DNA, 17 bp, Homo sapiens
agactgcattatattta

SEQ ID NO: 4254310 - DNA, 21 bp, Homo sapiens
agactgcattatatttattac

SEQ ID NO: 4254311 - DNA, 18 bp, Homo sapiens
agactgggtaggaaagag

SEQ ID NO: 4254312 - DNA, 17 bp, Homo sapiens
agagaacttccagatcc

SEQ ID NO: 4254313 - DNA, 13 bp, Homo sapiens
agagaagaaagaa

SEQ ID NO: 4254314 - DNA, 13 bp, Homo sapiens
agagaaggagcag

SEQ ID NO: 4254315 - DNA, 20 bp, Homo sapiens
agagacacactgaagaagca

SEQ ID NO: 4254316 - DNA, 15 bp, Homo sapiens
agagatcaggaagag

SEQ ID NO: 4254317 - DNA, 20 bp, Homo sapiens
agagatcaggaagagaagga

SEQ ID NO: 4254318 - DNA, 16 bp, Homo sapiens
agagcactgctccagt

SEQ ID NO: 4254319 - DNA, 16 bp, Homo sapiens
agagctgatggagaag

SEQ ID NO: 4254320 - DNA, 19 bp, Homo sapiens
agagctgatggagaaggaa

SEQ ID NO: 4254321 - DNA, 21 bp, Homo sapiens
agagctggagatgaggccaga

SEQ ID NO: 4254322 - DNA, 23 bp, Homo sapiens
agaggccaggcaggagcccttct

SEQ ID NO: 4254323 - DNA, 18 bp, Homo sapiens
agatcaggaagagaagga

SEQ ID NO: 4254324 - DNA, 14 bp, Homo sapiens
agatcctggaaatc

SEQ ID NO: 4254325 - DNA, 22 bp, Homo sapiens
agatgaggccagaccatggaca

SEQ ID NO: 4254326 - DNA, 19 bp, Homo sapiens
agatgcagttctgaagaag

SEQ ID NO: 4254327 - DNA, 22 bp, Homo sapiens
agatgtatgtacttcatgctgt

SEQ ID NO: 4254328 - DNA, 16 bp, Homo sapiens
agatttaccacttgtg

SEQ ID NO: 4254329 - DNA, 23 bp, Homo sapiens
agcaaaattttttctctaggaaa

SEQ ID NO: 4254330 - DNA, 18 bp, Homo sapiens
agcaacaataaatagaca

SEQ ID NO: 4254331 - DNA, 17 bp, Homo sapiens
agcaagaccccatctca

SEQ ID NO: 4254332 - DNA, 21 bp, Homo sapiens
agcaattacaacggagtcaaa

SEQ ID NO: 4254333 - DNA, 19 bp, Homo sapiens
agcaatttaaatgttatga

SEQ ID NO: 4254334 - DNA, 16 bp, Homo sapiens
agcaccaatcatgaat

SEQ ID NO: 4254335 - DNA, 21 bp, Homo sapiens
agcagagctgatggagaagga

SEQ ID NO: 4254336 - DNA, 23 bp, Homo sapiens
agcagagctgatggagaaggaag

SEQ ID NO: 4254337 - DNA, 23 bp, Homo sapiens
agcataaatgttgacatgggaca

SEQ ID NO: 4254338 - DNA, 13 bp, Homo sapiens
agccaagtgcagg

SEQ ID NO: 4254339 - DNA, 22 bp, Homo sapiens
agcccattcattccattctgga

SEQ ID NO: 4254340 - DNA, 22 bp, Homo sapiens
agcccttctatacccacccaga

SEQ ID NO: 4254341 - DNA, 23 bp, Homo sapiens
agcccttctatacccacccagaa

SEQ ID NO: 4254342 - DNA, 19 bp, Homo sapiens
agcccttctttccacagaa

SEQ ID NO: 4254343 - DNA, 17 bp, Homo sapiens
agcctggggctgaggct

SEQ ID NO: 4254344 - DNA, 11 bp, Homo sapiens
agctatataag

SEQ ID NO: 4254345 - DNA, 15 bp, Homo sapiens
agctgatggagaagg

SEQ ID NO: 4254346 - DNA, 19 bp, Homo sapiens
agctggagatgaggccaga

SEQ ID NO: 4254347 - DNA, 20 bp, Homo sapiens
agctggagatgaggccagac

SEQ ID NO: 4254348 - DNA, 21 bp, Homo sapiens
agctggagatgaggccagacc

SEQ ID NO: 4254349 - DNA, 23 bp, Homo sapiens
agctggagatgaggccagaccat

SEQ ID NO: 4254350 - DNA, 21 bp, Homo sapiens
agcttattgtctagtgaaact

SEQ ID NO: 4254351 - DNA, 12 bp, Homo sapiens
aggaaagaaaac

SEQ ID NO: 4254352 - DNA, 24 bp, Homo sapiens
aggaaagcgcctccaaccctagca

SEQ ID NO: 4254353 - DNA, 13 bp, Homo sapiens
aggaaatatttat

SEQ ID NO: 4254354 - DNA, 14 bp, Homo sapiens
aggaaatatttatt

SEQ ID NO: 4254355 - DNA, 18 bp, Homo sapiens
aggaaatatttattttaa

SEQ ID NO: 4254356 - DNA, 20 bp, Homo sapiens
aggaaggaggacccaggaca

SEQ ID NO: 4254357 - DNA, 21 bp, Homo sapiens
aggaaggaggacccaggacag

SEQ ID NO: 4254358 - DNA, 18 bp, Homo sapiens
aggaaggcagggaggagg

SEQ ID NO: 4254359 - DNA, 20 bp, Homo sapiens
aggaaggcagggaggaggca

SEQ ID NO: 4254360 - DNA, 22 bp, Homo sapiens
aggaaggcagggaggaggcaga

SEQ ID NO: 4254361 - DNA, 23 bp, Homo sapiens
aggaagttgacttatagtacatg

SEQ ID NO: 4254362 - DNA, 11 bp, Homo sapiens
aggacacatgt

SEQ ID NO: 4254363 - DNA, 13 bp, Homo sapiens
aggacacatgtcc

SEQ ID NO: 4254364 - DNA, 12 bp, Homo sapiens
aggacccaggac

SEQ ID NO: 4254365 - DNA, 23 bp, Homo sapiens
aggagcccttctatacccaccca

SEQ ID NO: 4254366 - DNA, 13 bp, Homo sapiens
aggaggacccagg

SEQ ID NO: 4254367 - DNA, 15 bp, Homo sapiens
aggatcagttaacta

SEQ ID NO: 4254368 - DNA, 17 bp, Homo sapiens
aggatcagttaactatt

SEQ ID NO: 4254369 - DNA, 11 bp, Homo sapiens
aggatccaggc

SEQ ID NO: 4254370 - DNA, 15 bp, Homo sapiens
aggcagagaagaaag

SEQ ID NO: 4254371 - DNA, 20 bp, Homo sapiens
aggcagctctaaatgtcaat

SEQ ID NO: 4254372 - DNA, 22 bp, Homo sapiens
aggcagggaggaggcagagaag

SEQ ID NO: 4254373 - DNA, 23 bp, Homo sapiens
aggcatgtgtcaccatgcccagc

SEQ ID NO: 4254374 - DNA, 18 bp, Homo sapiens
aggccagaccatggacac

SEQ ID NO: 4254375 - DNA, 19 bp, Homo sapiens
aggccggcttgccacaccc

SEQ ID NO: 4254376 - DNA, 20 bp, Homo sapiens
aggccggcttgccacacccc

SEQ ID NO: 4254377 - DNA, 21 bp, Homo sapiens
aggccggcttgccacaccccc

SEQ ID NO: 4254378 - DNA, 15 bp, Homo sapiens
aggctagatgtatgt

SEQ ID NO: 4254379 - DNA, 16 bp, Homo sapiens
aggctagatgtatgta

SEQ ID NO: 4254380 - DNA, 22 bp, Homo sapiens
aggctgggaatggaggggcaga

SEQ ID NO: 4254381 - DNA, 15 bp, Homo sapiens
agggaaaacattcca

SEQ ID NO: 4254382 - DNA, 14 bp, Homo sapiens
agggaccggcggac

SEQ ID NO: 4254383 - DNA, 20 bp, Homo sapiens
agggaggaggcagagaagaa

SEQ ID NO: 4254384 - DNA, 14 bp, Homo sapiens
aggggcagagccag

SEQ ID NO: 4254385 - DNA, 17 bp, Homo sapiens
aggggctaccaggaaag

SEQ ID NO: 4254386 - DNA, 21 bp, Homo sapiens
aggggcttataataaaggact

SEQ ID NO: 4254387 - DNA, 13 bp, Homo sapiens
agggtggcagcaa

SEQ ID NO: 4254388 - DNA, 16 bp, Homo sapiens
agggtggcagcaacaa

SEQ ID NO: 4254389 - DNA, 14 bp, Homo sapiens
aggtgagaccacct

SEQ ID NO: 4254390 - DNA, 15 bp, Homo sapiens
aggtgagaccacctc

SEQ ID NO: 4254391 - DNA, 21 bp, Homo sapiens
aggtggtggtagagaagcaag

SEQ ID NO: 4254392 - DNA, 13 bp, Homo sapiens
aggttgaaaaaca

SEQ ID NO: 4254393 - DNA, 17 bp, Homo sapiens
agtaactacagttaggg

SEQ ID NO: 4254394 - DNA, 16 bp, Homo sapiens
agtacacaataagcaa

SEQ ID NO: 4254395 - DNA, 10 bp, Homo sapiens
ctaaccaagt

SEQ ID NO: 4254396 - DNA, 16 bp, Homo sapiens
ctaagaaacttaaatt

SEQ ID NO: 4254397 - DNA, 15 bp, Homo sapiens
ctaagagagaatgag

SEQ ID NO: 4254398 - DNA, 19 bp, Homo sapiens
ctaagtacacaataagcaa

SEQ ID NO: 4254399 - DNA, 20 bp, Homo sapiens
ctaagtacacaataagcaaa

SEQ ID NO: 4254400 - DNA, 14 bp, Homo sapiens
ctaattctaatgtg

SEQ ID NO: 4254401 - DNA, 11 bp, Homo sapiens
ctaatttttgt

SEQ ID NO: 4254402 - DNA, 16 bp, Homo sapiens
ctacaacctccgcctc

SEQ ID NO: 4254403 - DNA, 12 bp, Homo sapiens
ctacacccagca

SEQ ID NO: 4254404 - DNA, 13 bp, Homo sapiens
ctacacccagcaa

SEQ ID NO: 4254405 - DNA, 14 bp, Homo sapiens
ctacactaagagag

SEQ ID NO: 4254406 - DNA, 20 bp, Homo sapiens
ctaccaaggtcttcttaata

SEQ ID NO: 4254407 - DNA, 18 bp, Homo sapiens
ctacctctccagcctcag

SEQ ID NO: 4254408 - DNA, 18 bp, Homo sapiens
ctagagtttagctggaaa

SEQ ID NO: 4254409 - DNA, 13 bp, Homo sapiens
ctagtgtagaatt

SEQ ID NO: 4254410 - DNA, 16 bp, Homo sapiens
ctataccaataaagtg

SEQ ID NO: 4254411 - DNA, 16 bp, Homo sapiens
ctatacccacccagaa

SEQ ID NO: 4254412 - DNA, 17 bp, Homo sapiens
ctatagctaagtacaca

SEQ ID NO: 4254413 - DNA, 19 bp, Homo sapiens
ctatataagacaagaactc

SEQ ID NO: 4254414 - DNA, 14 bp, Homo sapiens
ctatctttgccacc

SEQ ID NO: 4254415 - DNA, 21 bp, Homo sapiens
ctatctttgccaccctcatgc

SEQ ID NO: 4254416 - DNA, 18 bp, Homo sapiens
ctatgaaatattatgtta

SEQ ID NO: 4254417 - DNA, 14 bp, Homo sapiens
ctattgcatttata

SEQ ID NO: 4254418 - DNA, 15 bp, Homo sapiens
ctcacccatcctaga

SEQ ID NO: 4254419 - DNA, 20 bp, Homo sapiens
ctcagctcactacaacctcc

SEQ ID NO: 4254420 - DNA, 13 bp, Homo sapiens
ctcatttcaggat

SEQ ID NO: 4254421 - DNA, 14 bp, Homo sapiens
ctcatttccaagca

SEQ ID NO: 4254422 - DNA, 17 bp, Homo sapiens
ctcatttccaagcaagt

SEQ ID NO: 4254423 - DNA, 19 bp, Homo sapiens
ctccatggccctgccatgc

SEQ ID NO: 4254424 - DNA, 22 bp, Homo sapiens
ctcccaagcacctgggattaca

SEQ ID NO: 4254425 - DNA, 15 bp, Homo sapiens
ctcctccacctcaac

SEQ ID NO: 4254426 - DNA, 14 bp, Homo sapiens
ctccttagaaaaaa

SEQ ID NO: 4254427 - DNA, 17 bp, Homo sapiens
ctcgccggatctgaggg

SEQ ID NO: 4254428 - DNA, 18 bp, Homo sapiens
ctcgccggatctgaggga

SEQ ID NO: 4254429 - DNA, 15 bp, Homo sapiens
ctcgtggacacctgc

SEQ ID NO: 4254430 - DNA, 21 bp, Homo sapiens
ctcgtggacacctgccctgcc

SEQ ID NO: 4254431 - DNA, 14 bp, Homo sapiens
ctcgttaatttgta

SEQ ID NO: 4254432 - DNA, 17 bp, Homo sapiens
ctctaggaaatatttat

SEQ ID NO: 4254433 - DNA, 16 bp, Homo sapiens
ctctataccaataaag

SEQ ID NO: 4254434 - DNA, 19 bp, Homo sapiens
ctctataccaataaagtga

SEQ ID NO: 4254435 - DNA, 10 bp, Homo sapiens
ctctcaatat

SEQ ID NO: 4254436 - DNA, 19 bp, Homo sapiens
ctctcaatattcaataaag

SEQ ID NO: 4254437 - DNA, 21 bp, Homo sapiens
ctctcaatattcaataaagct

SEQ ID NO: 4254438 - DNA, 19 bp, Homo sapiens
ctctcagttgcagccctgc

SEQ ID NO: 4254439 - DNA, 15 bp, Homo sapiens
ctctcataccctccc

SEQ ID NO: 4254440 - DNA, 16 bp, Homo sapiens
ctctccaaaccacttt

SEQ ID NO: 4254441 - DNA, 21 bp, Homo sapiens
ctctgaggggctaccaggaaa

SEQ ID NO: 4254442 - DNA, 14 bp, Homo sapiens
ctctgcagtctcta

SEQ ID NO: 4254443 - DNA, 22 bp, Homo sapiens
ctctgcagtctctataccaata

SEQ ID NO: 4254444 - DNA, 13 bp, Homo sapiens
ctcttaagaagac

SEQ ID NO: 4254445 - DNA, 20 bp, Homo sapiens
ctcttagatgcagttctgaa

SEQ ID NO: 4254446 - DNA, 22 bp, Homo sapiens
ctcttagatgcagttctgaaga

SEQ ID NO: 4254447 - DNA, 15 bp, Homo sapiens
ctcttccttccctgc

SEQ ID NO: 4254448 - DNA, 20 bp, Homo sapiens
ctctttaaaaggaaagaaaa

SEQ ID NO: 4254449 - DNA, 17 bp, Homo sapiens
ctctttctttcaataaa

SEQ ID NO: 4254450 - DNA, 13 bp, Homo sapiens
ctgaactttgctg

SEQ ID NO: 4254451 - DNA, 14 bp, Homo sapiens
ctgaactttgctga

SEQ ID NO: 4254452 - DNA, 13 bp, Homo sapiens
ctgaatttccctc

SEQ ID NO: 4254453 - DNA, 23 bp, Homo sapiens
ctgaccctccaccgcagaaggaa

SEQ ID NO: 4254454 - DNA, 17 bp, Homo sapiens
ctgactcttaagaagac

SEQ ID NO: 4254455 - DNA, 20 bp, Homo sapiens
ctgaggggctaccaggaaag

SEQ ID NO: 4254456 - DNA, 14 bp, Homo sapiens
ctgatggagaagga

SEQ ID NO: 4254457 - DNA, 14 bp, Homo sapiens
ctgcaacctccacc

SEQ ID NO: 4254458 - DNA, 16 bp, Homo sapiens
ctgccacctcctgcct

SEQ ID NO: 4254459 - DNA, 19 bp, Homo sapiens
ctgccacctcctgcctcag

SEQ ID NO: 4254460 - DNA, 16 bp, Homo sapiens
ctgccacctgtctgtc

SEQ ID NO: 4254461 - DNA, 22 bp, Homo sapiens
ctgccctctcccaaaaaactac

SEQ ID NO: 4254462 - DNA, 11 bp, Homo sapiens
ctgccctgcca

SEQ ID NO: 4254463 - DNA, 14 bp, Homo sapiens
ctgccctgccacct

SEQ ID NO: 4254464 - DNA, 15 bp, Homo sapiens
ctgccctgccacctg

SEQ ID NO: 4254465 - DNA, 17 bp, Homo sapiens
ctgccctgccacctgtc

SEQ ID NO: 4254466 - DNA, 17 bp, Homo sapiens
ctgcctcccttcatgca

SEQ ID NO: 4254467 - DNA, 21 bp, Homo sapiens
ctgcctcccttcatgcatgga

SEQ ID NO: 4254468 - DNA, 23 bp, Homo sapiens
ctgcctcccttcatgcatggaaa

SEQ ID NO: 4254469 - DNA, 19 bp, Homo sapiens
ctgcctcttccctcttcct

SEQ ID NO: 4254470 - DNA, 23 bp, Homo sapiens
ctgcctggacttggcccctgcca

SEQ ID NO: 4254471 - DNA, 15 bp, Homo sapiens
ctgctacaatgtcct

SEQ ID NO: 4254472 - DNA, 11 bp, Homo sapiens
ctgctgcctgc

SEQ ID NO: 4254473 - DNA, 16 bp, Homo sapiens
ctgctgctacaatgtc

SEQ ID NO: 4254474 - DNA, 14 bp, Homo sapiens
ctgctgctgcctgc

SEQ ID NO: 4254475 - DNA, 15 bp, Homo sapiens
ctgctgctgcctgcc

SEQ ID NO: 4254476 - DNA, 15 bp, Homo sapiens
ctgctgtgaaagaag

SEQ ID NO: 4254477 - DNA, 13 bp, Homo sapiens
ctgcttaattcaa

SEQ ID NO: 4254478 - DNA, 20 bp, Homo sapiens
ctggaaaccttccacccagt

SEQ ID NO: 4254479 - DNA, 16 bp, Homo sapiens
ctggaaccatcagaaa

SEQ ID NO: 4254480 - DNA, 18 bp, Homo sapiens
ctggacttggcccctgcc

SEQ ID NO: 4254481 - DNA, 16 bp, Homo sapiens
ctggagatgaggccag

SEQ ID NO: 4254482 - DNA, 21 bp, Homo sapiens
ctggattccagagcactgctc

SEQ ID NO: 4254483 - DNA, 12 bp, Homo sapiens
ctggccccaccc

SEQ ID NO: 4254484 - DNA, 13 bp, Homo sapiens
ctgggaatggagg

SEQ ID NO: 4254485 - DNA, 20 bp, Homo sapiens
ctgggaatggaggggcagag

SEQ ID NO: 4254486 - DNA, 23 bp, Homo sapiens
ctgggattacaggtgtgagccac

SEQ ID NO: 4254487 - DNA, 15 bp, Homo sapiens
ctgggtaggaaagag

SEQ ID NO: 4254488 - DNA, 20 bp, Homo sapiens
ctggtatgaacttgaggaca

SEQ ID NO: 4254489 - DNA, 23 bp, Homo sapiens
ctggtatgaacttgaggacacat

SEQ ID NO: 4254490 - DNA, 19 bp, Homo sapiens
ctggtgcactggccccacc

SEQ ID NO: 4254491 - DNA, 13 bp, Homo sapiens
ctggtgtttcttg

SEQ ID NO: 4254492 - DNA, 13 bp, Homo sapiens
ctgtattttaaaa

SEQ ID NO: 4254493 - DNA, 22 bp, Homo sapiens
ctgtattttaaaagaatgatta

SEQ ID NO: 4254494 - DNA, 18 bp, Homo sapiens
ctgtgtgactcaaaccaa

SEQ ID NO: 4254495 - DNA, 19 bp, Homo sapiens
ctgttataatctttcacag

SEQ ID NO: 4254496 - DNA, 14 bp, Homo sapiens
ctgttttataattt

SEQ ID NO: 4254497 - DNA, 16 bp, Homo sapiens
cttagaatacagtttt

SEQ ID NO: 4254498 - DNA, 21 bp, Homo sapiens
cttagggttatgattaagtaa

SEQ ID NO: 4254499 - DNA, 14 bp, Homo sapiens
cttataataaagga

SEQ ID NO: 4254500 - DNA, 17 bp, Homo sapiens
cttatagtacatgataa

SEQ ID NO: 4254501 - DNA, 19 bp, Homo sapiens
cttatagtacatgataaat

SEQ ID NO: 4254502 - DNA, 14 bp, Homo sapiens
cttattatttttga

SEQ ID NO: 4254503 - DNA, 17 bp, Homo sapiens
cttcagtctctatacca

SEQ ID NO: 4254504 - DNA, 23 bp, Homo sapiens
cttcagtctctataccaataaag

SEQ ID NO: 4254505 - DNA, 13 bp, Homo sapiens
cttcatctggaac

SEQ ID NO: 4254506 - DNA, 23 bp, Homo sapiens
cttcatgcatggaaattcccttc

SEQ ID NO: 4254507 - DNA, 18 bp, Homo sapiens
cttccctatctttgccac

SEQ ID NO: 4254508 - DNA, 19 bp, Homo sapiens
cttccctgctgtgaaagaa

SEQ ID NO: 4254509 - DNA, 14 bp, Homo sapiens
cttccctttcctga

SEQ ID NO: 4254510 - DNA, 20 bp, Homo sapiens
cttccctttcctgagtccca

SEQ ID NO: 4254511 - DNA, 15 bp, Homo sapiens
cttctatacccaccc

SEQ ID NO: 4254512 - DNA, 22 bp, Homo sapiens
cttctcagatttctgaggaaat

SEQ ID NO: 4254513 - DNA, 16 bp, Homo sapiens
cttctcttgttaggta

SEQ ID NO: 4254514 - DNA, 18 bp, Homo sapiens
cttctgaataaagcaatt

SEQ ID NO: 4254515 - DNA, 19 bp, Homo sapiens
cttctgacataatccagta

SEQ ID NO: 4254516 - DNA, 19 bp, Homo sapiens
cttcttttttcaaaagaaa

SEQ ID NO: 4254517 - DNA, 16 bp, Homo sapiens
cttgaggacacatgtc

SEQ ID NO: 4254518 - DNA, 12 bp, Homo sapiens
cttgatgaagaa

SEQ ID NO: 4254519 - DNA, 16 bp, Homo sapiens
cttgcaaaaagggtca

SEQ ID NO: 4254520 - DNA, 19 bp, Homo sapiens
tccctcaacctcatcctct

SEQ ID NO: 4254521 - DNA, 18 bp, Homo sapiens
tccctcacccatcctaga

SEQ ID NO: 4254522 - DNA, 16 bp, Homo sapiens
tccctctctcataccc

SEQ ID NO: 4254523 - DNA, 21 bp, Homo sapiens
tccctcttccttccctgctgt

SEQ ID NO: 4254524 - DNA, 20 bp, Homo sapiens
tccctggaaaccttccaccc

SEQ ID NO: 4254525 - DNA, 15 bp, Homo sapiens
tcccttgatgaagaa

SEQ ID NO: 4254526 - DNA, 15 bp, Homo sapiens
tccgctatccaccaa

SEQ ID NO: 4254527 - DNA, 21 bp, Homo sapiens
tccgtgcttaaccaaagaagc

SEQ ID NO: 4254528 - DNA, 22 bp, Homo sapiens
tcctaagctggagtgcagtggc

SEQ ID NO: 4254529 - DNA, 20 bp, Homo sapiens
tcctccagggtggcagcaac

SEQ ID NO: 4254530 - DNA, 21 bp, Homo sapiens
tcctccagggtggcagcaaca

SEQ ID NO: 4254531 - DNA, 20 bp, Homo sapiens
tcctcccacttcagcctccc

SEQ ID NO: 4254532 - DNA, 17 bp, Homo sapiens
tcctctccccatgatgt

SEQ ID NO: 4254533 - DNA, 21 bp, Homo sapiens
tcctgaaaacccttgccatgt

SEQ ID NO: 4254534 - DNA, 22 bp, Homo sapiens
tcctgaaaacccttgccatgtg

SEQ ID NO: 4254535 - DNA, 21 bp, Homo sapiens
tcctgaccccaagttatccac

SEQ ID NO: 4254536 - DNA, 16 bp, Homo sapiens
tccttggccatgcaga

SEQ ID NO: 4254537 - DNA, 17 bp, Homo sapiens
tccttggccatgcagaa

SEQ ID NO: 4254538 - DNA, 10 bp, Homo sapiens
tcggaccagc

SEQ ID NO: 4254539 - DNA, 17 bp, Homo sapiens
tcgtggacacctgccct

SEQ ID NO: 4254540 - DNA, 20 bp, Homo sapiens
tcgtggacacctgccctgcc

SEQ ID NO: 4254541 - DNA, 13 bp, Homo sapiens
tcgttaatttgta

SEQ ID NO: 4254542 - DNA, 17 bp, Homo sapiens
tctacactaagagagaa

SEQ ID NO: 4254543 - DNA, 14 bp, Homo sapiens
tctataccaataaa

SEQ ID NO: 4254544 - DNA, 16 bp, Homo sapiens
tctatacccacccaga

SEQ ID NO: 4254545 - DNA, 18 bp, Homo sapiens
tctatgaaatattatgtt

SEQ ID NO: 4254546 - DNA, 20 bp, Homo sapiens
tctattttttgaaaagcaga

SEQ ID NO: 4254547 - DNA, 15 bp, Homo sapiens
tctcagctcactgca

SEQ ID NO: 4254548 - DNA, 18 bp, Homo sapiens
tctcagctcactgcaacc

SEQ ID NO: 4254549 - DNA, 15 bp, Homo sapiens
tctcagtctgtcacc

SEQ ID NO: 4254550 - DNA, 21 bp, Homo sapiens
tctcagttgcagccctgctgc

SEQ ID NO: 4254551 - DNA, 19 bp, Homo sapiens
tctccagcctcagcctccc

SEQ ID NO: 4254552 - DNA, 16 bp, Homo sapiens
tctccatggccctgcc

SEQ ID NO: 4254553 - DNA, 20 bp, Homo sapiens
tctccatggccctgccatgc

SEQ ID NO: 4254554 - DNA, 14 bp, Homo sapiens
tctctataccaata

SEQ ID NO: 4254555 - DNA, 21 bp, Homo sapiens
tctctgaggggctaccaggaa

SEQ ID NO: 4254556 - DNA, 13 bp, Homo sapiens
tctcttcagtctc

SEQ ID NO: 4254557 - DNA, 19 bp, Homo sapiens
tctgacataatccagtaaa

SEQ ID NO: 4254558 - DNA, 20 bp, Homo sapiens
tctgaggggctaccaggaaa

SEQ ID NO: 4254559 - DNA, 21 bp, Homo sapiens
tctgaggggctaccaggaaag

SEQ ID NO: 4254560 - DNA, 18 bp, Homo sapiens
tctggaagtgactttggc

SEQ ID NO: 4254561 - DNA, 19 bp, Homo sapiens
tctggaagtgactttggct

SEQ ID NO: 4254562 - DNA, 14 bp, Homo sapiens
tctgtaaaactaag

SEQ ID NO: 4254563 - DNA, 12 bp, Homo sapiens
tcttaagaagac

SEQ ID NO: 4254564 - DNA, 14 bp, Homo sapiens
tcttccttccctgc

SEQ ID NO: 4254565 - DNA, 15 bp, Homo sapiens
tcttccttccctgct

SEQ ID NO: 4254566 - DNA, 20 bp, Homo sapiens
tgaaaatattgttttacaat

SEQ ID NO: 4254567 - DNA, 16 bp, Homo sapiens
tgaaagatgatcattt

SEQ ID NO: 4254568 - DNA, 15 bp, Homo sapiens
tgaaaggtacttcaa

SEQ ID NO: 4254569 - DNA, 19 bp, Homo sapiens
tgaaatcccatcaggtcac

SEQ ID NO: 4254570 - DNA, 22 bp, Homo sapiens
tgaaattatgtgacattttaca

SEQ ID NO: 4254571 - DNA, 12 bp, Homo sapiens
tgaaccaccgcg

SEQ ID NO: 4254572 - DNA, 23 bp, Homo sapiens
tgaactagagtttagctggaaaa

SEQ ID NO: 4254573 - DNA, 17 bp, Homo sapiens
tgaacttgaggacacat

SEQ ID NO: 4254574 - DNA, 19 bp, Homo sapiens
tgaacttgaggacacatgt

SEQ ID NO: 4254575 - DNA, 22 bp, Homo sapiens
tgaacttgaggacacatgtcca

SEQ ID NO: 4254576 - DNA, 11 bp, Homo sapiens
tgaactttgct

SEQ ID NO: 4254577 - DNA, 15 bp, Homo sapiens
tgaactttgctgagc

SEQ ID NO: 4254578 - DNA, 20 bp, Homo sapiens
tgaagatttaccacttgtgt

SEQ ID NO: 4254579 - DNA, 15 bp, Homo sapiens
tgaatacatttccaa

SEQ ID NO: 4254580 - DNA, 14 bp, Homo sapiens
tgaattaagttttt

SEQ ID NO: 4254581 - DNA, 12 bp, Homo sapiens
tgacaagctcac

SEQ ID NO: 4254582 - DNA, 20 bp, Homo sapiens
tgacaagctcacagaccttt

SEQ ID NO: 4254583 - DNA, 16 bp, Homo sapiens
tgacattttacattaa

SEQ ID NO: 4254584 - DNA, 19 bp, Homo sapiens
tgacctgcctcccttcatg

SEQ ID NO: 4254585 - DNA, 19 bp, Homo sapiens
tgagacagaatctcagtct

SEQ ID NO: 4254586 - DNA, 10 bp, Homo sapiens
tgagacatcc

SEQ ID NO: 4254587 - DNA, 13 bp, Homo sapiens
tgagacatccagc

SEQ ID NO: 4254588 - DNA, 15 bp, Homo sapiens
tgagaccacctctca

SEQ ID NO: 4254589 - DNA, 15 bp, Homo sapiens
tgagcagtcaggaaa

SEQ ID NO: 4254590 - DNA, 20 bp, Homo sapiens
tgagcagtcaggaaagagaa

SEQ ID NO: 4254591 - DNA, 15 bp, Homo sapiens
tgaggacacatgtcc

SEQ ID NO: 4254592 - DNA, 13 bp, Homo sapiens
tgaggccagacca

SEQ ID NO: 4254593 - DNA, 17 bp, Homo sapiens
tgatagacaattgaggt

SEQ ID NO: 4254594 - DNA, 17 bp, Homo sapiens
tgatcaccgactgaaaa

SEQ ID NO: 4254595 - DNA, 17 bp, Homo sapiens
tgatcagcttattgtct

SEQ ID NO: 4254596 - DNA, 11 bp, Homo sapiens
tgatgaagaag

SEQ ID NO: 4254597 - DNA, 12 bp, Homo sapiens
tgatgaagaagt

SEQ ID NO: 4254598 - DNA, 16 bp, Homo sapiens
tgatggagaaggaagg

SEQ ID NO: 4254599 - DNA, 16 bp, Homo sapiens
tgattaagtaatgata

SEQ ID NO: 4254600 - DNA, 18 bp, Homo sapiens
tgattaagtaatgataac

SEQ ID NO: 4254601 - DNA, 23 bp, Homo sapiens
tgattaagtaatgataactggaa

SEQ ID NO: 4254602 - DNA, 14 bp, Homo sapiens
tgcaaaaagggtca

SEQ ID NO: 4254603 - DNA, 14 bp, Homo sapiens
tgcaacctctgcct

SEQ ID NO: 4254604 - DNA, 15 bp, Homo sapiens
tgcaagccagatttt

SEQ ID NO: 4254605 - DNA, 14 bp, Homo sapiens
tgcagccctgctgc

SEQ ID NO: 4254606 - DNA, 22 bp, Homo sapiens
tgcagccctgctgctgcctgcc

SEQ ID NO: 4254607 - DNA, 20 bp, Homo sapiens
tgcagtctctataccaataa

SEQ ID NO: 4254608 - DNA, 22 bp, Homo sapiens
tgcagtctctataccaataaag

SEQ ID NO: 4254609 - DNA, 22 bp, Homo sapiens
tgcagtggcatcatctcagctc

SEQ ID NO: 4254610 - DNA, 22 bp, Homo sapiens
tgcagtggcgcgatctcagctc

SEQ ID NO: 4254611 - DNA, 14 bp, Homo sapiens
tgcagttctgaaga

SEQ ID NO: 4254612 - DNA, 18 bp, Homo sapiens
tgcagttctgaagaagat

SEQ ID NO: 4254613 - DNA, 23 bp, Homo sapiens
tgcatggaaattcccttcatctg

SEQ ID NO: 4254614 - DNA, 15 bp, Homo sapiens
tgcattatatttatt

SEQ ID NO: 4254615 - DNA, 21 bp, Homo sapiens
tgcattatatttattactgta

SEQ ID NO: 4254616 - DNA, 13 bp, Homo sapiens
tgcatttatatgt

SEQ ID NO: 4254617 - DNA, 10 bp, Homo sapiens
tgccacctgt

SEQ ID NO: 4254618 - DNA, 11 bp, Homo sapiens
tgccacctgtc

SEQ ID NO: 4254619 - DNA, 13 bp, Homo sapiens
tgccacctgtctg

SEQ ID NO: 4254620 - DNA, 16 bp, Homo sapiens
tgccacctgtctgtct

SEQ ID NO: 4254621 - DNA, 15 bp, Homo sapiens
tgccctgccacctgt

SEQ ID NO: 4254622 - DNA, 17 bp, Homo sapiens
tgccctgccacctgtct

SEQ ID NO: 4254623 - DNA, 19 bp, Homo sapiens
tgccctgccacctgtctgt

SEQ ID NO: 4254624 - DNA, 21 bp, Homo sapiens
tgccctgccacctgtctgtct

SEQ ID NO: 4254625 - DNA, 22 bp, Homo sapiens
tgccctgccacctgtctgtctg

SEQ ID NO: 4254626 - DNA, 22 bp, Homo sapiens
tgccttctcaactccaaactga

SEQ ID NO: 4254627 - DNA, 13 bp, Homo sapiens
tgcctttgacctg

SEQ ID NO: 4254628 - DNA, 17 bp, Homo sapiens
tgcctttgacctgcctc

SEQ ID NO: 4254629 - DNA, 19 bp, Homo sapiens
tgccttttcccaactccag

SEQ ID NO: 4254630 - DNA, 20 bp, Homo sapiens
tgcgagtgctcatttcagga

SEQ ID NO: 4254631 - DNA, 22 bp, Homo sapiens
tgcggaggaaggaggacccagg

SEQ ID NO: 4254632 - DNA, 15 bp, Homo sapiens
tgctaagcattccaa

SEQ ID NO: 4254633 - DNA, 19 bp, Homo sapiens
tgctaagcattccaactat

SEQ ID NO: 4254634 - DNA, 14 bp, Homo sapiens
tgctagtaattgga

SEQ ID NO: 4254635 - DNA, 16 bp, Homo sapiens
tgctagtaattggaaa

SEQ ID NO: 4254636 - DNA, 11 bp, Homo sapiens
tgctcatggaa

SEQ ID NO: 4254637 - DNA, 14 bp, Homo sapiens
tgctcatggaattg

SEQ ID NO: 4254638 - DNA, 13 bp, Homo sapiens
tgctctcctccac

SEQ ID NO: 4254639 - DNA, 23 bp, Homo sapiens
tgctgagcctgtaaaataaaagg

SEQ ID NO: 4254640 - DNA, 13 bp, Homo sapiens
tgctgtattttaa

SEQ ID NO: 4254641 - DNA, 21 bp, Homo sapiens
tgctgtattttaaaagaatga

SEQ ID NO: 4254642 - DNA, 17 bp, Homo sapiens
tgcttctgttttataat

SEQ ID NO: 4254643 - DNA, 12 bp, Homo sapiens
tgctttgtattg

SEQ ID NO: 4254644 - DNA, 21 bp, Homo sapiens
agtacacaataagcaaaaaca

SEQ ID NO: 4254645 - DNA, 22 bp, Homo sapiens
agtacacaataagcaaaaacaa

SEQ ID NO: 4254646 - DNA, 23 bp, Homo sapiens
agtaccagtaggggcttataata

SEQ ID NO: 4254647 - DNA, 19 bp, Homo sapiens
agtagcgttttttaaatgt

SEQ ID NO: 4254648 - DNA, 18 bp, Homo sapiens
agtatgttagtgcaaatt

SEQ ID NO: 4254649 - DNA, 21 bp, Homo sapiens
agtattagaataccacaggaa

SEQ ID NO: 4254650 - DNA, 16 bp, Homo sapiens
agtattgtccaggtct

SEQ ID NO: 4254651 - DNA, 19 bp, Homo sapiens
agtcaaattgtgtgaaagg

SEQ ID NO: 4254652 - DNA, 23 bp, Homo sapiens
agtcaaattgtgtgaaaggtact

SEQ ID NO: 4254653 - DNA, 14 bp, Homo sapiens
agtcaggaaagaga

SEQ ID NO: 4254654 - DNA, 16 bp, Homo sapiens
agtccaagcatttaga

SEQ ID NO: 4254655 - DNA, 18 bp, Homo sapiens
agtcccatccctgcgtga

SEQ ID NO: 4254656 - DNA, 19 bp, Homo sapiens
agtcctgggattacaggtg

SEQ ID NO: 4254657 - DNA, 15 bp, Homo sapiens
agtctctataccaat

SEQ ID NO: 4254658 - DNA, 19 bp, Homo sapiens
agtctctataccaataaag

SEQ ID NO: 4254659 - DNA, 20 bp, Homo sapiens
agtctctataccaataaagt

SEQ ID NO: 4254660 - DNA, 21 bp, Homo sapiens
agtctctataccaataaagtg

SEQ ID NO: 4254661 - DNA, 22 bp, Homo sapiens
agtctctataccaataaagtga

SEQ ID NO: 4254662 - DNA, 16 bp, Homo sapiens
agtctctgaggggcta

SEQ ID NO: 4254663 - DNA, 23 bp, Homo sapiens
agtctctgaggggctaccaggaa

SEQ ID NO: 4254664 - DNA, 22 bp, Homo sapiens
agtgcaaattgtcacaggacag

SEQ ID NO: 4254665 - DNA, 15 bp, Homo sapiens
agtgctgaatttccc

SEQ ID NO: 4254666 - DNA, 20 bp, Homo sapiens
agtggcgcgatctcagctca

SEQ ID NO: 4254667 - DNA, 15 bp, Homo sapiens
agttctgaagaagat

SEQ ID NO: 4254668 - DNA, 17 bp, Homo sapiens
agttgacttatagtaca

SEQ ID NO: 4254669 - DNA, 15 bp, Homo sapiens
agtttagctggaaaa

SEQ ID NO: 4254670 - DNA, 21 bp, Homo sapiens
agttttttgaaattatgtgac

SEQ ID NO: 4254671 - DNA, 11 bp, Homo sapiens
ataaaaaggac

SEQ ID NO: 4254672 - DNA, 14 bp, Homo sapiens
ataaaaaggacatc

SEQ ID NO: 4254673 - DNA, 19 bp, Homo sapiens
ataaaaaggacatcagcaa

SEQ ID NO: 4254674 - DNA, 12 bp, Homo sapiens
ataaaataattt

SEQ ID NO: 4254675 - DNA, 22 bp, Homo sapiens
ataaaataattttatctctttc

SEQ ID NO: 4254676 - DNA, 16 bp, Homo sapiens
ataaaataatttttat

SEQ ID NO: 4254677 - DNA, 18 bp, Homo sapiens
ataaaatccatacatttg

SEQ ID NO: 4254678 - DNA, 11 bp, Homo sapiens
ataaagcaatt

SEQ ID NO: 4254679 - DNA, 18 bp, Homo sapiens
ataaagtgaccctgctct

SEQ ID NO: 4254680 - DNA, 11 bp, Homo sapiens
ataaatgtatc

SEQ ID NO: 4254681 - DNA, 11 bp, Homo sapiens
ataataaagga

SEQ ID NO: 4254682 - DNA, 21 bp, Homo sapiens
ataatctttcacaggggacag

SEQ ID NO: 4254683 - DNA, 15 bp, Homo sapiens
ataattttgtgaagc

SEQ ID NO: 4254684 - DNA, 21 bp, Homo sapiens
ataatttttatatttgaaata

SEQ ID NO: 4254685 - DNA, 20 bp, Homo sapiens
atacatcccttacctgggaa

SEQ ID NO: 4254686 - DNA, 20 bp, Homo sapiens
atacattgtatatatgtgta

SEQ ID NO: 4254687 - DNA, 12 bp, Homo sapiens
ataccaataaag

SEQ ID NO: 4254688 - DNA, 21 bp, Homo sapiens
ataccaataaagtgaccctgc

SEQ ID NO: 4254689 - DNA, 22 bp, Homo sapiens
ataccacaggaaccacaagact

SEQ ID NO: 4254690 - DNA, 14 bp, Homo sapiens
ataccctccctccc

SEQ ID NO: 4254691 - DNA, 22 bp, Homo sapiens
ataccctccctccctaccctaa

SEQ ID NO: 4254692 - DNA, 14 bp, Homo sapiens
atagagacgggact

SEQ ID NO: 4254693 - DNA, 18 bp, Homo sapiens
atagctaagtacacaata

SEQ ID NO: 4254694 - DNA, 21 bp, Homo sapiens
atagtctctttaaaaggaaag

SEQ ID NO: 4254695 - DNA, 12 bp, Homo sapiens
atataacaatgc

SEQ ID NO: 4254696 - DNA, 19 bp, Homo sapiens
atatataacaatgctgtat

SEQ ID NO: 4254697 - DNA, 20 bp, Homo sapiens
atatgcttctgttttataat

SEQ ID NO: 4254698 - DNA, 22 bp, Homo sapiens
atatgcttctgttttataattt

SEQ ID NO: 4254699 - DNA, 22 bp, Homo sapiens
atatgtgtatgcacagtaaaaa

SEQ ID NO: 4254700 - DNA, 15 bp, Homo sapiens
atattacaatgatca

SEQ ID NO: 4254701 - DNA, 13 bp, Homo sapiens
atattatgttaaa

SEQ ID NO: 4254702 - DNA, 14 bp, Homo sapiens
atattatgttaaaa

SEQ ID NO: 4254703 - DNA, 16 bp, Homo sapiens
atattatgttaaaact

SEQ ID NO: 4254704 - DNA, 13 bp, Homo sapiens
atattcaataaag

SEQ ID NO: 4254705 - DNA, 14 bp, Homo sapiens
atattgtttgctaa

SEQ ID NO: 4254706 - DNA, 19 bp, Homo sapiens
atattgttttacaatagtt

SEQ ID NO: 4254707 - DNA, 14 bp, Homo sapiens
atatttattactgt

SEQ ID NO: 4254708 - DNA, 14 bp, Homo sapiens
atatttgaaatatt

SEQ ID NO: 4254709 - DNA, 19 bp, Homo sapiens
atatttgaaatattgactt

SEQ ID NO: 4254710 - DNA, 21 bp, Homo sapiens
atcaatctgtaaaactaagaa

SEQ ID NO: 4254711 - DNA, 15 bp, Homo sapiens
atcaggtcaccgcga

SEQ ID NO: 4254712 - DNA, 18 bp, Homo sapiens
atcagttaactattgcat

SEQ ID NO: 4254713 - DNA, 23 bp, Homo sapiens
atccagcctaacttacattctta

SEQ ID NO: 4254714 - DNA, 21 bp, Homo sapiens
atccagcctggggctgaggct

SEQ ID NO: 4254715 - DNA, 14 bp, Homo sapiens
atccaggccggctt

SEQ ID NO: 4254716 - DNA, 11 bp, Homo sapiens
atcccatcagg

SEQ ID NO: 4254717 - DNA, 12 bp, Homo sapiens
atccctcaccca

SEQ ID NO: 4254718 - DNA, 14 bp, Homo sapiens
atctcaattcttcc

SEQ ID NO: 4254719 - DNA, 13 bp, Homo sapiens
atctcttcagtct

SEQ ID NO: 4254720 - DNA, 20 bp, Homo sapiens
atgaaatattatgttaaaac

SEQ ID NO: 4254721 - DNA, 17 bp, Homo sapiens
atgaacttgaggacaca

SEQ ID NO: 4254722 - DNA, 18 bp, Homo sapiens
atgaacttgaggacacat

SEQ ID NO: 4254723 - DNA, 15 bp, Homo sapiens
atgaattaagttttt

SEQ ID NO: 4254724 - DNA, 15 bp, Homo sapiens
atgaattacatttgt

SEQ ID NO: 4254725 - DNA, 16 bp, Homo sapiens
atgaattacatttgta

SEQ ID NO: 4254726 - DNA, 19 bp, Homo sapiens
atgaattacatttgtataa

SEQ ID NO: 4254727 - DNA, 23 bp, Homo sapiens
atgaattagttttatatgcttct

SEQ ID NO: 4254728 - DNA, 16 bp, Homo sapiens
atgactatgtaaacta

SEQ ID NO: 4254729 - DNA, 14 bp, Homo sapiens
atgagagacacact

SEQ ID NO: 4254730 - DNA, 17 bp, Homo sapiens
atgagagacacactgaa

SEQ ID NO: 4254731 - DNA, 14 bp, Homo sapiens
atgaggccagacca

SEQ ID NO: 4254732 - DNA, 18 bp, Homo sapiens
atgatcaccgactgaaaa

SEQ ID NO: 4254733 - DNA, 22 bp, Homo sapiens
atgattatgaattacatttgta

SEQ ID NO: 4254734 - DNA, 12 bp, Homo sapiens
atgattcccagc

SEQ ID NO: 4254735 - DNA, 17 bp, Homo sapiens
atgcacagtaaaaatgg

SEQ ID NO: 4254736 - DNA, 17 bp, Homo sapiens
atgcagttctgaagaag

SEQ ID NO: 4254737 - DNA, 18 bp, Homo sapiens
atgcagttctgaagaaga

SEQ ID NO: 4254738 - DNA, 19 bp, Homo sapiens
atgcagttctgaagaagat

SEQ ID NO: 4254739 - DNA, 12 bp, Homo sapiens
atgcatggaaat

SEQ ID NO: 4254740 - DNA, 16 bp, Homo sapiens
atgcatggaaattccc

SEQ ID NO: 4254741 - DNA, 14 bp, Homo sapiens
atgccttttcccaa

SEQ ID NO: 4254742 - DNA, 20 bp, Homo sapiens
atgccttttcccaactccag

SEQ ID NO: 4254743 - DNA, 19 bp, Homo sapiens
atgcgagtgctcatttcag

SEQ ID NO: 4254744 - DNA, 20 bp, Homo sapiens
atggaaattcccttcatctg

SEQ ID NO: 4254745 - DNA, 23 bp, Homo sapiens
atggaattggagctcgtgggaca

SEQ ID NO: 4254746 - DNA, 22 bp, Homo sapiens
atggacactacacccagcaata

SEQ ID NO: 4254747 - DNA, 15 bp, Homo sapiens
atggaggggcagagc

SEQ ID NO: 4254748 - DNA, 16 bp, Homo sapiens
atggcactagtatttc

SEQ ID NO: 4254749 - DNA, 21 bp, Homo sapiens
atgggacatttgctcatggaa

SEQ ID NO: 4254750 - DNA, 22 bp, Homo sapiens
atgggacatttgctcatggaat

SEQ ID NO: 4254751 - DNA, 14 bp, Homo sapiens
atgggggtttcacc

SEQ ID NO: 4254752 - DNA, 22 bp, Homo sapiens
atgggttagggaaaacattcca

SEQ ID NO: 4254753 - DNA, 20 bp, Homo sapiens
atggtcacgtttggtgcttc

SEQ ID NO: 4254754 - DNA, 24 bp, Homo sapiens
atggtcacgtttggtgcttctcag

SEQ ID NO: 4254755 - DNA, 16 bp, Homo sapiens
atgtacttcatgctgt

SEQ ID NO: 4254756 - DNA, 14 bp, Homo sapiens
atgtatctgaatat

SEQ ID NO: 4254757 - DNA, 16 bp, Homo sapiens
atgtgacattttacat

SEQ ID NO: 4254758 - DNA, 15 bp, Homo sapiens
atgtgtatgcacagt

SEQ ID NO: 4254759 - DNA, 24 bp, Homo sapiens
atgttatgactatgtaaactactt

SEQ ID NO: 4254760 - DNA, 16 bp, Homo sapiens
atgttcagattattgg

SEQ ID NO: 4254761 - DNA, 20 bp, Homo sapiens
atgttcttttaaatgattga

SEQ ID NO: 4254762 - DNA, 21 bp, Homo sapiens
atgtttcaaacatatataaca

SEQ ID NO: 4254763 - DNA, 15 bp, Homo sapiens
atgttttcaggctag

SEQ ID NO: 4254764 - DNA, 17 bp, Homo sapiens
attaaaccggaccatct

SEQ ID NO: 4254765 - DNA, 20 bp, Homo sapiens
attaaattttttttacattt

SEQ ID NO: 4254766 - DNA, 21 bp, Homo sapiens
attaagtaatgataactggaa

SEQ ID NO: 4254767 - DNA, 13 bp, Homo sapiens
cttgccacacccc

SEQ ID NO: 4254768 - DNA, 15 bp, Homo sapiens
cttggccatgcagaa

SEQ ID NO: 4254769 - DNA, 16 bp, Homo sapiens
cttggggctgatgcag

SEQ ID NO: 4254770 - DNA, 20 bp, Homo sapiens
ctttaaggggaggaaccaga

SEQ ID NO: 4254771 - DNA, 13 bp, Homo sapiens
ctttccacagaag

SEQ ID NO: 4254772 - DNA, 18 bp, Homo sapiens
ctttcctgagtcccatcc

SEQ ID NO: 4254773 - DNA, 20 bp, Homo sapiens
ctttcctgagtcccatccct

SEQ ID NO: 4254774 - DNA, 22 bp, Homo sapiens
ctttcctgagtcccatccctgc

SEQ ID NO: 4254775 - DNA, 15 bp, Homo sapiens
ctttgacctgcctcc

SEQ ID NO: 4254776 - DNA, 21 bp, Homo sapiens
ctttgccaccctcatgctgtg

SEQ ID NO: 4254777 - DNA, 13 bp, Homo sapiens
gaaaaaaaattat

SEQ ID NO: 4254778 - DNA, 13 bp, Homo sapiens
gaaaacattccat

SEQ ID NO: 4254779 - DNA, 15 bp, Homo sapiens
gaaaagcagacattt

SEQ ID NO: 4254780 - DNA, 14 bp, Homo sapiens
gaaaagtatgttag

SEQ ID NO: 4254781 - DNA, 22 bp, Homo sapiens
gaaaatattgttttacaatagt

SEQ ID NO: 4254782 - DNA, 18 bp, Homo sapiens
gaaacaccctcacactgg

SEQ ID NO: 4254783 - DNA, 22 bp, Homo sapiens
gaaacaccctcacactgggact

SEQ ID NO: 4254784 - DNA, 21 bp, Homo sapiens
gaaaccctgcacccattagca

SEQ ID NO: 4254785 - DNA, 16 bp, Homo sapiens
gaaagaacggaagaag

SEQ ID NO: 4254786 - DNA, 15 bp, Homo sapiens
gaaatatttatttta

SEQ ID NO: 4254787 - DNA, 17 bp, Homo sapiens
gaaatatttattttaat

SEQ ID NO: 4254788 - DNA, 17 bp, Homo sapiens
gaaatcccatcaggtca

SEQ ID NO: 4254789 - DNA, 23 bp, Homo sapiens
gaaattatgtgacattttacatt

SEQ ID NO: 4254790 - DNA, 17 bp, Homo sapiens
gaaattcccttcatctg

SEQ ID NO: 4254791 - DNA, 22 bp, Homo sapiens
gaaattcccttcatctggaacc

SEQ ID NO: 4254792 - DNA, 14 bp, Homo sapiens
gaacataaaaagga

SEQ ID NO: 4254793 - DNA, 22 bp, Homo sapiens
gaacataaaaaggacatcagca

SEQ ID NO: 4254794 - DNA, 15 bp, Homo sapiens
gaaccacaagactgc

SEQ ID NO: 4254795 - DNA, 20 bp, Homo sapiens
gaaccctaaataataaaaat

SEQ ID NO: 4254796 - DNA, 19 bp, Homo sapiens
gaacttgaggacacatgtc

SEQ ID NO: 4254797 - DNA, 21 bp, Homo sapiens
gaacttgaggacacatgtcca

SEQ ID NO: 4254798 - DNA, 19 bp, Homo sapiens
gaactttgctgagcctgta

SEQ ID NO: 4254799 - DNA, 19 bp, Homo sapiens
gaagaaagaacggaagaag

SEQ ID NO: 4254800 - DNA, 20 bp, Homo sapiens
gaagaaagaacggaagaaga

SEQ ID NO: 4254801 - DNA, 12 bp, Homo sapiens
gaagaactgaaa

SEQ ID NO: 4254802 - DNA, 17 bp, Homo sapiens
gaagactgcattatatt

SEQ ID NO: 4254803 - DNA, 12 bp, Homo sapiens
gaagagaaggag

SEQ ID NO: 4254804 - DNA, 16 bp, Homo sapiens
gaagagatcaggaaga

SEQ ID NO: 4254805 - DNA, 15 bp, Homo sapiens
gaagatcccccagaa

SEQ ID NO: 4254806 - DNA, 14 bp, Homo sapiens
gaagcaaaattttt

SEQ ID NO: 4254807 - DNA, 19 bp, Homo sapiens
gaagcctccttagaaaaaa

SEQ ID NO: 4254808 - DNA, 19 bp, Homo sapiens
gaaggaggacccaggacag

SEQ ID NO: 4254809 - DNA, 17 bp, Homo sapiens
gaaggcagggaggaggc

SEQ ID NO: 4254810 - DNA, 13 bp, Homo sapiens
gaagtgactttgg

SEQ ID NO: 4254811 - DNA, 11 bp, Homo sapiens
gaataaagcaa

SEQ ID NO: 4254812 - DNA, 20 bp, Homo sapiens
gaatgagagacacactgaag

SEQ ID NO: 4254813 - DNA, 23 bp, Homo sapiens
gaatgagagacacactgaagaag

SEQ ID NO: 4254814 - DNA, 22 bp, Homo sapiens
gaatgattatgaattacatttg

SEQ ID NO: 4254815 - DNA, 22 bp, Homo sapiens
gaatggaggggcagagccagga

SEQ ID NO: 4254816 - DNA, 13 bp, Homo sapiens
gacacactgaaga

SEQ ID NO: 4254817 - DNA, 9 bp, Homo sapiens
gacacctgc

SEQ ID NO: 4254818 - DNA, 12 bp, Homo sapiens
gacacctgccct

SEQ ID NO: 4254819 - DNA, 20 bp, Homo sapiens
gacacgcacggcagccacag

SEQ ID NO: 4254820 - DNA, 22 bp, Homo sapiens
gacacgcacggcagccacagct

SEQ ID NO: 4254821 - DNA, 17 bp, Homo sapiens
gacactacacccagcaa

SEQ ID NO: 4254822 - DNA, 15 bp, Homo sapiens
gacaggatccaggcc

SEQ ID NO: 4254823 - DNA, 23 bp, Homo sapiens
gacaggatggttcccttgatgaa

SEQ ID NO: 4254824 - DNA, 17 bp, Homo sapiens
gacatgggacatttgct

SEQ ID NO: 4254825 - DNA, 16 bp, Homo sapiens
gaccatggacactaca

SEQ ID NO: 4254826 - DNA, 21 bp, Homo sapiens
gaccatggacactacacccag

SEQ ID NO: 4254827 - DNA, 12 bp, Homo sapiens
gacccaggacag

SEQ ID NO: 4254828 - DNA, 19 bp, Homo sapiens
gaccctccaccgcagaagg

SEQ ID NO: 4254829 - DNA, 22 bp, Homo sapiens
gaccctccaccgcagaaggaag

SEQ ID NO: 4254830 - DNA, 16 bp, Homo sapiens
gacgggtttcaccatg

SEQ ID NO: 4254831 - DNA, 14 bp, Homo sapiens
gactcttaagaaga

SEQ ID NO: 4254832 - DNA, 16 bp, Homo sapiens
gactcttaagaagact

SEQ ID NO: 4254833 - DNA, 21 bp, Homo sapiens
gactcttaagaagactgcatt

SEQ ID NO: 4254834 - DNA, 14 bp, Homo sapiens
gactgcattatatt

SEQ ID NO: 4254835 - DNA, 16 bp, Homo sapiens
gactgcattatattta

SEQ ID NO: 4254836 - DNA, 23 bp, Homo sapiens
gactgcggaggaaggaggaccca

SEQ ID NO: 4254837 - DNA, 23 bp, Homo sapiens
gagaacttccagatcctggaaat

SEQ ID NO: 4254838 - DNA, 21 bp, Homo sapiens
gagaagaaagaacggaagaag

SEQ ID NO: 4254839 - DNA, 13 bp, Homo sapiens
gagaagaactgaa

SEQ ID NO: 4254840 - DNA, 14 bp, Homo sapiens
gagaagaactgaaa

SEQ ID NO: 4254841 - DNA, 20 bp, Homo sapiens
gagaatgagagacacactga

SEQ ID NO: 4254842 - DNA, 17 bp, Homo sapiens
gagagaggttgaaaaac

SEQ ID NO: 4254843 - DNA, 13 bp, Homo sapiens
gagcactgctcca

SEQ ID NO: 4254844 - DNA, 20 bp, Homo sapiens
gagcagagctgatggagaag

SEQ ID NO: 4254845 - DNA, 23 bp, Homo sapiens
gagcagagctgatggagaaggaa

SEQ ID NO: 4254846 - DNA, 23 bp, Homo sapiens
gagcccttctatacccacccaga

SEQ ID NO: 4254847 - DNA, 18 bp, Homo sapiens
gagctgatggagaaggaa

SEQ ID NO: 4254848 - DNA, 16 bp, Homo sapiens
gaggaaggaggaccca

SEQ ID NO: 4254849 - DNA, 18 bp, Homo sapiens
gaggaaggaggacccagg

SEQ ID NO: 4254850 - DNA, 14 bp, Homo sapiens
gaggacccaggaca

SEQ ID NO: 4254851 - DNA, 15 bp, Homo sapiens
gaggacccaggacag

SEQ ID NO: 4254852 - DNA, 22 bp, Homo sapiens
gaggctgggaatggaggggcag

SEQ ID NO: 4254853 - DNA, 12 bp, Homo sapiens
gaggtaagtttt

SEQ ID NO: 4254854 - DNA, 22 bp, Homo sapiens
gataaatggcttcctggcaata

SEQ ID NO: 4254855 - DNA, 23 bp, Homo sapiens
gatcaccgactgaaaatattgtt

SEQ ID NO: 4254856 - DNA, 23 bp, Homo sapiens
gatcagcttattgtctagtgaaa

SEQ ID NO: 4254857 - DNA, 14 bp, Homo sapiens
gatcagttaactat

SEQ ID NO: 4254858 - DNA, 18 bp, Homo sapiens
gatccactcgcctcagcc

SEQ ID NO: 4254859 - DNA, 19 bp, Homo sapiens
gatctcagctcactgcaac

SEQ ID NO: 4254860 - DNA, 13 bp, Homo sapiens
gatgaggccagac

SEQ ID NO: 4254861 - DNA, 14 bp, Homo sapiens
gatggagaaggaag

SEQ ID NO: 4254862 - DNA, 15 bp, Homo sapiens
gatttaccacttgtg

SEQ ID NO: 4254863 - DNA, 16 bp, Homo sapiens
gatttaccacttgtgt

SEQ ID NO: 4254864 - DNA, 15 bp, Homo sapiens
gattttcctgaaaac

SEQ ID NO: 4254865 - DNA, 21 bp, Homo sapiens
gatttttttcccaattgagaa

SEQ ID NO: 4254866 - DNA, 13 bp, Homo sapiens
gcaatttaaatgt

SEQ ID NO: 4254867 - DNA, 18 bp, Homo sapiens
gcaatttaaatgttatga

SEQ ID NO: 4254868 - DNA, 20 bp, Homo sapiens
gcacagcctcttagatgcag

SEQ ID NO: 4254869 - DNA, 16 bp, Homo sapiens
gcactggcgaggagag

SEQ ID NO: 4254870 - DNA, 18 bp, Homo sapiens
gcagagctgatggagaag

SEQ ID NO: 4254871 - DNA, 23 bp, Homo sapiens
gcagagctgatggagaaggaagg

SEQ ID NO: 4254872 - DNA, 22 bp, Homo sapiens
gcagtggcatcatctcagctca

SEQ ID NO: 4254873 - DNA, 13 bp, Homo sapiens
gcagttctgaaga

SEQ ID NO: 4254874 - DNA, 17 bp, Homo sapiens
gcagttctgaagaagat

SEQ ID NO: 4254875 - DNA, 21 bp, Homo sapiens
gcatccctcacccatcctaga

SEQ ID NO: 4254876 - DNA, 15 bp, Homo sapiens
gcatgccttcaaatc

SEQ ID NO: 4254877 - DNA, 23 bp, Homo sapiens
gcatggaaattcccttcatctgg

SEQ ID NO: 4254878 - DNA, 10 bp, Homo sapiens
gccacctgtc

SEQ ID NO: 4254879 - DNA, 19 bp, Homo sapiens
gccagattttcctgaaaac

SEQ ID NO: 4254880 - DNA, 15 bp, Homo sapiens
gccatgcagaaagca

SEQ ID NO: 4254881 - DNA, 19 bp, Homo sapiens
gccatgggcactgtgggta

SEQ ID NO: 4254882 - DNA, 20 bp, Homo sapiens
gccattctcctgcctcagcc

SEQ ID NO: 4254883 - DNA, 16 bp, Homo sapiens
gcccattcattccatt

SEQ ID NO: 4254884 - DNA, 21 bp, Homo sapiens
gccccaccctcgtggacacct

SEQ ID NO: 4254885 - DNA, 22 bp, Homo sapiens
gccccaccctcgtggacacctg

SEQ ID NO: 4254886 - DNA, 23 bp, Homo sapiens
gcccctgccacctcctgcctcag

SEQ ID NO: 4254887 - DNA, 15 bp, Homo sapiens
gccctgccacctgtc

SEQ ID NO: 4254888 - DNA, 21 bp, Homo sapiens
gcccttctatacccacccaga

SEQ ID NO: 4254889 - DNA, 15 bp, Homo sapiens
gccggatctgaggga

SEQ ID NO: 4254890 - DNA, 16 bp, Homo sapiens
tggaaaccttccaccc

SEQ ID NO: 4254891 - DNA, 22 bp, Homo sapiens
tggaaattcccttcatctggaa

SEQ ID NO: 4254892 - DNA, 15 bp, Homo sapiens
tggaagtgactttgg

SEQ ID NO: 4254893 - DNA, 23 bp, Homo sapiens
tggacacctgccctgccctgcca

SEQ ID NO: 4254894 - DNA, 20 bp, Homo sapiens
tggacactacacccagcaat

SEQ ID NO: 4254895 - DNA, 11 bp, Homo sapiens
tggagaaggaa

SEQ ID NO: 4254896 - DNA, 14 bp, Homo sapiens
tggagatgaggcca

SEQ ID NO: 4254897 - DNA, 18 bp, Homo sapiens
tggagatgaggccagacc

SEQ ID NO: 4254898 - DNA, 24 bp, Homo sapiens
tggagatgaggccagaccatggac

SEQ ID NO: 4254899 - DNA, 11 bp, Homo sapiens
tggagggaagc

SEQ ID NO: 4254900 - DNA, 18 bp, Homo sapiens
tggaggggcagagccagg

SEQ ID NO: 4254901 - DNA, 12 bp, Homo sapiens
tggattccagag

SEQ ID NO: 4254902 - DNA, 15 bp, Homo sapiens
tggcaggtgcagccc

SEQ ID NO: 4254903 - DNA, 18 bp, Homo sapiens
tggcatcatctcagctca

SEQ ID NO: 4254904 - DNA, 20 bp, Homo sapiens
tggccaggcttgtctcgaac

SEQ ID NO: 4254905 - DNA, 12 bp, Homo sapiens
tggctgcatgcg

SEQ ID NO: 4254906 - DNA, 21 bp, Homo sapiens
tgggacagtcacctcatggaa

SEQ ID NO: 4254907 - DNA, 19 bp, Homo sapiens
tgggcagcaatttaaatgt

SEQ ID NO: 4254908 - DNA, 20 bp, Homo sapiens
tggtaaggggaattgaggac

SEQ ID NO: 4254909 - DNA, 23 bp, Homo sapiens
tggtatgaacttgaggacacatg

SEQ ID NO: 4254910 - DNA, 20 bp, Homo sapiens
tggtcacgtttggtgcttct

SEQ ID NO: 4254911 - DNA, 17 bp, Homo sapiens
tgtaagaaaatatcact

SEQ ID NO: 4254912 - DNA, 20 bp, Homo sapiens
tgtaatcttatttaggaagt

SEQ ID NO: 4254913 - DNA, 16 bp, Homo sapiens
tgtagtagcgtttttt

SEQ ID NO: 4254914 - DNA, 22 bp, Homo sapiens
tgtagtagcgttttttaaatgt

SEQ ID NO: 4254915 - DNA, 13 bp, Homo sapiens
tgtataaaataat

SEQ ID NO: 4254916 - DNA, 14 bp, Homo sapiens
tgtatactatagta

SEQ ID NO: 4254917 - DNA, 17 bp, Homo sapiens
tgtatactatagtacca

SEQ ID NO: 4254918 - DNA, 19 bp, Homo sapiens
tgtatactatagtaccagt

SEQ ID NO: 4254919 - DNA, 16 bp, Homo sapiens
tgtattgtatattaca

SEQ ID NO: 4254920 - DNA, 21 bp, Homo sapiens
tgtcaataaaatccatacatt

SEQ ID NO: 4254921 - DNA, 14 bp, Homo sapiens
tgtctgtctgtccc

SEQ ID NO: 4254922 - DNA, 16 bp, Homo sapiens
tgtggaacataaaaag

SEQ ID NO: 4254923 - DNA, 19 bp, Homo sapiens
tgtggaacataaaaaggac

SEQ ID NO: 4254924 - DNA, 21 bp, Homo sapiens
tgtggaacataaaaaggacat

SEQ ID NO: 4254925 - DNA, 13 bp, Homo sapiens
tgtgtaagtagat

SEQ ID NO: 4254926 - DNA, 14 bp, Homo sapiens
tgttagtgcaaatt

SEQ ID NO: 4254927 - DNA, 12 bp, Homo sapiens
tgttataatctt

SEQ ID NO: 4254928 - DNA, 18 bp, Homo sapiens
tgttatgactatgtaaac

SEQ ID NO: 4254929 - DNA, 20 bp, Homo sapiens
tgttatgactatgtaaacta

SEQ ID NO: 4254930 - DNA, 14 bp, Homo sapiens
tgttattaaacaaa

SEQ ID NO: 4254931 - DNA, 19 bp, Homo sapiens
tgttgaataaatgtatctg

SEQ ID NO: 4254932 - DNA, 19 bp, Homo sapiens
tgttggagaagaactgaaa

SEQ ID NO: 4254933 - DNA, 15 bp, Homo sapiens
tgtttgctaagcatt

SEQ ID NO: 4254934 - DNA, 19 bp, Homo sapiens
tgtttgctaagcattccaa

SEQ ID NO: 4254935 - DNA, 22 bp, Homo sapiens
tgttttacaatagttctgtggg

SEQ ID NO: 4254936 - DNA, 14 bp, Homo sapiens
tgttttgcaagcca

SEQ ID NO: 4254937 - DNA, 14 bp, Homo sapiens
ttaaatgtatacta

SEQ ID NO: 4254938 - DNA, 17 bp, Homo sapiens
ttaaattttttttacat

SEQ ID NO: 4254939 - DNA, 16 bp, Homo sapiens
ttaataatgtttcaaa

SEQ ID NO: 4254940 - DNA, 16 bp, Homo sapiens
ttacaacggagtcaaa

SEQ ID NO: 4254941 - DNA, 23 bp, Homo sapiens
ttacaacggagtcaaaaattaaa

SEQ ID NO: 4254942 - DNA, 15 bp, Homo sapiens
ttacatttgtataaa

SEQ ID NO: 4254943 - DNA, 15 bp, Homo sapiens
ttacgtgctctgtgg

SEQ ID NO: 4254944 - DNA, 19 bp, Homo sapiens
ttagaaacacaactatatt

SEQ ID NO: 4254945 - DNA, 20 bp, Homo sapiens
ttagatgcagttctgaagaa

SEQ ID NO: 4254946 - DNA, 21 bp, Homo sapiens
ttagatgcagttctgaagaag

SEQ ID NO: 4254947 - DNA, 23 bp, Homo sapiens
ttagatgcagttctgaagaagat

SEQ ID NO: 4254948 - DNA, 12 bp, Homo sapiens
ttagctggaaaa

SEQ ID NO: 4254949 - DNA, 13 bp, Homo sapiens
ttagctggaaaag

SEQ ID NO: 4254950 - DNA, 22 bp, Homo sapiens
ttaggaagttgacttatagtac

SEQ ID NO: 4254951 - DNA, 18 bp, Homo sapiens
ttatataagcttgtattc

SEQ ID NO: 4254952 - DNA, 14 bp, Homo sapiens
ttatatgtaccgta

SEQ ID NO: 4254953 - DNA, 14 bp, Homo sapiens
ttatgaattacatt

SEQ ID NO: 4254954 - DNA, 17 bp, Homo sapiens
ttatgaattacatttgt

SEQ ID NO: 4254955 - DNA, 21 bp, Homo sapiens
ttatgaattacatttgtataa

SEQ ID NO: 4254956 - DNA, 20 bp, Homo sapiens
ttatgtgacattttacatta

SEQ ID NO: 4254957 - DNA, 23 bp, Homo sapiens
ttcaaatcaatctgtaaaactaa

SEQ ID NO: 4254958 - DNA, 18 bp, Homo sapiens
ttcaagcgattctcctgc

SEQ ID NO: 4254959 - DNA, 13 bp, Homo sapiens
ttcaataaagctg

SEQ ID NO: 4254960 - DNA, 24 bp, Homo sapiens
ttcagtctctataccaataaagtg

SEQ ID NO: 4254961 - DNA, 12 bp, Homo sapiens
ttcatctggaac

SEQ ID NO: 4254962 - DNA, 13 bp, Homo sapiens
ttcatgcatggaa

SEQ ID NO: 4254963 - DNA, 11 bp, Homo sapiens
ttcccaaaagc

SEQ ID NO: 4254964 - DNA, 21 bp, Homo sapiens
ttcccaaaagcccattcattc

SEQ ID NO: 4254965 - DNA, 23 bp, Homo sapiens
ttcccaaaggcattataaaaaga

SEQ ID NO: 4254966 - DNA, 16 bp, Homo sapiens
ttccctatctttgcca

SEQ ID NO: 4254967 - DNA, 21 bp, Homo sapiens
ttccctctctcataccctccc

SEQ ID NO: 4254968 - DNA, 22 bp, Homo sapiens
ttccctgctgtgaaagaagtaa

SEQ ID NO: 4254969 - DNA, 17 bp, Homo sapiens
ttcccttgatgaagaag

SEQ ID NO: 4254970 - DNA, 18 bp, Homo sapiens
ttcccttgatgaagaagt

SEQ ID NO: 4254971 - DNA, 13 bp, Homo sapiens
ttccctttcctga

SEQ ID NO: 4254972 - DNA, 21 bp, Homo sapiens
ttccttccctgctgtgaaaga

SEQ ID NO: 4254973 - DNA, 13 bp, Homo sapiens
ttctactgctctc

SEQ ID NO: 4254974 - DNA, 20 bp, Homo sapiens
ttctactgctctcctccacc

SEQ ID NO: 4254975 - DNA, 20 bp, Homo sapiens
ttctcagatttctgaggaaa

SEQ ID NO: 4254976 - DNA, 19 bp, Homo sapiens
ttctccagcctcagcctcc

SEQ ID NO: 4254977 - DNA, 13 bp, Homo sapiens
ttctgaagaagat

SEQ ID NO: 4254978 - DNA, 17 bp, Homo sapiens
ttctgttttataatttt

SEQ ID NO: 4254979 - DNA, 18 bp, Homo sapiens
ttcttatgccatataatt

SEQ ID NO: 4254980 - DNA, 12 bp, Homo sapiens
ttgaaccaataa

SEQ ID NO: 4254981 - DNA, 12 bp, Homo sapiens
ttgaataaatgt

SEQ ID NO: 4254982 - DNA, 21 bp, Homo sapiens
ttgaataaatgtatctgaata

SEQ ID NO: 4254983 - DNA, 11 bp, Homo sapiens
ttgaggacaca

SEQ ID NO: 4254984 - DNA, 15 bp, Homo sapiens
ttgaggacactgata

SEQ ID NO: 4254985 - DNA, 18 bp, Homo sapiens
ttgatggtggtatgtttt

SEQ ID NO: 4254986 - DNA, 21 bp, Homo sapiens
ttgattggtgattaggtggtg

SEQ ID NO: 4254987 - DNA, 22 bp, Homo sapiens
ttgcagccctgctgctgcctgc

SEQ ID NO: 4254988 - DNA, 20 bp, Homo sapiens
ttgcatttatatgtaccgta

SEQ ID NO: 4254989 - DNA, 23 bp, Homo sapiens
ttgccaggctggagtgcagtggc

SEQ ID NO: 4254990 - DNA, 12 bp, Homo sapiens
ttgctcatggaa

SEQ ID NO: 4254991 - DNA, 17 bp, Homo sapiens
ttggagaagaactgaaa

SEQ ID NO: 4254992 - DNA, 13 bp, Homo sapiens
ttggccatgcaga

SEQ ID NO: 4254993 - DNA, 19 bp, Homo sapiens
ttgggcagcaatttaaatg

SEQ ID NO: 4254994 - DNA, 21 bp, Homo sapiens
ttgtagtagcgttttttaaat

SEQ ID NO: 4254995 - DNA, 23 bp, Homo sapiens
ttgtagtgttggagaagaactga

SEQ ID NO: 4254996 - DNA, 13 bp, Homo sapiens
ttgtataaaataa

SEQ ID NO: 4254997 - DNA, 16 bp, Homo sapiens
ttgtataaaataattt

SEQ ID NO: 4254998 - DNA, 17 bp, Homo sapiens
ttgtataaaataatttt

SEQ ID NO: 4254999 - DNA, 15 bp, Homo sapiens
ttgtatattacaatg

SEQ ID NO: 4255000 - DNA, 22 bp, Homo sapiens
ttgtattcaaaaattatctata

SEQ ID NO: 4255001 - DNA, 18 bp, Homo sapiens
ttgtattgtatattacaa

SEQ ID NO: 4255002 - DNA, 15 bp, Homo sapiens
ttgtctagtgaaact

SEQ ID NO: 4255003 - DNA, 23 bp, Homo sapiens
ttgtgtgaaaggtacttcaaatc

SEQ ID NO: 4255004 - DNA, 12 bp, Homo sapiens
ttgttttacaat

SEQ ID NO: 4255005 - DNA, 20 bp, Homo sapiens
tttaaaaaagaaacatttgg

SEQ ID NO: 4255006 - DNA, 12 bp, Homo sapiens
tttaaatgtata

SEQ ID NO: 4255007 - DNA, 14 bp, Homo sapiens
tttaaatgtatact

SEQ ID NO: 4255008 - DNA, 15 bp, Homo sapiens
tttaaatgtatacta

SEQ ID NO: 4255009 - DNA, 19 bp, Homo sapiens
tttaataatgtttcaaaca

SEQ ID NO: 4255010 - DNA, 22 bp, Homo sapiens
tttagctggaaaagtatgttag

SEQ ID NO: 4255011 - DNA, 19 bp, Homo sapiens
tttattactgtaagaaaat

SEQ ID NO: 4255012 - DNA, 13 bp, Homo sapiens
tttcaaaagaaag

SEQ ID NO: 4255013 - DNA, 16 bp, Homo sapiens
tttcaaacatatataa

SEQ ID NO: 4255014 - DNA, 14 bp, Homo sapiens
aaaagcagacattt

SEQ ID NO: 4255015 - DNA, 19 bp, Homo sapiens
aaaagtatgttagtgcaaa

SEQ ID NO: 4255016 - DNA, 14 bp, Homo sapiens
aaaatatatactaa

SEQ ID NO: 4255017 - DNA, 20 bp, Homo sapiens
aaaatattgttttacaatag

SEQ ID NO: 4255018 - DNA, 17 bp, Homo sapiens
aaaatctcaatatttca

SEQ ID NO: 4255019 - DNA, 14 bp, Homo sapiens
aaaattacaactaa

SEQ ID NO: 4255020 - DNA, 19 bp, Homo sapiens
aaaattttttctctaggaa

SEQ ID NO: 4255021 - DNA, 12 bp, Homo sapiens
aaacaggatcag

SEQ ID NO: 4255022 - DNA, 13 bp, Homo sapiens
aaacatatataac

SEQ ID NO: 4255023 - DNA, 19 bp, Homo sapiens
aaacatgtttccactattg

SEQ ID NO: 4255024 - DNA, 16 bp, Homo sapiens
aaaccttccacccagt

SEQ ID NO: 4255025 - DNA, 23 bp, Homo sapiens
aaaccttccacccagtgctgaat

SEQ ID NO: 4255026 - DNA, 15 bp, Homo sapiens
aaactacatattgta

SEQ ID NO: 4255027 - DNA, 12 bp, Homo sapiens
aaagaaaatttt

SEQ ID NO: 4255028 - DNA, 17 bp, Homo sapiens
aaagcagcctggccaac

SEQ ID NO: 4255029 - DNA, 15 bp, Homo sapiens
aaagcatccctcacc

SEQ ID NO: 4255030 - DNA, 16 bp, Homo sapiens
aaagcccattcattcc

SEQ ID NO: 4255031 - DNA, 17 bp, Homo sapiens
aaagcccattcattcca

SEQ ID NO: 4255032 - DNA, 17 bp, Homo sapiens
aaagctatataagacaa

SEQ ID NO: 4255033 - DNA, 23 bp, Homo sapiens
aaagctgctgagaatctagcctc

SEQ ID NO: 4255034 - DNA, 16 bp, Homo sapiens
aaaggaaagaaaacat

SEQ ID NO: 4255035 - DNA, 15 bp, Homo sapiens
aaaggacatcagcaa

SEQ ID NO: 4255036 - DNA, 19 bp, Homo sapiens
aaataattttatctctttc

SEQ ID NO: 4255037 - DNA, 20 bp, Homo sapiens
aaataatttttatatttgaa

SEQ ID NO: 4255038 - DNA, 22 bp, Homo sapiens
aaataatttttatatttgaaat

SEQ ID NO: 4255039 - DNA, 13 bp, Homo sapiens
aaatatttatttt

SEQ ID NO: 4255040 - DNA, 21 bp, Homo sapiens
aaatatttattttaataatgt

SEQ ID NO: 4255041 - DNA, 19 bp, Homo sapiens
cagcaacaataaatagaca

SEQ ID NO: 4255042 - DNA, 22 bp, Homo sapiens
cagcaattacaacggagtcaaa

SEQ ID NO: 4255043 - DNA, 16 bp, Homo sapiens
cagcaatttaaatgtt

SEQ ID NO: 4255044 - DNA, 22 bp, Homo sapiens
cagcacagcctcttagatgcag

SEQ ID NO: 4255045 - DNA, 19 bp, Homo sapiens
ctggagatgaggccagacc

SEQ ID NO: 4255046 - DNA, 23 bp, Homo sapiens
ctggcattacaggtgtgagccac

SEQ ID NO: 4255047 - DNA, 23 bp, Homo sapiens
ctgggaatggaggggcagagcca

SEQ ID NO: 4255048 - DNA, 10 bp, Homo sapiens
ctgggacagg

SEQ ID NO: 4255049 - DNA, 20 bp, Homo sapiens
ctggggctgaggctgaggca

SEQ ID NO: 4255050 - DNA, 15 bp, Homo sapiens
accaatcatgaatta

SEQ ID NO: 4255051 - DNA, 16 bp, Homo sapiens
accacaagactgcaca

SEQ ID NO: 4255052 - DNA, 16 bp, Homo sapiens
accaccacgcctggct

SEQ ID NO: 4255053 - DNA, 23 bp, Homo sapiens
accacctctcaatattcaataaa

SEQ ID NO: 4255054 - DNA, 20 bp, Homo sapiens
accagtaggggcttataata

SEQ ID NO: 4255055 - DNA, 22 bp, Homo sapiens
accatcaccagaattaatttta

SEQ ID NO: 4255056 - DNA, 15 bp, Homo sapiens
accatctctccaact

SEQ ID NO: 4255057 - DNA, 15 bp, Homo sapiens
acccacccagaatga

SEQ ID NO: 4255058 - DNA, 11 bp, Homo sapiens
acccaggacag

SEQ ID NO: 4255059 - DNA, 14 bp, Homo sapiens
acccagtgctgaat

SEQ ID NO: 4255060 - DNA, 22 bp, Homo sapiens
acccctaaaagaaaccctgcac

SEQ ID NO: 4255061 - DNA, 20 bp, Homo sapiens
accctaaataataaaaataa

SEQ ID NO: 4255062 - DNA, 17 bp, Homo sapiens
accctaaccaagttcct

SEQ ID NO: 4255063 - DNA, 13 bp, Homo sapiens
accctagcaaaag

SEQ ID NO: 4255064 - DNA, 13 bp, Homo sapiens
accctcatgctgt

SEQ ID NO: 4255065 - DNA, 17 bp, Homo sapiens
acctatttccagaaata

SEQ ID NO: 4255066 - DNA, 17 bp, Homo sapiens
acctccctcaacctcat

SEQ ID NO: 4255067 - DNA, 16 bp, Homo sapiens
acctctccagcctcag

SEQ ID NO: 4255068 - DNA, 21 bp, Homo sapiens
acctgcctcccttcatgcatg

SEQ ID NO: 4255069 - DNA, 11 bp, Homo sapiens
acctgtctgtc

SEQ ID NO: 4255070 - DNA, 12 bp, Homo sapiens
acctgtctgtct

SEQ ID NO: 4255071 - DNA, 23 bp, Homo sapiens
acgcgcctcgccggatctgaggg

SEQ ID NO: 4255072 - DNA, 15 bp, Homo sapiens
acggcagccacagct

SEQ ID NO: 4255073 - DNA, 15 bp, Homo sapiens
actacacccagcaat

SEQ ID NO: 4255074 - DNA, 15 bp, Homo sapiens
actacagttagggct

SEQ ID NO: 4255075 - DNA, 13 bp, Homo sapiens
actacgcctggct

SEQ ID NO: 4255076 - DNA, 18 bp, Homo sapiens
actagtatttctatgaaa

SEQ ID NO: 4255077 - DNA, 20 bp, Homo sapiens
actagtatttctatgaaata

SEQ ID NO: 4255078 - DNA, 22 bp, Homo sapiens
actataggcatgcgccaccatg

SEQ ID NO: 4255079 - DNA, 16 bp, Homo sapiens
aggggcagagccagga

SEQ ID NO: 4255080 - DNA, 17 bp, Homo sapiens
aggggcagagccaggaa

SEQ ID NO: 4255081 - DNA, 14 bp, Homo sapiens
aggggctaccagga

SEQ ID NO: 4255082 - DNA, 11 bp, Homo sapiens
agggtggcagc

SEQ ID NO: 4255083 - DNA, 15 bp, Homo sapiens
agggtggcagcaaca

SEQ ID NO: 4255084 - DNA, 17 bp, Homo sapiens
agggttatgattaagta

SEQ ID NO: 4255085 - DNA, 17 bp, Homo sapiens
aggtaatttttttcacc

SEQ ID NO: 4255086 - DNA, 23 bp, Homo sapiens
aggtacttcaaatccttgaagat

SEQ ID NO: 4255087 - DNA, 19 bp, Homo sapiens
aggtcttcttaatatgttc

SEQ ID NO: 4255088 - DNA, 14 bp, Homo sapiens
agtaaaaaggctaa

SEQ ID NO: 4255089 - DNA, 19 bp, Homo sapiens
agtaactacagttagggct

SEQ ID NO: 4255090 - DNA, 17 bp, Homo sapiens
agtaatgataactggaa

SEQ ID NO: 4255091 - DNA, 20 bp, Homo sapiens
agtaatgataactggaaact

SEQ ID NO: 4255092 - DNA, 12 bp, Homo sapiens
agtaattggaaa

SEQ ID NO: 4255093 - DNA, 17 bp, Homo sapiens
agtacacaataagcaaa

SEQ ID NO: 4255094 - DNA, 18 bp, Homo sapiens
agtacacaataagcaaaa

SEQ ID NO: 4255095 - DNA, 19 bp, Homo sapiens
agtagataggccatgggca

SEQ ID NO: 4255096 - DNA, 18 bp, Homo sapiens
agtagcgttttttaaatg

SEQ ID NO: 4255097 - DNA, 21 bp, Homo sapiens
agtagcgttttttaaatgtat

SEQ ID NO: 4255098 - DNA, 18 bp, Homo sapiens
agtatgggttagggaaaa

SEQ ID NO: 4255099 - DNA, 16 bp, Homo sapiens
agtatttctatgaaat

SEQ ID NO: 4255100 - DNA, 17 bp, Homo sapiens
agtcaaattgtgtgaaa

SEQ ID NO: 4255101 - DNA, 15 bp, Homo sapiens
agtcacctcatggaa

SEQ ID NO: 4255102 - DNA, 17 bp, Homo sapiens
agtcacctcatggaatt

SEQ ID NO: 4255103 - DNA, 15 bp, Homo sapiens
agtcaggaaagagaa

SEQ ID NO: 4255104 - DNA, 16 bp, Homo sapiens
agtcaggaaagagaac

SEQ ID NO: 4255105 - DNA, 17 bp, Homo sapiens
agtctctataccaataa

SEQ ID NO: 4255106 - DNA, 22 bp, Homo sapiens
agtctctgaggggctaccagga

SEQ ID NO: 4255107 - DNA, 17 bp, Homo sapiens
agtctttggaaccctaa

SEQ ID NO: 4255108 - DNA, 17 bp, Homo sapiens
agtgaccctgctctcac

SEQ ID NO: 4255109 - DNA, 21 bp, Homo sapiens
agtgagcagtcaggaaagaga

SEQ ID NO: 4255110 - DNA, 17 bp, Homo sapiens
agtgatctgcccgcctc

SEQ ID NO: 4255111 - DNA, 14 bp, Homo sapiens
agtgcaaattgtca

SEQ ID NO: 4255112 - DNA, 23 bp, Homo sapiens
agtgcagtggcgcgatctcagct

SEQ ID NO: 4255113 - DNA, 19 bp, Homo sapiens
agtgctgaatttccctctc

SEQ ID NO: 4255114 - DNA, 15 bp, Homo sapiens
agtggcatcatctca

SEQ ID NO: 4255115 - DNA, 14 bp, Homo sapiens
agtgttggagaaga

SEQ ID NO: 4255116 - DNA, 17 bp, Homo sapiens
agtgttggagaagaact

SEQ ID NO: 4255117 - DNA, 18 bp, Homo sapiens
agtgttggagaagaactg

SEQ ID NO: 4255118 - DNA, 15 bp, Homo sapiens
agttaactattgcat

SEQ ID NO: 4255119 - DNA, 17 bp, Homo sapiens
agttaactattgcattt

SEQ ID NO: 4255120 - DNA, 19 bp, Homo sapiens
agttaactattgcatttat

SEQ ID NO: 4255121 - DNA, 20 bp, Homo sapiens
agttaactattgcatttata

SEQ ID NO: 4255122 - DNA, 24 bp, Homo sapiens
agttaactattgcatttatatgta

SEQ ID NO: 4255123 - DNA, 13 bp, Homo sapiens
agttctgaagaag

SEQ ID NO: 4255124 - DNA, 19 bp, Homo sapiens
agttcttactgcttaattc

SEQ ID NO: 4255125 - DNA, 10 bp, Homo sapiens
agttgcagcc

SEQ ID NO: 4255126 - DNA, 16 bp, Homo sapiens
agtttagctggaaaag

SEQ ID NO: 4255127 - DNA, 16 bp, Homo sapiens
agttttatatgcttct

SEQ ID NO: 4255128 - DNA, 23 bp, Homo sapiens
agttttttgaaattatgtgacat

SEQ ID NO: 4255129 - DNA, 13 bp, Homo sapiens
ataaaaagaatga

SEQ ID NO: 4255130 - DNA, 22 bp, Homo sapiens
ataaaataatttttatatttga

SEQ ID NO: 4255131 - DNA, 19 bp, Homo sapiens
ataaaatccatacatttgt

SEQ ID NO: 4255132 - DNA, 13 bp, Homo sapiens
ataaatgtatctg

SEQ ID NO: 4255133 - DNA, 14 bp, Homo sapiens
ataaatgtatctga

SEQ ID NO: 4255134 - DNA, 15 bp, Homo sapiens
ataaatgtatctgaa

SEQ ID NO: 4255135 - DNA, 17 bp, Homo sapiens
ataaatgtatctgaata

SEQ ID NO: 4255136 - DNA, 15 bp, Homo sapiens
ataacaatgctgtat

SEQ ID NO: 4255137 - DNA, 18 bp, Homo sapiens
ataagcttatgcttaaat

SEQ ID NO: 4255138 - DNA, 17 bp, Homo sapiens
ataatccagtaaaataa

SEQ ID NO: 4255139 - DNA, 13 bp, Homo sapiens
ataatgtttcaaa

SEQ ID NO: 4255140 - DNA, 14 bp, Homo sapiens
ataattttgtgaag

SEQ ID NO: 4255141 - DNA, 19 bp, Homo sapiens
ataatttttatatttgaaa

SEQ ID NO: 4255142 - DNA, 14 bp, Homo sapiens
ataccaataaagtg

SEQ ID NO: 4255143 - DNA, 13 bp, Homo sapiens
atacccacccaga

SEQ ID NO: 4255144 - DNA, 15 bp, Homo sapiens
atataacaatgctgt

SEQ ID NO: 4255145 - DNA, 17 bp, Homo sapiens
atataacaatgctgtat

SEQ ID NO: 4255146 - DNA, 19 bp, Homo sapiens
atataagcttgtattcctt

SEQ ID NO: 4255147 - DNA, 12 bp, Homo sapiens
atataattctta

SEQ ID NO: 4255148 - DNA, 18 bp, Homo sapiens
atatcacttgtcaataaa

SEQ ID NO: 4255149 - DNA, 12 bp, Homo sapiens
atattacaatga

SEQ ID NO: 4255150 - DNA, 20 bp, Homo sapiens
atattcaataaagctgctga

SEQ ID NO: 4255151 - DNA, 13 bp, Homo sapiens
atatttgaaatat

SEQ ID NO: 4255152 - DNA, 16 bp, Homo sapiens
atcaagggtacactgc

SEQ ID NO: 4255153 - DNA, 21 bp, Homo sapiens
atcaagggtacactgccttct

SEQ ID NO: 4255154 - DNA, 16 bp, Homo sapiens
atcagaaacaccctca

SEQ ID NO: 4255155 - DNA, 13 bp, Homo sapiens
atcagcttattgt

SEQ ID NO: 4255156 - DNA, 17 bp, Homo sapiens
atcaggaagagaaggag

SEQ ID NO: 4255157 - DNA, 19 bp, Homo sapiens
atcaggaagagaaggagca

SEQ ID NO: 4255158 - DNA, 17 bp, Homo sapiens
atcagggttagtattgt

SEQ ID NO: 4255159 - DNA, 13 bp, Homo sapiens
atcatctcagctc

SEQ ID NO: 4255160 - DNA, 14 bp, Homo sapiens
atccatacatttgt

SEQ ID NO: 4255161 - DNA, 12 bp, Homo sapiens
atcccccagaaa

SEQ ID NO: 4255162 - DNA, 19 bp, Homo sapiens
atccctcacccatcctaga

SEQ ID NO: 4255163 - DNA, 22 bp, Homo sapiens
atccttcatctggattccagag

SEQ ID NO: 4255164 - DNA, 12 bp, Homo sapiens
atccttgaagat

SEQ ID NO: 4255165 - DNA, 16 bp, Homo sapiens
atccttgagtcaaaaa

SEQ ID NO: 4255166 - DNA, 16 bp, Homo sapiens
atctatagaaagctat

SEQ ID NO: 4255167 - DNA, 15 bp, Homo sapiens
atctcagctcactac

SEQ ID NO: 4255168 - DNA, 14 bp, Homo sapiens
atctcagctcactg

SEQ ID NO: 4255169 - DNA, 21 bp, Homo sapiens
atctcatttccaagcaagtat

SEQ ID NO: 4255170 - DNA, 15 bp, Homo sapiens
atctgcgtgtgtgca

SEQ ID NO: 4255171 - DNA, 18 bp, Homo sapiens
atctggaaccatcagaaa

SEQ ID NO: 4255172 - DNA, 13 bp, Homo sapiens
atcttatttagga

SEQ ID NO: 4255173 - DNA, 13 bp, Homo sapiens
atgaaatattatg

SEQ ID NO: 4255174 - DNA, 21 bp, Homo sapiens
atgaaatattatgttaaaact

SEQ ID NO: 4255175 - DNA, 15 bp, Homo sapiens
atgaacttgaggaca

SEQ ID NO: 4255176 - DNA, 20 bp, Homo sapiens
atgaagcctccttagaaaaa

SEQ ID NO: 4255177 - DNA, 23 bp, Homo sapiens
atgaagtccaagcatttagatgt

SEQ ID NO: 4255178 - DNA, 21 bp, Homo sapiens
atgaattagttttatatgctt

SEQ ID NO: 4255179 - DNA, 15 bp, Homo sapiens
atgactatgtaaact

SEQ ID NO: 4255180 - DNA, 12 bp, Homo sapiens
atgaggccagac

SEQ ID NO: 4255181 - DNA, 13 bp, Homo sapiens
gatctgagggaga

SEQ ID NO: 4255182 - DNA, 15 bp, Homo sapiens
gatggagaaggaagg

SEQ ID NO: 4255183 - DNA, 22 bp, Homo sapiens
gattaagtaatgataactggaa

SEQ ID NO: 4255184 - DNA, 22 bp, Homo sapiens
gattacaggtgtgagccaccac

SEQ ID NO: 4255185 - DNA, 19 bp, Homo sapiens
gattccagagcactgctcc

SEQ ID NO: 4255186 - DNA, 14 bp, Homo sapiens
gatttctgaggaaa

SEQ ID NO: 4255187 - DNA, 16 bp, Homo sapiens
gcaaattgtcacagga

SEQ ID NO: 4255188 - DNA, 13 bp, Homo sapiens
gcaacctccacct

SEQ ID NO: 4255189 - DNA, 23 bp, Homo sapiens
gcaagatggggagtgagaggctg

SEQ ID NO: 4255190 - DNA, 20 bp, Homo sapiens
gcaattacaacggagtcaaa

SEQ ID NO: 4255191 - DNA, 15 bp, Homo sapiens
gcactggcgaggaga

SEQ ID NO: 4255192 - DNA, 20 bp, Homo sapiens
gcagaaagcatccctcaccc

SEQ ID NO: 4255193 - DNA, 16 bp, Homo sapiens
gcagaaggaaggcagg

SEQ ID NO: 4255194 - DNA, 22 bp, Homo sapiens
gcagaaggaaggcagggaggag

SEQ ID NO: 4255195 - DNA, 17 bp, Homo sapiens
gcagacattttaaaaaa

SEQ ID NO: 4255196 - DNA, 19 bp, Homo sapiens
gcagagctgatggagaagg

SEQ ID NO: 4255197 - DNA, 21 bp, Homo sapiens
gcagagctgatggagaaggaa

SEQ ID NO: 4255198 - DNA, 11 bp, Homo sapiens
gcagcaacaat

SEQ ID NO: 4255199 - DNA, 16 bp, Homo sapiens
gcagcaatttaaatgt

SEQ ID NO: 4255200 - DNA, 21 bp, Homo sapiens
gcagccctgctgctgcctgcc

SEQ ID NO: 4255201 - DNA, 20 bp, Homo sapiens
gcagtctctataccaataaa

SEQ ID NO: 4255202 - DNA, 22 bp, Homo sapiens
gcagtggcgtgatctcagctca

SEQ ID NO: 4255203 - DNA, 15 bp, Homo sapiens
gcagttctgaagaag

SEQ ID NO: 4255204 - DNA, 22 bp, Homo sapiens
gcagttgttgcccacagctgta

SEQ ID NO: 4255205 - DNA, 13 bp, Homo sapiens
gccaccctcatgc

SEQ ID NO: 4255206 - DNA, 15 bp, Homo sapiens
gccaccctcatgctg

SEQ ID NO: 4255207 - DNA, 16 bp, Homo sapiens
gccaccctcatgctgt

SEQ ID NO: 4255208 - DNA, 13 bp, Homo sapiens
gccacctgtctgt

SEQ ID NO: 4255209 - DNA, 21 bp, Homo sapiens
gccagccacggggactcagcc

SEQ ID NO: 4255210 - DNA, 19 bp, Homo sapiens
gcccattcattccattctg

SEQ ID NO: 4255211 - DNA, 23 bp, Homo sapiens
gcccattcattccattctggaag

SEQ ID NO: 4255212 - DNA, 20 bp, Homo sapiens
gccccaccctcgtggacacc

SEQ ID NO: 4255213 - DNA, 22 bp, Homo sapiens
gcccccagtatctcttcagtct

SEQ ID NO: 4255214 - DNA, 20 bp, Homo sapiens
gcccctggtccctctgcagt

SEQ ID NO: 4255215 - DNA, 14 bp, Homo sapiens
gccctgccacctgt

SEQ ID NO: 4255216 - DNA, 18 bp, Homo sapiens
gccctgccacctgtctgt

SEQ ID NO: 4255217 - DNA, 20 bp, Homo sapiens
gccctgccacctgtctgtct

SEQ ID NO: 4255218 - DNA, 20 bp, Homo sapiens
gcccttctatacccacccag

SEQ ID NO: 4255219 - DNA, 22 bp, Homo sapiens
gcccttctatacccacccagaa

SEQ ID NO: 4255220 - DNA, 20 bp, Homo sapiens
gcctattgttgaataaatgt

SEQ ID NO: 4255221 - DNA, 15 bp, Homo sapiens
gcctcccttcatgca

SEQ ID NO: 4255222 - DNA, 18 bp, Homo sapiens
gcctcccttcatgcatgg

SEQ ID NO: 4255223 - DNA, 22 bp, Homo sapiens
gcctcccttcatgcatggaaat

SEQ ID NO: 4255224 - DNA, 23 bp, Homo sapiens
gcctcccttcatgcatggaaatt

SEQ ID NO: 4255225 - DNA, 13 bp, Homo sapiens
gcctcttccctct

SEQ ID NO: 4255226 - DNA, 13 bp, Homo sapiens
gcctttggcaggt

SEQ ID NO: 4255227 - DNA, 23 bp, Homo sapiens
gcgattctcctgcctcagcctcc

SEQ ID NO: 4255228 - DNA, 22 bp, Homo sapiens
gcgcccttaactgcatccagcc

SEQ ID NO: 4255229 - DNA, 18 bp, Homo sapiens
gcgcctccaaccctagca

SEQ ID NO: 4255230 - DNA, 21 bp, Homo sapiens
gctaagtacacaataagcaaa

SEQ ID NO: 4255231 - DNA, 13 bp, Homo sapiens
gctaccaggaaag

SEQ ID NO: 4255232 - DNA, 18 bp, Homo sapiens
gctagatgtatgtacttc

SEQ ID NO: 4255233 - DNA, 16 bp, Homo sapiens
gctagcaaatagtaat

SEQ ID NO: 4255234 - DNA, 21 bp, Homo sapiens
gctagtaattggaaaggcagc

SEQ ID NO: 4255235 - DNA, 14 bp, Homo sapiens
gctcatttcaggat

SEQ ID NO: 4255236 - DNA, 21 bp, Homo sapiens
gctcctccagggtggcagcaa

SEQ ID NO: 4255237 - DNA, 22 bp, Homo sapiens
gctcctccagggtggcagcaac

SEQ ID NO: 4255238 - DNA, 16 bp, Homo sapiens
gctctccaaaccactt

SEQ ID NO: 4255239 - DNA, 17 bp, Homo sapiens
gctctccaaaccacttt

SEQ ID NO: 4255240 - DNA, 17 bp, Homo sapiens
gctgatggagaaggaag

SEQ ID NO: 4255241 - DNA, 14 bp, Homo sapiens
gctgcctcttccct

SEQ ID NO: 4255242 - DNA, 21 bp, Homo sapiens
gctggaaaagtatgttagtgc

SEQ ID NO: 4255243 - DNA, 20 bp, Homo sapiens
gctggagatgaggccagacc

SEQ ID NO: 4255244 - DNA, 12 bp, Homo sapiens
gctggagtgcag

SEQ ID NO: 4255245 - DNA, 21 bp, Homo sapiens
gctgggaatggaggggcagag

SEQ ID NO: 4255246 - DNA, 13 bp, Homo sapiens
gctgtattttaaa

SEQ ID NO: 4255247 - DNA, 21 bp, Homo sapiens
gctgtattttaaaagaatgat

SEQ ID NO: 4255248 - DNA, 14 bp, Homo sapiens
gcttccctttcctg

SEQ ID NO: 4255249 - DNA, 22 bp, Homo sapiens
gcttctcagatttctgaggaaa

SEQ ID NO: 4255250 - DNA, 16 bp, Homo sapiens
gcttttcccaaaagcc

SEQ ID NO: 4255251 - DNA, 23 bp, Homo sapiens
ggaaagcgcctccaaccctagca

SEQ ID NO: 4255252 - DNA, 17 bp, Homo sapiens
ggaaatatttattttaa

SEQ ID NO: 4255253 - DNA, 19 bp, Homo sapiens
ggaaattcccttcatctgg

SEQ ID NO: 4255254 - DNA, 13 bp, Homo sapiens
ggaacataaaaag

SEQ ID NO: 4255255 - DNA, 14 bp, Homo sapiens
ggaagatcccccag

SEQ ID NO: 4255256 - DNA, 22 bp, Homo sapiens
ggaagatcccccagaaaagaaa

SEQ ID NO: 4255257 - DNA, 19 bp, Homo sapiens
ggaaggaggacccaggaca

SEQ ID NO: 4255258 - DNA, 21 bp, Homo sapiens
ggaaggcagggaggaggcaga

SEQ ID NO: 4255259 - DNA, 16 bp, Homo sapiens
ggaatggaggggcaga

SEQ ID NO: 4255260 - DNA, 17 bp, Homo sapiens
ggaatggaggggcagag

SEQ ID NO: 4255261 - DNA, 21 bp, Homo sapiens
ggaatggaggggcagagccag

SEQ ID NO: 4255262 - DNA, 12 bp, Homo sapiens
ggacacctgccc

SEQ ID NO: 4255263 - DNA, 18 bp, Homo sapiens
ggacactacacccagcaa

SEQ ID NO: 4255264 - DNA, 15 bp, Homo sapiens
ggacaggatccaggc

SEQ ID NO: 4255265 - DNA, 18 bp, Homo sapiens
ggacagtcacctcatgga

SEQ ID NO: 4255266 - DNA, 17 bp, Homo sapiens
ggaccagcttttcccaa

SEQ ID NO: 4255267 - DNA, 10 bp, Homo sapiens
ggacccagga

SEQ ID NO: 4255268 - DNA, 11 bp, Homo sapiens
ggagaagaact

SEQ ID NO: 4255269 - DNA, 14 bp, Homo sapiens
ggagatgaggccag

SEQ ID NO: 4255270 - DNA, 13 bp, Homo sapiens
ggaggacccagga

SEQ ID NO: 4255271 - DNA, 16 bp, Homo sapiens
ggaggacccaggacag

SEQ ID NO: 4255272 - DNA, 17 bp, Homo sapiens
ggaggaggcagagaaga

SEQ ID NO: 4255273 - DNA, 19 bp, Homo sapiens
ggaggcagagaagaaagaa

SEQ ID NO: 4255274 - DNA, 22 bp, Homo sapiens
ggattccactcgtgtgtttcta

SEQ ID NO: 4255275 - DNA, 14 bp, Homo sapiens
ggcacacaccacca

SEQ ID NO: 4255276 - DNA, 16 bp, Homo sapiens
ggcactggcgaggaga

SEQ ID NO: 4255277 - DNA, 22 bp, Homo sapiens
ggcagcaacaataaatagacac

SEQ ID NO: 4255278 - DNA, 23 bp, Homo sapiens
ggccccaccctcgtggacacctg

SEQ ID NO: 4255279 - DNA, 20 bp, Homo sapiens
ggcccctgccacctcctgcc

SEQ ID NO: 4255280 - DNA, 19 bp, Homo sapiens
ggccggcttgccacacccc

SEQ ID NO: 4255281 - DNA, 14 bp, Homo sapiens
ggctaccaggaaag

SEQ ID NO: 4255282 - DNA, 15 bp, Homo sapiens
ggctgctgctacaat

SEQ ID NO: 4255283 - DNA, 19 bp, Homo sapiens
gggacatttgctcatggaa

SEQ ID NO: 4255284 - DNA, 20 bp, Homo sapiens
gggaccggcggaccccagcc

SEQ ID NO: 4255285 - DNA, 13 bp, Homo sapiens
gggcaagaggaat

SEQ ID NO: 4255286 - DNA, 16 bp, Homo sapiens
gggcctttggcaggtg

SEQ ID NO: 4255287 - DNA, 15 bp, Homo sapiens
gggctaccaggaaag

SEQ ID NO: 4255288 - DNA, 14 bp, Homo sapiens
ggggctaccaggaa

SEQ ID NO: 4255289 - DNA, 20 bp, Homo sapiens
ggggcttataataaaggact

SEQ ID NO: 4255290 - DNA, 23 bp, Homo sapiens
ggggtctcttctgaataaagcaa

SEQ ID NO: 4255291 - DNA, 17 bp, Homo sapiens
caaatcaatctgtaaaa

SEQ ID NO: 4255292 - DNA, 15 bp, Homo sapiens
caaatccttgaagat

SEQ ID NO: 4255293 - DNA, 23 bp, Homo sapiens
caacacacacatgcttccctttc

SEQ ID NO: 4255294 - DNA, 15 bp, Homo sapiens
caacctcatcctctc

SEQ ID NO: 4255295 - DNA, 14 bp, Homo sapiens
caacttcagtccaa

SEQ ID NO: 4255296 - DNA, 14 bp, Homo sapiens
caagcaatcctccc

SEQ ID NO: 4255297 - DNA, 21 bp, Homo sapiens
caagccagattttcctgaaaa

SEQ ID NO: 4255298 - DNA, 22 bp, Homo sapiens
caaggcctggtgtttcttgata

SEQ ID NO: 4255299 - DNA, 13 bp, Homo sapiens
caaggtctgcttt

SEQ ID NO: 4255300 - DNA, 14 bp, Homo sapiens
caaggtctgctttt

SEQ ID NO: 4255301 - DNA, 10 bp, Homo sapiens
caagtaaaaa

SEQ ID NO: 4255302 - DNA, 21 bp, Homo sapiens
caagttccttggccatgcaga

SEQ ID NO: 4255303 - DNA, 23 bp, Homo sapiens
caataaaatccatacatttgtgt

SEQ ID NO: 4255304 - DNA, 14 bp, Homo sapiens
caataaagtgaccc

SEQ ID NO: 4255305 - DNA, 12 bp, Homo sapiens
caataagcaaaa

SEQ ID NO: 4255306 - DNA, 17 bp, Homo sapiens
caatagtcaaattgtgt

SEQ ID NO: 4255307 - DNA, 17 bp, Homo sapiens
caatattcaataaagct

SEQ ID NO: 4255308 - DNA, 12 bp, Homo sapiens
caatatttcaga

SEQ ID NO: 4255309 - DNA, 18 bp, Homo sapiens
caatctgtaaaactaaga

SEQ ID NO: 4255310 - DNA, 19 bp, Homo sapiens
caattacaacggagtcaaa

SEQ ID NO: 4255311 - DNA, 17 bp, Homo sapiens
caattcttccctatctt

SEQ ID NO: 4255312 - DNA, 21 bp, Homo sapiens
caattcttccctatctttgcc

SEQ ID NO: 4255313 - DNA, 22 bp, Homo sapiens
caattcttccctatctttgcca

SEQ ID NO: 4255314 - DNA, 19 bp, Homo sapiens
caattcttttaactgttgt

SEQ ID NO: 4255315 - DNA, 14 bp, Homo sapiens
caattgagaaaaat

SEQ ID NO: 4255316 - DNA, 13 bp, Homo sapiens
caatttaaatgtt

SEQ ID NO: 4255317 - DNA, 14 bp, Homo sapiens
caatttaaatgtta

SEQ ID NO: 4255318 - DNA, 13 bp, Homo sapiens
cacaataagcaaa

SEQ ID NO: 4255319 - DNA, 22 bp, Homo sapiens
cacacatgaagtccaagcattt

SEQ ID NO: 4255320 - DNA, 14 bp, Homo sapiens
cacactgaagaagc

SEQ ID NO: 4255321 - DNA, 17 bp, Homo sapiens
cacagcctcttagatgc

SEQ ID NO: 4255322 - DNA, 14 bp, Homo sapiens
cacagctgcctctt

SEQ ID NO: 4255323 - DNA, 19 bp, Homo sapiens
cacaggaaccacaagactg

SEQ ID NO: 4255324 - DNA, 20 bp, Homo sapiens
cacatgcttccctttcctga

SEQ ID NO: 4255325 - DNA, 20 bp, Homo sapiens
cacccaggctggactgcaat

SEQ ID NO: 4255326 - DNA, 12 bp, Homo sapiens
cacccctaggac

SEQ ID NO: 4255327 - DNA, 14 bp, Homo sapiens
caccctcatgctgt

SEQ ID NO: 4255328 - DNA, 20 bp, Homo sapiens
caccctcgtggacacctgcc

SEQ ID NO: 4255329 - DNA, 15 bp, Homo sapiens
caccgcagaaggaag

SEQ ID NO: 4255330 - DNA, 12 bp, Homo sapiens
cacctcatggaa

SEQ ID NO: 4255331 - DNA, 21 bp, Homo sapiens
cacctctcaatattcaataaa

SEQ ID NO: 4255332 - DNA, 22 bp, Homo sapiens
cacctctcaatattcaataaag

SEQ ID NO: 4255333 - DNA, 13 bp, Homo sapiens
cacctgccctgcc

SEQ ID NO: 4255334 - DNA, 16 bp, Homo sapiens
cacctgccctgccctg

SEQ ID NO: 4255335 - DNA, 18 bp, Homo sapiens
cacctgccctgccctgcc

SEQ ID NO: 4255336 - DNA, 22 bp, Homo sapiens
cacctgtctgtctgtctgtccc

SEQ ID NO: 4255337 - DNA, 16 bp, Homo sapiens
cacgcctggctaattt

SEQ ID NO: 4255338 - DNA, 20 bp, Homo sapiens
cacggcagccacagcttggg

SEQ ID NO: 4255339 - DNA, 13 bp, Homo sapiens
cactacaacctcc

SEQ ID NO: 4255340 - DNA, 18 bp, Homo sapiens
cactacacccagcaatag

SEQ ID NO: 4255341 - DNA, 23 bp, Homo sapiens
cactgaagaagcaccaatcatga

SEQ ID NO: 4255342 - DNA, 14 bp, Homo sapiens
cactgcaacctccg

SEQ ID NO: 4255343 - DNA, 13 bp, Homo sapiens
cactggccccacc

SEQ ID NO: 4255344 - DNA, 16 bp, Homo sapiens
cactggccccaccctc

SEQ ID NO: 4255345 - DNA, 17 bp, Homo sapiens
cactgggacttgcaaaa

SEQ ID NO: 4255346 - DNA, 24 bp, Homo sapiens
cactgtgggtagacacacatgaag

SEQ ID NO: 4255347 - DNA, 16 bp, Homo sapiens
cacttgtcaataaaat

SEQ ID NO: 4255348 - DNA, 14 bp, Homo sapiens
cactttttgcagct

SEQ ID NO: 4255349 - DNA, 23 bp, Homo sapiens
cagaaaagaaagctacagaagaa

SEQ ID NO: 4255350 - DNA, 18 bp, Homo sapiens
cagaaacaccctcacact

SEQ ID NO: 4255351 - DNA, 13 bp, Homo sapiens
cagaactacttct

SEQ ID NO: 4255352 - DNA, 13 bp, Homo sapiens
cagacattttaaa

SEQ ID NO: 4255353 - DNA, 21 bp, Homo sapiens
cagaccatggacactacaccc

SEQ ID NO: 4255354 - DNA, 17 bp, Homo sapiens
cagagcaagaccccatc

SEQ ID NO: 4255355 - DNA, 13 bp, Homo sapiens
cagagcactgctc

SEQ ID NO: 4255356 - DNA, 23 bp, Homo sapiens
cagagccaggaagatcccccaga

SEQ ID NO: 4255357 - DNA, 21 bp, Homo sapiens
cagagctgatggagaaggaag

SEQ ID NO: 4255358 - DNA, 17 bp, Homo sapiens
cagagctggagatgagg

SEQ ID NO: 4255359 - DNA, 23 bp, Homo sapiens
cagagctggagatgaggccagac

SEQ ID NO: 4255360 - DNA, 14 bp, Homo sapiens
cagataatcacaat

SEQ ID NO: 4255361 - DNA, 14 bp, Homo sapiens
cagatttccagcct

SEQ ID NO: 4255362 - DNA, 14 bp, Homo sapiens
cagattttcctgaa

SEQ ID NO: 4255363 - DNA, 15 bp, Homo sapiens
cagcaatttaaatgt

SEQ ID NO: 4255364 - DNA, 23 bp, Homo sapiens
cagccatccagggggcaagagga

SEQ ID NO: 4255365 - DNA, 21 bp, Homo sapiens
cagcccccactgcctttgacc

SEQ ID NO: 4255366 - DNA, 20 bp, Homo sapiens
cagcccttctttccacagaa

SEQ ID NO: 4255367 - DNA, 18 bp, Homo sapiens
cagctctcagttgcagcc

SEQ ID NO: 4255368 - DNA, 14 bp, Homo sapiens
cagcttattgtcta

SEQ ID NO: 4255369 - DNA, 20 bp, Homo sapiens
cagcttattgtctagtgaaa

SEQ ID NO: 4255370 - DNA, 18 bp, Homo sapiens
caggaagatcccccagaa

SEQ ID NO: 4255371 - DNA, 19 bp, Homo sapiens
caggaagatcccccagaaa

SEQ ID NO: 4255372 - DNA, 23 bp, Homo sapiens
caggacagcccttctttccacag

SEQ ID NO: 4255373 - DNA, 23 bp, Homo sapiens
caggatggttcccttgatgaaga

SEQ ID NO: 4255374 - DNA, 20 bp, Homo sapiens
caggccggcttgccacaccc

SEQ ID NO: 4255375 - DNA, 16 bp, Homo sapiens
caggctggagtgcagt

SEQ ID NO: 4255376 - DNA, 23 bp, Homo sapiens
cagggaccggcggaccccagcca

SEQ ID NO: 4255377 - DNA, 22 bp, Homo sapiens
cagggagactgggtaggaaaga

SEQ ID NO: 4255378 - DNA, 15 bp, Homo sapiens
cagggaggaggcaga

SEQ ID NO: 4255379 - DNA, 21 bp, Homo sapiens
cagggaggaggcagagaagaa

SEQ ID NO: 4255380 - DNA, 11 bp, Homo sapiens
caggggacagg

SEQ ID NO: 4255381 - DNA, 17 bp, Homo sapiens
caggtcaccgcgaggcc

SEQ ID NO: 4255382 - DNA, 18 bp, Homo sapiens
caggtgcagcccccactg

SEQ ID NO: 4255383 - DNA, 19 bp, Homo sapiens
cagtaggggcttataataa

SEQ ID NO: 4255384 - DNA, 16 bp, Homo sapiens
cagtatctcttcagtc

SEQ ID NO: 4255385 - DNA, 17 bp, Homo sapiens
cagtatctcttcagtct

SEQ ID NO: 4255386 - DNA, 19 bp, Homo sapiens
cagtatctcttcagtctct

SEQ ID NO: 4255387 - DNA, 22 bp, Homo sapiens
cagtatctcttcagtctctata

SEQ ID NO: 4255388 - DNA, 15 bp, Homo sapiens
cagtcaggaaagaga

SEQ ID NO: 4255389 - DNA, 18 bp, Homo sapiens
cagtcaggaaagagaact

SEQ ID NO: 4255390 - DNA, 21 bp, Homo sapiens
cagtggcatcatctcagctca

SEQ ID NO: 4255391 - DNA, 21 bp, Homo sapiens
cagttacctctgcctcagaaa

SEQ ID NO: 4255392 - DNA, 12 bp, Homo sapiens
cagttctgaaga

SEQ ID NO: 4255393 - DNA, 16 bp, Homo sapiens
cagttctgaagaagat

SEQ ID NO: 4255394 - DNA, 11 bp, Homo sapiens
cagttgcagcc

SEQ ID NO: 4255395 - DNA, 18 bp, Homo sapiens
cagtttatttgaaccaat

SEQ ID NO: 4255396 - DNA, 19 bp, Homo sapiens
cagtttatttgaaccaata

SEQ ID NO: 4255397 - DNA, 21 bp, Homo sapiens
cataaaaaggacatcagcaaa

SEQ ID NO: 4255398 - DNA, 17 bp, Homo sapiens
cataatccagtaaaata

SEQ ID NO: 4255399 - DNA, 20 bp, Homo sapiens
catatataacaatgctgtat

SEQ ID NO: 4255400 - DNA, 23 bp, Homo sapiens
catccagcagatttccagccttc

SEQ ID NO: 4255401 - DNA, 13 bp, Homo sapiens
catccagggggca

SEQ ID NO: 4255402 - DNA, 14 bp, Homo sapiens
catccctcacccat

SEQ ID NO: 4255403 - DNA, 20 bp, Homo sapiens
catccctcacccatcctaga

SEQ ID NO: 4255404 - DNA, 11 bp, Homo sapiens
catcctctcca

SEQ ID NO: 4255405 - DNA, 17 bp, Homo sapiens
catctggaaccatcaga

SEQ ID NO: 4255406 - DNA, 16 bp, Homo sapiens
catgaattagttttat

SEQ ID NO: 4255407 - DNA, 18 bp, Homo sapiens
catgagtcactacgcctg

SEQ ID NO: 4255408 - DNA, 17 bp, Homo sapiens
catgctgtgtgactcaa

SEQ ID NO: 4255409 - DNA, 21 bp, Homo sapiens
catgctgtgtgactcaaacca

SEQ ID NO: 4255410 - DNA, 22 bp, Homo sapiens
catgctgtgtgactcaaaccaa

SEQ ID NO: 4255411 - DNA, 20 bp, Homo sapiens
catgcttccctttcctgagt

SEQ ID NO: 4255412 - DNA, 21 bp, Homo sapiens
catggacactacacccagcaa

SEQ ID NO: 4255413 - DNA, 16 bp, Homo sapiens
cattcattccattctg

SEQ ID NO: 4255414 - DNA, 17 bp, Homo sapiens
cattcattccattctgg

SEQ ID NO: 4255415 - DNA, 12 bp, Homo sapiens
cattccatcctt

SEQ ID NO: 4255416 - DNA, 14 bp, Homo sapiens
cattccattctgga

SEQ ID NO: 4255417 - DNA, 15 bp, Homo sapiens
cattccattctggaa

SEQ ID NO: 4255418 - DNA, 14 bp, Homo sapiens
ctcaattcttccct

SEQ ID NO: 4255419 - DNA, 19 bp, Homo sapiens
ctcaattcttccctatctt

SEQ ID NO: 4255420 - DNA, 16 bp, Homo sapiens
ctcagatttctgagga

SEQ ID NO: 4255421 - DNA, 18 bp, Homo sapiens
ctcagcctcccaagtaac

SEQ ID NO: 4255422 - DNA, 16 bp, Homo sapiens
ctcagcctctcgaagt

SEQ ID NO: 4255423 - DNA, 20 bp, Homo sapiens
ctcagctcactgcaacctcc

SEQ ID NO: 4255424 - DNA, 16 bp, Homo sapiens
ctcataccctccctcc

SEQ ID NO: 4255425 - DNA, 21 bp, Homo sapiens
ctcatttccaagcaagtatta

SEQ ID NO: 4255426 - DNA, 22 bp, Homo sapiens
ctccaaaccactttttgcagct

SEQ ID NO: 4255427 - DNA, 21 bp, Homo sapiens
ctccaaactgactcttaagaa

SEQ ID NO: 4255428 - DNA, 18 bp, Homo sapiens
ctccaccgcagaaggaag

SEQ ID NO: 4255429 - DNA, 14 bp, Homo sapiens
ctccagcctcagct

SEQ ID NO: 4255430 - DNA, 19 bp, Homo sapiens
ctccagggtggcagcaaca

SEQ ID NO: 4255431 - DNA, 19 bp, Homo sapiens
ctccccatgatgtttagaa

SEQ ID NO: 4255432 - DNA, 16 bp, Homo sapiens
ctcccctttttttccc

SEQ ID NO: 4255433 - DNA, 13 bp, Homo sapiens
ctccctcaacctc

SEQ ID NO: 4255434 - DNA, 12 bp, Homo sapiens
ctcgtggacacc

SEQ ID NO: 4255435 - DNA, 17 bp, Homo sapiens
ctcgtggacacctgccc

SEQ ID NO: 4255436 - DNA, 13 bp, Homo sapiens
ctctaacatttcc

SEQ ID NO: 4255437 - DNA, 18 bp, Homo sapiens
ctctcaatattcaataaa

SEQ ID NO: 4255438 - DNA, 15 bp, Homo sapiens
ctctcagttgcagcc

SEQ ID NO: 4255439 - DNA, 15 bp, Homo sapiens
ctctccaaaccactt

SEQ ID NO: 4255440 - DNA, 18 bp, Homo sapiens
ctctccagcctcagctct

SEQ ID NO: 4255441 - DNA, 16 bp, Homo sapiens
ctctccccatgatgtt

SEQ ID NO: 4255442 - DNA, 13 bp, Homo sapiens
ctcttcctttctt

SEQ ID NO: 4255443 - DNA, 10 bp, Homo sapiens
ctcttctgaa

SEQ ID NO: 4255444 - DNA, 16 bp, Homo sapiens
ctcttctgaataaagc

SEQ ID NO: 4255445 - DNA, 20 bp, Homo sapiens
ctcttctgaataaagcaatt

SEQ ID NO: 4255446 - DNA, 22 bp, Homo sapiens
ctgaaaatattgttttacaata

SEQ ID NO: 4255447 - DNA, 21 bp, Homo sapiens
ctgaactttgctgagcctgta

SEQ ID NO: 4255448 - DNA, 14 bp, Homo sapiens
ctgaagaagatggt

SEQ ID NO: 4255449 - DNA, 13 bp, Homo sapiens
ctgaataaagcaa

SEQ ID NO: 4255450 - DNA, 21 bp, Homo sapiens
ctgaggaaattgctttgtatt

SEQ ID NO: 4255451 - DNA, 14 bp, Homo sapiens
ctgaggctgaggca

SEQ ID NO: 4255452 - DNA, 18 bp, Homo sapiens
ctgaggggctaccaggaa

SEQ ID NO: 4255453 - DNA, 16 bp, Homo sapiens
ctgatggagaaggaag

SEQ ID NO: 4255454 - DNA, 17 bp, Homo sapiens
ctgcagtctctatacca

SEQ ID NO: 4255455 - DNA, 13 bp, Homo sapiens
ctgccacctgtct

SEQ ID NO: 4255456 - DNA, 18 bp, Homo sapiens
ctgccacctgtctgtctg

SEQ ID NO: 4255457 - DNA, 16 bp, Homo sapiens
ctgccctgccacctgt

SEQ ID NO: 4255458 - DNA, 20 bp, Homo sapiens
ctgccctgccacctgtctgt

SEQ ID NO: 4255459 - DNA, 21 bp, Homo sapiens
ctgccctgccacctgtctgtc

SEQ ID NO: 4255460 - DNA, 11 bp, Homo sapiens
ctgccctgccc

SEQ ID NO: 4255461 - DNA, 14 bp, Homo sapiens
ctgccctgccctgc

SEQ ID NO: 4255462 - DNA, 14 bp, Homo sapiens
ctgcctcccttcat

SEQ ID NO: 4255463 - DNA, 15 bp, Homo sapiens
ctgcctcccttcatg

SEQ ID NO: 4255464 - DNA, 18 bp, Homo sapiens
ctgcctcttccctcttcc

SEQ ID NO: 4255465 - DNA, 13 bp, Homo sapiens
ctgctgcctgcct

SEQ ID NO: 4255466 - DNA, 12 bp, Homo sapiens
ctgcttaattca

SEQ ID NO: 4255467 - DNA, 23 bp, Homo sapiens
ctggaaaagtatgttagtgcaaa

SEQ ID NO: 4255468 - DNA, 21 bp, Homo sapiens
ctggaaatcagggttagtatt

SEQ ID NO: 4255469 - DNA, 15 bp, Homo sapiens
ctggaaccatcagaa

SEQ ID NO: 4255470 - DNA, 17 bp, Homo sapiens
ctggacttggcccctgc

SEQ ID NO: 4255471 - DNA, 20 bp, Homo sapiens
ctggagatgaggccagacca

SEQ ID NO: 4255472 - DNA, 14 bp, Homo sapiens
ctggagtgcagtgg

SEQ ID NO: 4255473 - DNA, 13 bp, Homo sapiens
ctggattccagag

SEQ ID NO: 4255474 - DNA, 23 bp, Homo sapiens
ctggccccaccctcgtggacacc

SEQ ID NO: 4255475 - DNA, 23 bp, Homo sapiens
ctgggactataggcatgcgccac

SEQ ID NO: 4255476 - DNA, 18 bp, Homo sapiens
ctgggacttgcaaaaagg

SEQ ID NO: 4255477 - DNA, 17 bp, Homo sapiens
ctgggtaggaaagagga

SEQ ID NO: 4255478 - DNA, 21 bp, Homo sapiens
ctggtatgaacttgaggacac

SEQ ID NO: 4255479 - DNA, 13 bp, Homo sapiens
ctgtaaaactaag

SEQ ID NO: 4255480 - DNA, 20 bp, Homo sapiens
ctgtaagaaaatatcacttg

SEQ ID NO: 4255481 - DNA, 16 bp, Homo sapiens
ctgtattttaaaagaa

SEQ ID NO: 4255482 - DNA, 19 bp, Homo sapiens
ctgtattttaaaagaatga

SEQ ID NO: 4255483 - DNA, 20 bp, Homo sapiens
ctgtctacactaagagagaa

SEQ ID NO: 4255484 - DNA, 15 bp, Homo sapiens
ctgtctgtctgtccc

SEQ ID NO: 4255485 - DNA, 19 bp, Homo sapiens
ctgttttataattttgtga

SEQ ID NO: 4255486 - DNA, 13 bp, Homo sapiens
cttaattcaaata

SEQ ID NO: 4255487 - DNA, 19 bp, Homo sapiens
cttagatgcagttctgaag

SEQ ID NO: 4255488 - DNA, 13 bp, Homo sapiens
cttatagtacatg

SEQ ID NO: 4255489 - DNA, 17 bp, Homo sapiens
cttcaaatccttgaaga

SEQ ID NO: 4255490 - DNA, 21 bp, Homo sapiens
cttcagtctctataccaataa

SEQ ID NO: 4255491 - DNA, 12 bp, Homo sapiens
cttcatctggaa

SEQ ID NO: 4255492 - DNA, 21 bp, Homo sapiens
cttcatgcatggaaattccct

SEQ ID NO: 4255493 - DNA, 12 bp, Homo sapiens
cttccacccagt

SEQ ID NO: 4255494 - DNA, 14 bp, Homo sapiens
cttccacccagtgc

SEQ ID NO: 4255495 - DNA, 19 bp, Homo sapiens
cttccagatcctggaaatc

SEQ ID NO: 4255496 - DNA, 17 bp, Homo sapiens
cttccctatctttgcca

SEQ ID NO: 4255497 - DNA, 22 bp, Homo sapiens
cttccctatctttgccaccctc

SEQ ID NO: 4255498 - DNA, 23 bp, Homo sapiens
cttccctggaaaccttccaccca

SEQ ID NO: 4255499 - DNA, 18 bp, Homo sapiens
cttctatacccacccaga

SEQ ID NO: 4255500 - DNA, 19 bp, Homo sapiens
cttctcagatttctgagga

SEQ ID NO: 4255501 - DNA, 19 bp, Homo sapiens
cttctccatggccctgcca

SEQ ID NO: 4255502 - DNA, 20 bp, Homo sapiens
cttcttttttcaaaagaaag

SEQ ID NO: 4255503 - DNA, 12 bp, Homo sapiens
cttgaggacaca

SEQ ID NO: 4255504 - DNA, 13 bp, Homo sapiens
cttgaggacacat

SEQ ID NO: 4255505 - DNA, 14 bp, Homo sapiens
cttgaggacacatg

SEQ ID NO: 4255506 - DNA, 18 bp, Homo sapiens
cttgaggacacatgtcca

SEQ ID NO: 4255507 - DNA, 13 bp, Homo sapiens
cttgatgaagaag

SEQ ID NO: 4255508 - DNA, 18 bp, Homo sapiens
cttggccatgcagaaagc

SEQ ID NO: 4255509 - DNA, 23 bp, Homo sapiens
cttgtgatccactcgcctcagcc

SEQ ID NO: 4255510 - DNA, 20 bp, Homo sapiens
ctttgacctgcctcccttca

SEQ ID NO: 4255511 - DNA, 17 bp, Homo sapiens
ctttgccaccctcatgc

SEQ ID NO: 4255512 - DNA, 24 bp, Homo sapiens
ctttggcaggtgcagcccccactg

SEQ ID NO: 4255513 - DNA, 14 bp, Homo sapiens
ctttggctgcatgc

SEQ ID NO: 4255514 - DNA, 16 bp, Homo sapiens
ctttggctgcatgcga

SEQ ID NO: 4255515 - DNA, 22 bp, Homo sapiens
cttttaactgttgtagaagaca

SEQ ID NO: 4255516 - DNA, 12 bp, Homo sapiens
ctttttgcagct

SEQ ID NO: 4255517 - DNA, 13 bp, Homo sapiens
ctttttgcagctt

SEQ ID NO: 4255518 - DNA, 14 bp, Homo sapiens
ctttttgcagcttt

SEQ ID NO: 4255519 - DNA, 16 bp, Homo sapiens
gaaaagcagacatttt

SEQ ID NO: 4255520 - DNA, 20 bp, Homo sapiens
gaaaagtatgttagtgcaaa

SEQ ID NO: 4255521 - DNA, 12 bp, Homo sapiens
gaaaatatcact

SEQ ID NO: 4255522 - DNA, 13 bp, Homo sapiens
gaaaatttttgta

SEQ ID NO: 4255523 - DNA, 16 bp, Homo sapiens
gaaaatttttgtagta

SEQ ID NO: 4255524 - DNA, 16 bp, Homo sapiens
gaaacacaactatatt

SEQ ID NO: 4255525 - DNA, 23 bp, Homo sapiens
gaaacttcagcggtttatataag

SEQ ID NO: 4255526 - DNA, 13 bp, Homo sapiens
gaaagaggaagca

SEQ ID NO: 4255527 - DNA, 17 bp, Homo sapiens
gaaagcgcctccaaccc

SEQ ID NO: 4255528 - DNA, 20 bp, Homo sapiens
gaaagtcagccatatctcca

SEQ ID NO: 4255529 - DNA, 13 bp, Homo sapiens
gaaatattatgtt

SEQ ID NO: 4255530 - DNA, 13 bp, Homo sapiens
gaaatatttattt

SEQ ID NO: 4255531 - DNA, 22 bp, Homo sapiens
gaaattatgtgacattttacat

SEQ ID NO: 4255532 - DNA, 18 bp, Homo sapiens
gaaattgctttgtattgt

SEQ ID NO: 4255533 - DNA, 19 bp, Homo sapiens
gaaccaataaaataatttt

SEQ ID NO: 4255534 - DNA, 14 bp, Homo sapiens
gaactgaaatcata

SEQ ID NO: 4255535 - DNA, 14 bp, Homo sapiens
gaacttgaggacac

SEQ ID NO: 4255536 - DNA, 17 bp, Homo sapiens
gaacttgaggacacatg

SEQ ID NO: 4255537 - DNA, 21 bp, Homo sapiens
gaagaagcaccaatcatgaat

SEQ ID NO: 4255538 - DNA, 14 bp, Homo sapiens
gaagagaaggagca

SEQ ID NO: 4255539 - DNA, 14 bp, Homo sapiens
gaagatcccccaga

SEQ ID NO: 4255540 - DNA, 18 bp, Homo sapiens
gaagatcccccagaaaag

SEQ ID NO: 4255541 - DNA, 18 bp, Homo sapiens
gaaggaaggcagggagga

SEQ ID NO: 4255542 - DNA, 13 bp, Homo sapiens
gaaggaggaccca

SEQ ID NO: 4255543 - DNA, 14 bp, Homo sapiens
gaaggaggacccag

SEQ ID NO: 4255544 - DNA, 13 bp, Homo sapiens
gaagggcaagttt

SEQ ID NO: 4255545 - DNA, 22 bp, Homo sapiens
gaagtccaagcatttagatgta

SEQ ID NO: 4255546 - DNA, 12 bp, Homo sapiens
cattctggaagt

SEQ ID NO: 4255547 - DNA, 21 bp, Homo sapiens
cattgacctatttccagaaat

SEQ ID NO: 4255548 - DNA, 19 bp, Homo sapiens
catttgtataaaataattt

SEQ ID NO: 4255549 - DNA, 19 bp, Homo sapiens
cattttttgggcagcaatt

SEQ ID NO: 4255550 - DNA, 11 bp, Homo sapiens
ccaaaccactt

SEQ ID NO: 4255551 - DNA, 22 bp, Homo sapiens
ccaaaccactttttgcagcttt

SEQ ID NO: 4255552 - DNA, 14 bp, Homo sapiens
ccacctctcaatat

SEQ ID NO: 4255553 - DNA, 11 bp, Homo sapiens
ccacctgtctg

SEQ ID NO: 4255554 - DNA, 12 bp, Homo sapiens
ccacctgtctgt

SEQ ID NO: 4255555 - DNA, 14 bp, Homo sapiens
ccacctgtctgtct

SEQ ID NO: 4255556 - DNA, 14 bp, Homo sapiens
ccactgcctttgac

SEQ ID NO: 4255557 - DNA, 22 bp, Homo sapiens
ccactgcctttgacctgcctcc

SEQ ID NO: 4255558 - DNA, 13 bp, Homo sapiens
ccactttttgcag

SEQ ID NO: 4255559 - DNA, 14 bp, Homo sapiens
ccactttttgcagc

SEQ ID NO: 4255560 - DNA, 15 bp, Homo sapiens
ccactttttgcagct

SEQ ID NO: 4255561 - DNA, 14 bp, Homo sapiens
ccagagactttagg

SEQ ID NO: 4255562 - DNA, 18 bp, Homo sapiens
ccagcagatttccagcct

SEQ ID NO: 4255563 - DNA, 13 bp, Homo sapiens
ccagcttttccca

SEQ ID NO: 4255564 - DNA, 22 bp, Homo sapiens
ccagtgctgaatttccctctct

SEQ ID NO: 4255565 - DNA, 23 bp, Homo sapiens
ccagtgggaggtgagaccacctc

SEQ ID NO: 4255566 - DNA, 18 bp, Homo sapiens
ccatcagaaacaccctca

SEQ ID NO: 4255567 - DNA, 20 bp, Homo sapiens
ccatcagaaacaccctcaca

SEQ ID NO: 4255568 - DNA, 20 bp, Homo sapiens
ccatggacactacacccagc

SEQ ID NO: 4255569 - DNA, 18 bp, Homo sapiens
ccatgggcactgtgggta

SEQ ID NO: 4255570 - DNA, 13 bp, Homo sapiens
ccattcattccat

SEQ ID NO: 4255571 - DNA, 12 bp, Homo sapiens
ccattctggaag

SEQ ID NO: 4255572 - DNA, 20 bp, Homo sapiens
cccaccctcgtggacacctg

SEQ ID NO: 4255573 - DNA, 15 bp, Homo sapiens
cccacttcagcctcc

SEQ ID NO: 4255574 - DNA, 18 bp, Homo sapiens
cccagaatgagacatcca

SEQ ID NO: 4255575 - DNA, 13 bp, Homo sapiens
cccagccatccag

SEQ ID NO: 4255576 - DNA, 15 bp, Homo sapiens
cccagtatctcttca

SEQ ID NO: 4255577 - DNA, 22 bp, Homo sapiens
ccccaccctcgtggacacctgc

SEQ ID NO: 4255578 - DNA, 17 bp, Homo sapiens
cccccactgcctttgac

SEQ ID NO: 4255579 - DNA, 20 bp, Homo sapiens
cccctaaaagaaaccctgca

SEQ ID NO: 4255580 - DNA, 15 bp, Homo sapiens
cccctagcctgcctc

SEQ ID NO: 4255581 - DNA, 17 bp, Homo sapiens
cccctccactctttctt

SEQ ID NO: 4255582 - DNA, 18 bp, Homo sapiens
cccctggtccctctgcag

SEQ ID NO: 4255583 - DNA, 19 bp, Homo sapiens
ccctaaataataaaaataa

SEQ ID NO: 4255584 - DNA, 16 bp, Homo sapiens
ccctatctttgccacc

SEQ ID NO: 4255585 - DNA, 19 bp, Homo sapiens
ccctatctttgccaccctc

SEQ ID NO: 4255586 - DNA, 12 bp, Homo sapiens
ccctcacactgg

SEQ ID NO: 4255587 - DNA, 12 bp, Homo sapiens
ccctcatgctgt

SEQ ID NO: 4255588 - DNA, 21 bp, Homo sapiens
ccctccaccgcagaaggaagg

SEQ ID NO: 4255589 - DNA, 15 bp, Homo sapiens
ccctccctaccctaa

SEQ ID NO: 4255590 - DNA, 19 bp, Homo sapiens
ccctcgtggacacctgccc

SEQ ID NO: 4255591 - DNA, 23 bp, Homo sapiens
ccctcgtggacacctgccctgcc

SEQ ID NO: 4255592 - DNA, 13 bp, Homo sapiens
ccctcttccttcc

SEQ ID NO: 4255593 - DNA, 14 bp, Homo sapiens
ccctgccacctcct

SEQ ID NO: 4255594 - DNA, 18 bp, Homo sapiens
ccctgccacctcctgcct

SEQ ID NO: 4255595 - DNA, 15 bp, Homo sapiens
ccctgccctgccacc

SEQ ID NO: 4255596 - DNA, 13 bp, Homo sapiens
ccctgctgctgcc

SEQ ID NO: 4255597 - DNA, 15 bp, Homo sapiens
ccctggaaaccttcc

SEQ ID NO: 4255598 - DNA, 21 bp, Homo sapiens
ccctggaaaccttccacccag

SEQ ID NO: 4255599 - DNA, 16 bp, Homo sapiens
cccttcatctggaacc

SEQ ID NO: 4255600 - DNA, 19 bp, Homo sapiens
cccttctatacccacccag

SEQ ID NO: 4255601 - DNA, 13 bp, Homo sapiens
ccgcagaaggaag

SEQ ID NO: 4255602 - DNA, 15 bp, Homo sapiens
ccgcagaaggaaggc

SEQ ID NO: 4255603 - DNA, 19 bp, Homo sapiens
cctaaataataaaaataaa

SEQ ID NO: 4255604 - DNA, 15 bp, Homo sapiens
cctaccctaaccaag

SEQ ID NO: 4255605 - DNA, 18 bp, Homo sapiens
cctaccctaaccaagttc

SEQ ID NO: 4255606 - DNA, 12 bp, Homo sapiens
cctatctttgcc

SEQ ID NO: 4255607 - DNA, 19 bp, Homo sapiens
cctatctttgccaccctca

SEQ ID NO: 4255608 - DNA, 21 bp, Homo sapiens
cctattcaacacacacatgct

SEQ ID NO: 4255609 - DNA, 13 bp, Homo sapiens
cctcaacctcatc

SEQ ID NO: 4255610 - DNA, 20 bp, Homo sapiens
cctcagaaaacaaggatgaa

SEQ ID NO: 4255611 - DNA, 17 bp, Homo sapiens
cctcagctctcagttgc

SEQ ID NO: 4255612 - DNA, 19 bp, Homo sapiens
cctccaaccctagcaaaag

SEQ ID NO: 4255613 - DNA, 21 bp, Homo sapiens
cctccctcaacctcatcctct

SEQ ID NO: 4255614 - DNA, 16 bp, Homo sapiens
cctcgtggacacctgc

SEQ ID NO: 4255615 - DNA, 20 bp, Homo sapiens
cctcgtggacacctgccctg

SEQ ID NO: 4255616 - DNA, 20 bp, Homo sapiens
cctctcaatattcaataaag

SEQ ID NO: 4255617 - DNA, 16 bp, Homo sapiens
cctctgcagtctctat

SEQ ID NO: 4255618 - DNA, 23 bp, Homo sapiens
cctgaccccaagttatccacctg

SEQ ID NO: 4255619 - DNA, 14 bp, Homo sapiens
cctgccacctcctg

SEQ ID NO: 4255620 - DNA, 16 bp, Homo sapiens
cctgccacctcctgcc

SEQ ID NO: 4255621 - DNA, 17 bp, Homo sapiens
cctgccacctcctgcct

SEQ ID NO: 4255622 - DNA, 14 bp, Homo sapiens
cctgccacctgtct

SEQ ID NO: 4255623 - DNA, 15 bp, Homo sapiens
cctgccacctgtctg

SEQ ID NO: 4255624 - DNA, 12 bp, Homo sapiens
cctgccctgcca

SEQ ID NO: 4255625 - DNA, 15 bp, Homo sapiens
cctgccctgccacct

SEQ ID NO: 4255626 - DNA, 15 bp, Homo sapiens
cctgctgctgcctgc

SEQ ID NO: 4255627 - DNA, 16 bp, Homo sapiens
cctgctgctgcctgcc

SEQ ID NO: 4255628 - DNA, 18 bp, Homo sapiens
cctggaaaccttccaccc

SEQ ID NO: 4255629 - DNA, 20 bp, Homo sapiens
cctggaaaccttccacccag

SEQ ID NO: 4255630 - DNA, 19 bp, Homo sapiens
cctggacttggcccctgcc

SEQ ID NO: 4255631 - DNA, 20 bp, Homo sapiens
cctggtgcactggccccacc

SEQ ID NO: 4255632 - DNA, 21 bp, Homo sapiens
cctgtctgtctgtctgtccca

SEQ ID NO: 4255633 - DNA, 22 bp, Homo sapiens
cctgtctgtctgtctgtcccaa

SEQ ID NO: 4255634 - DNA, 13 bp, Homo sapiens
ccttcatctggaa

SEQ ID NO: 4255635 - DNA, 12 bp, Homo sapiens
ccttcatgcatg

SEQ ID NO: 4255636 - DNA, 21 bp, Homo sapiens
ccttcatgcatggaaattccc

SEQ ID NO: 4255637 - DNA, 13 bp, Homo sapiens
ccttccctgctgt

SEQ ID NO: 4255638 - DNA, 18 bp, Homo sapiens
ccttctatacccacccag

SEQ ID NO: 4255639 - DNA, 22 bp, Homo sapiens
ccttctccatggccctgccatg

SEQ ID NO: 4255640 - DNA, 15 bp, Homo sapiens
ccttggccatgcaga

SEQ ID NO: 4255641 - DNA, 16 bp, Homo sapiens
cctttgacctgcctcc

SEQ ID NO: 4255642 - DNA, 22 bp, Homo sapiens
cctttgacctgcctcccttcat

SEQ ID NO: 4255643 - DNA, 20 bp, Homo sapiens
cctttggcaggtgcagcccc

SEQ ID NO: 4255644 - DNA, 12 bp, Homo sapiens
ccttttcccaac

SEQ ID NO: 4255645 - DNA, 17 bp, Homo sapiens
cgactgaaaatattgtt

SEQ ID NO: 4255646 - DNA, 20 bp, Homo sapiens
cgagataccccacctccctc

SEQ ID NO: 4255647 - DNA, 23 bp, Homo sapiens
cgaggcctattgttgaataaatg

SEQ ID NO: 4255648 - DNA, 16 bp, Homo sapiens
cgcacggcagccacag

SEQ ID NO: 4255649 - DNA, 12 bp, Homo sapiens
cgcagaaggaag

SEQ ID NO: 4255650 - DNA, 14 bp, Homo sapiens
cgcgatctcagctc

SEQ ID NO: 4255651 - DNA, 22 bp, Homo sapiens
cggaagaagagatcaggaagag

SEQ ID NO: 4255652 - DNA, 16 bp, Homo sapiens
cggcttgccacacccc

SEQ ID NO: 4255653 - DNA, 15 bp, Homo sapiens
cggtttatataagct

SEQ ID NO: 4255654 - DNA, 17 bp, Homo sapiens
cgtgatccacccgcctc

SEQ ID NO: 4255655 - DNA, 13 bp, Homo sapiens
cgtggacacctgc

SEQ ID NO: 4255656 - DNA, 14 bp, Homo sapiens
cgtggacacctgcc

SEQ ID NO: 4255657 - DNA, 15 bp, Homo sapiens
cgtggacacctgccc

SEQ ID NO: 4255658 - DNA, 17 bp, Homo sapiens
cgtggacacctgccctg

SEQ ID NO: 4255659 - DNA, 18 bp, Homo sapiens
cgtttggtgcttctcaga

SEQ ID NO: 4255660 - DNA, 19 bp, Homo sapiens
ctaagtccagtgtttcttt

SEQ ID NO: 4255661 - DNA, 13 bp, Homo sapiens
ctaatttttttgt

SEQ ID NO: 4255662 - DNA, 14 bp, Homo sapiens
ctacacccagcaat

SEQ ID NO: 4255663 - DNA, 12 bp, Homo sapiens
ctaccaggaaag

SEQ ID NO: 4255664 - DNA, 22 bp, Homo sapiens
ctagtatttctatgaaatatta

SEQ ID NO: 4255665 - DNA, 14 bp, Homo sapiens
ctagtcaccagaga

SEQ ID NO: 4255666 - DNA, 23 bp, Homo sapiens
ctagttgatcagcttattgtcta

SEQ ID NO: 4255667 - DNA, 13 bp, Homo sapiens
ctataccaataaa

SEQ ID NO: 4255668 - DNA, 12 bp, Homo sapiens
ctatctttgcca

SEQ ID NO: 4255669 - DNA, 15 bp, Homo sapiens
ctatctttgccaccc

SEQ ID NO: 4255670 - DNA, 15 bp, Homo sapiens
ctattgttgaataaa

SEQ ID NO: 4255671 - DNA, 12 bp, Homo sapiens
ctcaacctcatc

SEQ ID NO: 4255672 - DNA, 13 bp, Homo sapiens
ctcaacctcatcc

SEQ ID NO: 4255673 - DNA, 16 bp, Homo sapiens
ctcaatattcaataaa

SEQ ID NO: 4255674 - DNA, 15 bp, Homo sapiens
agtcaaaaattaaac

SEQ ID NO: 4255675 - DNA, 14 bp, Homo sapiens
agtcaccagagact

SEQ ID NO: 4255676 - DNA, 14 bp, Homo sapiens
agtcacctcatgga

SEQ ID NO: 4255677 - DNA, 21 bp, Homo sapiens
agtccaagcatttagatgtat

SEQ ID NO: 4255678 - DNA, 18 bp, Homo sapiens
agtcttactctgttgcca

SEQ ID NO: 4255679 - DNA, 12 bp, Homo sapiens
agtgagaggctg

SEQ ID NO: 4255680 - DNA, 14 bp, Homo sapiens
agtgatcaaactac

SEQ ID NO: 4255681 - DNA, 18 bp, Homo sapiens
agtgcaaattgtcacagg

SEQ ID NO: 4255682 - DNA, 21 bp, Homo sapiens
agtgcaaattgtcacaggaca

SEQ ID NO: 4255683 - DNA, 13 bp, Homo sapiens
agtggacaggagt

SEQ ID NO: 4255684 - DNA, 20 bp, Homo sapiens
agtggcatcatctcagctca

SEQ ID NO: 4255685 - DNA, 19 bp, Homo sapiens
agtggcgtgatctcagctc

SEQ ID NO: 4255686 - DNA, 16 bp, Homo sapiens
agtgttggagaagaac

SEQ ID NO: 4255687 - DNA, 14 bp, Homo sapiens
agttctgaagaaga

SEQ ID NO: 4255688 - DNA, 16 bp, Homo sapiens
agttctgaagaagatg

SEQ ID NO: 4255689 - DNA, 23 bp, Homo sapiens
agttcttactgcttaattcaaat

SEQ ID NO: 4255690 - DNA, 15 bp, Homo sapiens
agttgacttatagta

SEQ ID NO: 4255691 - DNA, 18 bp, Homo sapiens
agttgacttatagtacat

SEQ ID NO: 4255692 - DNA, 14 bp, Homo sapiens
ataaaggactgtaa

SEQ ID NO: 4255693 - DNA, 16 bp, Homo sapiens
ataaatgtatctgaat

SEQ ID NO: 4255694 - DNA, 17 bp, Homo sapiens
ataacaatgctgtattt

SEQ ID NO: 4255695 - DNA, 21 bp, Homo sapiens
ataacaatgctgtattttaaa

SEQ ID NO: 4255696 - DNA, 13 bp, Homo sapiens
ataataaaggact

SEQ ID NO: 4255697 - DNA, 18 bp, Homo sapiens
ataatgtttcaaacatat

SEQ ID NO: 4255698 - DNA, 13 bp, Homo sapiens
ataattttgtgaa

SEQ ID NO: 4255699 - DNA, 20 bp, Homo sapiens
ataattttgtgaagcaaaat

SEQ ID NO: 4255700 - DNA, 14 bp, Homo sapiens
ataatttttatatt

SEQ ID NO: 4255701 - DNA, 13 bp, Homo sapiens
ataccaataaagt

SEQ ID NO: 4255702 - DNA, 15 bp, Homo sapiens
ataccaataaagtga

SEQ ID NO: 4255703 - DNA, 14 bp, Homo sapiens
atactatagtacca

SEQ ID NO: 4255704 - DNA, 14 bp, Homo sapiens
atagacaattgagg

SEQ ID NO: 4255705 - DNA, 21 bp, Homo sapiens
atagacaattgaggtaagttt

SEQ ID NO: 4255706 - DNA, 12 bp, Homo sapiens
atagacacgcac

SEQ ID NO: 4255707 - DNA, 14 bp, Homo sapiens
atagtcaaattgtg

SEQ ID NO: 4255708 - DNA, 14 bp, Homo sapiens
atagtctctttaaa

SEQ ID NO: 4255709 - DNA, 14 bp, Homo sapiens
atatataacaatgc

SEQ ID NO: 4255710 - DNA, 18 bp, Homo sapiens
atatataacaatgctgta

SEQ ID NO: 4255711 - DNA, 23 bp, Homo sapiens
atatgcttctgttttataatttt

SEQ ID NO: 4255712 - DNA, 15 bp, Homo sapiens
atatttattttaata

SEQ ID NO: 4255713 - DNA, 17 bp, Homo sapiens
atatttattttaataat

SEQ ID NO: 4255714 - DNA, 18 bp, Homo sapiens
atatttattttaataatg

SEQ ID NO: 4255715 - DNA, 23 bp, Homo sapiens
atatttcagataatcacaataca

SEQ ID NO: 4255716 - DNA, 14 bp, Homo sapiens
atcactgaactttg

SEQ ID NO: 4255717 - DNA, 22 bp, Homo sapiens
atcacttgtcaataaaatccat

SEQ ID NO: 4255718 - DNA, 15 bp, Homo sapiens
atcatctatagaaag

SEQ ID NO: 4255719 - DNA, 19 bp, Homo sapiens
atcatctatagaaagctat

SEQ ID NO: 4255720 - DNA, 14 bp, Homo sapiens
atcatctcagctca

SEQ ID NO: 4255721 - DNA, 19 bp, Homo sapiens
atcatctcagctcactgca

SEQ ID NO: 4255722 - DNA, 20 bp, Homo sapiens
atccacccgcctcagcctcc

SEQ ID NO: 4255723 - DNA, 19 bp, Homo sapiens
atccagcctggggctgagg

SEQ ID NO: 4255724 - DNA, 17 bp, Homo sapiens
atccagggggcaagagg

SEQ ID NO: 4255725 - DNA, 15 bp, Homo sapiens
atccagtaaaataat

SEQ ID NO: 4255726 - DNA, 21 bp, Homo sapiens
atcctctccacagctgcctct

SEQ ID NO: 4255727 - DNA, 17 bp, Homo sapiens
atctatagaaagctata

SEQ ID NO: 4255728 - DNA, 16 bp, Homo sapiens
atctcaattcttccct

SEQ ID NO: 4255729 - DNA, 11 bp, Homo sapiens
atctcagctca

SEQ ID NO: 4255730 - DNA, 14 bp, Homo sapiens
atctcatttccaag

SEQ ID NO: 4255731 - DNA, 15 bp, Homo sapiens
atctggattccagag

SEQ ID NO: 4255732 - DNA, 14 bp, Homo sapiens
atctttgccaccct

SEQ ID NO: 4255733 - DNA, 15 bp, Homo sapiens
atctttgccaccctc

SEQ ID NO: 4255734 - DNA, 16 bp, Homo sapiens
atctttgccaccctca

SEQ ID NO: 4255735 - DNA, 18 bp, Homo sapiens
atgaaatattatgttaaa

SEQ ID NO: 4255736 - DNA, 16 bp, Homo sapiens
atgaacttgaggacac

SEQ ID NO: 4255737 - DNA, 19 bp, Homo sapiens
atgaacttgaggacacatg

SEQ ID NO: 4255738 - DNA, 20 bp, Homo sapiens
atgaacttgaggacacatgt

SEQ ID NO: 4255739 - DNA, 21 bp, Homo sapiens
atgaacttgaggacacatgtc

SEQ ID NO: 4255740 - DNA, 17 bp, Homo sapiens
atgaattacatttgtat

SEQ ID NO: 4255741 - DNA, 18 bp, Homo sapiens
atgaattacatttgtata

SEQ ID NO: 4255742 - DNA, 22 bp, Homo sapiens
atgaattacatttgtataaaat

SEQ ID NO: 4255743 - DNA, 13 bp, Homo sapiens
atgaccagtaaag

SEQ ID NO: 4255744 - DNA, 13 bp, Homo sapiens
atgagagacacac

SEQ ID NO: 4255745 - DNA, 23 bp, Homo sapiens
atgagagacacactgaagaagca

SEQ ID NO: 4255746 - DNA, 14 bp, Homo sapiens
atgataactggaaa

SEQ ID NO: 4255747 - DNA, 19 bp, Homo sapiens
atgattgaattatatgttc

SEQ ID NO: 4255748 - DNA, 14 bp, Homo sapiens
atgctgtattttaa

SEQ ID NO: 4255749 - DNA, 19 bp, Homo sapiens
atgctgtattttaaaagaa

SEQ ID NO: 4255750 - DNA, 23 bp, Homo sapiens
atgctgtattttaaaagaatgat

SEQ ID NO: 4255751 - DNA, 23 bp, Homo sapiens
atgctgtctacactaagagagaa

SEQ ID NO: 4255752 - DNA, 21 bp, Homo sapiens
atgcttctgttttataatttt

SEQ ID NO: 4255753 - DNA, 17 bp, Homo sapiens
atggacactacacccag

SEQ ID NO: 4255754 - DNA, 15 bp, Homo sapiens
atggagaaggaaggc

SEQ ID NO: 4255755 - DNA, 14 bp, Homo sapiens
atggaggggcagag

SEQ ID NO: 4255756 - DNA, 14 bp, Homo sapiens
atggcactagtatt

SEQ ID NO: 4255757 - DNA, 23 bp, Homo sapiens
atggcttcctggcaatagtcaaa

SEQ ID NO: 4255758 - DNA, 21 bp, Homo sapiens
atggttcccttgatgaagaag

SEQ ID NO: 4255759 - DNA, 16 bp, Homo sapiens
atgtaccgtaggcttt

SEQ ID NO: 4255760 - DNA, 21 bp, Homo sapiens
atgtcaatcagcctagttgat

SEQ ID NO: 4255761 - DNA, 18 bp, Homo sapiens
atgttatgactatgtaaa

SEQ ID NO: 4255762 - DNA, 18 bp, Homo sapiens
atgtttcaaacatatata

SEQ ID NO: 4255763 - DNA, 21 bp, Homo sapiens
atgttttcaggctagatgtat

SEQ ID NO: 4255764 - DNA, 19 bp, Homo sapiens
attaaattttttttacatt

SEQ ID NO: 4255765 - DNA, 15 bp, Homo sapiens
attaagtaatgataa

SEQ ID NO: 4255766 - DNA, 17 bp, Homo sapiens
attacaacggagtcaaa

SEQ ID NO: 4255767 - DNA, 15 bp, Homo sapiens
attacatttgtataa

SEQ ID NO: 4255768 - DNA, 13 bp, Homo sapiens
attacgtgctctg

SEQ ID NO: 4255769 - DNA, 15 bp, Homo sapiens
attactgtaagaaaa

SEQ ID NO: 4255770 - DNA, 18 bp, Homo sapiens
attagcagtccctccaca

SEQ ID NO: 4255771 - DNA, 18 bp, Homo sapiens
attagtaagctagcaaat

SEQ ID NO: 4255772 - DNA, 22 bp, Homo sapiens
attatgaattacatttgtataa

SEQ ID NO: 4255773 - DNA, 20 bp, Homo sapiens
attatgtgacattttacatt

SEQ ID NO: 4255774 - DNA, 21 bp, Homo sapiens
attatgttaaaactgggacag

SEQ ID NO: 4255775 - DNA, 17 bp, Homo sapiens
attcattccattctgga

SEQ ID NO: 4255776 - DNA, 21 bp, Homo sapiens
attccattctggaagtgactt

SEQ ID NO: 4255777 - DNA, 19 bp, Homo sapiens
attcccttcatctggaacc

SEQ ID NO: 4255778 - DNA, 22 bp, Homo sapiens
attgacctatttccagaaatac

SEQ ID NO: 4255779 - DNA, 18 bp, Homo sapiens
attgactttttatggcac

SEQ ID NO: 4255780 - DNA, 20 bp, Homo sapiens
attgagaaaaatatatacta

SEQ ID NO: 4255781 - DNA, 16 bp, Homo sapiens
attgaggtaagttttt

SEQ ID NO: 4255782 - DNA, 21 bp, Homo sapiens
attgttgaataaatgtatctg

SEQ ID NO: 4255783 - DNA, 14 bp, Homo sapiens
attgttttacaata

SEQ ID NO: 4255784 - DNA, 16 bp, Homo sapiens
atttaggaagttgact

SEQ ID NO: 4255785 - DNA, 16 bp, Homo sapiens
atttagttgtaaacca

SEQ ID NO: 4255786 - DNA, 19 bp, Homo sapiens
atttattttaataatgttt

SEQ ID NO: 4255787 - DNA, 18 bp, Homo sapiens
atttctatgaaatattat

SEQ ID NO: 4255788 - DNA, 14 bp, Homo sapiens
atttgctcatggaa

SEQ ID NO: 4255789 - DNA, 15 bp, Homo sapiens
atttgtataaaataa

SEQ ID NO: 4255790 - DNA, 19 bp, Homo sapiens
atttgtataaaataatttt

SEQ ID NO: 4255791 - DNA, 21 bp, Homo sapiens
atttgtataaaataattttta

SEQ ID NO: 4255792 - DNA, 23 bp, Homo sapiens
attttaaaagaatgattatgaat

SEQ ID NO: 4255793 - DNA, 12 bp, Homo sapiens
attttacattaa

SEQ ID NO: 4255794 - DNA, 15 bp, Homo sapiens
attttacattaaatt

SEQ ID NO: 4255795 - DNA, 14 bp, Homo sapiens
attttcctgaaaac

SEQ ID NO: 4255796 - DNA, 23 bp, Homo sapiens
attttttctctaggaaatattta

SEQ ID NO: 4255797 - DNA, 19 bp, Homo sapiens
atttttttcccaattgaga

SEQ ID NO: 4255798 - DNA, 14 bp, Homo sapiens
attttttttacatt

SEQ ID NO: 4255799 - DNA, 11 bp, Homo sapiens
caaaaaactac

SEQ ID NO: 4255800 - DNA, 17 bp, Homo sapiens
caaactgactcttaaga

SEQ ID NO: 4255801 - DNA, 15 bp, Homo sapiens
accgcagaaggaagg

SEQ ID NO: 4255802 - DNA, 16 bp, Homo sapiens
acctagggtgatatta

SEQ ID NO: 4255803 - DNA, 21 bp, Homo sapiens
acctagggtgatattaaccag

SEQ ID NO: 4255804 - DNA, 13 bp, Homo sapiens
acctcaatgtccc

SEQ ID NO: 4255805 - DNA, 17 bp, Homo sapiens
acctcgtgatccacccg

SEQ ID NO: 4255806 - DNA, 19 bp, Homo sapiens
acctctcaatattcaataa

SEQ ID NO: 4255807 - DNA, 20 bp, Homo sapiens
acctctcaatattcaataaa

SEQ ID NO: 4255808 - DNA, 18 bp, Homo sapiens
acctctgcctcagaaaac

SEQ ID NO: 4255809 - DNA, 20 bp, Homo sapiens
acctctgcctcagaaaacaa

SEQ ID NO: 4255810 - DNA, 18 bp, Homo sapiens
acctgccctgccctgcca

SEQ ID NO: 4255811 - DNA, 18 bp, Homo sapiens
acctgtctgtctgtctgt

SEQ ID NO: 4255812 - DNA, 17 bp, Homo sapiens
acgcacggcagccacag

SEQ ID NO: 4255813 - DNA, 21 bp, Homo sapiens
acggagtctcactctgtcacc

SEQ ID NO: 4255814 - DNA, 13 bp, Homo sapiens
actaagagagaat

SEQ ID NO: 4255815 - DNA, 16 bp, Homo sapiens
actacacccagcaata

SEQ ID NO: 4255816 - DNA, 23 bp, Homo sapiens
actacttcttttttcaaaagaaa

SEQ ID NO: 4255817 - DNA, 20 bp, Homo sapiens
actagagtttagctggaaaa

SEQ ID NO: 4255818 - DNA, 17 bp, Homo sapiens
actatctcatttccaag

SEQ ID NO: 4255819 - DNA, 21 bp, Homo sapiens
actccaaactgactcttaaga

SEQ ID NO: 4255820 - DNA, 14 bp, Homo sapiens
actccagaaagtga

SEQ ID NO: 4255821 - DNA, 19 bp, Homo sapiens
actcgttaatttgtagtgt

SEQ ID NO: 4255822 - DNA, 14 bp, Homo sapiens
actcttaagaagac

SEQ ID NO: 4255823 - DNA, 20 bp, Homo sapiens
actcttaagaagactgcatt

SEQ ID NO: 4255824 - DNA, 16 bp, Homo sapiens
actgaactttgctgag

SEQ ID NO: 4255825 - DNA, 14 bp, Homo sapiens
actgactcttaaga

SEQ ID NO: 4255826 - DNA, 16 bp, Homo sapiens
actgactcttaagaag

SEQ ID NO: 4255827 - DNA, 20 bp, Homo sapiens
actgcaacctccacctcgca

SEQ ID NO: 4255828 - DNA, 14 bp, Homo sapiens
actgcattatattt

SEQ ID NO: 4255829 - DNA, 15 bp, Homo sapiens
actgcattatattta

SEQ ID NO: 4255830 - DNA, 11 bp, Homo sapiens
actgcctttga

SEQ ID NO: 4255831 - DNA, 22 bp, Homo sapiens
actgtaatcttatttaggaagt

SEQ ID NO: 4255832 - DNA, 18 bp, Homo sapiens
acttatagtacatgataa

SEQ ID NO: 4255833 - DNA, 18 bp, Homo sapiens
acttcaaatccttgaaga

SEQ ID NO: 4255834 - DNA, 18 bp, Homo sapiens
acttcagcggtttatata

SEQ ID NO: 4255835 - DNA, 19 bp, Homo sapiens
acttcagcggtttatataa

SEQ ID NO: 4255836 - DNA, 20 bp, Homo sapiens
acttccagatcctggaaatc

SEQ ID NO: 4255837 - DNA, 21 bp, Homo sapiens
acttctcttgttaggtaattt

SEQ ID NO: 4255838 - DNA, 12 bp, Homo sapiens
acttgaggacac

SEQ ID NO: 4255839 - DNA, 16 bp, Homo sapiens
acttgaggacacatgt

SEQ ID NO: 4255840 - DNA, 17 bp, Homo sapiens
acttgaggacacatgtc

SEQ ID NO: 4255841 - DNA, 17 bp, Homo sapiens
acttgcaaaaagggtca

SEQ ID NO: 4255842 - DNA, 23 bp, Homo sapiens
acttgcaaaaagggtcagtatgg

SEQ ID NO: 4255843 - DNA, 16 bp, Homo sapiens
acttgtgttttgcaag

SEQ ID NO: 4255844 - DNA, 22 bp, Homo sapiens
actttttatggcactagtattt

SEQ ID NO: 4255845 - DNA, 12 bp, Homo sapiens
actttttgcagc

SEQ ID NO: 4255846 - DNA, 20 bp, Homo sapiens
agaaaatttttgtagtagcg

SEQ ID NO: 4255847 - DNA, 21 bp, Homo sapiens
agaaacttaaattttagttct

SEQ ID NO: 4255848 - DNA, 12 bp, Homo sapiens
agaacggaagaa

SEQ ID NO: 4255849 - DNA, 14 bp, Homo sapiens
agaagaactgaaat

SEQ ID NO: 4255850 - DNA, 21 bp, Homo sapiens
agaagactgcattatatttat

SEQ ID NO: 4255851 - DNA, 19 bp, Homo sapiens
agaaggaaggcagggagga

SEQ ID NO: 4255852 - DNA, 20 bp, Homo sapiens
agaaggaaggcagggaggag

SEQ ID NO: 4255853 - DNA, 17 bp, Homo sapiens
agaatgagagacacact

SEQ ID NO: 4255854 - DNA, 22 bp, Homo sapiens
agaatgagagacacactgaaga

SEQ ID NO: 4255855 - DNA, 20 bp, Homo sapiens
agacacgcacggcagccaca

SEQ ID NO: 4255856 - DNA, 20 bp, Homo sapiens
agacagaatctcagtctgtc

SEQ ID NO: 4255857 - DNA, 12 bp, Homo sapiens
agaccatggaca

SEQ ID NO: 4255858 - DNA, 17 bp, Homo sapiens
agagacacactgaagaa

SEQ ID NO: 4255859 - DNA, 12 bp, Homo sapiens
agagcactgctc

SEQ ID NO: 4255860 - DNA, 17 bp, Homo sapiens
agagctgatggagaagg

SEQ ID NO: 4255861 - DNA, 18 bp, Homo sapiens
agagctgatggagaagga

SEQ ID NO: 4255862 - DNA, 22 bp, Homo sapiens
agagctggagatgaggccagac

SEQ ID NO: 4255863 - DNA, 16 bp, Homo sapiens
agagtttagctggaaa

SEQ ID NO: 4255864 - DNA, 13 bp, Homo sapiens
agatgaggccaga

SEQ ID NO: 4255865 - DNA, 21 bp, Homo sapiens
agatgaggccagaccatggac

SEQ ID NO: 4255866 - DNA, 14 bp, Homo sapiens
agatttctgaggaa

SEQ ID NO: 4255867 - DNA, 15 bp, Homo sapiens
agatttctgaggaaa

SEQ ID NO: 4255868 - DNA, 14 bp, Homo sapiens
agattttcctgaaa

SEQ ID NO: 4255869 - DNA, 15 bp, Homo sapiens
agattttcctgaaaa

SEQ ID NO: 4255870 - DNA, 17 bp, Homo sapiens
agcaatttaaatgttat

SEQ ID NO: 4255871 - DNA, 17 bp, Homo sapiens
agcagtcaggaaagaga

SEQ ID NO: 4255872 - DNA, 22 bp, Homo sapiens
agcatttagatgtataggttga

SEQ ID NO: 4255873 - DNA, 21 bp, Homo sapiens
agccaggaagatcccccagaa

SEQ ID NO: 4255874 - DNA, 23 bp, Homo sapiens
agcccattcattccattctggaa

SEQ ID NO: 4255875 - DNA, 19 bp, Homo sapiens
agcccttctatacccaccc

SEQ ID NO: 4255876 - DNA, 20 bp, Homo sapiens
agcccttctatacccaccca

SEQ ID NO: 4255877 - DNA, 21 bp, Homo sapiens
agcccttctccatggccctgc

SEQ ID NO: 4255878 - DNA, 17 bp, Homo sapiens
agcccttctttccacag

SEQ ID NO: 4255879 - DNA, 18 bp, Homo sapiens
agcccttctttccacaga

SEQ ID NO: 4255880 - DNA, 23 bp, Homo sapiens
agcctcagctctcagttgcagcc

SEQ ID NO: 4255881 - DNA, 24 bp, Homo sapiens
agcgattctcctgcctcagcctcc

SEQ ID NO: 4255882 - DNA, 11 bp, Homo sapiens
agcgtttttta

SEQ ID NO: 4255883 - DNA, 20 bp, Homo sapiens
agcgttttttaaatgtatac

SEQ ID NO: 4255884 - DNA, 19 bp, Homo sapiens
agctcactgcaacctccac

SEQ ID NO: 4255885 - DNA, 21 bp, Homo sapiens
agctctcagttgcagccctgc

SEQ ID NO: 4255886 - DNA, 14 bp, Homo sapiens
agctgatggagaag

SEQ ID NO: 4255887 - DNA, 22 bp, Homo sapiens
agctggagatgaggccagacca

SEQ ID NO: 4255888 - DNA, 14 bp, Homo sapiens
agctggagtgcagt

SEQ ID NO: 4255889 - DNA, 19 bp, Homo sapiens
agctggagtgcagtggcat

SEQ ID NO: 4255890 - DNA, 14 bp, Homo sapiens
agctgtatgattcc

SEQ ID NO: 4255891 - DNA, 17 bp, Homo sapiens
agctgtatgattcccag

SEQ ID NO: 4255892 - DNA, 18 bp, Homo sapiens
agcttttcccaaaagccc

SEQ ID NO: 4255893 - DNA, 12 bp, Homo sapiens
aggaaatattta

SEQ ID NO: 4255894 - DNA, 16 bp, Homo sapiens
aggaagagaaggagca

SEQ ID NO: 4255895 - DNA, 19 bp, Homo sapiens
aggaagcaaatagaagaga

SEQ ID NO: 4255896 - DNA, 19 bp, Homo sapiens
aggaaggaggacccaggac

SEQ ID NO: 4255897 - DNA, 18 bp, Homo sapiens
aggaagttgacttatagt

SEQ ID NO: 4255898 - DNA, 22 bp, Homo sapiens
aggaagttgacttatagtacat

SEQ ID NO: 4255899 - DNA, 17 bp, Homo sapiens
aggacactgatatgggt

SEQ ID NO: 4255900 - DNA, 20 bp, Homo sapiens
aggacaggatccaggccggc

SEQ ID NO: 4255901 - DNA, 14 bp, Homo sapiens
aggacatcagcaaa

SEQ ID NO: 4255902 - DNA, 15 bp, Homo sapiens
aggacatcagcaaac

SEQ ID NO: 4255903 - DNA, 14 bp, Homo sapiens
aggaggacccagga

SEQ ID NO: 4255904 - DNA, 23 bp, Homo sapiens
aggatggttcccttgatgaagaa

SEQ ID NO: 4255905 - DNA, 14 bp, Homo sapiens
aggcagagaagaaa

SEQ ID NO: 4255906 - DNA, 18 bp, Homo sapiens
aggcagttcaaagcagga

SEQ ID NO: 4255907 - DNA, 19 bp, Homo sapiens
aggcctattgttgaataaa

SEQ ID NO: 4255908 - DNA, 21 bp, Homo sapiens
aggcctattgttgaataaatg

SEQ ID NO: 4255909 - DNA, 17 bp, Homo sapiens
aggctagatgtatgtac

SEQ ID NO: 4255910 - DNA, 15 bp, Homo sapiens
agggctcctattcaa

SEQ ID NO: 4255911 - DNA, 22 bp, Homo sapiens
agggctgttataatctttcaca

SEQ ID NO: 4255912 - DNA, 13 bp, Homo sapiens
aggggcagagcca

SEQ ID NO: 4255913 - DNA, 15 bp, Homo sapiens
aggggcagagccagg

SEQ ID NO: 4255914 - DNA, 13 bp, Homo sapiens
aggtaagtttttt

SEQ ID NO: 4255915 - DNA, 19 bp, Homo sapiens
aggttcaagcaatcctccc

SEQ ID NO: 4255916 - DNA, 13 bp, Homo sapiens
agtaatgataact

SEQ ID NO: 4255917 - DNA, 18 bp, Homo sapiens
agtaatgataactggaaa

SEQ ID NO: 4255918 - DNA, 13 bp, Homo sapiens
agtaattggaaag

SEQ ID NO: 4255919 - DNA, 22 bp, Homo sapiens
agtacatgataaatgatagaca

SEQ ID NO: 4255920 - DNA, 22 bp, Homo sapiens
agtagagacgaggtttcactgt

SEQ ID NO: 4255921 - DNA, 20 bp, Homo sapiens
agtagcgttttttaaatgta

SEQ ID NO: 4255922 - DNA, 18 bp, Homo sapiens
agtatctcttcagtctct

SEQ ID NO: 4255923 - DNA, 13 bp, Homo sapiens
agtatttctatga

SEQ ID NO: 4255924 - DNA, 15 bp, Homo sapiens
agtatttctatgaaa

SEQ ID NO: 4255925 - DNA, 17 bp, Homo sapiens
agtatttctatgaaata

SEQ ID NO: 4255926 - DNA, 22 bp, Homo sapiens
agtatttctatgaaatattatg

SEQ ID NO: 4255927 - DNA, 19 bp, Homo sapiens
tttgtagtagcgtttttta

SEQ ID NO: 4255928 - DNA, 17 bp, Homo sapiens
tttgtagtgttggagaa

SEQ ID NO: 4255929 - DNA, 19 bp, Homo sapiens
tttgtagtgttggagaaga

SEQ ID NO: 4255930 - DNA, 21 bp, Homo sapiens
tttgtagtgttggagaagaac

SEQ ID NO: 4255931 - DNA, 14 bp, Homo sapiens
tttgtataaaataa

SEQ ID NO: 4255932 - DNA, 19 bp, Homo sapiens
tttgtataaaataattttt

SEQ ID NO: 4255933 - DNA, 13 bp, Homo sapiens
tttgtattcaaaa

SEQ ID NO: 4255934 - DNA, 17 bp, Homo sapiens
tttgtgaagcaaaattt

SEQ ID NO: 4255935 - DNA, 14 bp, Homo sapiens
ttttaaaagaatga

SEQ ID NO: 4255936 - DNA, 15 bp, Homo sapiens
ttttaaaagaatgat

SEQ ID NO: 4255937 - DNA, 12 bp, Homo sapiens
ttttaaatgtat

SEQ ID NO: 4255938 - DNA, 12 bp, Homo sapiens
ttttaataatgt

SEQ ID NO: 4255939 - DNA, 14 bp, Homo sapiens
ttttaataatgttt

SEQ ID NO: 4255940 - DNA, 13 bp, Homo sapiens
ttttacattaaat

SEQ ID NO: 4255941 - DNA, 15 bp, Homo sapiens
ttttatatgcttctg

SEQ ID NO: 4255942 - DNA, 20 bp, Homo sapiens
ttttatatgcttctgtttta

SEQ ID NO: 4255943 - DNA, 13 bp, Homo sapiens
ttttatatttgaa

SEQ ID NO: 4255944 - DNA, 19 bp, Homo sapiens
ttttatggcactagtattt

SEQ ID NO: 4255945 - DNA, 22 bp, Homo sapiens
ttttatggcactagtatttcta

SEQ ID NO: 4255946 - DNA, 22 bp, Homo sapiens
ttttcagtttatttgaaccaat

SEQ ID NO: 4255947 - DNA, 13 bp, Homo sapiens
ttttcctgaaaac

SEQ ID NO: 4255948 - DNA, 16 bp, Homo sapiens
ttttctctaggaaata

SEQ ID NO: 4255949 - DNA, 20 bp, Homo sapiens
ttttgaaaagcagacatttt

SEQ ID NO: 4255950 - DNA, 21 bp, Homo sapiens
ttttgaaatcccatcaggtca

SEQ ID NO: 4255951 - DNA, 12 bp, Homo sapiens
ttttgcagcttt

SEQ ID NO: 4255952 - DNA, 18 bp, Homo sapiens
ttttggtctggagggaag

SEQ ID NO: 4255953 - DNA, 15 bp, Homo sapiens
tttttaaatgtatac

SEQ ID NO: 4255954 - DNA, 23 bp, Homo sapiens
tttttaaatgtatactatagtac

SEQ ID NO: 4255955 - DNA, 17 bp, Homo sapiens
tttttatatttgaaata

SEQ ID NO: 4255956 - DNA, 19 bp, Homo sapiens
tttttatatttgaaatatt

SEQ ID NO: 4255957 - DNA, 20 bp, Homo sapiens
tttttgaaaagcagacattt

SEQ ID NO: 4255958 - DNA, 21 bp, Homo sapiens
tttttgggcagcaatttaaat

SEQ ID NO: 4255959 - DNA, 23 bp, Homo sapiens
tttttgggcagcaatttaaatgt

SEQ ID NO: 4255960 - DNA, 16 bp, Homo sapiens
tttttgttattaaaca

SEQ ID NO: 4255961 - DNA, 23 bp, Homo sapiens
ttttttaaaaaagaaacatttgg

SEQ ID NO: 4255962 - DNA, 12 bp, Homo sapiens
ttttttgttatt

SEQ ID NO: 4255963 - DNA, 19 bp, Homo sapiens
tggaaccctaaataataaa

SEQ ID NO: 4255964 - DNA, 15 bp, Homo sapiens
tggacacctgccctg

SEQ ID NO: 4255965 - DNA, 16 bp, Homo sapiens
tggacactacacccag

SEQ ID NO: 4255966 - DNA, 14 bp, Homo sapiens
tggagaagaactga

SEQ ID NO: 4255967 - DNA, 15 bp, Homo sapiens
tggagatgaggccag

SEQ ID NO: 4255968 - DNA, 21 bp, Homo sapiens
tggagctcgtgggacagtcac

SEQ ID NO: 4255969 - DNA, 21 bp, Homo sapiens
tggaggggcagagccaggaag

SEQ ID NO: 4255970 - DNA, 13 bp, Homo sapiens
tggagtgcagtgg

SEQ ID NO: 4255971 - DNA, 20 bp, Homo sapiens
tggccagtctggtctcgaac

SEQ ID NO: 4255972 - DNA, 22 bp, Homo sapiens
tggccccaccctcgtggacacc

SEQ ID NO: 4255973 - DNA, 17 bp, Homo sapiens
tgggaatggaggggcag

SEQ ID NO: 4255974 - DNA, 19 bp, Homo sapiens
tgggaatggaggggcagag

SEQ ID NO: 4255975 - DNA, 23 bp, Homo sapiens
tgggaatggaggggcagagccag

SEQ ID NO: 4255976 - DNA, 20 bp, Homo sapiens
tgggacagtcacctcatgga

SEQ ID NO: 4255977 - DNA, 19 bp, Homo sapiens
tgggacatttgctcatgga

SEQ ID NO: 4255978 - DNA, 12 bp, Homo sapiens
tgggcagcaatt

SEQ ID NO: 4255979 - DNA, 17 bp, Homo sapiens
tgggcagcaatttaaat

SEQ ID NO: 4255980 - DNA, 16 bp, Homo sapiens
tgggttagggaaaaca

SEQ ID NO: 4255981 - DNA, 18 bp, Homo sapiens
tgggttagggaaaacatt

SEQ ID NO: 4255982 - DNA, 21 bp, Homo sapiens
tgggttagggaaaacattcca

SEQ ID NO: 4255983 - DNA, 19 bp, Homo sapiens
tggtatgaacttgaggaca

SEQ ID NO: 4255984 - DNA, 21 bp, Homo sapiens
tggtatgaacttgaggacaca

SEQ ID NO: 4255985 - DNA, 22 bp, Homo sapiens
tggtatgaacttgaggacacat

SEQ ID NO: 4255986 - DNA, 21 bp, Homo sapiens
tggtatgttttcaggctagat

SEQ ID NO: 4255987 - DNA, 18 bp, Homo sapiens
tgtaagaaaatatcactt

SEQ ID NO: 4255988 - DNA, 21 bp, Homo sapiens
tgtagtagcgttttttaaatg

SEQ ID NO: 4255989 - DNA, 14 bp, Homo sapiens
tgtataaaataatt

SEQ ID NO: 4255990 - DNA, 15 bp, Homo sapiens
tgtatattacaatga

SEQ ID NO: 4255991 - DNA, 15 bp, Homo sapiens
tgtatgattcccagc

SEQ ID NO: 4255992 - DNA, 17 bp, Homo sapiens
tgtctacactaagagag

SEQ ID NO: 4255993 - DNA, 18 bp, Homo sapiens
tgtgacattttacattaa

SEQ ID NO: 4255994 - DNA, 19 bp, Homo sapiens
tgtgctagtaattggaaag

SEQ ID NO: 4255995 - DNA, 20 bp, Homo sapiens
tgtgtgaaaggtacttcaaa

SEQ ID NO: 4255996 - DNA, 19 bp, Homo sapiens
tgtgttttgcaagccagat

SEQ ID NO: 4255997 - DNA, 16 bp, Homo sapiens
tgttatgactatgtaa

SEQ ID NO: 4255998 - DNA, 20 bp, Homo sapiens
tgttcttttaaatgattgaa

SEQ ID NO: 4255999 - DNA, 17 bp, Homo sapiens
tgttgaataaatgtatc

SEQ ID NO: 4256000 - DNA, 20 bp, Homo sapiens
tgttggagaagaactgaaat

SEQ ID NO: 4256001 - DNA, 13 bp, Homo sapiens
tgtttcaaacata

SEQ ID NO: 4256002 - DNA, 22 bp, Homo sapiens
tgtttctattttttgaaaagca

SEQ ID NO: 4256003 - DNA, 15 bp, Homo sapiens
ttaaaaaagaaacat

SEQ ID NO: 4256004 - DNA, 18 bp, Homo sapiens
ttaaaaaagaaacatttg

SEQ ID NO: 4256005 - DNA, 19 bp, Homo sapiens
ttaaaaaagaaacatttgg

SEQ ID NO: 4256006 - DNA, 12 bp, Homo sapiens
ttaaatgtatac

SEQ ID NO: 4256007 - DNA, 16 bp, Homo sapiens
ttaaatgttatgacta

SEQ ID NO: 4256008 - DNA, 20 bp, Homo sapiens
ttaaatgttatgactatgta

SEQ ID NO: 4256009 - DNA, 18 bp, Homo sapiens
ttaataatgtttcaaaca

SEQ ID NO: 4256010 - DNA, 17 bp, Homo sapiens
ttacaatagttctgtgg

SEQ ID NO: 4256011 - DNA, 14 bp, Homo sapiens
ttacatttgtataa

SEQ ID NO: 4256012 - DNA, 20 bp, Homo sapiens
ttactgcttaattcaaataa

SEQ ID NO: 4256013 - DNA, 22 bp, Homo sapiens
ttagatgcagttctgaagaaga

SEQ ID NO: 4256014 - DNA, 23 bp, Homo sapiens
ttaggaagttgacttatagtaca

SEQ ID NO: 4256015 - DNA, 18 bp, Homo sapiens
ttataataaaggactgta

SEQ ID NO: 4256016 - DNA, 11 bp, Homo sapiens
ttataatcttt

SEQ ID NO: 4256017 - DNA, 14 bp, Homo sapiens
ttataattttgtga

SEQ ID NO: 4256018 - DNA, 17 bp, Homo sapiens
ttataattttgtgaagc

SEQ ID NO: 4256019 - DNA, 15 bp, Homo sapiens
ttatatttgaaatat

SEQ ID NO: 4256020 - DNA, 19 bp, Homo sapiens
ttatatttgaaatattgac

SEQ ID NO: 4256021 - DNA, 18 bp, Homo sapiens
ttatctatagctaagtac

SEQ ID NO: 4256022 - DNA, 15 bp, Homo sapiens
ttatgactatgtaaa

SEQ ID NO: 4256023 - DNA, 22 bp, Homo sapiens
ttatgattaagtaatgataact

SEQ ID NO: 4256024 - DNA, 16 bp, Homo sapiens
ttatgcttaaattcaa

SEQ ID NO: 4256025 - DNA, 16 bp, Homo sapiens
ttattactgtaagaaa

SEQ ID NO: 4256026 - DNA, 18 bp, Homo sapiens
ttattactgtaagaaaat

SEQ ID NO: 4256027 - DNA, 15 bp, Homo sapiens
ttattgtctagtgaa

SEQ ID NO: 4256028 - DNA, 19 bp, Homo sapiens
ttattttaataatgtttca

SEQ ID NO: 4256029 - DNA, 12 bp, Homo sapiens
ttcaaaagaaag

SEQ ID NO: 4256030 - DNA, 13 bp, Homo sapiens
ttcaaaagaaagt

SEQ ID NO: 4256031 - DNA, 14 bp, Homo sapiens
ttcaaacatatata

SEQ ID NO: 4256032 - DNA, 17 bp, Homo sapiens
ttcaaatccttgaagat

SEQ ID NO: 4256033 - DNA, 14 bp, Homo sapiens
ttcaagcaatcctc

SEQ ID NO: 4256034 - DNA, 17 bp, Homo sapiens
ttcagcggtttatataa

SEQ ID NO: 4256035 - DNA, 21 bp, Homo sapiens
ttcagtctctataccaataaa

SEQ ID NO: 4256036 - DNA, 23 bp, Homo sapiens
ttcagtctctataccaataaagt

SEQ ID NO: 4256037 - DNA, 17 bp, Homo sapiens
ttcatctggaaccatca

SEQ ID NO: 4256038 - DNA, 23 bp, Homo sapiens
ttcatctggaaccatcagaaaca

SEQ ID NO: 4256039 - DNA, 16 bp, Homo sapiens
ttcatgaccagtaaag

SEQ ID NO: 4256040 - DNA, 14 bp, Homo sapiens
ttcatgcatggaaa

SEQ ID NO: 4256041 - DNA, 16 bp, Homo sapiens
ttcatgcatggaaatt

SEQ ID NO: 4256042 - DNA, 18 bp, Homo sapiens
ttccagagcactgctcca

SEQ ID NO: 4256043 - DNA, 18 bp, Homo sapiens
ttccagatcctggaaatc

SEQ ID NO: 4256044 - DNA, 19 bp, Homo sapiens
ttccagatcctggaaatca

SEQ ID NO: 4256045 - DNA, 18 bp, Homo sapiens
ttcccaactccagaaagt

SEQ ID NO: 4256046 - DNA, 14 bp, Homo sapiens
ttcccttcatctgg

SEQ ID NO: 4256047 - DNA, 15 bp, Homo sapiens
ttcccttcatctgga

SEQ ID NO: 4256048 - DNA, 18 bp, Homo sapiens
ttcctctgtctcctaagc

SEQ ID NO: 4256049 - DNA, 19 bp, Homo sapiens
ttctaccaaggtcttctta

SEQ ID NO: 4256050 - DNA, 21 bp, Homo sapiens
ttctggtatgaacttgaggac

SEQ ID NO: 4256051 - DNA, 19 bp, Homo sapiens
ttcttagggttatgattaa

SEQ ID NO: 4256052 - DNA, 18 bp, Homo sapiens
ttctttccacagaagctc

SEQ ID NO: 4256053 - DNA, 15 bp, Homo sapiens
ttgaaaagcagacat

SEQ ID NO: 4256054 - DNA, 19 bp, Homo sapiens
ttgaataaatgtatctgaa

SEQ ID NO: 4256055 - DNA, 20 bp, Homo sapiens
ttgaataaatgtatctgaat

SEQ ID NO: 4256056 - DNA, 23 bp, Homo sapiens
ttgacctgcctcccttcatgcat

SEQ ID NO: 4256057 - DNA, 12 bp, Homo sapiens
ttgactttttat

SEQ ID NO: 4256058 - DNA, 11 bp, Homo sapiens
ttgagaaaaat

SEQ ID NO: 4256059 - DNA, 15 bp, Homo sapiens
ttgaggacacatgtc

SEQ ID NO: 4256060 - DNA, 14 bp, Homo sapiens
ttgaggacactgat

SEQ ID NO: 4256061 - DNA, 20 bp, Homo sapiens
ttgatatgccttttcccaac

SEQ ID NO: 4256062 - DNA, 13 bp, Homo sapiens
ttgatgaagaagt

SEQ ID NO: 4256063 - DNA, 23 bp, Homo sapiens
ttgatgaagaagttgatatgcct

SEQ ID NO: 4256064 - DNA, 15 bp, Homo sapiens
ttgcatttatatgta

SEQ ID NO: 4256065 - DNA, 16 bp, Homo sapiens
ttgccaccctcatgct

SEQ ID NO: 4256066 - DNA, 19 bp, Homo sapiens
ttgccaggctggagtgcag

SEQ ID NO: 4256067 - DNA, 11 bp, Homo sapiens
ttgctcatgga

SEQ ID NO: 4256068 - DNA, 22 bp, Homo sapiens
ttggagaagaactgaaatcata

SEQ ID NO: 4256069 - DNA, 19 bp, Homo sapiens
ttggccatgcagaaagcat

SEQ ID NO: 4256070 - DNA, 18 bp, Homo sapiens
ttgggcagcaatttaaat

SEQ ID NO: 4256071 - DNA, 20 bp, Homo sapiens
ttggtaaggggaattgagga

SEQ ID NO: 4256072 - DNA, 22 bp, Homo sapiens
ttgtagtagcgttttttaaatg

SEQ ID NO: 4256073 - DNA, 23 bp, Homo sapiens
ttgtagtagcgttttttaaatgt

SEQ ID NO: 4256074 - DNA, 14 bp, Homo sapiens
ttgtatattacaat

SEQ ID NO: 4256075 - DNA, 20 bp, Homo sapiens
ttgtcaataaaatccataca

SEQ ID NO: 4256076 - DNA, 13 bp, Homo sapiens
ttgttgaataaat

SEQ ID NO: 4256077 - DNA, 19 bp, Homo sapiens
tttaaaaaatagcagcttt

SEQ ID NO: 4256078 - DNA, 16 bp, Homo sapiens
tttaaaaaatggtcac

SEQ ID NO: 4256079 - DNA, 17 bp, Homo sapiens
tttaaaaggaaagaaaa

SEQ ID NO: 4256080 - DNA, 16 bp, Homo sapiens
tttaaaattacaacta

SEQ ID NO: 4256081 - DNA, 13 bp, Homo sapiens
tttaaatgtatac

SEQ ID NO: 4256082 - DNA, 13 bp, Homo sapiens
tttatataagctt

SEQ ID NO: 4256083 - DNA, 21 bp, Homo sapiens
tttatatgcttctgttttata

SEQ ID NO: 4256084 - DNA, 21 bp, Homo sapiens
tttcagtttatttgaaccaat

SEQ ID NO: 4256085 - DNA, 18 bp, Homo sapiens
tttcatataaatggaatt

SEQ ID NO: 4256086 - DNA, 13 bp, Homo sapiens
tttgaaaagcaga

SEQ ID NO: 4256087 - DNA, 18 bp, Homo sapiens
tttgaaaagcagacattt

SEQ ID NO: 4256088 - DNA, 17 bp, Homo sapiens
tttgaaattatgtgaca

SEQ ID NO: 4256089 - DNA, 21 bp, Homo sapiens
tttggtgcttctcagatttct

SEQ ID NO: 4256090 - DNA, 22 bp, Homo sapiens
tccagcagatttccagccttct

SEQ ID NO: 4256091 - DNA, 14 bp, Homo sapiens
tccagtaaaataat

SEQ ID NO: 4256092 - DNA, 23 bp, Homo sapiens
tccagtgggaggtgagaccacct

SEQ ID NO: 4256093 - DNA, 20 bp, Homo sapiens
tcccaagcacctgggattac

SEQ ID NO: 4256094 - DNA, 16 bp, Homo sapiens
tcccaattgagaaaaa

SEQ ID NO: 4256095 - DNA, 12 bp, Homo sapiens
tcccatccctgc

SEQ ID NO: 4256096 - DNA, 14 bp, Homo sapiens
tcccatccctgcgt

SEQ ID NO: 4256097 - DNA, 18 bp, Homo sapiens
tccctcaacctcatcctc

SEQ ID NO: 4256098 - DNA, 22 bp, Homo sapiens
tccctctgcagtctctatacca

SEQ ID NO: 4256099 - DNA, 21 bp, Homo sapiens
tcccttcatctggaaccatca

SEQ ID NO: 4256100 - DNA, 17 bp, Homo sapiens
tcccttcatgcatggaa

SEQ ID NO: 4256101 - DNA, 16 bp, Homo sapiens
tcccttgatgaagaag

SEQ ID NO: 4256102 - DNA, 14 bp, Homo sapiens
tccttccctgctgt

SEQ ID NO: 4256103 - DNA, 12 bp, Homo sapiens
tcgaagtgctga

SEQ ID NO: 4256104 - DNA, 13 bp, Homo sapiens
tcgaagtgctgag

SEQ ID NO: 4256105 - DNA, 12 bp, Homo sapiens
tcgcctcagcct

SEQ ID NO: 4256106 - DNA, 21 bp, Homo sapiens
tcgtggaacagttacctctgc

SEQ ID NO: 4256107 - DNA, 13 bp, Homo sapiens
tcgtggacacctg

SEQ ID NO: 4256108 - DNA, 14 bp, Homo sapiens
tcgtggacacctgc

SEQ ID NO: 4256109 - DNA, 18 bp, Homo sapiens
tcgtggacacctgccctg

SEQ ID NO: 4256110 - DNA, 19 bp, Homo sapiens
tcgtggacacctgccctgc

SEQ ID NO: 4256111 - DNA, 21 bp, Homo sapiens
tcgtgtgtttctattttttga

SEQ ID NO: 4256112 - DNA, 21 bp, Homo sapiens
tctacactaagagagaatgag

SEQ ID NO: 4256113 - DNA, 17 bp, Homo sapiens
tctaccaaaaatctcaa

SEQ ID NO: 4256114 - DNA, 17 bp, Homo sapiens
tctaggaaatatttatt

SEQ ID NO: 4256115 - DNA, 19 bp, Homo sapiens
tctagtgagcagtcaggaa

SEQ ID NO: 4256116 - DNA, 22 bp, Homo sapiens
tctagtgagcagtcaggaaaga

SEQ ID NO: 4256117 - DNA, 15 bp, Homo sapiens
tctataccaataaag

SEQ ID NO: 4256118 - DNA, 16 bp, Homo sapiens
tctataccaataaagt

SEQ ID NO: 4256119 - DNA, 17 bp, Homo sapiens
tctataccaataaagtg

SEQ ID NO: 4256120 - DNA, 18 bp, Homo sapiens
tctataccaataaagtga

SEQ ID NO: 4256121 - DNA, 17 bp, Homo sapiens
tctatacccacccagaa

SEQ ID NO: 4256122 - DNA, 17 bp, Homo sapiens
tctatgaaatattatgt

SEQ ID NO: 4256123 - DNA, 16 bp, Homo sapiens
tctcaaactcctgacc

SEQ ID NO: 4256124 - DNA, 16 bp, Homo sapiens
tctcagctcactgcaa

SEQ ID NO: 4256125 - DNA, 16 bp, Homo sapiens
tctcataccctccctc

SEQ ID NO: 4256126 - DNA, 19 bp, Homo sapiens
tctccattgtgcctaagtc

SEQ ID NO: 4256127 - DNA, 18 bp, Homo sapiens
tctcccaaaaaactactt

SEQ ID NO: 4256128 - DNA, 19 bp, Homo sapiens
tctctaggaaatatttatt

SEQ ID NO: 4256129 - DNA, 19 bp, Homo sapiens
tctctataccaataaagtg

SEQ ID NO: 4256130 - DNA, 19 bp, Homo sapiens
tctctttaaaaggaaagaa

SEQ ID NO: 4256131 - DNA, 14 bp, Homo sapiens
tctgaataaagcaa

SEQ ID NO: 4256132 - DNA, 13 bp, Homo sapiens
tctgacataatcc

SEQ ID NO: 4256133 - DNA, 21 bp, Homo sapiens
tctgactgtttccatcaaggg

SEQ ID NO: 4256134 - DNA, 14 bp, Homo sapiens
tctggattccagag

SEQ ID NO: 4256135 - DNA, 22 bp, Homo sapiens
tctggtatgaacttgaggacac

SEQ ID NO: 4256136 - DNA, 21 bp, Homo sapiens
tctgtaaaactaagaaactta

SEQ ID NO: 4256137 - DNA, 18 bp, Homo sapiens
tctgtaagcataagctta

SEQ ID NO: 4256138 - DNA, 16 bp, Homo sapiens
tctgtctgtcccaaag

SEQ ID NO: 4256139 - DNA, 18 bp, Homo sapiens
tctgtctgtctgtcccaa

SEQ ID NO: 4256140 - DNA, 19 bp, Homo sapiens
tcttaatatgttcttttaa

SEQ ID NO: 4256141 - DNA, 22 bp, Homo sapiens
tcttagggttatgattaagtaa

SEQ ID NO: 4256142 - DNA, 17 bp, Homo sapiens
tcttccttccctgctgt

SEQ ID NO: 4256143 - DNA, 18 bp, Homo sapiens
tcttctgaataaagcaat

SEQ ID NO: 4256144 - DNA, 15 bp, Homo sapiens
tctttaaaattacaa

SEQ ID NO: 4256145 - DNA, 19 bp, Homo sapiens
tctttccacagaagctcca

SEQ ID NO: 4256146 - DNA, 16 bp, Homo sapiens
tgaaaagcagacattt

SEQ ID NO: 4256147 - DNA, 16 bp, Homo sapiens
tgaaaatattgtttta

SEQ ID NO: 4256148 - DNA, 19 bp, Homo sapiens
tgaaactcgttaatttgta

SEQ ID NO: 4256149 - DNA, 18 bp, Homo sapiens
tgaaatattatgttaaaa

SEQ ID NO: 4256150 - DNA, 20 bp, Homo sapiens
tgaaatcccatcaggtcacc

SEQ ID NO: 4256151 - DNA, 20 bp, Homo sapiens
tgaaattatgtgacatttta

SEQ ID NO: 4256152 - DNA, 20 bp, Homo sapiens
tgaacttgaggacacatgtc

SEQ ID NO: 4256153 - DNA, 20 bp, Homo sapiens
tgaagaagcaccaatcatga

SEQ ID NO: 4256154 - DNA, 22 bp, Homo sapiens
tgaagaagcaccaatcatgaat

SEQ ID NO: 4256155 - DNA, 21 bp, Homo sapiens
tgaagtccaagcatttagatg

SEQ ID NO: 4256156 - DNA, 22 bp, Homo sapiens
tgaagtccaagcatttagatgt

SEQ ID NO: 4256157 - DNA, 13 bp, Homo sapiens
tgaataaatgtat

SEQ ID NO: 4256158 - DNA, 17 bp, Homo sapiens
tgaataaatgtatctga

SEQ ID NO: 4256159 - DNA, 13 bp, Homo sapiens
tgaattacatttg

SEQ ID NO: 4256160 - DNA, 15 bp, Homo sapiens
tgacaagctcacaga

SEQ ID NO: 4256161 - DNA, 16 bp, Homo sapiens
tgacatgggacatttg

SEQ ID NO: 4256162 - DNA, 12 bp, Homo sapiens
tgacattttaca

SEQ ID NO: 4256163 - DNA, 14 bp, Homo sapiens
tgacattttacatt

SEQ ID NO: 4256164 - DNA, 23 bp, Homo sapiens
tgaccctccaccgcagaaggaag

SEQ ID NO: 4256165 - DNA, 20 bp, Homo sapiens
tgacctcaagtgatctgccc

SEQ ID NO: 4256166 - DNA, 16 bp, Homo sapiens
tgacctgcctcccttc

SEQ ID NO: 4256167 - DNA, 17 bp, Homo sapiens
tgacctgcctcccttca

SEQ ID NO: 4256168 - DNA, 13 bp, Homo sapiens
tgactatgtaaac

SEQ ID NO: 4256169 - DNA, 13 bp, Homo sapiens
tgactcttaagaa

SEQ ID NO: 4256170 - DNA, 14 bp, Homo sapiens
tgactcttaagaag

SEQ ID NO: 4256171 - DNA, 15 bp, Homo sapiens
tgactcttaagaaga

SEQ ID NO: 4256172 - DNA, 15 bp, Homo sapiens
tgactgtttccatca

SEQ ID NO: 4256173 - DNA, 13 bp, Homo sapiens
tgacttatagtac

SEQ ID NO: 4256174 - DNA, 15 bp, Homo sapiens
tgacttatagtacat

SEQ ID NO: 4256175 - DNA, 19 bp, Homo sapiens
tgacttatagtacatgata

SEQ ID NO: 4256176 - DNA, 18 bp, Homo sapiens
tgagaaaaatatatacta

SEQ ID NO: 4256177 - DNA, 12 bp, Homo sapiens
tgagaccacctc

SEQ ID NO: 4256178 - DNA, 19 bp, Homo sapiens
tgagagacacactgaagaa

SEQ ID NO: 4256179 - DNA, 22 bp, Homo sapiens
tgagagacacactgaagaagca

SEQ ID NO: 4256180 - DNA, 19 bp, Homo sapiens
tgagaggctgggaatggag

SEQ ID NO: 4256181 - DNA, 17 bp, Homo sapiens
tgagcagtcaggaaaga

SEQ ID NO: 4256182 - DNA, 13 bp, Homo sapiens
tgaggacacatgt

SEQ ID NO: 4256183 - DNA, 15 bp, Homo sapiens
tgaggcactggcgag

SEQ ID NO: 4256184 - DNA, 19 bp, Homo sapiens
tgaggggctaccaggaaag

SEQ ID NO: 4256185 - DNA, 16 bp, Homo sapiens
tgataactggaaactt

SEQ ID NO: 4256186 - DNA, 19 bp, Homo sapiens
tgatcaaaatcaattaaaa

SEQ ID NO: 4256187 - DNA, 19 bp, Homo sapiens
tgatcaccgactgaaaata

SEQ ID NO: 4256188 - DNA, 24 bp, Homo sapiens
tgatcagcttattgtctagtgaaa

SEQ ID NO: 4256189 - DNA, 18 bp, Homo sapiens
tgatctcagctcactgca

SEQ ID NO: 4256190 - DNA, 17 bp, Homo sapiens
tgatgaagaagttgata

SEQ ID NO: 4256191 - DNA, 17 bp, Homo sapiens
tgattatgaattacatt

SEQ ID NO: 4256192 - DNA, 21 bp, Homo sapiens
tgcaaggcctggtgtttcttg

SEQ ID NO: 4256193 - DNA, 15 bp, Homo sapiens
tgcactggccccacc

SEQ ID NO: 4256194 - DNA, 20 bp, Homo sapiens
tgcagaaagcatccctcacc

SEQ ID NO: 4256195 - DNA, 17 bp, Homo sapiens
tgcagcccccactgcct

SEQ ID NO: 4256196 - DNA, 23 bp, Homo sapiens
tgcagcccccactgcctttgacc

SEQ ID NO: 4256197 - DNA, 18 bp, Homo sapiens
tgcagtctctataccaat

SEQ ID NO: 4256198 - DNA, 22 bp, Homo sapiens
tgcagtggcgtgatctcagctc

SEQ ID NO: 4256199 - DNA, 15 bp, Homo sapiens
tgcagttctgaagaa

SEQ ID NO: 4256200 - DNA, 11 bp, Homo sapiens
tgcatggaaat

SEQ ID NO: 4256201 - DNA, 14 bp, Homo sapiens
tgccacctcctgcc

SEQ ID NO: 4256202 - DNA, 12 bp, Homo sapiens
tgccacctgtct

SEQ ID NO: 4256203 - DNA, 15 bp, Homo sapiens
tgccacctgtctgtc

SEQ ID NO: 4256204 - DNA, 17 bp, Homo sapiens
tgccaggctggagtgca

SEQ ID NO: 4256205 - DNA, 20 bp, Homo sapiens
tgccctgccacctgtctgtc

SEQ ID NO: 4256206 - DNA, 22 bp, Homo sapiens
tgcctaagtccagtgtttcttt

SEQ ID NO: 4256207 - DNA, 18 bp, Homo sapiens
tgcctcagaaaacaagga

SEQ ID NO: 4256208 - DNA, 23 bp, Homo sapiens
tgcctttgacctgcctcccttca

SEQ ID NO: 4256209 - DNA, 17 bp, Homo sapiens
tgccttttcccaactcc

SEQ ID NO: 4256210 - DNA, 14 bp, Homo sapiens
tgctgctgcctgcc

SEQ ID NO: 4256211 - DNA, 15 bp, Homo sapiens
tgcttaataaattgt

SEQ ID NO: 4256212 - DNA, 17 bp, Homo sapiens
tgcttaattcaaataat

SEQ ID NO: 4256213 - DNA, 16 bp, Homo sapiens
tgcttccctttcctga

SEQ ID NO: 4256214 - DNA, 13 bp, Homo sapiens
tgcttctccagcc

SEQ ID NO: 4256215 - DNA, 14 bp, Homo sapiens
tgcttctgttttat

SEQ ID NO: 4256216 - DNA, 17 bp, Homo sapiens
tggaaattcccttcatc

SEQ ID NO: 4256217 - DNA, 17 bp, Homo sapiens
taaccaggggccatgaa

SEQ ID NO: 4256218 - DNA, 16 bp, Homo sapiens
taactattgcatttat

SEQ ID NO: 4256219 - DNA, 21 bp, Homo sapiens
taactattgcatttatatgta

SEQ ID NO: 4256220 - DNA, 21 bp, Homo sapiens
taagaaaatatcacttgtcaa

SEQ ID NO: 4256221 - DNA, 13 bp, Homo sapiens
taagagagaatga

SEQ ID NO: 4256222 - DNA, 14 bp, Homo sapiens
taagagagaatgag

SEQ ID NO: 4256223 - DNA, 21 bp, Homo sapiens
taagcataagcttatgcttaa

SEQ ID NO: 4256224 - DNA, 20 bp, Homo sapiens
taagtaatgataactggaaa

SEQ ID NO: 4256225 - DNA, 12 bp, Homo sapiens
taagtccagtgt

SEQ ID NO: 4256226 - DNA, 18 bp, Homo sapiens
taagtttttttttaaaaa

SEQ ID NO: 4256227 - DNA, 12 bp, Homo sapiens
taataaaggact

SEQ ID NO: 4256228 - DNA, 13 bp, Homo sapiens
taataaaggactg

SEQ ID NO: 4256229 - DNA, 20 bp, Homo sapiens
taataaaggactgtaatctt

SEQ ID NO: 4256230 - DNA, 20 bp, Homo sapiens
taataatttttaagaaataa

SEQ ID NO: 4256231 - DNA, 20 bp, Homo sapiens
taatatgttcttttaaatga

SEQ ID NO: 4256232 - DNA, 12 bp, Homo sapiens
taatccagtaaa

SEQ ID NO: 4256233 - DNA, 18 bp, Homo sapiens
taatttttatatttgaaa

SEQ ID NO: 4256234 - DNA, 21 bp, Homo sapiens
taatttttatatttgaaatat

SEQ ID NO: 4256235 - DNA, 15 bp, Homo sapiens
tacaacctccgcctc

SEQ ID NO: 4256236 - DNA, 22 bp, Homo sapiens
tacaacggagtcaaaaattaaa

SEQ ID NO: 4256237 - DNA, 16 bp, Homo sapiens
tacatttgtataaaat

SEQ ID NO: 4256238 - DNA, 11 bp, Homo sapiens
tacatttgtgt

SEQ ID NO: 4256239 - DNA, 22 bp, Homo sapiens
taccaaaaatctcaatatttca

SEQ ID NO: 4256240 - DNA, 12 bp, Homo sapiens
taccaataaagt

SEQ ID NO: 4256241 - DNA, 23 bp, Homo sapiens
taccacaggaaccacaagactgc

SEQ ID NO: 4256242 - DNA, 20 bp, Homo sapiens
taccgtaggctttgtattca

SEQ ID NO: 4256243 - DNA, 18 bp, Homo sapiens
tacgtgctctgtgggtct

SEQ ID NO: 4256244 - DNA, 12 bp, Homo sapiens
tactatagtacc

SEQ ID NO: 4256245 - DNA, 19 bp, Homo sapiens
tactgcttaattcaaataa

SEQ ID NO: 4256246 - DNA, 14 bp, Homo sapiens
tactgtaagaaaat

SEQ ID NO: 4256247 - DNA, 21 bp, Homo sapiens
tacttcaaatccttgaagatt

SEQ ID NO: 4256248 - DNA, 20 bp, Homo sapiens
tacttcttttttcaaaagaa

SEQ ID NO: 4256249 - DNA, 11 bp, Homo sapiens
tagaaagctat

SEQ ID NO: 4256250 - DNA, 23 bp, Homo sapiens
tagaataccacaggaaccacaag

SEQ ID NO: 4256251 - DNA, 18 bp, Homo sapiens
tagacaattgaggtaagt

SEQ ID NO: 4256252 - DNA, 18 bp, Homo sapiens
tagagtttagctggaaaa

SEQ ID NO: 4256253 - DNA, 14 bp, Homo sapiens
tagataggccatgg

SEQ ID NO: 4256254 - DNA, 20 bp, Homo sapiens
tagatatcatgcaaatttca

SEQ ID NO: 4256255 - DNA, 20 bp, Homo sapiens
tagatgtatgtacttcatgc

SEQ ID NO: 4256256 - DNA, 15 bp, Homo sapiens
tagctaagtacacaa

SEQ ID NO: 4256257 - DNA, 22 bp, Homo sapiens
tagctaagtacacaataagcaa

SEQ ID NO: 4256258 - DNA, 18 bp, Homo sapiens
taggaaatatttatttta

SEQ ID NO: 4256259 - DNA, 19 bp, Homo sapiens
taggaaatatttattttaa

SEQ ID NO: 4256260 - DNA, 13 bp, Homo sapiens
tagggaaaacatt

SEQ ID NO: 4256261 - DNA, 18 bp, Homo sapiens
tagggaaaacattccatc

SEQ ID NO: 4256262 - DNA, 21 bp, Homo sapiens
taggggcttataataaaggac

SEQ ID NO: 4256263 - DNA, 23 bp, Homo sapiens
taggggcttataataaaggactg

SEQ ID NO: 4256264 - DNA, 17 bp, Homo sapiens
tagtattgtccaggtct

SEQ ID NO: 4256265 - DNA, 18 bp, Homo sapiens
tagtatttctatgaaata

SEQ ID NO: 4256266 - DNA, 19 bp, Homo sapiens
tagtatttctatgaaatat

SEQ ID NO: 4256267 - DNA, 18 bp, Homo sapiens
tagtctctttaaaaggaa

SEQ ID NO: 4256268 - DNA, 14 bp, Homo sapiens
tagtgcaaattgtc

SEQ ID NO: 4256269 - DNA, 15 bp, Homo sapiens
tagtgcaaattgtca

SEQ ID NO: 4256270 - DNA, 12 bp, Homo sapiens
tagtgttggaga

SEQ ID NO: 4256271 - DNA, 17 bp, Homo sapiens
tagttgccttaaaataa

SEQ ID NO: 4256272 - DNA, 21 bp, Homo sapiens
tataaaataatttttatattt

SEQ ID NO: 4256273 - DNA, 23 bp, Homo sapiens
tataaaataatttttatatttga

SEQ ID NO: 4256274 - DNA, 14 bp, Homo sapiens
tataataaaggact

SEQ ID NO: 4256275 - DNA, 19 bp, Homo sapiens
tataataaaggactgtaat

SEQ ID NO: 4256276 - DNA, 14 bp, Homo sapiens
tataccaataaagt

SEQ ID NO: 4256277 - DNA, 15 bp, Homo sapiens
tataccaataaagtg

SEQ ID NO: 4256278 - DNA, 15 bp, Homo sapiens
tatacccacccagaa

SEQ ID NO: 4256279 - DNA, 13 bp, Homo sapiens
tatagaaagctat

SEQ ID NO: 4256280 - DNA, 24 bp, Homo sapiens
tatagaaagctatataagacaaga

SEQ ID NO: 4256281 - DNA, 14 bp, Homo sapiens
tatagtacatgata

SEQ ID NO: 4256282 - DNA, 19 bp, Homo sapiens
tatataacaatgctgtatt

SEQ ID NO: 4256283 - DNA, 21 bp, Homo sapiens
tatatatgtgtatgcacagta

SEQ ID NO: 4256284 - DNA, 23 bp, Homo sapiens
tatatatgtgtatgcacagtaaa

SEQ ID NO: 4256285 - DNA, 14 bp, Homo sapiens
tatatgtgtatgca

SEQ ID NO: 4256286 - DNA, 13 bp, Homo sapiens
tatattacaatga

SEQ ID NO: 4256287 - DNA, 17 bp, Homo sapiens
tatattacaatgatcac

SEQ ID NO: 4256288 - DNA, 15 bp, Homo sapiens
tatatttattactgt

SEQ ID NO: 4256289 - DNA, 19 bp, Homo sapiens
tatatttattactgtaaga

SEQ ID NO: 4256290 - DNA, 23 bp, Homo sapiens
tatatttattactgtaagaaaat

SEQ ID NO: 4256291 - DNA, 13 bp, Homo sapiens
tatatttgaaata

SEQ ID NO: 4256292 - DNA, 13 bp, Homo sapiens
tatctcttcagtc

SEQ ID NO: 4256293 - DNA, 16 bp, Homo sapiens
tatctcttcagtctct

SEQ ID NO: 4256294 - DNA, 19 bp, Homo sapiens
tatgaacttgaggacacat

SEQ ID NO: 4256295 - DNA, 22 bp, Homo sapiens
tatgaacttgaggacacatgtc

SEQ ID NO: 4256296 - DNA, 17 bp, Homo sapiens
tatgaattacatttgta

SEQ ID NO: 4256297 - DNA, 15 bp, Homo sapiens
tatgcttctgtttta

SEQ ID NO: 4256298 - DNA, 13 bp, Homo sapiens
tatgtacttcatg

SEQ ID NO: 4256299 - DNA, 17 bp, Homo sapiens
tatgtacttcatgctgt

SEQ ID NO: 4256300 - DNA, 14 bp, Homo sapiens
tatgtgacatttta

SEQ ID NO: 4256301 - DNA, 19 bp, Homo sapiens
tatgttagtgcaaattgtc

SEQ ID NO: 4256302 - DNA, 14 bp, Homo sapiens
tattactgtaagaa

SEQ ID NO: 4256303 - DNA, 14 bp, Homo sapiens
tattcaataaagct

SEQ ID NO: 4256304 - DNA, 16 bp, Homo sapiens
tattcaattcttttaa

SEQ ID NO: 4256305 - DNA, 16 bp, Homo sapiens
tattgtatattacaat

SEQ ID NO: 4256306 - DNA, 17 bp, Homo sapiens
tattgtatattacaatg

SEQ ID NO: 4256307 - DNA, 15 bp, Homo sapiens
tattgttttacaata

SEQ ID NO: 4256308 - DNA, 20 bp, Homo sapiens
tattgttttacaatagttct

SEQ ID NO: 4256309 - DNA, 14 bp, Homo sapiens
tatttattactgta

SEQ ID NO: 4256310 - DNA, 21 bp, Homo sapiens
tatttctatgaaatattatgt

SEQ ID NO: 4256311 - DNA, 18 bp, Homo sapiens
tcaaactacatattgtaa

SEQ ID NO: 4256312 - DNA, 15 bp, Homo sapiens
tcaaattgtgtgaaa

SEQ ID NO: 4256313 - DNA, 19 bp, Homo sapiens
tcaactccaaactgactct

SEQ ID NO: 4256314 - DNA, 16 bp, Homo sapiens
tcaatattcaataaag

SEQ ID NO: 4256315 - DNA, 17 bp, Homo sapiens
tcaatattcaataaagc

SEQ ID NO: 4256316 - DNA, 19 bp, Homo sapiens
tcaattcttccctatcttt

SEQ ID NO: 4256317 - DNA, 23 bp, Homo sapiens
tcaattcttccctatctttgcca

SEQ ID NO: 4256318 - DNA, 23 bp, Homo sapiens
tcacaggacagcccttctttcca

SEQ ID NO: 4256319 - DNA, 19 bp, Homo sapiens
tcacccaggttggagtgca

SEQ ID NO: 4256320 - DNA, 21 bp, Homo sapiens
tcactgaactttgctgagcct

SEQ ID NO: 4256321 - DNA, 18 bp, Homo sapiens
tcactgcaacctctgcct

SEQ ID NO: 4256322 - DNA, 21 bp, Homo sapiens
tcagaaacaccctcacactgg

SEQ ID NO: 4256323 - DNA, 16 bp, Homo sapiens
tcagatttctgaggaa

SEQ ID NO: 4256324 - DNA, 20 bp, Homo sapiens
tcagcctcccgagtagctgg

SEQ ID NO: 4256325 - DNA, 13 bp, Homo sapiens
tcaggctagatgt

SEQ ID NO: 4256326 - DNA, 15 bp, Homo sapiens
tcagtctctatacca

SEQ ID NO: 4256327 - DNA, 16 bp, Homo sapiens
tcagttaactattgca

SEQ ID NO: 4256328 - DNA, 19 bp, Homo sapiens
tcatctcagctcactgcaa

SEQ ID NO: 4256329 - DNA, 16 bp, Homo sapiens
tcatgaattagtttta

SEQ ID NO: 4256330 - DNA, 14 bp, Homo sapiens
tcattccattctgg

SEQ ID NO: 4256331 - DNA, 15 bp, Homo sapiens
tcattccattctgga

SEQ ID NO: 4256332 - DNA, 16 bp, Homo sapiens
tcattccattctggaa

SEQ ID NO: 4256333 - DNA, 19 bp, Homo sapiens
tcattccattctggaagtg

SEQ ID NO: 4256334 - DNA, 14 bp, Homo sapiens
tccaaccctagcaa

SEQ ID NO: 4256335 - DNA, 15 bp, Homo sapiens
tccaaccctagcaaa

SEQ ID NO: 4256336 - DNA, 21 bp, Homo sapiens
tccaactatctcatttccaag

SEQ ID NO: 4256337 - DNA, 17 bp, Homo sapiens
tccaagcatttagatgt

SEQ ID NO: 4256338 - DNA, 15 bp, Homo sapiens
tccaccgcagaagga

SEQ ID NO: 4256339 - DNA, 16 bp, Homo sapiens
tccaccgcagaaggaa

SEQ ID NO: 4256340 - DNA, 16 bp, Homo sapiens
tccactcgtgtgtttc

SEQ ID NO: 4256341 - DNA, 18 bp, Homo sapiens
tccactcgtgtgtttcta

SEQ ID NO: 4256342 - DNA, 19 bp, Homo sapiens
tccagaaatacaattttag

SEQ ID NO: 4256343 - DNA, 17 bp, Homo sapiens
tccagatcctggaaatc

SEQ ID NO: 4256344 - DNA, 23 bp, Homo sapiens
gctggaaaagtatgttagtgcaa

SEQ ID NO: 4256345 - DNA, 14 bp, Homo sapiens
gctggagtgcagtg

SEQ ID NO: 4256346 - DNA, 16 bp, Homo sapiens
gctggcattacaggtg

SEQ ID NO: 4256347 - DNA, 20 bp, Homo sapiens
gctgtattttaaaagaatga

SEQ ID NO: 4256348 - DNA, 22 bp, Homo sapiens
gctgtattttaaaagaatgatt

SEQ ID NO: 4256349 - DNA, 14 bp, Homo sapiens
gcttaattcaaata

SEQ ID NO: 4256350 - DNA, 19 bp, Homo sapiens
gcttcctggcaatagtcaa

SEQ ID NO: 4256351 - DNA, 17 bp, Homo sapiens
ggaaaccttccacccag

SEQ ID NO: 4256352 - DNA, 19 bp, Homo sapiens
ggaaagcagcctggccaac

SEQ ID NO: 4256353 - DNA, 19 bp, Homo sapiens
ggaaagcgcctccaaccct

SEQ ID NO: 4256354 - DNA, 20 bp, Homo sapiens
ggaaattcccttcatctgga

SEQ ID NO: 4256355 - DNA, 22 bp, Homo sapiens
ggaaattcccttcatctggaac

SEQ ID NO: 4256356 - DNA, 22 bp, Homo sapiens
ggaagaagagatcaggaagaga

SEQ ID NO: 4256357 - DNA, 12 bp, Homo sapiens
ggaagagaagga

SEQ ID NO: 4256358 - DNA, 16 bp, Homo sapiens
ggaaggaggacccagg

SEQ ID NO: 4256359 - DNA, 16 bp, Homo sapiens
ggaattggagctcgtg

SEQ ID NO: 4256360 - DNA, 22 bp, Homo sapiens
ggaattggagctcgtgggacag

SEQ ID NO: 4256361 - DNA, 12 bp, Homo sapiens
ggacacatgtcc

SEQ ID NO: 4256362 - DNA, 11 bp, Homo sapiens
ggacacctgcc

SEQ ID NO: 4256363 - DNA, 13 bp, Homo sapiens
ggacacctgccct

SEQ ID NO: 4256364 - DNA, 14 bp, Homo sapiens
ggacacctgccctg

SEQ ID NO: 4256365 - DNA, 16 bp, Homo sapiens
ggacacctgccctgcc

SEQ ID NO: 4256366 - DNA, 20 bp, Homo sapiens
ggacactacacccagcaata

SEQ ID NO: 4256367 - DNA, 21 bp, Homo sapiens
ggacactacacccagcaatag

SEQ ID NO: 4256368 - DNA, 17 bp, Homo sapiens
ggacagtcacctcatgg

SEQ ID NO: 4256369 - DNA, 20 bp, Homo sapiens
ggacatttgctcatggaatt

SEQ ID NO: 4256370 - DNA, 22 bp, Homo sapiens
ggaccagcttttcccaaaagcc

SEQ ID NO: 4256371 - DNA, 15 bp, Homo sapiens
ggactgcggaggaag

SEQ ID NO: 4256372 - DNA, 16 bp, Homo sapiens
ggactgcggaggaagg

SEQ ID NO: 4256373 - DNA, 14 bp, Homo sapiens
ggagaagaactgaa

SEQ ID NO: 4256374 - DNA, 19 bp, Homo sapiens
ggagcagagctgatggaga

SEQ ID NO: 4256375 - DNA, 19 bp, Homo sapiens
ggaggaaccagagtgctga

SEQ ID NO: 4256376 - DNA, 18 bp, Homo sapiens
ggaggaaggaggacccag

SEQ ID NO: 4256377 - DNA, 13 bp, Homo sapiens
ggaggggcagagc

SEQ ID NO: 4256378 - DNA, 15 bp, Homo sapiens
ggaggggcagagcca

SEQ ID NO: 4256379 - DNA, 16 bp, Homo sapiens
ggagtcaaaaattaaa

SEQ ID NO: 4256380 - DNA, 20 bp, Homo sapiens
ggcagagaagaaagaacgga

SEQ ID NO: 4256381 - DNA, 13 bp, Homo sapiens
ggcagagccagga

SEQ ID NO: 4256382 - DNA, 15 bp, Homo sapiens
ggcagcaacaataaa

SEQ ID NO: 4256383 - DNA, 17 bp, Homo sapiens
ggcagcaacaataaata

SEQ ID NO: 4256384 - DNA, 20 bp, Homo sapiens
ggccaggcaggagcccttct

SEQ ID NO: 4256385 - DNA, 20 bp, Homo sapiens
ggcctattgttgaataaatg

SEQ ID NO: 4256386 - DNA, 17 bp, Homo sapiens
ggctagactagtctcaa

SEQ ID NO: 4256387 - DNA, 17 bp, Homo sapiens
ggctcctattcaacaca

SEQ ID NO: 4256388 - DNA, 14 bp, Homo sapiens
ggcttgccacaccc

SEQ ID NO: 4256389 - DNA, 14 bp, Homo sapiens
gggaattgaggaca

SEQ ID NO: 4256390 - DNA, 21 bp, Homo sapiens
gggacagtcacctcatggaat

SEQ ID NO: 4256391 - DNA, 22 bp, Homo sapiens
gggacagtcacctcatggaatt

SEQ ID NO: 4256392 - DNA, 20 bp, Homo sapiens
gggacatttgctcatggaat

SEQ ID NO: 4256393 - DNA, 22 bp, Homo sapiens
gggacgttcgtggtcctgcgct

SEQ ID NO: 4256394 - DNA, 12 bp, Homo sapiens
gggctaccagga

SEQ ID NO: 4256395 - DNA, 13 bp, Homo sapiens
ggggcagagccag

SEQ ID NO: 4256396 - DNA, 15 bp, Homo sapiens
ggggcagagccagga

SEQ ID NO: 4256397 - DNA, 18 bp, Homo sapiens
ggtaagttttttgaaatt

SEQ ID NO: 4256398 - DNA, 15 bp, Homo sapiens
ggtagacacacatga

SEQ ID NO: 4256399 - DNA, 22 bp, Homo sapiens
ggtagacacacatgaagtccaa

SEQ ID NO: 4256400 - DNA, 16 bp, Homo sapiens
ggtatgaacttgagga

SEQ ID NO: 4256401 - DNA, 20 bp, Homo sapiens
ggtatgaacttgaggacaca

SEQ ID NO: 4256402 - DNA, 20 bp, Homo sapiens
ggtcacgtttggtgcttctc

SEQ ID NO: 4256403 - DNA, 13 bp, Homo sapiens
ggtcggaccagct

SEQ ID NO: 4256404 - DNA, 14 bp, Homo sapiens
ggtcggaccagctt

SEQ ID NO: 4256405 - DNA, 20 bp, Homo sapiens
ggtctcttctgaataaagca

SEQ ID NO: 4256406 - DNA, 14 bp, Homo sapiens
ggtgagaccacctc

SEQ ID NO: 4256407 - DNA, 13 bp, Homo sapiens
ggtggcagcaaca

SEQ ID NO: 4256408 - DNA, 14 bp, Homo sapiens
ggtggcagcaacaa

SEQ ID NO: 4256409 - DNA, 16 bp, Homo sapiens
ggttagggaaaacatt

SEQ ID NO: 4256410 - DNA, 19 bp, Homo sapiens
ggtttcaccatgttggcca

SEQ ID NO: 4256411 - DNA, 16 bp, Homo sapiens
gtaaaataaaaggtcg

SEQ ID NO: 4256412 - DNA, 21 bp, Homo sapiens
gtaaagcccatttttaaaata

SEQ ID NO: 4256413 - DNA, 23 bp, Homo sapiens
gtaagcataagcttatgcttaaa

SEQ ID NO: 4256414 - DNA, 21 bp, Homo sapiens
gtacttcaaatccttgaagat

SEQ ID NO: 4256415 - DNA, 19 bp, Homo sapiens
gtagagttgatcaaaatca

SEQ ID NO: 4256416 - DNA, 17 bp, Homo sapiens
gtagcgttttttaaatg

SEQ ID NO: 4256417 - DNA, 20 bp, Homo sapiens
gtagtgttggagaagaactg

SEQ ID NO: 4256418 - DNA, 15 bp, Homo sapiens
gtataaaataatttt

SEQ ID NO: 4256419 - DNA, 15 bp, Homo sapiens
gtatattacaatgat

SEQ ID NO: 4256420 - DNA, 12 bp, Homo sapiens
gtatctcttcag

SEQ ID NO: 4256421 - DNA, 13 bp, Homo sapiens
gtatctcttcagt

SEQ ID NO: 4256422 - DNA, 17 bp, Homo sapiens
gtatgaaccaccgcgcc

SEQ ID NO: 4256423 - DNA, 19 bp, Homo sapiens
gtatgaacttgaggacaca

SEQ ID NO: 4256424 - DNA, 23 bp, Homo sapiens
gtatgaacttgaggacacatgtc

SEQ ID NO: 4256425 - DNA, 21 bp, Homo sapiens
gtatgggttagggaaaacatt

SEQ ID NO: 4256426 - DNA, 18 bp, Homo sapiens
gtatgtacttcatgctgt

SEQ ID NO: 4256427 - DNA, 16 bp, Homo sapiens
gtattttaaaagaatg

SEQ ID NO: 4256428 - DNA, 13 bp, Homo sapiens
gtcaaaaattaaa

SEQ ID NO: 4256429 - DNA, 14 bp, Homo sapiens
gtcaaaaattaaac

SEQ ID NO: 4256430 - DNA, 20 bp, Homo sapiens
gtcacccaggttggagtgca

SEQ ID NO: 4256431 - DNA, 14 bp, Homo sapiens
gtcacctcatggaa

SEQ ID NO: 4256432 - DNA, 15 bp, Homo sapiens
gtcccatccctgcgt

SEQ ID NO: 4256433 - DNA, 17 bp, Homo sapiens
gtctacactaagagaga

SEQ ID NO: 4256434 - DNA, 13 bp, Homo sapiens
gtctgactgtttc

SEQ ID NO: 4256435 - DNA, 14 bp, Homo sapiens
gtctgtctgtctgt

SEQ ID NO: 4256436 - DNA, 17 bp, Homo sapiens
gtgacattttacattaa

SEQ ID NO: 4256437 - DNA, 21 bp, Homo sapiens
gtgacattttacattaaattt

SEQ ID NO: 4256438 - DNA, 18 bp, Homo sapiens
gtgactttggctgcatgc

SEQ ID NO: 4256439 - DNA, 14 bp, Homo sapiens
gtgagaccacctct

SEQ ID NO: 4256440 - DNA, 13 bp, Homo sapiens
gtgcacctgcccc

SEQ ID NO: 4256441 - DNA, 24 bp, Homo sapiens
gtgcagtggcgcgatctcagctca

SEQ ID NO: 4256442 - DNA, 24 bp, Homo sapiens
gtgcagtggcgtgatctcagctca

SEQ ID NO: 4256443 - DNA, 12 bp, Homo sapiens
gtggacacctgc

SEQ ID NO: 4256444 - DNA, 19 bp, Homo sapiens
gtggcatcatctcagctca

SEQ ID NO: 4256445 - DNA, 13 bp, Homo sapiens
gtggtagagaagc

SEQ ID NO: 4256446 - DNA, 17 bp, Homo sapiens
gttaactattgcattta

SEQ ID NO: 4256447 - DNA, 20 bp, Homo sapiens
gttagggaaaacattccatc

SEQ ID NO: 4256448 - DNA, 18 bp, Homo sapiens
gttcccttgatgaagaag

SEQ ID NO: 4256449 - DNA, 12 bp, Homo sapiens
gttctgaagaag

SEQ ID NO: 4256450 - DNA, 15 bp, Homo sapiens
gttctgaagaagatg

SEQ ID NO: 4256451 - DNA, 23 bp, Homo sapiens
gttctggtatgaacttgaggaca

SEQ ID NO: 4256452 - DNA, 12 bp, Homo sapiens
gttgaataaatg

SEQ ID NO: 4256453 - DNA, 14 bp, Homo sapiens
gttgacatgggaca

SEQ ID NO: 4256454 - DNA, 14 bp, Homo sapiens
gttggagtgcagtg

SEQ ID NO: 4256455 - DNA, 16 bp, Homo sapiens
gttgtaaaccaagtga

SEQ ID NO: 4256456 - DNA, 17 bp, Homo sapiens
gtttcctccaagctatt

SEQ ID NO: 4256457 - DNA, 17 bp, Homo sapiens
gtttctattttttgaaa

SEQ ID NO: 4256458 - DNA, 17 bp, Homo sapiens
gtttttttgttattaaa

SEQ ID NO: 4256459 - DNA, 16 bp, Homo sapiens
taaaaaagaaacattt

SEQ ID NO: 4256460 - DNA, 16 bp, Homo sapiens
taaaaataaacatgtt

SEQ ID NO: 4256461 - DNA, 18 bp, Homo sapiens
taaaatagtctctttaaa

SEQ ID NO: 4256462 - DNA, 19 bp, Homo sapiens
taaaatccatacatttgtg

SEQ ID NO: 4256463 - DNA, 14 bp, Homo sapiens
taaaggactgtaat

SEQ ID NO: 4256464 - DNA, 17 bp, Homo sapiens
taaagtgaccctgctct

SEQ ID NO: 4256465 - DNA, 12 bp, Homo sapiens
taaatgtatact

SEQ ID NO: 4256466 - DNA, 15 bp, Homo sapiens
taaatgtatctgaat

SEQ ID NO: 4256467 - DNA, 22 bp, Homo sapiens
taaatgttatgactatgtaaac

SEQ ID NO: 4256468 - DNA, 23 bp, Homo sapiens
taaatgttatgactatgtaaact

SEQ ID NO: 4256469 - DNA, 15 bp, Homo sapiens
taacaatgctgtatt

SEQ ID NO: 4256470 - DNA, 19 bp, Homo sapiens
taacaatgctgtattttaa

SEQ ID NO: 4256471 - DNA, 23 bp, Homo sapiens
gaagtccaagcatttagatgtat

SEQ ID NO: 4256472 - DNA, 21 bp, Homo sapiens
gaataaatgtatctgaatatc

SEQ ID NO: 4256473 - DNA, 22 bp, Homo sapiens
gaatgagagacacactgaagaa

SEQ ID NO: 4256474 - DNA, 15 bp, Homo sapiens
gaatggaggggcaga

SEQ ID NO: 4256475 - DNA, 20 bp, Homo sapiens
gaatggaggggcagagccag

SEQ ID NO: 4256476 - DNA, 13 bp, Homo sapiens
gaattacatttgt

SEQ ID NO: 4256477 - DNA, 15 bp, Homo sapiens
gaattacgtgctctg

SEQ ID NO: 4256478 - DNA, 19 bp, Homo sapiens
gaattacgtgctctgtggg

SEQ ID NO: 4256479 - DNA, 14 bp, Homo sapiens
gaatttccctctct

SEQ ID NO: 4256480 - DNA, 12 bp, Homo sapiens
gacacacatgaa

SEQ ID NO: 4256481 - DNA, 15 bp, Homo sapiens
gacacactgaagaag

SEQ ID NO: 4256482 - DNA, 16 bp, Homo sapiens
gacacactgaagaagc

SEQ ID NO: 4256483 - DNA, 14 bp, Homo sapiens
gacacctgccctgc

SEQ ID NO: 4256484 - DNA, 16 bp, Homo sapiens
gacacctgccctgccc

SEQ ID NO: 4256485 - DNA, 14 bp, Homo sapiens
gacacgcacggcag

SEQ ID NO: 4256486 - DNA, 19 bp, Homo sapiens
gacacgcacggcagccaca

SEQ ID NO: 4256487 - DNA, 14 bp, Homo sapiens
gacactacacccag

SEQ ID NO: 4256488 - DNA, 15 bp, Homo sapiens
gacactacacccagc

SEQ ID NO: 4256489 - DNA, 16 bp, Homo sapiens
gacactacacccagca

SEQ ID NO: 4256490 - DNA, 19 bp, Homo sapiens
gacactacacccagcaata

SEQ ID NO: 4256491 - DNA, 21 bp, Homo sapiens
gacagcccttctttccacaga

SEQ ID NO: 4256492 - DNA, 13 bp, Homo sapiens
gacaggatccagg

SEQ ID NO: 4256493 - DNA, 18 bp, Homo sapiens
gacagtcacctcatggaa

SEQ ID NO: 4256494 - DNA, 16 bp, Homo sapiens
gacatttgctcatgga

SEQ ID NO: 4256495 - DNA, 17 bp, Homo sapiens
gacatttgctcatggaa

SEQ ID NO: 4256496 - DNA, 20 bp, Homo sapiens
gacattttaaaaaatggtca

SEQ ID NO: 4256497 - DNA, 15 bp, Homo sapiens
gacattttacattaa

SEQ ID NO: 4256498 - DNA, 22 bp, Homo sapiens
gacccaggacaggatccaggcc

SEQ ID NO: 4256499 - DNA, 19 bp, Homo sapiens
gaccggcggaccccagcca

SEQ ID NO: 4256500 - DNA, 20 bp, Homo sapiens
gaccggcggaccccagccat

SEQ ID NO: 4256501 - DNA, 11 bp, Homo sapiens
gacctgcctcc

SEQ ID NO: 4256502 - DNA, 15 bp, Homo sapiens
gactcttaagaagac

SEQ ID NO: 4256503 - DNA, 18 bp, Homo sapiens
gactcttaagaagactgc

SEQ ID NO: 4256504 - DNA, 15 bp, Homo sapiens
gactgaaaatattgt

SEQ ID NO: 4256505 - DNA, 24 bp, Homo sapiens
gactgcattatatttattactgta

SEQ ID NO: 4256506 - DNA, 17 bp, Homo sapiens
gactgggtaggaaagag

SEQ ID NO: 4256507 - DNA, 16 bp, Homo sapiens
gacttatagtacatga

SEQ ID NO: 4256508 - DNA, 15 bp, Homo sapiens
gacttggcccctgcc

SEQ ID NO: 4256509 - DNA, 22 bp, Homo sapiens
gactttttatggcactagtatt

SEQ ID NO: 4256510 - DNA, 22 bp, Homo sapiens
gagaacttccagatcctggaaa

SEQ ID NO: 4256511 - DNA, 16 bp, Homo sapiens
gagaagaactgaaatc

SEQ ID NO: 4256512 - DNA, 22 bp, Homo sapiens
gagaagcaagtaaaaaggctaa

SEQ ID NO: 4256513 - DNA, 21 bp, Homo sapiens
gagaatgagagacacactgaa

SEQ ID NO: 4256514 - DNA, 23 bp, Homo sapiens
gagacgggactgcggaggaagga

SEQ ID NO: 4256515 - DNA, 15 bp, Homo sapiens
gagactgggtaggaa

SEQ ID NO: 4256516 - DNA, 16 bp, Homo sapiens
gagctcgtgggacagt

SEQ ID NO: 4256517 - DNA, 16 bp, Homo sapiens
gagctgatggagaagg

SEQ ID NO: 4256518 - DNA, 22 bp, Homo sapiens
gagctggagatgaggccagacc

SEQ ID NO: 4256519 - DNA, 11 bp, Homo sapiens
gaggacacatg

SEQ ID NO: 4256520 - DNA, 13 bp, Homo sapiens
gaggacacatgtc

SEQ ID NO: 4256521 - DNA, 20 bp, Homo sapiens
gaggaggcagagaagaaaga

SEQ ID NO: 4256522 - DNA, 18 bp, Homo sapiens
gaggccagaccatggaca

SEQ ID NO: 4256523 - DNA, 20 bp, Homo sapiens
gaggcctattgttgaataaa

SEQ ID NO: 4256524 - DNA, 23 bp, Homo sapiens
gaggctgggaatggaggggcaga

SEQ ID NO: 4256525 - DNA, 17 bp, Homo sapiens
gagtcactacgcctggc

SEQ ID NO: 4256526 - DNA, 16 bp, Homo sapiens
gatatcatgcaaattt

SEQ ID NO: 4256527 - DNA, 21 bp, Homo sapiens
gatccacccgcctcagcctcc

SEQ ID NO: 4256528 - DNA, 23 bp, Homo sapiens
gatccaggccggcttgccacacc

SEQ ID NO: 4256529 - DNA, 12 bp, Homo sapiens
gatcccccagaa

SEQ ID NO: 4256530 - DNA, 17 bp, Homo sapiens
gatctcagctcactaca

SEQ ID NO: 4256531 - DNA, 17 bp, Homo sapiens
gatctcagctcactgca

SEQ ID NO: 4256532 - DNA, 22 bp, Homo sapiens
gatgaggccagaccatggacac

SEQ ID NO: 4256533 - DNA, 18 bp, Homo sapiens
gatgcagttctgaagaag

SEQ ID NO: 4256534 - DNA, 13 bp, Homo sapiens
gatggagaaggaa

SEQ ID NO: 4256535 - DNA, 17 bp, Homo sapiens
gatggggtttcaccatg

SEQ ID NO: 4256536 - DNA, 15 bp, Homo sapiens
gatttccagccttct

SEQ ID NO: 4256537 - DNA, 15 bp, Homo sapiens
gcaaaaacaaaaaga

SEQ ID NO: 4256538 - DNA, 21 bp, Homo sapiens
gcaaaaacaaaaagaaaagaa

SEQ ID NO: 4256539 - DNA, 10 bp, Homo sapiens
gcaagccaga

SEQ ID NO: 4256540 - DNA, 20 bp, Homo sapiens
gcaagtattagaataccaca

SEQ ID NO: 4256541 - DNA, 18 bp, Homo sapiens
gcaagtttccatcatcta

SEQ ID NO: 4256542 - DNA, 11 bp, Homo sapiens
gcaatagagac

SEQ ID NO: 4256543 - DNA, 18 bp, Homo sapiens
gcaatagtcaaattgtgt

SEQ ID NO: 4256544 - DNA, 22 bp, Homo sapiens
gcaatagtcaaattgtgtgaaa

SEQ ID NO: 4256545 - DNA, 15 bp, Homo sapiens
gcacagcctcttaga

SEQ ID NO: 4256546 - DNA, 18 bp, Homo sapiens
gcacagcctcttagatgc

SEQ ID NO: 4256547 - DNA, 14 bp, Homo sapiens
gcacggcagccaca

SEQ ID NO: 4256548 - DNA, 16 bp, Homo sapiens
gcacggcagccacagc

SEQ ID NO: 4256549 - DNA, 19 bp, Homo sapiens
gcagaaagcatccctcacc

SEQ ID NO: 4256550 - DNA, 12 bp, Homo sapiens
gcagaaggaagg

SEQ ID NO: 4256551 - DNA, 15 bp, Homo sapiens
gcagaaggaaggcag

SEQ ID NO: 4256552 - DNA, 14 bp, Homo sapiens
gcagagccaggaag

SEQ ID NO: 4256553 - DNA, 15 bp, Homo sapiens
gcagagccaggaaga

SEQ ID NO: 4256554 - DNA, 22 bp, Homo sapiens
gcagagctgatggagaaggaag

SEQ ID NO: 4256555 - DNA, 17 bp, Homo sapiens
gcagcaatttaaatgtt

SEQ ID NO: 4256556 - DNA, 18 bp, Homo sapiens
gcagtctctataccaata

SEQ ID NO: 4256557 - DNA, 22 bp, Homo sapiens
gcagtctctataccaataaagt

SEQ ID NO: 4256558 - DNA, 23 bp, Homo sapiens
gcagtctctataccaataaagtg

SEQ ID NO: 4256559 - DNA, 18 bp, Homo sapiens
gcagtggcgcgatctcag

SEQ ID NO: 4256560 - DNA, 22 bp, Homo sapiens
gcagtggcgcgatctcagctca

SEQ ID NO: 4256561 - DNA, 15 bp, Homo sapiens
gcatcatctcagctc

SEQ ID NO: 4256562 - DNA, 11 bp, Homo sapiens
gcatccagcct

SEQ ID NO: 4256563 - DNA, 15 bp, Homo sapiens
gcattataaaaagaa

SEQ ID NO: 4256564 - DNA, 13 bp, Homo sapiens
gcattatatttat

SEQ ID NO: 4256565 - DNA, 12 bp, Homo sapiens
gccacctgtctg

SEQ ID NO: 4256566 - DNA, 13 bp, Homo sapiens
gccagaccatgga

SEQ ID NO: 4256567 - DNA, 16 bp, Homo sapiens
gccagaccatggacac

SEQ ID NO: 4256568 - DNA, 17 bp, Homo sapiens
gccagaccatggacact

SEQ ID NO: 4256569 - DNA, 19 bp, Homo sapiens
gccaggctggagtgcagtg

SEQ ID NO: 4256570 - DNA, 14 bp, Homo sapiens
gccagggagcgagt

SEQ ID NO: 4256571 - DNA, 22 bp, Homo sapiens
gccatgtgctagtaattggaaa

SEQ ID NO: 4256572 - DNA, 19 bp, Homo sapiens
gcccccactgcctttgacc

SEQ ID NO: 4256573 - DNA, 13 bp, Homo sapiens
gccctgccacctg

SEQ ID NO: 4256574 - DNA, 17 bp, Homo sapiens
gccctgccctgccacct

SEQ ID NO: 4256575 - DNA, 19 bp, Homo sapiens
gcccttctttccacagaag

SEQ ID NO: 4256576 - DNA, 17 bp, Homo sapiens
gcctattgttgaataaa

SEQ ID NO: 4256577 - DNA, 19 bp, Homo sapiens
gcctattgttgaataaatg

SEQ ID NO: 4256578 - DNA, 19 bp, Homo sapiens
gcctcaccagccctggcaa

SEQ ID NO: 4256579 - DNA, 20 bp, Homo sapiens
gcctccaaccctagcaaaag

SEQ ID NO: 4256580 - DNA, 14 bp, Homo sapiens
gcctcccaggttca

SEQ ID NO: 4256581 - DNA, 22 bp, Homo sapiens
gcctggggctgaggctgaggca

SEQ ID NO: 4256582 - DNA, 18 bp, Homo sapiens
gccttggggctgatgcag

SEQ ID NO: 4256583 - DNA, 16 bp, Homo sapiens
gcctttgacctgcctc

SEQ ID NO: 4256584 - DNA, 19 bp, Homo sapiens
gcgagataccccacctccc

SEQ ID NO: 4256585 - DNA, 14 bp, Homo sapiens
gcgatctcagctca

SEQ ID NO: 4256586 - DNA, 21 bp, Homo sapiens
gcgcctcgccggatctgaggg

SEQ ID NO: 4256587 - DNA, 16 bp, Homo sapiens
gcgtgatctcagctca

SEQ ID NO: 4256588 - DNA, 19 bp, Homo sapiens
gcgttttttaaatgtatac

SEQ ID NO: 4256589 - DNA, 20 bp, Homo sapiens
gctaagtacacaataagcaa

SEQ ID NO: 4256590 - DNA, 22 bp, Homo sapiens
gctaagtacacaataagcaaaa

SEQ ID NO: 4256591 - DNA, 16 bp, Homo sapiens
gctagatgtatgtact

SEQ ID NO: 4256592 - DNA, 12 bp, Homo sapiens
gctatccaccaa

SEQ ID NO: 4256593 - DNA, 16 bp, Homo sapiens
gctgatggagaaggaa

SEQ ID NO: 4256594 - DNA, 20 bp, Homo sapiens
gctgcccctggtgcactggc

SEQ ID NO: 4256595 - DNA, 18 bp, Homo sapiens
gctgcctcttccctcttc

SEQ ID NO: 4256596 - DNA, 12 bp, Homo sapiens
gctgctgcctgc

SEQ ID NO: 4256597 - DNA, 16 bp, Homo sapiens
gctgctgcctgcctgg

SEQ ID NO: 4256598 - DNA, 13 bp, Homo sapiens
aaataataatttt

SEQ ID NO: 4256599 - DNA, 15 bp, Homo sapiens
aaataatttttatat

SEQ ID NO: 4256600 - DNA, 23 bp, Homo sapiens
aaataatttttatatttgaaata

SEQ ID NO: 4256601 - DNA, 12 bp, Homo sapiens
aaatatatacta

SEQ ID NO: 4256602 - DNA, 17 bp, Homo sapiens
aaatattatgttaaaac

SEQ ID NO: 4256603 - DNA, 15 bp, Homo sapiens
aaatatttattttaa

SEQ ID NO: 4256604 - DNA, 16 bp, Homo sapiens
aaatctcaattcttcc

SEQ ID NO: 4256605 - DNA, 20 bp, Homo sapiens
aaatggtctctaacatttcc

SEQ ID NO: 4256606 - DNA, 11 bp, Homo sapiens
aaatgtatact

SEQ ID NO: 4256607 - DNA, 14 bp, Homo sapiens
aaatgtatctgaat

SEQ ID NO: 4256608 - DNA, 22 bp, Homo sapiens
aaatgttatgactatgtaaact

SEQ ID NO: 4256609 - DNA, 16 bp, Homo sapiens
aaattatctatagcta

SEQ ID NO: 4256610 - DNA, 20 bp, Homo sapiens
aaattatgtgacattttaca

SEQ ID NO: 4256611 - DNA, 22 bp, Homo sapiens
aaattatgtgacattttacatt

SEQ ID NO: 4256612 - DNA, 18 bp, Homo sapiens
aaattttttttacatttt

SEQ ID NO: 4256613 - DNA, 15 bp, Homo sapiens
aacaatgctgtattt

SEQ ID NO: 4256614 - DNA, 15 bp, Homo sapiens
aacacaactatattg

SEQ ID NO: 4256615 - DNA, 16 bp, Homo sapiens
aacacaactatattgt

SEQ ID NO: 4256616 - DNA, 15 bp, Homo sapiens
aacataaaaaggaca

SEQ ID NO: 4256617 - DNA, 22 bp, Homo sapiens
aacataaaaaggacatcagcaa

SEQ ID NO: 4256618 - DNA, 16 bp, Homo sapiens
aacatatataacaatg

SEQ ID NO: 4256619 - DNA, 13 bp, Homo sapiens
aacattccatcct

SEQ ID NO: 4256620 - DNA, 23 bp, Homo sapiens
aacattccatccttgagtcaaaa

SEQ ID NO: 4256621 - DNA, 17 bp, Homo sapiens
aaccaaggttttgaaat

SEQ ID NO: 4256622 - DNA, 14 bp, Homo sapiens
aaccactttttgca

SEQ ID NO: 4256623 - DNA, 17 bp, Homo sapiens
aaccactttttgcagct

SEQ ID NO: 4256624 - DNA, 15 bp, Homo sapiens
aaccagagtgctgaa

SEQ ID NO: 4256625 - DNA, 20 bp, Homo sapiens
aacctagggtgatattaacc

SEQ ID NO: 4256626 - DNA, 16 bp, Homo sapiens
aactattgcatttata

SEQ ID NO: 4256627 - DNA, 21 bp, Homo sapiens
aactccagaaagtgacaagct

SEQ ID NO: 4256628 - DNA, 18 bp, Homo sapiens
aactcgttaatttgtagt

SEQ ID NO: 4256629 - DNA, 20 bp, Homo sapiens
aactgaaatcatacttctta

SEQ ID NO: 4256630 - DNA, 15 bp, Homo sapiens
aactgactcttaaga

SEQ ID NO: 4256631 - DNA, 19 bp, Homo sapiens
aactgctaatctactttct

SEQ ID NO: 4256632 - DNA, 16 bp, Homo sapiens
aactggggctcctcca

SEQ ID NO: 4256633 - DNA, 15 bp, Homo sapiens
aacttgaggacacat

SEQ ID NO: 4256634 - DNA, 16 bp, Homo sapiens
aacttgaggacacatg

SEQ ID NO: 4256635 - DNA, 18 bp, Homo sapiens
aacttgaggacacatgtc

SEQ ID NO: 4256636 - DNA, 22 bp, Homo sapiens
aagaaaatttttgtagtagcgt

SEQ ID NO: 4256637 - DNA, 16 bp, Homo sapiens
aagaaagtcagccata

SEQ ID NO: 4256638 - DNA, 15 bp, Homo sapiens
aagaagactgcatta

SEQ ID NO: 4256639 - DNA, 16 bp, Homo sapiens
aagaatgattatgaat

SEQ ID NO: 4256640 - DNA, 17 bp, Homo sapiens
aagactgcattatattt

SEQ ID NO: 4256641 - DNA, 13 bp, Homo sapiens
aagatgatcattt

SEQ ID NO: 4256642 - DNA, 19 bp, Homo sapiens
aagcaaaattttttctcta

SEQ ID NO: 4256643 - DNA, 19 bp, Homo sapiens
aagcaagtaaaaaggctaa

SEQ ID NO: 4256644 - DNA, 21 bp, Homo sapiens
aagcccattcattccattctg

SEQ ID NO: 4256645 - DNA, 19 bp, Homo sapiens
aagcctccttagaaaaaaa

SEQ ID NO: 4256646 - DNA, 20 bp, Homo sapiens
aagctacagaagaaactggg

SEQ ID NO: 4256647 - DNA, 20 bp, Homo sapiens
aagctcacagacctttgaac

SEQ ID NO: 4256648 - DNA, 20 bp, Homo sapiens
aagctggagtgcagtggcat

SEQ ID NO: 4256649 - DNA, 23 bp, Homo sapiens
aagcttgtattcctttttctctc

SEQ ID NO: 4256650 - DNA, 17 bp, Homo sapiens
aaggaaggctccatctc

SEQ ID NO: 4256651 - DNA, 14 bp, Homo sapiens
aaggacatcagcaa

SEQ ID NO: 4256652 - DNA, 14 bp, Homo sapiens
aaggactgtaatct

SEQ ID NO: 4256653 - DNA, 14 bp, Homo sapiens
aaggaggacccagg

SEQ ID NO: 4256654 - DNA, 20 bp, Homo sapiens
aaggcagctctaaatgtcaa

SEQ ID NO: 4256655 - DNA, 19 bp, Homo sapiens
aaggcagggaggaggcaga

SEQ ID NO: 4256656 - DNA, 13 bp, Homo sapiens
aaggtacttcaaa

SEQ ID NO: 4256657 - DNA, 14 bp, Homo sapiens
aaggtcggaccagc

SEQ ID NO: 4256658 - DNA, 12 bp, Homo sapiens
aaggtctgcttt

SEQ ID NO: 4256659 - DNA, 17 bp, Homo sapiens
aagtacacaataagcaa

SEQ ID NO: 4256660 - DNA, 18 bp, Homo sapiens
aagtatgttagtgcaaat

SEQ ID NO: 4256661 - DNA, 21 bp, Homo sapiens
aagtatgttagtgcaaattgt

SEQ ID NO: 4256662 - DNA, 23 bp, Homo sapiens
aagtatgttagtgcaaattgtca

SEQ ID NO: 4256663 - DNA, 13 bp, Homo sapiens
aagtattagaata

SEQ ID NO: 4256664 - DNA, 21 bp, Homo sapiens
aagttgacttatagtacatga

SEQ ID NO: 4256665 - DNA, 18 bp, Homo sapiens
aataaaggactgtaatct

SEQ ID NO: 4256666 - DNA, 13 bp, Homo sapiens
aataaatgtatct

SEQ ID NO: 4256667 - DNA, 16 bp, Homo sapiens
aataaatgtatctgaa

SEQ ID NO: 4256668 - DNA, 23 bp, Homo sapiens
aatacatcccttacctgggaaag

SEQ ID NO: 4256669 - DNA, 23 bp, Homo sapiens
aataccacaggaaccacaagact

SEQ ID NO: 4256670 - DNA, 12 bp, Homo sapiens
aatatcacttgt

SEQ ID NO: 4256671 - DNA, 15 bp, Homo sapiens
aatatcacttgtcaa

SEQ ID NO: 4256672 - DNA, 21 bp, Homo sapiens
aatatgccccattcaacatct

SEQ ID NO: 4256673 - DNA, 15 bp, Homo sapiens
aatattcaataaagc

SEQ ID NO: 4256674 - DNA, 15 bp, Homo sapiens
aatatttattttaat

SEQ ID NO: 4256675 - DNA, 14 bp, Homo sapiens
aatatttcagataa

SEQ ID NO: 4256676 - DNA, 17 bp, Homo sapiens
aatcatgaattagtttt

SEQ ID NO: 4256677 - DNA, 13 bp, Homo sapiens
aatccatacattt

SEQ ID NO: 4256678 - DNA, 14 bp, Homo sapiens
aatgataactggaa

SEQ ID NO: 4256679 - DNA, 16 bp, Homo sapiens
aatgataactggaaac

SEQ ID NO: 4256680 - DNA, 17 bp, Homo sapiens
aatgataactggaaact

SEQ ID NO: 4256681 - DNA, 20 bp, Homo sapiens
aatgataactggaaacttca

SEQ ID NO: 4256682 - DNA, 21 bp, Homo sapiens
aatgatagacaattgaggtaa

SEQ ID NO: 4256683 - DNA, 20 bp, Homo sapiens
aatggaggggcagagccagg

SEQ ID NO: 4256684 - DNA, 19 bp, Homo sapiens
aatgtatactatagtacca

SEQ ID NO: 4256685 - DNA, 22 bp, Homo sapiens
aatgttatgactatgtaaacta

SEQ ID NO: 4256686 - DNA, 23 bp, Homo sapiens
aatgtttcaaacatatataacaa

SEQ ID NO: 4256687 - DNA, 13 bp, Homo sapiens
aattacatttgta

SEQ ID NO: 4256688 - DNA, 14 bp, Homo sapiens
aattacatttgtat

SEQ ID NO: 4256689 - DNA, 17 bp, Homo sapiens
aattagttttatatgct

SEQ ID NO: 4256690 - DNA, 15 bp, Homo sapiens
aattatctatagcta

SEQ ID NO: 4256691 - DNA, 22 bp, Homo sapiens
aattatctatagctaagtacac

SEQ ID NO: 4256692 - DNA, 17 bp, Homo sapiens
aattatgtgacatttta

SEQ ID NO: 4256693 - DNA, 22 bp, Homo sapiens
aattctttaaaattacaactaa

SEQ ID NO: 4256694 - DNA, 19 bp, Homo sapiens
aattgagaaaaatatatac

SEQ ID NO: 4256695 - DNA, 15 bp, Homo sapiens
aattggagctcgtgg

SEQ ID NO: 4256696 - DNA, 23 bp, Homo sapiens
aattgtgtgaaaggtacttcaaa

SEQ ID NO: 4256697 - DNA, 11 bp, Homo sapiens
aatttaaatgt

SEQ ID NO: 4256698 - DNA, 13 bp, Homo sapiens
aatttaaatgtta

SEQ ID NO: 4256699 - DNA, 13 bp, Homo sapiens
aattttgtgaagc

SEQ ID NO: 4256700 - DNA, 18 bp, Homo sapiens
aattttgtgaagcaaaat

SEQ ID NO: 4256701 - DNA, 19 bp, Homo sapiens
aatttttatatttgaaata

SEQ ID NO: 4256702 - DNA, 13 bp, Homo sapiens
aatttttgtagta

SEQ ID NO: 4256703 - DNA, 10 bp, Homo sapiens
acaactaagt

SEQ ID NO: 4256704 - DNA, 15 bp, Homo sapiens
acaataagcaaaaac

SEQ ID NO: 4256705 - DNA, 21 bp, Homo sapiens
acaatgatcaccgactgaaaa

SEQ ID NO: 4256706 - DNA, 17 bp, Homo sapiens
acaatgctgtattttaa

SEQ ID NO: 4256707 - DNA, 22 bp, Homo sapiens
acaatgctgtattttaaaagaa

SEQ ID NO: 4256708 - DNA, 22 bp, Homo sapiens
acaatgtcctaactgaaagatg

SEQ ID NO: 4256709 - DNA, 17 bp, Homo sapiens
acacaactatattgttt

SEQ ID NO: 4256710 - DNA, 13 bp, Homo sapiens
acacactgaagaa

SEQ ID NO: 4256711 - DNA, 14 bp, Homo sapiens
acacactgaagaag

SEQ ID NO: 4256712 - DNA, 22 bp, Homo sapiens
acacctgccctgccctgccacc

SEQ ID NO: 4256713 - DNA, 23 bp, Homo sapiens
acactacacccagcaatagagac

SEQ ID NO: 4256714 - DNA, 12 bp, Homo sapiens
acactgaagaag

SEQ ID NO: 4256715 - DNA, 14 bp, Homo sapiens
acactgaagaagca

SEQ ID NO: 4256716 - DNA, 13 bp, Homo sapiens
acactgggacttg

SEQ ID NO: 4256717 - DNA, 16 bp, Homo sapiens
acagaagctccaggta

SEQ ID NO: 4256718 - DNA, 14 bp, Homo sapiens
acagacctttgaac

SEQ ID NO: 4256719 - DNA, 23 bp, Homo sapiens
acagagctggagatgaggccaga

SEQ ID NO: 4256720 - DNA, 14 bp, Homo sapiens
acagagtcttcctc

SEQ ID NO: 4256721 - DNA, 15 bp, Homo sapiens
acagctgcctcttcc

SEQ ID NO: 4256722 - DNA, 20 bp, Homo sapiens
acagctgtatgattcccagc

SEQ ID NO: 4256723 - DNA, 22 bp, Homo sapiens
acaggatggttcccttgatgaa

SEQ ID NO: 4256724 - DNA, 16 bp, Homo sapiens
acaggcatgtgtcacc

SEQ ID NO: 4256725 - DNA, 19 bp, Homo sapiens
acaggcatgtgtcaccatg

SEQ ID NO: 4256726 - DNA, 21 bp, Homo sapiens
acagggcctttggcaggtgca

SEQ ID NO: 4256727 - DNA, 14 bp, Homo sapiens
acataaaaaggaca

SEQ ID NO: 4256728 - DNA, 22 bp, Homo sapiens
acataaaaaggacatcagcaaa

SEQ ID NO: 4256729 - DNA, 11 bp, Homo sapiens
acatctttaag

SEQ ID NO: 4256730 - DNA, 20 bp, Homo sapiens
acatctttaaggggaggaac

SEQ ID NO: 4256731 - DNA, 16 bp, Homo sapiens
acatgaagtccaagca

SEQ ID NO: 4256732 - DNA, 13 bp, Homo sapiens
acatgcttccctt

SEQ ID NO: 4256733 - DNA, 14 bp, Homo sapiens
acatgggacatttg

SEQ ID NO: 4256734 - DNA, 15 bp, Homo sapiens
acatgggacatttgc

SEQ ID NO: 4256735 - DNA, 18 bp, Homo sapiens
acatttgctcatggaatt

SEQ ID NO: 4256736 - DNA, 20 bp, Homo sapiens
acattttaaaaaatggtcac

SEQ ID NO: 4256737 - DNA, 23 bp, Homo sapiens
accaaaaatctcaatatttcaga

SEQ ID NO: 4256738 - DNA, 12 bp, Homo sapiens
accaataaagtg

SEQ ID NO: 4256739 - DNA, 13 bp, Homo sapiens
accaatcatgaat

SEQ ID NO: 4256740 - DNA, 15 bp, Homo sapiens
accacctctcaatat

SEQ ID NO: 4256741 - DNA, 20 bp, Homo sapiens
accacgcctggctaattttt

SEQ ID NO: 4256742 - DNA, 15 bp, Homo sapiens
accactttttgcagc

SEQ ID NO: 4256743 - DNA, 17 bp, Homo sapiens
accactttttgcagctt

SEQ ID NO: 4256744 - DNA, 18 bp, Homo sapiens
accactttttgcagcttt

SEQ ID NO: 4256745 - DNA, 14 bp, Homo sapiens
accagtctgactgt

SEQ ID NO: 4256746 - DNA, 21 bp, Homo sapiens
accatggacactacacccagc

SEQ ID NO: 4256747 - DNA, 23 bp, Homo sapiens
accatggacactacacccagcaa

SEQ ID NO: 4256748 - DNA, 24 bp, Homo sapiens
accatggacactacacccagcaat

SEQ ID NO: 4256749 - DNA, 12 bp, Homo sapiens
acccacccagaa

SEQ ID NO: 4256750 - DNA, 18 bp, Homo sapiens
acccagaatgagacatcc

SEQ ID NO: 4256751 - DNA, 20 bp, Homo sapiens
acccagaatgagacatccag

SEQ ID NO: 4256752 - DNA, 10 bp, Homo sapiens
acccaggaca

SEQ ID NO: 4256753 - DNA, 19 bp, Homo sapiens
acccaggttggagtgcagt

SEQ ID NO: 4256754 - DNA, 20 bp, Homo sapiens
acccaggttggagtgcagtg

SEQ ID NO: 4256755 - DNA, 21 bp, Homo sapiens
acccctaaaagaaaccctgca

SEQ ID NO: 4256756 - DNA, 13 bp, Homo sapiens
acccctccactct

SEQ ID NO: 4256757 - DNA, 17 bp, Homo sapiens
acccctccactctttct

SEQ ID NO: 4256758 - DNA, 16 bp, Homo sapiens
accctaaccaagttcc

SEQ ID NO: 4256759 - DNA, 12 bp, Homo sapiens
accctcatgctg

SEQ ID NO: 4256760 - DNA, 17 bp, Homo sapiens
accctccctccctaccc

SEQ ID NO: 4256761 - DNA, 23 bp, Homo sapiens
accctcgtggacacctgccctgc

SEQ ID NO: 4256762 - DNA, 10 bp, Homo sapiens
aaaaaactac

SEQ ID NO: 4256763 - DNA, 16 bp, Homo sapiens
aaaaagaaacatttgg

SEQ ID NO: 4256764 - DNA, 16 bp, Homo sapiens
aaaaaggacatcagca

SEQ ID NO: 4256765 - DNA, 21 bp, Homo sapiens
aaaaattaaaccggaccatct

SEQ ID NO: 4256766 - DNA, 19 bp, Homo sapiens
aaaaattatctatagctaa

SEQ ID NO: 4256767 - DNA, 16 bp, Homo sapiens
aaaacattccatcctt

SEQ ID NO: 4256768 - DNA, 17 bp, Homo sapiens
aaaactacttctttttt

SEQ ID NO: 4256769 - DNA, 13 bp, Homo sapiens
aaaagcagacatt

SEQ ID NO: 4256770 - DNA, 17 bp, Homo sapiens
aaaaggacatcagcaaa

SEQ ID NO: 4256771 - DNA, 16 bp, Homo sapiens
aaaataatttttatat

SEQ ID NO: 4256772 - DNA, 17 bp, Homo sapiens
aaaataatttttatatt

SEQ ID NO: 4256773 - DNA, 20 bp, Homo sapiens
aaaataatttttatatttga

SEQ ID NO: 4256774 - DNA, 23 bp, Homo sapiens
aaaataatttttatatttgaaat

SEQ ID NO: 4256775 - DNA, 12 bp, Homo sapiens
aaaatacattgt

SEQ ID NO: 4256776 - DNA, 19 bp, Homo sapiens
aaaatccatacatttgtgt

SEQ ID NO: 4256777 - DNA, 16 bp, Homo sapiens
aaacatatataacaat

SEQ ID NO: 4256778 - DNA, 19 bp, Homo sapiens
aaacatatataacaatgct

SEQ ID NO: 4256779 - DNA, 10 bp, Homo sapiens
aaaccacttt

SEQ ID NO: 4256780 - DNA, 20 bp, Homo sapiens
aaaccactttttgcagcttt

SEQ ID NO: 4256781 - DNA, 16 bp, Homo sapiens
aaactgactcttaaga

SEQ ID NO: 4256782 - DNA, 17 bp, Homo sapiens
aaactgactcttaagaa

SEQ ID NO: 4256783 - DNA, 23 bp, Homo sapiens
aaacttcagcggtttatataagc

SEQ ID NO: 4256784 - DNA, 13 bp, Homo sapiens
aaagaaacatttg

SEQ ID NO: 4256785 - DNA, 15 bp, Homo sapiens
aaagaacggaagaag

SEQ ID NO: 4256786 - DNA, 16 bp, Homo sapiens
aaagaatgattatgaa

SEQ ID NO: 4256787 - DNA, 12 bp, Homo sapiens
aaagcatccctc

SEQ ID NO: 4256788 - DNA, 13 bp, Homo sapiens
aaaggactgtaat

SEQ ID NO: 4256789 - DNA, 20 bp, Homo sapiens
aaagggctgttataatcttt

SEQ ID NO: 4256790 - DNA, 22 bp, Homo sapiens
aaagggctgttataatctttca

SEQ ID NO: 4256791 - DNA, 14 bp, Homo sapiens
aaaggtacttcaaa

SEQ ID NO: 4256792 - DNA, 17 bp, Homo sapiens
aaagtatgttagtgcaa

SEQ ID NO: 4256793 - DNA, 14 bp, Homo sapiens
aaagtgaccctgtt

SEQ ID NO: 4256794 - DNA, 19 bp, Homo sapiens
aaataatgaatacatttcc

SEQ ID NO: 4256795 - DNA, 18 bp, Homo sapiens
aaatacattgtatatatg

SEQ ID NO: 4256796 - DNA, 16 bp, Homo sapiens
aaatagaagagagagg

SEQ ID NO: 4256797 - DNA, 16 bp, Homo sapiens
aaatatatactaaaca

SEQ ID NO: 4256798 - DNA, 22 bp, Homo sapiens
aaatatcacttgtcaataaaat

SEQ ID NO: 4256799 - DNA, 20 bp, Homo sapiens
aaatcaatctgtaaaactaa

SEQ ID NO: 4256800 - DNA, 18 bp, Homo sapiens
aaatctcaatatttcaga

SEQ ID NO: 4256801 - DNA, 13 bp, Homo sapiens
aaatgtatctgaa

SEQ ID NO: 4256802 - DNA, 12 bp, Homo sapiens
aaattacaacta

SEQ ID NO: 4256803 - DNA, 13 bp, Homo sapiens
aaattacaactaa

SEQ ID NO: 4256804 - DNA, 16 bp, Homo sapiens
aaattttttttacatt

SEQ ID NO: 4256805 - DNA, 17 bp, Homo sapiens
aaattttttttacattt

SEQ ID NO: 4256806 - DNA, 15 bp, Homo sapiens
aacaaggatgaatta

SEQ ID NO: 4256807 - DNA, 21 bp, Homo sapiens
aacaccctcacactgggactt

SEQ ID NO: 4256808 - DNA, 20 bp, Homo sapiens
aacaggatcagttaactatt

SEQ ID NO: 4256809 - DNA, 19 bp, Homo sapiens
aacataaaaaggacatcag

SEQ ID NO: 4256810 - DNA, 10 bp, Homo sapiens
aacattccat

SEQ ID NO: 4256811 - DNA, 14 bp, Homo sapiens
aacattccatcctt

SEQ ID NO: 4256812 - DNA, 22 bp, Homo sapiens
aaccaaatcactgaactttgct

SEQ ID NO: 4256813 - DNA, 15 bp, Homo sapiens
aaccactttttgcag

SEQ ID NO: 4256814 - DNA, 17 bp, Homo sapiens
aacctagggtgatatta

SEQ ID NO: 4256815 - DNA, 14 bp, Homo sapiens
aacggaagaagaga

SEQ ID NO: 4256816 - DNA, 13 bp, Homo sapiens
aactatattgttt

SEQ ID NO: 4256817 - DNA, 20 bp, Homo sapiens
aactatctcatttccaagca

SEQ ID NO: 4256818 - DNA, 19 bp, Homo sapiens
aactcttcaaggtctgctt

SEQ ID NO: 4256819 - DNA, 18 bp, Homo sapiens
aactgactcttaagaaga

SEQ ID NO: 4256820 - DNA, 17 bp, Homo sapiens
aactgggacaggggaga

SEQ ID NO: 4256821 - DNA, 21 bp, Homo sapiens
aacttcagcggtttatataag

SEQ ID NO: 4256822 - DNA, 13 bp, Homo sapiens
aacttgaggacac

SEQ ID NO: 4256823 - DNA, 17 bp, Homo sapiens
aacttgaggacacatgt

SEQ ID NO: 4256824 - DNA, 20 bp, Homo sapiens
aacttgaggacacatgtcca

SEQ ID NO: 4256825 - DNA, 13 bp, Homo sapiens
aagaaaacatctt

SEQ ID NO: 4256826 - DNA, 17 bp, Homo sapiens
aagaaaacatctttaag

SEQ ID NO: 4256827 - DNA, 19 bp, Homo sapiens
aagaaaatttttgtagtag

SEQ ID NO: 4256828 - DNA, 11 bp, Homo sapiens
aagaaacattt

SEQ ID NO: 4256829 - DNA, 16 bp, Homo sapiens
aagaaagaacggaaga

SEQ ID NO: 4256830 - DNA, 20 bp, Homo sapiens
aagaagactgcattatattt

SEQ ID NO: 4256831 - DNA, 13 bp, Homo sapiens
aagagaaggagca

SEQ ID NO: 4256832 - DNA, 15 bp, Homo sapiens
aagagatcaggaaga

SEQ ID NO: 4256833 - DNA, 22 bp, Homo sapiens
aagagatcaggaagagaaggag

SEQ ID NO: 4256834 - DNA, 14 bp, Homo sapiens
aagaggaagcaaat

SEQ ID NO: 4256835 - DNA, 19 bp, Homo sapiens
aagaggaattacgtgctct

SEQ ID NO: 4256836 - DNA, 16 bp, Homo sapiens
aagatttaccacttgt

SEQ ID NO: 4256837 - DNA, 16 bp, Homo sapiens
aagcagacattttaaa

SEQ ID NO: 4256838 - DNA, 13 bp, Homo sapiens
aagcatccctcac

SEQ ID NO: 4256839 - DNA, 16 bp, Homo sapiens
aagcatttagatgtat

SEQ ID NO: 4256840 - DNA, 13 bp, Homo sapiens
aagccagattttc

SEQ ID NO: 4256841 - DNA, 19 bp, Homo sapiens
aagccagattttcctgaaa

SEQ ID NO: 4256842 - DNA, 23 bp, Homo sapiens
aagcccattcattccattctgga

SEQ ID NO: 4256843 - DNA, 21 bp, Homo sapiens
aagccttggggctgatgcagt

SEQ ID NO: 4256844 - DNA, 14 bp, Homo sapiens
aagcgcctccaacc

SEQ ID NO: 4256845 - DNA, 16 bp, Homo sapiens
aagctagcaaatagta

SEQ ID NO: 4256846 - DNA, 15 bp, Homo sapiens
aaggaaagaaaacat

SEQ ID NO: 4256847 - DNA, 23 bp, Homo sapiens
aaggagcagagctgatggagaag

SEQ ID NO: 4256848 - DNA, 13 bp, Homo sapiens
aaggaggacccag

SEQ ID NO: 4256849 - DNA, 21 bp, Homo sapiens
aaggaggacccaggacaggat

SEQ ID NO: 4256850 - DNA, 22 bp, Homo sapiens
aaggaggacccaggacaggatc

SEQ ID NO: 4256851 - DNA, 14 bp, Homo sapiens
aaggtacttcaaat

SEQ ID NO: 4256852 - DNA, 19 bp, Homo sapiens
aagtaatgataactggaaa

SEQ ID NO: 4256853 - DNA, 18 bp, Homo sapiens
aagtacacaataagcaaa

SEQ ID NO: 4256854 - DNA, 18 bp, Homo sapiens
aagtccaagcatttagat

SEQ ID NO: 4256855 - DNA, 21 bp, Homo sapiens
aagtgatcaaactacatattg

SEQ ID NO: 4256856 - DNA, 16 bp, Homo sapiens
aagttgacttatagta

SEQ ID NO: 4256857 - DNA, 16 bp, Homo sapiens
aagtttccatcatcta

SEQ ID NO: 4256858 - DNA, 22 bp, Homo sapiens
aataaaatccatacatttgtgt

SEQ ID NO: 4256859 - DNA, 14 bp, Homo sapiens
aataaagctgctga

SEQ ID NO: 4256860 - DNA, 12 bp, Homo sapiens
aataaagtgacc

SEQ ID NO: 4256861 - DNA, 12 bp, Homo sapiens
aataatgtttca

SEQ ID NO: 4256862 - DNA, 14 bp, Homo sapiens
aataatgtttcaaa

SEQ ID NO: 4256863 - DNA, 14 bp, Homo sapiens
aataattttatctc

SEQ ID NO: 4256864 - DNA, 16 bp, Homo sapiens
aataatttttatattt

SEQ ID NO: 4256865 - DNA, 16 bp, Homo sapiens
aatagtcaaattgtgt

SEQ ID NO: 4256866 - DNA, 17 bp, Homo sapiens
aatattgttttacaata

SEQ ID NO: 4256867 - DNA, 21 bp, Homo sapiens
aatcagggttagtattgtcca

SEQ ID NO: 4256868 - DNA, 19 bp, Homo sapiens
aatcatgaattagttttat

SEQ ID NO: 4256869 - DNA, 14 bp, Homo sapiens
aatccatacatttg

SEQ ID NO: 4256870 - DNA, 13 bp, Homo sapiens
aatccttgaagat

SEQ ID NO: 4256871 - DNA, 16 bp, Homo sapiens
aatctcaatatttcag

SEQ ID NO: 4256872 - DNA, 17 bp, Homo sapiens
aatctcaattcttccct

SEQ ID NO: 4256873 - DNA, 16 bp, Homo sapiens
aatgctgtattttaaa

SEQ ID NO: 4256874 - DNA, 21 bp, Homo sapiens
aatgctgtattttaaaagaat

SEQ ID NO: 4256875 - DNA, 22 bp, Homo sapiens
aatgctgtattttaaaagaatg

SEQ ID NO: 4256876 - DNA, 21 bp, Homo sapiens
aatggaggggcagagccagga

SEQ ID NO: 4256877 - DNA, 22 bp, Homo sapiens
aatggtcacgtttggtgcttct

SEQ ID NO: 4256878 - DNA, 19 bp, Homo sapiens
aatgttatgactatgtaaa

SEQ ID NO: 4256879 - DNA, 18 bp, Homo sapiens
aatgttcacaatatattt

SEQ ID NO: 4256880 - DNA, 18 bp, Homo sapiens
aatgttgacatgggacat

SEQ ID NO: 4256881 - DNA, 14 bp, Homo sapiens
aattacaactaagt

SEQ ID NO: 4256882 - DNA, 15 bp, Homo sapiens
aattatgtgacattt

SEQ ID NO: 4256883 - DNA, 18 bp, Homo sapiens
aattgaggacactgatat

SEQ ID NO: 4256884 - DNA, 20 bp, Homo sapiens
aatttttttcacctagattt

SEQ ID NO: 4256885 - DNA, 12 bp, Homo sapiens
aattttttttac

SEQ ID NO: 4256886 - DNA, 16 bp, Homo sapiens
aattttttttacattt

SEQ ID NO: 4256887 - DNA, 22 bp, Homo sapiens
acaactaagtgatttgtatgtc

SEQ ID NO: 4256888 - DNA, 13 bp, Homo sapiens
acaactatattgt

SEQ ID NO: 4256889 - DNA, 22 bp, Homo sapiens
acaagctcacagacctttgaac

SEQ ID NO: 4256890 - DNA, 14 bp, Homo sapiens
acaatgctgtattt

SEQ ID NO: 4256891 - DNA, 23 bp, Homo sapiens
acacatgcttccctttcctgagt

SEQ ID NO: 4256892 - DNA, 23 bp, Homo sapiens
acacccagcaatagagacgggac

SEQ ID NO: 4256893 - DNA, 13 bp, Homo sapiens
acaccctcacact

SEQ ID NO: 4256894 - DNA, 21 bp, Homo sapiens
acacctactagtcaccagaga

SEQ ID NO: 4256895 - DNA, 14 bp, Homo sapiens
acacctgccctgcc

SEQ ID NO: 4256896 - DNA, 15 bp, Homo sapiens
acacctgccctgccc

SEQ ID NO: 4256897 - DNA, 21 bp, Homo sapiens
acacgcacggcagccacagct

SEQ ID NO: 4256898 - DNA, 13 bp, Homo sapiens
acactaagagaga

SEQ ID NO: 4256899 - DNA, 14 bp, Homo sapiens
acactaagagagaa

SEQ ID NO: 4256900 - DNA, 18 bp, Homo sapiens
acactaagagagaatgag

SEQ ID NO: 4256901 - DNA, 13 bp, Homo sapiens
acactacacccag

SEQ ID NO: 4256902 - DNA, 14 bp, Homo sapiens
acactacacccagc

SEQ ID NO: 4256903 - DNA, 15 bp, Homo sapiens
acactacacccagca

SEQ ID NO: 4256904 - DNA, 15 bp, Homo sapiens
acagaagaaactggg

SEQ ID NO: 4256905 - DNA, 20 bp, Homo sapiens
acagcccttctttccacaga

SEQ ID NO: 4256906 - DNA, 14 bp, Homo sapiens
acagctgtatgatt

SEQ ID NO: 4256907 - DNA, 22 bp, Homo sapiens
acaggaaccacaagactgcaca

SEQ ID NO: 4256908 - DNA, 13 bp, Homo sapiens
acaggatccaggc

SEQ ID NO: 4256909 - DNA, 24 bp, Homo sapiens
acaggatggttcccttgatgaaga

SEQ ID NO: 4256910 - DNA, 16 bp, Homo sapiens
acagtcacctcatgga

SEQ ID NO: 4256911 - DNA, 21 bp, Homo sapiens
acataaaaaggacatcagcaa

SEQ ID NO: 4256912 - DNA, 19 bp, Homo sapiens
acatatataacaatgctgt

SEQ ID NO: 4256913 - DNA, 12 bp, Homo sapiens
acatcagcaaac

SEQ ID NO: 4256914 - DNA, 13 bp, Homo sapiens
acatcagcaaaca

SEQ ID NO: 4256915 - DNA, 19 bp, Homo sapiens
acatgcttccctttcctga

SEQ ID NO: 4256916 - DNA, 11 bp, Homo sapiens
acatgggacat

SEQ ID NO: 4256917 - DNA, 21 bp, Homo sapiens
acatgtccagtgggaggtgag

SEQ ID NO: 4256918 - DNA, 15 bp, Homo sapiens
acatttgctcatgga

SEQ ID NO: 4256919 - DNA, 14 bp, Homo sapiens
acatttgtataaaa

SEQ ID NO: 4256920 - DNA, 19 bp, Homo sapiens
acatttgtataaaataatt

SEQ ID NO: 4256921 - DNA, 11 bp, Homo sapiens
accaataaagt

SEQ ID NO: 4256922 - DNA, 21 bp, Homo sapiens
accaccgcgcccagccttttt

SEQ ID NO: 4256923 - DNA, 13 bp, Homo sapiens
accacgcctggct

SEQ ID NO: 4256924 - DNA, 19 bp, Homo sapiens
accacttgtgttttgcaag

SEQ ID NO: 4256925 - DNA, 23 bp, Homo sapiens
accacttgtgttttgcaagccag

SEQ ID NO: 4256926 - DNA, 16 bp, Homo sapiens
accactttttgcagct

SEQ ID NO: 4256927 - DNA, 20 bp, Homo sapiens
accactttttgcagctttct

SEQ ID NO: 4256928 - DNA, 23 bp, Homo sapiens
accatcagaaacaccctcacact

SEQ ID NO: 4256929 - DNA, 20 bp, Homo sapiens
accatggccagctaattttt

SEQ ID NO: 4256930 - DNA, 19 bp, Homo sapiens
acccagaatgagacatcca

SEQ ID NO: 4256931 - DNA, 14 bp, Homo sapiens
acccaggacaggat

SEQ ID NO: 4256932 - DNA, 17 bp, Homo sapiens
acccaggacaggatcca

SEQ ID NO: 4256933 - DNA, 22 bp, Homo sapiens
acccattagcagtccctccaca

SEQ ID NO: 4256934 - DNA, 15 bp, Homo sapiens
accctaaccaagttc

SEQ ID NO: 4256935 - DNA, 15 bp, Homo sapiens
accctcacactggga

SEQ ID NO: 4256936 - DNA, 18 bp, Homo sapiens
accctccaccgcagaagg

SEQ ID NO: 4256937 - DNA, 20 bp, Homo sapiens
accctccaccgcagaaggaa

SEQ ID NO: 4256938 - DNA, 19 bp, Homo sapiens
accctcgtggacacctgcc

SEQ ID NO: 4256939 - DNA, 20 bp, Homo sapiens
accctcgtggacacctgccc

SEQ ID NO: 4256940 - DNA, 14 bp, Homo sapiens
accgcagaaggaag

SEQ ID NO: 4256941 - DNA, 12 bp, Homo sapiens
accggaccatct

SEQ ID NO: 4256942 - DNA, 16 bp, Homo sapiens
acctatttccagaaat

SEQ ID NO: 4256943 - DNA, 19 bp, Homo sapiens
acctatttccagaaataca

SEQ ID NO: 4256944 - DNA, 19 bp, Homo sapiens
acctccctcaacctcatcc

SEQ ID NO: 4256945 - DNA, 21 bp, Homo sapiens
acctctcaatattcaataaag

SEQ ID NO: 4256946 - DNA, 23 bp, Homo sapiens
acctctcaatattcaataaagct

SEQ ID NO: 4256947 - DNA, 20 bp, Homo sapiens
acctctccagcctcagctct

SEQ ID NO: 4256948 - DNA, 12 bp, Homo sapiens
acctgccctgcc

SEQ ID NO: 4256949 - DNA, 13 bp, Homo sapiens
acctgccctgccc

SEQ ID NO: 4256950 - DNA, 17 bp, Homo sapiens
acctgccctgccctgcc

SEQ ID NO: 4256951 - DNA, 20 bp, Homo sapiens
acctgtctgtctgtctgtcc

SEQ ID NO: 4256952 - DNA, 12 bp, Homo sapiens
accttccaccca

SEQ ID NO: 4256953 - DNA, 14 bp, Homo sapiens
accttccacccagt

SEQ ID NO: 4256954 - DNA, 20 bp, Homo sapiens
accttttggtctggagggaa

SEQ ID NO: 4256955 - DNA, 15 bp, Homo sapiens
acgcacggcagccac

SEQ ID NO: 4256956 - DNA, 15 bp, Homo sapiens
actaagagagaatga

SEQ ID NO: 4256957 - DNA, 14 bp, Homo sapiens
actacacccagcaa

SEQ ID NO: 4256958 - DNA, 20 bp, Homo sapiens
actacaggcacacaccacca

SEQ ID NO: 4256959 - DNA, 20 bp, Homo sapiens
actataggcatgcgccacca

SEQ ID NO: 4256960 - DNA, 11 bp, Homo sapiens
actatgtaaac

SEQ ID NO: 4256961 - DNA, 15 bp, Homo sapiens
actattgcatttata

SEQ ID NO: 4256962 - DNA, 18 bp, Homo sapiens
actccagaaagtgacaag

SEQ ID NO: 4256963 - DNA, 18 bp, Homo sapiens
actcctgacctcaagtga

SEQ ID NO: 4256964 - DNA, 23 bp, Homo sapiens
actcgtgtgtttctattttttga

SEQ ID NO: 4256965 - DNA, 14 bp, Homo sapiens
actcgttaatttgt

SEQ ID NO: 4256966 - DNA, 15 bp, Homo sapiens
actcttaagaagact

SEQ ID NO: 4256967 - DNA, 21 bp, Homo sapiens
actcttaagaagactgcatta

SEQ ID NO: 4256968 - DNA, 19 bp, Homo sapiens
actcttcaaggtctgcttt

SEQ ID NO: 4256969 - DNA, 12 bp, Homo sapiens
actgaagaagca

SEQ ID NO: 4256970 - DNA, 22 bp, Homo sapiens
actgaagaagcaccaatcatga

SEQ ID NO: 4256971 - DNA, 13 bp, Homo sapiens
actgactcttaag

SEQ ID NO: 4256972 - DNA, 15 bp, Homo sapiens
actgactcttaagaa

SEQ ID NO: 4256973 - DNA, 20 bp, Homo sapiens
actgactcttaagaagactg

SEQ ID NO: 4256974 - DNA, 16 bp, Homo sapiens
actgcaacctctgcct

SEQ ID NO: 4256975 - DNA, 19 bp, Homo sapiens
actgccttctcaactccaa

SEQ ID NO: 4256976 - DNA, 23 bp, Homo sapiens
actgcgcccttaactgcatccag

SEQ ID NO: 4256977 - DNA, 13 bp, Homo sapiens
actgcttaattca

SEQ ID NO: 4256978 - DNA, 16 bp, Homo sapiens
actgcttaattcaaat

SEQ ID NO: 4256979 - DNA, 13 bp, Homo sapiens
actggccccaccc

SEQ ID NO: 4256980 - DNA, 22 bp, Homo sapiens
actgtaagaaaatatcacttgt

SEQ ID NO: 4256981 - DNA, 19 bp, Homo sapiens
actgttgtagaagacaaaa

SEQ ID NO: 4256982 - DNA, 17 bp, Homo sapiens
acttatagtacatgata

SEQ ID NO: 4256983 - DNA, 17 bp, Homo sapiens
acttcaaatccttgaag

SEQ ID NO: 4256984 - DNA, 20 bp, Homo sapiens
acttcaaatccttgaagatt

SEQ ID NO: 4256985 - DNA, 17 bp, Homo sapiens
acttcagcggtttatat

SEQ ID NO: 4256986 - DNA, 22 bp, Homo sapiens
acttcttttttcaaaagaaagt

SEQ ID NO: 4256987 - DNA, 23 bp, Homo sapiens
acttcttttttcaaaagaaagtc

SEQ ID NO: 4256988 - DNA, 13 bp, Homo sapiens
acttgaggacaca

SEQ ID NO: 4256989 - DNA, 18 bp, Homo sapiens
acttgaggacacatgtcc

SEQ ID NO: 4256990 - DNA, 13 bp, Homo sapiens
actttttgcagct

SEQ ID NO: 4256991 - DNA, 15 bp, Homo sapiens
actttttgcagcttt

SEQ ID NO: 4256992 - DNA, 22 bp, Homo sapiens
agaaaatttttgtagtagcgtt

SEQ ID NO: 4256993 - DNA, 16 bp, Homo sapiens
agaaacacaactatat

SEQ ID NO: 4256994 - DNA, 17 bp, Homo sapiens
agaaacaccctcacact

SEQ ID NO: 4256995 - DNA, 15 bp, Homo sapiens
agaaacatttggtaa

SEQ ID NO: 4256996 - DNA, 22 bp, Homo sapiens
agaaagcatccctcacccatcc

SEQ ID NO: 4256997 - DNA, 17 bp, Homo sapiens
agaaataaatttatttc

SEQ ID NO: 4256998 - DNA, 13 bp, Homo sapiens
agaacggaagaag

SEQ ID NO: 4256999 - DNA, 18 bp, Homo sapiens
agaagaaagaacggaaga

SEQ ID NO: 4257000 - DNA, 12 bp, Homo sapiens
agaagacaaaat

SEQ ID NO: 4257001 - DNA, 11 bp, Homo sapiens
agaaggaaggc

SEQ ID NO: 4257002 - DNA, 17 bp, Homo sapiens
agaaggaaggcagggag

SEQ ID NO: 4257003 - DNA, 13 bp, Homo sapiens
agaagttgatatg

SEQ ID NO: 4257004 - DNA, 14 bp, Homo sapiens
agaatgagacatcc

SEQ ID NO: 4257005 - DNA, 15 bp, Homo sapiens
agacacacatgaagt

SEQ ID NO: 4257006 - DNA, 16 bp, Homo sapiens
agacacactgaagaag

SEQ ID NO: 4257007 - DNA, 20 bp, Homo sapiens
agacagagtcttcctctgtc

SEQ ID NO: 4257008 - DNA, 20 bp, Homo sapiens
agacattttaaaaaatggtc

SEQ ID NO: 4257009 - DNA, 17 bp, Homo sapiens
agagaagaaagaacgga

SEQ ID NO: 4257010 - DNA, 16 bp, Homo sapiens
agagacacactgaaga

SEQ ID NO: 4257011 - DNA, 19 bp, Homo sapiens
agagatcaggaagagaagg

SEQ ID NO: 4257012 - DNA, 18 bp, Homo sapiens
agagcaagaccccatctc

SEQ ID NO: 4257013 - DNA, 20 bp, Homo sapiens
agagctgatggagaaggaag

SEQ ID NO: 4257014 - DNA, 23 bp, Homo sapiens
agagctggagatgaggccagacc

SEQ ID NO: 4257015 - DNA, 19 bp, Homo sapiens
agatcaggaagagaaggag

SEQ ID NO: 4257016 - DNA, 19 bp, Homo sapiens
agatcccccagaaaagaaa

SEQ ID NO: 4257017 - DNA, 14 bp, Homo sapiens
agatgaggccagac

SEQ ID NO: 4257018 - DNA, 16 bp, Homo sapiens
agatgaggccagacca

SEQ ID NO: 4257019 - DNA, 16 bp, Homo sapiens
agatgcagttctgaag

SEQ ID NO: 4257020 - DNA, 17 bp, Homo sapiens
agatgcagttctgaaga

SEQ ID NO: 4257021 - DNA, 18 bp, Homo sapiens
agatgcagttctgaagaa

SEQ ID NO: 4257022 - DNA, 16 bp, Homo sapiens
agattttcctgaaaac

SEQ ID NO: 4257023 - DNA, 13 bp, Homo sapiens
agcaatttaaatg

SEQ ID NO: 4257024 - DNA, 16 bp, Homo sapiens
agcaatttaaatgtta

SEQ ID NO: 4257025 - DNA, 22 bp, Homo sapiens
agcacagcctcttagatgcagt

SEQ ID NO: 4257026 - DNA, 11 bp, Homo sapiens
agcagacattt

SEQ ID NO: 4257027 - DNA, 19 bp, Homo sapiens
agcagagctgatggagaag

SEQ ID NO: 4257028 - DNA, 19 bp, Homo sapiens
agccagattttcctgaaaa

SEQ ID NO: 4257029 - DNA, 22 bp, Homo sapiens
agccaggaagatcccccagaaa

SEQ ID NO: 4257030 - DNA, 18 bp, Homo sapiens
agcgcctccaaccctagc

SEQ ID NO: 4257031 - DNA, 22 bp, Homo sapiens
agcgcctccaaccctagcaaaa

SEQ ID NO: 4257032 - DNA, 14 bp, Homo sapiens
agcgttttttaaat

SEQ ID NO: 4257033 - DNA, 23 bp, Homo sapiens
agcgttttttaaatgtatactat

SEQ ID NO: 4257034 - DNA, 13 bp, Homo sapiens
agctggaaaagta

SEQ ID NO: 4257035 - DNA, 18 bp, Homo sapiens
agctggagatgaggccag

SEQ ID NO: 4257036 - DNA, 15 bp, Homo sapiens
agctggagtgcagtg

SEQ ID NO: 4257037 - DNA, 19 bp, Homo sapiens
aggaaagagaacttccaga

SEQ ID NO: 4257038 - DNA, 12 bp, Homo sapiens
aggaagagaagg

SEQ ID NO: 4257039 - DNA, 16 bp, Homo sapiens
aggaagatcccccaga

SEQ ID NO: 4257040 - DNA, 18 bp, Homo sapiens
aggaagatcccccagaaa

SEQ ID NO: 4257041 - DNA, 22 bp, Homo sapiens
aggaaggaggacccaggacagg

SEQ ID NO: 4257042 - DNA, 16 bp, Homo sapiens
aggaaggcagggagga

SEQ ID NO: 4257043 - DNA, 14 bp, Homo sapiens
aggaatggaagtcc

SEQ ID NO: 4257044 - DNA, 16 bp, Homo sapiens
aggaattacgtgctct

SEQ ID NO: 4257045 - DNA, 12 bp, Homo sapiens
aggacacatgtc

SEQ ID NO: 4257046 - DNA, 14 bp, Homo sapiens
aggacactgatatg

SEQ ID NO: 4257047 - DNA, 12 bp, Homo sapiens
aggacatcagca

SEQ ID NO: 4257048 - DNA, 16 bp, Homo sapiens
aggacatcagcaaaca

SEQ ID NO: 4257049 - DNA, 22 bp, Homo sapiens
aggacatcagcaaacaggatca

SEQ ID NO: 4257050 - DNA, 18 bp, Homo sapiens
aggacccaggacaggatc

SEQ ID NO: 4257051 - DNA, 16 bp, Homo sapiens
aggaggacccaggaca

SEQ ID NO: 4257052 - DNA, 23 bp, Homo sapiens
aggcacacaccaccacgcctggc

SEQ ID NO: 4257053 - DNA, 13 bp, Homo sapiens
aggcagagaagaa

SEQ ID NO: 4257054 - DNA, 17 bp, Homo sapiens
aggccagaccatggaca

SEQ ID NO: 4257055 - DNA, 22 bp, Homo sapiens
aggcctattgttgaataaatgt

SEQ ID NO: 4257056 - DNA, 17 bp, Homo sapiens
aggcctggtgtttcttg

SEQ ID NO: 4257057 - DNA, 16 bp, Homo sapiens
agggaaaacattccat

SEQ ID NO: 4257058 - DNA, 18 bp, Homo sapiens
agggaaaacattccatcc

SEQ ID NO: 4257059 - DNA, 21 bp, Homo sapiens
agggagactgggtaggaaaga

SEQ ID NO: 4257060 - DNA, 15 bp, Homo sapiens
aggggctaccaggaa

SEQ ID NO: 4257061 - DNA, 16 bp, Homo sapiens
agggggcaagaggaat

SEQ ID NO: 4257062 - DNA, 16 bp, Homo sapiens
aggtgagaccacctct

SEQ ID NO: 4257063 - DNA, 20 bp, Homo sapiens
aggtttcactgtgttggcca

SEQ ID NO: 4257064 - DNA, 17 bp, Homo sapiens
agtaaaataataatttt

SEQ ID NO: 4257065 - DNA, 22 bp, Homo sapiens
agtagcgttttttaaatgtata

SEQ ID NO: 4257066 - DNA, 16 bp, Homo sapiens
agtatctcttcagtct

SEQ ID NO: 4257067 - DNA, 21 bp, Homo sapiens
agtatgttagtgcaaattgtc

SEQ ID NO: 4257068 - DNA, 18 bp, Homo sapiens
agtattagaataccacag

SEQ ID NO: 4257069 - DNA, 15 bp, Homo sapiens
agtattgtccaggtc

SEQ ID NO: 4257070 - DNA, 18 bp, Homo sapiens
agtatttctatgaaatat

SEQ ID NO: 4257071 - DNA, 13 bp, Homo sapiens
agtcaaattgtgt

SEQ ID NO: 4257072 - DNA, 15 bp, Homo sapiens
agtcaaattgtgtga

SEQ ID NO: 4257073 - DNA, 20 bp, Homo sapiens
agtgaaactcgttaatttgt

SEQ ID NO: 4257074 - DNA, 14 bp, Homo sapiens
agtgaccctgctct

SEQ ID NO: 4257075 - DNA, 18 bp, Homo sapiens
agtgactttggctgcatg

SEQ ID NO: 4257076 - DNA, 23 bp, Homo sapiens
agtgcagtggcatcatctcagct

SEQ ID NO: 4257077 - DNA, 23 bp, Homo sapiens
agtgcagtggcgtgatctcagct

SEQ ID NO: 4257078 - DNA, 18 bp, Homo sapiens
agtgccagcacctgccca

SEQ ID NO: 4257079 - DNA, 17 bp, Homo sapiens
agtgctcatttcaggat

SEQ ID NO: 4257080 - DNA, 20 bp, Homo sapiens
agtgctggcattacaggtgt

SEQ ID NO: 4257081 - DNA, 19 bp, Homo sapiens
agtggcatcatctcagctc

SEQ ID NO: 4257082 - DNA, 19 bp, Homo sapiens
agtggcgcgatctcagctc

SEQ ID NO: 4257083 - DNA, 20 bp, Homo sapiens
agtggcgtgatctcagctca

SEQ ID NO: 4257084 - DNA, 23 bp, Homo sapiens
agtgttggagaagaactgaaatc

SEQ ID NO: 4257085 - DNA, 11 bp, Homo sapiens
agtgtttcttt

SEQ ID NO: 4257086 - DNA, 21 bp, Homo sapiens
agttgacttatagtacatgat

SEQ ID NO: 4257087 - DNA, 21 bp, Homo sapiens
agttgatatgccttttcccaa

SEQ ID NO: 4257088 - DNA, 20 bp, Homo sapiens
ataaaaggtcggaccagctt

SEQ ID NO: 4257089 - DNA, 15 bp, Homo sapiens
ataaaataattttta

SEQ ID NO: 4257090 - DNA, 21 bp, Homo sapiens
ataaaataatttttatatttg

SEQ ID NO: 4257091 - DNA, 20 bp, Homo sapiens
ataaagtgaccctgctctca

SEQ ID NO: 4257092 - DNA, 19 bp, Homo sapiens
ataacaatgctgtatttta

SEQ ID NO: 4257093 - DNA, 20 bp, Homo sapiens
ataacaatgctgtattttaa

SEQ ID NO: 4257094 - DNA, 12 bp, Homo sapiens
ataactggaaac

SEQ ID NO: 4257095 - DNA, 20 bp, Homo sapiens
ataagcaaaaacaaaaagaa

SEQ ID NO: 4257096 - DNA, 18 bp, Homo sapiens
ataataaaggactgtaat

SEQ ID NO: 4257097 - DNA, 14 bp, Homo sapiens
ataataattagtaa

SEQ ID NO: 4257098 - DNA, 14 bp, Homo sapiens
ataatctttcacag

SEQ ID NO: 4257099 - DNA, 23 bp, Homo sapiens
ataatgtttcaaacatatataac

SEQ ID NO: 4257100 - DNA, 14 bp, Homo sapiens
ataatttagatggt

SEQ ID NO: 4257101 - DNA, 16 bp, Homo sapiens
ataatttttatatttg

SEQ ID NO: 4257102 - DNA, 22 bp, Homo sapiens
ataatttttatatttgaaatat

SEQ ID NO: 4257103 - DNA, 22 bp, Homo sapiens
atacatgtaattctaccaaggt

SEQ ID NO: 4257104 - DNA, 14 bp, Homo sapiens
atacccacccagaa

SEQ ID NO: 4257105 - DNA, 16 bp, Homo sapiens
ataccctccctcccta

SEQ ID NO: 4257106 - DNA, 12 bp, Homo sapiens
atagaaagctat

SEQ ID NO: 4257107 - DNA, 13 bp, Homo sapiens
atagctaagtaca

SEQ ID NO: 4257108 - DNA, 14 bp, Homo sapiens
atagctaagtacac

SEQ ID NO: 4257109 - DNA, 15 bp, Homo sapiens
atagctaagtacaca

SEQ ID NO: 4257110 - DNA, 20 bp, Homo sapiens
atagtacatgataaatgata

SEQ ID NO: 4257111 - DNA, 17 bp, Homo sapiens
atagtcaaattgtgtga

SEQ ID NO: 4257112 - DNA, 18 bp, Homo sapiens
atagtcaaattgtgtgaa

SEQ ID NO: 4257113 - DNA, 17 bp, Homo sapiens
atatataacaatgctgt

SEQ ID NO: 4257114 - DNA, 13 bp, Homo sapiens
atattacaatgat

SEQ ID NO: 4257115 - DNA, 16 bp, Homo sapiens
atattacaatgatcac

SEQ ID NO: 4257116 - DNA, 15 bp, Homo sapiens
atattcaataaagct

SEQ ID NO: 4257117 - DNA, 19 bp, Homo sapiens
atatttattactgtaagaa

SEQ ID NO: 4257118 - DNA, 22 bp, Homo sapiens
atatttattactgtaagaaaat

SEQ ID NO: 4257119 - DNA, 13 bp, Homo sapiens
atatttattttaa

SEQ ID NO: 4257120 - DNA, 14 bp, Homo sapiens
atatttattttaat

SEQ ID NO: 4257121 - DNA, 23 bp, Homo sapiens
atatttgaaatattgacttttta

SEQ ID NO: 4257122 - DNA, 16 bp, Homo sapiens
atcaccgactgaaaat

SEQ ID NO: 4257123 - DNA, 21 bp, Homo sapiens
atcactgaactttgctgagcc

SEQ ID NO: 4257124 - DNA, 20 bp, Homo sapiens
atcagaaacaccctcacact

SEQ ID NO: 4257125 - DNA, 14 bp, Homo sapiens
atcaggaagagaag

SEQ ID NO: 4257126 - DNA, 12 bp, Homo sapiens
atcagttaacta

SEQ ID NO: 4257127 - DNA, 17 bp, Homo sapiens
atcatgaattagtttta

SEQ ID NO: 4257128 - DNA, 21 bp, Homo sapiens
atcatgaattagttttatatg

SEQ ID NO: 4257129 - DNA, 17 bp, Homo sapiens
atccacctgccttggct

SEQ ID NO: 4257130 - DNA, 23 bp, Homo sapiens
atccaggccggcttgccacaccc

SEQ ID NO: 4257131 - DNA, 17 bp, Homo sapiens
atcccccagaaaagaaa

SEQ ID NO: 4257132 - DNA, 20 bp, Homo sapiens
atcctcccacttcagcctcc

SEQ ID NO: 4257133 - DNA, 13 bp, Homo sapiens
atctcaatatttc

SEQ ID NO: 4257134 - DNA, 13 bp, Homo sapiens
atctcagctcact

SEQ ID NO: 4257135 - DNA, 23 bp, Homo sapiens
atctcatttccaagcaagtatta

SEQ ID NO: 4257136 - DNA, 22 bp, Homo sapiens
atctccattgtgcctaagtcca

SEQ ID NO: 4257137 - DNA, 12 bp, Homo sapiens
atctcttcagtc

SEQ ID NO: 4257138 - DNA, 21 bp, Homo sapiens
atctcttcagtctctatacca

SEQ ID NO: 4257139 - DNA, 17 bp, Homo sapiens
atgaaatattatgttaa

SEQ ID NO: 4257140 - DNA, 13 bp, Homo sapiens
atgaacttgagga

SEQ ID NO: 4257141 - DNA, 22 bp, Homo sapiens
atgaacttgaggacacatgtcc

SEQ ID NO: 4257142 - DNA, 20 bp, Homo sapiens
atgaagtccaagcatttaga

SEQ ID NO: 4257143 - DNA, 14 bp, Homo sapiens
atgaatacatttcc

SEQ ID NO: 4257144 - DNA, 21 bp, Homo sapiens
atgaatacatttccaaaatgg

SEQ ID NO: 4257145 - DNA, 19 bp, Homo sapiens
atgagagacacactgaaga

SEQ ID NO: 4257146 - DNA, 20 bp, Homo sapiens
atgagagacacactgaagaa

SEQ ID NO: 4257147 - DNA, 21 bp, Homo sapiens
atgagagacacactgaagaag

SEQ ID NO: 4257148 - DNA, 13 bp, Homo sapiens
atgaggccagacc

SEQ ID NO: 4257149 - DNA, 15 bp, Homo sapiens
atgataactggaaac

SEQ ID NO: 4257150 - DNA, 22 bp, Homo sapiens
atgccttttcccaactccagaa

SEQ ID NO: 4257151 - DNA, 22 bp, Homo sapiens
atgctgtctacactaagagaga

SEQ ID NO: 4257152 - DNA, 16 bp, Homo sapiens
atgcttccctttcctg

SEQ ID NO: 4257153 - DNA, 18 bp, Homo sapiens
atggacactacacccagc

SEQ ID NO: 4257154 - DNA, 12 bp, Homo sapiens
atggagaaggaa

SEQ ID NO: 4257155 - DNA, 19 bp, Homo sapiens
atggaggggcagagccagg

SEQ ID NO: 4257156 - DNA, 20 bp, Homo sapiens
atgggacatttgctcatgga

SEQ ID NO: 4257157 - DNA, 21 bp, Homo sapiens
atggtcacgtttggtgcttct

SEQ ID NO: 4257158 - DNA, 15 bp, Homo sapiens
atgtatctgaatatc

SEQ ID NO: 4257159 - DNA, 20 bp, Homo sapiens
atgtgctagtaattggaaag

SEQ ID NO: 4257160 - DNA, 18 bp, Homo sapiens
atgtggaccttagaatac

SEQ ID NO: 4257161 - DNA, 19 bp, Homo sapiens
atgtgtatgcacagtaaaa

SEQ ID NO: 4257162 - DNA, 15 bp, Homo sapiens
atgttgacatgggac

SEQ ID NO: 4257163 - DNA, 17 bp, Homo sapiens
atgttttcaggctagat

SEQ ID NO: 4257164 - DNA, 17 bp, Homo sapiens
attaaattttttttaca

SEQ ID NO: 4257165 - DNA, 16 bp, Homo sapiens
attacatttgtataaa

SEQ ID NO: 4257166 - DNA, 17 bp, Homo sapiens
attacatttgtataaaa

SEQ ID NO: 4257167 - DNA, 20 bp, Homo sapiens
attacatttgtataaaataa

SEQ ID NO: 4257168 - DNA, 16 bp, Homo sapiens
attactgtaagaaaat

SEQ ID NO: 4257169 - DNA, 18 bp, Homo sapiens
attatatgttcagattat

SEQ ID NO: 4257170 - DNA, 19 bp, Homo sapiens
attatgtgacattttacat

SEQ ID NO: 4257171 - DNA, 17 bp, Homo sapiens
attccagagcactgctc

SEQ ID NO: 4257172 - DNA, 16 bp, Homo sapiens
attcccttcatctgga

SEQ ID NO: 4257173 - DNA, 20 bp, Homo sapiens
attcttccctatctttgcca

SEQ ID NO: 4257174 - DNA, 21 bp, Homo sapiens
attcttccctatctttgccac

SEQ ID NO: 4257175 - DNA, 13 bp, Homo sapiens
attgactttttat

SEQ ID NO: 4257176 - DNA, 16 bp, Homo sapiens
attggagctcgtggaa

SEQ ID NO: 4257177 - DNA, 18 bp, Homo sapiens
attgtatattacaatgat

SEQ ID NO: 4257178 - DNA, 13 bp, Homo sapiens
attgttgaataaa

SEQ ID NO: 4257179 - DNA, 14 bp, Homo sapiens
attgttgaataaat

SEQ ID NO: 4257180 - DNA, 18 bp, Homo sapiens
attgttgaataaatgtat

SEQ ID NO: 4257181 - DNA, 15 bp, Homo sapiens
attgttttacaatag

SEQ ID NO: 4257182 - DNA, 15 bp, Homo sapiens
atttaccacttgtgt

SEQ ID NO: 4257183 - DNA, 23 bp, Homo sapiens
atttaggaagttgacttatagta

SEQ ID NO: 4257184 - DNA, 19 bp, Homo sapiens
atttattactgtaagaaaa

SEQ ID NO: 4257185 - DNA, 14 bp, Homo sapiens
atttctatgaaata

SEQ ID NO: 4257186 - DNA, 23 bp, Homo sapiens
atttggtaaggggaattgaggac

SEQ ID NO: 4257187 - DNA, 18 bp, Homo sapiens
atttgtagtgttggagaa

SEQ ID NO: 4257188 - DNA, 19 bp, Homo sapiens
atttgtagtgttggagaag

SEQ ID NO: 4257189 - DNA, 22 bp, Homo sapiens
atttgtagtgttggagaagaac

SEQ ID NO: 4257190 - DNA, 16 bp, Homo sapiens
attttaaaagaatgat

SEQ ID NO: 4257191 - DNA, 17 bp, Homo sapiens
attttaaaagaatgatt

SEQ ID NO: 4257192 - DNA, 19 bp, Homo sapiens
attttaataatgtttcaaa

SEQ ID NO: 4257193 - DNA, 15 bp, Homo sapiens
atttttatatttgaa

SEQ ID NO: 4257194 - DNA, 19 bp, Homo sapiens
atttttatatttgaaatat

SEQ ID NO: 4257195 - DNA, 16 bp, Homo sapiens
attttttgaaaagcag

SEQ ID NO: 4257196 - DNA, 22 bp, Homo sapiens
attttttgggcagcaatttaaa

SEQ ID NO: 4257197 - DNA, 14 bp, Homo sapiens
caaaaacaaaaaga

SEQ ID NO: 4257198 - DNA, 22 bp, Homo sapiens
caaaagcccattcattccattc

SEQ ID NO: 4257199 - DNA, 16 bp, Homo sapiens
caaaattttttctcta

SEQ ID NO: 4257200 - DNA, 22 bp, Homo sapiens
caaaattttttctctaggaaat

SEQ ID NO: 4257201 - DNA, 19 bp, Homo sapiens
caaaccactttttgcagct

SEQ ID NO: 4257202 - DNA, 20 bp, Homo sapiens
caaaccactttttgcagctt

SEQ ID NO: 4257203 - DNA, 21 bp, Homo sapiens
caaactgactcttaagaagac

SEQ ID NO: 4257204 - DNA, 21 bp, Homo sapiens
caaaggcattataaaaagaat

SEQ ID NO: 4257205 - DNA, 17 bp, Homo sapiens
caaatttcatgaccagt

SEQ ID NO: 4257206 - DNA, 12 bp, Homo sapiens
caacaataaata

SEQ ID NO: 4257207 - DNA, 15 bp, Homo sapiens
caacacacacatgct

SEQ ID NO: 4257208 - DNA, 20 bp, Homo sapiens
caacctccgcatccggggtt

SEQ ID NO: 4257209 - DNA, 19 bp, Homo sapiens
caactatctcatttccaag

SEQ ID NO: 4257210 - DNA, 20 bp, Homo sapiens
caagaacacagccctgcttc

SEQ ID NO: 4257211 - DNA, 16 bp, Homo sapiens
caagaccgatcggcgg

SEQ ID NO: 4257212 - DNA, 19 bp, Homo sapiens
caagactgcacatcaaaat

SEQ ID NO: 4257213 - DNA, 22 bp, Homo sapiens
caagatggggagtgagaggctg

SEQ ID NO: 4257214 - DNA, 14 bp, Homo sapiens
caagcaagtattag

SEQ ID NO: 4257215 - DNA, 19 bp, Homo sapiens
caagcatttagatgtatag

SEQ ID NO: 4257216 - DNA, 15 bp, Homo sapiens
caagctattcaattc

SEQ ID NO: 4257217 - DNA, 21 bp, Homo sapiens
caaggcctggtgtttcttgat

SEQ ID NO: 4257218 - DNA, 15 bp, Homo sapiens
caagtaaaaaggcta

SEQ ID NO: 4257219 - DNA, 14 bp, Homo sapiens
caagtattagaata

SEQ ID NO: 4257220 - DNA, 20 bp, Homo sapiens
caagtattagaataccacag

SEQ ID NO: 4257221 - DNA, 15 bp, Homo sapiens
caataaagctgctga

SEQ ID NO: 4257222 - DNA, 17 bp, Homo sapiens
caataaagctgctgaga

SEQ ID NO: 4257223 - DNA, 17 bp, Homo sapiens
caataaatagacacgca

SEQ ID NO: 4257224 - DNA, 14 bp, Homo sapiens
caatattcaataaa

SEQ ID NO: 4257225 - DNA, 15 bp, Homo sapiens
caatattcaataaag

SEQ ID NO: 4257226 - DNA, 18 bp, Homo sapiens
caatcctcccacttcagc

SEQ ID NO: 4257227 - DNA, 22 bp, Homo sapiens
caatcctcccacttcagcctcc

SEQ ID NO: 4257228 - DNA, 20 bp, Homo sapiens
caattcttccctatctttgc

SEQ ID NO: 4257229 - DNA, 11 bp, Homo sapiens
caatttaaatg

SEQ ID NO: 4257230 - DNA, 13 bp, Homo sapiens
cacactgaagaag

SEQ ID NO: 4257231 - DNA, 19 bp, Homo sapiens
cacactgggacttgcaaaa

SEQ ID NO: 4257232 - DNA, 21 bp, Homo sapiens
cacagcctcttagatgcagtt

SEQ ID NO: 4257233 - DNA, 22 bp, Homo sapiens
cacagctgcctcttccctcttc

SEQ ID NO: 4257234 - DNA, 21 bp, Homo sapiens
cacagtaaaaatggaaactat

SEQ ID NO: 4257235 - DNA, 21 bp, Homo sapiens
caccatattggccagtctggt

SEQ ID NO: 4257236 - DNA, 21 bp, Homo sapiens
caccctcatgctgtgtgactc

SEQ ID NO: 4257237 - DNA, 19 bp, Homo sapiens
caccctcgtggacacctgc

SEQ ID NO: 4257238 - DNA, 14 bp, Homo sapiens
caccgcagaaggaa

SEQ ID NO: 4257239 - DNA, 15 bp, Homo sapiens
caccgcgaggcctat

SEQ ID NO: 4257240 - DNA, 15 bp, Homo sapiens
cacctccctcaacct

SEQ ID NO: 4257241 - DNA, 19 bp, Homo sapiens
cacctccctcaacctcatc

SEQ ID NO: 4257242 - DNA, 13 bp, Homo sapiens
cacctcctgcctc

SEQ ID NO: 4257243 - DNA, 12 bp, Homo sapiens
cacctgccctgc

SEQ ID NO: 4257244 - DNA, 14 bp, Homo sapiens
cacctgccctgccc

SEQ ID NO: 4257245 - DNA, 19 bp, Homo sapiens
cacctgccctgccctgcca

SEQ ID NO: 4257246 - DNA, 21 bp, Homo sapiens
cacctgccctgccctgccacc

SEQ ID NO: 4257247 - DNA, 20 bp, Homo sapiens
cacctgggattacaagcatg

SEQ ID NO: 4257248 - DNA, 12 bp, Homo sapiens
cacctgtctgtc

SEQ ID NO: 4257249 - DNA, 19 bp, Homo sapiens
cactagtatttctatgaaa

SEQ ID NO: 4257250 - DNA, 15 bp, Homo sapiens
cactcgtgtgtttct

SEQ ID NO: 4257251 - DNA, 16 bp, Homo sapiens
cactcgtgtgtttcta

SEQ ID NO: 4257252 - DNA, 15 bp, Homo sapiens
cactctttctttcaa

SEQ ID NO: 4257253 - DNA, 17 bp, Homo sapiens
cactgcaacctccacct

SEQ ID NO: 4257254 - DNA, 14 bp, Homo sapiens
cactggccccaccc

SEQ ID NO: 4257255 - DNA, 17 bp, Homo sapiens
cacttgtgttttgcaag

SEQ ID NO: 4257256 - DNA, 19 bp, Homo sapiens
cacttgtgttttgcaagcc

SEQ ID NO: 4257257 - DNA, 20 bp, Homo sapiens
cagaaacaccctcacactgg

SEQ ID NO: 4257258 - DNA, 22 bp, Homo sapiens
cagaaggaaggcagggaggagg

SEQ ID NO: 4257259 - DNA, 14 bp, Homo sapiens
cagaccatggacac

SEQ ID NO: 4257260 - DNA, 13 bp, Homo sapiens
cagagaagaaaga

SEQ ID NO: 4257261 - DNA, 14 bp, Homo sapiens
cagagaagaaagaa

SEQ ID NO: 4257262 - DNA, 17 bp, Homo sapiens
cagagactttagggggt

SEQ ID NO: 4257263 - DNA, 13 bp, Homo sapiens
cagagccaggaag

SEQ ID NO: 4257264 - DNA, 14 bp, Homo sapiens
cagagccaggaaga

SEQ ID NO: 4257265 - DNA, 19 bp, Homo sapiens
cagagctgatggagaagga

SEQ ID NO: 4257266 - DNA, 20 bp, Homo sapiens
cagagctgatggagaaggaa

SEQ ID NO: 4257267 - DNA, 21 bp, Homo sapiens
cagagctggagatgaggccag

SEQ ID NO: 4257268 - DNA, 14 bp, Homo sapiens
cagatcctggaaat

SEQ ID NO: 4257269 - DNA, 14 bp, Homo sapiens
cagatttctgagga

SEQ ID NO: 4257270 - DNA, 17 bp, Homo sapiens
cagatttctgaggaaat

SEQ ID NO: 4257271 - DNA, 20 bp, Homo sapiens
cagcaacaataaatagacac

SEQ ID NO: 4257272 - DNA, 15 bp, Homo sapiens
cagcaatagagacgg

SEQ ID NO: 4257273 - DNA, 17 bp, Homo sapiens
cagcaatagagacggga

SEQ ID NO: 4257274 - DNA, 14 bp, Homo sapiens
cagcaatttaaatg

SEQ ID NO: 4257275 - DNA, 20 bp, Homo sapiens
cagccctgctgctgcctgcc

SEQ ID NO: 4257276 - DNA, 19 bp, Homo sapiens
cagcccttctttccacaga

SEQ ID NO: 4257277 - DNA, 16 bp, Homo sapiens
cagccttctactgctc

SEQ ID NO: 4257278 - DNA, 19 bp, Homo sapiens
cagctgcctcttccctctt

SEQ ID NO: 4257279 - DNA, 19 bp, Homo sapiens
cagctgtatgattcccagc

SEQ ID NO: 4257280 - DNA, 20 bp, Homo sapiens
cagctgtatgattcccagcc

SEQ ID NO: 4257281 - DNA, 20 bp, Homo sapiens
cagcttttcccaaaagccca

SEQ ID NO: 4257282 - DNA, 19 bp, Homo sapiens
caggaaagcgcctccaacc

SEQ ID NO: 4257283 - DNA, 18 bp, Homo sapiens
caggaaccacaagactgc

SEQ ID NO: 4257284 - DNA, 14 bp, Homo sapiens
caggaagagaagga

SEQ ID NO: 4257285 - DNA, 15 bp, Homo sapiens
caggatcagttaact

SEQ ID NO: 4257286 - DNA, 18 bp, Homo sapiens
caggatggtctccatctc

SEQ ID NO: 4257287 - DNA, 16 bp, Homo sapiens
caggcacacaccacca

SEQ ID NO: 4257288 - DNA, 14 bp, Homo sapiens
caggcaggagccct

SEQ ID NO: 4257289 - DNA, 14 bp, Homo sapiens
cagtatctcttcag

SEQ ID NO: 4257290 - DNA, 23 bp, Homo sapiens
cagtatgggttagggaaaacatt

SEQ ID NO: 4257291 - DNA, 22 bp, Homo sapiens
cagtcaggaaagagaacttcca

SEQ ID NO: 4257292 - DNA, 21 bp, Homo sapiens
cagtctctataccaataaagt

SEQ ID NO: 4257293 - DNA, 21 bp, Homo sapiens
cagtgggaggtgagaccacct

SEQ ID NO: 4257294 - DNA, 15 bp, Homo sapiens
cagttctgaagaaga

SEQ ID NO: 4257295 - DNA, 22 bp, Homo sapiens
cagttctgaagaagatggtacc

SEQ ID NO: 4257296 - DNA, 13 bp, Homo sapiens
cataaaaaggaca

SEQ ID NO: 4257297 - DNA, 19 bp, Homo sapiens
cataaaaaggacatcagca

SEQ ID NO: 4257298 - DNA, 20 bp, Homo sapiens
cataaaaaggacatcagcaa

SEQ ID NO: 4257299 - DNA, 17 bp, Homo sapiens
catcagaaacaccctca

SEQ ID NO: 4257300 - DNA, 11 bp, Homo sapiens
catcagcaaac

SEQ ID NO: 4257301 - DNA, 21 bp, Homo sapiens
catcaggtcaccgcgaggcct

SEQ ID NO: 4257302 - DNA, 15 bp, Homo sapiens
catcatctcagctca

SEQ ID NO: 4257303 - DNA, 23 bp, Homo sapiens
catccttcatctggattccagag

SEQ ID NO: 4257304 - DNA, 22 bp, Homo sapiens
catctagtgagcagtcaggaaa

SEQ ID NO: 4257305 - DNA, 17 bp, Homo sapiens
catctatagaaagctat

SEQ ID NO: 4257306 - DNA, 19 bp, Homo sapiens
catctcagctcactgcaac

SEQ ID NO: 4257307 - DNA, 20 bp, Homo sapiens
catctcagctcactgcaacc

SEQ ID NO: 4257308 - DNA, 12 bp, Homo sapiens
catctggaacca

SEQ ID NO: 4257309 - DNA, 13 bp, Homo sapiens
catgataaatgat

SEQ ID NO: 4257310 - DNA, 14 bp, Homo sapiens
catgatgtttagaa

SEQ ID NO: 4257311 - DNA, 15 bp, Homo sapiens
catgcatggaaattc

SEQ ID NO: 4257312 - DNA, 20 bp, Homo sapiens
catgctctccaaaccacttt

SEQ ID NO: 4257313 - DNA, 18 bp, Homo sapiens
catggacactacacccag

SEQ ID NO: 4257314 - DNA, 20 bp, Homo sapiens
catggacactacacccagca

SEQ ID NO: 4257315 - DNA, 16 bp, Homo sapiens
catggccctgccatgc

SEQ ID NO: 4257316 - DNA, 15 bp, Homo sapiens
cattcattccattct

SEQ ID NO: 4257317 - DNA, 15 bp, Homo sapiens
cattgacctatttcc

SEQ ID NO: 4257318 - DNA, 12 bp, Homo sapiens
catttccaagca

SEQ ID NO: 4257319 - DNA, 14 bp, Homo sapiens
catttgctcatgga

SEQ ID NO: 4257320 - DNA, 18 bp, Homo sapiens
catttgctcatggaattg

SEQ ID NO: 4257321 - DNA, 17 bp, Homo sapiens
catttgtataaaataat

SEQ ID NO: 4257322 - DNA, 18 bp, Homo sapiens
cattttacattaaatttt

SEQ ID NO: 4257323 - DNA, 12 bp, Homo sapiens
ccaaaaaactac

SEQ ID NO: 4257324 - DNA, 14 bp, Homo sapiens
ccaaaccacttttt

SEQ ID NO: 4257325 - DNA, 22 bp, Homo sapiens
ccaaactgactcttaagaagac

SEQ ID NO: 4257326 - DNA, 20 bp, Homo sapiens
ccaaatcactgaactttgct

SEQ ID NO: 4257327 - DNA, 21 bp, Homo sapiens
ccaactccagaaagtgacaag

SEQ ID NO: 4257328 - DNA, 14 bp, Homo sapiens
ccaagcaagtatta

SEQ ID NO: 4257329 - DNA, 16 bp, Homo sapiens
ccaaggtcttcttaat

SEQ ID NO: 4257330 - DNA, 18 bp, Homo sapiens
ccacagaagctccaggta

SEQ ID NO: 4257331 - DNA, 14 bp, Homo sapiens
ccacagctgcctct

SEQ ID NO: 4257332 - DNA, 16 bp, Homo sapiens
ccaccatggccagcta

SEQ ID NO: 4257333 - DNA, 22 bp, Homo sapiens
ccacccagaatgagacatccag

SEQ ID NO: 4257334 - DNA, 21 bp, Homo sapiens
ccaccctcgtggacacctgcc

SEQ ID NO: 4257335 - DNA, 23 bp, Homo sapiens
ccacctctcaatattcaataaag

SEQ ID NO: 4257336 - DNA, 17 bp, Homo sapiens
ccacggggactcagccc

SEQ ID NO: 4257337 - DNA, 14 bp, Homo sapiens
ccagaccatggaca

SEQ ID NO: 4257338 - DNA, 23 bp, Homo sapiens
ccagcaattacaacggagtcaaa

SEQ ID NO: 4257339 - DNA, 14 bp, Homo sapiens
ccagcctcagctct

SEQ ID NO: 4257340 - DNA, 17 bp, Homo sapiens
ccaggaagatcccccag

SEQ ID NO: 4257341 - DNA, 17 bp, Homo sapiens
ccaggctggagtgcagt

SEQ ID NO: 4257342 - DNA, 14 bp, Homo sapiens
ccagggaccggcgg

SEQ ID NO: 4257343 - DNA, 17 bp, Homo sapiens
ccagggtggcagcaaca

SEQ ID NO: 4257344 - DNA, 20 bp, Homo sapiens
ccagtatctcttcagtctct

SEQ ID NO: 4257345 - DNA, 20 bp, Homo sapiens
ccagtgggaggtgagaccac

SEQ ID NO: 4257346 - DNA, 13 bp, Homo sapiens
ccatacatttgtg

SEQ ID NO: 4257347 - DNA, 14 bp, Homo sapiens
ccatacatttgtgt

SEQ ID NO: 4257348 - DNA, 14 bp, Homo sapiens
ccatattggccagt

SEQ ID NO: 4257349 - DNA, 23 bp, Homo sapiens
ccatcagaaacaccctcacactg

SEQ ID NO: 4257350 - DNA, 20 bp, Homo sapiens
ccatcatctatagaaagcta

SEQ ID NO: 4257351 - DNA, 14 bp, Homo sapiens
ccatgcagaaagca

SEQ ID NO: 4257352 - DNA, 15 bp, Homo sapiens
ccatgcagaaagcat

SEQ ID NO: 4257353 - DNA, 21 bp, Homo sapiens
ccatggacactacacccagca

SEQ ID NO: 4257354 - DNA, 23 bp, Homo sapiens
ccatggacactacacccagcaat

SEQ ID NO: 4257355 - DNA, 14 bp, Homo sapiens
ccattcattccatt

SEQ ID NO: 4257356 - DNA, 18 bp, Homo sapiens
ccattcattccattctgg

SEQ ID NO: 4257357 - DNA, 19 bp, Homo sapiens
ccattctggaagtgacttt

SEQ ID NO: 4257358 - DNA, 20 bp, Homo sapiens
cccaagcacctgggattaca

SEQ ID NO: 4257359 - DNA, 15 bp, Homo sapiens
cccaattgagaaaaa

SEQ ID NO: 4257360 - DNA, 13 bp, Homo sapiens
cccacccctagga

SEQ ID NO: 4257361 - DNA, 22 bp, Homo sapiens
cccaccctcgtggacacctgcc

SEQ ID NO: 4257362 - DNA, 23 bp, Homo sapiens
cccaccctcgtggacacctgccc

SEQ ID NO: 4257363 - DNA, 20 bp, Homo sapiens
cccagaaaagaaagctacag

SEQ ID NO: 4257364 - DNA, 20 bp, Homo sapiens
cccagaatgagacatccagc

SEQ ID NO: 4257365 - DNA, 17 bp, Homo sapiens
cccaggacaggatccag

SEQ ID NO: 4257366 - DNA, 18 bp, Homo sapiens
cccattcattccattctg

SEQ ID NO: 4257367 - DNA, 21 bp, Homo sapiens
ccccaccctcgtggacacctg

SEQ ID NO: 4257368 - DNA, 17 bp, Homo sapiens
ccccagccatccagggg

SEQ ID NO: 4257369 - DNA, 22 bp, Homo sapiens
cccccagaaaagaaagctacag

SEQ ID NO: 4257370 - DNA, 15 bp, Homo sapiens
cccctgccacctcct

SEQ ID NO: 4257371 - DNA, 13 bp, Homo sapiens
cccgcctcagcct

SEQ ID NO: 4257372 - DNA, 15 bp, Homo sapiens
ccctaaccaagttcc

SEQ ID NO: 4257373 - DNA, 10 bp, Homo sapiens
ccctcacact

SEQ ID NO: 4257374 - DNA, 13 bp, Homo sapiens
ccctcacccatcc

SEQ ID NO: 4257375 - DNA, 18 bp, Homo sapiens
ccctccaccgcagaagga

SEQ ID NO: 4257376 - DNA, 16 bp, Homo sapiens
ccctcgtggacacctg

SEQ ID NO: 4257377 - DNA, 18 bp, Homo sapiens
ccctcgtggacacctgcc

SEQ ID NO: 4257378 - DNA, 17 bp, Homo sapiens
ccctgccacctgtctgt

SEQ ID NO: 4257379 - DNA, 18 bp, Homo sapiens
ccctgccacctgtctgtc

SEQ ID NO: 4257380 - DNA, 21 bp, Homo sapiens
ccctggtgcactggccccacc

SEQ ID NO: 4257381 - DNA, 13 bp, Homo sapiens
cccttctataccc

SEQ ID NO: 4257382 - DNA, 18 bp, Homo sapiens
cccttctatacccaccca

SEQ ID NO: 4257383 - DNA, 21 bp, Homo sapiens
cccttctatacccacccagaa

SEQ ID NO: 4257384 - DNA, 17 bp, Homo sapiens
cccttctttccacagaa

SEQ ID NO: 4257385 - DNA, 15 bp, Homo sapiens
cccttgatgaagaag

SEQ ID NO: 4257386 - DNA, 18 bp, Homo sapiens
ccgcagaaggaaggcagg

SEQ ID NO: 4257387 - DNA, 18 bp, Homo sapiens
ccgcctcagcctcccaaa

SEQ ID NO: 4257388 - DNA, 17 bp, Homo sapiens
ccggcttgccacacccc

SEQ ID NO: 4257389 - DNA, 19 bp, Homo sapiens
cctaaaagaaaccctgcac

SEQ ID NO: 4257390 - DNA, 23 bp, Homo sapiens
cctattcaacacacacatgcttc

SEQ ID NO: 4257391 - DNA, 18 bp, Homo sapiens
cctattgttgaataaatg

SEQ ID NO: 4257392 - DNA, 23 bp, Homo sapiens
cctattgttgaataaatgtatct

SEQ ID NO: 4257393 - DNA, 16 bp, Homo sapiens
cctatttccagaaata

SEQ ID NO: 4257394 - DNA, 14 bp, Homo sapiens
cctcaacctcatcc

SEQ ID NO: 4257395 - DNA, 15 bp, Homo sapiens
cctccactctttctt

SEQ ID NO: 4257396 - DNA, 15 bp, Homo sapiens
cctcgtggacacctg

SEQ ID NO: 4257397 - DNA, 17 bp, Homo sapiens
cctcgtggacacctgcc

SEQ ID NO: 4257398 - DNA, 23 bp, Homo sapiens
cctcttccttccctgctgtgaaa

SEQ ID NO: 4257399 - DNA, 19 bp, Homo sapiens
cctgccacctcctgcctca

SEQ ID NO: 4257400 - DNA, 13 bp, Homo sapiens
cctgccacctgtc

SEQ ID NO: 4257401 - DNA, 17 bp, Homo sapiens
cctgccacctgtctgtc

SEQ ID NO: 4257402 - DNA, 18 bp, Homo sapiens
cctgccctgccacctgtc

SEQ ID NO: 4257403 - DNA, 15 bp, Homo sapiens
cctgccctgccctgc

SEQ ID NO: 4257404 - DNA, 16 bp, Homo sapiens
cctgcctcagcctccc

SEQ ID NO: 4257405 - DNA, 19 bp, Homo sapiens
cctggtgcactggccccac

SEQ ID NO: 4257406 - DNA, 23 bp, Homo sapiens
cctgtggaacataaaaaggacat

SEQ ID NO: 4257407 - DNA, 16 bp, Homo sapiens
ccttaactgcatccag

SEQ ID NO: 4257408 - DNA, 14 bp, Homo sapiens
ccttcatctggaac

SEQ ID NO: 4257409 - DNA, 15 bp, Homo sapiens
ccttcatgcatggaa

SEQ ID NO: 4257410 - DNA, 19 bp, Homo sapiens
ccttctccatggccctgcc

SEQ ID NO: 4257411 - DNA, 15 bp, Homo sapiens
cctttgacctgcctc

SEQ ID NO: 4257412 - DNA, 21 bp, Homo sapiens
cctttgacctgcctcccttca

SEQ ID NO: 4257413 - DNA, 19 bp, Homo sapiens
cctttggcaggtgcagccc

SEQ ID NO: 4257414 - DNA, 18 bp, Homo sapiens
cgactgaaaatattgttt

SEQ ID NO: 4257415 - DNA, 20 bp, Homo sapiens
cgatcttggttcactgcaac

SEQ ID NO: 4257416 - DNA, 15 bp, Homo sapiens
cgccggatctgaggg

SEQ ID NO: 4257417 - DNA, 17 bp, Homo sapiens
cgcctccaaccctagca

SEQ ID NO: 4257418 - DNA, 15 bp, Homo sapiens
cgcgatctcagctca

SEQ ID NO: 4257419 - DNA, 19 bp, Homo sapiens
cggaggaaggaggacccag

SEQ ID NO: 4257420 - DNA, 20 bp, Homo sapiens
cggaggaaggaggacccagg

SEQ ID NO: 4257421 - DNA, 23 bp, Homo sapiens
cggaggaaggaggacccaggaca

SEQ ID NO: 4257422 - DNA, 17 bp, Homo sapiens
cggcccacaattaattt

SEQ ID NO: 4257423 - DNA, 24 bp, Homo sapiens
cgtgatccacccgcctcagcctcc

SEQ ID NO: 4257424 - DNA, 18 bp, Homo sapiens
cgtggacacctgccctgc

SEQ ID NO: 4257425 - DNA, 19 bp, Homo sapiens
cgtggacacctgccctgcc

SEQ ID NO: 4257426 - DNA, 12 bp, Homo sapiens
ctaaccaagttc

SEQ ID NO: 4257427 - DNA, 16 bp, Homo sapiens
ctaatctactttctgt

SEQ ID NO: 4257428 - DNA, 23 bp, Homo sapiens
ctaatgtggaccttagaatacag

SEQ ID NO: 4257429 - DNA, 11 bp, Homo sapiens
ctacacccagc

SEQ ID NO: 4257430 - DNA, 16 bp, Homo sapiens
ctacacccagcaatag

SEQ ID NO: 4257431 - DNA, 23 bp, Homo sapiens
ctacttcttttttcaaaagaaag

SEQ ID NO: 4257432 - DNA, 16 bp, Homo sapiens
ctagcaaaagtgcaag

SEQ ID NO: 4257433 - DNA, 17 bp, Homo sapiens
ctagcaaaagtgcaaga

SEQ ID NO: 4257434 - DNA, 15 bp, Homo sapiens
ctaggaaatatttat

SEQ ID NO: 4257435 - DNA, 20 bp, Homo sapiens
ctaggaaatatttattttaa

SEQ ID NO: 4257436 - DNA, 20 bp, Homo sapiens
ctaggcagttcaaagcagga

SEQ ID NO: 4257437 - DNA, 20 bp, Homo sapiens
ctagtgaaactcgttaattt

SEQ ID NO: 4257438 - DNA, 15 bp, Homo sapiens
ctatacccacccaga

SEQ ID NO: 4257439 - DNA, 15 bp, Homo sapiens
ctatagctaagtaca

SEQ ID NO: 4257440 - DNA, 18 bp, Homo sapiens
ctatctcatttccaagca

SEQ ID NO: 4257441 - DNA, 19 bp, Homo sapiens
ctatctttgccaccctcat

SEQ ID NO: 4257442 - DNA, 13 bp, Homo sapiens
ctatgaaatatta

SEQ ID NO: 4257443 - DNA, 19 bp, Homo sapiens
ctattgcatttatatgtac

SEQ ID NO: 4257444 - DNA, 17 bp, Homo sapiens
ctattgttgaataaatg

SEQ ID NO: 4257445 - DNA, 19 bp, Homo sapiens
ctcaaaccaaatcactgaa

SEQ ID NO: 4257446 - DNA, 22 bp, Homo sapiens
ctcaaaccaaatcactgaactt

SEQ ID NO: 4257447 - DNA, 18 bp, Homo sapiens
ctcaatattcaataaagc

SEQ ID NO: 4257448 - DNA, 14 bp, Homo sapiens
ctcacccatcctag

SEQ ID NO: 4257449 - DNA, 19 bp, Homo sapiens
ctcagaaaacaaggatgaa

SEQ ID NO: 4257450 - DNA, 23 bp, Homo sapiens
ctcagaaaacaaggatgaattaa

SEQ ID NO: 4257451 - DNA, 15 bp, Homo sapiens
ctcagctcactgcaa

SEQ ID NO: 4257452 - DNA, 20 bp, Homo sapiens
ctcagctctcagttgcagcc

SEQ ID NO: 4257453 - DNA, 13 bp, Homo sapiens
ctcagttgcagcc

SEQ ID NO: 4257454 - DNA, 15 bp, Homo sapiens
ctccacagctgcctc

SEQ ID NO: 4257455 - DNA, 17 bp, Homo sapiens
ctccagcctcagcctcc

SEQ ID NO: 4257456 - DNA, 21 bp, Homo sapiens
ctcctccagggtggcagcaac

SEQ ID NO: 4257457 - DNA, 22 bp, Homo sapiens
ctcctccagggtggcagcaaca

SEQ ID NO: 4257458 - DNA, 13 bp, Homo sapiens
ctctcccaaaaaa

SEQ ID NO: 4257459 - DNA, 21 bp, Homo sapiens
ctctctcataccctccctccc

SEQ ID NO: 4257460 - DNA, 20 bp, Homo sapiens
ctctgaggggctaccaggaa

SEQ ID NO: 4257461 - DNA, 22 bp, Homo sapiens
ctctgtctcctaagctggagtg

SEQ ID NO: 4257462 - DNA, 21 bp, Homo sapiens
ctctgttgccaggctggagtg

SEQ ID NO: 4257463 - DNA, 15 bp, Homo sapiens
ctcttagatgcagtt

SEQ ID NO: 4257464 - DNA, 21 bp, Homo sapiens
ctcttagatgcagttctgaag

SEQ ID NO: 4257465 - DNA, 14 bp, Homo sapiens
ctcttccctcttcc

SEQ ID NO: 4257466 - DNA, 19 bp, Homo sapiens
ctcttccttccctgctgtg

SEQ ID NO: 4257467 - DNA, 19 bp, Homo sapiens
ctcttctgaataaagcaat

SEQ ID NO: 4257468 - DNA, 19 bp, Homo sapiens
ctctttaaaaggaaagaaa

SEQ ID NO: 4257469 - DNA, 23 bp, Homo sapiens
ctctttaaaaggaaagaaaacat

SEQ ID NO: 4257470 - DNA, 17 bp, Homo sapiens
ctgaaaatattgtttta

SEQ ID NO: 4257471 - DNA, 20 bp, Homo sapiens
ctgaaaatattgttttacaa

SEQ ID NO: 4257472 - DNA, 24 bp, Homo sapiens
ctgaaaatattgttttacaatagt

SEQ ID NO: 4257473 - DNA, 12 bp, Homo sapiens
ctgaactttgct

SEQ ID NO: 4257474 - DNA, 23 bp, Homo sapiens
ctgaagaagcaccaatcatgaat

SEQ ID NO: 4257475 - DNA, 18 bp, Homo sapiens
ctgaccctccaccgcaga

SEQ ID NO: 4257476 - DNA, 17 bp, Homo sapiens
ctgaggggctaccagga

SEQ ID NO: 4257477 - DNA, 13 bp, Homo sapiens
ctgagtcccatcc

SEQ ID NO: 4257478 - DNA, 15 bp, Homo sapiens
ctgatggagaaggaa

SEQ ID NO: 4257479 - DNA, 17 bp, Homo sapiens
ctgatggagaaggaagg

SEQ ID NO: 4257480 - DNA, 23 bp, Homo sapiens
ctgcagtctctataccaataaag

SEQ ID NO: 4257481 - DNA, 23 bp, Homo sapiens
ctgcatgcgagtgctcatttcag

SEQ ID NO: 4257482 - DNA, 14 bp, Homo sapiens
ctgccacctcctgc

SEQ ID NO: 4257483 - DNA, 11 bp, Homo sapiens
ctgccacctgt

SEQ ID NO: 4257484 - DNA, 17 bp, Homo sapiens
ctgccacctgtctgtct

SEQ ID NO: 4257485 - DNA, 13 bp, Homo sapiens
ctgccctgccacc

SEQ ID NO: 4257486 - DNA, 15 bp, Homo sapiens
ctgccctgccctgcc

SEQ ID NO: 4257487 - DNA, 18 bp, Homo sapiens
ctgcctcccttcatgcat

SEQ ID NO: 4257488 - DNA, 23 bp, Homo sapiens
ctgcggaggaaggaggacccagg

SEQ ID NO: 4257489 - DNA, 19 bp, Homo sapiens
ctgcttctgacataatcca

SEQ ID NO: 4257490 - DNA, 15 bp, Homo sapiens
ctggaagtgactttg

SEQ ID NO: 4257491 - DNA, 18 bp, Homo sapiens
ctggagatgaggccagac

SEQ ID NO: 4257492 - DNA, 19 bp, Homo sapiens
ctgggtaggaaagaggaag

SEQ ID NO: 4257493 - DNA, 22 bp, Homo sapiens
ctggtatgaacttgaggacaca

SEQ ID NO: 4257494 - DNA, 16 bp, Homo sapiens
ctggtgcactggcccc

SEQ ID NO: 4257495 - DNA, 14 bp, Homo sapiens
ctggtgtttcttga

SEQ ID NO: 4257496 - DNA, 14 bp, Homo sapiens
ctgtctgtctgtct

SEQ ID NO: 4257497 - DNA, 18 bp, Homo sapiens
ctgtggaacataaaaagg

SEQ ID NO: 4257498 - DNA, 21 bp, Homo sapiens
ctgtggaacataaaaaggaca

SEQ ID NO: 4257499 - DNA, 21 bp, Homo sapiens
ctgttgccaggctggagtgca

SEQ ID NO: 4257500 - DNA, 15 bp, Homo sapiens
ctgttttataatttt

SEQ ID NO: 4257501 - DNA, 14 bp, Homo sapiens
ctgtttttttgtta

SEQ ID NO: 4257502 - DNA, 16 bp, Homo sapiens
cttataataaaggact

SEQ ID NO: 4257503 - DNA, 17 bp, Homo sapiens
cttataataaaggactg

SEQ ID NO: 4257504 - DNA, 20 bp, Homo sapiens
cttataataaaggactgtaa

SEQ ID NO: 4257505 - DNA, 16 bp, Homo sapiens
cttattatttttgaga

SEQ ID NO: 4257506 - DNA, 16 bp, Homo sapiens
cttcagcggtttatat

SEQ ID NO: 4257507 - DNA, 18 bp, Homo sapiens
cttcagcggtttatataa

SEQ ID NO: 4257508 - DNA, 13 bp, Homo sapiens
cttcagtctctat

SEQ ID NO: 4257509 - DNA, 22 bp, Homo sapiens
cttcagtctctataccaataaa

SEQ ID NO: 4257510 - DNA, 11 bp, Homo sapiens
cttcatctgga

SEQ ID NO: 4257511 - DNA, 15 bp, Homo sapiens
cttcatctggaacca

SEQ ID NO: 4257512 - DNA, 23 bp, Homo sapiens
cttcatgctgtctacactaagag

SEQ ID NO: 4257513 - DNA, 16 bp, Homo sapiens
cttccctatctttgcc

SEQ ID NO: 4257514 - DNA, 23 bp, Homo sapiens
cttccctatctttgccaccctca

SEQ ID NO: 4257515 - DNA, 15 bp, Homo sapiens
cttccttccctgctg

SEQ ID NO: 4257516 - DNA, 16 bp, Homo sapiens
cttccttccctgctgt

SEQ ID NO: 4257517 - DNA, 14 bp, Homo sapiens
cttctcagatttct

SEQ ID NO: 4257518 - DNA, 17 bp, Homo sapiens
cttctccatggccctgc

SEQ ID NO: 4257519 - DNA, 16 bp, Homo sapiens
cttctgaataaagcaa

SEQ ID NO: 4257520 - DNA, 22 bp, Homo sapiens
cttctgaataaagcaattagca

SEQ ID NO: 4257521 - DNA, 20 bp, Homo sapiens
cttctgttttataattttgt

SEQ ID NO: 4257522 - DNA, 19 bp, Homo sapiens
cttctttccacagaagctc

SEQ ID NO: 4257523 - DNA, 15 bp, Homo sapiens
cttgcaaaaagggtc

SEQ ID NO: 4257524 - DNA, 19 bp, Homo sapiens
cttgccacaccccccaccc

SEQ ID NO: 4257525 - DNA, 18 bp, Homo sapiens
cttggggctgatgcagtt

SEQ ID NO: 4257526 - DNA, 18 bp, Homo sapiens
ctttaaaaggaaagaaaa

SEQ ID NO: 4257527 - DNA, 17 bp, Homo sapiens
ctttaaaattacaacta

SEQ ID NO: 4257528 - DNA, 21 bp, Homo sapiens
ctttctttcaataaaacgcag

SEQ ID NO: 4257529 - DNA, 14 bp, Homo sapiens
ctttgacctgcctc

SEQ ID NO: 4257530 - DNA, 18 bp, Homo sapiens
ctttgacctgcctccctt

SEQ ID NO: 4257531 - DNA, 18 bp, Homo sapiens
ctttgctgagcctgtaaa

SEQ ID NO: 4257532 - DNA, 13 bp, Homo sapiens
ctttggcaggtgc

SEQ ID NO: 4257533 - DNA, 13 bp, Homo sapiens
ctttgtattcaaa

SEQ ID NO: 4257534 - DNA, 22 bp, Homo sapiens
ctttgtattgtatattacaatg

SEQ ID NO: 4257535 - DNA, 16 bp, Homo sapiens
cttttttcaaaagaaa

SEQ ID NO: 4257536 - DNA, 19 bp, Homo sapiens
gaaaaatatatactaaaca

SEQ ID NO: 4257537 - DNA, 14 bp, Homo sapiens
gaaaacaaggatga

SEQ ID NO: 4257538 - DNA, 19 bp, Homo sapiens
gaaacaccctcacactggg

SEQ ID NO: 4257539 - DNA, 11 bp, Homo sapiens
gaaacatttgg

SEQ ID NO: 4257540 - DNA, 14 bp, Homo sapiens
gaaaccttccaccc

SEQ ID NO: 4257541 - DNA, 17 bp, Homo sapiens
gaaaccttccacccagt

SEQ ID NO: 4257542 - DNA, 23 bp, Homo sapiens
gaaactcgttaatttgtagtgtt

SEQ ID NO: 4257543 - DNA, 22 bp, Homo sapiens
gaaagcgcctccaaccctagca

SEQ ID NO: 4257544 - DNA, 16 bp, Homo sapiens
gaaatatttattttaa

SEQ ID NO: 4257545 - DNA, 18 bp, Homo sapiens
gaaatatttattttaata

SEQ ID NO: 4257546 - DNA, 22 bp, Homo sapiens
gaaatatttattttaataatgt

SEQ ID NO: 4257547 - DNA, 24 bp, Homo sapiens
gaacagttacctctgcctcagaaa

SEQ ID NO: 4257548 - DNA, 16 bp, Homo sapiens
gaacataaaaaggaca

SEQ ID NO: 4257549 - DNA, 14 bp, Homo sapiens
gaaccacaagactg

SEQ ID NO: 4257550 - DNA, 21 bp, Homo sapiens
gaactagagtttagctggaaa

SEQ ID NO: 4257551 - DNA, 22 bp, Homo sapiens
gaactagagtttagctggaaaa

SEQ ID NO: 4257552 - DNA, 22 bp, Homo sapiens
gaacttccagatcctggaaatc

SEQ ID NO: 4257553 - DNA, 13 bp, Homo sapiens
gaacttgaggaca

SEQ ID NO: 4257554 - DNA, 15 bp, Homo sapiens
gaacttgaggacaca

SEQ ID NO: 4257555 - DNA, 16 bp, Homo sapiens
gaacttgaggacacat

SEQ ID NO: 4257556 - DNA, 18 bp, Homo sapiens
gaacttgaggacacatgt

SEQ ID NO: 4257557 - DNA, 19 bp, Homo sapiens
gaagactgcattatattta

SEQ ID NO: 4257558 - DNA, 15 bp, Homo sapiens
gaagagaaggagcag

SEQ ID NO: 4257559 - DNA, 20 bp, Homo sapiens
gaagcaagtaaaaaggctaa

SEQ ID NO: 4257560 - DNA, 20 bp, Homo sapiens
gaaggaaggcagggaggagg

SEQ ID NO: 4257561 - DNA, 17 bp, Homo sapiens
gaaggaggacccaggac

SEQ ID NO: 4257562 - DNA, 20 bp, Homo sapiens
gaaggcagggaggaggcaga

SEQ ID NO: 4257563 - DNA, 14 bp, Homo sapiens
gaagtaactacagt

SEQ ID NO: 4257564 - DNA, 12 bp, Homo sapiens
gaagtccaagca

SEQ ID NO: 4257565 - DNA, 15 bp, Homo sapiens
gaagtgactttggct

SEQ ID NO: 4257566 - DNA, 21 bp, Homo sapiens
gaagtgactttggctgcatgc

SEQ ID NO: 4257567 - DNA, 21 bp, Homo sapiens
gaagttgacttatagtacatg

SEQ ID NO: 4257568 - DNA, 13 bp, Homo sapiens
gaataaagcaatt

SEQ ID NO: 4257569 - DNA, 15 bp, Homo sapiens
gaatgagacatccag

SEQ ID NO: 4257570 - DNA, 14 bp, Homo sapiens
gaatgattatgaat

SEQ ID NO: 4257571 - DNA, 16 bp, Homo sapiens
gaatggaggggcagag

SEQ ID NO: 4257572 - DNA, 18 bp, Homo sapiens
gaattacatttgtataaa

SEQ ID NO: 4257573 - DNA, 11 bp, Homo sapiens
gaattagtttt

SEQ ID NO: 4257574 - DNA, 19 bp, Homo sapiens
gaattctttaaaattacaa

SEQ ID NO: 4257575 - DNA, 13 bp, Homo sapiens
gacacctgccctg

SEQ ID NO: 4257576 - DNA, 15 bp, Homo sapiens
gacacctgccctgcc

SEQ ID NO: 4257577 - DNA, 22 bp, Homo sapiens
gacacctgccctgccctgccac

SEQ ID NO: 4257578 - DNA, 23 bp, Homo sapiens
gacacctgccctgccctgccacc

SEQ ID NO: 4257579 - DNA, 18 bp, Homo sapiens
gacactacacccagcaat

SEQ ID NO: 4257580 - DNA, 20 bp, Homo sapiens
gacactacacccagcaatag

SEQ ID NO: 4257581 - DNA, 18 bp, Homo sapiens
gacaggatccaggccggc

SEQ ID NO: 4257582 - DNA, 13 bp, Homo sapiens
gacatccagcaga

SEQ ID NO: 4257583 - DNA, 22 bp, Homo sapiens
gacatccagcagatttccagcc

SEQ ID NO: 4257584 - DNA, 16 bp, Homo sapiens
gacatgggacatttgc

SEQ ID NO: 4257585 - DNA, 22 bp, Homo sapiens
gacatgggacatttgctcatgg

SEQ ID NO: 4257586 - DNA, 14 bp, Homo sapiens
gacattttacatta

SEQ ID NO: 4257587 - DNA, 16 bp, Homo sapiens
gaccacctctcaatat

SEQ ID NO: 4257588 - DNA, 22 bp, Homo sapiens
gaccagcttttcccaaaagccc

SEQ ID NO: 4257589 - DNA, 17 bp, Homo sapiens
gactcttaagaagactg

SEQ ID NO: 4257590 - DNA, 16 bp, Homo sapiens
gactttggctgcatgc

SEQ ID NO: 4257591 - DNA, 19 bp, Homo sapiens
gactttggctgcatgcgag

SEQ ID NO: 4257592 - DNA, 22 bp, Homo sapiens
gagaacctagggtgatattaac

SEQ ID NO: 4257593 - DNA, 13 bp, Homo sapiens
gagaaggagcaga

SEQ ID NO: 4257594 - DNA, 12 bp, Homo sapiens
gagacatccagc

SEQ ID NO: 4257595 - DNA, 12 bp, Homo sapiens
gagaccacctct

SEQ ID NO: 4257596 - DNA, 19 bp, Homo sapiens
gagagaggttgaaaaacaa

SEQ ID NO: 4257597 - DNA, 13 bp, Homo sapiens
gagatcaggaaga

SEQ ID NO: 4257598 - DNA, 20 bp, Homo sapiens
gagatcaggaagagaaggag

SEQ ID NO: 4257599 - DNA, 20 bp, Homo sapiens
gagcaagaccccatctcaaa

SEQ ID NO: 4257600 - DNA, 20 bp, Homo sapiens
gagccaggaagatcccccag

SEQ ID NO: 4257601 - DNA, 21 bp, Homo sapiens
gagccaggaagatcccccaga

SEQ ID NO: 4257602 - DNA, 22 bp, Homo sapiens
gagcccttctatacccacccag

SEQ ID NO: 4257603 - DNA, 15 bp, Homo sapiens
gagctgatggagaag

SEQ ID NO: 4257604 - DNA, 21 bp, Homo sapiens
gagctggagatgaggccagac

SEQ ID NO: 4257605 - DNA, 21 bp, Homo sapiens
gaggaaggaggacccaggaca

SEQ ID NO: 4257606 - DNA, 12 bp, Homo sapiens
gaggacacatgt

SEQ ID NO: 4257607 - DNA, 16 bp, Homo sapiens
gaggcagagaagaaag

SEQ ID NO: 4257608 - DNA, 18 bp, Homo sapiens
gaggcagagaagaaagaa

SEQ ID NO: 4257609 - DNA, 22 bp, Homo sapiens
gaggcctattgttgaataaatg

SEQ ID NO: 4257610 - DNA, 16 bp, Homo sapiens
gagggagaacaagacc

SEQ ID NO: 4257611 - DNA, 13 bp, Homo sapiens
gaggggcagagcc

SEQ ID NO: 4257612 - DNA, 15 bp, Homo sapiens
gagtcaaaaattaaa

SEQ ID NO: 4257613 - DNA, 19 bp, Homo sapiens
gagtgctgaaggaatggaa

SEQ ID NO: 4257614 - DNA, 12 bp, Homo sapiens
gatcaggaagag

SEQ ID NO: 4257615 - DNA, 15 bp, Homo sapiens
gatcaggaagagaag

SEQ ID NO: 4257616 - DNA, 17 bp, Homo sapiens
gatcaggaagagaagga

SEQ ID NO: 4257617 - DNA, 18 bp, Homo sapiens
gatcaggaagagaaggag

SEQ ID NO: 4257618 - DNA, 12 bp, Homo sapiens
gatccacccgcc

SEQ ID NO: 4257619 - DNA, 13 bp, Homo sapiens
gatcctggaaatc

SEQ ID NO: 4257620 - DNA, 15 bp, Homo sapiens
gatgaggccagacca

SEQ ID NO: 4257621 - DNA, 12 bp, Homo sapiens
gatggagaagga

SEQ ID NO: 4257622 - DNA, 16 bp, Homo sapiens
gatggagaaggaaggc

SEQ ID NO: 4257623 - DNA, 18 bp, Homo sapiens
gatgggggtttcaccata

SEQ ID NO: 4257624 - DNA, 22 bp, Homo sapiens
gatggttcccttgatgaagaag

SEQ ID NO: 4257625 - DNA, 21 bp, Homo sapiens
gattaacaggtatgaaccacc

SEQ ID NO: 4257626 - DNA, 14 bp, Homo sapiens
gattaagtaatgat

SEQ ID NO: 4257627 - DNA, 14 bp, Homo sapiens
gattacacacgtga

SEQ ID NO: 4257628 - DNA, 20 bp, Homo sapiens
gcaaaaacaaaaagaaaaga

SEQ ID NO: 4257629 - DNA, 21 bp, Homo sapiens
gcaaacaggatcagttaacta

SEQ ID NO: 4257630 - DNA, 13 bp, Homo sapiens
gcaacaataaata

SEQ ID NO: 4257631 - DNA, 20 bp, Homo sapiens
gcaaggcctggtgtttcttg

SEQ ID NO: 4257632 - DNA, 20 bp, Homo sapiens
gcaatcctcccacttcagcc

SEQ ID NO: 4257633 - DNA, 23 bp, Homo sapiens
gcaatcctcccacttcagcctcc

SEQ ID NO: 4257634 - DNA, 22 bp, Homo sapiens
gcacacaccaccacgcctggct

SEQ ID NO: 4257635 - DNA, 14 bp, Homo sapiens
gcactggccccacc

SEQ ID NO: 4257636 - DNA, 15 bp, Homo sapiens
gcactggccccaccc

SEQ ID NO: 4257637 - DNA, 19 bp, Homo sapiens
gcactgtgggtagacacac

SEQ ID NO: 4257638 - DNA, 13 bp, Homo sapiens
gcagaaggaaggc

SEQ ID NO: 4257639 - DNA, 16 bp, Homo sapiens
gcagagccaggaagat

SEQ ID NO: 4257640 - DNA, 16 bp, Homo sapiens
gcagcaacaataaata

SEQ ID NO: 4257641 - DNA, 12 bp, Homo sapiens
gcagcaatttaa

SEQ ID NO: 4257642 - DNA, 15 bp, Homo sapiens
gcagcaatttaaatg

SEQ ID NO: 4257643 - DNA, 20 bp, Homo sapiens
gcagccctgctgctgcctgc

SEQ ID NO: 4257644 - DNA, 17 bp, Homo sapiens
gcagtctctataccaat

SEQ ID NO: 4257645 - DNA, 21 bp, Homo sapiens
gcagtctctataccaataaag

SEQ ID NO: 4257646 - DNA, 14 bp, Homo sapiens
gcagttctgaagaa

SEQ ID NO: 4257647 - DNA, 12 bp, Homo sapiens
gcatttagatgt

SEQ ID NO: 4257648 - DNA, 13 bp, Homo sapiens
gcatttagatgta

SEQ ID NO: 4257649 - DNA, 14 bp, Homo sapiens
gccacctgtctgtc

SEQ ID NO: 4257650 - DNA, 15 bp, Homo sapiens
gccacctgtctgtct

SEQ ID NO: 4257651 - DNA, 18 bp, Homo sapiens
gccacggggactcagccc

SEQ ID NO: 4257652 - DNA, 19 bp, Homo sapiens
gccaggaagatcccccaga

SEQ ID NO: 4257653 - DNA, 16 bp, Homo sapiens
gccaggctggagtgca

SEQ ID NO: 4257654 - DNA, 18 bp, Homo sapiens
gccaggctggagtgcagt

SEQ ID NO: 4257655 - DNA, 16 bp, Homo sapiens
gcccacagctgtatga

SEQ ID NO: 4257656 - DNA, 23 bp, Homo sapiens
gccccaccctcgtggacacctgc

SEQ ID NO: 4257657 - DNA, 16 bp, Homo sapiens
gccctgccacctgtct

SEQ ID NO: 4257658 - DNA, 17 bp, Homo sapiens
gccctgccacctgtctg

SEQ ID NO: 4257659 - DNA, 13 bp, Homo sapiens
gccctgccctgcc

SEQ ID NO: 4257660 - DNA, 18 bp, Homo sapiens
gccctgctgctgcctgcc

SEQ ID NO: 4257661 - DNA, 13 bp, Homo sapiens
gccttcaaatcaa

SEQ ID NO: 4257662 - DNA, 22 bp, Homo sapiens
gcgaggcctattgttgaataaa

SEQ ID NO: 4257663 - DNA, 16 bp, Homo sapiens
gcgcgatctcagctca

SEQ ID NO: 4257664 - DNA, 12 bp, Homo sapiens
gcgtgatctcag

SEQ ID NO: 4257665 - DNA, 15 bp, Homo sapiens
gcgtgatctcagctc

SEQ ID NO: 4257666 - DNA, 14 bp, Homo sapiens
gctaagcattccaa

SEQ ID NO: 4257667 - DNA, 16 bp, Homo sapiens
gctacagaagaaactg

SEQ ID NO: 4257668 - DNA, 13 bp, Homo sapiens
gctagatgtatgt

SEQ ID NO: 4257669 - DNA, 14 bp, Homo sapiens
gctagatgtatgta

SEQ ID NO: 4257670 - DNA, 17 bp, Homo sapiens
gctatataagacaagaa

SEQ ID NO: 4257671 - DNA, 24 bp, Homo sapiens
gctgaatttccctctctcataccc

SEQ ID NO: 4257672 - DNA, 18 bp, Homo sapiens
gctggagatgaggccaga

SEQ ID NO: 4257673 - DNA, 15 bp, Homo sapiens
gctggagtgcagtgg

SEQ ID NO: 4257674 - DNA, 12 bp, Homo sapiens
gctgtattttaa

SEQ ID NO: 4257675 - DNA, 18 bp, Homo sapiens
gctgtattttaaaagaat

SEQ ID NO: 4257676 - DNA, 18 bp, Homo sapiens
gcttatgcttaaattcaa

SEQ ID NO: 4257677 - DNA, 18 bp, Homo sapiens
ggaaaccttccacccagt

SEQ ID NO: 4257678 - DNA, 15 bp, Homo sapiens
ggaaatatttatttt

SEQ ID NO: 4257679 - DNA, 18 bp, Homo sapiens
ggaaatatttattttaat

SEQ ID NO: 4257680 - DNA, 19 bp, Homo sapiens
ggaaatcagggttagtatt

SEQ ID NO: 4257681 - DNA, 18 bp, Homo sapiens
ggaacataaaaaggacat

SEQ ID NO: 4257682 - DNA, 17 bp, Homo sapiens
ggaagagaaggagcaga

SEQ ID NO: 4257683 - DNA, 13 bp, Homo sapiens
ggacacatgtcca

SEQ ID NO: 4257684 - DNA, 19 bp, Homo sapiens
ggacacatgtccagtggga

SEQ ID NO: 4257685 - DNA, 15 bp, Homo sapiens
ggacacctgccctgc

SEQ ID NO: 4257686 - DNA, 17 bp, Homo sapiens
ggacacctgccctgccc

SEQ ID NO: 4257687 - DNA, 15 bp, Homo sapiens
ggacactacacccag

SEQ ID NO: 4257688 - DNA, 19 bp, Homo sapiens
ggacactacacccagcaat

SEQ ID NO: 4257689 - DNA, 22 bp, Homo sapiens
ggacactacacccagcaataga

SEQ ID NO: 4257690 - DNA, 12 bp, Homo sapiens
ggacatcagcaa

SEQ ID NO: 4257691 - DNA, 15 bp, Homo sapiens
ggacatcagcaaaca

SEQ ID NO: 4257692 - DNA, 17 bp, Homo sapiens
ggaccccagccatccag

SEQ ID NO: 4257693 - DNA, 12 bp, Homo sapiens
ggagaaggaagg

SEQ ID NO: 4257694 - DNA, 15 bp, Homo sapiens
ggagatgaggccaga

SEQ ID NO: 4257695 - DNA, 16 bp, Homo sapiens
ggagatgaggccagac

SEQ ID NO: 4257696 - DNA, 23 bp, Homo sapiens
ggagcagagctgatggagaagga

SEQ ID NO: 4257697 - DNA, 18 bp, Homo sapiens
ggaggaggcagagaagaa

SEQ ID NO: 4257698 - DNA, 14 bp, Homo sapiens
ggaggcagagaaga

SEQ ID NO: 4257699 - DNA, 15 bp, Homo sapiens
ggaggcagagaagaa

SEQ ID NO: 4257700 - DNA, 12 bp, Homo sapiens
ggaggggcagag

SEQ ID NO: 4257701 - DNA, 12 bp, Homo sapiens
ggagtgcagtgg

SEQ ID NO: 4257702 - DNA, 23 bp, Homo sapiens
ggatggttcccttgatgaagaag

SEQ ID NO: 4257703 - DNA, 16 bp, Homo sapiens
ggcagagccaggaaga

SEQ ID NO: 4257704 - DNA, 17 bp, Homo sapiens
ggcagagccaggaagat

SEQ ID NO: 4257705 - DNA, 17 bp, Homo sapiens
ggcatcatctcagctca

SEQ ID NO: 4257706 - DNA, 18 bp, Homo sapiens
ggcctattgttgaataaa

SEQ ID NO: 4257707 - DNA, 22 bp, Homo sapiens
ggctgggaatggaggggcagag

SEQ ID NO: 4257708 - DNA, 21 bp, Homo sapiens
gggacatttgctcatggaatt

SEQ ID NO: 4257709 - DNA, 15 bp, Homo sapiens
gggaggaggcagaga

SEQ ID NO: 4257710 - DNA, 13 bp, Homo sapiens
gggcagagccagg

SEQ ID NO: 4257711 - DNA, 16 bp, Homo sapiens
gggcagcaatttaaat

SEQ ID NO: 4257712 - DNA, 20 bp, Homo sapiens
gggcttataataaaggactg

SEQ ID NO: 4257713 - DNA, 16 bp, Homo sapiens
ggggcagagccaggaa

SEQ ID NO: 4257714 - DNA, 13 bp, Homo sapiens
gggtggcagcaac

SEQ ID NO: 4257715 - DNA, 19 bp, Homo sapiens
ggtatgaacttgaggacac

SEQ ID NO: 4257716 - DNA, 21 bp, Homo sapiens
ggtatgaacttgaggacacat

SEQ ID NO: 4257717 - DNA, 15 bp, Homo sapiens
ggtgagaccacctct

SEQ ID NO: 4257718 - DNA, 17 bp, Homo sapiens
gtaaaaatggaaactat

SEQ ID NO: 4257719 - DNA, 18 bp, Homo sapiens
gtacacaataagcaaaaa

SEQ ID NO: 4257720 - DNA, 20 bp, Homo sapiens
gtacacaataagcaaaaaca

SEQ ID NO: 4257721 - DNA, 23 bp, Homo sapiens
gtacactgccttctcaactccaa

SEQ ID NO: 4257722 - DNA, 22 bp, Homo sapiens
gtacttcaaatccttgaagatt

SEQ ID NO: 4257723 - DNA, 18 bp, Homo sapiens
gtagcgttttttaaatgt

SEQ ID NO: 4257724 - DNA, 22 bp, Homo sapiens
gtagtagcgttttttaaatgta

SEQ ID NO: 4257725 - DNA, 17 bp, Homo sapiens
gtagttgccttaaaata

SEQ ID NO: 4257726 - DNA, 14 bp, Homo sapiens
gtatattacaatga

SEQ ID NO: 4257727 - DNA, 17 bp, Homo sapiens
gtatattacaatgatca

SEQ ID NO: 4257728 - DNA, 20 bp, Homo sapiens
gtatgaacttgaggacacat

SEQ ID NO: 4257729 - DNA, 14 bp, Homo sapiens
gtatgattcccagc

SEQ ID NO: 4257730 - DNA, 19 bp, Homo sapiens
gtattcaaaaattatctat

SEQ ID NO: 4257731 - DNA, 22 bp, Homo sapiens
gtatttctatgaaatattatgt

SEQ ID NO: 4257732 - DNA, 17 bp, Homo sapiens
gtattttaaaagaatga

SEQ ID NO: 4257733 - DNA, 20 bp, Homo sapiens
gtattttaaaagaatgatta

SEQ ID NO: 4257734 - DNA, 23 bp, Homo sapiens
gtcaaaaattaaaccggaccatc

SEQ ID NO: 4257735 - DNA, 21 bp, Homo sapiens
gtcaataaaatccatacattt

SEQ ID NO: 4257736 - DNA, 23 bp, Homo sapiens
gtcaataaaatccatacatttgt

SEQ ID NO: 4257737 - DNA, 16 bp, Homo sapiens
gtcactacgcctggct

SEQ ID NO: 4257738 - DNA, 13 bp, Homo sapiens
gtcaggaaagaga

SEQ ID NO: 4257739 - DNA, 24 bp, Homo sapiens
gtccagtgggaggtgagaccacct

SEQ ID NO: 4257740 - DNA, 15 bp, Homo sapiens
gtccagtgtttcttt

SEQ ID NO: 4257741 - DNA, 17 bp, Homo sapiens
gtctctataccaataaa

SEQ ID NO: 4257742 - DNA, 18 bp, Homo sapiens
gtctctataccaataaag

SEQ ID NO: 4257743 - DNA, 19 bp, Homo sapiens
gtctctgaggggctaccag

SEQ ID NO: 4257744 - DNA, 20 bp, Homo sapiens
gtctcttctgaataaagcaa

SEQ ID NO: 4257745 - DNA, 21 bp, Homo sapiens
gtctcttctgaataaagcaat

SEQ ID NO: 4257746 - DNA, 22 bp, Homo sapiens
gtctcttctgaataaagcaatt

SEQ ID NO: 4257747 - DNA, 22 bp, Homo sapiens
gtctctttaaaaggaaagaaaa

SEQ ID NO: 4257748 - DNA, 20 bp, Homo sapiens
gtgaaactcgttaatttgta

SEQ ID NO: 4257749 - DNA, 13 bp, Homo sapiens
gtgaaagaagtaa

SEQ ID NO: 4257750 - DNA, 16 bp, Homo sapiens
gtgacaagctcacaga

SEQ ID NO: 4257751 - DNA, 20 bp, Homo sapiens
gtgacattttacattaaatt

SEQ ID NO: 4257752 - DNA, 20 bp, Homo sapiens
gtgagaccacctctcaatat

SEQ ID NO: 4257753 - DNA, 16 bp, Homo sapiens
gtgagcagtcaggaaa

SEQ ID NO: 4257754 - DNA, 23 bp, Homo sapiens
gtgcagggcctgtaatcccagca

SEQ ID NO: 4257755 - DNA, 18 bp, Homo sapiens
gtgctagtaattggaaag

SEQ ID NO: 4257756 - DNA, 16 bp, Homo sapiens
gtgctcatttcaggat

SEQ ID NO: 4257757 - DNA, 19 bp, Homo sapiens
gtggaacataaaaaggaca

SEQ ID NO: 4257758 - DNA, 20 bp, Homo sapiens
gtggaacataaaaaggacat

SEQ ID NO: 4257759 - DNA, 11 bp, Homo sapiens
gtggacacctg

SEQ ID NO: 4257760 - DNA, 14 bp, Homo sapiens
gtggacacctgccc

SEQ ID NO: 4257761 - DNA, 16 bp, Homo sapiens
gtggacacctgccctg

SEQ ID NO: 4257762 - DNA, 19 bp, Homo sapiens
gtggacacctgccctgccc

SEQ ID NO: 4257763 - DNA, 17 bp, Homo sapiens
gtgggaggtgagaccac

SEQ ID NO: 4257764 - DNA, 14 bp, Homo sapiens
gtgggtagacacac

SEQ ID NO: 4257765 - DNA, 21 bp, Homo sapiens
gtgtaagtagataggccatgg

SEQ ID NO: 4257766 - DNA, 23 bp, Homo sapiens
gttacctctgcctcagaaaacaa

SEQ ID NO: 4257767 - DNA, 20 bp, Homo sapiens
gttatccacctgccttggct

SEQ ID NO: 4257768 - DNA, 17 bp, Homo sapiens
gttatgactatgtaaac

SEQ ID NO: 4257769 - DNA, 13 bp, Homo sapiens
gttctgaagaaga

SEQ ID NO: 4257770 - DNA, 18 bp, Homo sapiens
gttgacatgggacatttg

SEQ ID NO: 4257771 - DNA, 21 bp, Homo sapiens
gttgatggtggtatgttttca

SEQ ID NO: 4257772 - DNA, 23 bp, Homo sapiens
gttgcagccctgctgctgcctgc

SEQ ID NO: 4257773 - DNA, 15 bp, Homo sapiens
gttggagtgcagtgg

SEQ ID NO: 4257774 - DNA, 20 bp, Homo sapiens
gtttagctggaaaagtatgt

SEQ ID NO: 4257775 - DNA, 21 bp, Homo sapiens
gtttagctggaaaagtatgtt

SEQ ID NO: 4257776 - DNA, 15 bp, Homo sapiens
gttttataattttgt

SEQ ID NO: 4257777 - DNA, 21 bp, Homo sapiens
taaaaaggacatcagcaaaca

SEQ ID NO: 4257778 - DNA, 16 bp, Homo sapiens
taaaagaaaccctgca

SEQ ID NO: 4257779 - DNA, 15 bp, Homo sapiens
taaaaggaaagaaaa

SEQ ID NO: 4257780 - DNA, 22 bp, Homo sapiens
taaaataattttatctctttct

SEQ ID NO: 4257781 - DNA, 22 bp, Homo sapiens
taaaataatttttatatttgaa

SEQ ID NO: 4257782 - DNA, 16 bp, Homo sapiens
taaaccggaccatctc

SEQ ID NO: 4257783 - DNA, 12 bp, Homo sapiens
taaatgtatctg

SEQ ID NO: 4257784 - DNA, 13 bp, Homo sapiens
taaatgtatctga

SEQ ID NO: 4257785 - DNA, 14 bp, Homo sapiens
taaatgtatctgaa

SEQ ID NO: 4257786 - DNA, 21 bp, Homo sapiens
taaatgttatgactatgtaaa

SEQ ID NO: 4257787 - DNA, 15 bp, Homo sapiens
taaatgttgacatgg

SEQ ID NO: 4257788 - DNA, 17 bp, Homo sapiens
taacaatgctgtatttt

SEQ ID NO: 4257789 - DNA, 23 bp, Homo sapiens
taagagagaatgagagacacact

SEQ ID NO: 4257790 - DNA, 23 bp, Homo sapiens
taagcaaaaacaaaaagaaaaga

SEQ ID NO: 4257791 - DNA, 19 bp, Homo sapiens
taagtaatgataactggaa

SEQ ID NO: 4257792 - DNA, 18 bp, Homo sapiens
taagtacacaataagcaa

SEQ ID NO: 4257793 - DNA, 13 bp, Homo sapiens
taataaaaataaa

SEQ ID NO: 4257794 - DNA, 16 bp, Homo sapiens
taataaaggactgtaa

SEQ ID NO: 4257795 - DNA, 15 bp, Homo sapiens
taataatgtttcaaa

SEQ ID NO: 4257796 - DNA, 15 bp, Homo sapiens
taatcttcaatagtt

SEQ ID NO: 4257797 - DNA, 22 bp, Homo sapiens
taatgataactggaaacttcag

SEQ ID NO: 4257798 - DNA, 20 bp, Homo sapiens
taatttgtagtgttggagaa

SEQ ID NO: 4257799 - DNA, 13 bp, Homo sapiens
taattttgtgaag

SEQ ID NO: 4257800 - DNA, 18 bp, Homo sapiens
taattttgtgaagcaaaa

SEQ ID NO: 4257801 - DNA, 16 bp, Homo sapiens
taatttttatatttga

SEQ ID NO: 4257802 - DNA, 17 bp, Homo sapiens
taatttttatatttgaa

SEQ ID NO: 4257803 - DNA, 19 bp, Homo sapiens
taatttttatatttgaaat

SEQ ID NO: 4257804 - DNA, 15 bp, Homo sapiens
tacacaataagcaaa

SEQ ID NO: 4257805 - DNA, 19 bp, Homo sapiens
tacactaagagagaatgag

SEQ ID NO: 4257806 - DNA, 11 bp, Homo sapiens
tacagaactac

SEQ ID NO: 4257807 - DNA, 21 bp, Homo sapiens
tacagttagggctcctattca

SEQ ID NO: 4257808 - DNA, 18 bp, Homo sapiens
taccaccagtctgactgt

SEQ ID NO: 4257809 - DNA, 12 bp, Homo sapiens
tacccacccaga

SEQ ID NO: 4257810 - DNA, 23 bp, Homo sapiens
tacctctccagcctcagctctca

SEQ ID NO: 4257811 - DNA, 19 bp, Homo sapiens
tacttcaaatccttgaaga

SEQ ID NO: 4257812 - DNA, 16 bp, Homo sapiens
tacttcatgctgtcta

SEQ ID NO: 4257813 - DNA, 15 bp, Homo sapiens
tagaaacacaactat

SEQ ID NO: 4257814 - DNA, 18 bp, Homo sapiens
tagaagacaaaatgttca

SEQ ID NO: 4257815 - DNA, 15 bp, Homo sapiens
tagacaattgaggta

SEQ ID NO: 4257816 - DNA, 16 bp, Homo sapiens
tagacacgcacggcag

SEQ ID NO: 4257817 - DNA, 17 bp, Homo sapiens
tagataggccatgggca

SEQ ID NO: 4257818 - DNA, 20 bp, Homo sapiens
tagatgcagttctgaagaag

SEQ ID NO: 4257819 - DNA, 16 bp, Homo sapiens
tagcgttttttaaatg

SEQ ID NO: 4257820 - DNA, 14 bp, Homo sapiens
tagctaagtacaca

SEQ ID NO: 4257821 - DNA, 17 bp, Homo sapiens
taggaagttgacttata

SEQ ID NO: 4257822 - DNA, 16 bp, Homo sapiens
tagggaaaacattcca

SEQ ID NO: 4257823 - DNA, 16 bp, Homo sapiens
tagtatttctatgaaa

SEQ ID NO: 4257824 - DNA, 13 bp, Homo sapiens
tagtcaaattgtg

SEQ ID NO: 4257825 - DNA, 18 bp, Homo sapiens
tagtcaccagagacttta

SEQ ID NO: 4257826 - DNA, 16 bp, Homo sapiens
tagtctctttaaaagg

SEQ ID NO: 4257827 - DNA, 22 bp, Homo sapiens
tagtgaaactcgttaatttgta

SEQ ID NO: 4257828 - DNA, 16 bp, Homo sapiens
tagtgttggagaagaa

SEQ ID NO: 4257829 - DNA, 23 bp, Homo sapiens
tagtgttggagaagaactgaaat

SEQ ID NO: 4257830 - DNA, 18 bp, Homo sapiens
tataacaatgctgtattt

SEQ ID NO: 4257831 - DNA, 19 bp, Homo sapiens
tataattttgtgaagcaaa

SEQ ID NO: 4257832 - DNA, 17 bp, Homo sapiens
tatactatagtaccagt

SEQ ID NO: 4257833 - DNA, 12 bp, Homo sapiens
tatagtacatga

SEQ ID NO: 4257834 - DNA, 13 bp, Homo sapiens
tatagtacatgat

SEQ ID NO: 4257835 - DNA, 19 bp, Homo sapiens
tatatgtaccgtaggcttt

SEQ ID NO: 4257836 - DNA, 12 bp, Homo sapiens
tatattacaatg

SEQ ID NO: 4257837 - DNA, 20 bp, Homo sapiens
tatatttgaaatattgactt

SEQ ID NO: 4257838 - DNA, 23 bp, Homo sapiens
tatccaccaaaagggctccctga

SEQ ID NO: 4257839 - DNA, 13 bp, Homo sapiens
tatctatagctaa

SEQ ID NO: 4257840 - DNA, 12 bp, Homo sapiens
tatctcttcagt

SEQ ID NO: 4257841 - DNA, 14 bp, Homo sapiens
tatctttgccaccc

SEQ ID NO: 4257842 - DNA, 16 bp, Homo sapiens
tatctttgccaccctc

SEQ ID NO: 4257843 - DNA, 22 bp, Homo sapiens
tatctttgccaccctcatgctg

SEQ ID NO: 4257844 - DNA, 16 bp, Homo sapiens
tatgaacttgaggaca

SEQ ID NO: 4257845 - DNA, 21 bp, Homo sapiens
tatgaacttgaggacacatgt

SEQ ID NO: 4257846 - DNA, 16 bp, Homo sapiens
tatgactatgtaaact

SEQ ID NO: 4257847 - DNA, 18 bp, Homo sapiens
tatgactatgtaaactac

SEQ ID NO: 4257848 - DNA, 16 bp, Homo sapiens
tatgattaagtaatga

SEQ ID NO: 4257849 - DNA, 20 bp, Homo sapiens
tatgattaagtaatgataac

SEQ ID NO: 4257850 - DNA, 21 bp, Homo sapiens
tatgattaagtaatgataact

SEQ ID NO: 4257851 - DNA, 12 bp, Homo sapiens
tatgttaaaact

SEQ ID NO: 4257852 - DNA, 21 bp, Homo sapiens
tatgttttcaggctagatgta

SEQ ID NO: 4257853 - DNA, 14 bp, Homo sapiens
tattacaatgatca

SEQ ID NO: 4257854 - DNA, 13 bp, Homo sapiens
tattcaataaagc

SEQ ID NO: 4257855 - DNA, 13 bp, Homo sapiens
tattgcatttata

SEQ ID NO: 4257856 - DNA, 19 bp, Homo sapiens
tattgtatattacaatgat

SEQ ID NO: 4257857 - DNA, 14 bp, Homo sapiens
tattgttttacaat

SEQ ID NO: 4257858 - DNA, 17 bp, Homo sapiens
tattgttttacaatagt

SEQ ID NO: 4257859 - DNA, 22 bp, Homo sapiens
tatttagttgtaaaccaagtga

SEQ ID NO: 4257860 - DNA, 14 bp, Homo sapiens
tatttattttaata

SEQ ID NO: 4257861 - DNA, 15 bp, Homo sapiens
tatttctatgaaata

SEQ ID NO: 4257862 - DNA, 22 bp, Homo sapiens
tatttctatgaaatattatgtt

SEQ ID NO: 4257863 - DNA, 16 bp, Homo sapiens
tatttgaaccaataaa

SEQ ID NO: 4257864 - DNA, 14 bp, Homo sapiens
tattttaaaagaat

SEQ ID NO: 4257865 - DNA, 18 bp, Homo sapiens
tattttaaaagaatgatt

SEQ ID NO: 4257866 - DNA, 19 bp, Homo sapiens
tattttaataatgtttcaa

SEQ ID NO: 4257867 - DNA, 12 bp, Homo sapiens
tcaaaaattaaa

SEQ ID NO: 4257868 - DNA, 20 bp, Homo sapiens
tcaaaaattatctatagcta

SEQ ID NO: 4257869 - DNA, 17 bp, Homo sapiens
tcaaacatatataacaa

SEQ ID NO: 4257870 - DNA, 20 bp, Homo sapiens
tcaaaccaaatcactgaact

SEQ ID NO: 4257871 - DNA, 14 bp, Homo sapiens
tcaaggtctgcttt

SEQ ID NO: 4257872 - DNA, 15 bp, Homo sapiens
tcaaggtctgctttt

SEQ ID NO: 4257873 - DNA, 14 bp, Homo sapiens
tcaataaaatccat

SEQ ID NO: 4257874 - DNA, 19 bp, Homo sapiens
tcaatatttcagataatca

SEQ ID NO: 4257875 - DNA, 16 bp, Homo sapiens
tcaccagccctggcaa

SEQ ID NO: 4257876 - DNA, 14 bp, Homo sapiens
tcacctcatggaat

SEQ ID NO: 4257877 - DNA, 18 bp, Homo sapiens
tcactgcaacctccacct

SEQ ID NO: 4257878 - DNA, 17 bp, Homo sapiens
tcacttgtcaataaaat

SEQ ID NO: 4257879 - DNA, 19 bp, Homo sapiens
tcagaaacaccctcacact

SEQ ID NO: 4257880 - DNA, 15 bp, Homo sapiens
tcagcaaacaggatc

SEQ ID NO: 4257881 - DNA, 13 bp, Homo sapiens
tcaggaaagagaa

SEQ ID NO: 4257882 - DNA, 17 bp, Homo sapiens
tcaggctagatgtatgt

SEQ ID NO: 4257883 - DNA, 20 bp, Homo sapiens
tcagtctctataccaataaa

SEQ ID NO: 4257884 - DNA, 18 bp, Homo sapiens
tcatctcagctcactgca

SEQ ID NO: 4257885 - DNA, 17 bp, Homo sapiens
tcatctggattccagag

SEQ ID NO: 4257886 - DNA, 21 bp, Homo sapiens
tcatgaattagttttatatgc

SEQ ID NO: 4257887 - DNA, 15 bp, Homo sapiens
tcatgcatggaaatt

SEQ ID NO: 4257888 - DNA, 21 bp, Homo sapiens
tcatggaattggagctcgtgg

SEQ ID NO: 4257889 - DNA, 12 bp, Homo sapiens
tccaaaccactt

SEQ ID NO: 4257890 - DNA, 19 bp, Homo sapiens
tccacagaagctccaggta

SEQ ID NO: 4257891 - DNA, 13 bp, Homo sapiens
tccactctttctt

SEQ ID NO: 4257892 - DNA, 14 bp, Homo sapiens
tccagatcctggaa

SEQ ID NO: 4257893 - DNA, 14 bp, Homo sapiens
tccagcctcagctc

SEQ ID NO: 4257894 - DNA, 19 bp, Homo sapiens
tccagcctggggctgaggc

SEQ ID NO: 4257895 - DNA, 18 bp, Homo sapiens
tccagggtggcagcaaca

SEQ ID NO: 4257896 - DNA, 15 bp, Homo sapiens
tccatacatttgtgt

SEQ ID NO: 4257897 - DNA, 20 bp, Homo sapiens
tccatccttgagtcaaaaaa

SEQ ID NO: 4257898 - DNA, 13 bp, Homo sapiens
tccattctggaag

SEQ ID NO: 4257899 - DNA, 14 bp, Homo sapiens
tccattctggaagt

SEQ ID NO: 4257900 - DNA, 21 bp, Homo sapiens
tcccaaagaagttctggtatg

SEQ ID NO: 4257901 - DNA, 20 bp, Homo sapiens
tcccaagtaactgggattac

SEQ ID NO: 4257902 - DNA, 20 bp, Homo sapiens
tcccaagtagctgagactac

SEQ ID NO: 4257903 - DNA, 19 bp, Homo sapiens
tccctaccctaaccaagtt

SEQ ID NO: 4257904 - DNA, 19 bp, Homo sapiens
tccctatctttgccaccct

SEQ ID NO: 4257905 - DNA, 14 bp, Homo sapiens
tccctcacccatcc

SEQ ID NO: 4257906 - DNA, 16 bp, Homo sapiens
tccctctgcagtctct

SEQ ID NO: 4257907 - DNA, 22 bp, Homo sapiens
tccctcttccttccctgctgtg

SEQ ID NO: 4257908 - DNA, 23 bp, Homo sapiens
tccctggaaaccttccacccagt

SEQ ID NO: 4257909 - DNA, 17 bp, Homo sapiens
tcctgcctcagcctccc

SEQ ID NO: 4257910 - DNA, 16 bp, Homo sapiens
tcctggaaatcagggt

SEQ ID NO: 4257911 - DNA, 16 bp, Homo sapiens
tcgccggatctgaggg

SEQ ID NO: 4257912 - DNA, 16 bp, Homo sapiens
tcgtggacacctgccc

SEQ ID NO: 4257913 - DNA, 22 bp, Homo sapiens
tcgtgggacagtcacctcatgg

SEQ ID NO: 4257914 - DNA, 21 bp, Homo sapiens
tctaggcagttcaaagcagga

SEQ ID NO: 4257915 - DNA, 14 bp, Homo sapiens
tctatgaaatatta

SEQ ID NO: 4257916 - DNA, 20 bp, Homo sapiens
tctcaatattcaataaagct

SEQ ID NO: 4257917 - DNA, 14 bp, Homo sapiens
tctcagatttctga

SEQ ID NO: 4257918 - DNA, 14 bp, Homo sapiens
tctcagttgcagcc

SEQ ID NO: 4257919 - DNA, 15 bp, Homo sapiens
tctcatttccaagca

SEQ ID NO: 4257920 - DNA, 14 bp, Homo sapiens
tctccaaaccactt

SEQ ID NO: 4257921 - DNA, 18 bp, Homo sapiens
tctccagcctcagctctc

SEQ ID NO: 4257922 - DNA, 19 bp, Homo sapiens
tctcctgcctcagcctccc

SEQ ID NO: 4257923 - DNA, 13 bp, Homo sapiens
tctctaggaaata

SEQ ID NO: 4257924 - DNA, 16 bp, Homo sapiens
tctctataccaataaa

SEQ ID NO: 4257925 - DNA, 17 bp, Homo sapiens
tctctataccaataaag

SEQ ID NO: 4257926 - DNA, 15 bp, Homo sapiens
tctctcataccctcc

SEQ ID NO: 4257927 - DNA, 19 bp, Homo sapiens
tctcttctgaataaagcaa

SEQ ID NO: 4257928 - DNA, 20 bp, Homo sapiens
tctcttctgaataaagcaat

SEQ ID NO: 4257929 - DNA, 18 bp, Homo sapiens
tctctttaaaaggaaaga

SEQ ID NO: 4257930 - DNA, 12 bp, Homo sapiens
tctgaagaagat

SEQ ID NO: 4257931 - DNA, 14 bp, Homo sapiens
tctgcagtctctat

SEQ ID NO: 4257932 - DNA, 21 bp, Homo sapiens
tctgcagtctctataccaata

SEQ ID NO: 4257933 - DNA, 22 bp, Homo sapiens
tctggaagtgactttggctgca

SEQ ID NO: 4257934 - DNA, 22 bp, Homo sapiens
tctggattccagagcactgctc

SEQ ID NO: 4257935 - DNA, 14 bp, Homo sapiens
tctgtctgtcccaa

SEQ ID NO: 4257936 - DNA, 15 bp, Homo sapiens
tctgtctgtcccaaa

SEQ ID NO: 4257937 - DNA, 22 bp, Homo sapiens
tctgttttataattttgtgaag

SEQ ID NO: 4257938 - DNA, 22 bp, Homo sapiens
tcttactgcttaattcaaataa

SEQ ID NO: 4257939 - DNA, 21 bp, Homo sapiens
tcttccctggaaaccttccac

SEQ ID NO: 4257940 - DNA, 17 bp, Homo sapiens
tcttctgaataaagcaa

SEQ ID NO: 4257941 - DNA, 22 bp, Homo sapiens
tcttcttaatatgttcttttaa

SEQ ID NO: 4257942 - DNA, 20 bp, Homo sapiens
tctttaaaattacaactaag

SEQ ID NO: 4257943 - DNA, 16 bp, Homo sapiens
tctttctttcaataaa

SEQ ID NO: 4257944 - DNA, 14 bp, Homo sapiens
tctttgccaccctc

SEQ ID NO: 4257945 - DNA, 18 bp, Homo sapiens
tctttgccaccctcatgc

SEQ ID NO: 4257946 - DNA, 21 bp, Homo sapiens
tctttgccaccctcatgctgt

SEQ ID NO: 4257947 - DNA, 17 bp, Homo sapiens
tcttttttcaaaagaaa

SEQ ID NO: 4257948 - DNA, 23 bp, Homo sapiens
tgaaaatattgttttacaatagt

SEQ ID NO: 4257949 - DNA, 16 bp, Homo sapiens
tgaaaggtacttcaaa

SEQ ID NO: 4257950 - DNA, 18 bp, Homo sapiens
tgaaatcccatcaggtca

SEQ ID NO: 4257951 - DNA, 16 bp, Homo sapiens
tgaacttgaggacaca

SEQ ID NO: 4257952 - DNA, 18 bp, Homo sapiens
tgaacttgaggacacatg

SEQ ID NO: 4257953 - DNA, 21 bp, Homo sapiens
tgaacttgaggacacatgtcc

SEQ ID NO: 4257954 - DNA, 14 bp, Homo sapiens
tgaagaagatggta

SEQ ID NO: 4257955 - DNA, 15 bp, Homo sapiens
tgaataaatgtatct

SEQ ID NO: 4257956 - DNA, 15 bp, Homo sapiens
tgaattatatgttca

SEQ ID NO: 4257957 - DNA, 17 bp, Homo sapiens
tgacatgggacatttgc

SEQ ID NO: 4257958 - DNA, 18 bp, Homo sapiens
tgacatgggacatttgct

SEQ ID NO: 4257959 - DNA, 18 bp, Homo sapiens
tgacctcgtgatccaccc

SEQ ID NO: 4257960 - DNA, 23 bp, Homo sapiens
tgacctgcctcccttcatgcatg

SEQ ID NO: 4257961 - DNA, 12 bp, Homo sapiens
tgactatgtaaa

SEQ ID NO: 4257962 - DNA, 16 bp, Homo sapiens
tgactcttaagaagac

SEQ ID NO: 4257963 - DNA, 14 bp, Homo sapiens
tgacttatagtaca

SEQ ID NO: 4257964 - DNA, 16 bp, Homo sapiens
tgactttggctgcatg

SEQ ID NO: 4257965 - DNA, 12 bp, Homo sapiens
tgagacatccag

SEQ ID NO: 4257966 - DNA, 19 bp, Homo sapiens
tgagaccacctctcaatat

SEQ ID NO: 4257967 - DNA, 21 bp, Homo sapiens
tgagagacacactgaagaagc

SEQ ID NO: 4257968 - DNA, 15 bp, Homo sapiens
tgaggacactgatat

SEQ ID NO: 4257969 - DNA, 17 bp, Homo sapiens
tgagggagaacaagacc

SEQ ID NO: 4257970 - DNA, 15 bp, Homo sapiens
tgaggtaagtttttt

SEQ ID NO: 4257971 - DNA, 14 bp, Homo sapiens
tgagtagagttgat

SEQ ID NO: 4257972 - DNA, 15 bp, Homo sapiens
tgagtcaaaaaatct

SEQ ID NO: 4257973 - DNA, 18 bp, Homo sapiens
tgatagacaattgaggta

SEQ ID NO: 4257974 - DNA, 17 bp, Homo sapiens
tgatggagaaggaaggc

SEQ ID NO: 4257975 - DNA, 19 bp, Homo sapiens
tgattatgaattacatttg

SEQ ID NO: 4257976 - DNA, 21 bp, Homo sapiens
tgattatgaattacatttgta

SEQ ID NO: 4257977 - DNA, 22 bp, Homo sapiens
tgattatgaattacatttgtat

SEQ ID NO: 4257978 - DNA, 13 bp, Homo sapiens
tgcaacctccacc

SEQ ID NO: 4257979 - DNA, 21 bp, Homo sapiens
tgcaagccagattttcctgaa

SEQ ID NO: 4257980 - DNA, 23 bp, Homo sapiens
tgcaaggcctggtgtttcttgat

SEQ ID NO: 4257981 - DNA, 22 bp, Homo sapiens
tgcacacctactagtcaccaga

SEQ ID NO: 4257982 - DNA, 14 bp, Homo sapiens
tgcacagtaaaaat

SEQ ID NO: 4257983 - DNA, 23 bp, Homo sapiens
tgcagtctctataccaataaagt

SEQ ID NO: 4257984 - DNA, 16 bp, Homo sapiens
tgcagttctgaagaag

SEQ ID NO: 4257985 - DNA, 17 bp, Homo sapiens
tgcagttctgaagaaga

SEQ ID NO: 4257986 - DNA, 22 bp, Homo sapiens
tgcagttctgaagaagatggta

SEQ ID NO: 4257987 - DNA, 19 bp, Homo sapiens
tgcatggaaattcccttca

SEQ ID NO: 4257988 - DNA, 14 bp, Homo sapiens
tgcatttatatgta

SEQ ID NO: 4257989 - DNA, 16 bp, Homo sapiens
tgcatttatatgtacc

SEQ ID NO: 4257990 - DNA, 23 bp, Homo sapiens
tgccacaccccccacccctagga

SEQ ID NO: 4257991 - DNA, 16 bp, Homo sapiens
tgccaccctcatgctg

SEQ ID NO: 4257992 - DNA, 14 bp, Homo sapiens
tgccacctgtctgt

SEQ ID NO: 4257993 - DNA, 19 bp, Homo sapiens
tgccaggctggagtgcagt

SEQ ID NO: 4257994 - DNA, 16 bp, Homo sapiens
tgccccattcaacatc

SEQ ID NO: 4257995 - DNA, 14 bp, Homo sapiens
tgccctgccctgcc

SEQ ID NO: 4257996 - DNA, 15 bp, Homo sapiens
tgccctgccctgcca

SEQ ID NO: 4257997 - DNA, 16 bp, Homo sapiens
tgcctcccttcatgca

SEQ ID NO: 4257998 - DNA, 15 bp, Homo sapiens
tgccttctcaactcc

SEQ ID NO: 4257999 - DNA, 21 bp, Homo sapiens
tgcggaggaaggaggacccag

SEQ ID NO: 4258000 - DNA, 23 bp, Homo sapiens
tgcggaggaaggaggacccagga

SEQ ID NO: 4258001 - DNA, 12 bp, Homo sapiens
tgctacaatgtc

SEQ ID NO: 4258002 - DNA, 14 bp, Homo sapiens
tgctcatttcagga

SEQ ID NO: 4258003 - DNA, 13 bp, Homo sapiens
tgctgctgcctgc

SEQ ID NO: 4258004 - DNA, 22 bp, Homo sapiens
tgctgtattttaaaagaatgat

SEQ ID NO: 4258005 - DNA, 23 bp, Homo sapiens
tgctgtattttaaaagaatgatt

SEQ ID NO: 4258006 - DNA, 18 bp, Homo sapiens
tgcttaattcaaataata

SEQ ID NO: 4258007 - DNA, 21 bp, Homo sapiens
tgcttctcagatttctgagga

SEQ ID NO: 4258008 - DNA, 14 bp, Homo sapiens
tgcttttcatcctt

SEQ ID NO: 4258009 - DNA, 22 bp, Homo sapiens
tggaaaagtatgttagtgcaaa

SEQ ID NO: 4258010 - DNA, 23 bp, Homo sapiens
tggaaacttcagcggtttatata

SEQ ID NO: 4258011 - DNA, 18 bp, Homo sapiens
tggaacataaaaaggaca

SEQ ID NO: 4258012 - DNA, 20 bp, Homo sapiens
tggaacataaaaaggacatc

SEQ ID NO: 4258013 - DNA, 23 bp, Homo sapiens
tggaagtgactttggctgcatgc

SEQ ID NO: 4258014 - DNA, 18 bp, Homo sapiens
tggaattggagctcgtgg

SEQ ID NO: 4258015 - DNA, 11 bp, Homo sapiens
tggacacctgc

SEQ ID NO: 4258016 - DNA, 17 bp, Homo sapiens
tggacacctgccctgcc

SEQ ID NO: 4258017 - DNA, 18 bp, Homo sapiens
tggacacctgccctgccc

SEQ ID NO: 4258018 - DNA, 17 bp, Homo sapiens
tggacactacacccagc

SEQ ID NO: 4258019 - DNA, 13 bp, Homo sapiens
tggagaagaactg

SEQ ID NO: 4258020 - DNA, 16 bp, Homo sapiens
tggagaagaactgaaa

SEQ ID NO: 4258021 - DNA, 16 bp, Homo sapiens
tggagatgaggccaga

SEQ ID NO: 4258022 - DNA, 17 bp, Homo sapiens
tggagatgaggccagac

SEQ ID NO: 4258023 - DNA, 14 bp, Homo sapiens
tggagctcgtggaa

SEQ ID NO: 4258024 - DNA, 17 bp, Homo sapiens
tggagctcgtggaacag

SEQ ID NO: 4258025 - DNA, 14 bp, Homo sapiens
tggaggggcagagc

SEQ ID NO: 4258026 - DNA, 16 bp, Homo sapiens
tggaggggcagagcca

SEQ ID NO: 4258027 - DNA, 23 bp, Homo sapiens
tggaggggcagagccaggaagat

SEQ ID NO: 4258028 - DNA, 15 bp, Homo sapiens
tggcactagtatttc

SEQ ID NO: 4258029 - DNA, 13 bp, Homo sapiens
tggcagcaacaat

SEQ ID NO: 4258030 - DNA, 18 bp, Homo sapiens
tggcgcgatctcagctca

SEQ ID NO: 4258031 - DNA, 20 bp, Homo sapiens
tgggacatttgctcatggaa

SEQ ID NO: 4258032 - DNA, 17 bp, Homo sapiens
tgggtagacacacatga

SEQ ID NO: 4258033 - DNA, 23 bp, Homo sapiens
tgggtaggaaagaggaagcaaat

SEQ ID NO: 4258034 - DNA, 19 bp, Homo sapiens
tggtcacgtttggtgcttc

SEQ ID NO: 4258035 - DNA, 23 bp, Homo sapiens
tggtgcttctcagatttctgagg

SEQ ID NO: 4258036 - DNA, 16 bp, Homo sapiens
tggttcccttgatgaa

SEQ ID NO: 4258037 - DNA, 23 bp, Homo sapiens
tgtagtagcgttttttaaatgta

SEQ ID NO: 4258038 - DNA, 14 bp, Homo sapiens
tgtagtgttggaga

SEQ ID NO: 4258039 - DNA, 16 bp, Homo sapiens
tgtagtgttggagaag

SEQ ID NO: 4258040 - DNA, 17 bp, Homo sapiens
tgtagtgttggagaaga

SEQ ID NO: 4258041 - DNA, 18 bp, Homo sapiens
tgtagtgttggagaagaa

SEQ ID NO: 4258042 - DNA, 21 bp, Homo sapiens
tgtagtgttggagaagaactg

SEQ ID NO: 4258043 - DNA, 19 bp, Homo sapiens
tgtatattacaatgatcac

SEQ ID NO: 4258044 - DNA, 16 bp, Homo sapiens
tgtatgattcccagcc

SEQ ID NO: 4258045 - DNA, 21 bp, Homo sapiens
tgtattgtatattacaatgat

SEQ ID NO: 4258046 - DNA, 18 bp, Homo sapiens
tgtattttaaaagaatga

SEQ ID NO: 4258047 - DNA, 19 bp, Homo sapiens
tgtattttaaaagaatgat

SEQ ID NO: 4258048 - DNA, 20 bp, Homo sapiens
tgtcaatcagcctagttgat

SEQ ID NO: 4258049 - DNA, 22 bp, Homo sapiens
tgtcacccaggttggagtgcag

SEQ ID NO: 4258050 - DNA, 15 bp, Homo sapiens
tgtctgtctgtctgt

SEQ ID NO: 4258051 - DNA, 16 bp, Homo sapiens
tgtctgtctgtctgtc

SEQ ID NO: 4258052 - DNA, 17 bp, Homo sapiens
tgtgacattttacatta

SEQ ID NO: 4258053 - DNA, 21 bp, Homo sapiens
tgtgtgaaaggtacttcaaat

SEQ ID NO: 4258054 - DNA, 22 bp, Homo sapiens
tgtgtgaaaggtacttcaaatc

SEQ ID NO: 4258055 - DNA, 13 bp, Homo sapiens
tgtgttttgcaag

SEQ ID NO: 4258056 - DNA, 15 bp, Homo sapiens
tgttataatctttca

SEQ ID NO: 4258057 - DNA, 16 bp, Homo sapiens
tgttcacaatatattt

SEQ ID NO: 4258058 - DNA, 16 bp, Homo sapiens
tgttggagaagaactg

SEQ ID NO: 4258059 - DNA, 17 bp, Homo sapiens
tgttggagaagaactga

SEQ ID NO: 4258060 - DNA, 21 bp, Homo sapiens
tgttggagaagaactgaaatc

SEQ ID NO: 4258061 - DNA, 19 bp, Homo sapiens
tgtttcaaacatatataac

SEQ ID NO: 4258062 - DNA, 17 bp, Homo sapiens
tgttttacaatagttct

SEQ ID NO: 4258063 - DNA, 21 bp, Homo sapiens
tgttttacaatagttctgtgg

SEQ ID NO: 4258064 - DNA, 20 bp, Homo sapiens
tgttttataattttgtgaag

SEQ ID NO: 4258065 - DNA, 16 bp, Homo sapiens
tgtttttttgttatta

SEQ ID NO: 4258066 - DNA, 13 bp, Homo sapiens
ttaaaagaatgat

SEQ ID NO: 4258067 - DNA, 18 bp, Homo sapiens
ttaaattttttttacatt

SEQ ID NO: 4258068 - DNA, 19 bp, Homo sapiens
ttaaattttttttacattt

SEQ ID NO: 4258069 - DNA, 20 bp, Homo sapiens
ttaaattttttttacatttt

SEQ ID NO: 4258070 - DNA, 22 bp, Homo sapiens
ttaagaagactgcattatattt

SEQ ID NO: 4258071 - DNA, 24 bp, Homo sapiens
ttaaggggaggaaccagagtgctg

SEQ ID NO: 4258072 - DNA, 18 bp, Homo sapiens
ttaagtaatgataactgg

SEQ ID NO: 4258073 - DNA, 19 bp, Homo sapiens
ttacaacggagtcaaaaat

SEQ ID NO: 4258074 - DNA, 21 bp, Homo sapiens
ttacattttttgggcagcaat

SEQ ID NO: 4258075 - DNA, 21 bp, Homo sapiens
ttaccacttgtgttttgcaag

SEQ ID NO: 4258076 - DNA, 15 bp, Homo sapiens
ttagggaaaacattc

SEQ ID NO: 4258077 - DNA, 17 bp, Homo sapiens
ttagggaaaacattcca

SEQ ID NO: 4258078 - DNA, 14 bp, Homo sapiens
ttagggttatgatt

SEQ ID NO: 4258079 - DNA, 16 bp, Homo sapiens
ttagggttatgattaa

SEQ ID NO: 4258080 - DNA, 17 bp, Homo sapiens
ttaggtaatttttttca

SEQ ID NO: 4258081 - DNA, 21 bp, Homo sapiens
ttataataaaggactgtaatc

SEQ ID NO: 4258082 - DNA, 18 bp, Homo sapiens
ttataattttgtgaagca

SEQ ID NO: 4258083 - DNA, 16 bp, Homo sapiens
ttatagtacatgataa

SEQ ID NO: 4258084 - DNA, 17 bp, Homo sapiens
ttatagtacatgataaa

SEQ ID NO: 4258085 - DNA, 12 bp, Homo sapiens
ttatatttgaaa

SEQ ID NO: 4258086 - DNA, 16 bp, Homo sapiens
ttatgactatgtaaac

SEQ ID NO: 4258087 - DNA, 14 bp, Homo sapiens
ttatgtgacatttt

SEQ ID NO: 4258088 - DNA, 16 bp, Homo sapiens
ttattaaacaaataat

SEQ ID NO: 4258089 - DNA, 15 bp, Homo sapiens
ttattttaataatgt

SEQ ID NO: 4258090 - DNA, 15 bp, Homo sapiens
ttcaaacatatataa

SEQ ID NO: 4258091 - DNA, 21 bp, Homo sapiens
ttcaagcgattctcctgcctc

SEQ ID NO: 4258092 - DNA, 18 bp, Homo sapiens
ttcaagtgcttctccagc

SEQ ID NO: 4258093 - DNA, 12 bp, Homo sapiens
ttcaataaagct

SEQ ID NO: 4258094 - DNA, 16 bp, Homo sapiens
ttcattccattctgga

SEQ ID NO: 4258095 - DNA, 20 bp, Homo sapiens
ttccctggaaaccttccacc

SEQ ID NO: 4258096 - DNA, 16 bp, Homo sapiens
ttcccttcatctggaa

SEQ ID NO: 4258097 - DNA, 18 bp, Homo sapiens
ttccttacagaactactt

SEQ ID NO: 4258098 - DNA, 15 bp, Homo sapiens
ttccttccctgctgt

SEQ ID NO: 4258099 - DNA, 14 bp, Homo sapiens
ttctatgaaatatt

SEQ ID NO: 4258100 - DNA, 14 bp, Homo sapiens
ttctcaactccaaa

SEQ ID NO: 4258101 - DNA, 18 bp, Homo sapiens
ttctcaactccaaactga

SEQ ID NO: 4258102 - DNA, 23 bp, Homo sapiens
ttctctcctctccccatgatgtt

SEQ ID NO: 4258103 - DNA, 15 bp, Homo sapiens
ttctgaataaagcaa

SEQ ID NO: 4258104 - DNA, 17 bp, Homo sapiens
ttctgaataaagcaatt

SEQ ID NO: 4258105 - DNA, 17 bp, Homo sapiens
ttgaaaagcagacattt

SEQ ID NO: 4258106 - DNA, 22 bp, Homo sapiens
ttgaataaatgtatctgaatat

SEQ ID NO: 4258107 - DNA, 13 bp, Homo sapiens
ttgaggacacatg

SEQ ID NO: 4258108 - DNA, 14 bp, Homo sapiens
ttgaggacacatgt

SEQ ID NO: 4258109 - DNA, 16 bp, Homo sapiens
ttgaggacacatgtcc

SEQ ID NO: 4258110 - DNA, 16 bp, Homo sapiens
ttgagtcaaaaaatct

SEQ ID NO: 4258111 - DNA, 14 bp, Homo sapiens
ttgatgaagaagtt

SEQ ID NO: 4258112 - DNA, 19 bp, Homo sapiens
ttgatggtggtatgttttc

SEQ ID NO: 4258113 - DNA, 22 bp, Homo sapiens
ttgcaagccagattttcctgaa

SEQ ID NO: 4258114 - DNA, 13 bp, Homo sapiens
ttgccaccctcat

SEQ ID NO: 4258115 - DNA, 16 bp, Homo sapiens
ttgctaagcattccaa

SEQ ID NO: 4258116 - DNA, 15 bp, Homo sapiens
ttggagaagaactga

SEQ ID NO: 4258117 - DNA, 15 bp, Homo sapiens
ttggagtgcagtggc

SEQ ID NO: 4258118 - DNA, 16 bp, Homo sapiens
ttgtatattacaatga

SEQ ID NO: 4258119 - DNA, 19 bp, Homo sapiens
ttgtattgtatattacaat

SEQ ID NO: 4258120 - DNA, 18 bp, Homo sapiens
ttgtgttttgcaagccag

SEQ ID NO: 4258121 - DNA, 15 bp, Homo sapiens
ttgttattaaacaaa

SEQ ID NO: 4258122 - DNA, 13 bp, Homo sapiens
ttgttttacaata

SEQ ID NO: 4258123 - DNA, 14 bp, Homo sapiens
tttaaaagaatgat

SEQ ID NO: 4258124 - DNA, 17 bp, Homo sapiens
tttaaaagaatgattat

SEQ ID NO: 4258125 - DNA, 13 bp, Homo sapiens
tttaataatgttt

SEQ ID NO: 4258126 - DNA, 15 bp, Homo sapiens
tttaataatgtttca

SEQ ID NO: 4258127 - DNA, 13 bp, Homo sapiens
tttaccacttgtg

SEQ ID NO: 4258128 - DNA, 12 bp, Homo sapiens
tttagaaacaca

SEQ ID NO: 4258129 - DNA, 22 bp, Homo sapiens
tttataattttgtgaagcaaaa

SEQ ID NO: 4258130 - DNA, 17 bp, Homo sapiens
tttatatgcttctgttt

SEQ ID NO: 4258131 - DNA, 19 bp, Homo sapiens
tttatatgcttctgtttta

SEQ ID NO: 4258132 - DNA, 17 bp, Homo sapiens
tttcaaacatatataac

SEQ ID NO: 4258133 - DNA, 21 bp, Homo sapiens
tttcagataatcacaatacat

SEQ ID NO: 4258134 - DNA, 13 bp, Homo sapiens
tttctatgaaata

SEQ ID NO: 4258135 - DNA, 14 bp, Homo sapiens
tttgaaatattgac

SEQ ID NO: 4258136 - DNA, 15 bp, Homo sapiens
tttgaaattatgtga

SEQ ID NO: 4258137 - DNA, 13 bp, Homo sapiens
tttgaaccaataa

SEQ ID NO: 4258138 - DNA, 20 bp, Homo sapiens
tttgagacagagtcttcctc

SEQ ID NO: 4258139 - DNA, 18 bp, Homo sapiens
tttgccaccctcatgctg

SEQ ID NO: 4258140 - DNA, 12 bp, Homo sapiens
tttgctcatgga

SEQ ID NO: 4258141 - DNA, 18 bp, Homo sapiens
tttggaaccctaaataat

SEQ ID NO: 4258142 - DNA, 17 bp, Homo sapiens
tttgtagtagcgttttt

SEQ ID NO: 4258143 - DNA, 17 bp, Homo sapiens
tttgtataaaataattt

SEQ ID NO: 4258144 - DNA, 14 bp, Homo sapiens
tttgtattgtatat

SEQ ID NO: 4258145 - DNA, 20 bp, Homo sapiens
ttttaataatgtttcaaaca

SEQ ID NO: 4258146 - DNA, 15 bp, Homo sapiens
ttttgttattaaaca

SEQ ID NO: 4258147 - DNA, 18 bp, Homo sapiens
tttttaaaaaagaaacat

SEQ ID NO: 4258148 - DNA, 11 bp, Homo sapiens
tttttacattt

SEQ ID NO: 4258149 - DNA, 10 bp, Homo sapiens
ttttttgaga

SEQ ID NO: 4258150 - DNA, 14 bp, Homo sapiens
tttttttgttatta

SEQ ID NO: 4258151 - DNA, 13 bp, Homo sapiens
aaaaaaaagcttc

SEQ ID NO: 4258152 - DNA, 12 bp, Homo sapiens
aaaaaaagatga

SEQ ID NO: 4258153 - DNA, 11 bp, Homo sapiens
aaaaaagatga

SEQ ID NO: 4258154 - DNA, 22 bp, Homo sapiens
aaaagaaaatctttataaatgt

SEQ ID NO: 4258155 - DNA, 14 bp, Homo sapiens
aaaatgaaagctac

SEQ ID NO: 4258156 - DNA, 12 bp, Homo sapiens
aaacaaagatgt

SEQ ID NO: 4258157 - DNA, 15 bp, Homo sapiens
aaacaacagctgaag

SEQ ID NO: 4258158 - DNA, 19 bp, Homo sapiens
aaactgttggaatggattt

SEQ ID NO: 4258159 - DNA, 22 bp, Homo sapiens
aaagaagagcgagagatcaaag

SEQ ID NO: 4258160 - DNA, 20 bp, Homo sapiens
aaaggtttaagaaatagaat

SEQ ID NO: 4258161 - DNA, 14 bp, Homo sapiens
aaattaaatgaatt

SEQ ID NO: 4258162 - DNA, 15 bp, Homo sapiens
aaattacctgtggat

SEQ ID NO: 4258163 - DNA, 18 bp, Homo sapiens
aaatttctgtaaaacagg

SEQ ID NO: 4258164 - DNA, 19 bp, Homo sapiens
aacaggttataacagtgtt

SEQ ID NO: 4258165 - DNA, 17 bp, Homo sapiens
aaccttgaaaaaaaaca

SEQ ID NO: 4258166 - DNA, 20 bp, Homo sapiens
aacgctctaggtacgatgac

SEQ ID NO: 4258167 - DNA, 21 bp, Homo sapiens
aactgatccagtataagacta

SEQ ID NO: 4258168 - DNA, 17 bp, Homo sapiens
aactgccgtaatttaac

SEQ ID NO: 4258169 - DNA, 19 bp, Homo sapiens
aacttgtgtccctaatgtg

SEQ ID NO: 4258170 - DNA, 18 bp, Homo sapiens
aagagcgagagatcaaag

SEQ ID NO: 4258171 - DNA, 21 bp, Homo sapiens
aagagcgagagatcaaagatg

SEQ ID NO: 4258172 - DNA, 23 bp, Homo sapiens
aagagcgagagatcaaagatgaa

SEQ ID NO: 4258173 - DNA, 20 bp, Homo sapiens
aagatactaaggacgttgtt

SEQ ID NO: 4258174 - DNA, 16 bp, Homo sapiens
aagatgttatggtgtt

SEQ ID NO: 4258175 - DNA, 19 bp, Homo sapiens
aagccgactctggccctgg

SEQ ID NO: 4258176 - DNA, 12 bp, Homo sapiens
aatacctgctca

SEQ ID NO: 4258177 - DNA, 18 bp, Homo sapiens
aatagatatgaaagctga

SEQ ID NO: 4258178 - DNA, 19 bp, Homo sapiens
aatagatatgaaagctgat

SEQ ID NO: 4258179 - DNA, 17 bp, Homo sapiens
aatggatttttctttaa

SEQ ID NO: 4258180 - DNA, 18 bp, Homo sapiens
aatggatttttctttaac

SEQ ID NO: 4258181 - DNA, 15 bp, Homo sapiens
aattgtgtggattct

SEQ ID NO: 4258182 - DNA, 20 bp, Homo sapiens
aattgtgttttaattgtaaa

SEQ ID NO: 4258183 - DNA, 20 bp, Homo sapiens
acaaagaaacaaagatgtta

SEQ ID NO: 4258184 - DNA, 20 bp, Homo sapiens
acagagactgaatagatatg

SEQ ID NO: 4258185 - DNA, 14 bp, Homo sapiens
acagagtggccgtc

SEQ ID NO: 4258186 - DNA, 22 bp, Homo sapiens
acagcaaacaggtgctaatttg

SEQ ID NO: 4258187 - DNA, 15 bp, Homo sapiens
acagcccagagcctg

SEQ ID NO: 4258188 - DNA, 18 bp, Homo sapiens
acagcccagagcctggct

SEQ ID NO: 4258189 - DNA, 18 bp, Homo sapiens
acaggtgctaatttgttt

SEQ ID NO: 4258190 - DNA, 15 bp, Homo sapiens
acagtggatcacaaa

SEQ ID NO: 4258191 - DNA, 17 bp, Homo sapiens
acagtggatcacaaagt

SEQ ID NO: 4258192 - DNA, 13 bp, Homo sapiens
acagttttaactg

SEQ ID NO: 4258193 - DNA, 21 bp, Homo sapiens
acagttttaactgtggatatt

SEQ ID NO: 4258194 - DNA, 14 bp, Homo sapiens
acatcacaagacta

SEQ ID NO: 4258195 - DNA, 15 bp, Homo sapiens
accagagagagttgt

SEQ ID NO: 4258196 - DNA, 23 bp, Homo sapiens
accattttgttattgactaacag

SEQ ID NO: 4258197 - DNA, 17 bp, Homo sapiens
acctacagttttaactg

SEQ ID NO: 4258198 - DNA, 15 bp, Homo sapiens
acctcgggcctgctg

SEQ ID NO: 4258199 - DNA, 17 bp, Homo sapiens
acctgcactaacagagt

SEQ ID NO: 4258200 - DNA, 20 bp, Homo sapiens
acctgctcacgtcaaatgca

SEQ ID NO: 4258201 - DNA, 13 bp, Homo sapiens
acctgtggatatt

SEQ ID NO: 4258202 - DNA, 18 bp, Homo sapiens
accttgaaaaaaaacagt

SEQ ID NO: 4258203 - DNA, 23 bp, Homo sapiens
accttgaaaaaaaacagtggatc

SEQ ID NO: 4258204 - DNA, 18 bp, Homo sapiens
acgcctcactgaaacatg

SEQ ID NO: 4258205 - DNA, 20 bp, Homo sapiens
acgcttgtagaactcactct

SEQ ID NO: 4258206 - DNA, 21 bp, Homo sapiens
acgcttgtagaactcactctg

SEQ ID NO: 4258207 - DNA, 22 bp, Homo sapiens
acgcttgtagaactcactctgg

SEQ ID NO: 4258208 - DNA, 15 bp, Homo sapiens
actaaaaaaaagatg

SEQ ID NO: 4258209 - DNA, 18 bp, Homo sapiens
actaacaggccaaagagt

SEQ ID NO: 4258210 - DNA, 16 bp, Homo sapiens
actcactctgggctgt

SEQ ID NO: 4258211 - DNA, 13 bp, Homo sapiens
actcagaaattca

SEQ ID NO: 4258212 - DNA, 16 bp, Homo sapiens
actcccaaccctggct

SEQ ID NO: 4258213 - DNA, 12 bp, Homo sapiens
actctggccctg

SEQ ID NO: 4258214 - DNA, 16 bp, Homo sapiens
actctggccctggccc

SEQ ID NO: 4258215 - DNA, 17 bp, Homo sapiens
actctggccctggccct

SEQ ID NO: 4258216 - DNA, 14 bp, Homo sapiens
actgcagcacctcc

SEQ ID NO: 4258217 - DNA, 12 bp, Homo sapiens
acttgaaagaaa

SEQ ID NO: 4258218 - DNA, 15 bp, Homo sapiens
acttgcttctctagc

SEQ ID NO: 4258219 - DNA, 16 bp, Homo sapiens
acttgcttctctagct

SEQ ID NO: 4258220 - DNA, 22 bp, Homo sapiens
acttgtgtccctaatgtgttta

SEQ ID NO: 4258221 - DNA, 17 bp, Homo sapiens
agaaacaaagatgttat

SEQ ID NO: 4258222 - DNA, 20 bp, Homo sapiens
agaactcactctgggctgta

SEQ ID NO: 4258223 - DNA, 24 bp, Homo sapiens
agaagagcgagagatcaaagatga

SEQ ID NO: 4258224 - DNA, 21 bp, Homo sapiens
agaagcctgcataatgtttct

SEQ ID NO: 4258225 - DNA, 18 bp, Homo sapiens
agaggactcccaaccctg

SEQ ID NO: 4258226 - DNA, 21 bp, Homo sapiens
agaggactcccaaccctggct

SEQ ID NO: 4258227 - DNA, 12 bp, Homo sapiens
agatcaaagatg

SEQ ID NO: 4258228 - DNA, 16 bp, Homo sapiens
agatgtttatttcagg

SEQ ID NO: 4258229 - DNA, 17 bp, Homo sapiens
agcaacgcttgtagaac

SEQ ID NO: 4258230 - DNA, 15 bp, Homo sapiens
agcacctccaggcct

SEQ ID NO: 4258231 - DNA, 16 bp, Homo sapiens
agcacctccaggcctg

SEQ ID NO: 4258232 - DNA, 22 bp, Homo sapiens
agcattgtaaaattatttcatg

SEQ ID NO: 4258233 - DNA, 23 bp, Homo sapiens
agcccatccattaggccagcaac

SEQ ID NO: 4258234 - DNA, 22 bp, Homo sapiens
agcccctcctccagcccctgtc

SEQ ID NO: 4258235 - DNA, 12 bp, Homo sapiens
agcccctgtccc

SEQ ID NO: 4258236 - DNA, 13 bp, Homo sapiens
agccgactctggc

SEQ ID NO: 4258237 - DNA, 17 bp, Homo sapiens
agccgactctggccctg

SEQ ID NO: 4258238 - DNA, 19 bp, Homo sapiens
agccgactctggccctggc

SEQ ID NO: 4258239 - DNA, 17 bp, Homo sapiens
agcctggctgcccatca

SEQ ID NO: 4258240 - DNA, 20 bp, Homo sapiens
agctgatactttgacagtgt

SEQ ID NO: 4258241 - DNA, 21 bp, Homo sapiens
agctgtgtgaatacctgctca

SEQ ID NO: 4258242 - DNA, 20 bp, Homo sapiens
aggactcccaaccctggctt

SEQ ID NO: 4258243 - DNA, 16 bp, Homo sapiens
aggatccggaaagaag

SEQ ID NO: 4258244 - DNA, 13 bp, Homo sapiens
aggccagcaacgc

SEQ ID NO: 4258245 - DNA, 23 bp, Homo sapiens
aggcctctccagtttgcacctgt

SEQ ID NO: 4258246 - DNA, 24 bp, Homo sapiens
aggcctctccagtttgcacctgtc

SEQ ID NO: 4258247 - DNA, 19 bp, Homo sapiens
cctgctcacgtcaaatgca

SEQ ID NO: 4258248 - DNA, 17 bp, Homo sapiens
cctgctctagtgggaca

SEQ ID NO: 4258249 - DNA, 23 bp, Homo sapiens
cctggctgcccatcatgtggccc

SEQ ID NO: 4258250 - DNA, 14 bp, Homo sapiens
cctgtccccaccct

SEQ ID NO: 4258251 - DNA, 16 bp, Homo sapiens
ccttagggcactgggc

SEQ ID NO: 4258252 - DNA, 17 bp, Homo sapiens
ccttccattttccccca

SEQ ID NO: 4258253 - DNA, 16 bp, Homo sapiens
cgactctggccctggc

SEQ ID NO: 4258254 - DNA, 18 bp, Homo sapiens
cgactctggccctggccc

SEQ ID NO: 4258255 - DNA, 16 bp, Homo sapiens
cgagagatcaaagatg

SEQ ID NO: 4258256 - DNA, 12 bp, Homo sapiens
cgcttgtagaac

SEQ ID NO: 4258257 - DNA, 23 bp, Homo sapiens
cgcttgtagaactcactctgggc

SEQ ID NO: 4258258 - DNA, 12 bp, Homo sapiens
cggaaagaagag

SEQ ID NO: 4258259 - DNA, 18 bp, Homo sapiens
cggaaagaagagcgagag

SEQ ID NO: 4258260 - DNA, 12 bp, Homo sapiens
cgtaatttaact

SEQ ID NO: 4258261 - DNA, 18 bp, Homo sapiens
cgtcttttcctgtttcct

SEQ ID NO: 4258262 - DNA, 21 bp, Homo sapiens
ctaaatgtgcaatagaaggtg

SEQ ID NO: 4258263 - DNA, 23 bp, Homo sapiens
ctaaattatttactgcaaaaaga

SEQ ID NO: 4258264 - DNA, 19 bp, Homo sapiens
ctaatttgttttggatata

SEQ ID NO: 4258265 - DNA, 15 bp, Homo sapiens
ctacactcacctgca

SEQ ID NO: 4258266 - DNA, 19 bp, Homo sapiens
ctacagttttaactgtgga

SEQ ID NO: 4258267 - DNA, 16 bp, Homo sapiens
ctaccgtcttttcctg

SEQ ID NO: 4258268 - DNA, 13 bp, Homo sapiens
ctactgcagcacc

SEQ ID NO: 4258269 - DNA, 18 bp, Homo sapiens
ctactgcagcacctccag

SEQ ID NO: 4258270 - DNA, 22 bp, Homo sapiens
ctactgcagcacctccaggcct

SEQ ID NO: 4258271 - DNA, 16 bp, Homo sapiens
ctagctctctaggcct

SEQ ID NO: 4258272 - DNA, 23 bp, Homo sapiens
ctagctgtgtgaatacctgctca

SEQ ID NO: 4258273 - DNA, 16 bp, Homo sapiens
ctaggcctctccagtt

SEQ ID NO: 4258274 - DNA, 17 bp, Homo sapiens
ctatctgtattcccaaa

SEQ ID NO: 4258275 - DNA, 12 bp, Homo sapiens
ctcactctgggc

SEQ ID NO: 4258276 - DNA, 14 bp, Homo sapiens
ctcactctgggctg

SEQ ID NO: 4258277 - DNA, 15 bp, Homo sapiens
ctcactctgggctgt

SEQ ID NO: 4258278 - DNA, 21 bp, Homo sapiens
ctccactcagctgtcctgcag

SEQ ID NO: 4258279 - DNA, 13 bp, Homo sapiens
ctccagcccctgt

SEQ ID NO: 4258280 - DNA, 13 bp, Homo sapiens
ctccaggcctgtt

SEQ ID NO: 4258281 - DNA, 17 bp, Homo sapiens
ctccagtttgcacctgt

SEQ ID NO: 4258282 - DNA, 16 bp, Homo sapiens
ctcctccagcccctgt

SEQ ID NO: 4258283 - DNA, 18 bp, Homo sapiens
ctcctccagcccctgtcc

SEQ ID NO: 4258284 - DNA, 17 bp, Homo sapiens
ctctaggcctctccagt

SEQ ID NO: 4258285 - DNA, 22 bp, Homo sapiens
ctctagtgggacagcccagagc

SEQ ID NO: 4258286 - DNA, 23 bp, Homo sapiens
ctctagtgggacagcccagagcc

SEQ ID NO: 4258287 - DNA, 23 bp, Homo sapiens
ctctccagtttgcacctgtcccc

SEQ ID NO: 4258288 - DNA, 14 bp, Homo sapiens
ctctctaggcctct

SEQ ID NO: 4258289 - DNA, 14 bp, Homo sapiens
ctctggccctggcc

SEQ ID NO: 4258290 - DNA, 16 bp, Homo sapiens
ctctggccctggccct

SEQ ID NO: 4258291 - DNA, 11 bp, Homo sapiens
ctctgggctgt

SEQ ID NO: 4258292 - DNA, 15 bp, Homo sapiens
ctgaatagatatgaa

SEQ ID NO: 4258293 - DNA, 17 bp, Homo sapiens
ctgaatctgctaccaaa

SEQ ID NO: 4258294 - DNA, 22 bp, Homo sapiens
ctgaatctgctaccaaaacagt

SEQ ID NO: 4258295 - DNA, 14 bp, Homo sapiens
ctgaggactgattt

SEQ ID NO: 4258296 - DNA, 20 bp, Homo sapiens
ctgcagcaaacactccaccc

SEQ ID NO: 4258297 - DNA, 18 bp, Homo sapiens
ctgcagcacctccaggcc

SEQ ID NO: 4258298 - DNA, 15 bp, Homo sapiens
ctgcataatgtttct

SEQ ID NO: 4258299 - DNA, 18 bp, Homo sapiens
ctgcccatcatgtggccc

SEQ ID NO: 4258300 - DNA, 20 bp, Homo sapiens
ctggcttggggtcaagaaac

SEQ ID NO: 4258301 - DNA, 23 bp, Homo sapiens
ctgggctgtaacgtggcactggt

SEQ ID NO: 4258302 - DNA, 16 bp, Homo sapiens
ctggtaggttgggaca

SEQ ID NO: 4258303 - DNA, 12 bp, Homo sapiens
ctgtaaagatgt

SEQ ID NO: 4258304 - DNA, 21 bp, Homo sapiens
ctgtaaagatgtttatttcag

SEQ ID NO: 4258305 - DNA, 22 bp, Homo sapiens
ctgtaaagatgtttatttcagg

SEQ ID NO: 4258306 - DNA, 18 bp, Homo sapiens
ctgtccccaccctccact

SEQ ID NO: 4258307 - DNA, 19 bp, Homo sapiens
ctgtccccaccctccactc

SEQ ID NO: 4258308 - DNA, 13 bp, Homo sapiens
ctgtcctgcagca

SEQ ID NO: 4258309 - DNA, 15 bp, Homo sapiens
ctgtcctgcagcaaa

SEQ ID NO: 4258310 - DNA, 16 bp, Homo sapiens
ctgtcctgcagcaaac

SEQ ID NO: 4258311 - DNA, 15 bp, Homo sapiens
ctgtgtttgcagcct

SEQ ID NO: 4258312 - DNA, 16 bp, Homo sapiens
ctgtgttttgaaagaa

SEQ ID NO: 4258313 - DNA, 18 bp, Homo sapiens
ctgttgctatagagccta

SEQ ID NO: 4258314 - DNA, 23 bp, Homo sapiens
ctgttggaatggatttttcttta

SEQ ID NO: 4258315 - DNA, 18 bp, Homo sapiens
cttagggcactgggctgt

SEQ ID NO: 4258316 - DNA, 23 bp, Homo sapiens
cttccattttcccccactactgc

SEQ ID NO: 4258317 - DNA, 20 bp, Homo sapiens
cttctgtaattgtgtggatt

SEQ ID NO: 4258318 - DNA, 15 bp, Homo sapiens
cttggggtcaagaaa

SEQ ID NO: 4258319 - DNA, 17 bp, Homo sapiens
cttgtagaactcactct

SEQ ID NO: 4258320 - DNA, 18 bp, Homo sapiens
cttgtagaactcactctg

SEQ ID NO: 4258321 - DNA, 20 bp, Homo sapiens
cttgtagaactcactctggg

SEQ ID NO: 4258322 - DNA, 13 bp, Homo sapiens
ctttaaattgtgt

SEQ ID NO: 4258323 - DNA, 13 bp, Homo sapiens
ctttataaatgta

SEQ ID NO: 4258324 - DNA, 20 bp, Homo sapiens
ctttcactaaaacacacagg

SEQ ID NO: 4258325 - DNA, 21 bp, Homo sapiens
ctttcctgtgtgtactctgtc

SEQ ID NO: 4258326 - DNA, 16 bp, Homo sapiens
gaaaaaaaacagtgga

SEQ ID NO: 4258327 - DNA, 15 bp, Homo sapiens
gaaattacctgtgga

SEQ ID NO: 4258328 - DNA, 17 bp, Homo sapiens
gaaattacctgtggata

SEQ ID NO: 4258329 - DNA, 21 bp, Homo sapiens
gaacctacagttttaactgtg

SEQ ID NO: 4258330 - DNA, 23 bp, Homo sapiens
gaacctacagttttaactgtgga

SEQ ID NO: 4258331 - DNA, 17 bp, Homo sapiens
gaactcactctgggctg

SEQ ID NO: 4258332 - DNA, 20 bp, Homo sapiens
gaacttgtgtccctaatgtg

SEQ ID NO: 4258333 - DNA, 19 bp, Homo sapiens
gaaggtgatgttgccatcc

SEQ ID NO: 4258334 - DNA, 16 bp, Homo sapiens
gaatagatatgaaagc

SEQ ID NO: 4258335 - DNA, 19 bp, Homo sapiens
gaatagatatgaaagctga

SEQ ID NO: 4258336 - DNA, 23 bp, Homo sapiens
gaatgctggactggaggcccctg

SEQ ID NO: 4258337 - DNA, 13 bp, Homo sapiens
gaattataactgt

SEQ ID NO: 4258338 - DNA, 13 bp, Homo sapiens
gactctggccctg

SEQ ID NO: 4258339 - DNA, 18 bp, Homo sapiens
gactctggccctggccct

SEQ ID NO: 4258340 - DNA, 14 bp, Homo sapiens
gactgatttcagag

SEQ ID NO: 4258341 - DNA, 20 bp, Homo sapiens
gactggaggcccctggagcc

SEQ ID NO: 4258342 - DNA, 13 bp, Homo sapiens
gacttgaaagaaa

SEQ ID NO: 4258343 - DNA, 13 bp, Homo sapiens
gagatcaaagatg

SEQ ID NO: 4258344 - DNA, 15 bp, Homo sapiens
gagatcaaagatgaa

SEQ ID NO: 4258345 - DNA, 15 bp, Homo sapiens
gagccagatggcaag

SEQ ID NO: 4258346 - DNA, 20 bp, Homo sapiens
gagcccctcctccagcccct

SEQ ID NO: 4258347 - DNA, 21 bp, Homo sapiens
gagcccctcctccagcccctg

SEQ ID NO: 4258348 - DNA, 16 bp, Homo sapiens
gagcctggctgcccat

SEQ ID NO: 4258349 - DNA, 17 bp, Homo sapiens
gagcgagagatcaaaga

SEQ ID NO: 4258350 - DNA, 17 bp, Homo sapiens
gaggactcccaaccctg

SEQ ID NO: 4258351 - DNA, 20 bp, Homo sapiens
gaggactcccaaccctggct

SEQ ID NO: 4258352 - DNA, 19 bp, Homo sapiens
gataccatgctgtaaggat

SEQ ID NO: 4258353 - DNA, 15 bp, Homo sapiens
gatatgaaagctgat

SEQ ID NO: 4258354 - DNA, 20 bp, Homo sapiens
gatctacttctgtaattgtg

SEQ ID NO: 4258355 - DNA, 22 bp, Homo sapiens
gatgttctattttttgttttgt

SEQ ID NO: 4258356 - DNA, 20 bp, Homo sapiens
gattagaaattacctgtgga

SEQ ID NO: 4258357 - DNA, 18 bp, Homo sapiens
gatttaaaagcctgctca

SEQ ID NO: 4258358 - DNA, 15 bp, Homo sapiens
gatttcatactgtaa

SEQ ID NO: 4258359 - DNA, 15 bp, Homo sapiens
gcaaacactccaccc

SEQ ID NO: 4258360 - DNA, 22 bp, Homo sapiens
gcagcaaacactccaccctcca

SEQ ID NO: 4258361 - DNA, 17 bp, Homo sapiens
gcagcacctccaggcct

SEQ ID NO: 4258362 - DNA, 19 bp, Homo sapiens
gcagcacctccaggcctgt

SEQ ID NO: 4258363 - DNA, 21 bp, Homo sapiens
gccaaatttaaaactgttgga

SEQ ID NO: 4258364 - DNA, 16 bp, Homo sapiens
gccactgttgttttgg

SEQ ID NO: 4258365 - DNA, 13 bp, Homo sapiens
gccagcaacgctt

SEQ ID NO: 4258366 - DNA, 14 bp, Homo sapiens
gccagcaacgcttg

SEQ ID NO: 4258367 - DNA, 22 bp, Homo sapiens
gccagcaacgcttgtagaactc

SEQ ID NO: 4258368 - DNA, 20 bp, Homo sapiens
gcccatccattaggccagca

SEQ ID NO: 4258369 - DNA, 13 bp, Homo sapiens
gcccctcctccag

SEQ ID NO: 4258370 - DNA, 20 bp, Homo sapiens
gcccctcctccagcccctgt

SEQ ID NO: 4258371 - DNA, 14 bp, Homo sapiens
gcccctggagccag

SEQ ID NO: 4258372 - DNA, 15 bp, Homo sapiens
gcccctggagccaga

SEQ ID NO: 4258373 - DNA, 12 bp, Homo sapiens
gccgactctggc

SEQ ID NO: 4258374 - DNA, 14 bp, Homo sapiens
gccgtaatttaact

SEQ ID NO: 4258375 - DNA, 23 bp, Homo sapiens
gccgtcctaacctcgggcctgct

SEQ ID NO: 4258376 - DNA, 17 bp, Homo sapiens
gccttagggcactgggc

SEQ ID NO: 4258377 - DNA, 23 bp, Homo sapiens
gcctttatttttggcgtggctga

SEQ ID NO: 4258378 - DNA, 12 bp, Homo sapiens
gcgtggctgact

SEQ ID NO: 4258379 - DNA, 20 bp, Homo sapiens
gctaatttgttttggatata

SEQ ID NO: 4258380 - DNA, 14 bp, Homo sapiens
gctaccaaaacagt

SEQ ID NO: 4258381 - DNA, 20 bp, Homo sapiens
aggcctgttgctatagagcc

SEQ ID NO: 4258382 - DNA, 15 bp, Homo sapiens
agggaagaaggagga

SEQ ID NO: 4258383 - DNA, 14 bp, Homo sapiens
agggcactgggctg

SEQ ID NO: 4258384 - DNA, 19 bp, Homo sapiens
aggggccttagggcactgg

SEQ ID NO: 4258385 - DNA, 23 bp, Homo sapiens
agtgctgtcttaaactaaatgtg

SEQ ID NO: 4258386 - DNA, 16 bp, Homo sapiens
agtggaacgaaaatga

SEQ ID NO: 4258387 - DNA, 15 bp, Homo sapiens
agtggatcacaaagt

SEQ ID NO: 4258388 - DNA, 14 bp, Homo sapiens
agttgtgtttcaac

SEQ ID NO: 4258389 - DNA, 13 bp, Homo sapiens
agtttcttgcttg

SEQ ID NO: 4258390 - DNA, 16 bp, Homo sapiens
agtttgcacctgtccc

SEQ ID NO: 4258391 - DNA, 13 bp, Homo sapiens
atagaaggtgatg

SEQ ID NO: 4258392 - DNA, 19 bp, Homo sapiens
atagtgtagctgaggaggc

SEQ ID NO: 4258393 - DNA, 13 bp, Homo sapiens
atatgaaagctga

SEQ ID NO: 4258394 - DNA, 16 bp, Homo sapiens
atccattaggccagca

SEQ ID NO: 4258395 - DNA, 15 bp, Homo sapiens
atctataaactataa

SEQ ID NO: 4258396 - DNA, 18 bp, Homo sapiens
atctgctaccaaaacagt

SEQ ID NO: 4258397 - DNA, 15 bp, Homo sapiens
atctttataaatgta

SEQ ID NO: 4258398 - DNA, 21 bp, Homo sapiens
atgcctatggtggatccaaac

SEQ ID NO: 4258399 - DNA, 20 bp, Homo sapiens
atgctggactggaggcccct

SEQ ID NO: 4258400 - DNA, 22 bp, Homo sapiens
atgctggactggaggcccctgg

SEQ ID NO: 4258401 - DNA, 19 bp, Homo sapiens
atggatttttctttaactg

SEQ ID NO: 4258402 - DNA, 21 bp, Homo sapiens
atggctgtgtttgcagcctgc

SEQ ID NO: 4258403 - DNA, 23 bp, Homo sapiens
atgtcaataaacaacagctgaag

SEQ ID NO: 4258404 - DNA, 13 bp, Homo sapiens
atgtgcaatagaa

SEQ ID NO: 4258405 - DNA, 18 bp, Homo sapiens
atgtgcaatagaaggtga

SEQ ID NO: 4258406 - DNA, 20 bp, Homo sapiens
atgttctattttttgttttg

SEQ ID NO: 4258407 - DNA, 12 bp, Homo sapiens
atgtttctggat

SEQ ID NO: 4258408 - DNA, 16 bp, Homo sapiens
attacctgtggatatt

SEQ ID NO: 4258409 - DNA, 19 bp, Homo sapiens
attacctgtggatatttgt

SEQ ID NO: 4258410 - DNA, 18 bp, Homo sapiens
attcaggacttgaaagaa

SEQ ID NO: 4258411 - DNA, 19 bp, Homo sapiens
attcaggacttgaaagaaa

SEQ ID NO: 4258412 - DNA, 13 bp, Homo sapiens
attggggtagttg

SEQ ID NO: 4258413 - DNA, 19 bp, Homo sapiens
attgtgtggattctttaaa

SEQ ID NO: 4258414 - DNA, 14 bp, Homo sapiens
atttaaaagcctgc

SEQ ID NO: 4258415 - DNA, 23 bp, Homo sapiens
atttatggttgttaaaaatgtca

SEQ ID NO: 4258416 - DNA, 17 bp, Homo sapiens
atttattttttcttttc

SEQ ID NO: 4258417 - DNA, 23 bp, Homo sapiens
atttcatactgtaacattcagga

SEQ ID NO: 4258418 - DNA, 20 bp, Homo sapiens
atttggatttaaaagcctgc

SEQ ID NO: 4258419 - DNA, 16 bp, Homo sapiens
atttgtatatggtatt

SEQ ID NO: 4258420 - DNA, 16 bp, Homo sapiens
atttgttttggatata

SEQ ID NO: 4258421 - DNA, 21 bp, Homo sapiens
attttcccccactactgcagc

SEQ ID NO: 4258422 - DNA, 20 bp, Homo sapiens
caaaatatattttgtttaca

SEQ ID NO: 4258423 - DNA, 19 bp, Homo sapiens
caaatttaaaactgttgga

SEQ ID NO: 4258424 - DNA, 15 bp, Homo sapiens
caacaaagaaacaaa

SEQ ID NO: 4258425 - DNA, 20 bp, Homo sapiens
caacaaagaaacaaagatgt

SEQ ID NO: 4258426 - DNA, 15 bp, Homo sapiens
caacagcaaacaggt

SEQ ID NO: 4258427 - DNA, 12 bp, Homo sapiens
caagaaacagcc

SEQ ID NO: 4258428 - DNA, 16 bp, Homo sapiens
caataaacaacagctg

SEQ ID NO: 4258429 - DNA, 23 bp, Homo sapiens
caatttggatttaaaagcctgct

SEQ ID NO: 4258430 - DNA, 22 bp, Homo sapiens
cacaaaatatattttgtttaca

SEQ ID NO: 4258431 - DNA, 19 bp, Homo sapiens
cacaggtgcaacagacttg

SEQ ID NO: 4258432 - DNA, 20 bp, Homo sapiens
cacatcacaagactatgcca

SEQ ID NO: 4258433 - DNA, 21 bp, Homo sapiens
cacccaatcaagggaagaagg

SEQ ID NO: 4258434 - DNA, 14 bp, Homo sapiens
cacccccttccccc

SEQ ID NO: 4258435 - DNA, 17 bp, Homo sapiens
caccctccaccttccat

SEQ ID NO: 4258436 - DNA, 15 bp, Homo sapiens
caccctccactcagc

SEQ ID NO: 4258437 - DNA, 13 bp, Homo sapiens
cacctccaggcct

SEQ ID NO: 4258438 - DNA, 18 bp, Homo sapiens
cacctccaggcctgttgc

SEQ ID NO: 4258439 - DNA, 15 bp, Homo sapiens
cacctgcactaacag

SEQ ID NO: 4258440 - DNA, 16 bp, Homo sapiens
cacctgcactaacaga

SEQ ID NO: 4258441 - DNA, 21 bp, Homo sapiens
cacctgcactaacagagtggc

SEQ ID NO: 4258442 - DNA, 19 bp, Homo sapiens
cactaaaacacacaggtgc

SEQ ID NO: 4258443 - DNA, 12 bp, Homo sapiens
cactactgcagc

SEQ ID NO: 4258444 - DNA, 13 bp, Homo sapiens
cactactgcagca

SEQ ID NO: 4258445 - DNA, 20 bp, Homo sapiens
cactcagctgtcctgcagca

SEQ ID NO: 4258446 - DNA, 21 bp, Homo sapiens
cactccaccctccaccttcca

SEQ ID NO: 4258447 - DNA, 18 bp, Homo sapiens
cactggtaggttgggaca

SEQ ID NO: 4258448 - DNA, 21 bp, Homo sapiens
cactggtaggttgggacacca

SEQ ID NO: 4258449 - DNA, 20 bp, Homo sapiens
cagaaattcaatttggattt

SEQ ID NO: 4258450 - DNA, 22 bp, Homo sapiens
cagagcccctcctccagcccct

SEQ ID NO: 4258451 - DNA, 17 bp, Homo sapiens
cagagcctggctgccca

SEQ ID NO: 4258452 - DNA, 22 bp, Homo sapiens
cagaggactcccaaccctggct

SEQ ID NO: 4258453 - DNA, 20 bp, Homo sapiens
cagatagtgtagctgaggag

SEQ ID NO: 4258454 - DNA, 14 bp, Homo sapiens
cagcaaacaggtgc

SEQ ID NO: 4258455 - DNA, 13 bp, Homo sapiens
cagcccctgtccc

SEQ ID NO: 4258456 - DNA, 21 bp, Homo sapiens
cagcctgctctagtgggacag

SEQ ID NO: 4258457 - DNA, 13 bp, Homo sapiens
caggcctgttgct

SEQ ID NO: 4258458 - DNA, 17 bp, Homo sapiens
caggttataacagtgtt

SEQ ID NO: 4258459 - DNA, 23 bp, Homo sapiens
cagtgtctgtgttttgaaagaat

SEQ ID NO: 4258460 - DNA, 13 bp, Homo sapiens
cagttttaactgt

SEQ ID NO: 4258461 - DNA, 14 bp, Homo sapiens
cagttttaactgtg

SEQ ID NO: 4258462 - DNA, 18 bp, Homo sapiens
cagttttaactgtggata

SEQ ID NO: 4258463 - DNA, 22 bp, Homo sapiens
cagttttaactgtggatattgt

SEQ ID NO: 4258464 - DNA, 19 bp, Homo sapiens
catcacgttagctgtccca

SEQ ID NO: 4258465 - DNA, 20 bp, Homo sapiens
catccattaggccagcaacg

SEQ ID NO: 4258466 - DNA, 14 bp, Homo sapiens
catgacagcctcca

SEQ ID NO: 4258467 - DNA, 16 bp, Homo sapiens
catgcttcacaatgtt

SEQ ID NO: 4258468 - DNA, 18 bp, Homo sapiens
cattcaacagagactgaa

SEQ ID NO: 4258469 - DNA, 13 bp, Homo sapiens
cattcaggaattc

SEQ ID NO: 4258470 - DNA, 16 bp, Homo sapiens
cattgaagccgactct

SEQ ID NO: 4258471 - DNA, 18 bp, Homo sapiens
cattgaagccgactctgg

SEQ ID NO: 4258472 - DNA, 14 bp, Homo sapiens
cattgtatatgtga

SEQ ID NO: 4258473 - DNA, 20 bp, Homo sapiens
catttttgtactaactagca

SEQ ID NO: 4258474 - DNA, 18 bp, Homo sapiens
ccaaatttaaaactgttg

SEQ ID NO: 4258475 - DNA, 12 bp, Homo sapiens
ccactactgcag

SEQ ID NO: 4258476 - DNA, 13 bp, Homo sapiens
ccactactgcagc

SEQ ID NO: 4258477 - DNA, 14 bp, Homo sapiens
ccactactgcagca

SEQ ID NO: 4258478 - DNA, 20 bp, Homo sapiens
ccactactgcagcacctcca

SEQ ID NO: 4258479 - DNA, 15 bp, Homo sapiens
ccactcagctgtcct

SEQ ID NO: 4258480 - DNA, 21 bp, Homo sapiens
ccagagcccctcctccagccc

SEQ ID NO: 4258481 - DNA, 15 bp, Homo sapiens
ccagaggactcccaa

SEQ ID NO: 4258482 - DNA, 20 bp, Homo sapiens
ccagaggactcccaaccctg

SEQ ID NO: 4258483 - DNA, 20 bp, Homo sapiens
ccagatagtgtagctgagga

SEQ ID NO: 4258484 - DNA, 11 bp, Homo sapiens
ccagcccctgt

SEQ ID NO: 4258485 - DNA, 17 bp, Homo sapiens
ccagcccctgtcccacc

SEQ ID NO: 4258486 - DNA, 13 bp, Homo sapiens
ccattaggccagc

SEQ ID NO: 4258487 - DNA, 19 bp, Homo sapiens
ccattgaagccgactctgg

SEQ ID NO: 4258488 - DNA, 20 bp, Homo sapiens
ccattgaagccgactctggc

SEQ ID NO: 4258489 - DNA, 22 bp, Homo sapiens
ccattttgttattgactaacag

SEQ ID NO: 4258490 - DNA, 14 bp, Homo sapiens
cccaccctccactc

SEQ ID NO: 4258491 - DNA, 18 bp, Homo sapiens
cccactactgcagcacct

SEQ ID NO: 4258492 - DNA, 20 bp, Homo sapiens
cccagagcctggctgcccat

SEQ ID NO: 4258493 - DNA, 22 bp, Homo sapiens
cccagcccatccattaggccag

SEQ ID NO: 4258494 - DNA, 15 bp, Homo sapiens
ccccaccctccactc

SEQ ID NO: 4258495 - DNA, 23 bp, Homo sapiens
ccccactactgcagcacctccag

SEQ ID NO: 4258496 - DNA, 17 bp, Homo sapiens
cccctcctccagcccct

SEQ ID NO: 4258497 - DNA, 22 bp, Homo sapiens
cccctcctccagcccctgtccc

SEQ ID NO: 4258498 - DNA, 15 bp, Homo sapiens
ccctgtcccaccccc

SEQ ID NO: 4258499 - DNA, 13 bp, Homo sapiens
ccgactctggccc

SEQ ID NO: 4258500 - DNA, 11 bp, Homo sapiens
ccggaaagaag

SEQ ID NO: 4258501 - DNA, 18 bp, Homo sapiens
cctaacctcgggcctgct

SEQ ID NO: 4258502 - DNA, 13 bp, Homo sapiens
cctaatgtgttta

SEQ ID NO: 4258503 - DNA, 18 bp, Homo sapiens
cctacactcacctgcact

SEQ ID NO: 4258504 - DNA, 22 bp, Homo sapiens
cctagctgtgtgaatacctgct

SEQ ID NO: 4258505 - DNA, 21 bp, Homo sapiens
cctccaccttccattttcccc

SEQ ID NO: 4258506 - DNA, 18 bp, Homo sapiens
cctccagcccctgtccca

SEQ ID NO: 4258507 - DNA, 16 bp, Homo sapiens
cctcctccagcccctg

SEQ ID NO: 4258508 - DNA, 18 bp, Homo sapiens
cctcctccagcccctgtc

SEQ ID NO: 4258509 - DNA, 19 bp, Homo sapiens
cctctccagtttgcacctg

SEQ ID NO: 4258510 - DNA, 20 bp, Homo sapiens
cctctccagtttgcacctgt

SEQ ID NO: 4258511 - DNA, 19 bp, Homo sapiens
cctgaggactgatttcaga

SEQ ID NO: 4258512 - DNA, 23 bp, Homo sapiens
cctgaggactgatttcagagtga

SEQ ID NO: 4258513 - DNA, 21 bp, Homo sapiens
cctgcagcaaacactccaccc

SEQ ID NO: 4258514 - DNA, 14 bp, Homo sapiens
tgctttttccaact

SEQ ID NO: 4258515 - DNA, 22 bp, Homo sapiens
tggaattcttagtcacaaaata

SEQ ID NO: 4258516 - DNA, 17 bp, Homo sapiens
tggactggaggcccctg

SEQ ID NO: 4258517 - DNA, 23 bp, Homo sapiens
tggactggaggcccctggagcca

SEQ ID NO: 4258518 - DNA, 13 bp, Homo sapiens
tggaggcccctgg

SEQ ID NO: 4258519 - DNA, 16 bp, Homo sapiens
tggaggcccctggagc

SEQ ID NO: 4258520 - DNA, 17 bp, Homo sapiens
tggaggcccctggagcc

SEQ ID NO: 4258521 - DNA, 11 bp, Homo sapiens
tggatatttgt

SEQ ID NO: 4258522 - DNA, 13 bp, Homo sapiens
tggatatttgtat

SEQ ID NO: 4258523 - DNA, 14 bp, Homo sapiens
tggatcacaaagtg

SEQ ID NO: 4258524 - DNA, 16 bp, Homo sapiens
tggatttaaaagcctg

SEQ ID NO: 4258525 - DNA, 15 bp, Homo sapiens
tggatttttctttaa

SEQ ID NO: 4258526 - DNA, 18 bp, Homo sapiens
tggatttttctttaactg

SEQ ID NO: 4258527 - DNA, 18 bp, Homo sapiens
tggcaagagggtgacagc

SEQ ID NO: 4258528 - DNA, 21 bp, Homo sapiens
tggctgtgtttgcagcctgct

SEQ ID NO: 4258529 - DNA, 20 bp, Homo sapiens
tgggacagcccagagcctgg

SEQ ID NO: 4258530 - DNA, 14 bp, Homo sapiens
tggtaggttgggac

SEQ ID NO: 4258531 - DNA, 16 bp, Homo sapiens
tgtaacgtggcactgg

SEQ ID NO: 4258532 - DNA, 19 bp, Homo sapiens
tgtaaggatccggaaagaa

SEQ ID NO: 4258533 - DNA, 20 bp, Homo sapiens
tgtaattgtgtggattcttt

SEQ ID NO: 4258534 - DNA, 21 bp, Homo sapiens
tgtaattgtgtggattcttta

SEQ ID NO: 4258535 - DNA, 15 bp, Homo sapiens
tgtagctgaggaggc

SEQ ID NO: 4258536 - DNA, 13 bp, Homo sapiens
tgtataaaagtgt

SEQ ID NO: 4258537 - DNA, 21 bp, Homo sapiens
tgtataaaagtgtgaaataaa

SEQ ID NO: 4258538 - DNA, 19 bp, Homo sapiens
tgtcccacccccttccccc

SEQ ID NO: 4258539 - DNA, 22 bp, Homo sapiens
tgtccccaccctccactcagct

SEQ ID NO: 4258540 - DNA, 20 bp, Homo sapiens
tgtgaagcaaactctaaaat

SEQ ID NO: 4258541 - DNA, 20 bp, Homo sapiens
tgttactaaaaaaaagatga

SEQ ID NO: 4258542 - DNA, 13 bp, Homo sapiens
ttaaaagcctgct

SEQ ID NO: 4258543 - DNA, 19 bp, Homo sapiens
ttaactgccgtaatttaac

SEQ ID NO: 4258544 - DNA, 12 bp, Homo sapiens
ttaactgtggat

SEQ ID NO: 4258545 - DNA, 13 bp, Homo sapiens
ttacctgtggata

SEQ ID NO: 4258546 - DNA, 18 bp, Homo sapiens
ttactaaaaaaaagatga

SEQ ID NO: 4258547 - DNA, 14 bp, Homo sapiens
ttacttgcttctct

SEQ ID NO: 4258548 - DNA, 18 bp, Homo sapiens
ttactttagaagcctgca

SEQ ID NO: 4258549 - DNA, 21 bp, Homo sapiens
ttactttggggctaatttaac

SEQ ID NO: 4258550 - DNA, 23 bp, Homo sapiens
ttagaagcctgcataatgtttct

SEQ ID NO: 4258551 - DNA, 17 bp, Homo sapiens
ttataactgtaaagatg

SEQ ID NO: 4258552 - DNA, 19 bp, Homo sapiens
ttatttcatgattagaaat

SEQ ID NO: 4258553 - DNA, 21 bp, Homo sapiens
ttcaacaaagaaacaaagatg

SEQ ID NO: 4258554 - DNA, 22 bp, Homo sapiens
ttcaacaaagaaacaaagatgt

SEQ ID NO: 4258555 - DNA, 16 bp, Homo sapiens
ttcaacggaaagtgct

SEQ ID NO: 4258556 - DNA, 22 bp, Homo sapiens
ttcatactgtaacattcaggaa

SEQ ID NO: 4258557 - DNA, 23 bp, Homo sapiens
ttcatgattagaaattacctgtg

SEQ ID NO: 4258558 - DNA, 18 bp, Homo sapiens
ttcccccactactgcagc

SEQ ID NO: 4258559 - DNA, 21 bp, Homo sapiens
ttcctgtgtgtactctgtcca

SEQ ID NO: 4258560 - DNA, 15 bp, Homo sapiens
ttctattttttgttt

SEQ ID NO: 4258561 - DNA, 13 bp, Homo sapiens
ttctgtaattgtg

SEQ ID NO: 4258562 - DNA, 12 bp, Homo sapiens
ttctttaactgc

SEQ ID NO: 4258563 - DNA, 14 bp, Homo sapiens
ttgaaagaatagaa

SEQ ID NO: 4258564 - DNA, 18 bp, Homo sapiens
ttgaagccgactctggcc

SEQ ID NO: 4258565 - DNA, 19 bp, Homo sapiens
ttgaagccgactctggccc

SEQ ID NO: 4258566 - DNA, 18 bp, Homo sapiens
ttgataaccttgaaaaaa

SEQ ID NO: 4258567 - DNA, 13 bp, Homo sapiens
ttgcacctgtccc

SEQ ID NO: 4258568 - DNA, 17 bp, Homo sapiens
ttgtagaactcactctg

SEQ ID NO: 4258569 - DNA, 22 bp, Homo sapiens
ttgtagaactcactctgggctg

SEQ ID NO: 4258570 - DNA, 13 bp, Homo sapiens
ttgtgtggattct

SEQ ID NO: 4258571 - DNA, 15 bp, Homo sapiens
ttgttaaaaatgtca

SEQ ID NO: 4258572 - DNA, 22 bp, Homo sapiens
tttaaaactgttggaatggatt

SEQ ID NO: 4258573 - DNA, 13 bp, Homo sapiens
tttaaaagcctgc

SEQ ID NO: 4258574 - DNA, 21 bp, Homo sapiens
tttaactgccgtaatttaact

SEQ ID NO: 4258575 - DNA, 17 bp, Homo sapiens
tttaactgtggatattg

SEQ ID NO: 4258576 - DNA, 19 bp, Homo sapiens
tttcaggcattggatattt

SEQ ID NO: 4258577 - DNA, 13 bp, Homo sapiens
tttgcacctgtcc

SEQ ID NO: 4258578 - DNA, 14 bp, Homo sapiens
tttgtataaaagtg

SEQ ID NO: 4258579 - DNA, 20 bp, Homo sapiens
tttgtataaaagtgtgaaat

SEQ ID NO: 4258580 - DNA, 16 bp, Homo sapiens
gctcaatccctgagga

SEQ ID NO: 4258581 - DNA, 18 bp, Homo sapiens
gctctctaggcctctcca

SEQ ID NO: 4258582 - DNA, 17 bp, Homo sapiens
gctgcccatcatgtggc

SEQ ID NO: 4258583 - DNA, 18 bp, Homo sapiens
gctgtaacgtggcactgg

SEQ ID NO: 4258584 - DNA, 18 bp, Homo sapiens
gctgttgttccattgaag

SEQ ID NO: 4258585 - DNA, 21 bp, Homo sapiens
gcttctctagctctctaggcc

SEQ ID NO: 4258586 - DNA, 19 bp, Homo sapiens
gcttgtagaactcactctg

SEQ ID NO: 4258587 - DNA, 23 bp, Homo sapiens
gcttgtagaactcactctgggct

SEQ ID NO: 4258588 - DNA, 19 bp, Homo sapiens
ggaaagtgctgtcttaaac

SEQ ID NO: 4258589 - DNA, 14 bp, Homo sapiens
ggaagaaggaggaa

SEQ ID NO: 4258590 - DNA, 16 bp, Homo sapiens
ggaggaatgctggact

SEQ ID NO: 4258591 - DNA, 18 bp, Homo sapiens
ggatttaaaagcctgctc

SEQ ID NO: 4258592 - DNA, 13 bp, Homo sapiens
ggcccctggagcc

SEQ ID NO: 4258593 - DNA, 12 bp, Homo sapiens
ggcctctccagt

SEQ ID NO: 4258594 - DNA, 15 bp, Homo sapiens
ggcctgttgctatag

SEQ ID NO: 4258595 - DNA, 24 bp, Homo sapiens
ggcctgttgctatagagcctacct

SEQ ID NO: 4258596 - DNA, 12 bp, Homo sapiens
ggctaatttaac

SEQ ID NO: 4258597 - DNA, 15 bp, Homo sapiens
ggctcctgttttgca

SEQ ID NO: 4258598 - DNA, 19 bp, Homo sapiens
gggacagcccagagcctgg

SEQ ID NO: 4258599 - DNA, 21 bp, Homo sapiens
gggccttagggcactgggctg

SEQ ID NO: 4258600 - DNA, 14 bp, Homo sapiens
ggggctaatttaac

SEQ ID NO: 4258601 - DNA, 17 bp, Homo sapiens
ggtaggttgggacacca

SEQ ID NO: 4258602 - DNA, 18 bp, Homo sapiens
ggtaggttgggacaccag

SEQ ID NO: 4258603 - DNA, 14 bp, Homo sapiens
ggtcaagaaacagc

SEQ ID NO: 4258604 - DNA, 18 bp, Homo sapiens
ggtcaagaaacagccagc

SEQ ID NO: 4258605 - DNA, 18 bp, Homo sapiens
ggtttactcactgctgca

SEQ ID NO: 4258606 - DNA, 15 bp, Homo sapiens
gtaattgtgtggatt

SEQ ID NO: 4258607 - DNA, 12 bp, Homo sapiens
gtaatttaactt

SEQ ID NO: 4258608 - DNA, 18 bp, Homo sapiens
gtagaactcactctgggc

SEQ ID NO: 4258609 - DNA, 19 bp, Homo sapiens
gtaggttgggacaccaggg

SEQ ID NO: 4258610 - DNA, 12 bp, Homo sapiens
gtatattcagga

SEQ ID NO: 4258611 - DNA, 23 bp, Homo sapiens
gtatattcaggacttgaaagaaa

SEQ ID NO: 4258612 - DNA, 21 bp, Homo sapiens
gtattcccaaaaattactttg

SEQ ID NO: 4258613 - DNA, 18 bp, Homo sapiens
gtcaataaacaacagctg

SEQ ID NO: 4258614 - DNA, 19 bp, Homo sapiens
gtcccacccccttccccca

SEQ ID NO: 4258615 - DNA, 22 bp, Homo sapiens
gtcctaacctcgggcctgctgc

SEQ ID NO: 4258616 - DNA, 17 bp, Homo sapiens
gtcttaaactaaatgtg

SEQ ID NO: 4258617 - DNA, 14 bp, Homo sapiens
gtgacagcttcctt

SEQ ID NO: 4258618 - DNA, 20 bp, Homo sapiens
gtgttactaaaaaaaagatg

SEQ ID NO: 4258619 - DNA, 16 bp, Homo sapiens
gtgttttaattgtaaa

SEQ ID NO: 4258620 - DNA, 15 bp, Homo sapiens
gtgttttgaaagaat

SEQ ID NO: 4258621 - DNA, 22 bp, Homo sapiens
gttaggggccttagggcactgg

SEQ ID NO: 4258622 - DNA, 13 bp, Homo sapiens
gttcaacaaagaa

SEQ ID NO: 4258623 - DNA, 23 bp, Homo sapiens
gttccattgaagccgactctggc

SEQ ID NO: 4258624 - DNA, 18 bp, Homo sapiens
gttggggaagggcctgcc

SEQ ID NO: 4258625 - DNA, 18 bp, Homo sapiens
gttgtactttggaattct

SEQ ID NO: 4258626 - DNA, 14 bp, Homo sapiens
gtttctggatttca

SEQ ID NO: 4258627 - DNA, 15 bp, Homo sapiens
gtttgcacctgtccc

SEQ ID NO: 4258628 - DNA, 11 bp, Homo sapiens
gtttgcagcct

SEQ ID NO: 4258629 - DNA, 16 bp, Homo sapiens
gttttaactgtggata

SEQ ID NO: 4258630 - DNA, 15 bp, Homo sapiens
taaaaaaaagatgaa

SEQ ID NO: 4258631 - DNA, 14 bp, Homo sapiens
taaaacacacaggt

SEQ ID NO: 4258632 - DNA, 13 bp, Homo sapiens
taaaattatttca

SEQ ID NO: 4258633 - DNA, 22 bp, Homo sapiens
taaatgtgcaatagaaggtgat

SEQ ID NO: 4258634 - DNA, 14 bp, Homo sapiens
taacagtgtttaaa

SEQ ID NO: 4258635 - DNA, 21 bp, Homo sapiens
taacattcaggaattcttgga

SEQ ID NO: 4258636 - DNA, 16 bp, Homo sapiens
taacctcgggcctgct

SEQ ID NO: 4258637 - DNA, 17 bp, Homo sapiens
taactgccgtaatttaa

SEQ ID NO: 4258638 - DNA, 15 bp, Homo sapiens
taactgtaaagatgt

SEQ ID NO: 4258639 - DNA, 23 bp, Homo sapiens
taactgtaaagatgtttatttca

SEQ ID NO: 4258640 - DNA, 13 bp, Homo sapiens
taactttctgggt

SEQ ID NO: 4258641 - DNA, 17 bp, Homo sapiens
taaggatccggaaagaa

SEQ ID NO: 4258642 - DNA, 14 bp, Homo sapiens
taattgtgtggatt

SEQ ID NO: 4258643 - DNA, 20 bp, Homo sapiens
taattgtgtggattctttaa

SEQ ID NO: 4258644 - DNA, 11 bp, Homo sapiens
taatttaactt

SEQ ID NO: 4258645 - DNA, 17 bp, Homo sapiens
taatttgttttggatat

SEQ ID NO: 4258646 - DNA, 19 bp, Homo sapiens
tacagttttaactgtggat

SEQ ID NO: 4258647 - DNA, 21 bp, Homo sapiens
tacagttttaactgtggatat

SEQ ID NO: 4258648 - DNA, 18 bp, Homo sapiens
taccatgcttcacaatgt

SEQ ID NO: 4258649 - DNA, 21 bp, Homo sapiens
tacgtagcctaaggctcctgt

SEQ ID NO: 4258650 - DNA, 15 bp, Homo sapiens
tactgtatattcagg

SEQ ID NO: 4258651 - DNA, 18 bp, Homo sapiens
tacttatttgtatatggt

SEQ ID NO: 4258652 - DNA, 17 bp, Homo sapiens
tactttagaagcctgca

SEQ ID NO: 4258653 - DNA, 17 bp, Homo sapiens
tactttggaattcttag

SEQ ID NO: 4258654 - DNA, 15 bp, Homo sapiens
tagaactcactctgg

SEQ ID NO: 4258655 - DNA, 17 bp, Homo sapiens
tagaactcactctgggc

SEQ ID NO: 4258656 - DNA, 18 bp, Homo sapiens
tagaactcactctgggct

SEQ ID NO: 4258657 - DNA, 19 bp, Homo sapiens
tagaactcactctgggctg

SEQ ID NO: 4258658 - DNA, 12 bp, Homo sapiens
tagaagcctgca

SEQ ID NO: 4258659 - DNA, 16 bp, Homo sapiens
tagggcactgggctgt

SEQ ID NO: 4258660 - DNA, 15 bp, Homo sapiens
tagttgtgtttcaac

SEQ ID NO: 4258661 - DNA, 19 bp, Homo sapiens
tatgccattggggtagttg

SEQ ID NO: 4258662 - DNA, 17 bp, Homo sapiens
tatggtggatccaaact

SEQ ID NO: 4258663 - DNA, 20 bp, Homo sapiens
tattcaggacttgaaagaaa

SEQ ID NO: 4258664 - DNA, 18 bp, Homo sapiens
tatttgtataaaagtgtg

SEQ ID NO: 4258665 - DNA, 19 bp, Homo sapiens
tattttttcttttctttac

SEQ ID NO: 4258666 - DNA, 14 bp, Homo sapiens
tcaacaaagaaaca

SEQ ID NO: 4258667 - DNA, 21 bp, Homo sapiens
tcaacaaagaaacaaagatgt

SEQ ID NO: 4258668 - DNA, 16 bp, Homo sapiens
tcaacagagactgaat

SEQ ID NO: 4258669 - DNA, 23 bp, Homo sapiens
tcaacgcctcactgaaacatggc

SEQ ID NO: 4258670 - DNA, 16 bp, Homo sapiens
tcaagaaacagccagc

SEQ ID NO: 4258671 - DNA, 17 bp, Homo sapiens
tcaagaaacagccagca

SEQ ID NO: 4258672 - DNA, 16 bp, Homo sapiens
tcaataaacaacagct

SEQ ID NO: 4258673 - DNA, 18 bp, Homo sapiens
tcaataaacaacagctga

SEQ ID NO: 4258674 - DNA, 20 bp, Homo sapiens
tcacaaaatatattttgttt

SEQ ID NO: 4258675 - DNA, 19 bp, Homo sapiens
tcagctgtcctgcagcaaa

SEQ ID NO: 4258676 - DNA, 20 bp, Homo sapiens
tcaggcattggatatttttt

SEQ ID NO: 4258677 - DNA, 23 bp, Homo sapiens
tcatgattagaaattacctgtgg

SEQ ID NO: 4258678 - DNA, 13 bp, Homo sapiens
tccaccctccacc

SEQ ID NO: 4258679 - DNA, 15 bp, Homo sapiens
tccaccctccacctt

SEQ ID NO: 4258680 - DNA, 13 bp, Homo sapiens
tccagcccctgtc

SEQ ID NO: 4258681 - DNA, 17 bp, Homo sapiens
tccagtttgcacctgtc

SEQ ID NO: 4258682 - DNA, 14 bp, Homo sapiens
tccattaggccagc

SEQ ID NO: 4258683 - DNA, 21 bp, Homo sapiens
tccattttcccccactactgc

SEQ ID NO: 4258684 - DNA, 16 bp, Homo sapiens
tccccaccctccactc

SEQ ID NO: 4258685 - DNA, 19 bp, Homo sapiens
tcctgcagcaaacactcca

SEQ ID NO: 4258686 - DNA, 16 bp, Homo sapiens
tctagctctctaggcc

SEQ ID NO: 4258687 - DNA, 14 bp, Homo sapiens
tctaggcctctcca

SEQ ID NO: 4258688 - DNA, 15 bp, Homo sapiens
tctaggcctctccag

SEQ ID NO: 4258689 - DNA, 24 bp, Homo sapiens
tctagtgggacagcccagagcctg

SEQ ID NO: 4258690 - DNA, 18 bp, Homo sapiens
tctccagtttgcacctgt

SEQ ID NO: 4258691 - DNA, 19 bp, Homo sapiens
tctctaggcctctccagtt

SEQ ID NO: 4258692 - DNA, 22 bp, Homo sapiens
tctgggctgtaacgtggcactg

SEQ ID NO: 4258693 - DNA, 18 bp, Homo sapiens
tctgtgttttgaaagaat

SEQ ID NO: 4258694 - DNA, 12 bp, Homo sapiens
tcttaaactaaa

SEQ ID NO: 4258695 - DNA, 16 bp, Homo sapiens
tgaagccgactctggc

SEQ ID NO: 4258696 - DNA, 20 bp, Homo sapiens
tgaagccgactctggccctg

SEQ ID NO: 4258697 - DNA, 14 bp, Homo sapiens
tgacagtgttttta

SEQ ID NO: 4258698 - DNA, 17 bp, Homo sapiens
tgactaacaggccaaag

SEQ ID NO: 4258699 - DNA, 17 bp, Homo sapiens
tgaggactgatttcaga

SEQ ID NO: 4258700 - DNA, 14 bp, Homo sapiens
tgatacatttttgt

SEQ ID NO: 4258701 - DNA, 20 bp, Homo sapiens
tgatctacttctgtaattgt

SEQ ID NO: 4258702 - DNA, 21 bp, Homo sapiens
tgatctacttctgtaattgtg

SEQ ID NO: 4258703 - DNA, 17 bp, Homo sapiens
tgattttttttaattac

SEQ ID NO: 4258704 - DNA, 17 bp, Homo sapiens
tgcactaacagagtggc

SEQ ID NO: 4258705 - DNA, 18 bp, Homo sapiens
tgcagcaaacactccacc

SEQ ID NO: 4258706 - DNA, 15 bp, Homo sapiens
tgcagcacctccagg

SEQ ID NO: 4258707 - DNA, 21 bp, Homo sapiens
tgcccagaggactcccaaccc

SEQ ID NO: 4258708 - DNA, 13 bp, Homo sapiens
tgctaatttgttt

SEQ ID NO: 4258709 - DNA, 14 bp, Homo sapiens
tgctctagtgggac

SEQ ID NO: 4258710 - DNA, 21 bp, Homo sapiens
tgctggactggaggcccctgg

SEQ ID NO: 4258711 - DNA, 14 bp, Homo sapiens
tgctgtcttaaact

SEQ ID NO: 4258712 - DNA, 21 bp, Homo sapiens
tgctgtcttaaactaaatgtg

SEQ ID NO: 4258713 - DNA, 21 bp, Homo sapiens
tgcttctctagctctctaggc

SEQ ID NO: 4258714 - DNA, 18 bp, Homo sapiens
gctgtgtgaatacctgct

SEQ ID NO: 4258715 - DNA, 18 bp, Homo sapiens
gctgtgtttgcagcctgc

SEQ ID NO: 4258716 - DNA, 23 bp, Homo sapiens
gcttcctttcctgtgtgtactct

SEQ ID NO: 4258717 - DNA, 18 bp, Homo sapiens
gcttctctagctctctag

SEQ ID NO: 4258718 - DNA, 19 bp, Homo sapiens
gcttctctagctctctagg

SEQ ID NO: 4258719 - DNA, 22 bp, Homo sapiens
gcttctctagctctctaggcct

SEQ ID NO: 4258720 - DNA, 14 bp, Homo sapiens
ggaatgctggactg

SEQ ID NO: 4258721 - DNA, 19 bp, Homo sapiens
ggaatggatttttctttaa

SEQ ID NO: 4258722 - DNA, 22 bp, Homo sapiens
ggaatggatttttctttaactg

SEQ ID NO: 4258723 - DNA, 14 bp, Homo sapiens
ggacgttgttttgg

SEQ ID NO: 4258724 - DNA, 15 bp, Homo sapiens
ggaggcccctggagc

SEQ ID NO: 4258725 - DNA, 12 bp, Homo sapiens
ggattctttaaa

SEQ ID NO: 4258726 - DNA, 17 bp, Homo sapiens
ggatttaaaagcctgct

SEQ ID NO: 4258727 - DNA, 17 bp, Homo sapiens
ggcaagagggtgacagc

SEQ ID NO: 4258728 - DNA, 17 bp, Homo sapiens
ggccagcaacgcttgta

SEQ ID NO: 4258729 - DNA, 21 bp, Homo sapiens
ggcctgttgctatagagccta

SEQ ID NO: 4258730 - DNA, 13 bp, Homo sapiens
ggctaatttaaca

SEQ ID NO: 4258731 - DNA, 14 bp, Homo sapiens
ggctcctgttttgc

SEQ ID NO: 4258732 - DNA, 16 bp, Homo sapiens
gggacagcccagagcc

SEQ ID NO: 4258733 - DNA, 14 bp, Homo sapiens
gggcactgggctgt

SEQ ID NO: 4258734 - DNA, 17 bp, Homo sapiens
gggccttagggcactgg

SEQ ID NO: 4258735 - DNA, 19 bp, Homo sapiens
gggctgtaacgtggcactg

SEQ ID NO: 4258736 - DNA, 15 bp, Homo sapiens
gggtttattcactga

SEQ ID NO: 4258737 - DNA, 19 bp, Homo sapiens
gtaaggatccggaaagaag

SEQ ID NO: 4258738 - DNA, 21 bp, Homo sapiens
gtaattgtgtggattctttaa

SEQ ID NO: 4258739 - DNA, 23 bp, Homo sapiens
gtacgaacctacagttttaactg

SEQ ID NO: 4258740 - DNA, 16 bp, Homo sapiens
gtagaactcactctgg

SEQ ID NO: 4258741 - DNA, 19 bp, Homo sapiens
gtagaactcactctgggct

SEQ ID NO: 4258742 - DNA, 16 bp, Homo sapiens
gtatatggtatttatt

SEQ ID NO: 4258743 - DNA, 18 bp, Homo sapiens
gtcaagaaacagccagca

SEQ ID NO: 4258744 - DNA, 22 bp, Homo sapiens
gtcttaaactaaatgtgcaata

SEQ ID NO: 4258745 - DNA, 16 bp, Homo sapiens
gtggaacgaaaatgaa

SEQ ID NO: 4258746 - DNA, 14 bp, Homo sapiens
gtggatattgttac

SEQ ID NO: 4258747 - DNA, 12 bp, Homo sapiens
gtggccccaccc

SEQ ID NO: 4258748 - DNA, 18 bp, Homo sapiens
gtgggacagcccagagcc

SEQ ID NO: 4258749 - DNA, 14 bp, Homo sapiens
gtgttcattgtttc

SEQ ID NO: 4258750 - DNA, 20 bp, Homo sapiens
gtgttttgaaagaatagaac

SEQ ID NO: 4258751 - DNA, 23 bp, Homo sapiens
gttcaacaaagaaacaaagatgt

SEQ ID NO: 4258752 - DNA, 21 bp, Homo sapiens
gttccattgaagccgactctg

SEQ ID NO: 4258753 - DNA, 23 bp, Homo sapiens
gttgccatcctaccgtcttttcc

SEQ ID NO: 4258754 - DNA, 17 bp, Homo sapiens
gttggaatggatttttc

SEQ ID NO: 4258755 - DNA, 18 bp, Homo sapiens
gtttcaacggaaagtgct

SEQ ID NO: 4258756 - DNA, 22 bp, Homo sapiens
gtttgtagtgccactgttgttt

SEQ ID NO: 4258757 - DNA, 22 bp, Homo sapiens
gttttgcacagccaaatttaaa

SEQ ID NO: 4258758 - DNA, 21 bp, Homo sapiens
taaaacaggttataacagtgt

SEQ ID NO: 4258759 - DNA, 18 bp, Homo sapiens
taaacaacagctgaagca

SEQ ID NO: 4258760 - DNA, 13 bp, Homo sapiens
taaactaaatgtg

SEQ ID NO: 4258761 - DNA, 19 bp, Homo sapiens
taacaagaactttaaattg

SEQ ID NO: 4258762 - DNA, 15 bp, Homo sapiens
taacaggccaaagag

SEQ ID NO: 4258763 - DNA, 18 bp, Homo sapiens
taagcagtgtctgtgttt

SEQ ID NO: 4258764 - DNA, 18 bp, Homo sapiens
taaggatccggaaagaag

SEQ ID NO: 4258765 - DNA, 22 bp, Homo sapiens
taatgtttctggatttcatact

SEQ ID NO: 4258766 - DNA, 14 bp, Homo sapiens
tacagttttaactg

SEQ ID NO: 4258767 - DNA, 17 bp, Homo sapiens
tacagttttaactgtgg

SEQ ID NO: 4258768 - DNA, 15 bp, Homo sapiens
tacccaaactgcttt

SEQ ID NO: 4258769 - DNA, 21 bp, Homo sapiens
tacctgctcacgtcaaatgca

SEQ ID NO: 4258770 - DNA, 16 bp, Homo sapiens
tactaaaaaaaagatg

SEQ ID NO: 4258771 - DNA, 18 bp, Homo sapiens
tactaaaaaaaagatgaa

SEQ ID NO: 4258772 - DNA, 16 bp, Homo sapiens
tactgcagcacctcca

SEQ ID NO: 4258773 - DNA, 21 bp, Homo sapiens
tactgcagcacctccaggcct

SEQ ID NO: 4258774 - DNA, 16 bp, Homo sapiens
tactgtaacattcagg

SEQ ID NO: 4258775 - DNA, 16 bp, Homo sapiens
tacttctgtaattgtg

SEQ ID NO: 4258776 - DNA, 21 bp, Homo sapiens
tactttagaagcctgcataat

SEQ ID NO: 4258777 - DNA, 20 bp, Homo sapiens
tactttgacagtgtttttag

SEQ ID NO: 4258778 - DNA, 20 bp, Homo sapiens
tagaactcactctgggctgt

SEQ ID NO: 4258779 - DNA, 11 bp, Homo sapiens
tagatttatgg

SEQ ID NO: 4258780 - DNA, 20 bp, Homo sapiens
tagcctaaggctcctgtttt

SEQ ID NO: 4258781 - DNA, 14 bp, Homo sapiens
tagctctctaggcc

SEQ ID NO: 4258782 - DNA, 14 bp, Homo sapiens
tagggcactgggct

SEQ ID NO: 4258783 - DNA, 22 bp, Homo sapiens
tatattcaggacttgaaagaaa

SEQ ID NO: 4258784 - DNA, 21 bp, Homo sapiens
tatggtatttattttttcttt

SEQ ID NO: 4258785 - DNA, 21 bp, Homo sapiens
tatgtcaataaacaacagctg

SEQ ID NO: 4258786 - DNA, 13 bp, Homo sapiens
tcaagaaacagcc

SEQ ID NO: 4258787 - DNA, 17 bp, Homo sapiens
tcaataaacaacagctg

SEQ ID NO: 4258788 - DNA, 13 bp, Homo sapiens
tcacctgcactaa

SEQ ID NO: 4258789 - DNA, 20 bp, Homo sapiens
cgcttgtagaactcactctg

SEQ ID NO: 4258790 - DNA, 22 bp, Homo sapiens
cgcttgtagaactcactctggg

SEQ ID NO: 4258791 - DNA, 23 bp, Homo sapiens
cgtccatcacgttagctgtccca

SEQ ID NO: 4258792 - DNA, 14 bp, Homo sapiens
ctaaaaaaaagatg

SEQ ID NO: 4258793 - DNA, 17 bp, Homo sapiens
ctacagttttaactgtg

SEQ ID NO: 4258794 - DNA, 18 bp, Homo sapiens
ctacagttttaactgtgg

SEQ ID NO: 4258795 - DNA, 20 bp, Homo sapiens
ctacagttttaactgtggat

SEQ ID NO: 4258796 - DNA, 21 bp, Homo sapiens
ctactgcagcacctccaggcc

SEQ ID NO: 4258797 - DNA, 15 bp, Homo sapiens
ctagctctctaggcc

SEQ ID NO: 4258798 - DNA, 19 bp, Homo sapiens
ctaggtacgatgacagtgt

SEQ ID NO: 4258799 - DNA, 20 bp, Homo sapiens
ctaggtacgatgacagtgtt

SEQ ID NO: 4258800 - DNA, 22 bp, Homo sapiens
ctagtgggacagcccagagcct

SEQ ID NO: 4258801 - DNA, 23 bp, Homo sapiens
ctagtgggacagcccagagcctg

SEQ ID NO: 4258802 - DNA, 23 bp, Homo sapiens
ctagttatacttatttgtatatg

SEQ ID NO: 4258803 - DNA, 12 bp, Homo sapiens
ctatctgtattc

SEQ ID NO: 4258804 - DNA, 15 bp, Homo sapiens
ctcaatccctgagga

SEQ ID NO: 4258805 - DNA, 17 bp, Homo sapiens
ctcagctgtcctgcagc

SEQ ID NO: 4258806 - DNA, 18 bp, Homo sapiens
ctcagctgtcctgcagca

SEQ ID NO: 4258807 - DNA, 15 bp, Homo sapiens
ctcagtttcttgctt

SEQ ID NO: 4258808 - DNA, 14 bp, Homo sapiens
ctccactcagctgt

SEQ ID NO: 4258809 - DNA, 20 bp, Homo sapiens
ctccagtttgcacctgtccc

SEQ ID NO: 4258810 - DNA, 14 bp, Homo sapiens
ctcccaaccctggc

SEQ ID NO: 4258811 - DNA, 17 bp, Homo sapiens
ctctaaaattataaatg

SEQ ID NO: 4258812 - DNA, 16 bp, Homo sapiens
ctctaggcctctccag

SEQ ID NO: 4258813 - DNA, 18 bp, Homo sapiens
ctctagtgggacagccca

SEQ ID NO: 4258814 - DNA, 20 bp, Homo sapiens
ctctccagtttgcacctgtc

SEQ ID NO: 4258815 - DNA, 22 bp, Homo sapiens
ctctccttcatgacagcctcca

SEQ ID NO: 4258816 - DNA, 13 bp, Homo sapiens
ctctggccctggc

SEQ ID NO: 4258817 - DNA, 20 bp, Homo sapiens
ctctggccctggcccttact

SEQ ID NO: 4258818 - DNA, 23 bp, Homo sapiens
ctctgggctgtaacgtggcactg

SEQ ID NO: 4258819 - DNA, 18 bp, Homo sapiens
ctgaattatctatttcat

SEQ ID NO: 4258820 - DNA, 17 bp, Homo sapiens
ctgcagcaaacactcca

SEQ ID NO: 4258821 - DNA, 14 bp, Homo sapiens
ctgcagcacctcca

SEQ ID NO: 4258822 - DNA, 22 bp, Homo sapiens
ctgcataatgtttctggatttc

SEQ ID NO: 4258823 - DNA, 13 bp, Homo sapiens
ctgcccagttgca

SEQ ID NO: 4258824 - DNA, 17 bp, Homo sapiens
ctgctctagtgggacag

SEQ ID NO: 4258825 - DNA, 21 bp, Homo sapiens
ctgctctagtgggacagccca

SEQ ID NO: 4258826 - DNA, 23 bp, Homo sapiens
ctgctctagtgggacagcccaga

SEQ ID NO: 4258827 - DNA, 22 bp, Homo sapiens
ctgctttttccaactcagaaat

SEQ ID NO: 4258828 - DNA, 14 bp, Homo sapiens
ctggaggcccctgg

SEQ ID NO: 4258829 - DNA, 19 bp, Homo sapiens
ctggaggcccctggagcca

SEQ ID NO: 4258830 - DNA, 20 bp, Homo sapiens
ctggaggcccctggagccag

SEQ ID NO: 4258831 - DNA, 19 bp, Homo sapiens
ctggcccttacttgcttct

SEQ ID NO: 4258832 - DNA, 20 bp, Homo sapiens
ctggtaggttgggacaccag

SEQ ID NO: 4258833 - DNA, 15 bp, Homo sapiens
ctgtaaaacaggtta

SEQ ID NO: 4258834 - DNA, 15 bp, Homo sapiens
ctgtaacattcagga

SEQ ID NO: 4258835 - DNA, 21 bp, Homo sapiens
ctgtaaggatccggaaagaag

SEQ ID NO: 4258836 - DNA, 12 bp, Homo sapiens
ctgtaattgtgt

SEQ ID NO: 4258837 - DNA, 20 bp, Homo sapiens
ctgtccagttcctttagaaa

SEQ ID NO: 4258838 - DNA, 12 bp, Homo sapiens
ctgtccccaccc

SEQ ID NO: 4258839 - DNA, 23 bp, Homo sapiens
ctgtcctgcagcaaacactccac

SEQ ID NO: 4258840 - DNA, 19 bp, Homo sapiens
ctgtcttaaactaaatgtg

SEQ ID NO: 4258841 - DNA, 21 bp, Homo sapiens
ctgtcttaaactaaatgtgca

SEQ ID NO: 4258842 - DNA, 18 bp, Homo sapiens
ctgtgtgaatacctgctc

SEQ ID NO: 4258843 - DNA, 19 bp, Homo sapiens
ctgtgtgaatacctgctca

SEQ ID NO: 4258844 - DNA, 22 bp, Homo sapiens
ctgtgttactaaaaaaaagatg

SEQ ID NO: 4258845 - DNA, 22 bp, Homo sapiens
ctgtgttttgaaagaatagaac

SEQ ID NO: 4258846 - DNA, 22 bp, Homo sapiens
ctgtttgcatttgatacatttt

SEQ ID NO: 4258847 - DNA, 14 bp, Homo sapiens
cttaaactaaatgt

SEQ ID NO: 4258848 - DNA, 16 bp, Homo sapiens
cttcccccagcccatc

SEQ ID NO: 4258849 - DNA, 16 bp, Homo sapiens
cttgaaaaaaaacagt

SEQ ID NO: 4258850 - DNA, 19 bp, Homo sapiens
cttgcttctctagctctct

SEQ ID NO: 4258851 - DNA, 18 bp, Homo sapiens
cttgcttggggaacttgt

SEQ ID NO: 4258852 - DNA, 14 bp, Homo sapiens
ctttagaagcctgc

SEQ ID NO: 4258853 - DNA, 21 bp, Homo sapiens
ctttgacctaaattatttact

SEQ ID NO: 4258854 - DNA, 20 bp, Homo sapiens
gaaaagtatattgataacct

SEQ ID NO: 4258855 - DNA, 13 bp, Homo sapiens
gaaaatgaaagct

SEQ ID NO: 4258856 - DNA, 12 bp, Homo sapiens
gaaacagccagc

SEQ ID NO: 4258857 - DNA, 15 bp, Homo sapiens
gaaacagccagcaag

SEQ ID NO: 4258858 - DNA, 18 bp, Homo sapiens
gaaattacctgtggatat

SEQ ID NO: 4258859 - DNA, 19 bp, Homo sapiens
gaaattacctgtggatatt

SEQ ID NO: 4258860 - DNA, 18 bp, Homo sapiens
gaacctacagttttaact

SEQ ID NO: 4258861 - DNA, 14 bp, Homo sapiens
gaagccgactctgg

SEQ ID NO: 4258862 - DNA, 15 bp, Homo sapiens
gaagccgactctggc

SEQ ID NO: 4258863 - DNA, 16 bp, Homo sapiens
gaagccgactctggcc

SEQ ID NO: 4258864 - DNA, 17 bp, Homo sapiens
gaagccgactctggccc

SEQ ID NO: 4258865 - DNA, 21 bp, Homo sapiens
gaagccgactctggccctggc

SEQ ID NO: 4258866 - DNA, 20 bp, Homo sapiens
gaaggaggaatgctggactg

SEQ ID NO: 4258867 - DNA, 13 bp, Homo sapiens
gaatacctgctca

SEQ ID NO: 4258868 - DNA, 18 bp, Homo sapiens
gaatgctggactggaggc

SEQ ID NO: 4258869 - DNA, 21 bp, Homo sapiens
gaatggatttttctttaactg

SEQ ID NO: 4258870 - DNA, 14 bp, Homo sapiens
gaattataactgta

SEQ ID NO: 4258871 - DNA, 11 bp, Homo sapiens
gacagcccaga

SEQ ID NO: 4258872 - DNA, 20 bp, Homo sapiens
gacagtgttccccgatacca

SEQ ID NO: 4258873 - DNA, 21 bp, Homo sapiens
gacagtgttccccgataccat

SEQ ID NO: 4258874 - DNA, 15 bp, Homo sapiens
gactcccaaccctgg

SEQ ID NO: 4258875 - DNA, 12 bp, Homo sapiens
gactctggccct

SEQ ID NO: 4258876 - DNA, 14 bp, Homo sapiens
gactctggccctgg

SEQ ID NO: 4258877 - DNA, 16 bp, Homo sapiens
gactggaggcccctgg

SEQ ID NO: 4258878 - DNA, 23 bp, Homo sapiens
gactggaggcccctggagccaga

SEQ ID NO: 4258879 - DNA, 15 bp, Homo sapiens
gagagatcaaagatg

SEQ ID NO: 4258880 - DNA, 17 bp, Homo sapiens
gagcccctcctccagcc

SEQ ID NO: 4258881 - DNA, 19 bp, Homo sapiens
gagcgagagatcaaagatg

SEQ ID NO: 4258882 - DNA, 17 bp, Homo sapiens
gaggaatgctggactgg

SEQ ID NO: 4258883 - DNA, 21 bp, Homo sapiens
gaggactcccaaccctggctt

SEQ ID NO: 4258884 - DNA, 17 bp, Homo sapiens
gaggcccctggagccag

SEQ ID NO: 4258885 - DNA, 16 bp, Homo sapiens
gagtgactacacacag

SEQ ID NO: 4258886 - DNA, 18 bp, Homo sapiens
gagttaggggccttaggg

SEQ ID NO: 4258887 - DNA, 16 bp, Homo sapiens
gataaccttgaaaaaa

SEQ ID NO: 4258888 - DNA, 18 bp, Homo sapiens
gatcaacgcctcactgaa

SEQ ID NO: 4258889 - DNA, 14 bp, Homo sapiens
gatccggaaagaag

SEQ ID NO: 4258890 - DNA, 21 bp, Homo sapiens
gatgaaaagtatattgataac

SEQ ID NO: 4258891 - DNA, 23 bp, Homo sapiens
gatgaaaagtatattgataacct

SEQ ID NO: 4258892 - DNA, 18 bp, Homo sapiens
gatgcccagaggactccc

SEQ ID NO: 4258893 - DNA, 16 bp, Homo sapiens
gatttaaaagcctgct

SEQ ID NO: 4258894 - DNA, 14 bp, Homo sapiens
gcaaacactccacc

SEQ ID NO: 4258895 - DNA, 17 bp, Homo sapiens
gcacagccaaatttaaa

SEQ ID NO: 4258896 - DNA, 13 bp, Homo sapiens
gcacctccaggcc

SEQ ID NO: 4258897 - DNA, 11 bp, Homo sapiens
gcacctgtccc

SEQ ID NO: 4258898 - DNA, 21 bp, Homo sapiens
gcacctgtccccaccctccac

SEQ ID NO: 4258899 - DNA, 19 bp, Homo sapiens
gcactggtaggttgggaca

SEQ ID NO: 4258900 - DNA, 22 bp, Homo sapiens
gcactggtaggttgggacacca

SEQ ID NO: 4258901 - DNA, 14 bp, Homo sapiens
gcagacgtccatca

SEQ ID NO: 4258902 - DNA, 21 bp, Homo sapiens
gcagcctgctctagtgggaca

SEQ ID NO: 4258903 - DNA, 12 bp, Homo sapiens
gccagcaacgct

SEQ ID NO: 4258904 - DNA, 19 bp, Homo sapiens
gcccatccattaggccagc

SEQ ID NO: 4258905 - DNA, 21 bp, Homo sapiens
gcccctcctccagcccctgtc

SEQ ID NO: 4258906 - DNA, 13 bp, Homo sapiens
gcccctggagcca

SEQ ID NO: 4258907 - DNA, 15 bp, Homo sapiens
gcccctgtcccaccc

SEQ ID NO: 4258908 - DNA, 19 bp, Homo sapiens
gcctgcccagttgcactca

SEQ ID NO: 4258909 - DNA, 19 bp, Homo sapiens
gctctctaggcctctccag

SEQ ID NO: 4258910 - DNA, 11 bp, Homo sapiens
gctgatttttt

SEQ ID NO: 4258911 - DNA, 20 bp, Homo sapiens
gctggactggaggcccctgg

SEQ ID NO: 4258912 - DNA, 16 bp, Homo sapiens
gctgtaacgtggcact

SEQ ID NO: 4258913 - DNA, 23 bp, Homo sapiens
gctgtaaggatccggaaagaaga

SEQ ID NO: 4258914 - DNA, 17 bp, Homo sapiens
gctgtgtttgcagcctg

SEQ ID NO: 4258915 - DNA, 19 bp, Homo sapiens
gctgtgtttgcagcctgct

SEQ ID NO: 4258916 - DNA, 18 bp, Homo sapiens
gcttgtagaactcactct

SEQ ID NO: 4258917 - DNA, 22 bp, Homo sapiens
gcttgtagaactcactctgggc

SEQ ID NO: 4258918 - DNA, 12 bp, Homo sapiens
aaaaaaaacagt

SEQ ID NO: 4258919 - DNA, 18 bp, Homo sapiens
aaaaaaacagtggatcac

SEQ ID NO: 4258920 - DNA, 13 bp, Homo sapiens
aaaacacacaggt

SEQ ID NO: 4258921 - DNA, 20 bp, Homo sapiens
aaacactccaccctccacct

SEQ ID NO: 4258922 - DNA, 23 bp, Homo sapiens
aaacagtggatcacaaagtggaa

SEQ ID NO: 4258923 - DNA, 22 bp, Homo sapiens
aaactgatccagtataagacta

SEQ ID NO: 4258924 - DNA, 21 bp, Homo sapiens
aaagtgtgaaataaatttttt

SEQ ID NO: 4258925 - DNA, 14 bp, Homo sapiens
aaatgaaagctact

SEQ ID NO: 4258926 - DNA, 12 bp, Homo sapiens
aacagccagcaa

SEQ ID NO: 4258927 - DNA, 23 bp, Homo sapiens
aacgcttgtagaactcactctgg

SEQ ID NO: 4258928 - DNA, 15 bp, Homo sapiens
aactagcattgtaaa

SEQ ID NO: 4258929 - DNA, 18 bp, Homo sapiens
aactgccgtaatttaact

SEQ ID NO: 4258930 - DNA, 11 bp, Homo sapiens
aactgtggata

SEQ ID NO: 4258931 - DNA, 13 bp, Homo sapiens
aactgtggatatt

SEQ ID NO: 4258932 - DNA, 14 bp, Homo sapiens
aactgtggatattg

SEQ ID NO: 4258933 - DNA, 14 bp, Homo sapiens
aagaaacaaagatg

SEQ ID NO: 4258934 - DNA, 14 bp, Homo sapiens
aagaaacagccagc

SEQ ID NO: 4258935 - DNA, 13 bp, Homo sapiens
aagaaatggtgaa

SEQ ID NO: 4258936 - DNA, 17 bp, Homo sapiens
aagaactttaaattgtg

SEQ ID NO: 4258937 - DNA, 23 bp, Homo sapiens
aagaagagcgagagatcaaagat

SEQ ID NO: 4258938 - DNA, 11 bp, Homo sapiens
aagaatagaac

SEQ ID NO: 4258939 - DNA, 23 bp, Homo sapiens
aagggcctgcccagttgcactca

SEQ ID NO: 4258940 - DNA, 23 bp, Homo sapiens
aagtttcattctccctttcacta

SEQ ID NO: 4258941 - DNA, 14 bp, Homo sapiens
aatagaaggtgatg

SEQ ID NO: 4258942 - DNA, 19 bp, Homo sapiens
aatatattttgtttacaaa

SEQ ID NO: 4258943 - DNA, 13 bp, Homo sapiens
aatcagaattaga

SEQ ID NO: 4258944 - DNA, 16 bp, Homo sapiens
aatctttataaatgta

SEQ ID NO: 4258945 - DNA, 18 bp, Homo sapiens
aatgaaagctactcatag

SEQ ID NO: 4258946 - DNA, 14 bp, Homo sapiens
aatgctggactgga

SEQ ID NO: 4258947 - DNA, 22 bp, Homo sapiens
aatgctggactggaggcccctg

SEQ ID NO: 4258948 - DNA, 23 bp, Homo sapiens
aatgctggactggaggcccctgg

SEQ ID NO: 4258949 - DNA, 15 bp, Homo sapiens
aatgtgcaatagaag

SEQ ID NO: 4258950 - DNA, 16 bp, Homo sapiens
aatgtttctggatttc

SEQ ID NO: 4258951 - DNA, 13 bp, Homo sapiens
aattataaatgac

SEQ ID NO: 4258952 - DNA, 15 bp, Homo sapiens
acagcaaacaggtgc

SEQ ID NO: 4258953 - DNA, 15 bp, Homo sapiens
acagccaaatttaaa

SEQ ID NO: 4258954 - DNA, 14 bp, Homo sapiens
acagccagcaagag

SEQ ID NO: 4258955 - DNA, 13 bp, Homo sapiens
acagcccagagcc

SEQ ID NO: 4258956 - DNA, 18 bp, Homo sapiens
acaggttataacagtgtt

SEQ ID NO: 4258957 - DNA, 18 bp, Homo sapiens
acagtggatcacaaagtg

SEQ ID NO: 4258958 - DNA, 18 bp, Homo sapiens
acattcaacagagactga

SEQ ID NO: 4258959 - DNA, 19 bp, Homo sapiens
acattcaggaattcttgga

SEQ ID NO: 4258960 - DNA, 23 bp, Homo sapiens
accagggaagaagatcaacgcct

SEQ ID NO: 4258961 - DNA, 11 bp, Homo sapiens
acctacagttt

SEQ ID NO: 4258962 - DNA, 15 bp, Homo sapiens
acctccaggcctgtt

SEQ ID NO: 4258963 - DNA, 18 bp, Homo sapiens
acctgcactaacagagtg

SEQ ID NO: 4258964 - DNA, 14 bp, Homo sapiens
acctgtccccaccc

SEQ ID NO: 4258965 - DNA, 21 bp, Homo sapiens
acctgtccccaccctccactc

SEQ ID NO: 4258966 - DNA, 22 bp, Homo sapiens
accttgaaaaaaaacagtggat

SEQ ID NO: 4258967 - DNA, 19 bp, Homo sapiens
acgaacctacagttttaac

SEQ ID NO: 4258968 - DNA, 22 bp, Homo sapiens
acgcctcactgaaacatggctg

SEQ ID NO: 4258969 - DNA, 23 bp, Homo sapiens
acgcttgtagaactcactctggg

SEQ ID NO: 4258970 - DNA, 12 bp, Homo sapiens
actactgcagca

SEQ ID NO: 4258971 - DNA, 14 bp, Homo sapiens
actcactctgggct

SEQ ID NO: 4258972 - DNA, 15 bp, Homo sapiens
actctaaaattataa

SEQ ID NO: 4258973 - DNA, 12 bp, Homo sapiens
actctgggctgt

SEQ ID NO: 4258974 - DNA, 17 bp, Homo sapiens
actgaaacatggctgtg

SEQ ID NO: 4258975 - DNA, 12 bp, Homo sapiens
actgatttcaga

SEQ ID NO: 4258976 - DNA, 22 bp, Homo sapiens
actgcaaaaagaaaatctttat

SEQ ID NO: 4258977 - DNA, 12 bp, Homo sapiens
actgcagcacct

SEQ ID NO: 4258978 - DNA, 18 bp, Homo sapiens
actgcagcacctccaggc

SEQ ID NO: 4258979 - DNA, 15 bp, Homo sapiens
actgccgtaatttaa

SEQ ID NO: 4258980 - DNA, 16 bp, Homo sapiens
actgccgtaatttaac

SEQ ID NO: 4258981 - DNA, 15 bp, Homo sapiens
actggaggcccctgg

SEQ ID NO: 4258982 - DNA, 18 bp, Homo sapiens
actggaggcccctggagc

SEQ ID NO: 4258983 - DNA, 13 bp, Homo sapiens
actgtaaagatgt

SEQ ID NO: 4258984 - DNA, 12 bp, Homo sapiens
actgttggaatg

SEQ ID NO: 4258985 - DNA, 21 bp, Homo sapiens
acttctgtaattgtgtggatt

SEQ ID NO: 4258986 - DNA, 24 bp, Homo sapiens
acttgaatgctagttatacttatt

SEQ ID NO: 4258987 - DNA, 13 bp, Homo sapiens
actttaaattgtg

SEQ ID NO: 4258988 - DNA, 15 bp, Homo sapiens
actttagaagcctgc

SEQ ID NO: 4258989 - DNA, 22 bp, Homo sapiens
actttgacctaaattatttact

SEQ ID NO: 4258990 - DNA, 15 bp, Homo sapiens
agaaaatctttataa

SEQ ID NO: 4258991 - DNA, 15 bp, Homo sapiens
agaaacagccagcaa

SEQ ID NO: 4258992 - DNA, 18 bp, Homo sapiens
agaaattacctgtggata

SEQ ID NO: 4258993 - DNA, 22 bp, Homo sapiens
agaaattcaatttggatttaaa

SEQ ID NO: 4258994 - DNA, 15 bp, Homo sapiens
agaactcactctggg

SEQ ID NO: 4258995 - DNA, 15 bp, Homo sapiens
agagatcaaagatga

SEQ ID NO: 4258996 - DNA, 20 bp, Homo sapiens
agagcccctcctccagcccc

SEQ ID NO: 4258997 - DNA, 22 bp, Homo sapiens
agagcccctcctccagcccctg

SEQ ID NO: 4258998 - DNA, 19 bp, Homo sapiens
agagcgagagatcaaagat

SEQ ID NO: 4258999 - DNA, 18 bp, Homo sapiens
agatactaaggacgttgt

SEQ ID NO: 4259000 - DNA, 17 bp, Homo sapiens
agatgaatgtcctgaaa

SEQ ID NO: 4259001 - DNA, 15 bp, Homo sapiens
agatgtttatttcag

SEQ ID NO: 4259002 - DNA, 14 bp, Homo sapiens
agcaacgcttgtag

SEQ ID NO: 4259003 - DNA, 17 bp, Homo sapiens
agcacctccaggcctgt

SEQ ID NO: 4259004 - DNA, 12 bp, Homo sapiens
agccaaatttaa

SEQ ID NO: 4259005 - DNA, 19 bp, Homo sapiens
agccaaatttaaaactgtt

SEQ ID NO: 4259006 - DNA, 14 bp, Homo sapiens
agcccagagcctgg

SEQ ID NO: 4259007 - DNA, 17 bp, Homo sapiens
agcccagagcctggctg

SEQ ID NO: 4259008 - DNA, 21 bp, Homo sapiens
agcccagagcctggctgccca

SEQ ID NO: 4259009 - DNA, 21 bp, Homo sapiens
agcccctcctccagcccctgt

SEQ ID NO: 4259010 - DNA, 23 bp, Homo sapiens
agcccctcctccagcccctgtcc

SEQ ID NO: 4259011 - DNA, 14 bp, Homo sapiens
agcctacctgtatg

SEQ ID NO: 4259012 - DNA, 18 bp, Homo sapiens
agcgggggcctaaaaaaa

SEQ ID NO: 4259013 - DNA, 16 bp, Homo sapiens
agctctctaggcctct

SEQ ID NO: 4259014 - DNA, 18 bp, Homo sapiens
agctctctaggcctctcc

SEQ ID NO: 4259015 - DNA, 19 bp, Homo sapiens
agctctctaggcctctcca

SEQ ID NO: 4259016 - DNA, 14 bp, Homo sapiens
agctgtcctgcagc

SEQ ID NO: 4259017 - DNA, 15 bp, Homo sapiens
agctgtcctgcagca

SEQ ID NO: 4259018 - DNA, 15 bp, Homo sapiens
aggaatgctggactg

SEQ ID NO: 4259019 - DNA, 16 bp, Homo sapiens
aggaatgctggactgg

SEQ ID NO: 4259020 - DNA, 17 bp, Homo sapiens
aggactcccaaccctgg

SEQ ID NO: 4259021 - DNA, 18 bp, Homo sapiens
aggactcccaaccctggc

SEQ ID NO: 4259022 - DNA, 17 bp, Homo sapiens
aggaggaatgctggact

SEQ ID NO: 4259023 - DNA, 22 bp, Homo sapiens
aggaggaatgctggactggagg

SEQ ID NO: 4259024 - DNA, 21 bp, Homo sapiens
aggcacctacactcacctgca

SEQ ID NO: 4259025 - DNA, 12 bp, Homo sapiens
aggccagcaacg

SEQ ID NO: 4259026 - DNA, 14 bp, Homo sapiens
aggccagcaacgct

SEQ ID NO: 4259027 - DNA, 17 bp, Homo sapiens
aggccagcaacgcttgt

SEQ ID NO: 4259028 - DNA, 16 bp, Homo sapiens
aggcccctggagccag

SEQ ID NO: 4259029 - DNA, 21 bp, Homo sapiens
aggcctctccagtttgcacct

SEQ ID NO: 4259030 - DNA, 21 bp, Homo sapiens
aggggccttagggcactgggc

SEQ ID NO: 4259031 - DNA, 22 bp, Homo sapiens
aggggccttagggcactgggct

SEQ ID NO: 4259032 - DNA, 21 bp, Homo sapiens
aggtgcaacagacttgaatgc

SEQ ID NO: 4259033 - DNA, 20 bp, Homo sapiens
aggtgctaatttgttttgga

SEQ ID NO: 4259034 - DNA, 16 bp, Homo sapiens
agtacgaacctacagt

SEQ ID NO: 4259035 - DNA, 17 bp, Homo sapiens
agtgccactgttgtttt

SEQ ID NO: 4259036 - DNA, 19 bp, Homo sapiens
agtgcggtttactcactgc

SEQ ID NO: 4259037 - DNA, 15 bp, Homo sapiens
agtgggacagcccag

SEQ ID NO: 4259038 - DNA, 22 bp, Homo sapiens
agtgggacagcccagagcctgg

SEQ ID NO: 4259039 - DNA, 16 bp, Homo sapiens
agtgtctgtgttttga

SEQ ID NO: 4259040 - DNA, 20 bp, Homo sapiens
agttatacttatttgtatat

SEQ ID NO: 4259041 - DNA, 14 bp, Homo sapiens
agttcctttagaaa

SEQ ID NO: 4259042 - DNA, 15 bp, Homo sapiens
agttgcactcaggtg

SEQ ID NO: 4259043 - DNA, 23 bp, Homo sapiens
agttgtgtttcaacggaaagtgc

SEQ ID NO: 4259044 - DNA, 18 bp, Homo sapiens
agttttaactgtggatat

SEQ ID NO: 4259045 - DNA, 16 bp, Homo sapiens
ataaacaacagctgaa

SEQ ID NO: 4259046 - DNA, 12 bp, Homo sapiens
atcaaagatgaa

SEQ ID NO: 4259047 - DNA, 13 bp, Homo sapiens
atccagtataaga

SEQ ID NO: 4259048 - DNA, 17 bp, Homo sapiens
atccattaggccagcaa

SEQ ID NO: 4259049 - DNA, 19 bp, Homo sapiens
atccattaggccagcaacg

SEQ ID NO: 4259050 - DNA, 22 bp, Homo sapiens
atccctgaggactgatttcaga

SEQ ID NO: 4259051 - DNA, 19 bp, Homo sapiens
atctacttctgtaattgtg

SEQ ID NO: 4259052 - DNA, 20 bp, Homo sapiens
atctacttctgtaattgtgt

SEQ ID NO: 4259053 - DNA, 17 bp, Homo sapiens
atgacagtgttccccga

SEQ ID NO: 4259054 - DNA, 14 bp, Homo sapiens
atgcatacaagttt

SEQ ID NO: 4259055 - DNA, 16 bp, Homo sapiens
atgcctatggtggatc

SEQ ID NO: 4259056 - DNA, 16 bp, Homo sapiens
atgctggactggaggc

SEQ ID NO: 4259057 - DNA, 15 bp, Homo sapiens
atggatttttcttta

SEQ ID NO: 4259058 - DNA, 17 bp, Homo sapiens
atggcagggggtggaat

SEQ ID NO: 4259059 - DNA, 24 bp, Homo sapiens
atggcagggggtggaattattact

SEQ ID NO: 4259060 - DNA, 20 bp, Homo sapiens
atggctgtgtttgcagcctg

SEQ ID NO: 4259061 - DNA, 14 bp, Homo sapiens
atgtggccccaccc

SEQ ID NO: 4259062 - DNA, 22 bp, Homo sapiens
atgtgttggggaagggcctgcc

SEQ ID NO: 4259063 - DNA, 14 bp, Homo sapiens
atgttaagttatat

SEQ ID NO: 4259064 - DNA, 22 bp, Homo sapiens
atgttgccatcctaccgtcttt

SEQ ID NO: 4259065 - DNA, 14 bp, Homo sapiens
atgtttatttcagg

SEQ ID NO: 4259066 - DNA, 14 bp, Homo sapiens
attacctgtggata

SEQ ID NO: 4259067 - DNA, 23 bp, Homo sapiens
attactttggggctaatttaaca

SEQ ID NO: 4259068 - DNA, 22 bp, Homo sapiens
attagaaattacctgtggatat

SEQ ID NO: 4259069 - DNA, 18 bp, Homo sapiens
attgaagccgactctggc

SEQ ID NO: 4259070 - DNA, 15 bp, Homo sapiens
atttatggttgttaa

SEQ ID NO: 4259071 - DNA, 15 bp, Homo sapiens
atttgttttggatat

SEQ ID NO: 4259072 - DNA, 16 bp, Homo sapiens
atttttctttaactgc

SEQ ID NO: 4259073 - DNA, 21 bp, Homo sapiens
caaaaatttctgtaaaacagg

SEQ ID NO: 4259074 - DNA, 16 bp, Homo sapiens
caaagaaacaaagatg

SEQ ID NO: 4259075 - DNA, 17 bp, Homo sapiens
caaagaaacaaagatgt

SEQ ID NO: 4259076 - DNA, 14 bp, Homo sapiens
caaagtggaacgaa

SEQ ID NO: 4259077 - DNA, 15 bp, Homo sapiens
caaagtggaacgaaa

SEQ ID NO: 4259078 - DNA, 20 bp, Homo sapiens
caacagagactgaatagata

SEQ ID NO: 4259079 - DNA, 14 bp, Homo sapiens
caacagctgaagca

SEQ ID NO: 4259080 - DNA, 23 bp, Homo sapiens
caacgcttgtagaactcactctg

SEQ ID NO: 4259081 - DNA, 19 bp, Homo sapiens
caagaaacagccagcaaga

SEQ ID NO: 4259082 - DNA, 16 bp, Homo sapiens
cacagccaaatttaaa

SEQ ID NO: 4259083 - DNA, 19 bp, Homo sapiens
cacagtacgaacctacagt

SEQ ID NO: 4259084 - DNA, 15 bp, Homo sapiens
caccagggaagaaga

SEQ ID NO: 4259085 - DNA, 12 bp, Homo sapiens
cacccccttccc

SEQ ID NO: 4259086 - DNA, 13 bp, Homo sapiens
cacccccttcccc

SEQ ID NO: 4259087 - DNA, 14 bp, Homo sapiens
cacctccaggcctg

SEQ ID NO: 4259088 - DNA, 22 bp, Homo sapiens
cacctgtccccaccctccactc

SEQ ID NO: 4259089 - DNA, 20 bp, Homo sapiens
cacgtcaaatgcatacaagt

SEQ ID NO: 4259090 - DNA, 14 bp, Homo sapiens
cactaacagagtgg

SEQ ID NO: 4259091 - DNA, 16 bp, Homo sapiens
cactactgcagcacct

SEQ ID NO: 4259092 - DNA, 12 bp, Homo sapiens
cactcacctgca

SEQ ID NO: 4259093 - DNA, 18 bp, Homo sapiens
cagagcccctcctccagc

SEQ ID NO: 4259094 - DNA, 21 bp, Homo sapiens
cagagcccctcctccagcccc

SEQ ID NO: 4259095 - DNA, 19 bp, Homo sapiens
cagaggactcccaaccctg

SEQ ID NO: 4259096 - DNA, 18 bp, Homo sapiens
cagatagtgtagctgagg

SEQ ID NO: 4259097 - DNA, 17 bp, Homo sapiens
cagcaacgcttgtagaa

SEQ ID NO: 4259098 - DNA, 14 bp, Homo sapiens
cagcacctccaggc

SEQ ID NO: 4259099 - DNA, 15 bp, Homo sapiens
cagcccagagcctgg

SEQ ID NO: 4259100 - DNA, 12 bp, Homo sapiens
cagcccatccat

SEQ ID NO: 4259101 - DNA, 18 bp, Homo sapiens
cagcccatccattaggcc

SEQ ID NO: 4259102 - DNA, 23 bp, Homo sapiens
cagcctgctctagtgggacagcc

SEQ ID NO: 4259103 - DNA, 16 bp, Homo sapiens
cagctgtcctgcagca

SEQ ID NO: 4259104 - DNA, 21 bp, Homo sapiens
caggaattcttggagaaaatg

SEQ ID NO: 4259105 - DNA, 15 bp, Homo sapiens
caggcattggatatt

SEQ ID NO: 4259106 - DNA, 23 bp, Homo sapiens
caggcctgttgctatagagccta

SEQ ID NO: 4259107 - DNA, 16 bp, Homo sapiens
caggttataacagtgt

SEQ ID NO: 4259108 - DNA, 17 bp, Homo sapiens
cagtggatcacaaagtg

SEQ ID NO: 4259109 - DNA, 18 bp, Homo sapiens
cagtttgcacctgtcccc

SEQ ID NO: 4259110 - DNA, 18 bp, Homo sapiens
cagtttgtagtgccactg

SEQ ID NO: 4259111 - DNA, 16 bp, Homo sapiens
cagttttaactgtgga

SEQ ID NO: 4259112 - DNA, 22 bp, Homo sapiens
cataatgtttctggatttcata

SEQ ID NO: 4259113 - DNA, 22 bp, Homo sapiens
catcatgtggccccacccaatc

SEQ ID NO: 4259114 - DNA, 13 bp, Homo sapiens
catgacagcctcc

SEQ ID NO: 4259115 - DNA, 19 bp, Homo sapiens
cattcaggaattcttggag

SEQ ID NO: 4259116 - DNA, 23 bp, Homo sapiens
cattgaagccgactctggccctg

SEQ ID NO: 4259117 - DNA, 18 bp, Homo sapiens
cattggatattttttact

SEQ ID NO: 4259118 - DNA, 17 bp, Homo sapiens
ccaaccctggcttgggg

SEQ ID NO: 4259119 - DNA, 19 bp, Homo sapiens
ccaccctccaccttccatt

SEQ ID NO: 4259120 - DNA, 19 bp, Homo sapiens
ccagagcctggctgcccat

SEQ ID NO: 4259121 - DNA, 21 bp, Homo sapiens
ccagagcctggctgcccatca

SEQ ID NO: 4259122 - DNA, 17 bp, Homo sapiens
ccagatagtgtagctga

SEQ ID NO: 4259123 - DNA, 17 bp, Homo sapiens
ccatccattaggccagc

SEQ ID NO: 4259124 - DNA, 18 bp, Homo sapiens
ccatccattaggccagca

SEQ ID NO: 4259125 - DNA, 16 bp, Homo sapiens
ccattaggccagcaac

SEQ ID NO: 4259126 - DNA, 20 bp, Homo sapiens
cccaaccctggcttggggtc

SEQ ID NO: 4259127 - DNA, 15 bp, Homo sapiens
cccactactgcagca

SEQ ID NO: 4259128 - DNA, 20 bp, Homo sapiens
cccagagcccctcctccagc

SEQ ID NO: 4259129 - DNA, 19 bp, Homo sapiens
cccagttgcactcaggtga

SEQ ID NO: 4259130 - DNA, 19 bp, Homo sapiens
cccatcatgtggccccacc

SEQ ID NO: 4259131 - DNA, 15 bp, Homo sapiens
cccatccattaggcc

SEQ ID NO: 4259132 - DNA, 17 bp, Homo sapiens
ccccaccctccactcag

SEQ ID NO: 4259133 - DNA, 14 bp, Homo sapiens
ccccactactgcag

SEQ ID NO: 4259134 - DNA, 19 bp, Homo sapiens
ccccactactgcagcacct

SEQ ID NO: 4259135 - DNA, 21 bp, Homo sapiens
ccccagagcccctcctccagc

SEQ ID NO: 4259136 - DNA, 12 bp, Homo sapiens
ccctccaccttc

SEQ ID NO: 4259137 - DNA, 15 bp, Homo sapiens
ccctccaccttccat

SEQ ID NO: 4259138 - DNA, 19 bp, Homo sapiens
ccctcctccagcccctgtc

SEQ ID NO: 4259139 - DNA, 13 bp, Homo sapiens
ccctggagccaga

SEQ ID NO: 4259140 - DNA, 22 bp, Homo sapiens
ccctgtcccacccccttccccc

SEQ ID NO: 4259141 - DNA, 16 bp, Homo sapiens
cccttcccccagccca

SEQ ID NO: 4259142 - DNA, 14 bp, Homo sapiens
ccgactctggccct

SEQ ID NO: 4259143 - DNA, 14 bp, Homo sapiens
ccgtaatttaactt

SEQ ID NO: 4259144 - DNA, 16 bp, Homo sapiens
ccgtcttttcctgttt

SEQ ID NO: 4259145 - DNA, 19 bp, Homo sapiens
cctacagttttaactgtgg

SEQ ID NO: 4259146 - DNA, 20 bp, Homo sapiens
cctacagttttaactgtgga

SEQ ID NO: 4259147 - DNA, 13 bp, Homo sapiens
cctccaccttcca

SEQ ID NO: 4259148 - DNA, 21 bp, Homo sapiens
cctccactcagctgtcctgca

SEQ ID NO: 4259149 - DNA, 14 bp, Homo sapiens
cctccagcccctgt

SEQ ID NO: 4259150 - DNA, 12 bp, Homo sapiens
cctcctccagcc

SEQ ID NO: 4259151 - DNA, 13 bp, Homo sapiens
cctcgggcctgct

SEQ ID NO: 4259152 - DNA, 18 bp, Homo sapiens
cctctccagtttgcacct

SEQ ID NO: 4259153 - DNA, 23 bp, Homo sapiens
cctctccttcatgacagcctcca

SEQ ID NO: 4259154 - DNA, 17 bp, Homo sapiens
cctgcactaacagagtg

SEQ ID NO: 4259155 - DNA, 19 bp, Homo sapiens
cctgcagcaaacactccac

SEQ ID NO: 4259156 - DNA, 22 bp, Homo sapiens
cctgcataatgtttctggattt

SEQ ID NO: 4259157 - DNA, 19 bp, Homo sapiens
cctgctcaatccctgagga

SEQ ID NO: 4259158 - DNA, 19 bp, Homo sapiens
cctgctctagtgggacagc

SEQ ID NO: 4259159 - DNA, 12 bp, Homo sapiens
cctggctgccca

SEQ ID NO: 4259160 - DNA, 22 bp, Homo sapiens
cctgtatgtcaataaacaacag

SEQ ID NO: 4259161 - DNA, 12 bp, Homo sapiens
cctgtcccaccc

SEQ ID NO: 4259162 - DNA, 16 bp, Homo sapiens
cctgtcccaccccctt

SEQ ID NO: 4259163 - DNA, 18 bp, Homo sapiens
cctgtgtgtactctgtcc

SEQ ID NO: 4259164 - DNA, 19 bp, Homo sapiens
cctgtgtgtactctgtcca

SEQ ID NO: 4259165 - DNA, 17 bp, Homo sapiens
ccttcatgacagcctcc

SEQ ID NO: 4259166 - DNA, 18 bp, Homo sapiens
ccttcatgacagcctcca

SEQ ID NO: 4259167 - DNA, 15 bp, Homo sapiens
ccttcccccagccca

SEQ ID NO: 4259168 - DNA, 17 bp, Homo sapiens
ccttcccccagcccatc

SEQ ID NO: 4259169 - DNA, 17 bp, Homo sapiens
ccttgaaaaaaaacagt

SEQ ID NO: 4259170 - DNA, 21 bp, Homo sapiens
cctttatttttggcgtggctg

SEQ ID NO: 4259171 - DNA, 24 bp, Homo sapiens
cctttcctgtgtgtactctgtcca

SEQ ID NO: 4259172 - DNA, 21 bp, Homo sapiens
cgcttgtagaactcactctgg

SEQ ID NO: 4259173 - DNA, 18 bp, Homo sapiens
ctaaatgtgcaatagaag

SEQ ID NO: 4259174 - DNA, 14 bp, Homo sapiens
ctaaattatttact

SEQ ID NO: 4259175 - DNA, 15 bp, Homo sapiens
ctaaattatttactg

SEQ ID NO: 4259176 - DNA, 17 bp, Homo sapiens
ctaacctcgggcctgct

SEQ ID NO: 4259177 - DNA, 15 bp, Homo sapiens
ctacagttttaactg

SEQ ID NO: 4259178 - DNA, 20 bp, Homo sapiens
ctactgcagcacctccaggc

SEQ ID NO: 4259179 - DNA, 17 bp, Homo sapiens
ctacttctgtaattgtg

SEQ ID NO: 4259180 - DNA, 18 bp, Homo sapiens
ctacttctgtaattgtgt

SEQ ID NO: 4259181 - DNA, 21 bp, Homo sapiens
ctagattgctaaggagctgat

SEQ ID NO: 4259182 - DNA, 22 bp, Homo sapiens
ctagcattgtaaaattatttca

SEQ ID NO: 4259183 - DNA, 23 bp, Homo sapiens
ctagcattgtaaaattatttcat

SEQ ID NO: 4259184 - DNA, 22 bp, Homo sapiens
ctagctctctaggcctctccag

SEQ ID NO: 4259185 - DNA, 18 bp, Homo sapiens
ctagtgggacagcccaga

SEQ ID NO: 4259186 - DNA, 17 bp, Homo sapiens
ctcacctgcactaacag

SEQ ID NO: 4259187 - DNA, 20 bp, Homo sapiens
ctcacctgcactaacagagt

SEQ ID NO: 4259188 - DNA, 14 bp, Homo sapiens
ctcacgtcaaatgc

SEQ ID NO: 4259189 - DNA, 23 bp, Homo sapiens
ctcactgaaacatggctgtgttt

SEQ ID NO: 4259190 - DNA, 16 bp, Homo sapiens
ctcagctgtcctgcag

SEQ ID NO: 4259191 - DNA, 14 bp, Homo sapiens
ctccaccctccacc

SEQ ID NO: 4259192 - DNA, 15 bp, Homo sapiens
ctccaccctccacct

SEQ ID NO: 4259193 - DNA, 12 bp, Homo sapiens
ctccaccttcca

SEQ ID NO: 4259194 - DNA, 18 bp, Homo sapiens
ctccactcagctgtcctg

SEQ ID NO: 4259195 - DNA, 12 bp, Homo sapiens
ctccagcccctg

SEQ ID NO: 4259196 - DNA, 16 bp, Homo sapiens
ctccagcccctgtccc

SEQ ID NO: 4259197 - DNA, 17 bp, Homo sapiens
ctccagcccctgtccca

SEQ ID NO: 4259198 - DNA, 20 bp, Homo sapiens
ctccaggcctgttgctatag

SEQ ID NO: 4259199 - DNA, 16 bp, Homo sapiens
ctccagtttgcacctg

SEQ ID NO: 4259200 - DNA, 18 bp, Homo sapiens
ctccagtttgcacctgtc

SEQ ID NO: 4259201 - DNA, 17 bp, Homo sapiens
ctcctccagcccctgtc

SEQ ID NO: 4259202 - DNA, 20 bp, Homo sapiens
ctcctccagcccctgtccca

SEQ ID NO: 4259203 - DNA, 15 bp, Homo sapiens
ctctaaaattataaa

SEQ ID NO: 4259204 - DNA, 17 bp, Homo sapiens
ctctagctctctaggcc

SEQ ID NO: 4259205 - DNA, 17 bp, Homo sapiens
ctctagtgcggtttact

SEQ ID NO: 4259206 - DNA, 13 bp, Homo sapiens
ctctagtgggaca

SEQ ID NO: 4259207 - DNA, 16 bp, Homo sapiens
ctctagtgggacagcc

SEQ ID NO: 4259208 - DNA, 20 bp, Homo sapiens
ctctagtgggacagcccaga

SEQ ID NO: 4259209 - DNA, 17 bp, Homo sapiens
ctctccagtttgcacct

SEQ ID NO: 4259210 - DNA, 19 bp, Homo sapiens
ctctccagtttgcacctgt

SEQ ID NO: 4259211 - DNA, 22 bp, Homo sapiens
ctctccagtttgcacctgtccc

SEQ ID NO: 4259212 - DNA, 17 bp, Homo sapiens
ctgaattatctatttca

SEQ ID NO: 4259213 - DNA, 14 bp, Homo sapiens
ctgcaaaaagaaaa

SEQ ID NO: 4259214 - DNA, 17 bp, Homo sapiens
ctgcactaacagagtgg

SEQ ID NO: 4259215 - DNA, 12 bp, Homo sapiens
ctgcagcacctc

SEQ ID NO: 4259216 - DNA, 20 bp, Homo sapiens
ctgcagcacctccaggcctg

SEQ ID NO: 4259217 - DNA, 15 bp, Homo sapiens
ctgccgtaatttaac

SEQ ID NO: 4259218 - DNA, 19 bp, Homo sapiens
ctggactggaggcccctgg

SEQ ID NO: 4259219 - DNA, 13 bp, Homo sapiens
ctggaggcccctg

SEQ ID NO: 4259220 - DNA, 21 bp, Homo sapiens
ctggaggcccctggagccaga

SEQ ID NO: 4259221 - DNA, 22 bp, Homo sapiens
ctgggctgtaacgtggcactgg

SEQ ID NO: 4259222 - DNA, 17 bp, Homo sapiens
ctgggttgcctttattt

SEQ ID NO: 4259223 - DNA, 17 bp, Homo sapiens
ctggtaggttgggacac

SEQ ID NO: 4259224 - DNA, 16 bp, Homo sapiens
ctgtaaagatgtttat

SEQ ID NO: 4259225 - DNA, 14 bp, Homo sapiens
ctgtatattcagga

SEQ ID NO: 4259226 - DNA, 14 bp, Homo sapiens
ctgtcctgcagcaa

SEQ ID NO: 4259227 - DNA, 17 bp, Homo sapiens
ctgtgttttgaaagaat

SEQ ID NO: 4259228 - DNA, 18 bp, Homo sapiens
ctgtttgcatttgataca

SEQ ID NO: 4259229 - DNA, 17 bp, Homo sapiens
cttagggcactgggctg

SEQ ID NO: 4259230 - DNA, 16 bp, Homo sapiens
cttatttgtatatggt

SEQ ID NO: 4259231 - DNA, 18 bp, Homo sapiens
cttcaggttggtttaatc

SEQ ID NO: 4259232 - DNA, 19 bp, Homo sapiens
cttccattttcccccacta

SEQ ID NO: 4259233 - DNA, 15 bp, Homo sapiens
cttctgtaattgtgt

SEQ ID NO: 4259234 - DNA, 14 bp, Homo sapiens
cttgaaaaaaaaca

SEQ ID NO: 4259235 - DNA, 21 bp, Homo sapiens
cttgtagaactcactctgggc

SEQ ID NO: 4259236 - DNA, 13 bp, Homo sapiens
ctttaaatgaata

SEQ ID NO: 4259237 - DNA, 19 bp, Homo sapiens
gaaaatctttataaatgta

SEQ ID NO: 4259238 - DNA, 12 bp, Homo sapiens
gaaacaaagatg

SEQ ID NO: 4259239 - DNA, 16 bp, Homo sapiens
gaacgaaaatgaaagc

SEQ ID NO: 4259240 - DNA, 13 bp, Homo sapiens
gaactcactctgg

SEQ ID NO: 4259241 - DNA, 14 bp, Homo sapiens
gaactcactctggg

SEQ ID NO: 4259242 - DNA, 16 bp, Homo sapiens
gaactcactctgggct

SEQ ID NO: 4259243 - DNA, 18 bp, Homo sapiens
gaactcactctgggctgt

SEQ ID NO: 4259244 - DNA, 23 bp, Homo sapiens
gaagaaggaggaatgctggactg

SEQ ID NO: 4259245 - DNA, 13 bp, Homo sapiens
gaagccgactctg

SEQ ID NO: 4259246 - DNA, 22 bp, Homo sapiens
gaagccgactctggccctggcc

SEQ ID NO: 4259247 - DNA, 22 bp, Homo sapiens
gaaggaggaatgctggactgga

SEQ ID NO: 4259248 - DNA, 22 bp, Homo sapiens
gaagggcctgcccagttgcact

SEQ ID NO: 4259249 - DNA, 21 bp, Homo sapiens
gaattataactgtaaagatgt

SEQ ID NO: 4259250 - DNA, 13 bp, Homo sapiens
gacagcccagagc

SEQ ID NO: 4259251 - DNA, 17 bp, Homo sapiens
gacagcccagagcctgg

SEQ ID NO: 4259252 - DNA, 17 bp, Homo sapiens
gactctggccctggccc

SEQ ID NO: 4259253 - DNA, 15 bp, Homo sapiens
gactggaggcccctg

SEQ ID NO: 4259254 - DNA, 21 bp, Homo sapiens
gagagagttgttttaataact

SEQ ID NO: 4259255 - DNA, 14 bp, Homo sapiens
gagagatcaaagat

SEQ ID NO: 4259256 - DNA, 20 bp, Homo sapiens
gagatcaaagatgaaaagta

SEQ ID NO: 4259257 - DNA, 20 bp, Homo sapiens
gagcctacctgtatgtcaat

SEQ ID NO: 4259258 - DNA, 18 bp, Homo sapiens
gaggaatgctggactgga

SEQ ID NO: 4259259 - DNA, 18 bp, Homo sapiens
gaggactcccaaccctgg

SEQ ID NO: 4259260 - DNA, 20 bp, Homo sapiens
gagggtggttcaacaaagaa

SEQ ID NO: 4259261 - DNA, 12 bp, Homo sapiens
gatcaaagatga

SEQ ID NO: 4259262 - DNA, 15 bp, Homo sapiens
gatcaaagatgaaaa

SEQ ID NO: 4259263 - DNA, 18 bp, Homo sapiens
gatcaaagatgaaaagta

SEQ ID NO: 4259264 - DNA, 15 bp, Homo sapiens
gattagaaattacct

SEQ ID NO: 4259265 - DNA, 22 bp, Homo sapiens
gattagaaattacctgtggata

SEQ ID NO: 4259266 - DNA, 13 bp, Homo sapiens
gatttttctttaa

SEQ ID NO: 4259267 - DNA, 15 bp, Homo sapiens
gatttttctttaact

SEQ ID NO: 4259268 - DNA, 17 bp, Homo sapiens
gcaaacactccaccctc

SEQ ID NO: 4259269 - DNA, 15 bp, Homo sapiens
gcacctccaggcctg

SEQ ID NO: 4259270 - DNA, 16 bp, Homo sapiens
gcacctccaggcctgt

SEQ ID NO: 4259271 - DNA, 18 bp, Homo sapiens
gcacctgtccccaccctc

SEQ ID NO: 4259272 - DNA, 20 bp, Homo sapiens
gcacctgtccccaccctcca

SEQ ID NO: 4259273 - DNA, 12 bp, Homo sapiens
gcactgggctgt

SEQ ID NO: 4259274 - DNA, 18 bp, Homo sapiens
gcagtgtctgtgttttga

SEQ ID NO: 4259275 - DNA, 20 bp, Homo sapiens
gcatacaagtttcattctcc

SEQ ID NO: 4259276 - DNA, 12 bp, Homo sapiens
gcattggatatt

SEQ ID NO: 4259277 - DNA, 18 bp, Homo sapiens
gccagcaacgcttgtaga

SEQ ID NO: 4259278 - DNA, 20 bp, Homo sapiens
gcccagaggactcccaaccc

SEQ ID NO: 4259279 - DNA, 21 bp, Homo sapiens
gcccagaggactcccaaccct

SEQ ID NO: 4259280 - DNA, 22 bp, Homo sapiens
gcccatccattaggccagcaac

SEQ ID NO: 4259281 - DNA, 15 bp, Homo sapiens
gcccctcctccagcc

SEQ ID NO: 4259282 - DNA, 18 bp, Homo sapiens
gcccctcctccagcccct

SEQ ID NO: 4259283 - DNA, 14 bp, Homo sapiens
gccgactctggccc

SEQ ID NO: 4259284 - DNA, 18 bp, Homo sapiens
gccgactctggccctggc

SEQ ID NO: 4259285 - DNA, 14 bp, Homo sapiens
gcctacctgtatgt

SEQ ID NO: 4259286 - DNA, 20 bp, Homo sapiens
gcctcactgaaacatggctg

SEQ ID NO: 4259287 - DNA, 21 bp, Homo sapiens
gcctctccagtttgcacctgt

SEQ ID NO: 4259288 - DNA, 19 bp, Homo sapiens
gcctgctctagtgggacag

SEQ ID NO: 4259289 - DNA, 19 bp, Homo sapiens
gccttagggcactgggctg

SEQ ID NO: 4259290 - DNA, 20 bp, Homo sapiens
gcggtttactcactgctgca

SEQ ID NO: 4259291 - DNA, 22 bp, Homo sapiens
gctagttatacttatttgtata

SEQ ID NO: 4259292 - DNA, 20 bp, Homo sapiens
gctcaatccctgaggactga

SEQ ID NO: 4259293 - DNA, 22 bp, Homo sapiens
gctcctgttttgcacagccaaa

SEQ ID NO: 4259294 - DNA, 19 bp, Homo sapiens
gctctaggtacgatgacag

SEQ ID NO: 4259295 - DNA, 20 bp, Homo sapiens
gctctagtgggacagcccag

SEQ ID NO: 4259296 - DNA, 15 bp, Homo sapiens
gctctctaggcctct

SEQ ID NO: 4259297 - DNA, 21 bp, Homo sapiens
gctgcccatcatgtggcccca

SEQ ID NO: 4259298 - DNA, 21 bp, Homo sapiens
gctgtcttaaactaaatgtgc

SEQ ID NO: 4259299 - DNA, 20 bp, Homo sapiens
gctgtgtgaatacctgctca

SEQ ID NO: 4259300 - DNA, 20 bp, Homo sapiens
ggaatggatttttctttaac

SEQ ID NO: 4259301 - DNA, 17 bp, Homo sapiens
ggacagcccagagcctg

SEQ ID NO: 4259302 - DNA, 18 bp, Homo sapiens
ggacagcccagagcctgg

SEQ ID NO: 4259303 - DNA, 21 bp, Homo sapiens
ggacagcccagagcctggctg

SEQ ID NO: 4259304 - DNA, 21 bp, Homo sapiens
ggactcccaaccctggcttgg

SEQ ID NO: 4259305 - DNA, 21 bp, Homo sapiens
ggcacctacactcacctgcac

SEQ ID NO: 4259306 - DNA, 22 bp, Homo sapiens
ggcactgggctgttgttccatt

SEQ ID NO: 4259307 - DNA, 21 bp, Homo sapiens
ggcactggtaggttgggacac

SEQ ID NO: 4259308 - DNA, 15 bp, Homo sapiens
ggcctgcccagttgc

SEQ ID NO: 4259309 - DNA, 15 bp, Homo sapiens
ggccttagggcactg

SEQ ID NO: 4259310 - DNA, 19 bp, Homo sapiens
ggctgcccatcatgtggcc

SEQ ID NO: 4259311 - DNA, 16 bp, Homo sapiens
gggaagggcctgccca

SEQ ID NO: 4259312 - DNA, 21 bp, Homo sapiens
gggacagcccagagcctggct

SEQ ID NO: 4259313 - DNA, 13 bp, Homo sapiens
gggctaatttaac

SEQ ID NO: 4259314 - DNA, 14 bp, Homo sapiens
gggcttttttcttt

SEQ ID NO: 4259315 - DNA, 20 bp, Homo sapiens
ggggccttagggcactgggc

SEQ ID NO: 4259316 - DNA, 23 bp, Homo sapiens
ggggccttagggcactgggctgt

SEQ ID NO: 4259317 - DNA, 15 bp, Homo sapiens
ggtaggttgggacac

SEQ ID NO: 4259318 - DNA, 19 bp, Homo sapiens
ggtcaagaaacagccagca

SEQ ID NO: 4259319 - DNA, 21 bp, Homo sapiens
ggtcaagaaacagccagcaag

SEQ ID NO: 4259320 - DNA, 12 bp, Homo sapiens
ggtctgtttgca

SEQ ID NO: 4259321 - DNA, 18 bp, Homo sapiens
gtaaggatccggaaagaa

SEQ ID NO: 4259322 - DNA, 15 bp, Homo sapiens
gtacgatgacagtgt

SEQ ID NO: 4259323 - DNA, 17 bp, Homo sapiens
gtagaactcactctggg

SEQ ID NO: 4259324 - DNA, 20 bp, Homo sapiens
gtagaactcactctgggctg

SEQ ID NO: 4259325 - DNA, 21 bp, Homo sapiens
gtagaactcactctgggctgt

SEQ ID NO: 4259326 - DNA, 22 bp, Homo sapiens
gtagaactcactctgggctgta

SEQ ID NO: 4259327 - DNA, 19 bp, Homo sapiens
gtatttattttttcttttc

SEQ ID NO: 4259328 - DNA, 22 bp, Homo sapiens
gtcaaatgcatacaagtttcat

SEQ ID NO: 4259329 - DNA, 22 bp, Homo sapiens
gtcaataaacaacagctgaagc

SEQ ID NO: 4259330 - DNA, 20 bp, Homo sapiens
gtcctgcagcaaacactcca

SEQ ID NO: 4259331 - DNA, 15 bp, Homo sapiens
gtgaatacctgctca

SEQ ID NO: 4259332 - DNA, 12 bp, Homo sapiens
gtgcaatagaag

SEQ ID NO: 4259333 - DNA, 16 bp, Homo sapiens
gtggatatttgtataa

SEQ ID NO: 4259334 - DNA, 23 bp, Homo sapiens
gtggatcacaaagtggaacgaaa

SEQ ID NO: 4259335 - DNA, 19 bp, Homo sapiens
gtggatccaaactgatcca

SEQ ID NO: 4259336 - DNA, 21 bp, Homo sapiens
gtggcactggtaggttgggac

SEQ ID NO: 4259337 - DNA, 22 bp, Homo sapiens
gtggcactggtaggttgggaca

SEQ ID NO: 4259338 - DNA, 13 bp, Homo sapiens
gtgggacagccca

SEQ ID NO: 4259339 - DNA, 14 bp, Homo sapiens
gtgtccctaatgtg

SEQ ID NO: 4259340 - DNA, 15 bp, Homo sapiens
gtgtgtactctgtcc

SEQ ID NO: 4259341 - DNA, 20 bp, Homo sapiens
gtgtttgcagcctgctctag

SEQ ID NO: 4259342 - DNA, 22 bp, Homo sapiens
gttcaacaaagaaacaaagatg

SEQ ID NO: 4259343 - DNA, 22 bp, Homo sapiens
gttccattgaagccgactctgg

SEQ ID NO: 4259344 - DNA, 22 bp, Homo sapiens
gttggaatggatttttctttaa

SEQ ID NO: 4259345 - DNA, 22 bp, Homo sapiens
gttttaactgtggatattgtta

SEQ ID NO: 4259346 - DNA, 15 bp, Homo sapiens
gttttgcacagccaa

SEQ ID NO: 4259347 - DNA, 23 bp, Homo sapiens
taaaaatggcagggggtggaatt

SEQ ID NO: 4259348 - DNA, 12 bp, Homo sapiens
taaaagcctgct

SEQ ID NO: 4259349 - DNA, 19 bp, Homo sapiens
taaatgtgcaatagaaggt

SEQ ID NO: 4259350 - DNA, 13 bp, Homo sapiens
taagaaatagaat

SEQ ID NO: 4259351 - DNA, 19 bp, Homo sapiens
taatttaactttctgggtt

SEQ ID NO: 4259352 - DNA, 14 bp, Homo sapiens
tacccaaactgctt

SEQ ID NO: 4259353 - DNA, 22 bp, Homo sapiens
tacgaacctacagttttaactg

SEQ ID NO: 4259354 - DNA, 16 bp, Homo sapiens
tactaaggacgttgtt

SEQ ID NO: 4259355 - DNA, 13 bp, Homo sapiens
tactgaatctgct

SEQ ID NO: 4259356 - DNA, 16 bp, Homo sapiens
tactgcaaaaagaaaa

SEQ ID NO: 4259357 - DNA, 20 bp, Homo sapiens
tacttctgtaattgtgtgga

SEQ ID NO: 4259358 - DNA, 22 bp, Homo sapiens
tacttctgtaattgtgtggatt

SEQ ID NO: 4259359 - DNA, 16 bp, Homo sapiens
tagaaattacctgtgg

SEQ ID NO: 4259360 - DNA, 16 bp, Homo sapiens
tagaactcactctggg

SEQ ID NO: 4259361 - DNA, 15 bp, Homo sapiens
tagatatgaaagctg

SEQ ID NO: 4259362 - DNA, 22 bp, Homo sapiens
tagctgtgtgaatacctgctca

SEQ ID NO: 4259363 - DNA, 13 bp, Homo sapiens
tagggcactgggc

SEQ ID NO: 4259364 - DNA, 13 bp, Homo sapiens
taggttgggacac

SEQ ID NO: 4259365 - DNA, 19 bp, Homo sapiens
tagttatacttatttgtat

SEQ ID NO: 4259366 - DNA, 16 bp, Homo sapiens
tataacagtgtttaaa

SEQ ID NO: 4259367 - DNA, 20 bp, Homo sapiens
tcaacaaagaaacaaagatg

SEQ ID NO: 4259368 - DNA, 19 bp, Homo sapiens
tcaacgcctcactgaaaca

SEQ ID NO: 4259369 - DNA, 21 bp, Homo sapiens
tcaacggaaagtgctgtctta

SEQ ID NO: 4259370 - DNA, 12 bp, Homo sapiens
tcaagaaacagc

SEQ ID NO: 4259371 - DNA, 15 bp, Homo sapiens
tcaagaaacagccag

SEQ ID NO: 4259372 - DNA, 18 bp, Homo sapiens
tcaagaaacagccagcaa

SEQ ID NO: 4259373 - DNA, 20 bp, Homo sapiens
tcaagaaacagccagcaaga

SEQ ID NO: 4259374 - DNA, 13 bp, Homo sapiens
tcactctgggctg

SEQ ID NO: 4259375 - DNA, 22 bp, Homo sapiens
tcagaattagagcatgggaggt

SEQ ID NO: 4259376 - DNA, 20 bp, Homo sapiens
tcagagtgactacacacagt

SEQ ID NO: 4259377 - DNA, 15 bp, Homo sapiens
tcagctgtcctgcag

SEQ ID NO: 4259378 - DNA, 17 bp, Homo sapiens
tcagctgtcctgcagca

SEQ ID NO: 4259379 - DNA, 18 bp, Homo sapiens
tcagctgtcctgcagcaa

SEQ ID NO: 4259380 - DNA, 14 bp, Homo sapiens
tccaccctccacct

SEQ ID NO: 4259381 - DNA, 18 bp, Homo sapiens
tccaccctccaccttcca

SEQ ID NO: 4259382 - DNA, 22 bp, Homo sapiens
tccactcagctgtcctgcagca

SEQ ID NO: 4259383 - DNA, 15 bp, Homo sapiens
tccagatagtgtagc

SEQ ID NO: 4259384 - DNA, 22 bp, Homo sapiens
tccagatagtgtagctgaggag

SEQ ID NO: 4259385 - DNA, 14 bp, Homo sapiens
tccagcccctgtcc

SEQ ID NO: 4259386 - DNA, 15 bp, Homo sapiens
tccagcccctgtccc

SEQ ID NO: 4259387 - DNA, 18 bp, Homo sapiens
tccagtttgcacctgtcc

SEQ ID NO: 4259388 - DNA, 19 bp, Homo sapiens
tccagtttgcacctgtccc

SEQ ID NO: 4259389 - DNA, 17 bp, Homo sapiens
tccattaggccagcaac

SEQ ID NO: 4259390 - DNA, 21 bp, Homo sapiens
tccattgaagccgactctggc

SEQ ID NO: 4259391 - DNA, 14 bp, Homo sapiens
tccattttccccca

SEQ ID NO: 4259392 - DNA, 15 bp, Homo sapiens
tccccaccctccact

SEQ ID NO: 4259393 - DNA, 19 bp, Homo sapiens
tccccaccctccactcagc

SEQ ID NO: 4259394 - DNA, 20 bp, Homo sapiens
tccctgaggactgatttcag

SEQ ID NO: 4259395 - DNA, 21 bp, Homo sapiens
tccctgaggactgatttcaga

SEQ ID NO: 4259396 - DNA, 12 bp, Homo sapiens
tcctccagcccc

SEQ ID NO: 4259397 - DNA, 20 bp, Homo sapiens
tcctgcagcaaacactccac

SEQ ID NO: 4259398 - DNA, 22 bp, Homo sapiens
tcctgcagcaaacactccaccc

SEQ ID NO: 4259399 - DNA, 17 bp, Homo sapiens
tcctgttttgcacagcc

SEQ ID NO: 4259400 - DNA, 21 bp, Homo sapiens
tcctgttttgcacagccaaat

SEQ ID NO: 4259401 - DNA, 15 bp, Homo sapiens
tcggaaatcttaaac

SEQ ID NO: 4259402 - DNA, 18 bp, Homo sapiens
tctaaaattataaatgac

SEQ ID NO: 4259403 - DNA, 15 bp, Homo sapiens
tctagctctctaggc

SEQ ID NO: 4259404 - DNA, 15 bp, Homo sapiens
tctagtgggacagcc

SEQ ID NO: 4259405 - DNA, 14 bp, Homo sapiens
tctataaactataa

SEQ ID NO: 4259406 - DNA, 21 bp, Homo sapiens
tctccttcatgacagcctcca

SEQ ID NO: 4259407 - DNA, 18 bp, Homo sapiens
tctctaggcctctccagt

SEQ ID NO: 4259408 - DNA, 13 bp, Homo sapiens
tctggccctggcc

SEQ ID NO: 4259409 - DNA, 15 bp, Homo sapiens
tctgggttgccttta

SEQ ID NO: 4259410 - DNA, 20 bp, Homo sapiens
tcttgcttggggaacttgtg

SEQ ID NO: 4259411 - DNA, 11 bp, Homo sapiens
tctttaactgc

SEQ ID NO: 4259412 - DNA, 20 bp, Homo sapiens
tctttaactgccgtaattta

SEQ ID NO: 4259413 - DNA, 21 bp, Homo sapiens
tctttaactgccgtaatttaa

SEQ ID NO: 4259414 - DNA, 21 bp, Homo sapiens
tgaaaagtatattgataacct

SEQ ID NO: 4259415 - DNA, 20 bp, Homo sapiens
tgaaagaatagaacacagtt

SEQ ID NO: 4259416 - DNA, 22 bp, Homo sapiens
tgaagcaaactctaaaattata

SEQ ID NO: 4259417 - DNA, 15 bp, Homo sapiens
tgaagccgactctgg

SEQ ID NO: 4259418 - DNA, 17 bp, Homo sapiens
tgaagccgactctggcc

SEQ ID NO: 4259419 - DNA, 19 bp, Homo sapiens
tgaagccgactctggccct

SEQ ID NO: 4259420 - DNA, 23 bp, Homo sapiens
tgattagaaattacctgtggata

SEQ ID NO: 4259421 - DNA, 23 bp, Homo sapiens
tgcaaatactgtatattcaggac

SEQ ID NO: 4259422 - DNA, 16 bp, Homo sapiens
tgcacctgtccccacc

SEQ ID NO: 4259423 - DNA, 17 bp, Homo sapiens
tgcacctgtccccaccc

SEQ ID NO: 4259424 - DNA, 19 bp, Homo sapiens
tgcagcaaacactccaccc

SEQ ID NO: 4259425 - DNA, 18 bp, Homo sapiens
tgcagcacctccaggcct

SEQ ID NO: 4259426 - DNA, 12 bp, Homo sapiens
tgcagcctgctc

SEQ ID NO: 4259427 - DNA, 16 bp, Homo sapiens
tgcatttgatacattt

SEQ ID NO: 4259428 - DNA, 12 bp, Homo sapiens
tgccactgttgt

SEQ ID NO: 4259429 - DNA, 19 bp, Homo sapiens
tgccattggggtagttgtg

SEQ ID NO: 4259430 - DNA, 21 bp, Homo sapiens
tgcccatcatgtggccccacc

SEQ ID NO: 4259431 - DNA, 22 bp, Homo sapiens
tgcccatcatgtggccccaccc

SEQ ID NO: 4259432 - DNA, 16 bp, Homo sapiens
tgctctagtgggacag

SEQ ID NO: 4259433 - DNA, 18 bp, Homo sapiens
tgctctagtgggacagcc

SEQ ID NO: 4259434 - DNA, 22 bp, Homo sapiens
tgcttctctagctctctaggcc

SEQ ID NO: 4259435 - DNA, 21 bp, Homo sapiens
tggactggaggcccctggagc

SEQ ID NO: 4259436 - DNA, 15 bp, Homo sapiens
tggatgcccagagga

SEQ ID NO: 4259437 - DNA, 20 bp, Homo sapiens
tggatttaaaagcctgctca

SEQ ID NO: 4259438 - DNA, 21 bp, Homo sapiens
tggcactggtaggttgggaca

SEQ ID NO: 4259439 - DNA, 23 bp, Homo sapiens
tggcttggggtcaagaaacagcc

SEQ ID NO: 4259440 - DNA, 14 bp, Homo sapiens
tgggacaccaggga

SEQ ID NO: 4259441 - DNA, 14 bp, Homo sapiens
tgggacagcccaga

SEQ ID NO: 4259442 - DNA, 18 bp, Homo sapiens
tgggacagcccagagcct

SEQ ID NO: 4259443 - DNA, 19 bp, Homo sapiens
tgtagaactcactctgggc

SEQ ID NO: 4259444 - DNA, 20 bp, Homo sapiens
tgtagaactcactctgggct

SEQ ID NO: 4259445 - DNA, 18 bp, Homo sapiens
tgtcaataaacaacagct

SEQ ID NO: 4259446 - DNA, 20 bp, Homo sapiens
tgtcccacccccttccccca

SEQ ID NO: 4259447 - DNA, 17 bp, Homo sapiens
tgtccccaccctccact

SEQ ID NO: 4259448 - DNA, 18 bp, Homo sapiens
tgtccccaccctccactc

SEQ ID NO: 4259449 - DNA, 18 bp, Homo sapiens
tgtcttaaactaaatgtg

SEQ ID NO: 4259450 - DNA, 13 bp, Homo sapiens
tgtggccccaccc

SEQ ID NO: 4259451 - DNA, 14 bp, Homo sapiens
tgtgtggattcttt

SEQ ID NO: 4259452 - DNA, 16 bp, Homo sapiens
tgtgtttgcagcctgc

SEQ ID NO: 4259453 - DNA, 16 bp, Homo sapiens
tgttacgtagcctaag

SEQ ID NO: 4259454 - DNA, 20 bp, Homo sapiens
tgttggggaagggcctgccc

SEQ ID NO: 4259455 - DNA, 16 bp, Homo sapiens
tgttttaataacttat

SEQ ID NO: 4259456 - DNA, 14 bp, Homo sapiens
ttaacaagaacttt

SEQ ID NO: 4259457 - DNA, 15 bp, Homo sapiens
ttaagaaatagaatt

SEQ ID NO: 4259458 - DNA, 12 bp, Homo sapiens
ttacctgtggat

SEQ ID NO: 4259459 - DNA, 13 bp, Homo sapiens
ttagaagcctgca

SEQ ID NO: 4259460 - DNA, 15 bp, Homo sapiens
ttagggcactgggct

SEQ ID NO: 4259461 - DNA, 23 bp, Homo sapiens
ttataaatgtaccagagagagtt

SEQ ID NO: 4259462 - DNA, 23 bp, Homo sapiens
ttatttttggcgtggctgactta

SEQ ID NO: 4259463 - DNA, 18 bp, Homo sapiens
ttcattctccctttcact

SEQ ID NO: 4259464 - DNA, 16 bp, Homo sapiens
ttccattttcccccac

SEQ ID NO: 4259465 - DNA, 17 bp, Homo sapiens
ttcccccactactgcag

SEQ ID NO: 4259466 - DNA, 18 bp, Homo sapiens
ttctctagctctctaggc

SEQ ID NO: 4259467 - DNA, 21 bp, Homo sapiens
ttggatttaaaagcctgctca

SEQ ID NO: 4259468 - DNA, 20 bp, Homo sapiens
ttgtagaactcactctgggc

SEQ ID NO: 4259469 - DNA, 19 bp, Homo sapiens
ttgtagtgccactgttgtt

SEQ ID NO: 4259470 - DNA, 16 bp, Homo sapiens
ttgtgtccctaatgtg

SEQ ID NO: 4259471 - DNA, 15 bp, Homo sapiens
tttaaaactgttgga

SEQ ID NO: 4259472 - DNA, 12 bp, Homo sapiens
tttaaattgtgt

SEQ ID NO: 4259473 - DNA, 14 bp, Homo sapiens
tttaagaaatagaa

SEQ ID NO: 4259474 - DNA, 13 bp, Homo sapiens
tttacccttcagg

SEQ ID NO: 4259475 - DNA, 23 bp, Homo sapiens
tttagaaaaaatggatgcccaga

SEQ ID NO: 4259476 - DNA, 22 bp, Homo sapiens
tttataaaagtgttcattgttt

SEQ ID NO: 4259477 - DNA, 23 bp, Homo sapiens
tttcaacggaaagtgctgtctta

SEQ ID NO: 4259478 - DNA, 22 bp, Homo sapiens
tttcagagtgactacacacagt

SEQ ID NO: 4259479 - DNA, 16 bp, Homo sapiens
tttcatgattagaaat

SEQ ID NO: 4259480 - DNA, 13 bp, Homo sapiens
tttctttaactgc

SEQ ID NO: 4259481 - DNA, 21 bp, Homo sapiens
tttgaaagaatagaacacagt

SEQ ID NO: 4259482 - DNA, 13 bp, Homo sapiens
tttgacagtgttt

SEQ ID NO: 4259483 - DNA, 15 bp, Homo sapiens
tttgcacctgtcccc

SEQ ID NO: 4259484 - DNA, 14 bp, Homo sapiens
ttttctttaactgc

SEQ ID NO: 4259485 - DNA, 12 bp, Homo sapiens
ttttgaaagaat

SEQ ID NO: 4259486 - DNA, 13 bp, Homo sapiens
ggaaatcttaaac

SEQ ID NO: 4259487 - DNA, 14 bp, Homo sapiens
ggacagcccagagc

SEQ ID NO: 4259488 - DNA, 18 bp, Homo sapiens
ggactcccaaccctggct

SEQ ID NO: 4259489 - DNA, 17 bp, Homo sapiens
ggactggaggcccctgg

SEQ ID NO: 4259490 - DNA, 21 bp, Homo sapiens
ggactggaggcccctggagcc

SEQ ID NO: 4259491 - DNA, 18 bp, Homo sapiens
ggaggcccctggagccag

SEQ ID NO: 4259492 - DNA, 17 bp, Homo sapiens
ggatccaaactgatcca

SEQ ID NO: 4259493 - DNA, 16 bp, Homo sapiens
ggatttaaaagcctgc

SEQ ID NO: 4259494 - DNA, 19 bp, Homo sapiens
ggatttaaaagcctgctca

SEQ ID NO: 4259495 - DNA, 12 bp, Homo sapiens
ggcactgggctg

SEQ ID NO: 4259496 - DNA, 13 bp, Homo sapiens
ggcactgggctgt

SEQ ID NO: 4259497 - DNA, 16 bp, Homo sapiens
ggccaaagagtctcca

SEQ ID NO: 4259498 - DNA, 12 bp, Homo sapiens
ggccctggccct

SEQ ID NO: 4259499 - DNA, 20 bp, Homo sapiens
ggcccttacttgcttctcta

SEQ ID NO: 4259500 - DNA, 20 bp, Homo sapiens
ggccttagggcactgggctg

SEQ ID NO: 4259501 - DNA, 20 bp, Homo sapiens
ggctgtgtttgcagcctgct

SEQ ID NO: 4259502 - DNA, 17 bp, Homo sapiens
gggacaccagggaagaa

SEQ ID NO: 4259503 - DNA, 19 bp, Homo sapiens
gggtcaagaaacagccagc

SEQ ID NO: 4259504 - DNA, 19 bp, Homo sapiens
ggtaggttgggacaccagg

SEQ ID NO: 4259505 - DNA, 23 bp, Homo sapiens
ggttcaacaaagaaacaaagatg

SEQ ID NO: 4259506 - DNA, 17 bp, Homo sapiens
ggtttaagaaatagaat

SEQ ID NO: 4259507 - DNA, 21 bp, Homo sapiens
gtaaagatgtttatttcaggc

SEQ ID NO: 4259508 - DNA, 22 bp, Homo sapiens
gtatgtcaataaacaacagctg

SEQ ID NO: 4259509 - DNA, 17 bp, Homo sapiens
gtcaataaacaacagct

SEQ ID NO: 4259510 - DNA, 20 bp, Homo sapiens
gtcaataaacaacagctgaa

SEQ ID NO: 4259511 - DNA, 16 bp, Homo sapiens
gtccccaccctccact

SEQ ID NO: 4259512 - DNA, 17 bp, Homo sapiens
gtccccaccctccactc

SEQ ID NO: 4259513 - DNA, 18 bp, Homo sapiens
gtccccaccctccactca

SEQ ID NO: 4259514 - DNA, 21 bp, Homo sapiens
gtcctgcagcaaacactccac

SEQ ID NO: 4259515 - DNA, 23 bp, Homo sapiens
gtcctgcagcaaacactccaccc

SEQ ID NO: 4259516 - DNA, 14 bp, Homo sapiens
gtctcagtttcttg

SEQ ID NO: 4259517 - DNA, 17 bp, Homo sapiens
gtctgtgttttgaaaga

SEQ ID NO: 4259518 - DNA, 13 bp, Homo sapiens
gtggattctttaa

SEQ ID NO: 4259519 - DNA, 21 bp, Homo sapiens
gtgggacagcccagagcctgg

SEQ ID NO: 4259520 - DNA, 17 bp, Homo sapiens
gtgtgtactctgtccag

SEQ ID NO: 4259521 - DNA, 21 bp, Homo sapiens
gtgttactaaaaaaaagatga

SEQ ID NO: 4259522 - DNA, 14 bp, Homo sapiens
gtgttttaattgta

SEQ ID NO: 4259523 - DNA, 18 bp, Homo sapiens
gttacgtagcctaaggct

SEQ ID NO: 4259524 - DNA, 15 bp, Homo sapiens
gttggaatggatttt

SEQ ID NO: 4259525 - DNA, 20 bp, Homo sapiens
gtttacaaaaatttctgtaa

SEQ ID NO: 4259526 - DNA, 20 bp, Homo sapiens
gtttagatttatggttgtta

SEQ ID NO: 4259527 - DNA, 15 bp, Homo sapiens
gttttaactgtggat

SEQ ID NO: 4259528 - DNA, 14 bp, Homo sapiens
taaaagcctgctca

SEQ ID NO: 4259529 - DNA, 15 bp, Homo sapiens
taaaattatttcatg

SEQ ID NO: 4259530 - DNA, 15 bp, Homo sapiens
taaacaacagctgaa

SEQ ID NO: 4259531 - DNA, 14 bp, Homo sapiens
taaactaaatgtgc

SEQ ID NO: 4259532 - DNA, 21 bp, Homo sapiens
taacacagcattgtatatgtg

SEQ ID NO: 4259533 - DNA, 15 bp, Homo sapiens
tacagttttaactgt

SEQ ID NO: 4259534 - DNA, 20 bp, Homo sapiens
tacagttttaactgtggata

SEQ ID NO: 4259535 - DNA, 12 bp, Homo sapiens
tacctgtggata

SEQ ID NO: 4259536 - DNA, 15 bp, Homo sapiens
tactgcagcacctcc

SEQ ID NO: 4259537 - DNA, 17 bp, Homo sapiens
tacttctgtaattgtgt

SEQ ID NO: 4259538 - DNA, 15 bp, Homo sapiens
tactttgacagtgtt

SEQ ID NO: 4259539 - DNA, 20 bp, Homo sapiens
tactttggggctaatttaac

SEQ ID NO: 4259540 - DNA, 18 bp, Homo sapiens
tagaaattacctgtggat

SEQ ID NO: 4259541 - DNA, 22 bp, Homo sapiens
tagaattataactgtaaagatg

SEQ ID NO: 4259542 - DNA, 24 bp, Homo sapiens
tagcattgtaaaattatttcatga

SEQ ID NO: 4259543 - DNA, 21 bp, Homo sapiens
tagcctaaggctcctgttttg

SEQ ID NO: 4259544 - DNA, 13 bp, Homo sapiens
tagctctctaggc

SEQ ID NO: 4259545 - DNA, 15 bp, Homo sapiens
tagctctctaggcct

SEQ ID NO: 4259546 - DNA, 17 bp, Homo sapiens
tagctctctaggcctct

SEQ ID NO: 4259547 - DNA, 15 bp, Homo sapiens
tagggcactgggctg

SEQ ID NO: 4259548 - DNA, 17 bp, Homo sapiens
tatattttgtttacaaa

SEQ ID NO: 4259549 - DNA, 22 bp, Homo sapiens
tattgactaacaggccaaagag

SEQ ID NO: 4259550 - DNA, 22 bp, Homo sapiens
tattgttacgtagcctaaggct

SEQ ID NO: 4259551 - DNA, 21 bp, Homo sapiens
tatttcaggcattggatattt

SEQ ID NO: 4259552 - DNA, 22 bp, Homo sapiens
tatttgtataaaagtgtgaaat

SEQ ID NO: 4259553 - DNA, 17 bp, Homo sapiens
tcacaaagtggaacgaa

SEQ ID NO: 4259554 - DNA, 14 bp, Homo sapiens
tcactgaaacatgg

SEQ ID NO: 4259555 - DNA, 17 bp, Homo sapiens
tcaggacttgaaagaaa

SEQ ID NO: 4259556 - DNA, 14 bp, Homo sapiens
tcatgacagcctcc

SEQ ID NO: 4259557 - DNA, 16 bp, Homo sapiens
tccagcccctgtccca

SEQ ID NO: 4259558 - DNA, 20 bp, Homo sapiens
tccagcccctgtcccacccc

SEQ ID NO: 4259559 - DNA, 23 bp, Homo sapiens
tccagcccctgtcccaccccctt

SEQ ID NO: 4259560 - DNA, 21 bp, Homo sapiens
tccagtataagactactgaat

SEQ ID NO: 4259561 - DNA, 15 bp, Homo sapiens
tccagttcctttaga

SEQ ID NO: 4259562 - DNA, 19 bp, Homo sapiens
tccatcacgttagctgtcc

SEQ ID NO: 4259563 - DNA, 15 bp, Homo sapiens
tccattaggccagca

SEQ ID NO: 4259564 - DNA, 20 bp, Homo sapiens
tccattaggccagcaacgct

SEQ ID NO: 4259565 - DNA, 22 bp, Homo sapiens
tccattgaagccgactctggcc

SEQ ID NO: 4259566 - DNA, 13 bp, Homo sapiens
tccccaccctcca

SEQ ID NO: 4259567 - DNA, 14 bp, Homo sapiens
tccccaccctccac

SEQ ID NO: 4259568 - DNA, 18 bp, Homo sapiens
tcccccactactgcagca

SEQ ID NO: 4259569 - DNA, 15 bp, Homo sapiens
tccctgaggactgat

SEQ ID NO: 4259570 - DNA, 14 bp, Homo sapiens
tcctccagcccctg

SEQ ID NO: 4259571 - DNA, 15 bp, Homo sapiens
tcctccagcccctgt

SEQ ID NO: 4259572 - DNA, 13 bp, Homo sapiens
tcctgcagcaaac

SEQ ID NO: 4259573 - DNA, 18 bp, Homo sapiens
tcctgtttcctagctgtg

SEQ ID NO: 4259574 - DNA, 21 bp, Homo sapiens
tctaggtacgatgacagtgtt

SEQ ID NO: 4259575 - DNA, 13 bp, Homo sapiens
tctagtgggacag

SEQ ID NO: 4259576 - DNA, 21 bp, Homo sapiens
tctataaactataacctctcc

SEQ ID NO: 4259577 - DNA, 14 bp, Homo sapiens
tctggccctggccc

SEQ ID NO: 4259578 - DNA, 15 bp, Homo sapiens
tctggccctggccct

SEQ ID NO: 4259579 - DNA, 21 bp, Homo sapiens
tctgggctgtaacgtggcact

SEQ ID NO: 4259580 - DNA, 23 bp, Homo sapiens
tctgggctgtaacgtggcactgg

SEQ ID NO: 4259581 - DNA, 13 bp, Homo sapiens
tctgtaattgtgt

SEQ ID NO: 4259582 - DNA, 16 bp, Homo sapiens
tgaaagctgatttttt

SEQ ID NO: 4259583 - DNA, 14 bp, Homo sapiens
tgaatacctgctca

SEQ ID NO: 4259584 - DNA, 21 bp, Homo sapiens
tgaatagatatgaaagctgat

SEQ ID NO: 4259585 - DNA, 17 bp, Homo sapiens
tgacctaaattatttac

SEQ ID NO: 4259586 - DNA, 16 bp, Homo sapiens
tgcaatagaaggtgat

SEQ ID NO: 4259587 - DNA, 21 bp, Homo sapiens
tgcacctgtccccaccctcca

SEQ ID NO: 4259588 - DNA, 22 bp, Homo sapiens
tgcagcaaacactccaccctcc

SEQ ID NO: 4259589 - DNA, 12 bp, Homo sapiens
tgcagcacctcc

SEQ ID NO: 4259590 - DNA, 16 bp, Homo sapiens
tgcagcacctccaggc

SEQ ID NO: 4259591 - DNA, 19 bp, Homo sapiens
tgcagcacctccaggcctg

SEQ ID NO: 4259592 - DNA, 17 bp, Homo sapiens
tgcataatgtttctgga

SEQ ID NO: 4259593 - DNA, 18 bp, Homo sapiens
tgcataatgtttctggat

SEQ ID NO: 4259594 - DNA, 18 bp, Homo sapiens
tgctatagagcctacctg

SEQ ID NO: 4259595 - DNA, 17 bp, Homo sapiens
tgctcacgtcaaatgca

SEQ ID NO: 4259596 - DNA, 13 bp, Homo sapiens
tgctgtcttaaac

SEQ ID NO: 4259597 - DNA, 14 bp, Homo sapiens
tgcttcacaatgtt

SEQ ID NO: 4259598 - DNA, 23 bp, Homo sapiens
tgcttctctagctctctaggcct

SEQ ID NO: 4259599 - DNA, 21 bp, Homo sapiens
tgctttttccaactcagaaat

SEQ ID NO: 4259600 - DNA, 15 bp, Homo sapiens
tggaatggatttttc

SEQ ID NO: 4259601 - DNA, 13 bp, Homo sapiens
tggagaaaatggg

SEQ ID NO: 4259602 - DNA, 22 bp, Homo sapiens
tggagaaaatgggtttattcac

SEQ ID NO: 4259603 - DNA, 14 bp, Homo sapiens
tggatattgttacg

SEQ ID NO: 4259604 - DNA, 18 bp, Homo sapiens
tggatttaaaagcctgct

SEQ ID NO: 4259605 - DNA, 22 bp, Homo sapiens
tggcactggtaggttgggacac

SEQ ID NO: 4259606 - DNA, 21 bp, Homo sapiens
tggcccttacttgcttctcta

SEQ ID NO: 4259607 - DNA, 23 bp, Homo sapiens
tggcccttacttgcttctctagc

SEQ ID NO: 4259608 - DNA, 20 bp, Homo sapiens
tggctgacttacatcatgtg

SEQ ID NO: 4259609 - DNA, 22 bp, Homo sapiens
tggcttggggtcaagaaacagc

SEQ ID NO: 4259610 - DNA, 16 bp, Homo sapiens
tggggaagggcctgcc

SEQ ID NO: 4259611 - DNA, 21 bp, Homo sapiens
tggggtcaagaaacagccagc

SEQ ID NO: 4259612 - DNA, 22 bp, Homo sapiens
tggggtcaagaaacagccagca

SEQ ID NO: 4259613 - DNA, 21 bp, Homo sapiens
tggtaggttgggacaccaggg

SEQ ID NO: 4259614 - DNA, 21 bp, Homo sapiens
tgtaaggatccggaaagaaga

SEQ ID NO: 4259615 - DNA, 22 bp, Homo sapiens
aataaattttttataaaagtgt

SEQ ID NO: 4259616 - DNA, 13 bp, Homo sapiens
aatagaacacagt

SEQ ID NO: 4259617 - DNA, 14 bp, Homo sapiens
aatgcatacaagtt

SEQ ID NO: 4259618 - DNA, 17 bp, Homo sapiens
aatgctggactggaggc

SEQ ID NO: 4259619 - DNA, 21 bp, Homo sapiens
aattaccatgcttcacaatgt

SEQ ID NO: 4259620 - DNA, 14 bp, Homo sapiens
aattacctgtggat

SEQ ID NO: 4259621 - DNA, 23 bp, Homo sapiens
aattactttggggctaatttaac

SEQ ID NO: 4259622 - DNA, 20 bp, Homo sapiens
aattataactgtaaagatgt

SEQ ID NO: 4259623 - DNA, 19 bp, Homo sapiens
aattgtgtggattctttaa

SEQ ID NO: 4259624 - DNA, 23 bp, Homo sapiens
aatttggatttaaaagcctgctc

SEQ ID NO: 4259625 - DNA, 17 bp, Homo sapiens
aattttttataaaagtg

SEQ ID NO: 4259626 - DNA, 17 bp, Homo sapiens
acaaagaaacaaagatg

SEQ ID NO: 4259627 - DNA, 15 bp, Homo sapiens
acaacagctgaagca

SEQ ID NO: 4259628 - DNA, 16 bp, Homo sapiens
acaacagctgaagcac

SEQ ID NO: 4259629 - DNA, 12 bp, Homo sapiens
acacacagtacg

SEQ ID NO: 4259630 - DNA, 20 bp, Homo sapiens
acacagcattgtatatgtga

SEQ ID NO: 4259631 - DNA, 14 bp, Homo sapiens
acagccaaatttaa

SEQ ID NO: 4259632 - DNA, 10 bp, Homo sapiens
acagcccaga

SEQ ID NO: 4259633 - DNA, 15 bp, Homo sapiens
acaggttataacagt

SEQ ID NO: 4259634 - DNA, 19 bp, Homo sapiens
acagttttaactgtggata

SEQ ID NO: 4259635 - DNA, 16 bp, Homo sapiens
accaaaacagttaatc

SEQ ID NO: 4259636 - DNA, 15 bp, Homo sapiens
accctccaccttcca

SEQ ID NO: 4259637 - DNA, 14 bp, Homo sapiens
acctccaggcctgt

SEQ ID NO: 4259638 - DNA, 16 bp, Homo sapiens
acctgctcacgtcaaa

SEQ ID NO: 4259639 - DNA, 20 bp, Homo sapiens
acctgtccccaccctccact

SEQ ID NO: 4259640 - DNA, 22 bp, Homo sapiens
acctgtccccaccctccactca

SEQ ID NO: 4259641 - DNA, 16 bp, Homo sapiens
accttgaaaaaaaaca

SEQ ID NO: 4259642 - DNA, 14 bp, Homo sapiens
acgatgacagtgtt

SEQ ID NO: 4259643 - DNA, 20 bp, Homo sapiens
acgtccatcacgttagctgt

SEQ ID NO: 4259644 - DNA, 13 bp, Homo sapiens
actacacacagta

SEQ ID NO: 4259645 - DNA, 22 bp, Homo sapiens
actcacctgcactaacagagtg

SEQ ID NO: 4259646 - DNA, 17 bp, Homo sapiens
actcagctgtcctgcag

SEQ ID NO: 4259647 - DNA, 21 bp, Homo sapiens
actctaaaattataaatgaca

SEQ ID NO: 4259648 - DNA, 13 bp, Homo sapiens
actctggccctgg

SEQ ID NO: 4259649 - DNA, 14 bp, Homo sapiens
actctggccctggc

SEQ ID NO: 4259650 - DNA, 23 bp, Homo sapiens
actctgggctgtaacgtggcact

SEQ ID NO: 4259651 - DNA, 11 bp, Homo sapiens
actctgtccag

SEQ ID NO: 4259652 - DNA, 16 bp, Homo sapiens
actgcagcacctccag

SEQ ID NO: 4259653 - DNA, 22 bp, Homo sapiens
actgcagcacctccaggcctgt

SEQ ID NO: 4259654 - DNA, 21 bp, Homo sapiens
actggaggcccctggagccag

SEQ ID NO: 4259655 - DNA, 15 bp, Homo sapiens
actgtaacattcagg

SEQ ID NO: 4259656 - DNA, 14 bp, Homo sapiens
actgtatattcagg

SEQ ID NO: 4259657 - DNA, 15 bp, Homo sapiens
acttacatcatgtgt

SEQ ID NO: 4259658 - DNA, 16 bp, Homo sapiens
actttagaagcctgca

SEQ ID NO: 4259659 - DNA, 14 bp, Homo sapiens
actttgacagtgtt

SEQ ID NO: 4259660 - DNA, 20 bp, Homo sapiens
actttgacctaaattattta

SEQ ID NO: 4259661 - DNA, 13 bp, Homo sapiens
agaaacaaagatg

SEQ ID NO: 4259662 - DNA, 13 bp, Homo sapiens
agaaacagccagc

SEQ ID NO: 4259663 - DNA, 16 bp, Homo sapiens
agaaatagaattataa

SEQ ID NO: 4259664 - DNA, 19 bp, Homo sapiens
agaaattacctgtggatat

SEQ ID NO: 4259665 - DNA, 11 bp, Homo sapiens
agaacacagtt

SEQ ID NO: 4259666 - DNA, 11 bp, Homo sapiens
agaagcctgca

SEQ ID NO: 4259667 - DNA, 22 bp, Homo sapiens
agaaggaggaatgctggactgg

SEQ ID NO: 4259668 - DNA, 17 bp, Homo sapiens
agaatagaacacagttt

SEQ ID NO: 4259669 - DNA, 24 bp, Homo sapiens
agactgaatagatatgaaagctga

SEQ ID NO: 4259670 - DNA, 15 bp, Homo sapiens
agagcccctcctcca

SEQ ID NO: 4259671 - DNA, 15 bp, Homo sapiens
agatatgaaagctga

SEQ ID NO: 4259672 - DNA, 17 bp, Homo sapiens
agatcaacgcctcactg

SEQ ID NO: 4259673 - DNA, 22 bp, Homo sapiens
agatggcaagagggtgacagct

SEQ ID NO: 4259674 - DNA, 23 bp, Homo sapiens
agcaacgcttgtagaactcactc

SEQ ID NO: 4259675 - DNA, 13 bp, Homo sapiens
agccaaatttaaa

SEQ ID NO: 4259676 - DNA, 21 bp, Homo sapiens
agcccatccattaggccagca

SEQ ID NO: 4259677 - DNA, 11 bp, Homo sapiens
agcccctgtcc

SEQ ID NO: 4259678 - DNA, 13 bp, Homo sapiens
agcccctgtccca

SEQ ID NO: 4259679 - DNA, 12 bp, Homo sapiens
agccgactctgg

SEQ ID NO: 4259680 - DNA, 20 bp, Homo sapiens
agccgactctggccctggcc

SEQ ID NO: 4259681 - DNA, 21 bp, Homo sapiens
agccgactctggccctggccc

SEQ ID NO: 4259682 - DNA, 18 bp, Homo sapiens
agcctaaggctcctgttt

SEQ ID NO: 4259683 - DNA, 19 bp, Homo sapiens
agcctaaggctcctgtttt

SEQ ID NO: 4259684 - DNA, 22 bp, Homo sapiens
agcctccaccccacaacccaaa

SEQ ID NO: 4259685 - DNA, 10 bp, Homo sapiens
agcctgctca

SEQ ID NO: 4259686 - DNA, 17 bp, Homo sapiens
agctctctaggcctctc

SEQ ID NO: 4259687 - DNA, 22 bp, Homo sapiens
agctctctaggcctctccagtt

SEQ ID NO: 4259688 - DNA, 22 bp, Homo sapiens
agctgtcctgcagcaaacactc

SEQ ID NO: 4259689 - DNA, 18 bp, Homo sapiens
agcttcacagtacccaaa

SEQ ID NO: 4259690 - DNA, 17 bp, Homo sapiens
aggaatgctggactgga

SEQ ID NO: 4259691 - DNA, 18 bp, Homo sapiens
aggactgatttcagagtg

SEQ ID NO: 4259692 - DNA, 16 bp, Homo sapiens
aggacttgaaagaaat

SEQ ID NO: 4259693 - DNA, 15 bp, Homo sapiens
aggagctgatacttt

SEQ ID NO: 4259694 - DNA, 19 bp, Homo sapiens
aggaggaatgctggactgg

SEQ ID NO: 4259695 - DNA, 14 bp, Homo sapiens
aggatccggaaaga

SEQ ID NO: 4259696 - DNA, 23 bp, Homo sapiens
aggcacctacactcacctgcact

SEQ ID NO: 4259697 - DNA, 21 bp, Homo sapiens
aggccaaagagtctccagttt

SEQ ID NO: 4259698 - DNA, 16 bp, Homo sapiens
aggctcctgttttgca

SEQ ID NO: 4259699 - DNA, 15 bp, Homo sapiens
agggcactgggctgt

SEQ ID NO: 4259700 - DNA, 20 bp, Homo sapiens
aggggccttagggcactggg

SEQ ID NO: 4259701 - DNA, 20 bp, Homo sapiens
agggtggttcaacaaagaaa

SEQ ID NO: 4259702 - DNA, 19 bp, Homo sapiens
aggtacgatgacagtgttc

SEQ ID NO: 4259703 - DNA, 17 bp, Homo sapiens
aggtgctaatttgtttt

SEQ ID NO: 4259704 - DNA, 23 bp, Homo sapiens
aggtgctaatttgttttggatat

SEQ ID NO: 4259705 - DNA, 19 bp, Homo sapiens
agtataagactactgaatc

SEQ ID NO: 4259706 - DNA, 21 bp, Homo sapiens
agtatattgataaccttgaaa

SEQ ID NO: 4259707 - DNA, 23 bp, Homo sapiens
agtcactggtctgtttgcatttg

SEQ ID NO: 4259708 - DNA, 24 bp, Homo sapiens
agtggaacgaaaatgaaagctact

SEQ ID NO: 4259709 - DNA, 16 bp, Homo sapiens
agtggatcacaaagtg

SEQ ID NO: 4259710 - DNA, 13 bp, Homo sapiens
agttttaactgtg

SEQ ID NO: 4259711 - DNA, 18 bp, Homo sapiens
ataaatgtaccagagaga

SEQ ID NO: 4259712 - DNA, 19 bp, Homo sapiens
atactgtatattcaggact

SEQ ID NO: 4259713 - DNA, 18 bp, Homo sapiens
atacttatttgtatatgg

SEQ ID NO: 4259714 - DNA, 14 bp, Homo sapiens
atcacaaagtggaa

SEQ ID NO: 4259715 - DNA, 24 bp, Homo sapiens
atcacaaagtggaacgaaaatgaa

SEQ ID NO: 4259716 - DNA, 15 bp, Homo sapiens
atccattaggccagc

SEQ ID NO: 4259717 - DNA, 15 bp, Homo sapiens
atccctgaggactga

SEQ ID NO: 4259718 - DNA, 18 bp, Homo sapiens
atccctgaggactgattt

SEQ ID NO: 4259719 - DNA, 13 bp, Homo sapiens
atccggaaagaag

SEQ ID NO: 4259720 - DNA, 22 bp, Homo sapiens
atgattagaaattacctgtgga

SEQ ID NO: 4259721 - DNA, 19 bp, Homo sapiens
atggatgcccagaggactc

SEQ ID NO: 4259722 - DNA, 16 bp, Homo sapiens
atggatttttctttaa

SEQ ID NO: 4259723 - DNA, 20 bp, Homo sapiens
atggatttttctttaactgc

SEQ ID NO: 4259724 - DNA, 15 bp, Homo sapiens
attacctgtggatat

SEQ ID NO: 4259725 - DNA, 21 bp, Homo sapiens
attactttggggctaatttaa

SEQ ID NO: 4259726 - DNA, 18 bp, Homo sapiens
attaggccagcaacgctt

SEQ ID NO: 4259727 - DNA, 19 bp, Homo sapiens
attgataaccttgaaaaaa

SEQ ID NO: 4259728 - DNA, 22 bp, Homo sapiens
attggatattttttactttaga

SEQ ID NO: 4259729 - DNA, 15 bp, Homo sapiens
attgtaaaaatggca

SEQ ID NO: 4259730 - DNA, 19 bp, Homo sapiens
attgttacgtagcctaagg

SEQ ID NO: 4259731 - DNA, 22 bp, Homo sapiens
atttattttttcttttctttac

SEQ ID NO: 4259732 - DNA, 19 bp, Homo sapiens
atttcaggcattggatatt

SEQ ID NO: 4259733 - DNA, 15 bp, Homo sapiens
atttcatgattagaa

SEQ ID NO: 4259734 - DNA, 18 bp, Homo sapiens
atttggatttaaaagcct

SEQ ID NO: 4259735 - DNA, 23 bp, Homo sapiens
atttggatttaaaagcctgctca

SEQ ID NO: 4259736 - DNA, 20 bp, Homo sapiens
attttcccccactactgcag

SEQ ID NO: 4259737 - DNA, 11 bp, Homo sapiens
attttgtttac

SEQ ID NO: 4259738 - DNA, 12 bp, Homo sapiens
attttgtttaca

SEQ ID NO: 4259739 - DNA, 22 bp, Homo sapiens
caaaatatattttgtttacaaa

SEQ ID NO: 4259740 - DNA, 18 bp, Homo sapiens
caaacactccaccctcca

SEQ ID NO: 4259741 - DNA, 12 bp, Homo sapiens
caaagatgaaaa

SEQ ID NO: 4259742 - DNA, 18 bp, Homo sapiens
caaatactgtatattcag

SEQ ID NO: 4259743 - DNA, 17 bp, Homo sapiens
caacagcaaacaggtgc

SEQ ID NO: 4259744 - DNA, 20 bp, Homo sapiens
caacggaaagtgctgtctta

SEQ ID NO: 4259745 - DNA, 16 bp, Homo sapiens
caagaaacagccagca

SEQ ID NO: 4259746 - DNA, 19 bp, Homo sapiens
cacccaatcaagggaagaa

SEQ ID NO: 4259747 - DNA, 20 bp, Homo sapiens
cacctgtccccaccctccac

SEQ ID NO: 4259748 - DNA, 18 bp, Homo sapiens
caccttccattttccccc

SEQ ID NO: 4259749 - DNA, 22 bp, Homo sapiens
cactcagctgtcctgcagcaaa

SEQ ID NO: 4259750 - DNA, 15 bp, Homo sapiens
cactccaccctccac

SEQ ID NO: 4259751 - DNA, 17 bp, Homo sapiens
cactccaccctccacct

SEQ ID NO: 4259752 - DNA, 18 bp, Homo sapiens
cactccaccctccacctt

SEQ ID NO: 4259753 - DNA, 19 bp, Homo sapiens
cactggtaggttgggacac

SEQ ID NO: 4259754 - DNA, 22 bp, Homo sapiens
cactggtaggttgggacaccag

SEQ ID NO: 4259755 - DNA, 16 bp, Homo sapiens
cagagcccctcctcca

SEQ ID NO: 4259756 - DNA, 15 bp, Homo sapiens
cagcaaacactccac

SEQ ID NO: 4259757 - DNA, 21 bp, Homo sapiens
cagcaaacactccaccctcca

SEQ ID NO: 4259758 - DNA, 18 bp, Homo sapiens
cagcaacgcttgtagaac

SEQ ID NO: 4259759 - DNA, 16 bp, Homo sapiens
cagcattgtatatgtg

SEQ ID NO: 4259760 - DNA, 22 bp, Homo sapiens
cagccaaatttaaaactgttgg

SEQ ID NO: 4259761 - DNA, 22 bp, Homo sapiens
cagcccatccattaggccagca

SEQ ID NO: 4259762 - DNA, 14 bp, Homo sapiens
cagcccctgtccca

SEQ ID NO: 4259763 - DNA, 15 bp, Homo sapiens
caggttataacagtg

SEQ ID NO: 4259764 - DNA, 15 bp, Homo sapiens
cagttcctttagaaa

SEQ ID NO: 4259765 - DNA, 12 bp, Homo sapiens
cagttttaactg

SEQ ID NO: 4259766 - DNA, 23 bp, Homo sapiens
cataatgtttctggatttcatac

SEQ ID NO: 4259767 - DNA, 18 bp, Homo sapiens
catagcgggggcctaaaa

SEQ ID NO: 4259768 - DNA, 15 bp, Homo sapiens
catcactttgaccta

SEQ ID NO: 4259769 - DNA, 15 bp, Homo sapiens
catcctaccgtcttt

SEQ ID NO: 4259770 - DNA, 23 bp, Homo sapiens
catggctgtgtttgcagcctgct

SEQ ID NO: 4259771 - DNA, 15 bp, Homo sapiens
catgtggccccaccc

SEQ ID NO: 4259772 - DNA, 20 bp, Homo sapiens
cattaggccagcaacgcttg

SEQ ID NO: 4259773 - DNA, 21 bp, Homo sapiens
cattgaagccgactctggccc

SEQ ID NO: 4259774 - DNA, 17 bp, Homo sapiens
cattgtttcgtaacaca

SEQ ID NO: 4259775 - DNA, 21 bp, Homo sapiens
cattttcccccactactgcag

SEQ ID NO: 4259776 - DNA, 23 bp, Homo sapiens
ccaaaaggtttaagaaatagaat

SEQ ID NO: 4259777 - DNA, 17 bp, Homo sapiens
ccaaactgatccagtat

SEQ ID NO: 4259778 - DNA, 11 bp, Homo sapiens
ccaaatttaaa

SEQ ID NO: 4259779 - DNA, 13 bp, Homo sapiens
ccaccctccactc

SEQ ID NO: 4259780 - DNA, 21 bp, Homo sapiens
ccagcccatccattaggccag

SEQ ID NO: 4259781 - DNA, 22 bp, Homo sapiens
ccagcccatccattaggccagc

SEQ ID NO: 4259782 - DNA, 16 bp, Homo sapiens
ccatccattaggccag

SEQ ID NO: 4259783 - DNA, 14 bp, Homo sapiens
ccattaggccagca

SEQ ID NO: 4259784 - DNA, 22 bp, Homo sapiens
ccattttcccccactactgcag

SEQ ID NO: 4259785 - DNA, 13 bp, Homo sapiens
cccaccctccact

SEQ ID NO: 4259786 - DNA, 20 bp, Homo sapiens
cccagttgcactcaggtgac

SEQ ID NO: 4259787 - DNA, 14 bp, Homo sapiens
cccatccattaggc

SEQ ID NO: 4259788 - DNA, 19 bp, Homo sapiens
cccatccattaggccagca

SEQ ID NO: 4259789 - DNA, 21 bp, Homo sapiens
ccccactactgcagcacctcc

SEQ ID NO: 4259790 - DNA, 19 bp, Homo sapiens
ccccagagcccctcctcca

SEQ ID NO: 4259791 - DNA, 13 bp, Homo sapiens
cccctcctccagc

SEQ ID NO: 4259792 - DNA, 11 bp, Homo sapiens
cccctggagcc

SEQ ID NO: 4259793 - DNA, 18 bp, Homo sapiens
ccctcctccagcccctgt

SEQ ID NO: 4259794 - DNA, 21 bp, Homo sapiens
cccttcccccagcccatccat

SEQ ID NO: 4259795 - DNA, 13 bp, Homo sapiens
ccgtaatttaact

SEQ ID NO: 4259796 - DNA, 15 bp, Homo sapiens
cctacagttttaact

SEQ ID NO: 4259797 - DNA, 17 bp, Homo sapiens
cctacagttttaactgt

SEQ ID NO: 4259798 - DNA, 16 bp, Homo sapiens
cctagctgtgtgaata

SEQ ID NO: 4259799 - DNA, 14 bp, Homo sapiens
cctccaccttccat

SEQ ID NO: 4259800 - DNA, 12 bp, Homo sapiens
cctccaggcctg

SEQ ID NO: 4259801 - DNA, 24 bp, Homo sapiens
cctgcagcaaacactccaccctcc

SEQ ID NO: 4259802 - DNA, 16 bp, Homo sapiens
cctgcccagttgcact

SEQ ID NO: 4259803 - DNA, 12 bp, Homo sapiens
cctggcccttac

SEQ ID NO: 4259804 - DNA, 18 bp, Homo sapiens
cctggcccttacttgctt

SEQ ID NO: 4259805 - DNA, 13 bp, Homo sapiens
cctgtccccaccc

SEQ ID NO: 4259806 - DNA, 17 bp, Homo sapiens
cctgtccccaccctcca

SEQ ID NO: 4259807 - DNA, 19 bp, Homo sapiens
cctgtccccaccctccact

SEQ ID NO: 4259808 - DNA, 17 bp, Homo sapiens
cgagagatcaaagatga

SEQ ID NO: 4259809 - DNA, 19 bp, Homo sapiens
cgcttgtagaactcactct

SEQ ID NO: 4259810 - DNA, 15 bp, Homo sapiens
ctaaaaaaaagatga

SEQ ID NO: 4259811 - DNA, 16 bp, Homo sapiens
ctaaggctcctgtttt

SEQ ID NO: 4259812 - DNA, 11 bp, Homo sapiens
ctaatttaaca

SEQ ID NO: 4259813 - DNA, 19 bp, Homo sapiens
ctactgcagcacctccagg

SEQ ID NO: 4259814 - DNA, 21 bp, Homo sapiens
ctagctctctaggcctctcca

SEQ ID NO: 4259815 - DNA, 15 bp, Homo sapiens
ctaggcctctccagt

SEQ ID NO: 4259816 - DNA, 14 bp, Homo sapiens
ctaggtacgatgac

SEQ ID NO: 4259817 - DNA, 13 bp, Homo sapiens
ctagtgggacagc

SEQ ID NO: 4259818 - DNA, 17 bp, Homo sapiens
ctagtgggacagcccag

SEQ ID NO: 4259819 - DNA, 16 bp, Homo sapiens
ctagttatacttattt

SEQ ID NO: 4259820 - DNA, 16 bp, Homo sapiens
ctatagagcctacctg

SEQ ID NO: 4259821 - DNA, 11 bp, Homo sapiens
ctcactctggg

SEQ ID NO: 4259822 - DNA, 13 bp, Homo sapiens
ctcactctgggct

SEQ ID NO: 4259823 - DNA, 19 bp, Homo sapiens
ctcagctgtcctgcagcaa

SEQ ID NO: 4259824 - DNA, 16 bp, Homo sapiens
ctccaccctccacctt

SEQ ID NO: 4259825 - DNA, 15 bp, Homo sapiens
ctccactcagctgtc

SEQ ID NO: 4259826 - DNA, 23 bp, Homo sapiens
ctccactcagctgtcctgcagca

SEQ ID NO: 4259827 - DNA, 14 bp, Homo sapiens
ctccagcccctgtc

SEQ ID NO: 4259828 - DNA, 15 bp, Homo sapiens
ctccagcccctgtcc

SEQ ID NO: 4259829 - DNA, 21 bp, Homo sapiens
ctccagtttgcacctgtcccc

SEQ ID NO: 4259830 - DNA, 16 bp, Homo sapiens
ctcccaaccctggctt

SEQ ID NO: 4259831 - DNA, 15 bp, Homo sapiens
ctccctttcactaaa

SEQ ID NO: 4259832 - DNA, 15 bp, Homo sapiens
ctcctccagcccctg

SEQ ID NO: 4259833 - DNA, 19 bp, Homo sapiens
ctcctgttttgcacagcca

SEQ ID NO: 4259834 - DNA, 19 bp, Homo sapiens
ctccttcatgacagcctcc

SEQ ID NO: 4259835 - DNA, 23 bp, Homo sapiens
ctctaggtacgatgacagtgttc

SEQ ID NO: 4259836 - DNA, 19 bp, Homo sapiens
ctctagtgggacagcccag

SEQ ID NO: 4259837 - DNA, 19 bp, Homo sapiens
ctctctaggcctctccagt

SEQ ID NO: 4259838 - DNA, 15 bp, Homo sapiens
ctgaatctgctacca

SEQ ID NO: 4259839 - DNA, 22 bp, Homo sapiens
ctgaggactgatttcagagtga

SEQ ID NO: 4259840 - DNA, 20 bp, Homo sapiens
ctgatactttgacagtgttt

SEQ ID NO: 4259841 - DNA, 19 bp, Homo sapiens
ctgcaaatactgtatattc

SEQ ID NO: 4259842 - DNA, 18 bp, Homo sapiens
ctgcagcaaacactccac

SEQ ID NO: 4259843 - DNA, 15 bp, Homo sapiens
ctgcagcacctccag

SEQ ID NO: 4259844 - DNA, 17 bp, Homo sapiens
ctgcagcacctccaggc

SEQ ID NO: 4259845 - DNA, 19 bp, Homo sapiens
ctgcagcacctccaggcct

SEQ ID NO: 4259846 - DNA, 18 bp, Homo sapiens
ctgctcacgtcaaatgca

SEQ ID NO: 4259847 - DNA, 16 bp, Homo sapiens
ctgctctagtgggaca

SEQ ID NO: 4259848 - DNA, 17 bp, Homo sapiens
ctggaggcccctggagc

SEQ ID NO: 4259849 - DNA, 12 bp, Homo sapiens
ctgggctgttgt

SEQ ID NO: 4259850 - DNA, 14 bp, Homo sapiens
ctgggctgttgttc

SEQ ID NO: 4259851 - DNA, 22 bp, Homo sapiens
ctggtaggttgggacaccaggg

SEQ ID NO: 4259852 - DNA, 23 bp, Homo sapiens
ctgtgttactaaaaaaaagatga

SEQ ID NO: 4259853 - DNA, 20 bp, Homo sapiens
ctgtgtttgcagcctgctct

SEQ ID NO: 4259854 - DNA, 23 bp, Homo sapiens
ctgtgtttgcagcctgctctagt

SEQ ID NO: 4259855 - DNA, 18 bp, Homo sapiens
ctgtgttttgaaagaata

SEQ ID NO: 4259856 - DNA, 23 bp, Homo sapiens
ctgttgctatagagcctacctgt

SEQ ID NO: 4259857 - DNA, 16 bp, Homo sapiens
ctgtttcctagctgtg

SEQ ID NO: 4259858 - DNA, 17 bp, Homo sapiens
ctgtttcctagctgtgt

SEQ ID NO: 4259859 - DNA, 15 bp, Homo sapiens
cttaaactaaatgtg

SEQ ID NO: 4259860 - DNA, 13 bp, Homo sapiens
cttagggcactgg

SEQ ID NO: 4259861 - DNA, 16 bp, Homo sapiens
cttcatgacagcctcc

SEQ ID NO: 4259862 - DNA, 14 bp, Homo sapiens
cttccattttcccc

SEQ ID NO: 4259863 - DNA, 22 bp, Homo sapiens
cttccattttcccccactactg

SEQ ID NO: 4259864 - DNA, 14 bp, Homo sapiens
cttcccccagccca

SEQ ID NO: 4259865 - DNA, 18 bp, Homo sapiens
cttgaaaaaaaacagtgg

SEQ ID NO: 4259866 - DNA, 20 bp, Homo sapiens
cttgaaaaaaaacagtggat

SEQ ID NO: 4259867 - DNA, 13 bp, Homo sapiens
cttgaaagaaatg

SEQ ID NO: 4259868 - DNA, 19 bp, Homo sapiens
cttgtagaactcactctgg

SEQ ID NO: 4259869 - DNA, 23 bp, Homo sapiens
cttgtagaactcactctgggctg

SEQ ID NO: 4259870 - DNA, 12 bp, Homo sapiens
tcactctgggct

SEQ ID NO: 4259871 - DNA, 16 bp, Homo sapiens
tcaggaattcttggag

SEQ ID NO: 4259872 - DNA, 18 bp, Homo sapiens
tcaggaattcttggagaa

SEQ ID NO: 4259873 - DNA, 16 bp, Homo sapiens
tcaggacttgaaagaa

SEQ ID NO: 4259874 - DNA, 21 bp, Homo sapiens
tcatcactttgacctaaatta

SEQ ID NO: 4259875 - DNA, 21 bp, Homo sapiens
tccactcagctgtcctgcagc

SEQ ID NO: 4259876 - DNA, 12 bp, Homo sapiens
tccagcccctgt

SEQ ID NO: 4259877 - DNA, 17 bp, Homo sapiens
tccagttcctttagaaa

SEQ ID NO: 4259878 - DNA, 17 bp, Homo sapiens
tccattttcccccacta

SEQ ID NO: 4259879 - DNA, 15 bp, Homo sapiens
tcccaaccctggctt

SEQ ID NO: 4259880 - DNA, 24 bp, Homo sapiens
tcccccactactgcagcacctcca

SEQ ID NO: 4259881 - DNA, 23 bp, Homo sapiens
tccccgataccatgctgtaagga

SEQ ID NO: 4259882 - DNA, 14 bp, Homo sapiens
tccctaatgtgttt

SEQ ID NO: 4259883 - DNA, 12 bp, Homo sapiens
tccggaaagaag

SEQ ID NO: 4259884 - DNA, 13 bp, Homo sapiens
tcctaccgtcttt

SEQ ID NO: 4259885 - DNA, 17 bp, Homo sapiens
tcctagctgtgtgaata

SEQ ID NO: 4259886 - DNA, 18 bp, Homo sapiens
tcctccagcccctgtccc

SEQ ID NO: 4259887 - DNA, 18 bp, Homo sapiens
tcctgtgtgtactctgtc

SEQ ID NO: 4259888 - DNA, 19 bp, Homo sapiens
tccttcatgacagcctcca

SEQ ID NO: 4259889 - DNA, 14 bp, Homo sapiens
tctagctctctagg

SEQ ID NO: 4259890 - DNA, 19 bp, Homo sapiens
tctagtgggacagcccaga

SEQ ID NO: 4259891 - DNA, 22 bp, Homo sapiens
tctttaactgccgtaatttaac

SEQ ID NO: 4259892 - DNA, 12 bp, Homo sapiens
tcttttctttac

SEQ ID NO: 4259893 - DNA, 16 bp, Homo sapiens
tgaaaaaaaacagtgg

SEQ ID NO: 4259894 - DNA, 20 bp, Homo sapiens
tgaaaagggtgttgggaggg

SEQ ID NO: 4259895 - DNA, 15 bp, Homo sapiens
tgaaagctactcata

SEQ ID NO: 4259896 - DNA, 18 bp, Homo sapiens
tgaagccgactctggccc

SEQ ID NO: 4259897 - DNA, 18 bp, Homo sapiens
tgaatagatatgaaagct

SEQ ID NO: 4259898 - DNA, 19 bp, Homo sapiens
tgaatgcctatggtggatc

SEQ ID NO: 4259899 - DNA, 21 bp, Homo sapiens
tgactaacaggccaaagagtc

SEQ ID NO: 4259900 - DNA, 18 bp, Homo sapiens
tgatctacttctgtaatt

SEQ ID NO: 4259901 - DNA, 16 bp, Homo sapiens
tgcaacagacttgaat

SEQ ID NO: 4259902 - DNA, 13 bp, Homo sapiens
tgcacctgtcccc

SEQ ID NO: 4259903 - DNA, 14 bp, Homo sapiens
tgcagcacctccag

SEQ ID NO: 4259904 - DNA, 20 bp, Homo sapiens
tgcagcacctccaggcctgt

SEQ ID NO: 4259905 - DNA, 22 bp, Homo sapiens
tgcagcctgctctagtgggaca

SEQ ID NO: 4259906 - DNA, 18 bp, Homo sapiens
tgcccatcatgtggcccc

SEQ ID NO: 4259907 - DNA, 14 bp, Homo sapiens
tgccgtaatttaac

SEQ ID NO: 4259908 - DNA, 10 bp, Homo sapiens
tgcttctcta

SEQ ID NO: 4259909 - DNA, 20 bp, Homo sapiens
tggaggcccctggagccaga

SEQ ID NO: 4259910 - DNA, 15 bp, Homo sapiens
tggatcacaaagtgg

SEQ ID NO: 4259911 - DNA, 22 bp, Homo sapiens
tggcaagagggtgacagcttcc

SEQ ID NO: 4259912 - DNA, 13 bp, Homo sapiens
tggccctggccct

SEQ ID NO: 4259913 - DNA, 22 bp, Homo sapiens
tggctgcccatcatgtggcccc

SEQ ID NO: 4259914 - DNA, 13 bp, Homo sapiens
tgggacaccaggg

SEQ ID NO: 4259915 - DNA, 18 bp, Homo sapiens
tgggacaccagggaagaa

SEQ ID NO: 4259916 - DNA, 20 bp, Homo sapiens
tgggctgtaacgtggcactg

SEQ ID NO: 4259917 - DNA, 20 bp, Homo sapiens
tggggtcaagaaacagccag

SEQ ID NO: 4259918 - DNA, 18 bp, Homo sapiens
tggtaggttgggacacca

SEQ ID NO: 4259919 - DNA, 11 bp, Homo sapiens
tgtaaagatgt

SEQ ID NO: 4259920 - DNA, 16 bp, Homo sapiens
tgtactaactagcatt

SEQ ID NO: 4259921 - DNA, 21 bp, Homo sapiens
tgtagaactcactctgggctg

SEQ ID NO: 4259922 - DNA, 18 bp, Homo sapiens
tgtataaaagtgtgaaat

SEQ ID NO: 4259923 - DNA, 22 bp, Homo sapiens
tgtatgtcaataaacaacagct

SEQ ID NO: 4259924 - DNA, 21 bp, Homo sapiens
tgtgaatacctgctcacgtca

SEQ ID NO: 4259925 - DNA, 16 bp, Homo sapiens
tgtgcaatagaaggtg

SEQ ID NO: 4259926 - DNA, 14 bp, Homo sapiens
tgtggattctttaa

SEQ ID NO: 4259927 - DNA, 14 bp, Homo sapiens
tgtgtactctgtcc

SEQ ID NO: 4259928 - DNA, 23 bp, Homo sapiens
tgtgttactaaaaaaaagatgaa

SEQ ID NO: 4259929 - DNA, 21 bp, Homo sapiens
ctttaactgccgtaatttaac

SEQ ID NO: 4259930 - DNA, 23 bp, Homo sapiens
ctttaactgccgtaatttaactt

SEQ ID NO: 4259931 - DNA, 15 bp, Homo sapiens
ctttagaagcctgca

SEQ ID NO: 4259932 - DNA, 18 bp, Homo sapiens
ctttggggctaatttaac

SEQ ID NO: 4259933 - DNA, 22 bp, Homo sapiens
ctttttccaactcagaaattca

SEQ ID NO: 4259934 - DNA, 13 bp, Homo sapiens
gaaagaatagaac

SEQ ID NO: 4259935 - DNA, 16 bp, Homo sapiens
gaaatagaattataac

SEQ ID NO: 4259936 - DNA, 16 bp, Homo sapiens
gaaattacctgtggat

SEQ ID NO: 4259937 - DNA, 19 bp, Homo sapiens
gaacctacagttttaactg

SEQ ID NO: 4259938 - DNA, 15 bp, Homo sapiens
gaactcactctgggc

SEQ ID NO: 4259939 - DNA, 22 bp, Homo sapiens
gaagagcgagagatcaaagatg

SEQ ID NO: 4259940 - DNA, 19 bp, Homo sapiens
gaagccgactctggccctg

SEQ ID NO: 4259941 - DNA, 15 bp, Homo sapiens
gacagcccagagcct

SEQ ID NO: 4259942 - DNA, 16 bp, Homo sapiens
gactctggccctggcc

SEQ ID NO: 4259943 - DNA, 16 bp, Homo sapiens
gactgatttcagagtg

SEQ ID NO: 4259944 - DNA, 14 bp, Homo sapiens
gagatcaaagatga

SEQ ID NO: 4259945 - DNA, 15 bp, Homo sapiens
gagcccctcctccag

SEQ ID NO: 4259946 - DNA, 22 bp, Homo sapiens
gagcccctcctccagcccctgt

SEQ ID NO: 4259947 - DNA, 20 bp, Homo sapiens
gagcgagagatcaaagatga

SEQ ID NO: 4259948 - DNA, 18 bp, Homo sapiens
gaggcccctggagccaga

SEQ ID NO: 4259949 - DNA, 18 bp, Homo sapiens
gagggtgacagcttcctt

SEQ ID NO: 4259950 - DNA, 13 bp, Homo sapiens
gatactaaggacg

SEQ ID NO: 4259951 - DNA, 16 bp, Homo sapiens
gatcaacgcctcactg

SEQ ID NO: 4259952 - DNA, 16 bp, Homo sapiens
gatccagtataagact

SEQ ID NO: 4259953 - DNA, 17 bp, Homo sapiens
gatccagtataagacta

SEQ ID NO: 4259954 - DNA, 20 bp, Homo sapiens
gcacctccaggcctgttgct

SEQ ID NO: 4259955 - DNA, 15 bp, Homo sapiens
gcacctgtccccacc

SEQ ID NO: 4259956 - DNA, 23 bp, Homo sapiens
gcacctgtccccaccctccactc

SEQ ID NO: 4259957 - DNA, 23 bp, Homo sapiens
gcactggtaggttgggacaccag

SEQ ID NO: 4259958 - DNA, 16 bp, Homo sapiens
gcagcaaacactccac

SEQ ID NO: 4259959 - DNA, 14 bp, Homo sapiens
gcagcacctccagg

SEQ ID NO: 4259960 - DNA, 15 bp, Homo sapiens
gcagcacctccaggc

SEQ ID NO: 4259961 - DNA, 16 bp, Homo sapiens
gcagcacctccaggcc

SEQ ID NO: 4259962 - DNA, 18 bp, Homo sapiens
gcagcacctccaggcctg

SEQ ID NO: 4259963 - DNA, 16 bp, Homo sapiens
gcagcctgctctagtg

SEQ ID NO: 4259964 - DNA, 18 bp, Homo sapiens
gcattggatattttttac

SEQ ID NO: 4259965 - DNA, 19 bp, Homo sapiens
gccagcaagagttaggggc

SEQ ID NO: 4259966 - DNA, 13 bp, Homo sapiens
gcccagagcctgg

SEQ ID NO: 4259967 - DNA, 16 bp, Homo sapiens
gcccagaggactccca

SEQ ID NO: 4259968 - DNA, 15 bp, Homo sapiens
gccgactctggccct

SEQ ID NO: 4259969 - DNA, 16 bp, Homo sapiens
gccgactctggccctg

SEQ ID NO: 4259970 - DNA, 17 bp, Homo sapiens
gccgactctggccctgg

SEQ ID NO: 4259971 - DNA, 13 bp, Homo sapiens
gccgtaatttaac

SEQ ID NO: 4259972 - DNA, 12 bp, Homo sapiens
gcctcactgaaa

SEQ ID NO: 4259973 - DNA, 20 bp, Homo sapiens
gcctgttgctatagagccta

SEQ ID NO: 4259974 - DNA, 19 bp, Homo sapiens
gcgagagatcaaagatgaa

SEQ ID NO: 4259975 - DNA, 14 bp, Homo sapiens
gctctagtgggaca

SEQ ID NO: 4259976 - DNA, 15 bp, Homo sapiens
gctctagtgggacag

SEQ ID NO: 4259977 - DNA, 21 bp, Homo sapiens
gctctagtgggacagcccaga

SEQ ID NO: 4259978 - DNA, 18 bp, Homo sapiens
gctgaggaggcacctaca

SEQ ID NO: 4259979 - DNA, 19 bp, Homo sapiens
gctgcccatcatgtggccc

SEQ ID NO: 4259980 - DNA, 23 bp, Homo sapiens
gctggactggaggcccctggagc

SEQ ID NO: 4259981 - DNA, 16 bp, Homo sapiens
tgtgttttgaaagaat

SEQ ID NO: 4259982 - DNA, 14 bp, Homo sapiens
tgttaaaaatgtca

SEQ ID NO: 4259983 - DNA, 21 bp, Homo sapiens
tgtttacaaaaatttctgtaa

SEQ ID NO: 4259984 - DNA, 13 bp, Homo sapiens
tgtttatttcagg

SEQ ID NO: 4259985 - DNA, 17 bp, Homo sapiens
tgtttctggatttcata

SEQ ID NO: 4259986 - DNA, 17 bp, Homo sapiens
tgtttgcagcctgctct

SEQ ID NO: 4259987 - DNA, 13 bp, Homo sapiens
tgttttaattgta

SEQ ID NO: 4259988 - DNA, 18 bp, Homo sapiens
tgttttgcacagccaaat

SEQ ID NO: 4259989 - DNA, 23 bp, Homo sapiens
ttaaacgctctaggtacgatgac

SEQ ID NO: 4259990 - DNA, 20 bp, Homo sapiens
ttacctgtggatatttgtat

SEQ ID NO: 4259991 - DNA, 12 bp, Homo sapiens
ttactcactgct

SEQ ID NO: 4259992 - DNA, 13 bp, Homo sapiens
ttacttgcttctc

SEQ ID NO: 4259993 - DNA, 19 bp, Homo sapiens
ttagaaattacctgtggat

SEQ ID NO: 4259994 - DNA, 10 bp, Homo sapiens
ttaggccagc

SEQ ID NO: 4259995 - DNA, 12 bp, Homo sapiens
ttataaaagtgt

SEQ ID NO: 4259996 - DNA, 18 bp, Homo sapiens
ttataactgtaaagatgt

SEQ ID NO: 4259997 - DNA, 19 bp, Homo sapiens
ttcacagtacccaaactgc

SEQ ID NO: 4259998 - DNA, 15 bp, Homo sapiens
ttcatgacagcctcc

SEQ ID NO: 4259999 - DNA, 16 bp, Homo sapiens
ttcatgacagcctcca

SEQ ID NO: 4260000 - DNA, 14 bp, Homo sapiens
ttccattttccccc

SEQ ID NO: 4260001 - DNA, 18 bp, Homo sapiens
ttccattttcccccacta

SEQ ID NO: 4260002 - DNA, 17 bp, Homo sapiens
ttcctgtgtgtactctg

SEQ ID NO: 4260003 - DNA, 23 bp, Homo sapiens
ttcctttcctgtgtgtactctgt

SEQ ID NO: 4260004 - DNA, 20 bp, Homo sapiens
ttctctagctctctaggcct

SEQ ID NO: 4260005 - DNA, 22 bp, Homo sapiens
ttctctagctctctaggcctct

SEQ ID NO: 4260006 - DNA, 18 bp, Homo sapiens
ttgcacagccaaatttaa

SEQ ID NO: 4260007 - DNA, 16 bp, Homo sapiens
ttgcacctgtccccac

SEQ ID NO: 4260008 - DNA, 23 bp, Homo sapiens
ttgcagcctgctctagtgggaca

SEQ ID NO: 4260009 - DNA, 19 bp, Homo sapiens
ttggatattttttacttta

SEQ ID NO: 4260010 - DNA, 19 bp, Homo sapiens
ttggatttaaaagcctgct

SEQ ID NO: 4260011 - DNA, 14 bp, Homo sapiens
ttgggacaccaggg

SEQ ID NO: 4260012 - DNA, 18 bp, Homo sapiens
ttggggaagggcctgccc

SEQ ID NO: 4260013 - DNA, 17 bp, Homo sapiens
ttgtaaaattatttcat

SEQ ID NO: 4260014 - DNA, 19 bp, Homo sapiens
ttgtagaactcactctggg

SEQ ID NO: 4260015 - DNA, 14 bp, Homo sapiens
tttaaaagcctgct

SEQ ID NO: 4260016 - DNA, 18 bp, Homo sapiens
tttaaagtctcagtttct

SEQ ID NO: 4260017 - DNA, 12 bp, Homo sapiens
tttaactgtgga

SEQ ID NO: 4260018 - DNA, 13 bp, Homo sapiens
tttaactgtggat

SEQ ID NO: 4260019 - DNA, 14 bp, Homo sapiens
tttagaagcctgca

SEQ ID NO: 4260020 - DNA, 15 bp, Homo sapiens
tttcaacggaaagtg

SEQ ID NO: 4260021 - DNA, 16 bp, Homo sapiens
tttcgtaacacagcat

SEQ ID NO: 4260022 - DNA, 12 bp, Homo sapiens
tttctttaactg

SEQ ID NO: 4260023 - DNA, 9 bp, Homo sapiens
tttcttttc

SEQ ID NO: 4260024 - DNA, 14 bp, Homo sapiens
tttgatacattttt

SEQ ID NO: 4260025 - DNA, 14 bp, Homo sapiens
ttttaactgtggat

SEQ ID NO: 4260026 - DNA, 18 bp, Homo sapiens
ttttctttaactgccgta

SEQ ID NO: 4260027 - DNA, 14 bp, Homo sapiens
aggcattggatatt

SEQ ID NO: 4260028 - DNA, 14 bp, Homo sapiens
aggcccctggagcc

SEQ ID NO: 4260029 - DNA, 22 bp, Homo sapiens
aggctcctgttttgcacagcca

SEQ ID NO: 4260030 - DNA, 18 bp, Homo sapiens
agggaagaaggaggaatg

SEQ ID NO: 4260031 - DNA, 13 bp, Homo sapiens
agggcactgggct

SEQ ID NO: 4260032 - DNA, 16 bp, Homo sapiens
agggcactgggctgtt

SEQ ID NO: 4260033 - DNA, 18 bp, Homo sapiens
agggcactgggctgttgt

SEQ ID NO: 4260034 - DNA, 17 bp, Homo sapiens
aggggccttagggcact

SEQ ID NO: 4260035 - DNA, 17 bp, Homo sapiens
agggtgacagcttcctt

SEQ ID NO: 4260036 - DNA, 18 bp, Homo sapiens
agtacgaacctacagttt

SEQ ID NO: 4260037 - DNA, 22 bp, Homo sapiens
agtgtctgtgttttgaaagaat

SEQ ID NO: 4260038 - DNA, 14 bp, Homo sapiens
agttaggggcctta

SEQ ID NO: 4260039 - DNA, 15 bp, Homo sapiens
ataaattttttataa

SEQ ID NO: 4260040 - DNA, 16 bp, Homo sapiens
atatattttgtttaca

SEQ ID NO: 4260041 - DNA, 17 bp, Homo sapiens
atatgaaagctgatttt

SEQ ID NO: 4260042 - DNA, 15 bp, Homo sapiens
atcacaaagtggaac

SEQ ID NO: 4260043 - DNA, 17 bp, Homo sapiens
atcatgtggccccaccc

SEQ ID NO: 4260044 - DNA, 18 bp, Homo sapiens
atccattaggccagcaac

SEQ ID NO: 4260045 - DNA, 23 bp, Homo sapiens
atctacttctgtaattgtgtgga

SEQ ID NO: 4260046 - DNA, 19 bp, Homo sapiens
atcttaaaccttaagatac

SEQ ID NO: 4260047 - DNA, 16 bp, Homo sapiens
atgaaaagtatattga

SEQ ID NO: 4260048 - DNA, 23 bp, Homo sapiens
atgattagaaattacctgtggat

SEQ ID NO: 4260049 - DNA, 19 bp, Homo sapiens
atgcctatggtggatccaa

SEQ ID NO: 4260050 - DNA, 19 bp, Homo sapiens
atgtcaataaacaacagct

SEQ ID NO: 4260051 - DNA, 15 bp, Homo sapiens
attataaatgacaac

SEQ ID NO: 4260052 - DNA, 12 bp, Homo sapiens
attataactgta

SEQ ID NO: 4260053 - DNA, 22 bp, Homo sapiens
attgaagccgactctggccctg

SEQ ID NO: 4260054 - DNA, 11 bp, Homo sapiens
attggatattt

SEQ ID NO: 4260055 - DNA, 20 bp, Homo sapiens
attgtaaaattatttcatga

SEQ ID NO: 4260056 - DNA, 13 bp, Homo sapiens
atttaaaactgtt

SEQ ID NO: 4260057 - DNA, 15 bp, Homo sapiens
atttaaaagcctgct

SEQ ID NO: 4260058 - DNA, 17 bp, Homo sapiens
atttaaaagcctgctca

SEQ ID NO: 4260059 - DNA, 23 bp, Homo sapiens
atttcagagtgactacacacagt

SEQ ID NO: 4260060 - DNA, 15 bp, Homo sapiens
atttttctttaactg

SEQ ID NO: 4260061 - DNA, 22 bp, Homo sapiens
caaaaatttctgtaaaacaggt

SEQ ID NO: 4260062 - DNA, 11 bp, Homo sapiens
caaagtggaac

SEQ ID NO: 4260063 - DNA, 13 bp, Homo sapiens
caagaaacagcca

SEQ ID NO: 4260064 - DNA, 14 bp, Homo sapiens
caagaaacagccag

SEQ ID NO: 4260065 - DNA, 15 bp, Homo sapiens
caagaaacagccagc

SEQ ID NO: 4260066 - DNA, 18 bp, Homo sapiens
caagaaacagccagcaag

SEQ ID NO: 4260067 - DNA, 21 bp, Homo sapiens
caagagggtgacagcttcctt

SEQ ID NO: 4260068 - DNA, 21 bp, Homo sapiens
caataaacaacagctgaagca

SEQ ID NO: 4260069 - DNA, 21 bp, Homo sapiens
caatttggatttaaaagcctg

SEQ ID NO: 4260070 - DNA, 16 bp, Homo sapiens
cacagcattgtatatg

SEQ ID NO: 4260071 - DNA, 13 bp, Homo sapiens
caccagggaagaa

SEQ ID NO: 4260072 - DNA, 13 bp, Homo sapiens
caccctccacctt

SEQ ID NO: 4260073 - DNA, 15 bp, Homo sapiens
cacctccaggcctgt

SEQ ID NO: 4260074 - DNA, 21 bp, Homo sapiens
cacctgtccccaccctccact

SEQ ID NO: 4260075 - DNA, 17 bp, Homo sapiens
cactactgcagcacctc

SEQ ID NO: 4260076 - DNA, 19 bp, Homo sapiens
cactactgcagcacctcca

SEQ ID NO: 4260077 - DNA, 18 bp, Homo sapiens
cactcagctgtcctgcag

SEQ ID NO: 4260078 - DNA, 12 bp, Homo sapiens
cactccaccctc

SEQ ID NO: 4260079 - DNA, 20 bp, Homo sapiens
cactggtctgtttgcatttg

SEQ ID NO: 4260080 - DNA, 16 bp, Homo sapiens
cagaaattcaatttgg

SEQ ID NO: 4260081 - DNA, 17 bp, Homo sapiens
cagagcccctcctccag

SEQ ID NO: 4260082 - DNA, 21 bp, Homo sapiens
cagaggactcccaaccctggc

SEQ ID NO: 4260083 - DNA, 16 bp, Homo sapiens
cagcacctccaggcct

SEQ ID NO: 4260084 - DNA, 18 bp, Homo sapiens
cagcacctccaggcctgt

SEQ ID NO: 4260085 - DNA, 14 bp, Homo sapiens
cagccaaatttaaa

SEQ ID NO: 4260086 - DNA, 14 bp, Homo sapiens
cagcccagagcctg

SEQ ID NO: 4260087 - DNA, 18 bp, Homo sapiens
cagcccagagcctggctg

SEQ ID NO: 4260088 - DNA, 21 bp, Homo sapiens
cagcccatccattaggccagc

SEQ ID NO: 4260089 - DNA, 22 bp, Homo sapiens
cagctgtcctgcagcaaacact

SEQ ID NO: 4260090 - DNA, 20 bp, Homo sapiens
cagcttcctttcctgtgtgt

SEQ ID NO: 4260091 - DNA, 16 bp, Homo sapiens
caggacttgaaagaaa

SEQ ID NO: 4260092 - DNA, 22 bp, Homo sapiens
caggccaaagagtctccagttt

SEQ ID NO: 4260093 - DNA, 20 bp, Homo sapiens
caggtgctaatttgttttgg

SEQ ID NO: 4260094 - DNA, 13 bp, Homo sapiens
cagtgtctgtgtt

SEQ ID NO: 4260095 - DNA, 21 bp, Homo sapiens
cagtgtttttagacctgtgtt

SEQ ID NO: 4260096 - DNA, 15 bp, Homo sapiens
cagttttaactgtgg

SEQ ID NO: 4260097 - DNA, 20 bp, Homo sapiens
cagttttaactgtggatatt

SEQ ID NO: 4260098 - DNA, 23 bp, Homo sapiens
cagttttaactgtggatattgtt

SEQ ID NO: 4260099 - DNA, 18 bp, Homo sapiens
cataatgtttctggattt

SEQ ID NO: 4260100 - DNA, 21 bp, Homo sapiens
cataatgtttctggatttcat

SEQ ID NO: 4260101 - DNA, 17 bp, Homo sapiens
catactgtaacattcag

SEQ ID NO: 4260102 - DNA, 13 bp, Homo sapiens
catccattaggcc

SEQ ID NO: 4260103 - DNA, 17 bp, Homo sapiens
catccattaggccagca

SEQ ID NO: 4260104 - DNA, 17 bp, Homo sapiens
catcctccagatagtgt

SEQ ID NO: 4260105 - DNA, 17 bp, Homo sapiens
catggctgtgtttgcag

SEQ ID NO: 4260106 - DNA, 20 bp, Homo sapiens
catggctgtgtttgcagcct

SEQ ID NO: 4260107 - DNA, 16 bp, Homo sapiens
cattaggccagcaacg

SEQ ID NO: 4260108 - DNA, 17 bp, Homo sapiens
cattgaagccgactctg

SEQ ID NO: 4260109 - DNA, 20 bp, Homo sapiens
cattgaagccgactctggcc

SEQ ID NO: 4260110 - DNA, 11 bp, Homo sapiens
cattggatatt

SEQ ID NO: 4260111 - DNA, 23 bp, Homo sapiens
cattggggtagttgtgtttcaac

SEQ ID NO: 4260112 - DNA, 19 bp, Homo sapiens
ccaaaaggtttaagaaata

SEQ ID NO: 4260113 - DNA, 17 bp, Homo sapiens
ccaccctccaccttcca

SEQ ID NO: 4260114 - DNA, 13 bp, Homo sapiens
ccagcccctgtcc

SEQ ID NO: 4260115 - DNA, 13 bp, Homo sapiens
ccaggcctgttgc

SEQ ID NO: 4260116 - DNA, 18 bp, Homo sapiens
ccagttgcactcaggtga

SEQ ID NO: 4260117 - DNA, 17 bp, Homo sapiens
ccagtttgcacctgtcc

SEQ ID NO: 4260118 - DNA, 20 bp, Homo sapiens
ccattaggccagcaacgctt

SEQ ID NO: 4260119 - DNA, 23 bp, Homo sapiens
ccattgaagccgactctggccct

SEQ ID NO: 4260120 - DNA, 18 bp, Homo sapiens
ccattttgttattgacta

SEQ ID NO: 4260121 - DNA, 23 bp, Homo sapiens
ccattttgttattgactaacagg

SEQ ID NO: 4260122 - DNA, 19 bp, Homo sapiens
cccacaacccaaaaggttt

SEQ ID NO: 4260123 - DNA, 16 bp, Homo sapiens
cccagagcccctcctc

SEQ ID NO: 4260124 - DNA, 14 bp, Homo sapiens
cccatcatgtggcc

SEQ ID NO: 4260125 - DNA, 23 bp, Homo sapiens
ccccagcccatccattaggccag

SEQ ID NO: 4260126 - DNA, 14 bp, Homo sapiens
ccctatctgtattc

SEQ ID NO: 4260127 - DNA, 17 bp, Homo sapiens
ccctccactcagctgtc

SEQ ID NO: 4260128 - DNA, 21 bp, Homo sapiens
ccctccactcagctgtcctgc

SEQ ID NO: 4260129 - DNA, 21 bp, Homo sapiens
ccctcctccagcccctgtccc

SEQ ID NO: 4260130 - DNA, 12 bp, Homo sapiens
ccctggagccag

SEQ ID NO: 4260131 - DNA, 20 bp, Homo sapiens
cccttacttgcttctctagc

SEQ ID NO: 4260132 - DNA, 19 bp, Homo sapiens
ccgactctggccctggccc

SEQ ID NO: 4260133 - DNA, 12 bp, Homo sapiens
ccgtaatttaac

SEQ ID NO: 4260134 - DNA, 15 bp, Homo sapiens
cctaaattatttact

SEQ ID NO: 4260135 - DNA, 21 bp, Homo sapiens
cctacagttttaactgtggat

SEQ ID NO: 4260136 - DNA, 22 bp, Homo sapiens
cctacagttttaactgtggata

SEQ ID NO: 4260137 - DNA, 15 bp, Homo sapiens
cctccagcccctgtc

SEQ ID NO: 4260138 - DNA, 17 bp, Homo sapiens
cctccagcccctgtccc

SEQ ID NO: 4260139 - DNA, 13 bp, Homo sapiens
cctccaggcctgt

SEQ ID NO: 4260140 - DNA, 17 bp, Homo sapiens
cctccaggcctgttgct

SEQ ID NO: 4260141 - DNA, 20 bp, Homo sapiens
cctcctccagcccctgtccc

SEQ ID NO: 4260142 - DNA, 21 bp, Homo sapiens
cctctccagtttgcacctgtc

SEQ ID NO: 4260143 - DNA, 23 bp, Homo sapiens
cctctccagtttgcacctgtccc

SEQ ID NO: 4260144 - DNA, 18 bp, Homo sapiens
cctgcagcaaacactcca

SEQ ID NO: 4260145 - DNA, 22 bp, Homo sapiens
cctgcccagttgcactcaggtg

SEQ ID NO: 4260146 - DNA, 18 bp, Homo sapiens
cctgctctagtgggacag

SEQ ID NO: 4260147 - DNA, 22 bp, Homo sapiens
cctgctctagtgggacagccca

SEQ ID NO: 4260148 - DNA, 12 bp, Homo sapiens
cctggagccaga

SEQ ID NO: 4260149 - DNA, 15 bp, Homo sapiens
cctggctgcccatca

SEQ ID NO: 4260150 - DNA, 22 bp, Homo sapiens
cctgtcccacccccttccccca

SEQ ID NO: 4260151 - DNA, 12 bp, Homo sapiens
cctgtggatatt

SEQ ID NO: 4260152 - DNA, 20 bp, Homo sapiens
cctgtgtgtactctgtccag

SEQ ID NO: 4260153 - DNA, 19 bp, Homo sapiens
cctgttgctatagagccta

SEQ ID NO: 4260154 - DNA, 20 bp, Homo sapiens
ccttacttgcttctctagct

SEQ ID NO: 4260155 - DNA, 19 bp, Homo sapiens
ccttccattttcccccact

SEQ ID NO: 4260156 - DNA, 20 bp, Homo sapiens
ccttccattttcccccacta

SEQ ID NO: 4260157 - DNA, 11 bp, Homo sapiens
aaaagcctgct

SEQ ID NO: 4260158 - DNA, 16 bp, Homo sapiens
aaagcttcacagtacc

SEQ ID NO: 4260159 - DNA, 13 bp, Homo sapiens
aaagtggaacgaa

SEQ ID NO: 4260160 - DNA, 20 bp, Homo sapiens
aaagtggaacgaaaatgaaa

SEQ ID NO: 4260161 - DNA, 13 bp, Homo sapiens
aaatgaaagctac

SEQ ID NO: 4260162 - DNA, 18 bp, Homo sapiens
aaattacctgtggatatt

SEQ ID NO: 4260163 - DNA, 14 bp, Homo sapiens
aacagtggatcaca

SEQ ID NO: 4260164 - DNA, 16 bp, Homo sapiens
aacctcgggcctgctg

SEQ ID NO: 4260165 - DNA, 20 bp, Homo sapiens
aaccttgaaaaaaaacagtg

SEQ ID NO: 4260166 - DNA, 21 bp, Homo sapiens
aactaaatgtgcaatagaagg

SEQ ID NO: 4260167 - DNA, 16 bp, Homo sapiens
aactgccgtaatttaa

SEQ ID NO: 4260168 - DNA, 20 bp, Homo sapiens
aagatgttatggtgtttaga

SEQ ID NO: 4260169 - DNA, 14 bp, Homo sapiens
aagccgactctggc

SEQ ID NO: 4260170 - DNA, 17 bp, Homo sapiens
aagccgactctggccct

SEQ ID NO: 4260171 - DNA, 13 bp, Homo sapiens
aatagaaggtgat

SEQ ID NO: 4260172 - DNA, 16 bp, Homo sapiens
aatagaattataactg

SEQ ID NO: 4260173 - DNA, 19 bp, Homo sapiens
aatctgctaccaaaacagt

SEQ ID NO: 4260174 - DNA, 13 bp, Homo sapiens
aatggatttttct

SEQ ID NO: 4260175 - DNA, 20 bp, Homo sapiens
aatggatttttctttaactg

SEQ ID NO: 4260176 - DNA, 17 bp, Homo sapiens
aatgtgcaatagaaggt

SEQ ID NO: 4260177 - DNA, 22 bp, Homo sapiens
aattactttggggctaatttaa

SEQ ID NO: 4260178 - DNA, 22 bp, Homo sapiens
aattatttcatgattagaaatt

SEQ ID NO: 4260179 - DNA, 17 bp, Homo sapiens
aattcaatttggattta

SEQ ID NO: 4260180 - DNA, 12 bp, Homo sapiens
aatttggattta

SEQ ID NO: 4260181 - DNA, 17 bp, Homo sapiens
aatttgttttggatata

SEQ ID NO: 4260182 - DNA, 18 bp, Homo sapiens
acaaagaaacaaagatgt

SEQ ID NO: 4260183 - DNA, 17 bp, Homo sapiens
acacagcattgtatatg

SEQ ID NO: 4260184 - DNA, 18 bp, Homo sapiens
acacagcattgtatatgt

SEQ ID NO: 4260185 - DNA, 18 bp, Homo sapiens
acactccaccctccacct

SEQ ID NO: 4260186 - DNA, 22 bp, Homo sapiens
acactccaccctccaccttcca

SEQ ID NO: 4260187 - DNA, 18 bp, Homo sapiens
acagcttcctttcctgtg

SEQ ID NO: 4260188 - DNA, 15 bp, Homo sapiens
acagtacccaaactg

SEQ ID NO: 4260189 - DNA, 17 bp, Homo sapiens
acagttttaactgtgga

SEQ ID NO: 4260190 - DNA, 12 bp, Homo sapiens
acccccttcccc

SEQ ID NO: 4260191 - DNA, 12 bp, Homo sapiens
accctccacctt

SEQ ID NO: 4260192 - DNA, 21 bp, Homo sapiens
accctccactcagctgtcctg

SEQ ID NO: 4260193 - DNA, 16 bp, Homo sapiens
acctacagttttaact

SEQ ID NO: 4260194 - DNA, 18 bp, Homo sapiens
acctacagttttaactgt

SEQ ID NO: 4260195 - DNA, 19 bp, Homo sapiens
acctacagttttaactgtg

SEQ ID NO: 4260196 - DNA, 23 bp, Homo sapiens
acctgtatgtcaataaacaacag

SEQ ID NO: 4260197 - DNA, 10 bp, Homo sapiens
acctgtggat

SEQ ID NO: 4260198 - DNA, 14 bp, Homo sapiens
acctgtggatattt

SEQ ID NO: 4260199 - DNA, 15 bp, Homo sapiens
acggaaagtgctgtc

SEQ ID NO: 4260200 - DNA, 13 bp, Homo sapiens
acgtggcactggt

SEQ ID NO: 4260201 - DNA, 16 bp, Homo sapiens
actaaaaaaaagatga

SEQ ID NO: 4260202 - DNA, 17 bp, Homo sapiens
actaaaaaaaagatgaa

SEQ ID NO: 4260203 - DNA, 13 bp, Homo sapiens
actactgcagcac

SEQ ID NO: 4260204 - DNA, 15 bp, Homo sapiens
actactgcagcacct

SEQ ID NO: 4260205 - DNA, 13 bp, Homo sapiens
actcactctgggc

SEQ ID NO: 4260206 - DNA, 15 bp, Homo sapiens
actcactctgggctg

SEQ ID NO: 4260207 - DNA, 14 bp, Homo sapiens
actcagctgtcctg

SEQ ID NO: 4260208 - DNA, 18 bp, Homo sapiens
actcagctgtcctgcagc

SEQ ID NO: 4260209 - DNA, 19 bp, Homo sapiens
actcagctgtcctgcagca

SEQ ID NO: 4260210 - DNA, 16 bp, Homo sapiens
actccaccctccacct

SEQ ID NO: 4260211 - DNA, 15 bp, Homo sapiens
actctggccctggcc

SEQ ID NO: 4260212 - DNA, 15 bp, Homo sapiens
actgatttcagagtg

SEQ ID NO: 4260213 - DNA, 15 bp, Homo sapiens
actgcagcacctcca

SEQ ID NO: 4260214 - DNA, 21 bp, Homo sapiens
actgcagcacctccaggcctg

SEQ ID NO: 4260215 - DNA, 17 bp, Homo sapiens
actgccgtaatttaact

SEQ ID NO: 4260216 - DNA, 22 bp, Homo sapiens
actggaggcccctggagccaga

SEQ ID NO: 4260217 - DNA, 18 bp, Homo sapiens
actggtaggttgggacac

SEQ ID NO: 4260218 - DNA, 15 bp, Homo sapiens
actgtggatattgtt

SEQ ID NO: 4260219 - DNA, 21 bp, Homo sapiens
actgttggaatggatttttct

SEQ ID NO: 4260220 - DNA, 15 bp, Homo sapiens
acttctgtaattgtg

SEQ ID NO: 4260221 - DNA, 18 bp, Homo sapiens
actttgacagtgttttta

SEQ ID NO: 4260222 - DNA, 17 bp, Homo sapiens
actttggggctaattta

SEQ ID NO: 4260223 - DNA, 20 bp, Homo sapiens
agaaattacctgtggatatt

SEQ ID NO: 4260224 - DNA, 19 bp, Homo sapiens
agaaattcaatttggattt

SEQ ID NO: 4260225 - DNA, 19 bp, Homo sapiens
agaactcactctgggctgt

SEQ ID NO: 4260226 - DNA, 20 bp, Homo sapiens
agaagatcaacgcctcactg

SEQ ID NO: 4260227 - DNA, 10 bp, Homo sapiens
agaagcctgc

SEQ ID NO: 4260228 - DNA, 21 bp, Homo sapiens
agactgaatagatatgaaagc

SEQ ID NO: 4260229 - DNA, 22 bp, Homo sapiens
agactgaatagatatgaaagct

SEQ ID NO: 4260230 - DNA, 22 bp, Homo sapiens
agagactgaatagatatgaaag

SEQ ID NO: 4260231 - DNA, 14 bp, Homo sapiens
agagatcaaagatg

SEQ ID NO: 4260232 - DNA, 19 bp, Homo sapiens
agagcccctcctccagccc

SEQ ID NO: 4260233 - DNA, 23 bp, Homo sapiens
agagcccctcctccagcccctgt

SEQ ID NO: 4260234 - DNA, 13 bp, Homo sapiens
agatcaaagatga

SEQ ID NO: 4260235 - DNA, 16 bp, Homo sapiens
agatcaacgcctcact

SEQ ID NO: 4260236 - DNA, 20 bp, Homo sapiens
agcccatccattaggccagc

SEQ ID NO: 4260237 - DNA, 13 bp, Homo sapiens
agcccctcctcca

SEQ ID NO: 4260238 - DNA, 20 bp, Homo sapiens
agcccctcctccagcccctg

SEQ ID NO: 4260239 - DNA, 15 bp, Homo sapiens
agccgactctggccc

SEQ ID NO: 4260240 - DNA, 16 bp, Homo sapiens
agccgactctggccct

SEQ ID NO: 4260241 - DNA, 18 bp, Homo sapiens
agccgactctggccctgg

SEQ ID NO: 4260242 - DNA, 13 bp, Homo sapiens
agctctctaggcc

SEQ ID NO: 4260243 - DNA, 16 bp, Homo sapiens
agctgtcctgcagcaa

SEQ ID NO: 4260244 - DNA, 19 bp, Homo sapiens
aggactcccaaccctggct

SEQ ID NO: 4260245 - DNA, 13 bp, Homo sapiens
aggacttgaaaga

SEQ ID NO: 4260246 - DNA, 18 bp, Homo sapiens
aggaggcacctacactca

SEQ ID NO: 4260247 - DNA, 13 bp, Homo sapiens
aggcattggatat

SEQ ID NO: 4260248 - DNA, 16 bp, Homo sapiens
tgtaattgtgtggatt

SEQ ID NO: 4260249 - DNA, 17 bp, Homo sapiens
tgtagaactcactctgg

SEQ ID NO: 4260250 - DNA, 19 bp, Homo sapiens
tgtccccaccctccactca

SEQ ID NO: 4260251 - DNA, 18 bp, Homo sapiens
tgtcctgcagcaaacact

SEQ ID NO: 4260252 - DNA, 20 bp, Homo sapiens
tgtctgtgttttgaaagaat

SEQ ID NO: 4260253 - DNA, 20 bp, Homo sapiens
tgtcttaaactaaatgtgca

SEQ ID NO: 4260254 - DNA, 13 bp, Homo sapiens
tgtgcaatagaag

SEQ ID NO: 4260255 - DNA, 21 bp, Homo sapiens
tgttccattgaagccgactct

SEQ ID NO: 4260256 - DNA, 16 bp, Homo sapiens
tgtttcctagctgtgt

SEQ ID NO: 4260257 - DNA, 14 bp, Homo sapiens
ttaaactaaatgtg

SEQ ID NO: 4260258 - DNA, 15 bp, Homo sapiens
ttaaattgtgtttta

SEQ ID NO: 4260259 - DNA, 13 bp, Homo sapiens
ttaactgtggata

SEQ ID NO: 4260260 - DNA, 15 bp, Homo sapiens
ttaactgtggatatt

SEQ ID NO: 4260261 - DNA, 17 bp, Homo sapiens
ttactaaaaaaaagatg

SEQ ID NO: 4260262 - DNA, 15 bp, Homo sapiens
ttacttgcttctcta

SEQ ID NO: 4260263 - DNA, 23 bp, Homo sapiens
ttagaaattacctgtggatattt

SEQ ID NO: 4260264 - DNA, 16 bp, Homo sapiens
ttagacctgtgttact

SEQ ID NO: 4260265 - DNA, 17 bp, Homo sapiens
ttaggccagcaacgctt

SEQ ID NO: 4260266 - DNA, 16 bp, Homo sapiens
ttataaaagtgttcat

SEQ ID NO: 4260267 - DNA, 13 bp, Homo sapiens
ttcacaatgttaa

SEQ ID NO: 4260268 - DNA, 23 bp, Homo sapiens
ttcacagtacccaaactgctttt

SEQ ID NO: 4260269 - DNA, 15 bp, Homo sapiens
ttcatgattagaaat

SEQ ID NO: 4260270 - DNA, 13 bp, Homo sapiens
ttcccccagccca

SEQ ID NO: 4260271 - DNA, 18 bp, Homo sapiens
ttcctagctgtgtgaata

SEQ ID NO: 4260272 - DNA, 13 bp, Homo sapiens
ttcgtaacacagc

SEQ ID NO: 4260273 - DNA, 23 bp, Homo sapiens
ttctattttttgttttgtttcct

SEQ ID NO: 4260274 - DNA, 17 bp, Homo sapiens
ttctctagctctctagg

SEQ ID NO: 4260275 - DNA, 19 bp, Homo sapiens
ttctttaactgccgtaatt

SEQ ID NO: 4260276 - DNA, 17 bp, Homo sapiens
ttgaagccgactctggc

SEQ ID NO: 4260277 - DNA, 14 bp, Homo sapiens
ttgacagtgttttt

SEQ ID NO: 4260278 - DNA, 19 bp, Homo sapiens
ttgcacagccaaatttaaa

SEQ ID NO: 4260279 - DNA, 18 bp, Homo sapiens
ttgcacctgtccccaccc

SEQ ID NO: 4260280 - DNA, 15 bp, Homo sapiens
ttgcagcctgctcta

SEQ ID NO: 4260281 - DNA, 22 bp, Homo sapiens
ttgcagcctgctctagtgggac

SEQ ID NO: 4260282 - DNA, 23 bp, Homo sapiens
ttggggtcaagaaacagccagca

SEQ ID NO: 4260283 - DNA, 16 bp, Homo sapiens
ttgtgtggattcttta

SEQ ID NO: 4260284 - DNA, 16 bp, Homo sapiens
ttgttacgtagcctaa

SEQ ID NO: 4260285 - DNA, 23 bp, Homo sapiens
ttgtttcctcccctatctgtatt

SEQ ID NO: 4260286 - DNA, 11 bp, Homo sapiens
tttaaattgtg

SEQ ID NO: 4260287 - DNA, 12 bp, Homo sapiens
tttaactgccgt

SEQ ID NO: 4260288 - DNA, 15 bp, Homo sapiens
tttaactgtggatat

SEQ ID NO: 4260289 - DNA, 18 bp, Homo sapiens
tttaactgtggatattgt

SEQ ID NO: 4260290 - DNA, 18 bp, Homo sapiens
tttactttagaagcctgc

SEQ ID NO: 4260291 - DNA, 15 bp, Homo sapiens
tttctggatttcata

SEQ ID NO: 4260292 - DNA, 20 bp, Homo sapiens
tttggatttaaaagcctgct

SEQ ID NO: 4260293 - DNA, 17 bp, Homo sapiens
ttttgcacagccaaatt

SEQ ID NO: 4260294 - DNA, 21 bp, Homo sapiens
tttttcttttcggaaatctta

SEQ ID NO: 4260295 - DNA, 20 bp, Homo sapiens
tttttggcgtggctgactta

SEQ ID NO: 4260296 - DNA, 19 bp, Homo sapiens
aaaacagtggatcacaaag

SEQ ID NO: 4260297 - DNA, 19 bp, Homo sapiens
aaaatgaaagctactcata

SEQ ID NO: 4260298 - DNA, 21 bp, Homo sapiens
aaaatggcagggggtggaatt

SEQ ID NO: 4260299 - DNA, 14 bp, Homo sapiens
aaacagccagcaag

SEQ ID NO: 4260300 - DNA, 12 bp, Homo sapiens
aaagcctgctca

SEQ ID NO: 4260301 - DNA, 13 bp, Homo sapiens
aaagcctgctcaa

SEQ ID NO: 4260302 - DNA, 14 bp, Homo sapiens
aaagctgatttttt

SEQ ID NO: 4260303 - DNA, 11 bp, Homo sapiens
aacaaagaaac

SEQ ID NO: 4260304 - DNA, 21 bp, Homo sapiens
aacacacaggtgcaacagact

SEQ ID NO: 4260305 - DNA, 19 bp, Homo sapiens
aacagagactgaatagata

SEQ ID NO: 4260306 - DNA, 13 bp, Homo sapiens
aacagtgtttaaa

SEQ ID NO: 4260307 - DNA, 20 bp, Homo sapiens
aacctacagttttaactgtg

SEQ ID NO: 4260308 - DNA, 13 bp, Homo sapiens
aaccttaagatac

SEQ ID NO: 4260309 - DNA, 16 bp, Homo sapiens
aacgaaaatgaaagct

SEQ ID NO: 4260310 - DNA, 22 bp, Homo sapiens
aacgcttgtagaactcactctg

SEQ ID NO: 4260311 - DNA, 12 bp, Homo sapiens
aactcactctgg

SEQ ID NO: 4260312 - DNA, 13 bp, Homo sapiens
aactcactctggg

SEQ ID NO: 4260313 - DNA, 16 bp, Homo sapiens
aactcactctgggctg

SEQ ID NO: 4260314 - DNA, 17 bp, Homo sapiens
aactcactctgggctgt

SEQ ID NO: 4260315 - DNA, 14 bp, Homo sapiens
aactgtaaagatgt

SEQ ID NO: 4260316 - DNA, 18 bp, Homo sapiens
aactgtggatattgttac

SEQ ID NO: 4260317 - DNA, 19 bp, Homo sapiens
aactgttggaatggatttt

SEQ ID NO: 4260318 - DNA, 15 bp, Homo sapiens
aagaaaatctttata

SEQ ID NO: 4260319 - DNA, 15 bp, Homo sapiens
aagaaacaaagatgt

SEQ ID NO: 4260320 - DNA, 12 bp, Homo sapiens
aagaaatagaat

SEQ ID NO: 4260321 - DNA, 19 bp, Homo sapiens
aagaagagcgagagatcaa

SEQ ID NO: 4260322 - DNA, 22 bp, Homo sapiens
aagaagagcgagagatcaaaga

SEQ ID NO: 4260323 - DNA, 21 bp, Homo sapiens
aagcaaactctaaaattataa

SEQ ID NO: 4260324 - DNA, 16 bp, Homo sapiens
aagccgactctggccc

SEQ ID NO: 4260325 - DNA, 18 bp, Homo sapiens
aagccgactctggccctg

SEQ ID NO: 4260326 - DNA, 21 bp, Homo sapiens
aagccgactctggccctggcc

SEQ ID NO: 4260327 - DNA, 18 bp, Homo sapiens
aagctgattttttttaat

SEQ ID NO: 4260328 - DNA, 16 bp, Homo sapiens
aaggatccggaaagaa

SEQ ID NO: 4260329 - DNA, 17 bp, Homo sapiens
aaggatccggaaagaag

SEQ ID NO: 4260330 - DNA, 20 bp, Homo sapiens
aagggaagaaggaggaatgc

SEQ ID NO: 4260331 - DNA, 21 bp, Homo sapiens
aagggtgttgggagggtggtt

SEQ ID NO: 4260332 - DNA, 20 bp, Homo sapiens
aagtggaacgaaaatgaaag

SEQ ID NO: 4260333 - DNA, 14 bp, Homo sapiens
aagtgttcattgtt

SEQ ID NO: 4260334 - DNA, 18 bp, Homo sapiens
tggcaggaggacaggtgg

SEQ ID NO: 4260335 - DNA, 17 bp, Homo sapiens
tggcaggagtgggctct

SEQ ID NO: 4260336 - DNA, 15 bp, Homo sapiens
tggcagggcaggcag

SEQ ID NO: 4260337 - DNA, 21 bp, Homo sapiens
tggcagggcaggcagagctca

SEQ ID NO: 4260338 - DNA, 19 bp, Homo sapiens
tggcaggtgtgggctccca

SEQ ID NO: 4260339 - DNA, 22 bp, Homo sapiens
tggcaggtgtgggctcccacgc

SEQ ID NO: 4260340 - DNA, 19 bp, Homo sapiens
tggcatctctggagtgtgt

SEQ ID NO: 4260341 - DNA, 12 bp, Homo sapiens
tggcatggggag

SEQ ID NO: 4260342 - DNA, 19 bp, Homo sapiens
tggccactttgcagacctg

SEQ ID NO: 4260343 - DNA, 22 bp, Homo sapiens
tggccactttgcagacctggga

SEQ ID NO: 4260344 - DNA, 16 bp, Homo sapiens
tggccagagggcccct

SEQ ID NO: 4260345 - DNA, 21 bp, Homo sapiens
tggccagcccagatggctccc

SEQ ID NO: 4260346 - DNA, 16 bp, Homo sapiens
tggccagggctccacg

SEQ ID NO: 4260347 - DNA, 17 bp, Homo sapiens
tggccagggctccacgg

SEQ ID NO: 4260348 - DNA, 15 bp, Homo sapiens
tggccaggtggccac

SEQ ID NO: 4260349 - DNA, 13 bp, Homo sapiens
tggcccacccctc

SEQ ID NO: 4260350 - DNA, 14 bp, Homo sapiens
tggcccacccctct

SEQ ID NO: 4260351 - DNA, 23 bp, Homo sapiens
tggcccacccctcttcccccttc

SEQ ID NO: 4260352 - DNA, 11 bp, Homo sapiens
tggcccagcag

SEQ ID NO: 4260353 - DNA, 14 bp, Homo sapiens
tggcccagccagca

SEQ ID NO: 4260354 - DNA, 17 bp, Homo sapiens
tggcccagccagcaggt

SEQ ID NO: 4260355 - DNA, 12 bp, Homo sapiens
tggcccagcctg

SEQ ID NO: 4260356 - DNA, 21 bp, Homo sapiens
tggcccagcctgtggcctcag

SEQ ID NO: 4260357 - DNA, 23 bp, Homo sapiens
tggcccagcctgtggcctcagca

SEQ ID NO: 4260358 - DNA, 18 bp, Homo sapiens
tggcccagtgagagtgag

SEQ ID NO: 4260359 - DNA, 19 bp, Homo sapiens
tggcccagtgagagtgagg

SEQ ID NO: 4260360 - DNA, 13 bp, Homo sapiens
tggccccaaatgt

SEQ ID NO: 4260361 - DNA, 15 bp, Homo sapiens
tggcccccgagctgg

SEQ ID NO: 4260362 - DNA, 17 bp, Homo sapiens
tggcccccgagctgggg

SEQ ID NO: 4260363 - DNA, 12 bp, Homo sapiens
tggcccctccca

SEQ ID NO: 4260364 - DNA, 20 bp, Homo sapiens
tggcccctcccacatccccc

SEQ ID NO: 4260365 - DNA, 18 bp, Homo sapiens
tggcccctccttctcccc

SEQ ID NO: 4260366 - DNA, 21 bp, Homo sapiens
tggccccttcacttctgacca

SEQ ID NO: 4260367 - DNA, 15 bp, Homo sapiens
tggcccgacagcctg

SEQ ID NO: 4260368 - DNA, 16 bp, Homo sapiens
tggcccgacagcctgg

SEQ ID NO: 4260369 - DNA, 17 bp, Homo sapiens
tggccctcctctggtca

SEQ ID NO: 4260370 - DNA, 23 bp, Homo sapiens
tggccctctcttaatgccacggc

SEQ ID NO: 4260371 - DNA, 13 bp, Homo sapiens
tggccctgctgcc

SEQ ID NO: 4260372 - DNA, 14 bp, Homo sapiens
tggccctgctgccc

SEQ ID NO: 4260373 - DNA, 21 bp, Homo sapiens
tggccgctgcagtcagcacag

SEQ ID NO: 4260374 - DNA, 14 bp, Homo sapiens
tggccgctgggaga

SEQ ID NO: 4260375 - DNA, 22 bp, Homo sapiens
tggccgctgggagaaaagccag

SEQ ID NO: 4260376 - DNA, 14 bp, Homo sapiens
tggccggccctgcc

SEQ ID NO: 4260377 - DNA, 16 bp, Homo sapiens
tggccggccctgcccc

SEQ ID NO: 4260378 - DNA, 17 bp, Homo sapiens
tggccggccctgccccc

SEQ ID NO: 4260379 - DNA, 20 bp, Homo sapiens
tggccgggggtgggggcctg

SEQ ID NO: 4260380 - DNA, 23 bp, Homo sapiens
tggccgtggagtcgagctggccg

SEQ ID NO: 4260381 - DNA, 19 bp, Homo sapiens
tggcctcaaccctccctca

SEQ ID NO: 4260382 - DNA, 20 bp, Homo sapiens
tggcctcaaccctccctcag

SEQ ID NO: 4260383 - DNA, 12 bp, Homo sapiens
tggcctcagcag

SEQ ID NO: 4260384 - DNA, 14 bp, Homo sapiens
tggcctcaggaggc

SEQ ID NO: 4260385 - DNA, 13 bp, Homo sapiens
tggcctcccagcc

SEQ ID NO: 4260386 - DNA, 16 bp, Homo sapiens
tggcctcccagccacc

SEQ ID NO: 4260387 - DNA, 14 bp, Homo sapiens
tggcctctggcctg

SEQ ID NO: 4260388 - DNA, 21 bp, Homo sapiens
tggcctcttcctccctccctg

SEQ ID NO: 4260389 - DNA, 14 bp, Homo sapiens
tggcctgagaagag

SEQ ID NO: 4260390 - DNA, 19 bp, Homo sapiens
tggcctgggaaaagggcag

SEQ ID NO: 4260391 - DNA, 18 bp, Homo sapiens
tggccttggttcctccag

SEQ ID NO: 4260392 - DNA, 15 bp, Homo sapiens
tggcgcacccggcag

SEQ ID NO: 4260393 - DNA, 13 bp, Homo sapiens
tggcgtctgtctt

SEQ ID NO: 4260394 - DNA, 17 bp, Homo sapiens
tggctaccgttttacaa

SEQ ID NO: 4260395 - DNA, 14 bp, Homo sapiens
tggctcacagccac

SEQ ID NO: 4260396 - DNA, 22 bp, Homo sapiens
tggctcacagccaccacctgga

SEQ ID NO: 4260397 - DNA, 15 bp, Homo sapiens
tggctccactgtaaa

SEQ ID NO: 4260398 - DNA, 20 bp, Homo sapiens
tggctccagtctgctgccct

SEQ ID NO: 4260399 - DNA, 23 bp, Homo sapiens
tggctccagtctgctgccctcca

SEQ ID NO: 4260400 - DNA, 14 bp, Homo sapiens
tggctcccacaggc

SEQ ID NO: 4260401 - DNA, 15 bp, Homo sapiens
tggctcccagggcca

SEQ ID NO: 4260402 - DNA, 18 bp, Homo sapiens
tggctcccagggtcctgg

SEQ ID NO: 4260403 - DNA, 23 bp, Homo sapiens
tggctcccctctatttagcatga

SEQ ID NO: 4260404 - DNA, 14 bp, Homo sapiens
tggctccctgggct

SEQ ID NO: 4260405 - DNA, 17 bp, Homo sapiens
tggctccctgggctggc

SEQ ID NO: 4260406 - DNA, 18 bp, Homo sapiens
tggctccctgggctggca

SEQ ID NO: 4260407 - DNA, 22 bp, Homo sapiens
tggctctgaatgtagccagccc

SEQ ID NO: 4260408 - DNA, 23 bp, Homo sapiens
tggctgcaagtggttaagaatgt

SEQ ID NO: 4260409 - DNA, 20 bp, Homo sapiens
tggctgccttctgcggagct

SEQ ID NO: 4260410 - DNA, 13 bp, Homo sapiens
tggctgtattttt

SEQ ID NO: 4260411 - DNA, 18 bp, Homo sapiens
tggctgtggcccctcctt

SEQ ID NO: 4260412 - DNA, 18 bp, Homo sapiens
tggcttagcgttctgttt

SEQ ID NO: 4260413 - DNA, 20 bp, Homo sapiens
tggcttcaatctacgatgtt

SEQ ID NO: 4260414 - DNA, 22 bp, Homo sapiens
tggcttcaatctacgatgttaa

SEQ ID NO: 4260415 - DNA, 14 bp, Homo sapiens
tggcttcagcccct

SEQ ID NO: 4260416 - DNA, 15 bp, Homo sapiens
tggcttcagcccctg

SEQ ID NO: 4260417 - DNA, 12 bp, Homo sapiens
tggcttcccagg

SEQ ID NO: 4260418 - DNA, 13 bp, Homo sapiens
tggcttcccagga

SEQ ID NO: 4260419 - DNA, 20 bp, Homo sapiens
tggcttcccaggaccctggg

SEQ ID NO: 4260420 - DNA, 19 bp, Homo sapiens
tggcttcccgctcagccct

SEQ ID NO: 4260421 - DNA, 21 bp, Homo sapiens
tggcttcccgctcagccctcc

SEQ ID NO: 4260422 - DNA, 12 bp, Homo sapiens
tggcttggagca

SEQ ID NO: 4260423 - DNA, 17 bp, Homo sapiens
tggcttggagcagaggt

SEQ ID NO: 4260424 - DNA, 12 bp, Homo sapiens
tggcttgtaggg

SEQ ID NO: 4260425 - DNA, 12 bp, Homo sapiens
tggctttcattt

SEQ ID NO: 4260426 - DNA, 14 bp, Homo sapiens
tggctttgccttta

SEQ ID NO: 4260427 - DNA, 14 bp, Homo sapiens
tggctttgtgctta

SEQ ID NO: 4260428 - DNA, 14 bp, Homo sapiens
tggcttttcactgc

SEQ ID NO: 4260429 - DNA, 15 bp, Homo sapiens
tggcttttcactgct

SEQ ID NO: 4260430 - DNA, 16 bp, Homo sapiens
tggcttttcactgctg

SEQ ID NO: 4260431 - DNA, 19 bp, Homo sapiens
tggcttttcactgctggct

SEQ ID NO: 4260432 - DNA, 23 bp, Homo sapiens
tgggaaatgctgatttaaacttc

SEQ ID NO: 4260433 - DNA, 13 bp, Homo sapiens
tgggacacagaga

SEQ ID NO: 4260434 - DNA, 15 bp, Homo sapiens
tgggacacagagacc

SEQ ID NO: 4260435 - DNA, 21 bp, Homo sapiens
tgggaccctcggggcaggaag

SEQ ID NO: 4260436 - DNA, 15 bp, Homo sapiens
tgggacggaagtggc

SEQ ID NO: 4260437 - DNA, 12 bp, Homo sapiens
tgggactggccc

SEQ ID NO: 4260438 - DNA, 15 bp, Homo sapiens
tgggagaaaagccag

SEQ ID NO: 4260439 - DNA, 16 bp, Homo sapiens
tgggagaaaagccaga

SEQ ID NO: 4260440 - DNA, 23 bp, Homo sapiens
tgggagaacctcgttgacatgca

SEQ ID NO: 4260441 - DNA, 16 bp, Homo sapiens
tgggagaagggacagc

SEQ ID NO: 4260442 - DNA, 12 bp, Homo sapiens
tgggagaggaag

SEQ ID NO: 4260443 - DNA, 14 bp, Homo sapiens
tgggagaggaagcc

SEQ ID NO: 4260444 - DNA, 13 bp, Homo sapiens
tgggagagtgagg

SEQ ID NO: 4260445 - DNA, 14 bp, Homo sapiens
tgggagagtgaggt

SEQ ID NO: 4260446 - DNA, 14 bp, Homo sapiens
tgggagatgctggg

SEQ ID NO: 4260447 - DNA, 19 bp, Homo sapiens
tgggagcctcgcccctcca

SEQ ID NO: 4260448 - DNA, 11 bp, Homo sapiens
tgggaggcagg

SEQ ID NO: 4260449 - DNA, 23 bp, Homo sapiens
tgggaggcaggtcccgagccccc

SEQ ID NO: 4260450 - DNA, 21 bp, Homo sapiens
tgggagtcaagtgtgcctgct

SEQ ID NO: 4260451 - DNA, 19 bp, Homo sapiens
tgggagtcagggagccctg

SEQ ID NO: 4260452 - DNA, 21 bp, Homo sapiens
tgggagtcagggagccctggg

SEQ ID NO: 4260453 - DNA, 15 bp, Homo sapiens
tgggagtgggagagg

SEQ ID NO: 4260454 - DNA, 19 bp, Homo sapiens
tgggatcattatttcatga

SEQ ID NO: 4260455 - DNA, 14 bp, Homo sapiens
tgggatccagagag

SEQ ID NO: 4260456 - DNA, 16 bp, Homo sapiens
tgggatccagagagaa

SEQ ID NO: 4260457 - DNA, 19 bp, Homo sapiens
tgggatccagagagaagca

SEQ ID NO: 4260458 - DNA, 20 bp, Homo sapiens
tgggatgcttgcctagggcc

SEQ ID NO: 4260459 - DNA, 14 bp, Homo sapiens
tgggatgggcacag

SEQ ID NO: 4260460 - DNA, 12 bp, Homo sapiens
tgggcacaggct

SEQ ID NO: 4260461 - DNA, 22 bp, Homo sapiens
tgtaatagtggctttcatttct

SEQ ID NO: 4260462 - DNA, 20 bp, Homo sapiens
tgtaatcacactctcttctt

SEQ ID NO: 4260463 - DNA, 20 bp, Homo sapiens
aggaactggtccaggccagg

SEQ ID NO: 4260464 - DNA, 21 bp, Homo sapiens
aggaagaggccgctgcagggt

SEQ ID NO: 4260465 - DNA, 18 bp, Homo sapiens
aggaagcacaagaagtgg

SEQ ID NO: 4260466 - DNA, 14 bp, Homo sapiens
aggaagccacgtgc

SEQ ID NO: 4260467 - DNA, 15 bp, Homo sapiens
aggaaggagccagct

SEQ ID NO: 4260468 - DNA, 20 bp, Homo sapiens
aggaaggagccagctcccag

SEQ ID NO: 4260469 - DNA, 18 bp, Homo sapiens
aggaagggactggtccag

SEQ ID NO: 4260470 - DNA, 19 bp, Homo sapiens
aggaagggactggtccagg

SEQ ID NO: 4260471 - DNA, 19 bp, Homo sapiens
aggaagggaggcctgaggg

SEQ ID NO: 4260472 - DNA, 20 bp, Homo sapiens
aggaaggtctcatgcctgag

SEQ ID NO: 4260473 - DNA, 14 bp, Homo sapiens
aggaagtcaggagc

SEQ ID NO: 4260474 - DNA, 15 bp, Homo sapiens
aggaagtcaggagcc

SEQ ID NO: 4260475 - DNA, 22 bp, Homo sapiens
aggaagtcaggagccagcaggg

SEQ ID NO: 4260476 - DNA, 13 bp, Homo sapiens
aggaagtccctga

SEQ ID NO: 4260477 - DNA, 17 bp, Homo sapiens
aggaatcaaaaattgaa

SEQ ID NO: 4260478 - DNA, 16 bp, Homo sapiens
aggaatgatattgctg

SEQ ID NO: 4260479 - DNA, 20 bp, Homo sapiens
aggaatgctcccccatcctc

SEQ ID NO: 4260480 - DNA, 21 bp, Homo sapiens
aggaatgggccaagccagggt

SEQ ID NO: 4260481 - DNA, 14 bp, Homo sapiens
aggaattttagaag

SEQ ID NO: 4260482 - DNA, 19 bp, Homo sapiens
aggacactgcctttgctgc

SEQ ID NO: 4260483 - DNA, 21 bp, Homo sapiens
aggacactgcctttgctgcct

SEQ ID NO: 4260484 - DNA, 22 bp, Homo sapiens
aggacactgcctttgctgcctt

SEQ ID NO: 4260485 - DNA, 14 bp, Homo sapiens
aggacagtttagga

SEQ ID NO: 4260486 - DNA, 18 bp, Homo sapiens
aggacagtttaggaccca

SEQ ID NO: 4260487 - DNA, 17 bp, Homo sapiens
aggaccaggagccaggt

SEQ ID NO: 4260488 - DNA, 17 bp, Homo sapiens
aggaccccatctgctga

SEQ ID NO: 4260489 - DNA, 15 bp, Homo sapiens
aggacccctcacctt

SEQ ID NO: 4260490 - DNA, 23 bp, Homo sapiens
aggacccctcaccttgcaacaca

SEQ ID NO: 4260491 - DNA, 16 bp, Homo sapiens
aggaccctgggtcacc

SEQ ID NO: 4260492 - DNA, 23 bp, Homo sapiens
aggaccctgggtcaccttcctgg

SEQ ID NO: 4260493 - DNA, 23 bp, Homo sapiens
aggacctccacctgggagatgct

SEQ ID NO: 4260494 - DNA, 13 bp, Homo sapiens
aggacctctgggg

SEQ ID NO: 4260495 - DNA, 18 bp, Homo sapiens
aggacgcatgcagggccc

SEQ ID NO: 4260496 - DNA, 17 bp, Homo sapiens
aggactccttaaatttg

SEQ ID NO: 4260497 - DNA, 21 bp, Homo sapiens
aggactctcacgatatgcaag

SEQ ID NO: 4260498 - DNA, 19 bp, Homo sapiens
aggactctgccttccaggc

SEQ ID NO: 4260499 - DNA, 21 bp, Homo sapiens
aggactctgccttccaggcgt

SEQ ID NO: 4260500 - DNA, 17 bp, Homo sapiens
aggactgccgaccgagg

SEQ ID NO: 4260501 - DNA, 22 bp, Homo sapiens
aggactgttttttcctgagctt

SEQ ID NO: 4260502 - DNA, 14 bp, Homo sapiens
aggagaaggcctgc

SEQ ID NO: 4260503 - DNA, 20 bp, Homo sapiens
aggagaaggcctgcccccct

SEQ ID NO: 4260504 - DNA, 18 bp, Homo sapiens
aggagacagtcaggaagc

SEQ ID NO: 4260505 - DNA, 19 bp, Homo sapiens
aggagacagtcaggaagcc

SEQ ID NO: 4260506 - DNA, 14 bp, Homo sapiens
aggagaccctgtct

SEQ ID NO: 4260507 - DNA, 19 bp, Homo sapiens
aggagactcaggcccacat

SEQ ID NO: 4260508 - DNA, 18 bp, Homo sapiens
aggagagccctctgctgc

SEQ ID NO: 4260509 - DNA, 19 bp, Homo sapiens
aggagagccctctgctgct

SEQ ID NO: 4260510 - DNA, 21 bp, Homo sapiens
aggagagccctctgctgcttt

SEQ ID NO: 4260511 - DNA, 23 bp, Homo sapiens
aggagcagcccacctgctgcccg

SEQ ID NO: 4260512 - DNA, 14 bp, Homo sapiens
aggagccagcaggg

SEQ ID NO: 4260513 - DNA, 17 bp, Homo sapiens
aggagcctatggcatct

SEQ ID NO: 4260514 - DNA, 18 bp, Homo sapiens
aggagcgggacctgtggc

SEQ ID NO: 4260515 - DNA, 13 bp, Homo sapiens
aggagcgtgtcct

SEQ ID NO: 4260516 - DNA, 15 bp, Homo sapiens
aggagcgtgtcctat

SEQ ID NO: 4260517 - DNA, 18 bp, Homo sapiens
aggagctcagggctggat

SEQ ID NO: 4260518 - DNA, 18 bp, Homo sapiens
aggagctggggagggaga

SEQ ID NO: 4260519 - DNA, 16 bp, Homo sapiens
aggaggaaaaaggctg

SEQ ID NO: 4260520 - DNA, 17 bp, Homo sapiens
aggaggaaaaaggctgg

SEQ ID NO: 4260521 - DNA, 15 bp, Homo sapiens
aggaggaactggtcc

SEQ ID NO: 4260522 - DNA, 17 bp, Homo sapiens
aggaggaactggtccag

SEQ ID NO: 4260523 - DNA, 16 bp, Homo sapiens
aggaggaagggactgg

SEQ ID NO: 4260524 - DNA, 18 bp, Homo sapiens
aggaggaagggactggtc

SEQ ID NO: 4260525 - DNA, 21 bp, Homo sapiens
aggaggaagggactggtccag

SEQ ID NO: 4260526 - DNA, 11 bp, Homo sapiens
aggaggacagg

SEQ ID NO: 4260527 - DNA, 22 bp, Homo sapiens
aggaggacctggggggggcaag

SEQ ID NO: 4260528 - DNA, 16 bp, Homo sapiens
aggaggagacagtcag

SEQ ID NO: 4260529 - DNA, 21 bp, Homo sapiens
aggaggagacagtcaggaagc

SEQ ID NO: 4260530 - DNA, 18 bp, Homo sapiens
aggaggatccgggctttg

SEQ ID NO: 4260531 - DNA, 20 bp, Homo sapiens
aggaggcagtggcttggagc

SEQ ID NO: 4260532 - DNA, 15 bp, Homo sapiens
aggagggggcccggc

SEQ ID NO: 4260533 - DNA, 21 bp, Homo sapiens
aggagtgggtgggacacagag

SEQ ID NO: 4260534 - DNA, 16 bp, Homo sapiens
aggagttaatgatcgt

SEQ ID NO: 4260535 - DNA, 19 bp, Homo sapiens
aggataaattaatgagttt

SEQ ID NO: 4260536 - DNA, 15 bp, Homo sapiens
aggatgaactagcca

SEQ ID NO: 4260537 - DNA, 17 bp, Homo sapiens
aggatgaactagccatg

SEQ ID NO: 4260538 - DNA, 14 bp, Homo sapiens
aggatggcgtgtcc

SEQ ID NO: 4260539 - DNA, 18 bp, Homo sapiens
aggatggcgtgtcccctg

SEQ ID NO: 4260540 - DNA, 22 bp, Homo sapiens
aggatgtggatggaggtgatga

SEQ ID NO: 4260541 - DNA, 20 bp, Homo sapiens
aggattaatctctaaaattc

SEQ ID NO: 4260542 - DNA, 13 bp, Homo sapiens
aggcaaatgtcca

SEQ ID NO: 4260543 - DNA, 15 bp, Homo sapiens
aggcaaatgtccaag

SEQ ID NO: 4260544 - DNA, 21 bp, Homo sapiens
aggcaaatgtccaagcatcag

SEQ ID NO: 4260545 - DNA, 13 bp, Homo sapiens
aggcaagaagtgg

SEQ ID NO: 4260546 - DNA, 18 bp, Homo sapiens
aggcaagctggcaggagg

SEQ ID NO: 4260547 - DNA, 19 bp, Homo sapiens
aggcaagctggcaggaggg

SEQ ID NO: 4260548 - DNA, 14 bp, Homo sapiens
aggcaccacagata

SEQ ID NO: 4260549 - DNA, 23 bp, Homo sapiens
aggcagaatggtgggctccagag

SEQ ID NO: 4260550 - DNA, 13 bp, Homo sapiens
aggcagaggacag

SEQ ID NO: 4260551 - DNA, 14 bp, Homo sapiens
aggcagcaacagga

SEQ ID NO: 4260552 - DNA, 21 bp, Homo sapiens
aggcagcaacaggaccaggag

SEQ ID NO: 4260553 - DNA, 22 bp, Homo sapiens
aggcagcaacaggaccaggagc

SEQ ID NO: 4260554 - DNA, 19 bp, Homo sapiens
aggcaggaagtcaggagcc

SEQ ID NO: 4260555 - DNA, 22 bp, Homo sapiens
aggcaggaagtcaggagccagc

SEQ ID NO: 4260556 - DNA, 21 bp, Homo sapiens
aggcagggagggaaacccggg

SEQ ID NO: 4260557 - DNA, 12 bp, Homo sapiens
aggcaggggctg

SEQ ID NO: 4260558 - DNA, 18 bp, Homo sapiens
aggcaggggctgggcaga

SEQ ID NO: 4260559 - DNA, 19 bp, Homo sapiens
aggcaggggctgggcagag

SEQ ID NO: 4260560 - DNA, 12 bp, Homo sapiens
aggcagtggcag

SEQ ID NO: 4260561 - DNA, 15 bp, Homo sapiens
aggcagtggcagcaa

SEQ ID NO: 4260562 - DNA, 23 bp, Homo sapiens
aggcagtggcttggagcagaggt

SEQ ID NO: 4260563 - DNA, 14 bp, Homo sapiens
aggcatactctcca

SEQ ID NO: 4260564 - DNA, 15 bp, Homo sapiens
aggcatactctccag

SEQ ID NO: 4260565 - DNA, 16 bp, Homo sapiens
aggcatactctccagg

SEQ ID NO: 4260566 - DNA, 15 bp, Homo sapiens
aggcatcattttcac

SEQ ID NO: 4260567 - DNA, 14 bp, Homo sapiens
aggcatgaccctgg

SEQ ID NO: 4260568 - DNA, 16 bp, Homo sapiens
aggccacatgagtccc

SEQ ID NO: 4260569 - DNA, 18 bp, Homo sapiens
aggccacctgcccccttc

SEQ ID NO: 4260570 - DNA, 16 bp, Homo sapiens
aggccacgggggaggc

SEQ ID NO: 4260571 - DNA, 23 bp, Homo sapiens
aggccacgggggaggccgaggca

SEQ ID NO: 4260572 - DNA, 22 bp, Homo sapiens
aggccagaggaagggaggcctg

SEQ ID NO: 4260573 - DNA, 12 bp, Homo sapiens
aggccagctcct

SEQ ID NO: 4260574 - DNA, 17 bp, Homo sapiens
aggcccagcctggcccc

SEQ ID NO: 4260575 - DNA, 23 bp, Homo sapiens
aggccccaaaaccacagccctgt

SEQ ID NO: 4260576 - DNA, 13 bp, Homo sapiens
aggccccagagac

SEQ ID NO: 4260577 - DNA, 20 bp, Homo sapiens
aggccccagagactcagagg

SEQ ID NO: 4260578 - DNA, 22 bp, Homo sapiens
aggccccagagactcagaggga

SEQ ID NO: 4260579 - DNA, 17 bp, Homo sapiens
acttgtgaaacacagct

SEQ ID NO: 4260580 - DNA, 17 bp, Homo sapiens
acttgtgtttgtatata

SEQ ID NO: 4260581 - DNA, 12 bp, Homo sapiens
actttaataata

SEQ ID NO: 4260582 - DNA, 22 bp, Homo sapiens
actttaataataaaaatcatgc

SEQ ID NO: 4260583 - DNA, 19 bp, Homo sapiens
actttacagttctggagga

SEQ ID NO: 4260584 - DNA, 15 bp, Homo sapiens
actttacctctctgt

SEQ ID NO: 4260585 - DNA, 15 bp, Homo sapiens
actttagaaagaaat

SEQ ID NO: 4260586 - DNA, 16 bp, Homo sapiens
actttagaaagaaatt

SEQ ID NO: 4260587 - DNA, 22 bp, Homo sapiens
actttagggctaaccagttctc

SEQ ID NO: 4260588 - DNA, 17 bp, Homo sapiens
agacttcaaaatattga

SEQ ID NO: 4260589 - DNA, 18 bp, Homo sapiens
agacttgatgaataaaca

SEQ ID NO: 4260590 - DNA, 19 bp, Homo sapiens
agagaaaagattaaaatta

SEQ ID NO: 4260591 - DNA, 15 bp, Homo sapiens
agagaagtgcccctg

SEQ ID NO: 4260592 - DNA, 16 bp, Homo sapiens
agagaattcactttac

SEQ ID NO: 4260593 - DNA, 20 bp, Homo sapiens
agagaattctaagattgtac

SEQ ID NO: 4260594 - DNA, 21 bp, Homo sapiens
agagaattctaagattgtaca

SEQ ID NO: 4260595 - DNA, 19 bp, Homo sapiens
agagaccacccatatcatg

SEQ ID NO: 4260596 - DNA, 15 bp, Homo sapiens
agagaccttctctta

SEQ ID NO: 4260597 - DNA, 19 bp, Homo sapiens
agagagaagtgcccctgct

SEQ ID NO: 4260598 - DNA, 22 bp, Homo sapiens
agagagtatggtgctgggtcct

SEQ ID NO: 4260599 - DNA, 17 bp, Homo sapiens
agagagtggctcctccc

SEQ ID NO: 4260600 - DNA, 15 bp, Homo sapiens
agagagttgaaccta

SEQ ID NO: 4260601 - DNA, 14 bp, Homo sapiens
agagatatatctga

SEQ ID NO: 4260602 - DNA, 13 bp, Homo sapiens
agagatattttgt

SEQ ID NO: 4260603 - DNA, 16 bp, Homo sapiens
agagatattttgtaaa

SEQ ID NO: 4260604 - DNA, 14 bp, Homo sapiens
agagatgaggaaat

SEQ ID NO: 4260605 - DNA, 14 bp, Homo sapiens
agagattaatttgt

SEQ ID NO: 4260606 - DNA, 19 bp, Homo sapiens
agagattgggggggcttgg

SEQ ID NO: 4260607 - DNA, 14 bp, Homo sapiens
agagcacagattca

SEQ ID NO: 4260608 - DNA, 16 bp, Homo sapiens
agagcattctggggtg

SEQ ID NO: 4260609 - DNA, 16 bp, Homo sapiens
agagccaaggcctatg

SEQ ID NO: 4260610 - DNA, 19 bp, Homo sapiens
agagccaaggcctatgcca

SEQ ID NO: 4260611 - DNA, 9 bp, Homo sapiens
agagccagg

SEQ ID NO: 4260612 - DNA, 14 bp, Homo sapiens
agagccagggctgt

SEQ ID NO: 4260613 - DNA, 15 bp, Homo sapiens
agagcccaatcactg

SEQ ID NO: 4260614 - DNA, 16 bp, Homo sapiens
agagcccgcccacctg

SEQ ID NO: 4260615 - DNA, 12 bp, Homo sapiens
agagcctccctc

SEQ ID NO: 4260616 - DNA, 13 bp, Homo sapiens
agagcctccctca

SEQ ID NO: 4260617 - DNA, 17 bp, Homo sapiens
agagcctccctcagcca

SEQ ID NO: 4260618 - DNA, 23 bp, Homo sapiens
agagcctccctcagccacgcctc

SEQ ID NO: 4260619 - DNA, 19 bp, Homo sapiens
agagcctggggtgggtgtg

SEQ ID NO: 4260620 - DNA, 18 bp, Homo sapiens
agagcgctcctctgcctt

SEQ ID NO: 4260621 - DNA, 20 bp, Homo sapiens
agagcgctcctctgccttgg

SEQ ID NO: 4260622 - DNA, 22 bp, Homo sapiens
agagctcagcacagcctcaccc

SEQ ID NO: 4260623 - DNA, 14 bp, Homo sapiens
agagctcaggagaa

SEQ ID NO: 4260624 - DNA, 16 bp, Homo sapiens
agagctcaggagaagg

SEQ ID NO: 4260625 - DNA, 17 bp, Homo sapiens
agagctcaggagaaggc

SEQ ID NO: 4260626 - DNA, 20 bp, Homo sapiens
agagctcaggagaaggcctg

SEQ ID NO: 4260627 - DNA, 11 bp, Homo sapiens
agagctcccag

SEQ ID NO: 4260628 - DNA, 15 bp, Homo sapiens
agagctcccaggacg

SEQ ID NO: 4260629 - DNA, 20 bp, Homo sapiens
agaggaacctctgatttatt

SEQ ID NO: 4260630 - DNA, 14 bp, Homo sapiens
agaggaagggaggc

SEQ ID NO: 4260631 - DNA, 22 bp, Homo sapiens
agaggagagaatgagagagtgt

SEQ ID NO: 4260632 - DNA, 16 bp, Homo sapiens
agaggagcaggaagca

SEQ ID NO: 4260633 - DNA, 19 bp, Homo sapiens
agaggagcgggacctgtgg

SEQ ID NO: 4260634 - DNA, 20 bp, Homo sapiens
agaggagcgggacctgtggc

SEQ ID NO: 4260635 - DNA, 22 bp, Homo sapiens
agaggaggaaaaaggctggtgg

SEQ ID NO: 4260636 - DNA, 19 bp, Homo sapiens
agaggagggatagagacgc

SEQ ID NO: 4260637 - DNA, 22 bp, Homo sapiens
agaggaggtgtggagtggaggg

SEQ ID NO: 4260638 - DNA, 19 bp, Homo sapiens
agaggattagtaagatctc

SEQ ID NO: 4260639 - DNA, 14 bp, Homo sapiens
agaggcagtggcag

SEQ ID NO: 4260640 - DNA, 17 bp, Homo sapiens
agaggcagtggcagcaa

SEQ ID NO: 4260641 - DNA, 12 bp, Homo sapiens
agaggccgctgc

SEQ ID NO: 4260642 - DNA, 14 bp, Homo sapiens
agaggccgctgcag

SEQ ID NO: 4260643 - DNA, 16 bp, Homo sapiens
agaggccgctgcaggg

SEQ ID NO: 4260644 - DNA, 20 bp, Homo sapiens
agaggccgctgcagggtggc

SEQ ID NO: 4260645 - DNA, 10 bp, Homo sapiens
agaggcctgg

SEQ ID NO: 4260646 - DNA, 12 bp, Homo sapiens
agaggcctggtg

SEQ ID NO: 4260647 - DNA, 13 bp, Homo sapiens
agaggcctggtgc

SEQ ID NO: 4260648 - DNA, 18 bp, Homo sapiens
agaggcctggtgccctgg

SEQ ID NO: 4260649 - DNA, 21 bp, Homo sapiens
agaggcctggtgccctggccc

SEQ ID NO: 4260650 - DNA, 22 bp, Homo sapiens
agaggcctggtgccctggccca

SEQ ID NO: 4260651 - DNA, 23 bp, Homo sapiens
agaggcctggtgccctggcccag

SEQ ID NO: 4260652 - DNA, 22 bp, Homo sapiens
agaggctctgaaagctgcttct

SEQ ID NO: 4260653 - DNA, 15 bp, Homo sapiens
agagggacagtgggc

SEQ ID NO: 4260654 - DNA, 15 bp, Homo sapiens
agagggagaaggaga

SEQ ID NO: 4260655 - DNA, 22 bp, Homo sapiens
agagggagaaggagaggctctg

SEQ ID NO: 4260656 - DNA, 20 bp, Homo sapiens
agagggcaggggctgcatcc

SEQ ID NO: 4260657 - DNA, 13 bp, Homo sapiens
agaggggagagga

SEQ ID NO: 4260658 - DNA, 17 bp, Homo sapiens
agaggggcggggccagg

SEQ ID NO: 4260659 - DNA, 18 bp, Homo sapiens
agaggtgagggaggcctg

SEQ ID NO: 4260660 - DNA, 19 bp, Homo sapiens
agaggtgagggaggcctga

SEQ ID NO: 4260661 - DNA, 17 bp, Homo sapiens
agagtaaaaccaaaggt

SEQ ID NO: 4260662 - DNA, 17 bp, Homo sapiens
agagtactttggtttct

SEQ ID NO: 4260663 - DNA, 17 bp, Homo sapiens
agagtatatatgtacag

SEQ ID NO: 4260664 - DNA, 20 bp, Homo sapiens
agagtatgcaagaagaatat

SEQ ID NO: 4260665 - DNA, 21 bp, Homo sapiens
agagtatgcaagaagaatata

SEQ ID NO: 4260666 - DNA, 15 bp, Homo sapiens
agagtatggattgaa

SEQ ID NO: 4260667 - DNA, 15 bp, Homo sapiens
agagtgcacagctgt

SEQ ID NO: 4260668 - DNA, 21 bp, Homo sapiens
agagtgcccttaaaataatga

SEQ ID NO: 4260669 - DNA, 13 bp, Homo sapiens
agagtggctcctc

SEQ ID NO: 4260670 - DNA, 20 bp, Homo sapiens
agagtggggctagactgggc

SEQ ID NO: 4260671 - DNA, 21 bp, Homo sapiens
agagtggggctagactgggct

SEQ ID NO: 4260672 - DNA, 22 bp, Homo sapiens
agagtggggctagactgggctg

SEQ ID NO: 4260673 - DNA, 13 bp, Homo sapiens
agagttgaaccta

SEQ ID NO: 4260674 - DNA, 15 bp, Homo sapiens
agagttgcagtaaag

SEQ ID NO: 4260675 - DNA, 16 bp, Homo sapiens
agatactttgcattgt

SEQ ID NO: 4260676 - DNA, 19 bp, Homo sapiens
agatactttgcattgtctg

SEQ ID NO: 4260677 - DNA, 15 bp, Homo sapiens
agatatatctgaaaa

SEQ ID NO: 4260678 - DNA, 21 bp, Homo sapiens
agatatatctgaaaactggaa

SEQ ID NO: 4260679 - DNA, 18 bp, Homo sapiens
agatattcatactttcca

SEQ ID NO: 4260680 - DNA, 19 bp, Homo sapiens
agatattcatactttccaa

SEQ ID NO: 4260681 - DNA, 15 bp, Homo sapiens
agatcagcattcaaa

SEQ ID NO: 4260682 - DNA, 24 bp, Homo sapiens
agatcagcattcaaaatagttcta

SEQ ID NO: 4260683 - DNA, 18 bp, Homo sapiens
agatctagccaggcctcc

SEQ ID NO: 4260684 - DNA, 15 bp, Homo sapiens
agatctcctgtaatt

SEQ ID NO: 4260685 - DNA, 20 bp, Homo sapiens
agatctcctgtaattttgta

SEQ ID NO: 4260686 - DNA, 15 bp, Homo sapiens
agatcttccttccgc

SEQ ID NO: 4260687 - DNA, 17 bp, Homo sapiens
agatcttgagcaaggca

SEQ ID NO: 4260688 - DNA, 13 bp, Homo sapiens
agatgaagaagaa

SEQ ID NO: 4260689 - DNA, 18 bp, Homo sapiens
agatgacacataaatctg

SEQ ID NO: 4260690 - DNA, 15 bp, Homo sapiens
agatgcagtgccagg

SEQ ID NO: 4260691 - DNA, 14 bp, Homo sapiens
agatgcctgggcct

SEQ ID NO: 4260692 - DNA, 21 bp, Homo sapiens
agatgctggtcatcctgggca

SEQ ID NO: 4260693 - DNA, 22 bp, Homo sapiens
agatggaacccttttggccccc

SEQ ID NO: 4260694 - DNA, 16 bp, Homo sapiens
agatgggatgcttgcc

SEQ ID NO: 4260695 - DNA, 14 bp, Homo sapiens
agatggggagggcg

SEQ ID NO: 4260696 - DNA, 20 bp, Homo sapiens
agatggtgaagcattctccc

SEQ ID NO: 4260697 - DNA, 21 bp, Homo sapiens
agatgtattatgcaaagtacc

SEQ ID NO: 4260698 - DNA, 18 bp, Homo sapiens
agatgtttgttttcaaaa

SEQ ID NO: 4260699 - DNA, 23 bp, Homo sapiens
agatgtttgttttcaaaatactt

SEQ ID NO: 4260700 - DNA, 19 bp, Homo sapiens
agattatttacaagaagaa

SEQ ID NO: 4260701 - DNA, 19 bp, Homo sapiens
agattccagagagtggctc

SEQ ID NO: 4260702 - DNA, 15 bp, Homo sapiens
agattctaaaacatt

SEQ ID NO: 4260703 - DNA, 22 bp, Homo sapiens
agattctgtgggcagctggctc

SEQ ID NO: 4260704 - DNA, 17 bp, Homo sapiens
agattggatcaagtatt

SEQ ID NO: 4260705 - DNA, 22 bp, Homo sapiens
agattggatcaagtattactaa

SEQ ID NO: 4260706 - DNA, 16 bp, Homo sapiens
agattgggggggcttg

SEQ ID NO: 4260707 - DNA, 18 bp, Homo sapiens
agattggttcatgcctgg

SEQ ID NO: 4260708 - DNA, 19 bp, Homo sapiens
agattgtacatatggaaat

SEQ ID NO: 4260709 - DNA, 15 bp, Homo sapiens
agattgttattaaat

SEQ ID NO: 4260710 - DNA, 17 bp, Homo sapiens
agattgttattaaatgt

SEQ ID NO: 4260711 - DNA, 13 bp, Homo sapiens
agatttagtttac

SEQ ID NO: 4260712 - DNA, 18 bp, Homo sapiens
agatttccctaaaaattc

SEQ ID NO: 4260713 - DNA, 12 bp, Homo sapiens
agatttgtattt

SEQ ID NO: 4260714 - DNA, 13 bp, Homo sapiens
agcaaacacacag

SEQ ID NO: 4260715 - DNA, 14 bp, Homo sapiens
agcaacaggaccag

SEQ ID NO: 4260716 - DNA, 12 bp, Homo sapiens
agcaacatgaat

SEQ ID NO: 4260717 - DNA, 13 bp, Homo sapiens
agcaacatgaatt

SEQ ID NO: 4260718 - DNA, 20 bp, Homo sapiens
agccctgctttgggctgccc

SEQ ID NO: 4260719 - DNA, 22 bp, Homo sapiens
agccctggggtttccacacagg

SEQ ID NO: 4260720 - DNA, 13 bp, Homo sapiens
agccctggtggcc

SEQ ID NO: 4260721 - DNA, 19 bp, Homo sapiens
agccctggttctccatccc

SEQ ID NO: 4260722 - DNA, 22 bp, Homo sapiens
agccctggttctccatccccat

SEQ ID NO: 4260723 - DNA, 20 bp, Homo sapiens
agggttagacaagcctggag

SEQ ID NO: 4260724 - DNA, 21 bp, Homo sapiens
agggttagacaagcctggagg

SEQ ID NO: 4260725 - DNA, 12 bp, Homo sapiens
agggttccagac

SEQ ID NO: 4260726 - DNA, 13 bp, Homo sapiens
agggttccagaca

SEQ ID NO: 4260727 - DNA, 17 bp, Homo sapiens
agggttcccccagccct

SEQ ID NO: 4260728 - DNA, 15 bp, Homo sapiens
agggttctagaaggg

SEQ ID NO: 4260729 - DNA, 22 bp, Homo sapiens
agggttctagaaggggcgaggc

SEQ ID NO: 4260730 - DNA, 22 bp, Homo sapiens
agggttgtgattttgtctgctt

SEQ ID NO: 4260731 - DNA, 20 bp, Homo sapiens
aggtaacatagatgcctggg

SEQ ID NO: 4260732 - DNA, 17 bp, Homo sapiens
aggtcatcccggggcca

SEQ ID NO: 4260733 - DNA, 20 bp, Homo sapiens
aggtcatcccggggccatgg

SEQ ID NO: 4260734 - DNA, 21 bp, Homo sapiens
aggtcccagacatgctgccca

SEQ ID NO: 4260735 - DNA, 22 bp, Homo sapiens
aggtcccgagccccctgtcctt

SEQ ID NO: 4260736 - DNA, 13 bp, Homo sapiens
aggtctcctgggc

SEQ ID NO: 4260737 - DNA, 24 bp, Homo sapiens
aggtctcctgggcatctggccctg

SEQ ID NO: 4260738 - DNA, 14 bp, Homo sapiens
aggtctgctcggcc

SEQ ID NO: 4260739 - DNA, 15 bp, Homo sapiens
aggtgacccttctgt

SEQ ID NO: 4260740 - DNA, 21 bp, Homo sapiens
aggtgacccttctgtctgtaa

SEQ ID NO: 4260741 - DNA, 17 bp, Homo sapiens
aggtgagggaggcctga

SEQ ID NO: 4260742 - DNA, 13 bp, Homo sapiens
aggtgcccagtct

SEQ ID NO: 4260743 - DNA, 21 bp, Homo sapiens
aggtgcccagtcttgagtggg

SEQ ID NO: 4260744 - DNA, 16 bp, Homo sapiens
aggtggaacaggagga

SEQ ID NO: 4260745 - DNA, 19 bp, Homo sapiens
aggtggaacaggaggaact

SEQ ID NO: 4260746 - DNA, 18 bp, Homo sapiens
aggtggaggcgagccaga

SEQ ID NO: 4260747 - DNA, 14 bp, Homo sapiens
aggtggccactcca

SEQ ID NO: 4260748 - DNA, 14 bp, Homo sapiens
aggtgggccagccc

SEQ ID NO: 4260749 - DNA, 15 bp, Homo sapiens
aggtgggccagcccc

SEQ ID NO: 4260750 - DNA, 23 bp, Homo sapiens
aggtgggccttccatgggcatgg

SEQ ID NO: 4260751 - DNA, 22 bp, Homo sapiens
aggtggggagggggtttggggg

SEQ ID NO: 4260752 - DNA, 23 bp, Homo sapiens
aggtggggagggggtttgggggc

SEQ ID NO: 4260753 - DNA, 19 bp, Homo sapiens
aggtgggtcaactccaagg

SEQ ID NO: 4260754 - DNA, 13 bp, Homo sapiens
aggtgggtcttgg

SEQ ID NO: 4260755 - DNA, 14 bp, Homo sapiens
aggtggtctgcacc

SEQ ID NO: 4260756 - DNA, 16 bp, Homo sapiens
aggtggtctgcacccc

SEQ ID NO: 4260757 - DNA, 23 bp, Homo sapiens
aggtggtctgcaccccacaggat

SEQ ID NO: 4260758 - DNA, 14 bp, Homo sapiens
aggtggtcttggag

SEQ ID NO: 4260759 - DNA, 17 bp, Homo sapiens
aggtggtcttggagagg

SEQ ID NO: 4260760 - DNA, 21 bp, Homo sapiens
aggtgtcatacagatttgcaa

SEQ ID NO: 4260761 - DNA, 17 bp, Homo sapiens
aggtgtggagtggaggg

SEQ ID NO: 4260762 - DNA, 17 bp, Homo sapiens
aggtgtgggctcccacg

SEQ ID NO: 4260763 - DNA, 22 bp, Homo sapiens
aggtgtgggctcccacgccctc

SEQ ID NO: 4260764 - DNA, 23 bp, Homo sapiens
aggtgtgggctcccacgccctcc

SEQ ID NO: 4260765 - DNA, 15 bp, Homo sapiens
aggtgtttctctgta

SEQ ID NO: 4260766 - DNA, 19 bp, Homo sapiens
aggttaaggggatctaaaa

SEQ ID NO: 4260767 - DNA, 14 bp, Homo sapiens
aggttgcttcaaga

SEQ ID NO: 4260768 - DNA, 19 bp, Homo sapiens
aggttggaactgctgccat

SEQ ID NO: 4260769 - DNA, 13 bp, Homo sapiens
aggtttagcgttt

SEQ ID NO: 4260770 - DNA, 17 bp, Homo sapiens
agtaaaattacagaaga

SEQ ID NO: 4260771 - DNA, 18 bp, Homo sapiens
agtaaaattacagaagaa

SEQ ID NO: 4260772 - DNA, 16 bp, Homo sapiens
agtaaaattatactgt

SEQ ID NO: 4260773 - DNA, 23 bp, Homo sapiens
agtaaacaataaaagtgtccatt

SEQ ID NO: 4260774 - DNA, 14 bp, Homo sapiens
agtaagttctgaaa

SEQ ID NO: 4260775 - DNA, 17 bp, Homo sapiens
agtaatatctttcagtt

SEQ ID NO: 4260776 - DNA, 14 bp, Homo sapiens
agtaatctgtataa

SEQ ID NO: 4260777 - DNA, 15 bp, Homo sapiens
agtaatctgtataat

SEQ ID NO: 4260778 - DNA, 23 bp, Homo sapiens
agtaatctgtataatactttgta

SEQ ID NO: 4260779 - DNA, 20 bp, Homo sapiens
agtaatggttctagaaggat

SEQ ID NO: 4260780 - DNA, 21 bp, Homo sapiens
agtactggtaagattgttatt

SEQ ID NO: 4260781 - DNA, 16 bp, Homo sapiens
agtacttcttctgtaa

SEQ ID NO: 4260782 - DNA, 23 bp, Homo sapiens
agtacttcttctgtaatatttac

SEQ ID NO: 4260783 - DNA, 21 bp, Homo sapiens
agtacttgctcaataaaggtc

SEQ ID NO: 4260784 - DNA, 20 bp, Homo sapiens
agtacttgtgaaacacagct

SEQ ID NO: 4260785 - DNA, 15 bp, Homo sapiens
agtagaatctcagca

SEQ ID NO: 4260786 - DNA, 16 bp, Homo sapiens
agtagaatctcagcac

SEQ ID NO: 4260787 - DNA, 16 bp, Homo sapiens
agtagcgctatagtta

SEQ ID NO: 4260788 - DNA, 16 bp, Homo sapiens
agtagctcgtgtgctt

SEQ ID NO: 4260789 - DNA, 21 bp, Homo sapiens
agtagtacttcttctgtaata

SEQ ID NO: 4260790 - DNA, 22 bp, Homo sapiens
agtagtacttcttctgtaatat

SEQ ID NO: 4260791 - DNA, 19 bp, Homo sapiens
agtatatagccttaagtct

SEQ ID NO: 4260792 - DNA, 15 bp, Homo sapiens
agtatatatgtacag

SEQ ID NO: 4260793 - DNA, 20 bp, Homo sapiens
agtatattttatttcaatgt

SEQ ID NO: 4260794 - DNA, 22 bp, Homo sapiens
agtatccctgatttattctggt

SEQ ID NO: 4260795 - DNA, 21 bp, Homo sapiens
agtatctcatcaacaaagaaa

SEQ ID NO: 4260796 - DNA, 20 bp, Homo sapiens
agtatctctactttcctgat

SEQ ID NO: 4260797 - DNA, 21 bp, Homo sapiens
agtatctctactttcctgatg

SEQ ID NO: 4260798 - DNA, 23 bp, Homo sapiens
agtatctctactttcctgatgtt

SEQ ID NO: 4260799 - DNA, 14 bp, Homo sapiens
agtatctgtacctg

SEQ ID NO: 4260800 - DNA, 16 bp, Homo sapiens
agtatgcaagaagaat

SEQ ID NO: 4260801 - DNA, 17 bp, Homo sapiens
agtatgcaagaagaata

SEQ ID NO: 4260802 - DNA, 19 bp, Homo sapiens
agtatgcaagaagaatata

SEQ ID NO: 4260803 - DNA, 22 bp, Homo sapiens
agtatgtcagtccaataaatta

SEQ ID NO: 4260804 - DNA, 18 bp, Homo sapiens
agtatgttttagcatgtg

SEQ ID NO: 4260805 - DNA, 14 bp, Homo sapiens
agtattatagatat

SEQ ID NO: 4260806 - DNA, 17 bp, Homo sapiens
agtattccttggcccag

SEQ ID NO: 4260807 - DNA, 20 bp, Homo sapiens
agtattccttggcccagcag

SEQ ID NO: 4260808 - DNA, 16 bp, Homo sapiens
agtcaactgctgtttt

SEQ ID NO: 4260809 - DNA, 14 bp, Homo sapiens
agtcacccctgtct

SEQ ID NO: 4260810 - DNA, 21 bp, Homo sapiens
agtcactccgttttgcaaaag

SEQ ID NO: 4260811 - DNA, 13 bp, Homo sapiens
agtcagcacagag

SEQ ID NO: 4260812 - DNA, 15 bp, Homo sapiens
agtcaggagccagca

SEQ ID NO: 4260813 - DNA, 16 bp, Homo sapiens
agtcaggagccagcag

SEQ ID NO: 4260814 - DNA, 17 bp, Homo sapiens
agtcaggagccagcagg

SEQ ID NO: 4260815 - DNA, 15 bp, Homo sapiens
agtcagggcggggct

SEQ ID NO: 4260816 - DNA, 22 bp, Homo sapiens
agtcagggcggggctggccagc

SEQ ID NO: 4260817 - DNA, 23 bp, Homo sapiens
agtcatcatgggggatttttcat

SEQ ID NO: 4260818 - DNA, 19 bp, Homo sapiens
agtcatgacatttctcaaa

SEQ ID NO: 4260819 - DNA, 15 bp, Homo sapiens
agtcatgatgaatca

SEQ ID NO: 4260820 - DNA, 22 bp, Homo sapiens
agtcatggctgtcccctgcaag

SEQ ID NO: 4260821 - DNA, 16 bp, Homo sapiens
agtcattaaattacta

SEQ ID NO: 4260822 - DNA, 19 bp, Homo sapiens
agtccagacctgggccctg

SEQ ID NO: 4260823 - DNA, 20 bp, Homo sapiens
agtccagacctgggccctgg

SEQ ID NO: 4260824 - DNA, 21 bp, Homo sapiens
agtccagacctgggccctggt

SEQ ID NO: 4260825 - DNA, 17 bp, Homo sapiens
agtccagctctcccctg

SEQ ID NO: 4260826 - DNA, 14 bp, Homo sapiens
agtctggaggtccc

SEQ ID NO: 4260827 - DNA, 16 bp, Homo sapiens
agtctggaggtcccag

SEQ ID NO: 4260828 - DNA, 16 bp, Homo sapiens
agtctgtctgcactgc

SEQ ID NO: 4260829 - DNA, 18 bp, Homo sapiens
agtctgtgaataaagcca

SEQ ID NO: 4260830 - DNA, 22 bp, Homo sapiens
agtcttaatatatatatccaga

SEQ ID NO: 4260831 - DNA, 15 bp, Homo sapiens
agtcttactgttttg

SEQ ID NO: 4260832 - DNA, 19 bp, Homo sapiens
agtcttactgttttgtgcg

SEQ ID NO: 4260833 - DNA, 16 bp, Homo sapiens
agtcttccatcagcag

SEQ ID NO: 4260834 - DNA, 19 bp, Homo sapiens
agtcttccatcagcagtga

SEQ ID NO: 4260835 - DNA, 11 bp, Homo sapiens
agtcttttgtc

SEQ ID NO: 4260836 - DNA, 16 bp, Homo sapiens
agtgaagcccaggagg

SEQ ID NO: 4260837 - DNA, 17 bp, Homo sapiens
agtgaagcccaggagga

SEQ ID NO: 4260838 - DNA, 20 bp, Homo sapiens
agtgaagcccaggaggacct

SEQ ID NO: 4260839 - DNA, 15 bp, Homo sapiens
agtgaagtccagtga

SEQ ID NO: 4260840 - DNA, 15 bp, Homo sapiens
agtgacaaggcccca

SEQ ID NO: 4260841 - DNA, 16 bp, Homo sapiens
agtgacaaggccccag

SEQ ID NO: 4260842 - DNA, 21 bp, Homo sapiens
agtgacaaggccccagagact

SEQ ID NO: 4260843 - DNA, 17 bp, Homo sapiens
agtgaccccagctccag

SEQ ID NO: 4260844 - DNA, 18 bp, Homo sapiens
agtgaccccagctccagg

SEQ ID NO: 4260845 - DNA, 15 bp, Homo sapiens
agtgacccggaggcc

SEQ ID NO: 4260846 - DNA, 17 bp, Homo sapiens
agtgacccggaggccac

SEQ ID NO: 4260847 - DNA, 18 bp, Homo sapiens
agtgacccggaggccaca

SEQ ID NO: 4260848 - DNA, 23 bp, Homo sapiens
agtgacccggaggccacatgagt

SEQ ID NO: 4260849 - DNA, 22 bp, Homo sapiens
agtgactaaaccattgtgcatt

SEQ ID NO: 4260850 - DNA, 22 bp, Homo sapiens
agtgactaccacttatttctaa

SEQ ID NO: 4260851 - DNA, 16 bp, Homo sapiens
agtgactgctgcgctg

SEQ ID NO: 4260852 - DNA, 22 bp, Homo sapiens
agtgactgctgcgctgtgctgg

SEQ ID NO: 4260853 - DNA, 19 bp, Homo sapiens
agtgagaaattatgaaagt

SEQ ID NO: 4260854 - DNA, 20 bp, Homo sapiens
agtgagatttgtatttatat

SEQ ID NO: 4260855 - DNA, 23 bp, Homo sapiens
agtgagatttgtatttatattag

SEQ ID NO: 4260856 - DNA, 16 bp, Homo sapiens
agtgagtgtggcttag

SEQ ID NO: 4260857 - DNA, 20 bp, Homo sapiens
agtgataacactggagtggt

SEQ ID NO: 4260858 - DNA, 23 bp, Homo sapiens
agtgatatggcttgtagggtgag

SEQ ID NO: 4260859 - DNA, 13 bp, Homo sapiens
agtgatgttgaaa

SEQ ID NO: 4260860 - DNA, 23 bp, Homo sapiens
agtgattgaagtatctgtacctg

SEQ ID NO: 4260861 - DNA, 16 bp, Homo sapiens
agtgatttgctatcat

SEQ ID NO: 4260862 - DNA, 22 bp, Homo sapiens
agtgcaatccatgtatctgtat

SEQ ID NO: 4260863 - DNA, 12 bp, Homo sapiens
agtgcacagctg

SEQ ID NO: 4260864 - DNA, 14 bp, Homo sapiens
agtgcacagctgtc

SEQ ID NO: 4260865 - DNA, 19 bp, Homo sapiens
agtgcagccccctcctgac

SEQ ID NO: 4260866 - DNA, 21 bp, Homo sapiens
agtgcagcccgtgtggcccct

SEQ ID NO: 4260867 - DNA, 23 bp, Homo sapiens
agtgcagcccgtgtggccccttc

SEQ ID NO: 4260868 - DNA, 11 bp, Homo sapiens
agtgcaggctg

SEQ ID NO: 4260869 - DNA, 22 bp, Homo sapiens
agtgcagtggtgcgatcttggc

SEQ ID NO: 4260870 - DNA, 16 bp, Homo sapiens
agtgcatctcagccca

SEQ ID NO: 4260871 - DNA, 17 bp, Homo sapiens
agtgcatctcagcccac

SEQ ID NO: 4260872 - DNA, 17 bp, Homo sapiens
agtgcatttctgggcct

SEQ ID NO: 4260873 - DNA, 19 bp, Homo sapiens
agtgcccatggggtagaag

SEQ ID NO: 4260874 - DNA, 13 bp, Homo sapiens
agtgcccctgctg

SEQ ID NO: 4260875 - DNA, 19 bp, Homo sapiens
agtgcccctgctgcctccc

SEQ ID NO: 4260876 - DNA, 12 bp, Homo sapiens
agtgcctctggt

SEQ ID NO: 4260877 - DNA, 19 bp, Homo sapiens
agtgctgagtctgtgaata

SEQ ID NO: 4260878 - DNA, 14 bp, Homo sapiens
agtggaaaaaagag

SEQ ID NO: 4260879 - DNA, 23 bp, Homo sapiens
agtggaaaaaagagaaaaaccaa

SEQ ID NO: 4260880 - DNA, 20 bp, Homo sapiens
agtggactttccaccccctc

SEQ ID NO: 4260881 - DNA, 22 bp, Homo sapiens
agtggactttccaccccctccc

SEQ ID NO: 4260882 - DNA, 14 bp, Homo sapiens
agtggagggagact

SEQ ID NO: 4260883 - DNA, 20 bp, Homo sapiens
agtggagggagactgaccca

SEQ ID NO: 4260884 - DNA, 22 bp, Homo sapiens
agtggcaaaggatccagatagc

SEQ ID NO: 4260885 - DNA, 21 bp, Homo sapiens
agtggcctacaaatcagtaat

SEQ ID NO: 4260886 - DNA, 22 bp, Homo sapiens
agtggcctacaaatcagtaatt

SEQ ID NO: 4260887 - DNA, 21 bp, Homo sapiens
agtggcctgagaagagtcgag

SEQ ID NO: 4260888 - DNA, 16 bp, Homo sapiens
agtggcttcagcccct

SEQ ID NO: 4260889 - DNA, 15 bp, Homo sapiens
agtggcttggagcag

SEQ ID NO: 4260890 - DNA, 20 bp, Homo sapiens
agtggcttggagcagaggtg

SEQ ID NO: 4260891 - DNA, 15 bp, Homo sapiens
agtgggagaggaagc

SEQ ID NO: 4260892 - DNA, 18 bp, Homo sapiens
agtgggagtcaagtgtgc

SEQ ID NO: 4260893 - DNA, 14 bp, Homo sapiens
agtgggccccctct

SEQ ID NO: 4260894 - DNA, 12 bp, Homo sapiens
agtgggccctgg

SEQ ID NO: 4260895 - DNA, 17 bp, Homo sapiens
agtgggccctggctctg

SEQ ID NO: 4260896 - DNA, 15 bp, Homo sapiens
agtgggctctgagca

SEQ ID NO: 4260897 - DNA, 20 bp, Homo sapiens
agtggggaggagactcaggc

SEQ ID NO: 4260898 - DNA, 23 bp, Homo sapiens
agtggggctagactgggctggct

SEQ ID NO: 4260899 - DNA, 20 bp, Homo sapiens
agtggtaacaagaggagcag

SEQ ID NO: 4260900 - DNA, 15 bp, Homo sapiens
agtggttaagaatgt

SEQ ID NO: 4260901 - DNA, 16 bp, Homo sapiens
agtgtattttctgtgt

SEQ ID NO: 4260902 - DNA, 15 bp, Homo sapiens
agtgtccccaggggc

SEQ ID NO: 4260903 - DNA, 18 bp, Homo sapiens
agtgtctgtccatctgtc

SEQ ID NO: 4260904 - DNA, 18 bp, Homo sapiens
agtgtgaatataaatgtg

SEQ ID NO: 4260905 - DNA, 12 bp, Homo sapiens
agtgtgagggtg

SEQ ID NO: 4260906 - DNA, 13 bp, Homo sapiens
agtgtgagggtgc

SEQ ID NO: 4260907 - DNA, 17 bp, Homo sapiens
agtgtgagggtgcaggg

SEQ ID NO: 4260908 - DNA, 20 bp, Homo sapiens
agtgtgccaccctctgcagg

SEQ ID NO: 4260909 - DNA, 23 bp, Homo sapiens
agtgtgcctgctatccagccgca

SEQ ID NO: 4260910 - DNA, 13 bp, Homo sapiens
agtgtgctgaggt

SEQ ID NO: 4260911 - DNA, 19 bp, Homo sapiens
agtgtgctgaggtgggcct

SEQ ID NO: 4260912 - DNA, 14 bp, Homo sapiens
agtgtggactctgg

SEQ ID NO: 4260913 - DNA, 17 bp, Homo sapiens
agtgtggactctggact

SEQ ID NO: 4260914 - DNA, 14 bp, Homo sapiens
agtgtggctcccct

SEQ ID NO: 4260915 - DNA, 14 bp, Homo sapiens
agtgtgggaatgcg

SEQ ID NO: 4260916 - DNA, 15 bp, Homo sapiens
agtgttgcctcctcc

SEQ ID NO: 4260917 - DNA, 22 bp, Homo sapiens
agtgtttaattgtataaaacag

SEQ ID NO: 4260918 - DNA, 13 bp, Homo sapiens
agtgtttatgtgc

SEQ ID NO: 4260919 - DNA, 16 bp, Homo sapiens
agtgtttatgtgctat

SEQ ID NO: 4260920 - DNA, 18 bp, Homo sapiens
agtgtttccagtgacaca

SEQ ID NO: 4260921 - DNA, 23 bp, Homo sapiens
agtgtttccagtgacacaactca

SEQ ID NO: 4260922 - DNA, 18 bp, Homo sapiens
agttacacatgatcataa

SEQ ID NO: 4260923 - DNA, 19 bp, Homo sapiens
agttactggttggtgttct

SEQ ID NO: 4260924 - DNA, 20 bp, Homo sapiens
atattgagcaatatgtcagt

SEQ ID NO: 4260925 - DNA, 19 bp, Homo sapiens
atattgctgaagaatctac

SEQ ID NO: 4260926 - DNA, 18 bp, Homo sapiens
atattgctgaatgcaaga

SEQ ID NO: 4260927 - DNA, 13 bp, Homo sapiens
atattggtgtgaa

SEQ ID NO: 4260928 - DNA, 14 bp, Homo sapiens
atattggtgtgaat

SEQ ID NO: 4260929 - DNA, 14 bp, Homo sapiens
atattgtatgtacc

SEQ ID NO: 4260930 - DNA, 20 bp, Homo sapiens
atatttaataggataaatta

SEQ ID NO: 4260931 - DNA, 17 bp, Homo sapiens
atatttacaatgtatta

SEQ ID NO: 4260932 - DNA, 22 bp, Homo sapiens
atatttatgacctcaacaaaga

SEQ ID NO: 4260933 - DNA, 17 bp, Homo sapiens
atatttctcatttagca

SEQ ID NO: 4260934 - DNA, 12 bp, Homo sapiens
atatttcttcaa

SEQ ID NO: 4260935 - DNA, 15 bp, Homo sapiens
atatttcttcaaata

SEQ ID NO: 4260936 - DNA, 18 bp, Homo sapiens
atatttcttcaaatatct

SEQ ID NO: 4260937 - DNA, 18 bp, Homo sapiens
atatttgtagctagaata

SEQ ID NO: 4260938 - DNA, 17 bp, Homo sapiens
atattttatttcaatgt

SEQ ID NO: 4260939 - DNA, 21 bp, Homo sapiens
atattttatttcaatgtaatt

SEQ ID NO: 4260940 - DNA, 19 bp, Homo sapiens
atattttcaacgcagccct

SEQ ID NO: 4260941 - DNA, 17 bp, Homo sapiens
atatttttttaacttta

SEQ ID NO: 4260942 - DNA, 17 bp, Homo sapiens
atatttttttctagcta

SEQ ID NO: 4260943 - DNA, 18 bp, Homo sapiens
atatttttttctagctat

SEQ ID NO: 4260944 - DNA, 16 bp, Homo sapiens
atcaaaaatattccat

SEQ ID NO: 4260945 - DNA, 20 bp, Homo sapiens
atcaaactttcagctttttt

SEQ ID NO: 4260946 - DNA, 13 bp, Homo sapiens
atcaaagtgttta

SEQ ID NO: 4260947 - DNA, 15 bp, Homo sapiens
atcaaagtgtttaat

SEQ ID NO: 4260948 - DNA, 21 bp, Homo sapiens
atcaaataaaaattctagatt

SEQ ID NO: 4260949 - DNA, 20 bp, Homo sapiens
atcaacagtgaacagcttca

SEQ ID NO: 4260950 - DNA, 15 bp, Homo sapiens
atcaagagagacaaa

SEQ ID NO: 4260951 - DNA, 22 bp, Homo sapiens
atcaagtcccgaggcagcaaca

SEQ ID NO: 4260952 - DNA, 23 bp, Homo sapiens
atcaagtcccgaggcagcaacag

SEQ ID NO: 4260953 - DNA, 13 bp, Homo sapiens
atcaagtctgtga

SEQ ID NO: 4260954 - DNA, 19 bp, Homo sapiens
atcaagtgcatttctgggc

SEQ ID NO: 4260955 - DNA, 21 bp, Homo sapiens
atcaatggcgcagtgcctctg

SEQ ID NO: 4260956 - DNA, 23 bp, Homo sapiens
atcaatggcgcagtgcctctggt

SEQ ID NO: 4260957 - DNA, 23 bp, Homo sapiens
atcaatgttcacgcaacttgaaa

SEQ ID NO: 4260958 - DNA, 12 bp, Homo sapiens
atcacaactttt

SEQ ID NO: 4260959 - DNA, 16 bp, Homo sapiens
atcacaacttttctgc

SEQ ID NO: 4260960 - DNA, 19 bp, Homo sapiens
atcacaacttttctgctac

SEQ ID NO: 4260961 - DNA, 19 bp, Homo sapiens
atcacgagatcttccttcc

SEQ ID NO: 4260962 - DNA, 22 bp, Homo sapiens
atcactaataaagtctgtctgc

SEQ ID NO: 4260963 - DNA, 15 bp, Homo sapiens
atcagaatccccgaa

SEQ ID NO: 4260964 - DNA, 20 bp, Homo sapiens
atcagacagtggatgagaca

SEQ ID NO: 4260965 - DNA, 12 bp, Homo sapiens
atcagcagtgat

SEQ ID NO: 4260966 - DNA, 15 bp, Homo sapiens
atcagcagtgattga

SEQ ID NO: 4260967 - DNA, 16 bp, Homo sapiens
atcagcattcaaaata

SEQ ID NO: 4260968 - DNA, 13 bp, Homo sapiens
atcagcccctgct

SEQ ID NO: 4260969 - DNA, 14 bp, Homo sapiens
atcagcccctgctg

SEQ ID NO: 4260970 - DNA, 24 bp, Homo sapiens
atcagccctgcccttcagcatcct

SEQ ID NO: 4260971 - DNA, 20 bp, Homo sapiens
atcagcctaggggtcaggga

SEQ ID NO: 4260972 - DNA, 20 bp, Homo sapiens
atcagggagcactggaggcc

SEQ ID NO: 4260973 - DNA, 21 bp, Homo sapiens
atcagtcctagaatgtttcat

SEQ ID NO: 4260974 - DNA, 23 bp, Homo sapiens
atcagtcctagaatgtttcattt

SEQ ID NO: 4260975 - DNA, 19 bp, Homo sapiens
atcataaaaggtgaccctt

SEQ ID NO: 4260976 - DNA, 19 bp, Homo sapiens
atcatatataataaattaa

SEQ ID NO: 4260977 - DNA, 19 bp, Homo sapiens
atcatgcacacaattagat

SEQ ID NO: 4260978 - DNA, 12 bp, Homo sapiens
atcatgtaatag

SEQ ID NO: 4260979 - DNA, 13 bp, Homo sapiens
atcatgtaatagt

SEQ ID NO: 4260980 - DNA, 13 bp, Homo sapiens
atcatgtgtttct

SEQ ID NO: 4260981 - DNA, 15 bp, Homo sapiens
atcatgtgtttctgt

SEQ ID NO: 4260982 - DNA, 20 bp, Homo sapiens
atcattggtatctgatatct

SEQ ID NO: 4260983 - DNA, 22 bp, Homo sapiens
atcattggtatctgatatctgt

SEQ ID NO: 4260984 - DNA, 19 bp, Homo sapiens
atcatttcttgggccctcc

SEQ ID NO: 4260985 - DNA, 15 bp, Homo sapiens
atcattttcctggga

SEQ ID NO: 4260986 - DNA, 13 bp, Homo sapiens
atccaactccagg

SEQ ID NO: 4260987 - DNA, 19 bp, Homo sapiens
atccactaggtgcccagtc

SEQ ID NO: 4260988 - DNA, 21 bp, Homo sapiens
atccagaactgtcttagtcat

SEQ ID NO: 4260989 - DNA, 20 bp, Homo sapiens
atccagagagaagcacccca

SEQ ID NO: 4260990 - DNA, 21 bp, Homo sapiens
atccagaggtgagggaggcct

SEQ ID NO: 4260991 - DNA, 23 bp, Homo sapiens
atccagaggtgagggaggcctga

SEQ ID NO: 4260992 - DNA, 16 bp, Homo sapiens
atccagatagcctagg

SEQ ID NO: 4260993 - DNA, 14 bp, Homo sapiens
atccagccaggggt

SEQ ID NO: 4260994 - DNA, 21 bp, Homo sapiens
atccagccgcaaatccatacc

SEQ ID NO: 4260995 - DNA, 22 bp, Homo sapiens
atccagccgcaaatccataccc

SEQ ID NO: 4260996 - DNA, 21 bp, Homo sapiens
atccataccccctgccccaga

SEQ ID NO: 4260997 - DNA, 19 bp, Homo sapiens
atccatgtgctgctgtggc

SEQ ID NO: 4260998 - DNA, 15 bp, Homo sapiens
atccattccagagct

SEQ ID NO: 4260999 - DNA, 19 bp, Homo sapiens
atccattccagagctgcag

SEQ ID NO: 4261000 - DNA, 20 bp, Homo sapiens
atccattttctaaactgttt

SEQ ID NO: 4261001 - DNA, 22 bp, Homo sapiens
atcccctcgcttcataggcaga

SEQ ID NO: 4261002 - DNA, 23 bp, Homo sapiens
atcccctcgcttcataggcagag

SEQ ID NO: 4261003 - DNA, 14 bp, Homo sapiens
atcccggggccatg

SEQ ID NO: 4261004 - DNA, 19 bp, Homo sapiens
atccctggacgcatgcagg

SEQ ID NO: 4261005 - DNA, 18 bp, Homo sapiens
atccctggtgaaagagta

SEQ ID NO: 4261006 - DNA, 13 bp, Homo sapiens
atcccttggcccc

SEQ ID NO: 4261007 - DNA, 14 bp, Homo sapiens
atcccttggcccct

SEQ ID NO: 4261008 - DNA, 17 bp, Homo sapiens
atcccttggcccctctc

SEQ ID NO: 4261009 - DNA, 22 bp, Homo sapiens
atccctttctaagcaggaaggt

SEQ ID NO: 4261010 - DNA, 13 bp, Homo sapiens
atccgagcgacgg

SEQ ID NO: 4261011 - DNA, 18 bp, Homo sapiens
atccgagcgacggctcct

SEQ ID NO: 4261012 - DNA, 21 bp, Homo sapiens
atccgagcgacggctcctccc

SEQ ID NO: 4261013 - DNA, 18 bp, Homo sapiens
atccgccctgggctctgg

SEQ ID NO: 4261014 - DNA, 20 bp, Homo sapiens
atccggcccccagagcgccc

SEQ ID NO: 4261015 - DNA, 12 bp, Homo sapiens
atcctcagcaag

SEQ ID NO: 4261016 - DNA, 19 bp, Homo sapiens
atcctccccttccctgcaa

SEQ ID NO: 4261017 - DNA, 19 bp, Homo sapiens
atcctcctggacccagcag

SEQ ID NO: 4261018 - DNA, 23 bp, Homo sapiens
atcctgggcatccccagccccct

SEQ ID NO: 4261019 - DNA, 20 bp, Homo sapiens
atcctgggcatgtccccagt

SEQ ID NO: 4261020 - DNA, 17 bp, Homo sapiens
atcctgtacaagtgctc

SEQ ID NO: 4261021 - DNA, 20 bp, Homo sapiens
atcctgtgtgattacagcat

SEQ ID NO: 4261022 - DNA, 20 bp, Homo sapiens
atccttaagaattccatcta

SEQ ID NO: 4261023 - DNA, 18 bp, Homo sapiens
atccttttatctcacaaa

SEQ ID NO: 4261024 - DNA, 17 bp, Homo sapiens
atcgctgccttgccatg

SEQ ID NO: 4261025 - DNA, 16 bp, Homo sapiens
atctaaaaaataactg

SEQ ID NO: 4261026 - DNA, 22 bp, Homo sapiens
atctaatcccttcaaggaagtg

SEQ ID NO: 4261027 - DNA, 14 bp, Homo sapiens
atctactagaacct

SEQ ID NO: 4261028 - DNA, 19 bp, Homo sapiens
atctactagaaccttctaa

SEQ ID NO: 4261029 - DNA, 15 bp, Homo sapiens
atctagcaagaagat

SEQ ID NO: 4261030 - DNA, 19 bp, Homo sapiens
atctagcaagaagattcta

SEQ ID NO: 4261031 - DNA, 17 bp, Homo sapiens
atctagccaggcctccc

SEQ ID NO: 4261032 - DNA, 19 bp, Homo sapiens
atctatctggtgatttcta

SEQ ID NO: 4261033 - DNA, 23 bp, Homo sapiens
atctatctggtgatttctagctc

SEQ ID NO: 4261034 - DNA, 18 bp, Homo sapiens
atctatgcattttctgga

SEQ ID NO: 4261035 - DNA, 16 bp, Homo sapiens
atctcacaaataagta

SEQ ID NO: 4261036 - DNA, 11 bp, Homo sapiens
atctcagccca

SEQ ID NO: 4261037 - DNA, 15 bp, Homo sapiens
atctcaggccacctg

SEQ ID NO: 4261038 - DNA, 22 bp, Homo sapiens
atctcattgcaaaaatatttta

SEQ ID NO: 4261039 - DNA, 12 bp, Homo sapiens
atctccaggccc

SEQ ID NO: 4261040 - DNA, 22 bp, Homo sapiens
atctccaggcccagcctggccc

SEQ ID NO: 4261041 - DNA, 19 bp, Homo sapiens
atctcctgtaattttgtag

SEQ ID NO: 4261042 - DNA, 17 bp, Homo sapiens
atctcgaagtcttccat

SEQ ID NO: 4261043 - DNA, 13 bp, Homo sapiens
atctcgctagcca

SEQ ID NO: 4261044 - DNA, 17 bp, Homo sapiens
atctctaaaattctagt

SEQ ID NO: 4261045 - DNA, 18 bp, Homo sapiens
atctctaaaattctagtc

SEQ ID NO: 4261046 - DNA, 16 bp, Homo sapiens
atctctactttcctga

SEQ ID NO: 4261047 - DNA, 23 bp, Homo sapiens
atctctgactttctttagtcttt

SEQ ID NO: 4261048 - DNA, 15 bp, Homo sapiens
atctctgattaaatt

SEQ ID NO: 4261049 - DNA, 22 bp, Homo sapiens
atctctgtgactcgcttagctg

SEQ ID NO: 4261050 - DNA, 23 bp, Homo sapiens
atctcttaagacagcatgtgtta

SEQ ID NO: 4261051 - DNA, 15 bp, Homo sapiens
atctcttcttataca

SEQ ID NO: 4261052 - DNA, 15 bp, Homo sapiens
atctgaaaactggaa

SEQ ID NO: 4261053 - DNA, 18 bp, Homo sapiens
atctgagaaaagctttga

SEQ ID NO: 4261054 - DNA, 23 bp, Homo sapiens
atctgcaaatagtttcaaatgag

SEQ ID NO: 4261055 - DNA, 20 bp, Homo sapiens
atctgctgacagatgttcca

SEQ ID NO: 4261056 - DNA, 22 bp, Homo sapiens
atggaggaaaaccaagccgtgg

SEQ ID NO: 4261057 - DNA, 17 bp, Homo sapiens
atggaggagagtgttta

SEQ ID NO: 4261058 - DNA, 13 bp, Homo sapiens
atggaggcgcctt

SEQ ID NO: 4261059 - DNA, 15 bp, Homo sapiens
atggaggcgccttcc

SEQ ID NO: 4261060 - DNA, 21 bp, Homo sapiens
atggaggcgccttcctgggtt

SEQ ID NO: 4261061 - DNA, 20 bp, Homo sapiens
atggagtccagacctgggcc

SEQ ID NO: 4261062 - DNA, 13 bp, Homo sapiens
atggccaggcctc

SEQ ID NO: 4261063 - DNA, 22 bp, Homo sapiens
atggccaggtggccactccaga

SEQ ID NO: 4261064 - DNA, 23 bp, Homo sapiens
atggccgttgcctctctgccagc

SEQ ID NO: 4261065 - DNA, 14 bp, Homo sapiens
atggcctcccagcc

SEQ ID NO: 4261066 - DNA, 13 bp, Homo sapiens
atggcgcacccgg

SEQ ID NO: 4261067 - DNA, 22 bp, Homo sapiens
atggcgcacccggcagcccccc

SEQ ID NO: 4261068 - DNA, 17 bp, Homo sapiens
atggcgcagtgcctctg

SEQ ID NO: 4261069 - DNA, 18 bp, Homo sapiens
atggcgcagtgcctctgg

SEQ ID NO: 4261070 - DNA, 22 bp, Homo sapiens
atggctattaacaattaattgt

SEQ ID NO: 4261071 - DNA, 20 bp, Homo sapiens
atggctccagtctgctgccc

SEQ ID NO: 4261072 - DNA, 18 bp, Homo sapiens
atggctccctgggctggc

SEQ ID NO: 4261073 - DNA, 13 bp, Homo sapiens
atggctctggcta

SEQ ID NO: 4261074 - DNA, 12 bp, Homo sapiens
atggctgtattt

SEQ ID NO: 4261075 - DNA, 16 bp, Homo sapiens
atggctgtatttttag

SEQ ID NO: 4261076 - DNA, 18 bp, Homo sapiens
atgggagtaagagcaaat

SEQ ID NO: 4261077 - DNA, 14 bp, Homo sapiens
atgggccaagccag

SEQ ID NO: 4261078 - DNA, 23 bp, Homo sapiens
atgggccaagccagggttccaga

SEQ ID NO: 4261079 - DNA, 14 bp, Homo sapiens
atggggaggggaga

SEQ ID NO: 4261080 - DNA, 16 bp, Homo sapiens
atggggaggggagaga

SEQ ID NO: 4261081 - DNA, 22 bp, Homo sapiens
atggggaggggagagaaggtgg

SEQ ID NO: 4261082 - DNA, 22 bp, Homo sapiens
atgggggctccagacattgtat

SEQ ID NO: 4261083 - DNA, 16 bp, Homo sapiens
atggggggccaacacc

SEQ ID NO: 4261084 - DNA, 16 bp, Homo sapiens
atggggtgggcctctg

SEQ ID NO: 4261085 - DNA, 18 bp, Homo sapiens
atggggtgggcctctggt

SEQ ID NO: 4261086 - DNA, 18 bp, Homo sapiens
atggggttgggctctgcg

SEQ ID NO: 4261087 - DNA, 24 bp, Homo sapiens
atggggttgggctctgcgtcccac

SEQ ID NO: 4261088 - DNA, 13 bp, Homo sapiens
atggtagaaaaat

SEQ ID NO: 4261089 - DNA, 13 bp, Homo sapiens
atggtatctcttt

SEQ ID NO: 4261090 - DNA, 16 bp, Homo sapiens
atggtgaactgtcatt

SEQ ID NO: 4261091 - DNA, 19 bp, Homo sapiens
atggtgagaattaaaataa

SEQ ID NO: 4261092 - DNA, 13 bp, Homo sapiens
atggtgcagtgaa

SEQ ID NO: 4261093 - DNA, 21 bp, Homo sapiens
atggtgctgcacccctggtgt

SEQ ID NO: 4261094 - DNA, 23 bp, Homo sapiens
atggtgctgcacccctggtgtcc

SEQ ID NO: 4261095 - DNA, 16 bp, Homo sapiens
atggtgctgggtcctt

SEQ ID NO: 4261096 - DNA, 16 bp, Homo sapiens
atggtgggctccagag

SEQ ID NO: 4261097 - DNA, 19 bp, Homo sapiens
atggtgggctccagagtag

SEQ ID NO: 4261098 - DNA, 20 bp, Homo sapiens
atggtgggctccagagtagg

SEQ ID NO: 4261099 - DNA, 19 bp, Homo sapiens
atggtggtttcagaaaggg

SEQ ID NO: 4261100 - DNA, 16 bp, Homo sapiens
atgtaatagtggcttt

SEQ ID NO: 4261101 - DNA, 16 bp, Homo sapiens
atgtaatcatttatct

SEQ ID NO: 4261102 - DNA, 12 bp, Homo sapiens
atgtagaactgt

SEQ ID NO: 4261103 - DNA, 21 bp, Homo sapiens
atgtagaactgttcatttcca

SEQ ID NO: 4261104 - DNA, 20 bp, Homo sapiens
atgtagaagagggagaagga

SEQ ID NO: 4261105 - DNA, 20 bp, Homo sapiens
atgtagcttcagtcattaaa

SEQ ID NO: 4261106 - DNA, 15 bp, Homo sapiens
atgtatatcagggtt

SEQ ID NO: 4261107 - DNA, 13 bp, Homo sapiens
atgtatcttattt

SEQ ID NO: 4261108 - DNA, 16 bp, Homo sapiens
atgtatcttatttata

SEQ ID NO: 4261109 - DNA, 15 bp, Homo sapiens
atgtatgtggaagca

SEQ ID NO: 4261110 - DNA, 12 bp, Homo sapiens
atgtattatgca

SEQ ID NO: 4261111 - DNA, 20 bp, Homo sapiens
atgtattatgtcctgtgaga

SEQ ID NO: 4261112 - DNA, 13 bp, Homo sapiens
atgtatttgtagt

SEQ ID NO: 4261113 - DNA, 18 bp, Homo sapiens
atgtcaagattcagctag

SEQ ID NO: 4261114 - DNA, 18 bp, Homo sapiens
atgtcaagctggccgtgg

SEQ ID NO: 4261115 - DNA, 16 bp, Homo sapiens
atgtcagtagtgcctg

SEQ ID NO: 4261116 - DNA, 17 bp, Homo sapiens
atgtcagtagtgcctgt

SEQ ID NO: 4261117 - DNA, 18 bp, Homo sapiens
atgtcatttcatttccta

SEQ ID NO: 4261118 - DNA, 19 bp, Homo sapiens
atgtccaagcatcagcaag

SEQ ID NO: 4261119 - DNA, 22 bp, Homo sapiens
atgtccaagcatcagcaagaca

SEQ ID NO: 4261120 - DNA, 16 bp, Homo sapiens
atgtccatgaaaaaca

SEQ ID NO: 4261121 - DNA, 16 bp, Homo sapiens
atgtcctattactgat

SEQ ID NO: 4261122 - DNA, 20 bp, Homo sapiens
atgtcctgtgagatgtgtat

SEQ ID NO: 4261123 - DNA, 12 bp, Homo sapiens
atgtctactgct

SEQ ID NO: 4261124 - DNA, 18 bp, Homo sapiens
atgtctgggtcgtctttt

SEQ ID NO: 4261125 - DNA, 10 bp, Homo sapiens
atgtctgtga

SEQ ID NO: 4261126 - DNA, 11 bp, Homo sapiens
atgtctgtgat

SEQ ID NO: 4261127 - DNA, 16 bp, Homo sapiens
atgtcttgagatgtat

SEQ ID NO: 4261128 - DNA, 14 bp, Homo sapiens
atgtgaaaggatat

SEQ ID NO: 4261129 - DNA, 18 bp, Homo sapiens
atgtgaaaggatatgaat

SEQ ID NO: 4261130 - DNA, 20 bp, Homo sapiens
catgtctttggcttcagaat

SEQ ID NO: 4261131 - DNA, 22 bp, Homo sapiens
catgtctttggcttcagaattg

SEQ ID NO: 4261132 - DNA, 21 bp, Homo sapiens
catgtgattggcagcttcaaa

SEQ ID NO: 4261133 - DNA, 15 bp, Homo sapiens
catgtgctgctgtgg

SEQ ID NO: 4261134 - DNA, 13 bp, Homo sapiens
catgtgctgtgca

SEQ ID NO: 4261135 - DNA, 20 bp, Homo sapiens
catgtgctgtgcacccgtgc

SEQ ID NO: 4261136 - DNA, 21 bp, Homo sapiens
catgtgctgtgcacccgtgcc

SEQ ID NO: 4261137 - DNA, 17 bp, Homo sapiens
catgtgtaacttctaga

SEQ ID NO: 4261138 - DNA, 15 bp, Homo sapiens
catgtgtaggaagag

SEQ ID NO: 4261139 - DNA, 20 bp, Homo sapiens
catgtgtaggaagaggccgc

SEQ ID NO: 4261140 - DNA, 21 bp, Homo sapiens
catgtgtcagctgtagaaagg

SEQ ID NO: 4261141 - DNA, 14 bp, Homo sapiens
catgtgtcgcctct

SEQ ID NO: 4261142 - DNA, 15 bp, Homo sapiens
catgtgttaatctta

SEQ ID NO: 4261143 - DNA, 22 bp, Homo sapiens
catgttaaagaggcgtcttgta

SEQ ID NO: 4261144 - DNA, 18 bp, Homo sapiens
cattaaaagaagactgga

SEQ ID NO: 4261145 - DNA, 12 bp, Homo sapiens
cattaaagtgca

SEQ ID NO: 4261146 - DNA, 17 bp, Homo sapiens
cattaatccacatgttt

SEQ ID NO: 4261147 - DNA, 19 bp, Homo sapiens
cattaatccacatgtttca

SEQ ID NO: 4261148 - DNA, 14 bp, Homo sapiens
cattaatgaaatac

SEQ ID NO: 4261149 - DNA, 20 bp, Homo sapiens
cattagactgaatttaacta

SEQ ID NO: 4261150 - DNA, 18 bp, Homo sapiens
cattagcagtttgctttg

SEQ ID NO: 4261151 - DNA, 19 bp, Homo sapiens
cattatagattttcatgtt

SEQ ID NO: 4261152 - DNA, 23 bp, Homo sapiens
cattatccttttatctcacaaat

SEQ ID NO: 4261153 - DNA, 16 bp, Homo sapiens
cattatggctttgtgc

SEQ ID NO: 4261154 - DNA, 17 bp, Homo sapiens
cattatggctttgtgct

SEQ ID NO: 4261155 - DNA, 19 bp, Homo sapiens
cattattaaatcagaatct

SEQ ID NO: 4261156 - DNA, 13 bp, Homo sapiens
cattcaaaatagt

SEQ ID NO: 4261157 - DNA, 20 bp, Homo sapiens
cattcaaaatagttctattt

SEQ ID NO: 4261158 - DNA, 22 bp, Homo sapiens
cattcatacttaaaaatttatt

SEQ ID NO: 4261159 - DNA, 18 bp, Homo sapiens
cattctatctactgattt

SEQ ID NO: 4261160 - DNA, 12 bp, Homo sapiens
cattctccccag

SEQ ID NO: 4261161 - DNA, 22 bp, Homo sapiens
cattctccccagtgtatgtctt

SEQ ID NO: 4261162 - DNA, 17 bp, Homo sapiens
cattctgctgcccccag

SEQ ID NO: 4261163 - DNA, 12 bp, Homo sapiens
cattctggctcc

SEQ ID NO: 4261164 - DNA, 15 bp, Homo sapiens
cattcttattttaga

SEQ ID NO: 4261165 - DNA, 13 bp, Homo sapiens
cattgaaataata

SEQ ID NO: 4261166 - DNA, 18 bp, Homo sapiens
cattgcaaaaatatttta

SEQ ID NO: 4261167 - DNA, 16 bp, Homo sapiens
cattgcaaaaggttaa

SEQ ID NO: 4261168 - DNA, 21 bp, Homo sapiens
cattgcaaaaggttaagccat

SEQ ID NO: 4261169 - DNA, 22 bp, Homo sapiens
cattgcaaaaggttaagccata

SEQ ID NO: 4261170 - DNA, 21 bp, Homo sapiens
cattgccgtggcatcttaaaa

SEQ ID NO: 4261171 - DNA, 19 bp, Homo sapiens
cattgtccccaatgaatat

SEQ ID NO: 4261172 - DNA, 16 bp, Homo sapiens
cattgtgcattctaga

SEQ ID NO: 4261173 - DNA, 18 bp, Homo sapiens
catttaaaatagttttct

SEQ ID NO: 4261174 - DNA, 23 bp, Homo sapiens
catttaaaatagttttctaaatg

SEQ ID NO: 4261175 - DNA, 21 bp, Homo sapiens
catttagcattgaaataataa

SEQ ID NO: 4261176 - DNA, 16 bp, Homo sapiens
catttagtcctcacct

SEQ ID NO: 4261177 - DNA, 15 bp, Homo sapiens
catttatcttatcta

SEQ ID NO: 4261178 - DNA, 20 bp, Homo sapiens
catttcttattaaccaaatt

SEQ ID NO: 4261179 - DNA, 12 bp, Homo sapiens
catttcttgggc

SEQ ID NO: 4261180 - DNA, 17 bp, Homo sapiens
catttcttgggccctcc

SEQ ID NO: 4261181 - DNA, 13 bp, Homo sapiens
catttgagtgtct

SEQ ID NO: 4261182 - DNA, 18 bp, Homo sapiens
catttgggagactgagct

SEQ ID NO: 4261183 - DNA, 13 bp, Homo sapiens
catttgtaggtag

SEQ ID NO: 4261184 - DNA, 16 bp, Homo sapiens
catttgttaatatcac

SEQ ID NO: 4261185 - DNA, 16 bp, Homo sapiens
cattttactgtctgta

SEQ ID NO: 4261186 - DNA, 15 bp, Homo sapiens
cattttctaaactgt

SEQ ID NO: 4261187 - DNA, 17 bp, Homo sapiens
cattttctaaactgttt

SEQ ID NO: 4261188 - DNA, 18 bp, Homo sapiens
cattttctaaactgtttt

SEQ ID NO: 4261189 - DNA, 15 bp, Homo sapiens
cattttgcgatgtgt

SEQ ID NO: 4261190 - DNA, 16 bp, Homo sapiens
cattttgcgatgtgtt

SEQ ID NO: 4261191 - DNA, 15 bp, Homo sapiens
cattttgtctggctg

SEQ ID NO: 4261192 - DNA, 14 bp, Homo sapiens
catttttcttggat

SEQ ID NO: 4261193 - DNA, 19 bp, Homo sapiens
ccaaaaaatgtgagctata

SEQ ID NO: 4261194 - DNA, 15 bp, Homo sapiens
ccaaaacccatcgtg

SEQ ID NO: 4261195 - DNA, 16 bp, Homo sapiens
ccaaaagctgctttcc

SEQ ID NO: 4261196 - DNA, 16 bp, Homo sapiens
ccaaacattcttattt

SEQ ID NO: 4261197 - DNA, 14 bp, Homo sapiens
ccaaaccaggggga

SEQ ID NO: 4261198 - DNA, 18 bp, Homo sapiens
ccaaaccagggggaagca

SEQ ID NO: 4261199 - DNA, 14 bp, Homo sapiens
ccaaactgtagtaa

SEQ ID NO: 4261200 - DNA, 16 bp, Homo sapiens
ccaaagagaaaagatt

SEQ ID NO: 4261201 - DNA, 13 bp, Homo sapiens
ccaaagaggcatt

SEQ ID NO: 4261202 - DNA, 17 bp, Homo sapiens
ccaaagaggcattcagc

SEQ ID NO: 4261203 - DNA, 19 bp, Homo sapiens
ccaaagaggcattcagcaa

SEQ ID NO: 4261204 - DNA, 16 bp, Homo sapiens
ccaaagagtcatcatg

SEQ ID NO: 4261205 - DNA, 20 bp, Homo sapiens
ccaaagcaagcacctgggtg

SEQ ID NO: 4261206 - DNA, 22 bp, Homo sapiens
ccaaatcctgggcatccccagc

SEQ ID NO: 4261207 - DNA, 23 bp, Homo sapiens
ccaaattaacctttcaggaaagt

SEQ ID NO: 4261208 - DNA, 19 bp, Homo sapiens
ccaaattttccttcctgtt

SEQ ID NO: 4261209 - DNA, 13 bp, Homo sapiens
ccaacaccaggga

SEQ ID NO: 4261210 - DNA, 15 bp, Homo sapiens
ccaacatttcctcag

SEQ ID NO: 4261211 - DNA, 23 bp, Homo sapiens
ccaaccacctctggccctgttgt

SEQ ID NO: 4261212 - DNA, 15 bp, Homo sapiens
ccaaccccggggcat

SEQ ID NO: 4261213 - DNA, 15 bp, Homo sapiens
ccaacccctgtggag

SEQ ID NO: 4261214 - DNA, 17 bp, Homo sapiens
ccaacctcactgccctc

SEQ ID NO: 4261215 - DNA, 15 bp, Homo sapiens
ccaacgaaaagcaca

SEQ ID NO: 4261216 - DNA, 12 bp, Homo sapiens
ccaactccaggg

SEQ ID NO: 4261217 - DNA, 12 bp, Homo sapiens
ccaactctctct

SEQ ID NO: 4261218 - DNA, 18 bp, Homo sapiens
ccaagaaaggaaaccttt

SEQ ID NO: 4261219 - DNA, 21 bp, Homo sapiens
ccaagatgtcaagctggccgt

SEQ ID NO: 4261220 - DNA, 16 bp, Homo sapiens
ccaagcatcagcaaga

SEQ ID NO: 4261221 - DNA, 18 bp, Homo sapiens
ccaagccagggttccaga

SEQ ID NO: 4261222 - DNA, 16 bp, Homo sapiens
ccaagcctgggccact

SEQ ID NO: 4261223 - DNA, 11 bp, Homo sapiens
ccaaggactgc

SEQ ID NO: 4261224 - DNA, 16 bp, Homo sapiens
ccaaggcaaatgtcca

SEQ ID NO: 4261225 - DNA, 17 bp, Homo sapiens
ccaaggcctatgccacc

SEQ ID NO: 4261226 - DNA, 20 bp, Homo sapiens
ccaaggcctatgccacctgc

SEQ ID NO: 4261227 - DNA, 13 bp, Homo sapiens
ccaaggctgcctg

SEQ ID NO: 4261228 - DNA, 15 bp, Homo sapiens
ccaagggcccagagg

SEQ ID NO: 4261229 - DNA, 19 bp, Homo sapiens
ccaaggggtctgctcctgt

SEQ ID NO: 4261230 - DNA, 20 bp, Homo sapiens
ccaaggggtctgctcctgtg

SEQ ID NO: 4261231 - DNA, 23 bp, Homo sapiens
ccaaggggtctgctcctgtggcg

SEQ ID NO: 4261232 - DNA, 16 bp, Homo sapiens
ccaaggtggtcttgga

SEQ ID NO: 4261233 - DNA, 20 bp, Homo sapiens
ccaatcaacagcatgtctac

SEQ ID NO: 4261234 - DNA, 20 bp, Homo sapiens
ccaatcacgagatcttcctt

SEQ ID NO: 4261235 - DNA, 13 bp, Homo sapiens
ccaatcactgcct

SEQ ID NO: 4261236 - DNA, 21 bp, Homo sapiens
ccaatccaacccatgcatggc

SEQ ID NO: 4261237 - DNA, 11 bp, Homo sapiens
ccaatctctgt

SEQ ID NO: 4261238 - DNA, 18 bp, Homo sapiens
ccaatgtgcccagtcatg

SEQ ID NO: 4261239 - DNA, 10 bp, Homo sapiens
ccaatttctc

SEQ ID NO: 4261240 - DNA, 20 bp, Homo sapiens
ccaattttaaaaaataacat

SEQ ID NO: 4261241 - DNA, 13 bp, Homo sapiens
ccacaaatgtcct

SEQ ID NO: 4261242 - DNA, 17 bp, Homo sapiens
ccacaaatgtcctcaga

SEQ ID NO: 4261243 - DNA, 19 bp, Homo sapiens
ccacaaggctgaaaagtgc

SEQ ID NO: 4261244 - DNA, 21 bp, Homo sapiens
ccacaaggctgaaaagtgctt

SEQ ID NO: 4261245 - DNA, 23 bp, Homo sapiens
ccacaaggctgaaaagtgctttg

SEQ ID NO: 4261246 - DNA, 20 bp, Homo sapiens
ccacaagggtgcccacctct

SEQ ID NO: 4261247 - DNA, 13 bp, Homo sapiens
ccacaattctttt

SEQ ID NO: 4261248 - DNA, 13 bp, Homo sapiens
ccacacaggcctg

SEQ ID NO: 4261249 - DNA, 22 bp, Homo sapiens
ccacacaggcctggcccagcca

SEQ ID NO: 4261250 - DNA, 20 bp, Homo sapiens
ccacacttcaggctcttctc

SEQ ID NO: 4261251 - DNA, 22 bp, Homo sapiens
ccacacttcaggctcttctcct

SEQ ID NO: 4261252 - DNA, 13 bp, Homo sapiens
ccacacttcctgt

SEQ ID NO: 4261253 - DNA, 18 bp, Homo sapiens
ccacacttcctgtccaga

SEQ ID NO: 4261254 - DNA, 12 bp, Homo sapiens
ccacagcaggtg

SEQ ID NO: 4261255 - DNA, 23 bp, Homo sapiens
ccacagccctgtcagtgcagccc

SEQ ID NO: 4261256 - DNA, 22 bp, Homo sapiens
ccacaggcccttcctctccact

SEQ ID NO: 4261257 - DNA, 23 bp, Homo sapiens
ccacaggcccttcctctccactg

SEQ ID NO: 4261258 - DNA, 23 bp, Homo sapiens
ccacagtatattttatttcaatg

SEQ ID NO: 4261259 - DNA, 22 bp, Homo sapiens
ccacatagtgatggttcccctg

SEQ ID NO: 4261260 - DNA, 16 bp, Homo sapiens
ccacattctgctgccc

SEQ ID NO: 4261261 - DNA, 16 bp, Homo sapiens
ccacattctggctcca

SEQ ID NO: 4261262 - DNA, 23 bp, Homo sapiens
ccacattgcataagtggacccag

SEQ ID NO: 4261263 - DNA, 16 bp, Homo sapiens
ccaccaactctctctg

SEQ ID NO: 4261264 - DNA, 17 bp, Homo sapiens
ccaccaactctctctgc

SEQ ID NO: 4261265 - DNA, 18 bp, Homo sapiens
ccaccaactctctctgcc

SEQ ID NO: 4261266 - DNA, 20 bp, Homo sapiens
ccaccaactctctctgcccc

SEQ ID NO: 4261267 - DNA, 13 bp, Homo sapiens
ccaccaaggctgc

SEQ ID NO: 4261268 - DNA, 16 bp, Homo sapiens
ccaccaaggctgcctg

SEQ ID NO: 4261269 - DNA, 17 bp, Homo sapiens
ccaccaaggctgcctgc

SEQ ID NO: 4261270 - DNA, 16 bp, Homo sapiens
ccaccacacacaccct

SEQ ID NO: 4261271 - DNA, 22 bp, Homo sapiens
ccaccacacacacccttcccca

SEQ ID NO: 4261272 - DNA, 22 bp, Homo sapiens
ccaccagagcctccctcagcca

SEQ ID NO: 4261273 - DNA, 13 bp, Homo sapiens
ccacccaccctct

SEQ ID NO: 4261274 - DNA, 14 bp, Homo sapiens
ccacccccagctcc

SEQ ID NO: 4261275 - DNA, 17 bp, Homo sapiens
ccacccccgggtgcctg

SEQ ID NO: 4261276 - DNA, 13 bp, Homo sapiens
ccaccccctgctg

SEQ ID NO: 4261277 - DNA, 18 bp, Homo sapiens
ccaccccctgctggtgcc

SEQ ID NO: 4261278 - DNA, 16 bp, Homo sapiens
ccaccccgcctctggg

SEQ ID NO: 4261279 - DNA, 22 bp, Homo sapiens
ccaccccgcctctgggctcaca

SEQ ID NO: 4261280 - DNA, 20 bp, Homo sapiens
ccaccccgttgttgtccctg

SEQ ID NO: 4261281 - DNA, 22 bp, Homo sapiens
ccaccccgttgttgtccctgca

SEQ ID NO: 4261282 - DNA, 18 bp, Homo sapiens
ccacccctcaagccagga

SEQ ID NO: 4261283 - DNA, 16 bp, Homo sapiens
ccacccctcttccccc

SEQ ID NO: 4261284 - DNA, 13 bp, Homo sapiens
ccaccccttcccc

SEQ ID NO: 4261285 - DNA, 16 bp, Homo sapiens
ccaccccttcccgccc

SEQ ID NO: 4261286 - DNA, 18 bp, Homo sapiens
ccacccggatctccaggc

SEQ ID NO: 4261287 - DNA, 20 bp, Homo sapiens
ccacccggatctccaggccc

SEQ ID NO: 4261288 - DNA, 21 bp, Homo sapiens
ccacccggatctccaggccca

SEQ ID NO: 4261289 - DNA, 22 bp, Homo sapiens
ccacccggatctccaggcccag

SEQ ID NO: 4261290 - DNA, 15 bp, Homo sapiens
ccacccgtggagatg

SEQ ID NO: 4261291 - DNA, 20 bp, Homo sapiens
ccacccgtttccaagcctgg

SEQ ID NO: 4261292 - DNA, 23 bp, Homo sapiens
ccacccgtttccaagcctgggcc

SEQ ID NO: 4261293 - DNA, 21 bp, Homo sapiens
ccaccctctgcagggcagcct

SEQ ID NO: 4261294 - DNA, 15 bp, Homo sapiens
ccaccctgccatgga

SEQ ID NO: 4261295 - DNA, 15 bp, Homo sapiens
ccaccctttgggggg

SEQ ID NO: 4261296 - DNA, 21 bp, Homo sapiens
ccaccgctccccagcccaggg

SEQ ID NO: 4261297 - DNA, 11 bp, Homo sapiens
ccacctcaggg

SEQ ID NO: 4261298 - DNA, 13 bp, Homo sapiens
ccacctcagggga

SEQ ID NO: 4261299 - DNA, 20 bp, Homo sapiens
ccacctgaagtgatgatgga

SEQ ID NO: 4261300 - DNA, 21 bp, Homo sapiens
ccacctgcagccccaggcctc

SEQ ID NO: 4261301 - DNA, 21 bp, Homo sapiens
ccacctgcccccttctcccac

SEQ ID NO: 4261302 - DNA, 23 bp, Homo sapiens
ccacctgcccccttctcccacac

SEQ ID NO: 4261303 - DNA, 15 bp, Homo sapiens
ccacctgctgcccgt

SEQ ID NO: 4261304 - DNA, 20 bp, Homo sapiens
ccacctggatggatctgctc

SEQ ID NO: 4261305 - DNA, 14 bp, Homo sapiens
ccacgccctcctcc

SEQ ID NO: 4261306 - DNA, 15 bp, Homo sapiens
ccacgcgctctgcat

SEQ ID NO: 4261307 - DNA, 19 bp, Homo sapiens
ccacgctgtctccagaccc

SEQ ID NO: 4261308 - DNA, 20 bp, Homo sapiens
ccacgctgtctccagacccc

SEQ ID NO: 4261309 - DNA, 13 bp, Homo sapiens
ccacggcagccac

SEQ ID NO: 4261310 - DNA, 14 bp, Homo sapiens
ccacggcagccacc

SEQ ID NO: 4261311 - DNA, 17 bp, Homo sapiens
ccacggcagccaccctg

SEQ ID NO: 4261312 - DNA, 21 bp, Homo sapiens
ccacggcagccaccctgccat

SEQ ID NO: 4261313 - DNA, 22 bp, Homo sapiens
ccacggcagccaccctgccatg

SEQ ID NO: 4261314 - DNA, 19 bp, Homo sapiens
ccactaggccctggtctgg

SEQ ID NO: 4261315 - DNA, 22 bp, Homo sapiens
ccactaggccctggtctggctt

SEQ ID NO: 4261316 - DNA, 17 bp, Homo sapiens
ccactaggtgcccagtc

SEQ ID NO: 4261317 - DNA, 21 bp, Homo sapiens
ccactaggtgcccagtcttga

SEQ ID NO: 4261318 - DNA, 17 bp, Homo sapiens
ccactccagacccctgg

SEQ ID NO: 4261319 - DNA, 19 bp, Homo sapiens
ccactccagacccctggct

SEQ ID NO: 4261320 - DNA, 13 bp, Homo sapiens
ccactcccctcat

SEQ ID NO: 4261321 - DNA, 16 bp, Homo sapiens
ccactcctcccaactc

SEQ ID NO: 4261322 - DNA, 17 bp, Homo sapiens
ccactcctcccaactct

SEQ ID NO: 4261323 - DNA, 13 bp, Homo sapiens
ccactctcctgag

SEQ ID NO: 4261324 - DNA, 23 bp, Homo sapiens
ccactgcagtcacccctgtctgc

SEQ ID NO: 4261325 - DNA, 17 bp, Homo sapiens
ccactggagcgtgtact

SEQ ID NO: 4261326 - DNA, 13 bp, Homo sapiens
ccactggcatctc

SEQ ID NO: 4261327 - DNA, 18 bp, Homo sapiens
ccactggcatctctggag

SEQ ID NO: 4261328 - DNA, 20 bp, Homo sapiens
ccactggcatctctggagtg

SEQ ID NO: 4261329 - DNA, 15 bp, Homo sapiens
ccacttatgctgctg

SEQ ID NO: 4261330 - DNA, 13 bp, Homo sapiens
ccacttatttcta

SEQ ID NO: 4261331 - DNA, 12 bp, Homo sapiens
ccacttggcatt

SEQ ID NO: 4261332 - DNA, 18 bp, Homo sapiens
ccagaaatgccgctgtgt

SEQ ID NO: 4261333 - DNA, 17 bp, Homo sapiens
ccagaacgcatgcaggg

SEQ ID NO: 4261334 - DNA, 19 bp, Homo sapiens
ccagaacgcatgcagggcc

SEQ ID NO: 4261335 - DNA, 18 bp, Homo sapiens
ccagaactaccaaaatga

SEQ ID NO: 4261336 - DNA, 18 bp, Homo sapiens
ccagaagtggcaggagga

SEQ ID NO: 4261337 - DNA, 15 bp, Homo sapiens
ccagacagagtggat

SEQ ID NO: 4261338 - DNA, 19 bp, Homo sapiens
ccagacagagtggatctgg

SEQ ID NO: 4261339 - DNA, 14 bp, Homo sapiens
ccagacatgctgcc

SEQ ID NO: 4261340 - DNA, 15 bp, Homo sapiens
ccagacatgctgccc

SEQ ID NO: 4261341 - DNA, 20 bp, Homo sapiens
ccagacatgctgcccacccc

SEQ ID NO: 4261342 - DNA, 21 bp, Homo sapiens
ccagacatgctgcccaccccc

SEQ ID NO: 4261343 - DNA, 14 bp, Homo sapiens
ccagaccccatcca

SEQ ID NO: 4261344 - DNA, 21 bp, Homo sapiens
ccagaccccatccagccaggg

SEQ ID NO: 4261345 - DNA, 15 bp, Homo sapiens
ccagacccctggctt

SEQ ID NO: 4261346 - DNA, 17 bp, Homo sapiens
ccagacccctggctttt

SEQ ID NO: 4261347 - DNA, 20 bp, Homo sapiens
ccagacgtgctcctgctgac

SEQ ID NO: 4261348 - DNA, 23 bp, Homo sapiens
ccagagaagcatcggagggaatt

SEQ ID NO: 4261349 - DNA, 12 bp, Homo sapiens
ccagagaagcct

SEQ ID NO: 4261350 - DNA, 20 bp, Homo sapiens
ccagagaagcctcagtccct

SEQ ID NO: 4261351 - DNA, 20 bp, Homo sapiens
ccagagagagaagtgcccct

SEQ ID NO: 4261352 - DNA, 16 bp, Homo sapiens
ccagagagtggctcct

SEQ ID NO: 4261353 - DNA, 18 bp, Homo sapiens
ccagagagtggctcctcc

SEQ ID NO: 4261354 - DNA, 11 bp, Homo sapiens
ccagagccagg

SEQ ID NO: 4261355 - DNA, 12 bp, Homo sapiens
ccagagccaggg

SEQ ID NO: 4261356 - DNA, 15 bp, Homo sapiens
ccagagccagggctg

SEQ ID NO: 4261357 - DNA, 16 bp, Homo sapiens
ccagagccagggctgt

SEQ ID NO: 4261358 - DNA, 18 bp, Homo sapiens
ccagagccagggctgtcc

SEQ ID NO: 4261359 - DNA, 21 bp, Homo sapiens
ccagagccatggactctacac

SEQ ID NO: 4261360 - DNA, 19 bp, Homo sapiens
ccagagcctatggaaaggg

SEQ ID NO: 4261361 - DNA, 17 bp, Homo sapiens
ccagagcctccctcagc

SEQ ID NO: 4261362 - DNA, 21 bp, Homo sapiens
ccagagcctccctcagccacg

SEQ ID NO: 4261363 - DNA, 13 bp, Homo sapiens
ccagagctcccag

SEQ ID NO: 4261364 - DNA, 16 bp, Homo sapiens
ccagagctcccaggac

SEQ ID NO: 4261365 - DNA, 19 bp, Homo sapiens
ccagagctcccaggacgca

SEQ ID NO: 4261366 - DNA, 13 bp, Homo sapiens
ccagagctgcaga

SEQ ID NO: 4261367 - DNA, 15 bp, Homo sapiens
ccagaggaagggagg

SEQ ID NO: 4261368 - DNA, 18 bp, Homo sapiens
ccagaggaagggaggcct

SEQ ID NO: 4261369 - DNA, 20 bp, Homo sapiens
ccagaggaagggaggcctga

SEQ ID NO: 4261370 - DNA, 16 bp, Homo sapiens
ccagaggaggtgcccg

SEQ ID NO: 4261371 - DNA, 13 bp, Homo sapiens
ccagagggcccct

SEQ ID NO: 4261372 - DNA, 18 bp, Homo sapiens
ccagagggcccctcactg

SEQ ID NO: 4261373 - DNA, 19 bp, Homo sapiens
ccagaggggcggggccagg

SEQ ID NO: 4261374 - DNA, 20 bp, Homo sapiens
ccagaggtgagggaggcctg

SEQ ID NO: 4261375 - DNA, 20 bp, Homo sapiens
ccagatgacacataaatctg

SEQ ID NO: 4261376 - DNA, 13 bp, Homo sapiens
ccagatggctccc

SEQ ID NO: 4261377 - DNA, 19 bp, Homo sapiens
ccagatggctccctgggct

SEQ ID NO: 4261378 - DNA, 15 bp, Homo sapiens
ccagattaggcctgg

SEQ ID NO: 4261379 - DNA, 16 bp, Homo sapiens
ccagattaggcctgga

SEQ ID NO: 4261380 - DNA, 17 bp, Homo sapiens
ccagattaggcctggag

SEQ ID NO: 4261381 - DNA, 18 bp, Homo sapiens
ccagattaggcctggagt

SEQ ID NO: 4261382 - DNA, 17 bp, Homo sapiens
ccagcaaagttttcaga

SEQ ID NO: 4261383 - DNA, 22 bp, Homo sapiens
caggacactgcctttgctgcct

SEQ ID NO: 4261384 - DNA, 17 bp, Homo sapiens
caggaccaggagccagg

SEQ ID NO: 4261385 - DNA, 16 bp, Homo sapiens
caggaccccatctgct

SEQ ID NO: 4261386 - DNA, 17 bp, Homo sapiens
caggaccccatctgctg

SEQ ID NO: 4261387 - DNA, 18 bp, Homo sapiens
caggaccccatctgctga

SEQ ID NO: 4261388 - DNA, 19 bp, Homo sapiens
caggaccccatctgctgag

SEQ ID NO: 4261389 - DNA, 13 bp, Homo sapiens
caggaccctgagg

SEQ ID NO: 4261390 - DNA, 12 bp, Homo sapiens
caggaccctggg

SEQ ID NO: 4261391 - DNA, 17 bp, Homo sapiens
caggacgcatgcagggc

SEQ ID NO: 4261392 - DNA, 19 bp, Homo sapiens
caggacgcatgcagggccc

SEQ ID NO: 4261393 - DNA, 14 bp, Homo sapiens
caggagaaggcctg

SEQ ID NO: 4261394 - DNA, 16 bp, Homo sapiens
caggagacactggtct

SEQ ID NO: 4261395 - DNA, 17 bp, Homo sapiens
caggagacactggtctc

SEQ ID NO: 4261396 - DNA, 19 bp, Homo sapiens
caggagacactggtctcag

SEQ ID NO: 4261397 - DNA, 21 bp, Homo sapiens
caggagacactggtctcagag

SEQ ID NO: 4261398 - DNA, 22 bp, Homo sapiens
caggagacactggtctcagagg

SEQ ID NO: 4261399 - DNA, 23 bp, Homo sapiens
caggagacactggtctcagagga

SEQ ID NO: 4261400 - DNA, 20 bp, Homo sapiens
caggagagattatttacaag

SEQ ID NO: 4261401 - DNA, 23 bp, Homo sapiens
caggagagcccccaccagcagca

SEQ ID NO: 4261402 - DNA, 19 bp, Homo sapiens
caggagagccctctgctgc

SEQ ID NO: 4261403 - DNA, 22 bp, Homo sapiens
caggagagccctctgctgcttt

SEQ ID NO: 4261404 - DNA, 13 bp, Homo sapiens
caggagccagcag

SEQ ID NO: 4261405 - DNA, 12 bp, Homo sapiens
caggagccaggt

SEQ ID NO: 4261406 - DNA, 18 bp, Homo sapiens
caggagccaggtgtcctg

SEQ ID NO: 4261407 - DNA, 19 bp, Homo sapiens
cagtcagggcggggctggc

SEQ ID NO: 4261408 - DNA, 20 bp, Homo sapiens
cagtcagggcggggctggcc

SEQ ID NO: 4261409 - DNA, 21 bp, Homo sapiens
cagtcagggcggggctggcca

SEQ ID NO: 4261410 - DNA, 19 bp, Homo sapiens
cagtcattaaattactata

SEQ ID NO: 4261411 - DNA, 14 bp, Homo sapiens
cagtccaataaatt

SEQ ID NO: 4261412 - DNA, 19 bp, Homo sapiens
cagtccctccctcctggct

SEQ ID NO: 4261413 - DNA, 13 bp, Homo sapiens
cagtccctctgag

SEQ ID NO: 4261414 - DNA, 19 bp, Homo sapiens
cagtcctgggccccctggg

SEQ ID NO: 4261415 - DNA, 20 bp, Homo sapiens
cagtcctgggccccctggga

SEQ ID NO: 4261416 - DNA, 14 bp, Homo sapiens
cagtctgctgccct

SEQ ID NO: 4261417 - DNA, 19 bp, Homo sapiens
cagtctggaggtcccagac

SEQ ID NO: 4261418 - DNA, 20 bp, Homo sapiens
cagtctggaggtcccagaca

SEQ ID NO: 4261419 - DNA, 23 bp, Homo sapiens
cagtctggaggtcccagacatgc

SEQ ID NO: 4261420 - DNA, 18 bp, Homo sapiens
cagtcttgagtgggcccc

SEQ ID NO: 4261421 - DNA, 20 bp, Homo sapiens
cagtcttgagtgggccccct

SEQ ID NO: 4261422 - DNA, 14 bp, Homo sapiens
cagtcttttgtcct

SEQ ID NO: 4261423 - DNA, 13 bp, Homo sapiens
cagtgaacagctt

SEQ ID NO: 4261424 - DNA, 14 bp, Homo sapiens
cagtgaagaaagcc

SEQ ID NO: 4261425 - DNA, 15 bp, Homo sapiens
cagtgaccctggagc

SEQ ID NO: 4261426 - DNA, 17 bp, Homo sapiens
cagtgaccctggagcta

SEQ ID NO: 4261427 - DNA, 13 bp, Homo sapiens
cagtgactccagg

SEQ ID NO: 4261428 - DNA, 14 bp, Homo sapiens
cagtgactgctgcg

SEQ ID NO: 4261429 - DNA, 18 bp, Homo sapiens
cagtgactgctgcgctgt

SEQ ID NO: 4261430 - DNA, 14 bp, Homo sapiens
cagtgagagtgagg

SEQ ID NO: 4261431 - DNA, 14 bp, Homo sapiens
cagtgatgttgaaa

SEQ ID NO: 4261432 - DNA, 13 bp, Homo sapiens
cagtgcaccccct

SEQ ID NO: 4261433 - DNA, 18 bp, Homo sapiens
cagtgcatctcagcccac

SEQ ID NO: 4261434 - DNA, 18 bp, Homo sapiens
cagtggactttccacccc

SEQ ID NO: 4261435 - DNA, 20 bp, Homo sapiens
cagtggactttccaccccct

SEQ ID NO: 4261436 - DNA, 22 bp, Homo sapiens
cagtggactttccaccccctcc

SEQ ID NO: 4261437 - DNA, 19 bp, Homo sapiens
cagtggagaggggacttgg

SEQ ID NO: 4261438 - DNA, 15 bp, Homo sapiens
cagtggcatggctcc

SEQ ID NO: 4261439 - DNA, 19 bp, Homo sapiens
cagtggcatggctccagtc

SEQ ID NO: 4261440 - DNA, 14 bp, Homo sapiens
cagtggcctacaaa

SEQ ID NO: 4261441 - DNA, 16 bp, Homo sapiens
cagtggcctcaaccct

SEQ ID NO: 4261442 - DNA, 19 bp, Homo sapiens
cagtggcctcaaccctccc

SEQ ID NO: 4261443 - DNA, 14 bp, Homo sapiens
cagtgggccctggc

SEQ ID NO: 4261444 - DNA, 17 bp, Homo sapiens
cagtgggccctggctct

SEQ ID NO: 4261445 - DNA, 13 bp, Homo sapiens
cagtgtagatttt

SEQ ID NO: 4261446 - DNA, 13 bp, Homo sapiens
cagtgtccccagg

SEQ ID NO: 4261447 - DNA, 16 bp, Homo sapiens
cagtgtgagggtgcag

SEQ ID NO: 4261448 - DNA, 17 bp, Homo sapiens
cagtgtgccaccctctg

SEQ ID NO: 4261449 - DNA, 18 bp, Homo sapiens
cagtgtgccaccctctgc

SEQ ID NO: 4261450 - DNA, 15 bp, Homo sapiens
cagtgtggactctgg

SEQ ID NO: 4261451 - DNA, 13 bp, Homo sapiens
cagtgttagctta

SEQ ID NO: 4261452 - DNA, 14 bp, Homo sapiens
cagtgttagcttag

SEQ ID NO: 4261453 - DNA, 16 bp, Homo sapiens
cagtgttgcctcctcc

SEQ ID NO: 4261454 - DNA, 11 bp, Homo sapiens
cagtgtttatg

SEQ ID NO: 4261455 - DNA, 13 bp, Homo sapiens
cagtgtttccagt

SEQ ID NO: 4261456 - DNA, 13 bp, Homo sapiens
cagtgttttcttg

SEQ ID NO: 4261457 - DNA, 13 bp, Homo sapiens
cagttagcacaga

SEQ ID NO: 4261458 - DNA, 15 bp, Homo sapiens
cagttagcacagagg

SEQ ID NO: 4261459 - DNA, 19 bp, Homo sapiens
cagttagcacagaggatgg

SEQ ID NO: 4261460 - DNA, 14 bp, Homo sapiens
cagttcctgcagca

SEQ ID NO: 4261461 - DNA, 21 bp, Homo sapiens
cagttcctgcagcagagcctg

SEQ ID NO: 4261462 - DNA, 13 bp, Homo sapiens
cagttctgatgag

SEQ ID NO: 4261463 - DNA, 22 bp, Homo sapiens
cagttgacacattgcacacaca

SEQ ID NO: 4261464 - DNA, 12 bp, Homo sapiens
cagttgcacagc

SEQ ID NO: 4261465 - DNA, 13 bp, Homo sapiens
cagttgcacagca

SEQ ID NO: 4261466 - DNA, 16 bp, Homo sapiens
cagttgcacagcatct

SEQ ID NO: 4261467 - DNA, 17 bp, Homo sapiens
cagttggactgtggcct

SEQ ID NO: 4261468 - DNA, 20 bp, Homo sapiens
cagttggactgtggcctcag

SEQ ID NO: 4261469 - DNA, 15 bp, Homo sapiens
cagttggcctcagca

SEQ ID NO: 4261470 - DNA, 21 bp, Homo sapiens
cagttgttatattcattcttt

SEQ ID NO: 4261471 - DNA, 22 bp, Homo sapiens
cagtttaggacccaaggtggtc

SEQ ID NO: 4261472 - DNA, 11 bp, Homo sapiens
cagtttccaag

SEQ ID NO: 4261473 - DNA, 16 bp, Homo sapiens
cagtttgcctctgcac

SEQ ID NO: 4261474 - DNA, 17 bp, Homo sapiens
cagtttgcctctgcacg

SEQ ID NO: 4261475 - DNA, 14 bp, Homo sapiens
cagtttgctttgta

SEQ ID NO: 4261476 - DNA, 21 bp, Homo sapiens
cagtttgctttgtatgcactt

SEQ ID NO: 4261477 - DNA, 16 bp, Homo sapiens
cataaaaataaccaaa

SEQ ID NO: 4261478 - DNA, 21 bp, Homo sapiens
cataaaaataaccaaaaaatg

SEQ ID NO: 4261479 - DNA, 14 bp, Homo sapiens
cataaaataaataa

SEQ ID NO: 4261480 - DNA, 17 bp, Homo sapiens
cataaaataaataatct

SEQ ID NO: 4261481 - DNA, 14 bp, Homo sapiens
cataaagtgagaaa

SEQ ID NO: 4261482 - DNA, 18 bp, Homo sapiens
cataaatctgtctgattc

SEQ ID NO: 4261483 - DNA, 20 bp, Homo sapiens
cataaatctgtctgattcta

SEQ ID NO: 4261484 - DNA, 16 bp, Homo sapiens
cataaatcttccaaag

SEQ ID NO: 4261485 - DNA, 13 bp, Homo sapiens
cataacaatgtat

SEQ ID NO: 4261486 - DNA, 21 bp, Homo sapiens
cataaggtcttattcttgtgc

SEQ ID NO: 4261487 - DNA, 13 bp, Homo sapiens
cataattaaattt

SEQ ID NO: 4261488 - DNA, 16 bp, Homo sapiens
cataattagatccatt

SEQ ID NO: 4261489 - DNA, 22 bp, Homo sapiens
cataattagatccattaattta

SEQ ID NO: 4261490 - DNA, 20 bp, Homo sapiens
cataccccctgccccagaga

SEQ ID NO: 4261491 - DNA, 13 bp, Homo sapiens
catactctccagg

SEQ ID NO: 4261492 - DNA, 13 bp, Homo sapiens
catactctgtgta

SEQ ID NO: 4261493 - DNA, 19 bp, Homo sapiens
catactctgtgtaatctct

SEQ ID NO: 4261494 - DNA, 16 bp, Homo sapiens
catacttcctggattt

SEQ ID NO: 4261495 - DNA, 17 bp, Homo sapiens
catactttccaacatta

SEQ ID NO: 4261496 - DNA, 23 bp, Homo sapiens
catagaactgtcccacaaaatat

SEQ ID NO: 4261497 - DNA, 14 bp, Homo sapiens
catagatgcctggg

SEQ ID NO: 4261498 - DNA, 16 bp, Homo sapiens
catagatgcctgggcc

SEQ ID NO: 4261499 - DNA, 17 bp, Homo sapiens
catagatgcctgggcct

SEQ ID NO: 4261500 - DNA, 17 bp, Homo sapiens
catagcttaagaagtat

SEQ ID NO: 4261501 - DNA, 15 bp, Homo sapiens
cataggcaagaggag

SEQ ID NO: 4261502 - DNA, 16 bp, Homo sapiens
cataggcaagaggagt

SEQ ID NO: 4261503 - DNA, 21 bp, Homo sapiens
cataggcagagcccgcccacc

SEQ ID NO: 4261504 - DNA, 20 bp, Homo sapiens
catagggtccactttggtaa

SEQ ID NO: 4261505 - DNA, 20 bp, Homo sapiens
catagtctgaagtgaagtac

SEQ ID NO: 4261506 - DNA, 18 bp, Homo sapiens
catagtctttgtttacat

SEQ ID NO: 4261507 - DNA, 12 bp, Homo sapiens
catatagtttgt

SEQ ID NO: 4261508 - DNA, 13 bp, Homo sapiens
catatagtttgtt

SEQ ID NO: 4261509 - DNA, 16 bp, Homo sapiens
catatagtttgttttc

SEQ ID NO: 4261510 - DNA, 23 bp, Homo sapiens
catatagtttgttttctttttct

SEQ ID NO: 4261511 - DNA, 18 bp, Homo sapiens
catatcaagtcccgaggc

SEQ ID NO: 4261512 - DNA, 21 bp, Homo sapiens
catatcaagtcccgaggcagc

SEQ ID NO: 4261513 - DNA, 14 bp, Homo sapiens
catatcatttctta

SEQ ID NO: 4261514 - DNA, 19 bp, Homo sapiens
catatgacaatttcaaaat

SEQ ID NO: 4261515 - DNA, 22 bp, Homo sapiens
catatgacaatttcaaaatgca

SEQ ID NO: 4261516 - DNA, 15 bp, Homo sapiens
catatgattgaaaag

SEQ ID NO: 4261517 - DNA, 20 bp, Homo sapiens
catatgattgaaaagaagaa

SEQ ID NO: 4261518 - DNA, 21 bp, Homo sapiens
catattcttgctttcacaaat

SEQ ID NO: 4261519 - DNA, 21 bp, Homo sapiens
catattgagatcagcattcaa

SEQ ID NO: 4261520 - DNA, 22 bp, Homo sapiens
catatttaataggataaattaa

SEQ ID NO: 4261521 - DNA, 14 bp, Homo sapiens
catatttgtagcta

SEQ ID NO: 4261522 - DNA, 13 bp, Homo sapiens
catcaacctagga

SEQ ID NO: 4261523 - DNA, 14 bp, Homo sapiens
attactgcatgcac

SEQ ID NO: 4261524 - DNA, 17 bp, Homo sapiens
attactggatctcttaa

SEQ ID NO: 4261525 - DNA, 15 bp, Homo sapiens
attagcatgaaaggt

SEQ ID NO: 4261526 - DNA, 15 bp, Homo sapiens
attagccaaagaggc

SEQ ID NO: 4261527 - DNA, 17 bp, Homo sapiens
attagccagtgaaaaac

SEQ ID NO: 4261528 - DNA, 15 bp, Homo sapiens
attagccctgcattt

SEQ ID NO: 4261529 - DNA, 18 bp, Homo sapiens
attaggaacagagtatat

SEQ ID NO: 4261530 - DNA, 21 bp, Homo sapiens
attaggaacagagtatatatg

SEQ ID NO: 4261531 - DNA, 23 bp, Homo sapiens
attaggaacagagtatatatgta

SEQ ID NO: 4261532 - DNA, 22 bp, Homo sapiens
attaggcctggagttgggctgg

SEQ ID NO: 4261533 - DNA, 17 bp, Homo sapiens
attagggctctaatttc

SEQ ID NO: 4261534 - DNA, 18 bp, Homo sapiens
attatatcagactgcttt

SEQ ID NO: 4261535 - DNA, 14 bp, Homo sapiens
attatcctgtgtga

SEQ ID NO: 4261536 - DNA, 16 bp, Homo sapiens
attattaaatcagaat

SEQ ID NO: 4261537 - DNA, 22 bp, Homo sapiens
attattacttttcctcttagaa

SEQ ID NO: 4261538 - DNA, 16 bp, Homo sapiens
attattgaatgttata

SEQ ID NO: 4261539 - DNA, 22 bp, Homo sapiens
attattgaatgttatatcatca

SEQ ID NO: 4261540 - DNA, 14 bp, Homo sapiens
attatttacaagaa

SEQ ID NO: 4261541 - DNA, 21 bp, Homo sapiens
attatttcaaccgcttgccat

SEQ ID NO: 4261542 - DNA, 19 bp, Homo sapiens
attcaaaaacatggccaca

SEQ ID NO: 4261543 - DNA, 12 bp, Homo sapiens
attcaaaatagt

SEQ ID NO: 4261544 - DNA, 22 bp, Homo sapiens
attcaaaatagttctatttcta

SEQ ID NO: 4261545 - DNA, 23 bp, Homo sapiens
attcaaaatagttctatttctat

SEQ ID NO: 4261546 - DNA, 11 bp, Homo sapiens
attcaaatgca

SEQ ID NO: 4261547 - DNA, 12 bp, Homo sapiens
attcaaatgcat

SEQ ID NO: 4261548 - DNA, 14 bp, Homo sapiens
attcaaatgcatga

SEQ ID NO: 4261549 - DNA, 15 bp, Homo sapiens
attcaaatgcatgat

SEQ ID NO: 4261550 - DNA, 21 bp, Homo sapiens
attcaaatttatttccaatgt

SEQ ID NO: 4261551 - DNA, 11 bp, Homo sapiens
attcaacaaat

SEQ ID NO: 4261552 - DNA, 19 bp, Homo sapiens
attcaacacttattttctg

SEQ ID NO: 4261553 - DNA, 23 bp, Homo sapiens
attcaattaagttattaacattt

SEQ ID NO: 4261554 - DNA, 14 bp, Homo sapiens
attcacaacacaat

SEQ ID NO: 4261555 - DNA, 17 bp, Homo sapiens
attcacttgtgtttgta

SEQ ID NO: 4261556 - DNA, 18 bp, Homo sapiens
attcacttgtgtttgtat

SEQ ID NO: 4261557 - DNA, 20 bp, Homo sapiens
attcacttgtgtttgtatat

SEQ ID NO: 4261558 - DNA, 22 bp, Homo sapiens
attcactttaccttcagcagtt

SEQ ID NO: 4261559 - DNA, 20 bp, Homo sapiens
attcactttgacacttttca

SEQ ID NO: 4261560 - DNA, 14 bp, Homo sapiens
attcagagatgtac

SEQ ID NO: 4261561 - DNA, 17 bp, Homo sapiens
attcagagatgtaccat

SEQ ID NO: 4261562 - DNA, 20 bp, Homo sapiens
attcagagatgtaccatgtt

SEQ ID NO: 4261563 - DNA, 16 bp, Homo sapiens
attcagcaattaaaga

SEQ ID NO: 4261564 - DNA, 21 bp, Homo sapiens
attcagcatcgtgtgggtccc

SEQ ID NO: 4261565 - DNA, 19 bp, Homo sapiens
attcaggcttgcattaaaa

SEQ ID NO: 4261566 - DNA, 20 bp, Homo sapiens
attcagggcccctgaagtga

SEQ ID NO: 4261567 - DNA, 18 bp, Homo sapiens
attcagtttctaaaattg

SEQ ID NO: 4261568 - DNA, 20 bp, Homo sapiens
attcagtttctaaaattgag

SEQ ID NO: 4261569 - DNA, 15 bp, Homo sapiens
attcataaaaataac

SEQ ID NO: 4261570 - DNA, 23 bp, Homo sapiens
attcataaaaataaccaaaaaat

SEQ ID NO: 4261571 - DNA, 14 bp, Homo sapiens
attcataacaatgt

SEQ ID NO: 4261572 - DNA, 18 bp, Homo sapiens
attcataacaatgtatgt

SEQ ID NO: 4261573 - DNA, 14 bp, Homo sapiens
attcatacttaaaa

SEQ ID NO: 4261574 - DNA, 18 bp, Homo sapiens
attcatagcatcctgatt

SEQ ID NO: 4261575 - DNA, 15 bp, Homo sapiens
attcattttgcaact

SEQ ID NO: 4261576 - DNA, 22 bp, Homo sapiens
attcatttttgaaactgcattt

SEQ ID NO: 4261577 - DNA, 15 bp, Homo sapiens
attccaagggcccag

SEQ ID NO: 4261578 - DNA, 23 bp, Homo sapiens
attccaccaggattaatctctaa

SEQ ID NO: 4261579 - DNA, 18 bp, Homo sapiens
attccagacctgaagaat

SEQ ID NO: 4261580 - DNA, 18 bp, Homo sapiens
attccagagagtggctcc

SEQ ID NO: 4261581 - DNA, 17 bp, Homo sapiens
attcccagacagcagtg

SEQ ID NO: 4261582 - DNA, 14 bp, Homo sapiens
attccccggagctg

SEQ ID NO: 4261583 - DNA, 20 bp, Homo sapiens
attcctatgctgcaatacat

SEQ ID NO: 4261584 - DNA, 14 bp, Homo sapiens
attccttggcccag

SEQ ID NO: 4261585 - DNA, 15 bp, Homo sapiens
attccttggcccagc

SEQ ID NO: 4261586 - DNA, 18 bp, Homo sapiens
attccttggcccagcagc

SEQ ID NO: 4261587 - DNA, 16 bp, Homo sapiens
attctaaaacattctt

SEQ ID NO: 4261588 - DNA, 19 bp, Homo sapiens
attctaaaacattctttaa

SEQ ID NO: 4261589 - DNA, 15 bp, Homo sapiens
attctaaatgttcat

SEQ ID NO: 4261590 - DNA, 18 bp, Homo sapiens
attctaagaaatatctgt

SEQ ID NO: 4261591 - DNA, 15 bp, Homo sapiens
attctataaattcaa

SEQ ID NO: 4261592 - DNA, 22 bp, Homo sapiens
attctattgcagttatagaaaa

SEQ ID NO: 4261593 - DNA, 21 bp, Homo sapiens
attctatttcaacttcaggaa

SEQ ID NO: 4261594 - DNA, 18 bp, Homo sapiens
attctcttttcaaacaca

SEQ ID NO: 4261595 - DNA, 20 bp, Homo sapiens
attctcttttcaaacacaca

SEQ ID NO: 4261596 - DNA, 22 bp, Homo sapiens
attctcttttcaaacacacaca

SEQ ID NO: 4261597 - DNA, 22 bp, Homo sapiens
attctgggtgttttcagaaaga

SEQ ID NO: 4261598 - DNA, 12 bp, Homo sapiens
attctgtccctg

SEQ ID NO: 4261599 - DNA, 15 bp, Homo sapiens
attctgtccctgtcc

SEQ ID NO: 4261600 - DNA, 22 bp, Homo sapiens
attctgtccctgtccctgcccc

SEQ ID NO: 4261601 - DNA, 15 bp, Homo sapiens
attctgtggattcta

SEQ ID NO: 4261602 - DNA, 16 bp, Homo sapiens
attctgtggattctat

SEQ ID NO: 4261603 - DNA, 21 bp, Homo sapiens
attctgtttatgttcttgcag

SEQ ID NO: 4261604 - DNA, 18 bp, Homo sapiens
attcttcaagatcccatt

SEQ ID NO: 4261605 - DNA, 21 bp, Homo sapiens
attcttcaagatcccatttga

SEQ ID NO: 4261606 - DNA, 20 bp, Homo sapiens
attcttgctttcacaaatat

SEQ ID NO: 4261607 - DNA, 20 bp, Homo sapiens
attcttttcagcttgtttct

SEQ ID NO: 4261608 - DNA, 22 bp, Homo sapiens
attcttttcagcttgtttctat

SEQ ID NO: 4261609 - DNA, 15 bp, Homo sapiens
attgaaaagaagaaa

SEQ ID NO: 4261610 - DNA, 20 bp, Homo sapiens
attgaaaagaagtagtgtct

SEQ ID NO: 4261611 - DNA, 19 bp, Homo sapiens
attgaagagagatatatct

SEQ ID NO: 4261612 - DNA, 12 bp, Homo sapiens
attgacaagttt

SEQ ID NO: 4261613 - DNA, 15 bp, Homo sapiens
attgacgtctagcta

SEQ ID NO: 4261614 - DNA, 16 bp, Homo sapiens
attgacttcgactgtg

SEQ ID NO: 4261615 - DNA, 22 bp, Homo sapiens
attgagatcagcattcaaaata

SEQ ID NO: 4261616 - DNA, 21 bp, Homo sapiens
attgagcagaattcattcata

SEQ ID NO: 4261617 - DNA, 17 bp, Homo sapiens
attgagggaaaacataa

SEQ ID NO: 4261618 - DNA, 16 bp, Homo sapiens
attgaggttaggaacc

SEQ ID NO: 4261619 - DNA, 14 bp, Homo sapiens
attgatattctaag

SEQ ID NO: 4261620 - DNA, 14 bp, Homo sapiens
attgatgggtgggc

SEQ ID NO: 4261621 - DNA, 18 bp, Homo sapiens
attgatgggtgggctagt

SEQ ID NO: 4261622 - DNA, 15 bp, Homo sapiens
attgcaaaaggttaa

SEQ ID NO: 4261623 - DNA, 21 bp, Homo sapiens
attgcaaaaggttaagccata

SEQ ID NO: 4261624 - DNA, 21 bp, Homo sapiens
attgcccacacctgcctctga

SEQ ID NO: 4261625 - DNA, 14 bp, Homo sapiens
attgccctgagggg

SEQ ID NO: 4261626 - DNA, 16 bp, Homo sapiens
attgccctgaggggcc

SEQ ID NO: 4261627 - DNA, 17 bp, Homo sapiens
attggacattttcttca

SEQ ID NO: 4261628 - DNA, 20 bp, Homo sapiens
attggaggatgggggtcctg

SEQ ID NO: 4261629 - DNA, 12 bp, Homo sapiens
attggcttgttt

SEQ ID NO: 4261630 - DNA, 17 bp, Homo sapiens
attgggcaagtgattga

SEQ ID NO: 4261631 - DNA, 16 bp, Homo sapiens
attgggggggcttggg

SEQ ID NO: 4261632 - DNA, 19 bp, Homo sapiens
attggtgataagtggaaaa

SEQ ID NO: 4261633 - DNA, 18 bp, Homo sapiens
attggttcatgcctgggg

SEQ ID NO: 4261634 - DNA, 15 bp, Homo sapiens
attgtagagtgccca

SEQ ID NO: 4261635 - DNA, 15 bp, Homo sapiens
attgtagcatttctt

SEQ ID NO: 4261636 - DNA, 16 bp, Homo sapiens
attgtagcatttcttg

SEQ ID NO: 4261637 - DNA, 15 bp, Homo sapiens
attgtataaaacagt

SEQ ID NO: 4261638 - DNA, 13 bp, Homo sapiens
attgtatcttcat

SEQ ID NO: 4261639 - DNA, 14 bp, Homo sapiens
attgtatgtacctg

SEQ ID NO: 4261640 - DNA, 19 bp, Homo sapiens
attgtattttactttgtgc

SEQ ID NO: 4261641 - DNA, 22 bp, Homo sapiens
attgtccacaaatgtcctcaga

SEQ ID NO: 4261642 - DNA, 15 bp, Homo sapiens
attgtgcattctaga

SEQ ID NO: 4261643 - DNA, 13 bp, Homo sapiens
attgtgctagtgc

SEQ ID NO: 4261644 - DNA, 14 bp, Homo sapiens
attgttacaatttt

SEQ ID NO: 4261645 - DNA, 13 bp, Homo sapiens
attgttattaaat

SEQ ID NO: 4261646 - DNA, 15 bp, Homo sapiens
attgtttaattgtag

SEQ ID NO: 4261647 - DNA, 21 bp, Homo sapiens
atttaaaaaggtttaaaacta

SEQ ID NO: 4261648 - DNA, 23 bp, Homo sapiens
atttaggtttctgagttcctgca

SEQ ID NO: 4261649 - DNA, 15 bp, Homo sapiens
atttagtcctcacct

SEQ ID NO: 4261650 - DNA, 16 bp, Homo sapiens
atttatatatgaagta

SEQ ID NO: 4261651 - DNA, 13 bp, Homo sapiens
atttatattagag

SEQ ID NO: 4261652 - DNA, 15 bp, Homo sapiens
atttatattcagaga

SEQ ID NO: 4261653 - DNA, 17 bp, Homo sapiens
atttatcatatttaata

SEQ ID NO: 4261654 - DNA, 14 bp, Homo sapiens
atttatctgtctga

SEQ ID NO: 4261655 - DNA, 20 bp, Homo sapiens
atttatgatataataaatat

SEQ ID NO: 4261656 - DNA, 16 bp, Homo sapiens
atttattgtatatatg

SEQ ID NO: 4261657 - DNA, 19 bp, Homo sapiens
caatggacaagcagtggat

SEQ ID NO: 4261658 - DNA, 15 bp, Homo sapiens
caatggcctaaactt

SEQ ID NO: 4261659 - DNA, 21 bp, Homo sapiens
caatggcgcagtgcctctggt

SEQ ID NO: 4261660 - DNA, 23 bp, Homo sapiens
caatgtatgtgaaagtgtaaaat

SEQ ID NO: 4261661 - DNA, 17 bp, Homo sapiens
caatgtgcccagtcatg

SEQ ID NO: 4261662 - DNA, 23 bp, Homo sapiens
caatgtggaaaaaatattttaaa

SEQ ID NO: 4261663 - DNA, 18 bp, Homo sapiens
caattaaagacatttaaa

SEQ ID NO: 4261664 - DNA, 18 bp, Homo sapiens
caattaattgtcttgcac

SEQ ID NO: 4261665 - DNA, 13 bp, Homo sapiens
caattctgtccct

SEQ ID NO: 4261666 - DNA, 16 bp, Homo sapiens
caattctgtccctgtc

SEQ ID NO: 4261667 - DNA, 18 bp, Homo sapiens
caattctgtccctgtccc

SEQ ID NO: 4261668 - DNA, 23 bp, Homo sapiens
caattctgtccctgtccctgccc

SEQ ID NO: 4261669 - DNA, 15 bp, Homo sapiens
caattcttttgaaag

SEQ ID NO: 4261670 - DNA, 17 bp, Homo sapiens
caattggacaattattt

SEQ ID NO: 4261671 - DNA, 16 bp, Homo sapiens
caattgtcatttataa

SEQ ID NO: 4261672 - DNA, 17 bp, Homo sapiens
caattgtcatttataaa

SEQ ID NO: 4261673 - DNA, 16 bp, Homo sapiens
caatttcaaaatgcat

SEQ ID NO: 4261674 - DNA, 21 bp, Homo sapiens
caatttcaaaatgcatgtgat

SEQ ID NO: 4261675 - DNA, 23 bp, Homo sapiens
caatttcaaaatgcatgtgattg

SEQ ID NO: 4261676 - DNA, 16 bp, Homo sapiens
caattttaaaaaataa

SEQ ID NO: 4261677 - DNA, 20 bp, Homo sapiens
caattttctatttaaaaaat

SEQ ID NO: 4261678 - DNA, 15 bp, Homo sapiens
cacaaaatatttcta

SEQ ID NO: 4261679 - DNA, 20 bp, Homo sapiens
cacaaataagtaatatcttt

SEQ ID NO: 4261680 - DNA, 18 bp, Homo sapiens
cacaacctcctcctccag

SEQ ID NO: 4261681 - DNA, 17 bp, Homo sapiens
cacaaccttctgtggct

SEQ ID NO: 4261682 - DNA, 19 bp, Homo sapiens
cacaaccttctgtggctca

SEQ ID NO: 4261683 - DNA, 20 bp, Homo sapiens
cacaactgtttttgaagaag

SEQ ID NO: 4261684 - DNA, 12 bp, Homo sapiens
cacaagaagtgg

SEQ ID NO: 4261685 - DNA, 23 bp, Homo sapiens
cacaagaagtgggagtgggagag

SEQ ID NO: 4261686 - DNA, 22 bp, Homo sapiens
cacaagacagcagagccatctg

SEQ ID NO: 4261687 - DNA, 21 bp, Homo sapiens
cacaagcagagtgcacagctg

SEQ ID NO: 4261688 - DNA, 14 bp, Homo sapiens
cacaataaagtgta

SEQ ID NO: 4261689 - DNA, 16 bp, Homo sapiens
cacaattagatttctc

SEQ ID NO: 4261690 - DNA, 19 bp, Homo sapiens
cacaattctgtccctgtcc

SEQ ID NO: 4261691 - DNA, 15 bp, Homo sapiens
cacaattcttttgaa

SEQ ID NO: 4261692 - DNA, 16 bp, Homo sapiens
cacacaagacagcaga

SEQ ID NO: 4261693 - DNA, 16 bp, Homo sapiens
cacacaattagatttc

SEQ ID NO: 4261694 - DNA, 16 bp, Homo sapiens
cacacacacacacagg

SEQ ID NO: 4261695 - DNA, 14 bp, Homo sapiens
cacacacacacagg

SEQ ID NO: 4261696 - DNA, 13 bp, Homo sapiens
cacacacacagga

SEQ ID NO: 4261697 - DNA, 14 bp, Homo sapiens
cacacacacccttc

SEQ ID NO: 4261698 - DNA, 16 bp, Homo sapiens
cacacacactcttcaa

SEQ ID NO: 4261699 - DNA, 12 bp, Homo sapiens
cacacacaggag

SEQ ID NO: 4261700 - DNA, 15 bp, Homo sapiens
cacacacccttcccc

SEQ ID NO: 4261701 - DNA, 13 bp, Homo sapiens
cacacacctgcac

SEQ ID NO: 4261702 - DNA, 14 bp, Homo sapiens
cacacacctgcaca

SEQ ID NO: 4261703 - DNA, 22 bp, Homo sapiens
cacacacctgcacaccgtccct

SEQ ID NO: 4261704 - DNA, 19 bp, Homo sapiens
caccccagcctaagatgaa

SEQ ID NO: 4261705 - DNA, 11 bp, Homo sapiens
cacccccaccc

SEQ ID NO: 4261706 - DNA, 16 bp, Homo sapiens
caccccctccctggcc

SEQ ID NO: 4261707 - DNA, 16 bp, Homo sapiens
caccccgcctctgggc

SEQ ID NO: 4261708 - DNA, 21 bp, Homo sapiens
caccccgttgttgtccctgca

SEQ ID NO: 4261709 - DNA, 15 bp, Homo sapiens
cacccctaaagagat

SEQ ID NO: 4261710 - DNA, 22 bp, Homo sapiens
cacccctcttcccaccaactct

SEQ ID NO: 4261711 - DNA, 16 bp, Homo sapiens
cacccctcttccccct

SEQ ID NO: 4261712 - DNA, 20 bp, Homo sapiens
cacccctgcacacacctgca

SEQ ID NO: 4261713 - DNA, 21 bp, Homo sapiens
cacccctggtgtccctgcctg

SEQ ID NO: 4261714 - DNA, 23 bp, Homo sapiens
cacccctggtgtccctgcctggc

SEQ ID NO: 4261715 - DNA, 11 bp, Homo sapiens
caccccttccc

SEQ ID NO: 4261716 - DNA, 12 bp, Homo sapiens
caccccttcccc

SEQ ID NO: 4261717 - DNA, 18 bp, Homo sapiens
caccccttccccactgcc

SEQ ID NO: 4261718 - DNA, 21 bp, Homo sapiens
cacccggatctccaggcccag

SEQ ID NO: 4261719 - DNA, 13 bp, Homo sapiens
cacccgtgccacg

SEQ ID NO: 4261720 - DNA, 21 bp, Homo sapiens
cacccgtgccacgcgctctgc

SEQ ID NO: 4261721 - DNA, 16 bp, Homo sapiens
cacccgtggagatggg

SEQ ID NO: 4261722 - DNA, 23 bp, Homo sapiens
cacccgtttccaagcctgggcca

SEQ ID NO: 4261723 - DNA, 20 bp, Homo sapiens
caccctctgcagggcagcct

SEQ ID NO: 4261724 - DNA, 10 bp, Homo sapiens
caccctgcca

SEQ ID NO: 4261725 - DNA, 12 bp, Homo sapiens
cacccttcccca

SEQ ID NO: 4261726 - DNA, 14 bp, Homo sapiens
cacccttccccact

SEQ ID NO: 4261727 - DNA, 15 bp, Homo sapiens
cacccttccccactc

SEQ ID NO: 4261728 - DNA, 17 bp, Homo sapiens
cacccttccccactccc

SEQ ID NO: 4261729 - DNA, 14 bp, Homo sapiens
caccgctccccagc

SEQ ID NO: 4261730 - DNA, 16 bp, Homo sapiens
caccgctccccagccc

SEQ ID NO: 4261731 - DNA, 18 bp, Homo sapiens
caccgctccccagcccag

SEQ ID NO: 4261732 - DNA, 19 bp, Homo sapiens
caccgtagtaacacataaa

SEQ ID NO: 4261733 - DNA, 17 bp, Homo sapiens
caccgtccctctccccg

SEQ ID NO: 4261734 - DNA, 11 bp, Homo sapiens
cacctaagtga

SEQ ID NO: 4261735 - DNA, 12 bp, Homo sapiens
cacctactgagt

SEQ ID NO: 4261736 - DNA, 19 bp, Homo sapiens
cacctatgtcatttcattt

SEQ ID NO: 4261737 - DNA, 11 bp, Homo sapiens
cacctccaccc

SEQ ID NO: 4261738 - DNA, 14 bp, Homo sapiens
cacctcccctcctt

SEQ ID NO: 4261739 - DNA, 23 bp, Homo sapiens
cacctcccctccttgcctcctgt

SEQ ID NO: 4261740 - DNA, 22 bp, Homo sapiens
cacctgaattcgagacaggcag

SEQ ID NO: 4261741 - DNA, 15 bp, Homo sapiens
cacctgcacacccct

SEQ ID NO: 4261742 - DNA, 18 bp, Homo sapiens
cacctgcacacccctgca

SEQ ID NO: 4261743 - DNA, 19 bp, Homo sapiens
cacctgcagccccaggcct

SEQ ID NO: 4261744 - DNA, 21 bp, Homo sapiens
cacctgcagccccaggcctcc

SEQ ID NO: 4261745 - DNA, 15 bp, Homo sapiens
cacctgcccccttct

SEQ ID NO: 4261746 - DNA, 18 bp, Homo sapiens
cactggaggcctctgcaa

SEQ ID NO: 4261747 - DNA, 22 bp, Homo sapiens
cactggagtggtaacaagagga

SEQ ID NO: 4261748 - DNA, 22 bp, Homo sapiens
cactggcccctagaatcagcct

SEQ ID NO: 4261749 - DNA, 11 bp, Homo sapiens
cactggctcct

SEQ ID NO: 4261750 - DNA, 15 bp, Homo sapiens
cactggctcctccag

SEQ ID NO: 4261751 - DNA, 16 bp, Homo sapiens
cactggctcctccagc

SEQ ID NO: 4261752 - DNA, 23 bp, Homo sapiens
cactggctggactggaggctggg

SEQ ID NO: 4261753 - DNA, 14 bp, Homo sapiens
cactggctttacat

SEQ ID NO: 4261754 - DNA, 18 bp, Homo sapiens
cactggtctcagaggagg

SEQ ID NO: 4261755 - DNA, 20 bp, Homo sapiens
cactggtctcagaggaggga

SEQ ID NO: 4261756 - DNA, 17 bp, Homo sapiens
cactgtgcagccgggga

SEQ ID NO: 4261757 - DNA, 18 bp, Homo sapiens
cactgtgcgttttagagt

SEQ ID NO: 4261758 - DNA, 22 bp, Homo sapiens
cacttaaaatcaaatttttctg

SEQ ID NO: 4261759 - DNA, 16 bp, Homo sapiens
cacttatgctgctgtg

SEQ ID NO: 4261760 - DNA, 20 bp, Homo sapiens
cacttatgctgctgtgaatt

SEQ ID NO: 4261761 - DNA, 12 bp, Homo sapiens
cacttatttcta

SEQ ID NO: 4261762 - DNA, 18 bp, Homo sapiens
cacttattttctgaattc

SEQ ID NO: 4261763 - DNA, 14 bp, Homo sapiens
cacttcaggctctt

SEQ ID NO: 4261764 - DNA, 20 bp, Homo sapiens
cacttcaggctcttctcctt

SEQ ID NO: 4261765 - DNA, 12 bp, Homo sapiens
cacttcctgtcc

SEQ ID NO: 4261766 - DNA, 17 bp, Homo sapiens
cacttcctgtccagaga

SEQ ID NO: 4261767 - DNA, 18 bp, Homo sapiens
cacttcctgtccagagag

SEQ ID NO: 4261768 - DNA, 15 bp, Homo sapiens
cactttatcttggga

SEQ ID NO: 4261769 - DNA, 22 bp, Homo sapiens
cactttccccgtgggccatggc

SEQ ID NO: 4261770 - DNA, 12 bp, Homo sapiens
cacttttctcca

SEQ ID NO: 4261771 - DNA, 22 bp, Homo sapiens
cagaaaaacaatggtaacattt

SEQ ID NO: 4261772 - DNA, 24 bp, Homo sapiens
cagaaaatttctcaatctatgtga

SEQ ID NO: 4261773 - DNA, 18 bp, Homo sapiens
cagaaagggcagcccctc

SEQ ID NO: 4261774 - DNA, 22 bp, Homo sapiens
cagaaagggcagcccctcccca

SEQ ID NO: 4261775 - DNA, 20 bp, Homo sapiens
cagaaccaacgggtctgtgg

SEQ ID NO: 4261776 - DNA, 15 bp, Homo sapiens
cagaactaccaaaat

SEQ ID NO: 4261777 - DNA, 16 bp, Homo sapiens
cagaactgagctcctc

SEQ ID NO: 4261778 - DNA, 20 bp, Homo sapiens
cagaactgagctcctctggg

SEQ ID NO: 4261779 - DNA, 23 bp, Homo sapiens
cagaactgagctcctctgggcag

SEQ ID NO: 4261780 - DNA, 24 bp, Homo sapiens
cagaactgagctcctctgggcagg

SEQ ID NO: 4261781 - DNA, 15 bp, Homo sapiens
cagcagaaggccttg

SEQ ID NO: 4261782 - DNA, 15 bp, Homo sapiens
cagcagagccatctg

SEQ ID NO: 4261783 - DNA, 10 bp, Homo sapiens
cagcagcaca

SEQ ID NO: 4261784 - DNA, 21 bp, Homo sapiens
cagcagcacaattctgtccct

SEQ ID NO: 4261785 - DNA, 23 bp, Homo sapiens
cagcagcacaattctgtccctgt

SEQ ID NO: 4261786 - DNA, 15 bp, Homo sapiens
cagcagcggcccaga

SEQ ID NO: 4261787 - DNA, 16 bp, Homo sapiens
cagcagcggcccagat

SEQ ID NO: 4261788 - DNA, 16 bp, Homo sapiens
cagcagggcgggccag

SEQ ID NO: 4261789 - DNA, 19 bp, Homo sapiens
cagcagggcgggccaggag

SEQ ID NO: 4261790 - DNA, 20 bp, Homo sapiens
cagcagggcgggccaggaga

SEQ ID NO: 4261791 - DNA, 18 bp, Homo sapiens
cagcagtacttgctcaat

SEQ ID NO: 4261792 - DNA, 22 bp, Homo sapiens
cagcagtgtgagggtgcaggga

SEQ ID NO: 4261793 - DNA, 21 bp, Homo sapiens
cagcagttttcttttaatttt

SEQ ID NO: 4261794 - DNA, 17 bp, Homo sapiens
cagcatcaacctaggag

SEQ ID NO: 4261795 - DNA, 20 bp, Homo sapiens
cagcatcaacctaggagcag

SEQ ID NO: 4261796 - DNA, 18 bp, Homo sapiens
cagcatcgtgtgggtccc

SEQ ID NO: 4261797 - DNA, 20 bp, Homo sapiens
cagcatgtgttaatcttaat

SEQ ID NO: 4261798 - DNA, 14 bp, Homo sapiens
cagcattcaaaata

SEQ ID NO: 4261799 - DNA, 15 bp, Homo sapiens
cagcattcaaaatag

SEQ ID NO: 4261800 - DNA, 21 bp, Homo sapiens
cagcattcaaaatagttctat

SEQ ID NO: 4261801 - DNA, 19 bp, Homo sapiens
cagccaccaaggctgcctg

SEQ ID NO: 4261802 - DNA, 21 bp, Homo sapiens
cagccaccaaggctgcctgcc

SEQ ID NO: 4261803 - DNA, 20 bp, Homo sapiens
cagccacccggatctccagg

SEQ ID NO: 4261804 - DNA, 15 bp, Homo sapiens
cagccaccctgccat

SEQ ID NO: 4261805 - DNA, 17 bp, Homo sapiens
cagccaccctgccatgg

SEQ ID NO: 4261806 - DNA, 17 bp, Homo sapiens
cagccacgcctctctca

SEQ ID NO: 4261807 - DNA, 18 bp, Homo sapiens
cagccacgcctctctcag

SEQ ID NO: 4261808 - DNA, 16 bp, Homo sapiens
cagccactcccagggg

SEQ ID NO: 4261809 - DNA, 23 bp, Homo sapiens
cagccagaaactgaactggccgc

SEQ ID NO: 4261810 - DNA, 12 bp, Homo sapiens
cagccagcaggt

SEQ ID NO: 4261811 - DNA, 19 bp, Homo sapiens
gccagattaggcctggagt

SEQ ID NO: 4261812 - DNA, 23 bp, Homo sapiens
gccagcaggttctctcctgtgag

SEQ ID NO: 4261813 - DNA, 11 bp, Homo sapiens
gccagcccctc

SEQ ID NO: 4261814 - DNA, 21 bp, Homo sapiens
gccagcccctcccaccacagc

SEQ ID NO: 4261815 - DNA, 14 bp, Homo sapiens
gccagccctggttc

SEQ ID NO: 4261816 - DNA, 19 bp, Homo sapiens
gccagccgctggtgcccac

SEQ ID NO: 4261817 - DNA, 10 bp, Homo sapiens
gccagctccc

SEQ ID NO: 4261818 - DNA, 20 bp, Homo sapiens
gccagctgcttctgcccacc

SEQ ID NO: 4261819 - DNA, 10 bp, Homo sapiens
gccaggagac

SEQ ID NO: 4261820 - DNA, 17 bp, Homo sapiens
gccaggagaccctgtct

SEQ ID NO: 4261821 - DNA, 19 bp, Homo sapiens
gccaggagtgggtgggaca

SEQ ID NO: 4261822 - DNA, 22 bp, Homo sapiens
gccaggagtgggtgggacacag

SEQ ID NO: 4261823 - DNA, 20 bp, Homo sapiens
gccaggcctcagggaccaag

SEQ ID NO: 4261824 - DNA, 13 bp, Homo sapiens
gccagggctctgg

SEQ ID NO: 4261825 - DNA, 14 bp, Homo sapiens
gccagggctgtcct

SEQ ID NO: 4261826 - DNA, 15 bp, Homo sapiens
gccagggctgtcctt

SEQ ID NO: 4261827 - DNA, 16 bp, Homo sapiens
gccagggctgtcctta

SEQ ID NO: 4261828 - DNA, 15 bp, Homo sapiens
gccagggttccagac

SEQ ID NO: 4261829 - DNA, 17 bp, Homo sapiens
gccagtcactccgtttt

SEQ ID NO: 4261830 - DNA, 15 bp, Homo sapiens
gccagtgactccagg

SEQ ID NO: 4261831 - DNA, 17 bp, Homo sapiens
gccatcagcccctgctg

SEQ ID NO: 4261832 - DNA, 19 bp, Homo sapiens
gccatcagcccctgctgct

SEQ ID NO: 4261833 - DNA, 19 bp, Homo sapiens
gccatccggcccccagagc

SEQ ID NO: 4261834 - DNA, 22 bp, Homo sapiens
gccatctgcgacaccaccaaca

SEQ ID NO: 4261835 - DNA, 23 bp, Homo sapiens
gccatgactagggtcctcaggca

SEQ ID NO: 4261836 - DNA, 18 bp, Homo sapiens
gccatgagctccagaccc

SEQ ID NO: 4261837 - DNA, 22 bp, Homo sapiens
gccatgagctccagacccccag

SEQ ID NO: 4261838 - DNA, 20 bp, Homo sapiens
gccatgaggcctcagtggac

SEQ ID NO: 4261839 - DNA, 22 bp, Homo sapiens
gccatgatgtggagtggggcag

SEQ ID NO: 4261840 - DNA, 20 bp, Homo sapiens
gccatgattcgcccaaagcc

SEQ ID NO: 4261841 - DNA, 22 bp, Homo sapiens
gccatgattttggccactttgc

SEQ ID NO: 4261842 - DNA, 23 bp, Homo sapiens
gccatggaagctggcaggagaca

SEQ ID NO: 4261843 - DNA, 18 bp, Homo sapiens
gccatggactctacactg

SEQ ID NO: 4261844 - DNA, 23 bp, Homo sapiens
gccatggactctacactgtgaac

SEQ ID NO: 4261845 - DNA, 16 bp, Homo sapiens
gccatggaggcgcctt

SEQ ID NO: 4261846 - DNA, 19 bp, Homo sapiens
gccatggtgttggaggggc

SEQ ID NO: 4261847 - DNA, 22 bp, Homo sapiens
gccatggtgttggaggggcagg

SEQ ID NO: 4261848 - DNA, 15 bp, Homo sapiens
gccatgtgctgtgca

SEQ ID NO: 4261849 - DNA, 22 bp, Homo sapiens
gccattagactgaatttaacta

SEQ ID NO: 4261850 - DNA, 18 bp, Homo sapiens
gccattttgtctggctgt

SEQ ID NO: 4261851 - DNA, 15 bp, Homo sapiens
gcccaatcactgcct

SEQ ID NO: 4261852 - DNA, 18 bp, Homo sapiens
gcccacatccattccaga

SEQ ID NO: 4261853 - DNA, 15 bp, Homo sapiens
gcccaccagctggct

SEQ ID NO: 4261854 - DNA, 21 bp, Homo sapiens
gcccaccagctggctctgcag

SEQ ID NO: 4261855 - DNA, 15 bp, Homo sapiens
gcccacccccctcat

SEQ ID NO: 4261856 - DNA, 17 bp, Homo sapiens
gcccaccccgcctctgg

SEQ ID NO: 4261857 - DNA, 19 bp, Homo sapiens
gcccacccctcttccccct

SEQ ID NO: 4261858 - DNA, 15 bp, Homo sapiens
gcccacgctcctgcc

SEQ ID NO: 4261859 - DNA, 16 bp, Homo sapiens
gcccagagagaccctg

SEQ ID NO: 4261860 - DNA, 19 bp, Homo sapiens
gcccagaggggcggggcca

SEQ ID NO: 4261861 - DNA, 20 bp, Homo sapiens
gcccagaggggcggggccag

SEQ ID NO: 4261862 - DNA, 21 bp, Homo sapiens
gcccagaggggcggggccagg

SEQ ID NO: 4261863 - DNA, 22 bp, Homo sapiens
gcccagaggggcggggccagga

SEQ ID NO: 4261864 - DNA, 18 bp, Homo sapiens
gcccagatggctccctgg

SEQ ID NO: 4261865 - DNA, 21 bp, Homo sapiens
gcccagatggctccctgggct

SEQ ID NO: 4261866 - DNA, 14 bp, Homo sapiens
gcccagcctggccc

SEQ ID NO: 4261867 - DNA, 22 bp, Homo sapiens
gcccagcctgtggcctcagcat

SEQ ID NO: 4261868 - DNA, 19 bp, Homo sapiens
gcccaggagagcccccacc

SEQ ID NO: 4261869 - DNA, 15 bp, Homo sapiens
gcccaggaggacctg

SEQ ID NO: 4261870 - DNA, 19 bp, Homo sapiens
gcccagggttcccccagcc

SEQ ID NO: 4261871 - DNA, 21 bp, Homo sapiens
gcccagggttcccccagccct

SEQ ID NO: 4261872 - DNA, 23 bp, Homo sapiens
gcccagggttcccccagccctgt

SEQ ID NO: 4261873 - DNA, 13 bp, Homo sapiens
gcccaggtctcct

SEQ ID NO: 4261874 - DNA, 17 bp, Homo sapiens
gcccagtcttgagtggg

SEQ ID NO: 4261875 - DNA, 21 bp, Homo sapiens
gccccaaaaccacagccctgt

SEQ ID NO: 4261876 - DNA, 21 bp, Homo sapiens
gccccacacaggcctggccca

SEQ ID NO: 4261877 - DNA, 13 bp, Homo sapiens
gccccactctgct

SEQ ID NO: 4261878 - DNA, 14 bp, Homo sapiens
gccccactctgctg

SEQ ID NO: 4261879 - DNA, 22 bp, Homo sapiens
gccccagaaatgccgctgtgtc

SEQ ID NO: 4261880 - DNA, 11 bp, Homo sapiens
gccccagagaa

SEQ ID NO: 4261881 - DNA, 18 bp, Homo sapiens
gccccagagaagcctcag

SEQ ID NO: 4261882 - DNA, 21 bp, Homo sapiens
gccccagagaagcctcagtcc

SEQ ID NO: 4261883 - DNA, 11 bp, Homo sapiens
gccccagagac

SEQ ID NO: 4261884 - DNA, 21 bp, Homo sapiens
gccccagcgagtctggagacc

SEQ ID NO: 4261885 - DNA, 12 bp, Homo sapiens
gccccaggcagg

SEQ ID NO: 4261886 - DNA, 19 bp, Homo sapiens
gccccaggcaggctgtgcg

SEQ ID NO: 4261887 - DNA, 12 bp, Homo sapiens
gccccaggcctc

SEQ ID NO: 4261888 - DNA, 22 bp, Homo sapiens
gccccaggcctccctcccccgg

SEQ ID NO: 4261889 - DNA, 18 bp, Homo sapiens
gccccagggccctgctca

SEQ ID NO: 4261890 - DNA, 19 bp, Homo sapiens
gccccagggccctgctcag

SEQ ID NO: 4261891 - DNA, 15 bp, Homo sapiens
gcccccacaggagcg

SEQ ID NO: 4261892 - DNA, 21 bp, Homo sapiens
gcccccacaggagcgtgtcct

SEQ ID NO: 4261893 - DNA, 16 bp, Homo sapiens
gcccccaccagcagca

SEQ ID NO: 4261894 - DNA, 14 bp, Homo sapiens
gcccccagacccca

SEQ ID NO: 4261895 - DNA, 17 bp, Homo sapiens
gcccccagaccccatcc

SEQ ID NO: 4261896 - DNA, 16 bp, Homo sapiens
gcccccagctgctcct

SEQ ID NO: 4261897 - DNA, 13 bp, Homo sapiens
gccccccacccca

SEQ ID NO: 4261898 - DNA, 14 bp, Homo sapiens
gccccccaccccag

SEQ ID NO: 4261899 - DNA, 12 bp, Homo sapiens
gccccccagagc

SEQ ID NO: 4261900 - DNA, 18 bp, Homo sapiens
gccccccagagccagggc

SEQ ID NO: 4261901 - DNA, 20 bp, Homo sapiens
gccccccagagccagggctg

SEQ ID NO: 4261902 - DNA, 23 bp, Homo sapiens
gccccccagagccagggctgtcc

SEQ ID NO: 4261903 - DNA, 13 bp, Homo sapiens
gcccccgagctgg

SEQ ID NO: 4261904 - DNA, 11 bp, Homo sapiens
gcccccgcccc

SEQ ID NO: 4261905 - DNA, 16 bp, Homo sapiens
gcccccgccccgcccc

SEQ ID NO: 4261906 - DNA, 16 bp, Homo sapiens
gcccccgccctctgcc

SEQ ID NO: 4261907 - DNA, 17 bp, Homo sapiens
gccccctcctgacccca

SEQ ID NO: 4261908 - DNA, 15 bp, Homo sapiens
gccccctggcccctc

SEQ ID NO: 4261909 - DNA, 20 bp, Homo sapiens
gccccctggcccctcccaca

SEQ ID NO: 4261910 - DNA, 22 bp, Homo sapiens
gccccctggggggcacagccag

SEQ ID NO: 4261911 - DNA, 15 bp, Homo sapiens
gcccccttctcccac

SEQ ID NO: 4261912 - DNA, 16 bp, Homo sapiens
gcccccttctcccaca

SEQ ID NO: 4261913 - DNA, 16 bp, Homo sapiens
gccccgccccccagag

SEQ ID NO: 4261914 - DNA, 20 bp, Homo sapiens
gccccgccccccagagccag

SEQ ID NO: 4261915 - DNA, 21 bp, Homo sapiens
gccccgccccccagagccagg

SEQ ID NO: 4261916 - DNA, 13 bp, Homo sapiens
gccccgccgtgtc

SEQ ID NO: 4261917 - DNA, 13 bp, Homo sapiens
gccccggccactc

SEQ ID NO: 4261918 - DNA, 17 bp, Homo sapiens
gccccggccactctgtt

SEQ ID NO: 4261919 - DNA, 19 bp, Homo sapiens
gccccggccactctgtttg

SEQ ID NO: 4261920 - DNA, 15 bp, Homo sapiens
gccccgtcaccatct

SEQ ID NO: 4261921 - DNA, 20 bp, Homo sapiens
gcccctagaatcagcctagg

SEQ ID NO: 4261922 - DNA, 18 bp, Homo sapiens
gcccctatcctgcaccct

SEQ ID NO: 4261923 - DNA, 22 bp, Homo sapiens
gcccctatcctgcaccctctgc

SEQ ID NO: 4261924 - DNA, 20 bp, Homo sapiens
gcccctcacctgggcacctg

SEQ ID NO: 4261925 - DNA, 17 bp, Homo sapiens
gcccctcactggctgga

SEQ ID NO: 4261926 - DNA, 19 bp, Homo sapiens
gcccctcactggctggact

SEQ ID NO: 4261927 - DNA, 15 bp, Homo sapiens
gcccctcccaccaca

SEQ ID NO: 4261928 - DNA, 15 bp, Homo sapiens
gcccctcccttcaac

SEQ ID NO: 4261929 - DNA, 13 bp, Homo sapiens
gcccctccttctc

SEQ ID NO: 4261930 - DNA, 16 bp, Homo sapiens
gcccctccttctcccc

SEQ ID NO: 4261931 - DNA, 19 bp, Homo sapiens
gcccctccttctcccctcc

SEQ ID NO: 4261932 - DNA, 21 bp, Homo sapiens
gcccctccttctcccctccag

SEQ ID NO: 4261933 - DNA, 18 bp, Homo sapiens
gcccctcttgccccccac

SEQ ID NO: 4261934 - DNA, 17 bp, Homo sapiens
gcccctgaagtgacccc

SEQ ID NO: 4261935 - DNA, 18 bp, Homo sapiens
gcccctgaagtgacccca

SEQ ID NO: 4261936 - DNA, 16 bp, Homo sapiens
gcccctgccccgtcac

SEQ ID NO: 4261937 - DNA, 19 bp, Homo sapiens
gcccctgctgcctccccaa

SEQ ID NO: 4261938 - DNA, 20 bp, Homo sapiens
gcccctgctgcctccccaac

SEQ ID NO: 4261939 - DNA, 23 bp, Homo sapiens
gcccctgctgctcctcggccaga

SEQ ID NO: 4261940 - DNA, 20 bp, Homo sapiens
gccccttcacttctgaccac

SEQ ID NO: 4261941 - DNA, 12 bp, Homo sapiens
gccccttccccc

SEQ ID NO: 4261942 - DNA, 16 bp, Homo sapiens
gcccctttttactccc

SEQ ID NO: 4261943 - DNA, 13 bp, Homo sapiens
gcccgcccacctg

SEQ ID NO: 4261944 - DNA, 15 bp, Homo sapiens
gcaggggctgggcag

SEQ ID NO: 4261945 - DNA, 13 bp, Homo sapiens
gcaggggggttgg

SEQ ID NO: 4261946 - DNA, 21 bp, Homo sapiens
gcaggggggttgggttccaga

SEQ ID NO: 4261947 - DNA, 22 bp, Homo sapiens
gcaggggggttgggttccagac

SEQ ID NO: 4261948 - DNA, 23 bp, Homo sapiens
gcaggggggttgggttccagaca

SEQ ID NO: 4261949 - DNA, 18 bp, Homo sapiens
gcagggtctttgtgtgct

SEQ ID NO: 4261950 - DNA, 14 bp, Homo sapiens
gcagggttctagaa

SEQ ID NO: 4261951 - DNA, 12 bp, Homo sapiens
gcaggtggccag

SEQ ID NO: 4261952 - DNA, 16 bp, Homo sapiens
gcaggtgtgggctccc

SEQ ID NO: 4261953 - DNA, 18 bp, Homo sapiens
gcaggtgtgggctcccac

SEQ ID NO: 4261954 - DNA, 19 bp, Homo sapiens
gcaggttctctcctgtgag

SEQ ID NO: 4261955 - DNA, 14 bp, Homo sapiens
gcagtacttgctca

SEQ ID NO: 4261956 - DNA, 21 bp, Homo sapiens
gcagtacttgctcaataaagg

SEQ ID NO: 4261957 - DNA, 18 bp, Homo sapiens
gcagtcagcacagagagc

SEQ ID NO: 4261958 - DNA, 19 bp, Homo sapiens
gcagtcagcacagagagcg

SEQ ID NO: 4261959 - DNA, 22 bp, Homo sapiens
gcagtcagcacagagagcggct

SEQ ID NO: 4261960 - DNA, 14 bp, Homo sapiens
gcagtcatcagaag

SEQ ID NO: 4261961 - DNA, 11 bp, Homo sapiens
gcagtcctggg

SEQ ID NO: 4261962 - DNA, 12 bp, Homo sapiens
gcagtcctgggc

SEQ ID NO: 4261963 - DNA, 18 bp, Homo sapiens
gcagtgacgtgagtgggg

SEQ ID NO: 4261964 - DNA, 19 bp, Homo sapiens
gcagtgcaccccctaaaga

SEQ ID NO: 4261965 - DNA, 13 bp, Homo sapiens
gcagtgcctctgg

SEQ ID NO: 4261966 - DNA, 17 bp, Homo sapiens
gcagtgcctctggtctg

SEQ ID NO: 4261967 - DNA, 13 bp, Homo sapiens
gcagtggagaggg

SEQ ID NO: 4261968 - DNA, 17 bp, Homo sapiens
gcagtggagaggggact

SEQ ID NO: 4261969 - DNA, 22 bp, Homo sapiens
gcagtggcttggagcagaggtg

SEQ ID NO: 4261970 - DNA, 17 bp, Homo sapiens
gcagtgggccctggctc

SEQ ID NO: 4261971 - DNA, 18 bp, Homo sapiens
gcagtgggccctggctct

SEQ ID NO: 4261972 - DNA, 20 bp, Homo sapiens
gcagtgggccctggctctgt

SEQ ID NO: 4261973 - DNA, 12 bp, Homo sapiens
gcagtgtgaggg

SEQ ID NO: 4261974 - DNA, 17 bp, Homo sapiens
gcagttggcctcagcag

SEQ ID NO: 4261975 - DNA, 14 bp, Homo sapiens
gcatattgactttt

SEQ ID NO: 4261976 - DNA, 18 bp, Homo sapiens
gcatcaacctaggagcag

SEQ ID NO: 4261977 - DNA, 20 bp, Homo sapiens
gcatcccagtggcctcaacc

SEQ ID NO: 4261978 - DNA, 18 bp, Homo sapiens
gcatccccagccccctgg

SEQ ID NO: 4261979 - DNA, 14 bp, Homo sapiens
gcatccctccaccc

SEQ ID NO: 4261980 - DNA, 21 bp, Homo sapiens
gcatccctccaccccagtccc

SEQ ID NO: 4261981 - DNA, 20 bp, Homo sapiens
gcatcccttggcccctctct

SEQ ID NO: 4261982 - DNA, 19 bp, Homo sapiens
gcatcctcagccccagggc

SEQ ID NO: 4261983 - DNA, 15 bp, Homo sapiens
gcatccttgaggacc

SEQ ID NO: 4261984 - DNA, 12 bp, Homo sapiens
gcatctcagccc

SEQ ID NO: 4261985 - DNA, 14 bp, Homo sapiens
gcatctcagcccac

SEQ ID NO: 4261986 - DNA, 15 bp, Homo sapiens
gcatctcagcccaca

SEQ ID NO: 4261987 - DNA, 22 bp, Homo sapiens
gcatctcagctcatcttcactg

SEQ ID NO: 4261988 - DNA, 12 bp, Homo sapiens
gcatctccagga

SEQ ID NO: 4261989 - DNA, 21 bp, Homo sapiens
gcatctggctaaggcatcatt

SEQ ID NO: 4261990 - DNA, 16 bp, Homo sapiens
gcatcttagggtaggg

SEQ ID NO: 4261991 - DNA, 20 bp, Homo sapiens
gcatgaaaggtaatctgaaa

SEQ ID NO: 4261992 - DNA, 21 bp, Homo sapiens
gcatgaaaggtaatctgaaac

SEQ ID NO: 4261993 - DNA, 13 bp, Homo sapiens
gcatgaagataaa

SEQ ID NO: 4261994 - DNA, 18 bp, Homo sapiens
gcatgacaagccccaggc

SEQ ID NO: 4261995 - DNA, 13 bp, Homo sapiens
gcatgaccctgga

SEQ ID NO: 4261996 - DNA, 15 bp, Homo sapiens
gcatgaccctggagc

SEQ ID NO: 4261997 - DNA, 14 bp, Homo sapiens
gcatgcaagctcag

SEQ ID NO: 4261998 - DNA, 22 bp, Homo sapiens
gcatgcagggcccccatgcagg

SEQ ID NO: 4261999 - DNA, 18 bp, Homo sapiens
gcatgccgagtgccccag

SEQ ID NO: 4262000 - DNA, 15 bp, Homo sapiens
gcatgcctgtgtgac

SEQ ID NO: 4262001 - DNA, 15 bp, Homo sapiens
gcatgctcctctgcc

SEQ ID NO: 4262002 - DNA, 12 bp, Homo sapiens
gcatgctgcctg

SEQ ID NO: 4262003 - DNA, 14 bp, Homo sapiens
gcatgctgcctgcc

SEQ ID NO: 4262004 - DNA, 21 bp, Homo sapiens
gcatgctgcctgcctccggcc

SEQ ID NO: 4262005 - DNA, 17 bp, Homo sapiens
gcatggacagggccagg

SEQ ID NO: 4262006 - DNA, 13 bp, Homo sapiens
gcatggccaggtg

SEQ ID NO: 4262007 - DNA, 14 bp, Homo sapiens
gcatggctccagtc

SEQ ID NO: 4262008 - DNA, 22 bp, Homo sapiens
gcatggctccagtctgctgccc

SEQ ID NO: 4262009 - DNA, 15 bp, Homo sapiens
gcatgtaagaaataa

SEQ ID NO: 4262010 - DNA, 13 bp, Homo sapiens
gcatgtctactgc

SEQ ID NO: 4262011 - DNA, 14 bp, Homo sapiens
gcatgtctactgct

SEQ ID NO: 4262012 - DNA, 11 bp, Homo sapiens
gcatgtctgca

SEQ ID NO: 4262013 - DNA, 22 bp, Homo sapiens
gcatgtctgggtcgtcttttga

SEQ ID NO: 4262014 - DNA, 20 bp, Homo sapiens
gcatgtgattggcagcttca

SEQ ID NO: 4262015 - DNA, 22 bp, Homo sapiens
gcatgtgtttggttctggggcc

SEQ ID NO: 4262016 - DNA, 23 bp, Homo sapiens
gcatgtttcccgctccaagagaa

SEQ ID NO: 4262017 - DNA, 23 bp, Homo sapiens
gcattaaattttagcaaagatat

SEQ ID NO: 4262018 - DNA, 13 bp, Homo sapiens
gcattctcactcc

SEQ ID NO: 4262019 - DNA, 21 bp, Homo sapiens
gcattctccccagtgtatgtc

SEQ ID NO: 4262020 - DNA, 19 bp, Homo sapiens
gcattctggggtggggctt

SEQ ID NO: 4262021 - DNA, 22 bp, Homo sapiens
gcattctggggtggggcttgga

SEQ ID NO: 4262022 - DNA, 12 bp, Homo sapiens
gcatttaaaatg

SEQ ID NO: 4262023 - DNA, 20 bp, Homo sapiens
gcatttcttgatgttgctta

SEQ ID NO: 4262024 - DNA, 12 bp, Homo sapiens
gcattttaccat

SEQ ID NO: 4262025 - DNA, 13 bp, Homo sapiens
gccaaacacttta

SEQ ID NO: 4262026 - DNA, 16 bp, Homo sapiens
gccaaatcctgggcat

SEQ ID NO: 4262027 - DNA, 12 bp, Homo sapiens
gccaaccccagc

SEQ ID NO: 4262028 - DNA, 21 bp, Homo sapiens
gccaaccccagcagtcctggg

SEQ ID NO: 4262029 - DNA, 15 bp, Homo sapiens
gccaacccctgtgga

SEQ ID NO: 4262030 - DNA, 15 bp, Homo sapiens
gccaactttccagac

SEQ ID NO: 4262031 - DNA, 12 bp, Homo sapiens
gccaagccaggg

SEQ ID NO: 4262032 - DNA, 20 bp, Homo sapiens
gccaagccagggttccagac

SEQ ID NO: 4262033 - DNA, 21 bp, Homo sapiens
gccaaggcctatgccacctgc

SEQ ID NO: 4262034 - DNA, 22 bp, Homo sapiens
gccaaggcctatgccacctgca

SEQ ID NO: 4262035 - DNA, 22 bp, Homo sapiens
gccaagtcagctttgccttcca

SEQ ID NO: 4262036 - DNA, 15 bp, Homo sapiens
gccaagtgcaggctg

SEQ ID NO: 4262037 - DNA, 16 bp, Homo sapiens
gccaatggagactgtc

SEQ ID NO: 4262038 - DNA, 20 bp, Homo sapiens
gccaatttctcttaagtact

SEQ ID NO: 4262039 - DNA, 22 bp, Homo sapiens
gccacacttcaggctcttctcc

SEQ ID NO: 4262040 - DNA, 16 bp, Homo sapiens
gccacatgagtcccag

SEQ ID NO: 4262041 - DNA, 18 bp, Homo sapiens
gccaccaaggctgcctgc

SEQ ID NO: 4262042 - DNA, 13 bp, Homo sapiens
gccaccacctgga

SEQ ID NO: 4262043 - DNA, 23 bp, Homo sapiens
gccaccatgtatgtggaagcagg

SEQ ID NO: 4262044 - DNA, 20 bp, Homo sapiens
gccaccctctgcagggcagc

SEQ ID NO: 4262045 - DNA, 21 bp, Homo sapiens
gccaccctctgcagggcagcc

SEQ ID NO: 4262046 - DNA, 13 bp, Homo sapiens
gccaccctgccat

SEQ ID NO: 4262047 - DNA, 13 bp, Homo sapiens
gccacccttggcc

SEQ ID NO: 4262048 - DNA, 21 bp, Homo sapiens
gccacctgcccccttctccca

SEQ ID NO: 4262049 - DNA, 23 bp, Homo sapiens
gccacgcctctctcagcccaggt

SEQ ID NO: 4262050 - DNA, 23 bp, Homo sapiens
gccacgcctgcgatggtgctgca

SEQ ID NO: 4262051 - DNA, 17 bp, Homo sapiens
gccacgcgctctgcatg

SEQ ID NO: 4262052 - DNA, 18 bp, Homo sapiens
gccacgcgctctgcatgc

SEQ ID NO: 4262053 - DNA, 20 bp, Homo sapiens
gccacgcgctctgcatgctc

SEQ ID NO: 4262054 - DNA, 15 bp, Homo sapiens
gccacggcagccacc

SEQ ID NO: 4262055 - DNA, 18 bp, Homo sapiens
gccacggcagccaccctg

SEQ ID NO: 4262056 - DNA, 22 bp, Homo sapiens
gccacgggggaggccgaggcag

SEQ ID NO: 4262057 - DNA, 17 bp, Homo sapiens
gccactcaggcagcctg

SEQ ID NO: 4262058 - DNA, 22 bp, Homo sapiens
gccactccagacccctggcttt

SEQ ID NO: 4262059 - DNA, 13 bp, Homo sapiens
gccactctcctga

SEQ ID NO: 4262060 - DNA, 15 bp, Homo sapiens
gccactctcctgagg

SEQ ID NO: 4262061 - DNA, 19 bp, Homo sapiens
gccactctcctgaggagca

SEQ ID NO: 4262062 - DNA, 21 bp, Homo sapiens
gccactgcagtcacccctgtc

SEQ ID NO: 4262063 - DNA, 24 bp, Homo sapiens
gccactgcagtcacccctgtctgc

SEQ ID NO: 4262064 - DNA, 16 bp, Homo sapiens
gccactggcatctctg

SEQ ID NO: 4262065 - DNA, 16 bp, Homo sapiens
gccacttatttccatg

SEQ ID NO: 4262066 - DNA, 16 bp, Homo sapiens
gccactttgcagacct

SEQ ID NO: 4262067 - DNA, 18 bp, Homo sapiens
gccactttgcagacctgg

SEQ ID NO: 4262068 - DNA, 23 bp, Homo sapiens
gccactttgcagacctgggactt

SEQ ID NO: 4262069 - DNA, 18 bp, Homo sapiens
gccagaagggggccatga

SEQ ID NO: 4262070 - DNA, 15 bp, Homo sapiens
gccagagctcccagg

SEQ ID NO: 4262071 - DNA, 17 bp, Homo sapiens
gccagaggcctggtgcc

SEQ ID NO: 4262072 - DNA, 16 bp, Homo sapiens
gccagagggcccctca

SEQ ID NO: 4262073 - DNA, 17 bp, Homo sapiens
gccagatgacagggagc

SEQ ID NO: 4262074 - DNA, 14 bp, Homo sapiens
gccagatggggcct

SEQ ID NO: 4262075 - DNA, 17 bp, Homo sapiens
gccagatggggcctctg

SEQ ID NO: 4262076 - DNA, 18 bp, Homo sapiens
gccagatggggcctctgt

SEQ ID NO: 4262077 - DNA, 18 bp, Homo sapiens
gccagattaggcctggag

SEQ ID NO: 4262078 - DNA, 16 bp, Homo sapiens
gaggaagccacgtgct

SEQ ID NO: 4262079 - DNA, 14 bp, Homo sapiens
gaggaagggactgg

SEQ ID NO: 4262080 - DNA, 14 bp, Homo sapiens
gaggaagggaggcc

SEQ ID NO: 4262081 - DNA, 17 bp, Homo sapiens
gaggaagggaggcctga

SEQ ID NO: 4262082 - DNA, 20 bp, Homo sapiens
gaggaatcgaggaaccagag

SEQ ID NO: 4262083 - DNA, 13 bp, Homo sapiens
gaggaatgctccc

SEQ ID NO: 4262084 - DNA, 15 bp, Homo sapiens
gaggaatgctccccc

SEQ ID NO: 4262085 - DNA, 14 bp, Homo sapiens
gaggacagcttccc

SEQ ID NO: 4262086 - DNA, 22 bp, Homo sapiens
gaggacaggtggaggcgagcca

SEQ ID NO: 4262087 - DNA, 17 bp, Homo sapiens
gaggacctccacctggg

SEQ ID NO: 4262088 - DNA, 14 bp, Homo sapiens
gaggagacagtcag

SEQ ID NO: 4262089 - DNA, 16 bp, Homo sapiens
gaggagactcaggccc

SEQ ID NO: 4262090 - DNA, 20 bp, Homo sapiens
gaggagcagcccacctgctg

SEQ ID NO: 4262091 - DNA, 13 bp, Homo sapiens
gaggagcaggaag

SEQ ID NO: 4262092 - DNA, 17 bp, Homo sapiens
gaggagctcagggctgg

SEQ ID NO: 4262093 - DNA, 13 bp, Homo sapiens
gaggaggatccgg

SEQ ID NO: 4262094 - DNA, 20 bp, Homo sapiens
gaggagggatagagacgcag

SEQ ID NO: 4262095 - DNA, 13 bp, Homo sapiens
gaggaggtgcccg

SEQ ID NO: 4262096 - DNA, 21 bp, Homo sapiens
gaggatggcttccccattgcc

SEQ ID NO: 4262097 - DNA, 11 bp, Homo sapiens
gaggcagagga

SEQ ID NO: 4262098 - DNA, 15 bp, Homo sapiens
gaggcagcaacagga

SEQ ID NO: 4262099 - DNA, 19 bp, Homo sapiens
gaggcaggggctgggcaga

SEQ ID NO: 4262100 - DNA, 14 bp, Homo sapiens
gaggcagtggcagc

SEQ ID NO: 4262101 - DNA, 15 bp, Homo sapiens
gaggccaagtgcagg

SEQ ID NO: 4262102 - DNA, 17 bp, Homo sapiens
gaggccaagtgcaggct

SEQ ID NO: 4262103 - DNA, 10 bp, Homo sapiens
gaggccacgg

SEQ ID NO: 4262104 - DNA, 12 bp, Homo sapiens
gaggcccaggga

SEQ ID NO: 4262105 - DNA, 17 bp, Homo sapiens
gaggccccttgctgctg

SEQ ID NO: 4262106 - DNA, 16 bp, Homo sapiens
gaggccgaggcagggg

SEQ ID NO: 4262107 - DNA, 23 bp, Homo sapiens
gaggcctctgcaagattctgtgg

SEQ ID NO: 4262108 - DNA, 12 bp, Homo sapiens
gaggcctgaggg

SEQ ID NO: 4262109 - DNA, 14 bp, Homo sapiens
gaggcctgaggggc

SEQ ID NO: 4262110 - DNA, 10 bp, Homo sapiens
gaggcctggt

SEQ ID NO: 4262111 - DNA, 12 bp, Homo sapiens
gaggcctggtct

SEQ ID NO: 4262112 - DNA, 13 bp, Homo sapiens
gaggcctggtctg

SEQ ID NO: 4262113 - DNA, 15 bp, Homo sapiens
gaggcctggtctgga

SEQ ID NO: 4262114 - DNA, 19 bp, Homo sapiens
gaggcctggtctggagccc

SEQ ID NO: 4262115 - DNA, 20 bp, Homo sapiens
gaggcctggtgccctggccc

SEQ ID NO: 4262116 - DNA, 21 bp, Homo sapiens
gaggcctggtgccctggccca

SEQ ID NO: 4262117 - DNA, 12 bp, Homo sapiens
gaggcgagccag

SEQ ID NO: 4262118 - DNA, 23 bp, Homo sapiens
gaggcgagccagattaggcctgg

SEQ ID NO: 4262119 - DNA, 14 bp, Homo sapiens
gaggcgtcttgtat

SEQ ID NO: 4262120 - DNA, 16 bp, Homo sapiens
gaggcgtcttgtattt

SEQ ID NO: 4262121 - DNA, 16 bp, Homo sapiens
gaggcgtgggatccag

SEQ ID NO: 4262122 - DNA, 13 bp, Homo sapiens
gaggctaagcctg

SEQ ID NO: 4262123 - DNA, 14 bp, Homo sapiens
gaggctaagcctgg

SEQ ID NO: 4262124 - DNA, 17 bp, Homo sapiens
gaggctaagcctggaca

SEQ ID NO: 4262125 - DNA, 19 bp, Homo sapiens
gaggctgccccaggggcac

SEQ ID NO: 4262126 - DNA, 15 bp, Homo sapiens
gaggctggagctggc

SEQ ID NO: 4262127 - DNA, 21 bp, Homo sapiens
gaggctggggcttttgtgcca

SEQ ID NO: 4262128 - DNA, 14 bp, Homo sapiens
gaggcttccttcat

SEQ ID NO: 4262129 - DNA, 22 bp, Homo sapiens
gagggacagtgggctatgccac

SEQ ID NO: 4262130 - DNA, 18 bp, Homo sapiens
gagggagaaggagaggct

SEQ ID NO: 4262131 - DNA, 12 bp, Homo sapiens
gagggaggcctg

SEQ ID NO: 4262132 - DNA, 16 bp, Homo sapiens
gagggcactggtggcc

SEQ ID NO: 4262133 - DNA, 22 bp, Homo sapiens
gagggcccctcactggctggac

SEQ ID NO: 4262134 - DNA, 16 bp, Homo sapiens
gagggcccttcccaac

SEQ ID NO: 4262135 - DNA, 15 bp, Homo sapiens
gagggcgcttttgta

SEQ ID NO: 4262136 - DNA, 13 bp, Homo sapiens
gaggggacttgga

SEQ ID NO: 4262137 - DNA, 11 bp, Homo sapiens
gaggggagaga

SEQ ID NO: 4262138 - DNA, 12 bp, Homo sapiens
gaggggcaggcc

SEQ ID NO: 4262139 - DNA, 22 bp, Homo sapiens
gaggggcaggcctttttgagcc

SEQ ID NO: 4262140 - DNA, 23 bp, Homo sapiens
gaggggcaggcctttttgagcca

SEQ ID NO: 4262141 - DNA, 17 bp, Homo sapiens
gaggggcggggccagga

SEQ ID NO: 4262142 - DNA, 20 bp, Homo sapiens
gaggggcggggccaggatgg

SEQ ID NO: 4262143 - DNA, 21 bp, Homo sapiens
gaggggcttccctctgctcca

SEQ ID NO: 4262144 - DNA, 15 bp, Homo sapiens
gaggggtctagaggc

SEQ ID NO: 4262145 - DNA, 22 bp, Homo sapiens
gagggtcccaaggcgtgcaggg

SEQ ID NO: 4262146 - DNA, 14 bp, Homo sapiens
gagggtgcagggac

SEQ ID NO: 4262147 - DNA, 16 bp, Homo sapiens
gagggtgcagggacca

SEQ ID NO: 4262148 - DNA, 22 bp, Homo sapiens
gagggtggcacttcgtggatga

SEQ ID NO: 4262149 - DNA, 13 bp, Homo sapiens
gagggtggcaggt

SEQ ID NO: 4262150 - DNA, 12 bp, Homo sapiens
gaggtcccagac

SEQ ID NO: 4262151 - DNA, 21 bp, Homo sapiens
gaggtcccagacatgctgccc

SEQ ID NO: 4262152 - DNA, 23 bp, Homo sapiens
gaggtcccagacatgctgcccac

SEQ ID NO: 4262153 - DNA, 17 bp, Homo sapiens
gaggtgagggaggcctg

SEQ ID NO: 4262154 - DNA, 18 bp, Homo sapiens
gaggtgagggaggcctga

SEQ ID NO: 4262155 - DNA, 16 bp, Homo sapiens
gaggtgcccgggcagg

SEQ ID NO: 4262156 - DNA, 14 bp, Homo sapiens
gaggtgcctgagag

SEQ ID NO: 4262157 - DNA, 22 bp, Homo sapiens
gaggtgcctgagagcagaatga

SEQ ID NO: 4262158 - DNA, 19 bp, Homo sapiens
gaggtgtggagtggagggg

SEQ ID NO: 4262159 - DNA, 20 bp, Homo sapiens
gagtattcattttgcaactt

SEQ ID NO: 4262160 - DNA, 20 bp, Homo sapiens
gagtccagacctgggccctg

SEQ ID NO: 4262161 - DNA, 16 bp, Homo sapiens
gagtcccagtgggagg

SEQ ID NO: 4262162 - DNA, 18 bp, Homo sapiens
gagtcccagtgggaggcg

SEQ ID NO: 4262163 - DNA, 13 bp, Homo sapiens
gagtcctgttctc

SEQ ID NO: 4262164 - DNA, 16 bp, Homo sapiens
gagtcctgttctcaga

SEQ ID NO: 4262165 - DNA, 20 bp, Homo sapiens
gagtcctgttctcagagctc

SEQ ID NO: 4262166 - DNA, 18 bp, Homo sapiens
gagtccttaaacagggca

SEQ ID NO: 4262167 - DNA, 17 bp, Homo sapiens
gagtctcattcctctgt

SEQ ID NO: 4262168 - DNA, 14 bp, Homo sapiens
gagtctcttctcca

SEQ ID NO: 4262169 - DNA, 16 bp, Homo sapiens
gagtctcttctccact

SEQ ID NO: 4262170 - DNA, 18 bp, Homo sapiens
gagtctcttctccactgg

SEQ ID NO: 4262171 - DNA, 15 bp, Homo sapiens
gagtctgaaggagag

SEQ ID NO: 4262172 - DNA, 13 bp, Homo sapiens
gagtgaggccccc

SEQ ID NO: 4262173 - DNA, 20 bp, Homo sapiens
gagtgaggtcatcccggggc

SEQ ID NO: 4262174 - DNA, 22 bp, Homo sapiens
gagtgatatggcttgtagggtg

SEQ ID NO: 4262175 - DNA, 14 bp, Homo sapiens
gagtgcacagctgt

SEQ ID NO: 4262176 - DNA, 19 bp, Homo sapiens
gagtgcccatggggtagaa

SEQ ID NO: 4262177 - DNA, 22 bp, Homo sapiens
gagtgcccttaaaataatgatt

SEQ ID NO: 4262178 - DNA, 23 bp, Homo sapiens
gagtgcccttaaaataatgattt

SEQ ID NO: 4262179 - DNA, 23 bp, Homo sapiens
gagtgctcaacctacagtggagg

SEQ ID NO: 4262180 - DNA, 11 bp, Homo sapiens
gagtgggagag

SEQ ID NO: 4262181 - DNA, 16 bp, Homo sapiens
gagtgggagaggaagc

SEQ ID NO: 4262182 - DNA, 14 bp, Homo sapiens
gagtgggccccctc

SEQ ID NO: 4262183 - DNA, 20 bp, Homo sapiens
gagtggggctagactgggct

SEQ ID NO: 4262184 - DNA, 19 bp, Homo sapiens
gagtgtggagctgcttcca

SEQ ID NO: 4262185 - DNA, 20 bp, Homo sapiens
gagtgtgggggtgccatggt

SEQ ID NO: 4262186 - DNA, 22 bp, Homo sapiens
gagtgtgtgggggtctgggagg

SEQ ID NO: 4262187 - DNA, 14 bp, Homo sapiens
gagttcctgcatgc

SEQ ID NO: 4262188 - DNA, 16 bp, Homo sapiens
gagttctaacacattt

SEQ ID NO: 4262189 - DNA, 17 bp, Homo sapiens
gagttctaacacatttc

SEQ ID NO: 4262190 - DNA, 21 bp, Homo sapiens
gagttgaggggcttccctctg

SEQ ID NO: 4262191 - DNA, 22 bp, Homo sapiens
gagttgaggggcttccctctgc

SEQ ID NO: 4262192 - DNA, 14 bp, Homo sapiens
gagttgggctggtt

SEQ ID NO: 4262193 - DNA, 14 bp, Homo sapiens
gataaagtgaccag

SEQ ID NO: 4262194 - DNA, 16 bp, Homo sapiens
gataacactggagtgg

SEQ ID NO: 4262195 - DNA, 14 bp, Homo sapiens
gataagtggaaaaa

SEQ ID NO: 4262196 - DNA, 15 bp, Homo sapiens
gataataactagatc

SEQ ID NO: 4262197 - DNA, 12 bp, Homo sapiens
gatacagaatga

SEQ ID NO: 4262198 - DNA, 18 bp, Homo sapiens
gataccatatacagctca

SEQ ID NO: 4262199 - DNA, 15 bp, Homo sapiens
gatactgcccggggc

SEQ ID NO: 4262200 - DNA, 14 bp, Homo sapiens
gatacttggtcctt

SEQ ID NO: 4262201 - DNA, 23 bp, Homo sapiens
gatataggtcagtgaggcccagg

SEQ ID NO: 4262202 - DNA, 16 bp, Homo sapiens
gatatatctgaaaact

SEQ ID NO: 4262203 - DNA, 21 bp, Homo sapiens
gatattctaagaaatatctgt

SEQ ID NO: 4262204 - DNA, 20 bp, Homo sapiens
gatattggtgtgaatgctgt

SEQ ID NO: 4262205 - DNA, 19 bp, Homo sapiens
gatattggttctatttatt

SEQ ID NO: 4262206 - DNA, 21 bp, Homo sapiens
gatattttcaacgcagccctg

SEQ ID NO: 4262207 - DNA, 23 bp, Homo sapiens
gatattttcaacgcagccctgct

SEQ ID NO: 4262208 - DNA, 16 bp, Homo sapiens
gatcaaagcaccttga

SEQ ID NO: 4262209 - DNA, 22 bp, Homo sapiens
gatcaatggcgcagtgcctctg

SEQ ID NO: 4262210 - DNA, 23 bp, Homo sapiens
gatcaatggcgcagtgcctctgg

SEQ ID NO: 4262211 - DNA, 14 bp, Homo sapiens
gatcactttctgaa

SEQ ID NO: 4262212 - DNA, 17 bp, Homo sapiens
gatcagcattcaaaata

SEQ ID NO: 4262213 - DNA, 24 bp, Homo sapiens
gatcagcattcaaaatagttctat

SEQ ID NO: 4262214 - DNA, 23 bp, Homo sapiens
gatcagtaaaattatactgtgtg

SEQ ID NO: 4262215 - DNA, 23 bp, Homo sapiens
gatccagatagcctagggtgagg

SEQ ID NO: 4262216 - DNA, 19 bp, Homo sapiens
gatccctagctgtgacctc

SEQ ID NO: 4262217 - DNA, 19 bp, Homo sapiens
gatccgagcgacggctcct

SEQ ID NO: 4262218 - DNA, 20 bp, Homo sapiens
gatcctcaaaaatcatcaaa

SEQ ID NO: 4262219 - DNA, 19 bp, Homo sapiens
gatcctccttccaggcccc

SEQ ID NO: 4262220 - DNA, 13 bp, Homo sapiens
gatccttcaaagt

SEQ ID NO: 4262221 - DNA, 19 bp, Homo sapiens
gatctaaaaggaggacagg

SEQ ID NO: 4262222 - DNA, 20 bp, Homo sapiens
gatctaaaaggaggacaggg

SEQ ID NO: 4262223 - DNA, 13 bp, Homo sapiens
gatctagccaggc

SEQ ID NO: 4262224 - DNA, 23 bp, Homo sapiens
gatctccaggcccagcctggccc

SEQ ID NO: 4262225 - DNA, 12 bp, Homo sapiens
gatctcttaaga

SEQ ID NO: 4262226 - DNA, 15 bp, Homo sapiens
gatctggagtctgaa

SEQ ID NO: 4262227 - DNA, 19 bp, Homo sapiens
gatctggagtctgaaggag

SEQ ID NO: 4262228 - DNA, 15 bp, Homo sapiens
gatgaacagttctcc

SEQ ID NO: 4262229 - DNA, 16 bp, Homo sapiens
gatgaactagccatga

SEQ ID NO: 4262230 - DNA, 20 bp, Homo sapiens
gatgaagaaaagtgggccag

SEQ ID NO: 4262231 - DNA, 18 bp, Homo sapiens
gatgaccaatctctgtga

SEQ ID NO: 4262232 - DNA, 21 bp, Homo sapiens
gatgagatcctcaaaaatcat

SEQ ID NO: 4262233 - DNA, 12 bp, Homo sapiens
gatgatttcaga

SEQ ID NO: 4262234 - DNA, 19 bp, Homo sapiens
gatgatttccgtcatgctc

SEQ ID NO: 4262235 - DNA, 22 bp, Homo sapiens
gatgcagtgccaggaaccctta

SEQ ID NO: 4262236 - DNA, 12 bp, Homo sapiens
gatgcatgcagg

SEQ ID NO: 4262237 - DNA, 15 bp, Homo sapiens
gatgcctgggcctga

SEQ ID NO: 4262238 - DNA, 12 bp, Homo sapiens
gatgctccagcc

SEQ ID NO: 4262239 - DNA, 19 bp, Homo sapiens
gatgctgggttctggggct

SEQ ID NO: 4262240 - DNA, 21 bp, Homo sapiens
gatgctggtcatcctgggcat

SEQ ID NO: 4262241 - DNA, 18 bp, Homo sapiens
gatggatctgctccatgc

SEQ ID NO: 4262242 - DNA, 20 bp, Homo sapiens
gatggatctgctccatgcag

SEQ ID NO: 4262243 - DNA, 21 bp, Homo sapiens
gatggccaggcctcagggacc

SEQ ID NO: 4262244 - DNA, 13 bp, Homo sapiens
gatggctccctgg

SEQ ID NO: 4262245 - DNA, 15 bp, Homo sapiens
gatggctccctgggc

SEQ ID NO: 4262246 - DNA, 16 bp, Homo sapiens
gatggctccctgggct

SEQ ID NO: 4262247 - DNA, 17 bp, Homo sapiens
gatggctccctgggctg

SEQ ID NO: 4262248 - DNA, 18 bp, Homo sapiens
gatggctccctgggctgg

SEQ ID NO: 4262249 - DNA, 23 bp, Homo sapiens
gatggctccctgggctggcatgg

SEQ ID NO: 4262250 - DNA, 12 bp, Homo sapiens
gatgggcacagg

SEQ ID NO: 4262251 - DNA, 15 bp, Homo sapiens
gatgggcacaggctg

SEQ ID NO: 4262252 - DNA, 18 bp, Homo sapiens
gatgggcacaggctgccc

SEQ ID NO: 4262253 - DNA, 20 bp, Homo sapiens
gatgggcatggggtgggcct

SEQ ID NO: 4262254 - DNA, 21 bp, Homo sapiens
gatgggcatggggtgggcctc

SEQ ID NO: 4262255 - DNA, 22 bp, Homo sapiens
gatgggcatggggtgggcctct

SEQ ID NO: 4262256 - DNA, 14 bp, Homo sapiens
gatggggagggcgc

SEQ ID NO: 4262257 - DNA, 13 bp, Homo sapiens
gatggggcctctg

SEQ ID NO: 4262258 - DNA, 11 bp, Homo sapiens
gatgggtgggc

SEQ ID NO: 4262259 - DNA, 21 bp, Homo sapiens
gatgggttttgttaggggtgg

SEQ ID NO: 4262260 - DNA, 23 bp, Homo sapiens
gatgggttttgttaggggtgggg

SEQ ID NO: 4262261 - DNA, 21 bp, Homo sapiens
gatggtgctgcacccctggtg

SEQ ID NO: 4262262 - DNA, 13 bp, Homo sapiens
gatggttcccctg

SEQ ID NO: 4262263 - DNA, 18 bp, Homo sapiens
gatgtcaaccttgtgtga

SEQ ID NO: 4262264 - DNA, 20 bp, Homo sapiens
gatgtcaaccttgtgtgagt

SEQ ID NO: 4262265 - DNA, 15 bp, Homo sapiens
gatgtcaagctggcc

SEQ ID NO: 4262266 - DNA, 19 bp, Homo sapiens
gatgtcaagctggccgtgg

SEQ ID NO: 4262267 - DNA, 20 bp, Homo sapiens
gatgtcaagctggccgtgga

SEQ ID NO: 4262268 - DNA, 18 bp, Homo sapiens
gatgtcttgagagcgctg

SEQ ID NO: 4262269 - DNA, 15 bp, Homo sapiens
gatgtgtatcagtgt

SEQ ID NO: 4262270 - DNA, 15 bp, Homo sapiens
gatgtgtatgtgttt

SEQ ID NO: 4262271 - DNA, 20 bp, Homo sapiens
gatgttaaacgtcacagcag

SEQ ID NO: 4262272 - DNA, 15 bp, Homo sapiens
gatgtttaatcaaga

SEQ ID NO: 4262273 - DNA, 16 bp, Homo sapiens
gatgtttgagcagtgg

SEQ ID NO: 4262274 - DNA, 20 bp, Homo sapiens
gattaaatttaatatactgc

SEQ ID NO: 4262275 - DNA, 19 bp, Homo sapiens
gattaatctctaaaattct

SEQ ID NO: 4262276 - DNA, 14 bp, Homo sapiens
gattaatttgtgta

SEQ ID NO: 4262277 - DNA, 23 bp, Homo sapiens
gattaatttgtgtagattgtgta

SEQ ID NO: 4262278 - DNA, 14 bp, Homo sapiens
gattagcatgaaag

SEQ ID NO: 4262279 - DNA, 12 bp, Homo sapiens
gattaggcctgg

SEQ ID NO: 4262280 - DNA, 13 bp, Homo sapiens
gattattgaatgt

SEQ ID NO: 4262281 - DNA, 14 bp, Homo sapiens
gattcaaatgcatg

SEQ ID NO: 4262282 - DNA, 10 bp, Homo sapiens
gattcaaatt

SEQ ID NO: 4262283 - DNA, 14 bp, Homo sapiens
gattcaaatttatt

SEQ ID NO: 4262284 - DNA, 22 bp, Homo sapiens
gattcaagactcaatgtggaaa

SEQ ID NO: 4262285 - DNA, 19 bp, Homo sapiens
gattcagggcccctgaagt

SEQ ID NO: 4262286 - DNA, 11 bp, Homo sapiens
gattcataaca

SEQ ID NO: 4262287 - DNA, 18 bp, Homo sapiens
gattcatttttgaaactg

SEQ ID NO: 4262288 - DNA, 10 bp, Homo sapiens
gattccaaat

SEQ ID NO: 4262289 - DNA, 20 bp, Homo sapiens
gattccccggagctgggaag

SEQ ID NO: 4262290 - DNA, 20 bp, Homo sapiens
gattcccgtggctttgtgct

SEQ ID NO: 4262291 - DNA, 18 bp, Homo sapiens
gattcgcccaaagccaga

SEQ ID NO: 4262292 - DNA, 17 bp, Homo sapiens
gattctaaaggggacag

SEQ ID NO: 4262293 - DNA, 24 bp, Homo sapiens
gattctaaaggggacagatcttga

SEQ ID NO: 4262294 - DNA, 18 bp, Homo sapiens
gattctatatttcatatt

SEQ ID NO: 4262295 - DNA, 22 bp, Homo sapiens
gattctatgcctgtatttccaa

SEQ ID NO: 4262296 - DNA, 13 bp, Homo sapiens
gattctcctctcc

SEQ ID NO: 4262297 - DNA, 14 bp, Homo sapiens
gattctgtgggcag

SEQ ID NO: 4262298 - DNA, 19 bp, Homo sapiens
gattctgtgggcagctggc

SEQ ID NO: 4262299 - DNA, 20 bp, Homo sapiens
gattggcaggtgtgggctcc

SEQ ID NO: 4262300 - DNA, 16 bp, Homo sapiens
gattgggggggcttgg

SEQ ID NO: 4262301 - DNA, 17 bp, Homo sapiens
gattgggggggcttggg

SEQ ID NO: 4262302 - DNA, 18 bp, Homo sapiens
gattggttcatgcctggg

SEQ ID NO: 4262303 - DNA, 21 bp, Homo sapiens
gattggttcatgcctggggtg

SEQ ID NO: 4262304 - DNA, 19 bp, Homo sapiens
gattgtaaaggtaggtgca

SEQ ID NO: 4262305 - DNA, 21 bp, Homo sapiens
gattgtcaccatgatcactta

SEQ ID NO: 4262306 - DNA, 16 bp, Homo sapiens
gattgttattaaatgt

SEQ ID NO: 4262307 - DNA, 14 bp, Homo sapiens
gatttaaatttaag

SEQ ID NO: 4262308 - DNA, 15 bp, Homo sapiens
gatttacgctcattg

SEQ ID NO: 4262309 - DNA, 21 bp, Homo sapiens
gatttattttgtatgaaatat

SEQ ID NO: 4262310 - DNA, 14 bp, Homo sapiens
gatttcaatgattg

SEQ ID NO: 4262311 - DNA, 20 bp, Homo sapiens
gatttcaatgattgtttaat

SEQ ID NO: 4262312 - DNA, 12 bp, Homo sapiens
gatttcagaaac

SEQ ID NO: 4262313 - DNA, 18 bp, Homo sapiens
gatttcagttcaatcaaa

SEQ ID NO: 4262314 - DNA, 12 bp, Homo sapiens
gatttcccctct

SEQ ID NO: 4262315 - DNA, 16 bp, Homo sapiens
gatttccgtcatgctc

SEQ ID NO: 4262316 - DNA, 15 bp, Homo sapiens
gatttcctaagctgt

SEQ ID NO: 4262317 - DNA, 11 bp, Homo sapiens
gatttctccca

SEQ ID NO: 4262318 - DNA, 20 bp, Homo sapiens
gatttctcccagctctagac

SEQ ID NO: 4262319 - DNA, 17 bp, Homo sapiens
gatttgcaaatgcacat

SEQ ID NO: 4262320 - DNA, 15 bp, Homo sapiens
gatttgtatttatat

SEQ ID NO: 4262321 - DNA, 22 bp, Homo sapiens
gatttgtatttatattagagtg

SEQ ID NO: 4262322 - DNA, 15 bp, Homo sapiens
gattttattttcaag

SEQ ID NO: 4262323 - DNA, 15 bp, Homo sapiens
gattttctttctatg

SEQ ID NO: 4262324 - DNA, 17 bp, Homo sapiens
gattttctttctatgta

SEQ ID NO: 4262325 - DNA, 20 bp, Homo sapiens
gattttttacaaattatgtt

SEQ ID NO: 4262326 - DNA, 18 bp, Homo sapiens
gcaaaatacatgatgatt

SEQ ID NO: 4262327 - DNA, 16 bp, Homo sapiens
gcaaacaaaatgatgg

SEQ ID NO: 4262328 - DNA, 20 bp, Homo sapiens
gcaaaggactgttttttcct

SEQ ID NO: 4262329 - DNA, 17 bp, Homo sapiens
gcaaagtaccaactgag

SEQ ID NO: 4262330 - DNA, 19 bp, Homo sapiens
gcaaatatttatgacctca

SEQ ID NO: 4262331 - DNA, 21 bp, Homo sapiens
gcaaatccataccccctgccc

SEQ ID NO: 4262332 - DNA, 22 bp, Homo sapiens
gcaaatccataccccctgcccc

SEQ ID NO: 4262333 - DNA, 21 bp, Homo sapiens
gcaaatgtccaagcatcagca

SEQ ID NO: 4262334 - DNA, 13 bp, Homo sapiens
gcaaattattcta

SEQ ID NO: 4262335 - DNA, 14 bp, Homo sapiens
gcaaattattctag

SEQ ID NO: 4262336 - DNA, 22 bp, Homo sapiens
gcaaattattctagtcaactgc

SEQ ID NO: 4262337 - DNA, 23 bp, Homo sapiens
gcaaattattctagtcaactgct

SEQ ID NO: 4262338 - DNA, 13 bp, Homo sapiens
gcaacacacagac

SEQ ID NO: 4262339 - DNA, 17 bp, Homo sapiens
gcaacaggaccaggagc

SEQ ID NO: 4262340 - DNA, 18 bp, Homo sapiens
gcaacaggaccaggagcc

SEQ ID NO: 4262341 - DNA, 21 bp, Homo sapiens
gcaacaggaccaggagccagg

SEQ ID NO: 4262342 - DNA, 17 bp, Homo sapiens
gcaacagggcttctctt

SEQ ID NO: 4262343 - DNA, 18 bp, Homo sapiens
gcaacggggaggccaagt

SEQ ID NO: 4262344 - DNA, 16 bp, Homo sapiens
gcaactgttggataat

SEQ ID NO: 4262345 - DNA, 15 bp, Homo sapiens
gcaagaagattctaa

SEQ ID NO: 4262346 - DNA, 16 bp, Homo sapiens
gcaagaagattctaaa

SEQ ID NO: 4262347 - DNA, 17 bp, Homo sapiens
gcaagaagattctaaaa

SEQ ID NO: 4262348 - DNA, 18 bp, Homo sapiens
gcaagaagattctaaaac

SEQ ID NO: 4262349 - DNA, 14 bp, Homo sapiens
gcaagaaggaattg

SEQ ID NO: 4262350 - DNA, 13 bp, Homo sapiens
gcaagaagtggga

SEQ ID NO: 4262351 - DNA, 14 bp, Homo sapiens
gcaagagctcagga

SEQ ID NO: 4262352 - DNA, 17 bp, Homo sapiens
gcaagagctcaggagaa

SEQ ID NO: 4262353 - DNA, 15 bp, Homo sapiens
gcaagattctgtggg

SEQ ID NO: 4262354 - DNA, 16 bp, Homo sapiens
gcaagattctgtgggc

SEQ ID NO: 4262355 - DNA, 21 bp, Homo sapiens
gcaagcacctgggtgtgctcc

SEQ ID NO: 4262356 - DNA, 13 bp, Homo sapiens
gcaagcctcagcc

SEQ ID NO: 4262357 - DNA, 16 bp, Homo sapiens
gcaagcctcagccact

SEQ ID NO: 4262358 - DNA, 14 bp, Homo sapiens
gcaagtcccaggga

SEQ ID NO: 4262359 - DNA, 23 bp, Homo sapiens
gcaagtcccagggagctctgcat

SEQ ID NO: 4262360 - DNA, 15 bp, Homo sapiens
gcaataaactcagtc

SEQ ID NO: 4262361 - DNA, 19 bp, Homo sapiens
gcaatatcttcgttagtaa

SEQ ID NO: 4262362 - DNA, 21 bp, Homo sapiens
gcaatatgtaacatgtctaaa

SEQ ID NO: 4262363 - DNA, 23 bp, Homo sapiens
gcacaagcagagtgcacagctgt

SEQ ID NO: 4262364 - DNA, 15 bp, Homo sapiens
gcacaaggagtgccc

SEQ ID NO: 4262365 - DNA, 12 bp, Homo sapiens
gcacacacacac

SEQ ID NO: 4262366 - DNA, 14 bp, Homo sapiens
gcacacacacacac

SEQ ID NO: 4262367 - DNA, 17 bp, Homo sapiens
gcacacacacacacagg

SEQ ID NO: 4262368 - DNA, 13 bp, Homo sapiens
gcacacacactct

SEQ ID NO: 4262369 - DNA, 16 bp, Homo sapiens
gcacacacagtctgtt

SEQ ID NO: 4262370 - DNA, 14 bp, Homo sapiens
gcacacacctgcac

SEQ ID NO: 4262371 - DNA, 17 bp, Homo sapiens
gcacacccctgcacaca

SEQ ID NO: 4262372 - DNA, 21 bp, Homo sapiens
gcacacccctgcacacacctg

SEQ ID NO: 4262373 - DNA, 16 bp, Homo sapiens
gcacaccctctctgtc

SEQ ID NO: 4262374 - DNA, 19 bp, Homo sapiens
gcacaccctctctgtccaa

SEQ ID NO: 4262375 - DNA, 19 bp, Homo sapiens
gcacaccgtccctctcccc

SEQ ID NO: 4262376 - DNA, 18 bp, Homo sapiens
gcacagcatctcagctca

SEQ ID NO: 4262377 - DNA, 13 bp, Homo sapiens
gcacagccagaaa

SEQ ID NO: 4262378 - DNA, 16 bp, Homo sapiens
gcacagctatgaaggc

SEQ ID NO: 4262379 - DNA, 18 bp, Homo sapiens
gcacagctttcctgggtc

SEQ ID NO: 4262380 - DNA, 19 bp, Homo sapiens
gcacaggctgccccacccc

SEQ ID NO: 4262381 - DNA, 19 bp, Homo sapiens
gcacagtgcatctcagccc

SEQ ID NO: 4262382 - DNA, 21 bp, Homo sapiens
gcacattgccctgaggggcct

SEQ ID NO: 4262383 - DNA, 23 bp, Homo sapiens
gcacattgccctgaggggcctgc

SEQ ID NO: 4262384 - DNA, 15 bp, Homo sapiens
gcaccaacctcactg

SEQ ID NO: 4262385 - DNA, 19 bp, Homo sapiens
gcaccaacctcactgccct

SEQ ID NO: 4262386 - DNA, 14 bp, Homo sapiens
gcacccatgcccca

SEQ ID NO: 4262387 - DNA, 20 bp, Homo sapiens
gcacccatgccccactctgc

SEQ ID NO: 4262388 - DNA, 12 bp, Homo sapiens
gcaccccacagg

SEQ ID NO: 4262389 - DNA, 15 bp, Homo sapiens
gcacccccacccttt

SEQ ID NO: 4262390 - DNA, 12 bp, Homo sapiens
gcacccctggtg

SEQ ID NO: 4262391 - DNA, 22 bp, Homo sapiens
gcacccctggtgtccctgcctg

SEQ ID NO: 4262392 - DNA, 21 bp, Homo sapiens
gcacccggcagccccccagtg

SEQ ID NO: 4262393 - DNA, 22 bp, Homo sapiens
gcacccggcagccccccagtgt

SEQ ID NO: 4262394 - DNA, 23 bp, Homo sapiens
gcacccggcagccccccagtgtc

SEQ ID NO: 4262395 - DNA, 23 bp, Homo sapiens
gcacccgtgccacgcgctctgca

SEQ ID NO: 4262396 - DNA, 15 bp, Homo sapiens
gcacctggggagtgg

SEQ ID NO: 4262397 - DNA, 17 bp, Homo sapiens
gcacctggggagtggga

SEQ ID NO: 4262398 - DNA, 15 bp, Homo sapiens
gcacctgtcccagaa

SEQ ID NO: 4262399 - DNA, 22 bp, Homo sapiens
gcacctgtcccagaaaaagcat

SEQ ID NO: 4262400 - DNA, 15 bp, Homo sapiens
gcacgcaagcctcag

SEQ ID NO: 4262401 - DNA, 17 bp, Homo sapiens
gcacgcaagcctcagcc

SEQ ID NO: 4262402 - DNA, 14 bp, Homo sapiens
gcacgtgcacacac

SEQ ID NO: 4262403 - DNA, 18 bp, Homo sapiens
gcacgtgcacacacctgc

SEQ ID NO: 4262404 - DNA, 20 bp, Homo sapiens
gcacgtgcacacacctgcac

SEQ ID NO: 4262405 - DNA, 18 bp, Homo sapiens
gcactatatacatcacgt

SEQ ID NO: 4262406 - DNA, 15 bp, Homo sapiens
gcactggaggcctct

SEQ ID NO: 4262407 - DNA, 19 bp, Homo sapiens
gcactggaggcctctgcaa

SEQ ID NO: 4262408 - DNA, 16 bp, Homo sapiens
gcactggccttctgat

SEQ ID NO: 4262409 - DNA, 14 bp, Homo sapiens
gcactggtggcccg

SEQ ID NO: 4262410 - DNA, 23 bp, Homo sapiens
gcactggtggcccgacagcctgg

SEQ ID NO: 4262411 - DNA, 24 bp, Homo sapiens
gcactggtggcccgacagcctggc

SEQ ID NO: 4262412 - DNA, 13 bp, Homo sapiens
gcacttggcctct

SEQ ID NO: 4262413 - DNA, 13 bp, Homo sapiens
gcagaaccagtcc

SEQ ID NO: 4262414 - DNA, 14 bp, Homo sapiens
gcagaactgagctc

SEQ ID NO: 4262415 - DNA, 20 bp, Homo sapiens
gcagaaggaggaagggactg

SEQ ID NO: 4262416 - DNA, 21 bp, Homo sapiens
gcagaaggaggaagggactgg

SEQ ID NO: 4262417 - DNA, 20 bp, Homo sapiens
gcagaaggccttgccttgtg

SEQ ID NO: 4262418 - DNA, 22 bp, Homo sapiens
gcagaccacactctgcctggcc

SEQ ID NO: 4262419 - DNA, 16 bp, Homo sapiens
gcagaccaggaaggaa

SEQ ID NO: 4262420 - DNA, 21 bp, Homo sapiens
gcagagattgggggggcttgg

SEQ ID NO: 4262421 - DNA, 22 bp, Homo sapiens
gcagagccatctgcgacaccac

SEQ ID NO: 4262422 - DNA, 15 bp, Homo sapiens
gcagagcccgcccac

SEQ ID NO: 4262423 - DNA, 22 bp, Homo sapiens
gcagagcccgcccacctgggcc

SEQ ID NO: 4262424 - DNA, 17 bp, Homo sapiens
gcagagctcagcacagc

SEQ ID NO: 4262425 - DNA, 11 bp, Homo sapiens
gcagaggacag

SEQ ID NO: 4262426 - DNA, 18 bp, Homo sapiens
gcagaggggagaggaagc

SEQ ID NO: 4262427 - DNA, 19 bp, Homo sapiens
gcagaggggagaggaagca

SEQ ID NO: 4262428 - DNA, 21 bp, Homo sapiens
gcagagtaaaattacagaaga

SEQ ID NO: 4262429 - DNA, 17 bp, Homo sapiens
gcagagtgcacagctgt

SEQ ID NO: 4262430 - DNA, 17 bp, Homo sapiens
gcagatctagccaggcc

SEQ ID NO: 4262431 - DNA, 19 bp, Homo sapiens
gcagatctagccaggcctc

SEQ ID NO: 4262432 - DNA, 19 bp, Homo sapiens
gcagcaacaggaccaggag

SEQ ID NO: 4262433 - DNA, 21 bp, Homo sapiens
gcagcaacaggaccaggagcc

SEQ ID NO: 4262434 - DNA, 13 bp, Homo sapiens
gcagcacaattct

SEQ ID NO: 4262435 - DNA, 16 bp, Homo sapiens
gcagcacattgccctg

SEQ ID NO: 4262436 - DNA, 20 bp, Homo sapiens
gcagcacattgccctgaggg

SEQ ID NO: 4262437 - DNA, 13 bp, Homo sapiens
gcagccaccctgc

SEQ ID NO: 4262438 - DNA, 16 bp, Homo sapiens
gcagccaccctgccat

SEQ ID NO: 4262439 - DNA, 15 bp, Homo sapiens
gcagcccacctgctg

SEQ ID NO: 4262440 - DNA, 12 bp, Homo sapiens
gcagcccagaga

SEQ ID NO: 4262441 - DNA, 13 bp, Homo sapiens
gcagcccagagag

SEQ ID NO: 4262442 - DNA, 22 bp, Homo sapiens
gcagcccagagagaccctgcca

SEQ ID NO: 4262443 - DNA, 23 bp, Homo sapiens
gcagcccagagagaccctgccaa

SEQ ID NO: 4262444 - DNA, 23 bp, Homo sapiens
gcagccccccagtgtccccaggg

SEQ ID NO: 4262445 - DNA, 15 bp, Homo sapiens
gcagccccctcctga

SEQ ID NO: 4262446 - DNA, 19 bp, Homo sapiens
gcagcccgtgtggcccctt

SEQ ID NO: 4262447 - DNA, 21 bp, Homo sapiens
gcagcccgtgtggccccttca

SEQ ID NO: 4262448 - DNA, 24 bp, Homo sapiens
gcagccctgctttgggctgccctg

SEQ ID NO: 4262449 - DNA, 19 bp, Homo sapiens
gcagccggagtcactgcct

SEQ ID NO: 4262450 - DNA, 22 bp, Homo sapiens
gcagccggagtcactgcctgga

SEQ ID NO: 4262451 - DNA, 18 bp, Homo sapiens
gcagccggggagctgagg

SEQ ID NO: 4262452 - DNA, 18 bp, Homo sapiens
gcagccgtgccttcagct

SEQ ID NO: 4262453 - DNA, 13 bp, Homo sapiens
gcagcctgtggga

SEQ ID NO: 4262454 - DNA, 13 bp, Homo sapiens
gcagcggcccaga

SEQ ID NO: 4262455 - DNA, 14 bp, Homo sapiens
gcagctgccagaga

SEQ ID NO: 4262456 - DNA, 11 bp, Homo sapiens
gcagctggctc

SEQ ID NO: 4262457 - DNA, 13 bp, Homo sapiens
gcagctggctctg

SEQ ID NO: 4262458 - DNA, 14 bp, Homo sapiens
gcagctggctctga

SEQ ID NO: 4262459 - DNA, 13 bp, Homo sapiens
gcagcttcaaaac

SEQ ID NO: 4262460 - DNA, 18 bp, Homo sapiens
gcagcttcaggtgagcca

SEQ ID NO: 4262461 - DNA, 18 bp, Homo sapiens
gcaggaagtcaggagcca

SEQ ID NO: 4262462 - DNA, 13 bp, Homo sapiens
gcaggaagtccct

SEQ ID NO: 4262463 - DNA, 16 bp, Homo sapiens
gcaggaagtccctgag

SEQ ID NO: 4262464 - DNA, 22 bp, Homo sapiens
gcaggacctcagagtccaggcc

SEQ ID NO: 4262465 - DNA, 19 bp, Homo sapiens
gcaggagcctagaggagga

SEQ ID NO: 4262466 - DNA, 14 bp, Homo sapiens
gcaggaggacaggt

SEQ ID NO: 4262467 - DNA, 14 bp, Homo sapiens
gcaggagggtggca

SEQ ID NO: 4262468 - DNA, 17 bp, Homo sapiens
gcaggagtgggctctga

SEQ ID NO: 4262469 - DNA, 22 bp, Homo sapiens
gcaggcccctttggacctgcag

SEQ ID NO: 4262470 - DNA, 22 bp, Homo sapiens
gcaggccctccgcgggggacag

SEQ ID NO: 4262471 - DNA, 17 bp, Homo sapiens
gcaggcggtatccagag

SEQ ID NO: 4262472 - DNA, 14 bp, Homo sapiens
gcagggcagcctgt

SEQ ID NO: 4262473 - DNA, 16 bp, Homo sapiens
gcagggcagcctgtgg

SEQ ID NO: 4262474 - DNA, 21 bp, Homo sapiens
gcagggcagcctgtgggagaa

SEQ ID NO: 4262475 - DNA, 23 bp, Homo sapiens
gcagggcagcctgtgggagaagg

SEQ ID NO: 4262476 - DNA, 17 bp, Homo sapiens
gcagggcccccacagga

SEQ ID NO: 4262477 - DNA, 16 bp, Homo sapiens
gcagggcgggccagga

SEQ ID NO: 4262478 - DNA, 19 bp, Homo sapiens
gcagggcgggccaggagaa

SEQ ID NO: 4262479 - DNA, 14 bp, Homo sapiens
gcaggggcagaagg

SEQ ID NO: 4262480 - DNA, 20 bp, Homo sapiens
gcaggggcagaaggaggaag

SEQ ID NO: 4262481 - DNA, 16 bp, Homo sapiens
ctcctgtgagctcccc

SEQ ID NO: 4262482 - DNA, 17 bp, Homo sapiens
ctcctgtgagctcccca

SEQ ID NO: 4262483 - DNA, 20 bp, Homo sapiens
ctcctgtggcggtgcagtgg

SEQ ID NO: 4262484 - DNA, 11 bp, Homo sapiens
ctcctgtgtaa

SEQ ID NO: 4262485 - DNA, 12 bp, Homo sapiens
ctccttccaggc

SEQ ID NO: 4262486 - DNA, 14 bp, Homo sapiens
ctccttccaggccc

SEQ ID NO: 4262487 - DNA, 10 bp, Homo sapiens
ctccttctcc

SEQ ID NO: 4262488 - DNA, 12 bp, Homo sapiens
ctccttctcccc

SEQ ID NO: 4262489 - DNA, 14 bp, Homo sapiens
ctccttctccccaa

SEQ ID NO: 4262490 - DNA, 19 bp, Homo sapiens
ctccttgaaaccagctcag

SEQ ID NO: 4262491 - DNA, 16 bp, Homo sapiens
ctccttgccgctggga

SEQ ID NO: 4262492 - DNA, 20 bp, Homo sapiens
ctccttgccgctgggagagc

SEQ ID NO: 4262493 - DNA, 17 bp, Homo sapiens
ctccttggttatatttt

SEQ ID NO: 4262494 - DNA, 20 bp, Homo sapiens
ctcctttcacaaccttctgt

SEQ ID NO: 4262495 - DNA, 14 bp, Homo sapiens
ctcgaagctgttct

SEQ ID NO: 4262496 - DNA, 17 bp, Homo sapiens
ctcgcccctccagtgtt

SEQ ID NO: 4262497 - DNA, 20 bp, Homo sapiens
ctcgcctcaggctttttcca

SEQ ID NO: 4262498 - DNA, 14 bp, Homo sapiens
ctcgcttagctgaa

SEQ ID NO: 4262499 - DNA, 12 bp, Homo sapiens
ctcggagcctgt

SEQ ID NO: 4262500 - DNA, 18 bp, Homo sapiens
ctcggccagagctcccag

SEQ ID NO: 4262501 - DNA, 20 bp, Homo sapiens
ctcggccagagctcccagga

SEQ ID NO: 4262502 - DNA, 22 bp, Homo sapiens
ctcggccagagctcccaggacg

SEQ ID NO: 4262503 - DNA, 20 bp, Homo sapiens
ctcggccgaggcctgcgccc

SEQ ID NO: 4262504 - DNA, 21 bp, Homo sapiens
ctcggccgtcttcactcgccc

SEQ ID NO: 4262505 - DNA, 18 bp, Homo sapiens
ctcggggcaggaagtccc

SEQ ID NO: 4262506 - DNA, 21 bp, Homo sapiens
ctcggggcaggaagtccctga

SEQ ID NO: 4262507 - DNA, 18 bp, Homo sapiens
ctcggtatagttttgtca

SEQ ID NO: 4262508 - DNA, 15 bp, Homo sapiens
ctcgttcccccaggg

SEQ ID NO: 4262509 - DNA, 22 bp, Homo sapiens
ctctaaatgaggggcctcaggt

SEQ ID NO: 4262510 - DNA, 16 bp, Homo sapiens
ctctaaggcaggatgt

SEQ ID NO: 4262511 - DNA, 16 bp, Homo sapiens
ctctacaactgagtcc

SEQ ID NO: 4262512 - DNA, 17 bp, Homo sapiens
ctctacaactgagtcct

SEQ ID NO: 4262513 - DNA, 21 bp, Homo sapiens
ctctacagctaatcagcattc

SEQ ID NO: 4262514 - DNA, 18 bp, Homo sapiens
ctctagacaaccctgcaa

SEQ ID NO: 4262515 - DNA, 15 bp, Homo sapiens
ctctaggtggggcgg

SEQ ID NO: 4262516 - DNA, 15 bp, Homo sapiens
ctctagtattccaga

SEQ ID NO: 4262517 - DNA, 13 bp, Homo sapiens
ctctatatataca

SEQ ID NO: 4262518 - DNA, 14 bp, Homo sapiens
ctctatttagcatg

SEQ ID NO: 4262519 - DNA, 19 bp, Homo sapiens
ctctcactctggcagcctc

SEQ ID NO: 4262520 - DNA, 22 bp, Homo sapiens
ctctcactctggcagcctcaga

SEQ ID NO: 4262521 - DNA, 13 bp, Homo sapiens
ctctcagcccagg

SEQ ID NO: 4262522 - DNA, 21 bp, Homo sapiens
ctctcagcccaggtctcctgg

SEQ ID NO: 4262523 - DNA, 15 bp, Homo sapiens
ctctcagcctccact

SEQ ID NO: 4262524 - DNA, 18 bp, Homo sapiens
ctctcaggcatgcctgtg

SEQ ID NO: 4262525 - DNA, 20 bp, Homo sapiens
ctctcaggcatgcctgtgtg

SEQ ID NO: 4262526 - DNA, 13 bp, Homo sapiens
ctctcatgaacct

SEQ ID NO: 4262527 - DNA, 16 bp, Homo sapiens
ctctccactgccttcg

SEQ ID NO: 4262528 - DNA, 20 bp, Homo sapiens
ctctccccggacaagcccag

SEQ ID NO: 4262529 - DNA, 21 bp, Homo sapiens
ctctccccggacaagcccagg

SEQ ID NO: 4262530 - DNA, 17 bp, Homo sapiens
ctctcccctgcgcaggc

SEQ ID NO: 4262531 - DNA, 20 bp, Homo sapiens
ctctcccctgcgcaggccct

SEQ ID NO: 4262532 - DNA, 19 bp, Homo sapiens
ctctccctccactcctccc

SEQ ID NO: 4262533 - DNA, 20 bp, Homo sapiens
ctctcctctctctccctcca

SEQ ID NO: 4262534 - DNA, 21 bp, Homo sapiens
ctctcctctctctccctccac

SEQ ID NO: 4262535 - DNA, 16 bp, Homo sapiens
ctctcctgaggagcag

SEQ ID NO: 4262536 - DNA, 17 bp, Homo sapiens
ctctcctgggccagggt

SEQ ID NO: 4262537 - DNA, 19 bp, Homo sapiens
ctctcctgtgagctcccca

SEQ ID NO: 4262538 - DNA, 21 bp, Homo sapiens
ctctcgcctcaggctttttcc

SEQ ID NO: 4262539 - DNA, 16 bp, Homo sapiens
ctctcgggctctctca

SEQ ID NO: 4262540 - DNA, 15 bp, Homo sapiens
ctctctcacccagcc

SEQ ID NO: 4262541 - DNA, 15 bp, Homo sapiens
ctctctcagcccagg

SEQ ID NO: 4262542 - DNA, 12 bp, Homo sapiens
ctctctccctcc

SEQ ID NO: 4262543 - DNA, 14 bp, Homo sapiens
ctctctccctccac

SEQ ID NO: 4262544 - DNA, 16 bp, Homo sapiens
ctctctggaaaggagg

SEQ ID NO: 4262545 - DNA, 20 bp, Homo sapiens
ctctctgtttaccctccctg

SEQ ID NO: 4262546 - DNA, 22 bp, Homo sapiens
ctctctgtttaccctccctgtc

SEQ ID NO: 4262547 - DNA, 23 bp, Homo sapiens
ctctctgtttaccctccctgtcc

SEQ ID NO: 4262548 - DNA, 16 bp, Homo sapiens
ctctcttaccccgtcc

SEQ ID NO: 4262549 - DNA, 22 bp, Homo sapiens
ctctgaaaatatttttttctag

SEQ ID NO: 4262550 - DNA, 19 bp, Homo sapiens
ctctgaactgctgctggtc

SEQ ID NO: 4262551 - DNA, 21 bp, Homo sapiens
ctctgaactgctgctggtcac

SEQ ID NO: 4262552 - DNA, 20 bp, Homo sapiens
ctctgaatgtagccagccca

SEQ ID NO: 4262553 - DNA, 15 bp, Homo sapiens
ctctgatcacaactt

SEQ ID NO: 4262554 - DNA, 19 bp, Homo sapiens
ctctgatcacaacttttct

SEQ ID NO: 4262555 - DNA, 21 bp, Homo sapiens
ctctgcacgtgcacacacctg

SEQ ID NO: 4262556 - DNA, 22 bp, Homo sapiens
ctctgcacgtgcacacacctgc

SEQ ID NO: 4262557 - DNA, 16 bp, Homo sapiens
ctctgcagggcagcct

SEQ ID NO: 4262558 - DNA, 18 bp, Homo sapiens
ctctgcagggcagcctgt

SEQ ID NO: 4262559 - DNA, 15 bp, Homo sapiens
ctctgcatgctcctc

SEQ ID NO: 4262560 - DNA, 17 bp, Homo sapiens
ctctgccatcagcccct

SEQ ID NO: 4262561 - DNA, 18 bp, Homo sapiens
ctctgccatcagcccctg

SEQ ID NO: 4262562 - DNA, 17 bp, Homo sapiens
ctctgcccccagctgct

SEQ ID NO: 4262563 - DNA, 18 bp, Homo sapiens
ctctgcccccagctgctc

SEQ ID NO: 4262564 - DNA, 19 bp, Homo sapiens
ctctgcccccagctgctcc

SEQ ID NO: 4262565 - DNA, 16 bp, Homo sapiens
ctctgcctgtccctct

SEQ ID NO: 4262566 - DNA, 20 bp, Homo sapiens
ctctgcctgtccctctcagg

SEQ ID NO: 4262567 - DNA, 15 bp, Homo sapiens
ctctgcctgtgcccg

SEQ ID NO: 4262568 - DNA, 19 bp, Homo sapiens
ctctgcctgtgcccgctgc

SEQ ID NO: 4262569 - DNA, 20 bp, Homo sapiens
ctctgcctgtgcccgctgcg

SEQ ID NO: 4262570 - DNA, 23 bp, Homo sapiens
ctctgcctgtgcccgctgcgctg

SEQ ID NO: 4262571 - DNA, 15 bp, Homo sapiens
ctctgccttccaggc

SEQ ID NO: 4262572 - DNA, 17 bp, Homo sapiens
ctctgcgtcccactgag

SEQ ID NO: 4262573 - DNA, 13 bp, Homo sapiens
ctctgctctgcac

SEQ ID NO: 4262574 - DNA, 14 bp, Homo sapiens
ctctgctctgcaca

SEQ ID NO: 4262575 - DNA, 24 bp, Homo sapiens
ctctgctgaggccagaggaaggga

SEQ ID NO: 4262576 - DNA, 15 bp, Homo sapiens
ctctggactgggaag

SEQ ID NO: 4262577 - DNA, 21 bp, Homo sapiens
ctctggactgggaagggggca

SEQ ID NO: 4262578 - DNA, 18 bp, Homo sapiens
gaatcacctaattaattt

SEQ ID NO: 4262579 - DNA, 18 bp, Homo sapiens
gaatcagtcctagaatgt

SEQ ID NO: 4262580 - DNA, 13 bp, Homo sapiens
gaatcccctcgct

SEQ ID NO: 4262581 - DNA, 22 bp, Homo sapiens
gaatcccctcgcttcataggca

SEQ ID NO: 4262582 - DNA, 12 bp, Homo sapiens
gaatctcagcac

SEQ ID NO: 4262583 - DNA, 18 bp, Homo sapiens
gaatgagagagtgtggaa

SEQ ID NO: 4262584 - DNA, 14 bp, Homo sapiens
gaatgctgtacctt

SEQ ID NO: 4262585 - DNA, 14 bp, Homo sapiens
gaatggctctggct

SEQ ID NO: 4262586 - DNA, 23 bp, Homo sapiens
gaatgggccaagccagggttcca

SEQ ID NO: 4262587 - DNA, 11 bp, Homo sapiens
gaatggggctt

SEQ ID NO: 4262588 - DNA, 17 bp, Homo sapiens
gaatggtgggctccaga

SEQ ID NO: 4262589 - DNA, 17 bp, Homo sapiens
gaatgtccccattctat

SEQ ID NO: 4262590 - DNA, 18 bp, Homo sapiens
gaatgtccccattctata

SEQ ID NO: 4262591 - DNA, 19 bp, Homo sapiens
gaatgtccccattctataa

SEQ ID NO: 4262592 - DNA, 20 bp, Homo sapiens
gaatgtccccattctataaa

SEQ ID NO: 4262593 - DNA, 12 bp, Homo sapiens
gaatgtgtagga

SEQ ID NO: 4262594 - DNA, 16 bp, Homo sapiens
gaatgttactttggaa

SEQ ID NO: 4262595 - DNA, 22 bp, Homo sapiens
gaatgttatatcatcaatactt

SEQ ID NO: 4262596 - DNA, 15 bp, Homo sapiens
gaatgtttcatttgc

SEQ ID NO: 4262597 - DNA, 16 bp, Homo sapiens
gaatgtttgaattaca

SEQ ID NO: 4262598 - DNA, 11 bp, Homo sapiens
gaattaaaata

SEQ ID NO: 4262599 - DNA, 20 bp, Homo sapiens
gaattacagggaagaaatca

SEQ ID NO: 4262600 - DNA, 16 bp, Homo sapiens
gaattatgtataacaa

SEQ ID NO: 4262601 - DNA, 12 bp, Homo sapiens
gaattcataaaa

SEQ ID NO: 4262602 - DNA, 17 bp, Homo sapiens
gaattcatgcctcaagt

SEQ ID NO: 4262603 - DNA, 12 bp, Homo sapiens
gaattcattcat

SEQ ID NO: 4262604 - DNA, 18 bp, Homo sapiens
gaattctaagattgtaca

SEQ ID NO: 4262605 - DNA, 19 bp, Homo sapiens
gaattctaagattgtacat

SEQ ID NO: 4262606 - DNA, 20 bp, Homo sapiens
gaattctaagattgtacata

SEQ ID NO: 4262607 - DNA, 19 bp, Homo sapiens
gaattgaagtcatcataaa

SEQ ID NO: 4262608 - DNA, 17 bp, Homo sapiens
gaattgagagatgtttt

SEQ ID NO: 4262609 - DNA, 15 bp, Homo sapiens
gaattgaggtctgct

SEQ ID NO: 4262610 - DNA, 15 bp, Homo sapiens
gaattgccagtcttt

SEQ ID NO: 4262611 - DNA, 22 bp, Homo sapiens
gaatttaactactaagaataaa

SEQ ID NO: 4262612 - DNA, 20 bp, Homo sapiens
gacaaaattgctgaggagct

SEQ ID NO: 4262613 - DNA, 22 bp, Homo sapiens
gacaaccaccgctccccagccc

SEQ ID NO: 4262614 - DNA, 18 bp, Homo sapiens
gacaaccgatgctccagc

SEQ ID NO: 4262615 - DNA, 20 bp, Homo sapiens
gacaagcccaggacactgcc

SEQ ID NO: 4262616 - DNA, 12 bp, Homo sapiens
gacaagccccag

SEQ ID NO: 4262617 - DNA, 16 bp, Homo sapiens
gacaagccccaggcag

SEQ ID NO: 4262618 - DNA, 15 bp, Homo sapiens
gacaagcctggagga

SEQ ID NO: 4262619 - DNA, 13 bp, Homo sapiens
gacaaggccccag

SEQ ID NO: 4262620 - DNA, 12 bp, Homo sapiens
gacaataaataa

SEQ ID NO: 4262621 - DNA, 18 bp, Homo sapiens
gacaatgacactggaagg

SEQ ID NO: 4262622 - DNA, 17 bp, Homo sapiens
gacaatttcaaaatgca

SEQ ID NO: 4262623 - DNA, 18 bp, Homo sapiens
gacacaaataccagagca

SEQ ID NO: 4262624 - DNA, 14 bp, Homo sapiens
gacacaactcatcc

SEQ ID NO: 4262625 - DNA, 15 bp, Homo sapiens
gacacacgcacacac

SEQ ID NO: 4262626 - DNA, 15 bp, Homo sapiens
gacacataaatctgt

SEQ ID NO: 4262627 - DNA, 14 bp, Homo sapiens
gacaccaccaacag

SEQ ID NO: 4262628 - DNA, 16 bp, Homo sapiens
gacaccaccaacaggc

SEQ ID NO: 4262629 - DNA, 16 bp, Homo sapiens
gacaccatcccctcct

SEQ ID NO: 4262630 - DNA, 17 bp, Homo sapiens
gacacgccttcccctca

SEQ ID NO: 4262631 - DNA, 18 bp, Homo sapiens
gacacggcctctggggag

SEQ ID NO: 4262632 - DNA, 19 bp, Homo sapiens
gacacggcctctggggaga

SEQ ID NO: 4262633 - DNA, 13 bp, Homo sapiens
gacactgcctttg

SEQ ID NO: 4262634 - DNA, 19 bp, Homo sapiens
gacactgcctttgctgcct

SEQ ID NO: 4262635 - DNA, 21 bp, Homo sapiens
gacactgcctttgctgccttc

SEQ ID NO: 4262636 - DNA, 18 bp, Homo sapiens
gacactggtctcagagga

SEQ ID NO: 4262637 - DNA, 18 bp, Homo sapiens
gacagaaccaacgggtct

SEQ ID NO: 4262638 - DNA, 22 bp, Homo sapiens
gacagaaccaacgggtctgtgg

SEQ ID NO: 4262639 - DNA, 16 bp, Homo sapiens
gacagacccagggtgg

SEQ ID NO: 4262640 - DNA, 15 bp, Homo sapiens
gacagagtctgggtg

SEQ ID NO: 4262641 - DNA, 13 bp, Homo sapiens
gacagagtggatc

SEQ ID NO: 4262642 - DNA, 18 bp, Homo sapiens
gacagagtggatctggag

SEQ ID NO: 4262643 - DNA, 21 bp, Homo sapiens
gacagagtggatctggagtct

SEQ ID NO: 4262644 - DNA, 13 bp, Homo sapiens
gacagatcttgag

SEQ ID NO: 4262645 - DNA, 22 bp, Homo sapiens
gacagcaacggggaggccaagt

SEQ ID NO: 4262646 - DNA, 15 bp, Homo sapiens
gacagcagtgtgagg

SEQ ID NO: 4262647 - DNA, 21 bp, Homo sapiens
gacagcagtgtgagggtgcag

SEQ ID NO: 4262648 - DNA, 11 bp, Homo sapiens
gacagcctggc

SEQ ID NO: 4262649 - DNA, 13 bp, Homo sapiens
gacagcctggcac

SEQ ID NO: 4262650 - DNA, 22 bp, Homo sapiens
gacagcgggtaaaaagagaagg

SEQ ID NO: 4262651 - DNA, 19 bp, Homo sapiens
gacaggaacacccagcccc

SEQ ID NO: 4262652 - DNA, 22 bp, Homo sapiens
gacaggaacacccagccccagc

SEQ ID NO: 4262653 - DNA, 14 bp, Homo sapiens
gacagggccagggt

SEQ ID NO: 4262654 - DNA, 15 bp, Homo sapiens
gacaggtggaggcga

SEQ ID NO: 4262655 - DNA, 21 bp, Homo sapiens
gacaggtggaggcgagccaga

SEQ ID NO: 4262656 - DNA, 16 bp, Homo sapiens
gacagtggctctccaa

SEQ ID NO: 4262657 - DNA, 16 bp, Homo sapiens
gacatctctgactttc

SEQ ID NO: 4262658 - DNA, 23 bp, Homo sapiens
gacatgctgcccaccccctgctg

SEQ ID NO: 4262659 - DNA, 16 bp, Homo sapiens
gacatggacccggagc

SEQ ID NO: 4262660 - DNA, 22 bp, Homo sapiens
gacatttaaaatagttttctaa

SEQ ID NO: 4262661 - DNA, 13 bp, Homo sapiens
gaccaagatgtca

SEQ ID NO: 4262662 - DNA, 15 bp, Homo sapiens
gaccaaggagatggg

SEQ ID NO: 4262663 - DNA, 15 bp, Homo sapiens
gaccaatctctgtga

SEQ ID NO: 4262664 - DNA, 20 bp, Homo sapiens
gaccagaagtggcaggagga

SEQ ID NO: 4262665 - DNA, 13 bp, Homo sapiens
gaccaggaaggaa

SEQ ID NO: 4262666 - DNA, 15 bp, Homo sapiens
gaccaggaaggaaga

SEQ ID NO: 4262667 - DNA, 14 bp, Homo sapiens
gaccaggagccagg

SEQ ID NO: 4262668 - DNA, 15 bp, Homo sapiens
gaccaggagccaggt

SEQ ID NO: 4262669 - DNA, 17 bp, Homo sapiens
gaccaggctcacaactg

SEQ ID NO: 4262670 - DNA, 20 bp, Homo sapiens
gaccatttagtcctcacctt

SEQ ID NO: 4262671 - DNA, 15 bp, Homo sapiens
gacccattcacattt

SEQ ID NO: 4262672 - DNA, 17 bp, Homo sapiens
gacccattcacatttta

SEQ ID NO: 4262673 - DNA, 23 bp, Homo sapiens
gaccccacttatgctgctgtgaa

SEQ ID NO: 4262674 - DNA, 17 bp, Homo sapiens
gaccccagctccaggca

SEQ ID NO: 4262675 - DNA, 16 bp, Homo sapiens
gaccccatccagccag

SEQ ID NO: 4262676 - DNA, 18 bp, Homo sapiens
gaccccatccagccaggg

SEQ ID NO: 4262677 - DNA, 13 bp, Homo sapiens
gacccccacccct

SEQ ID NO: 4262678 - DNA, 21 bp, Homo sapiens
gacccccaccccttccccact

SEQ ID NO: 4262679 - DNA, 18 bp, Homo sapiens
gacccctaccctttccca

SEQ ID NO: 4262680 - DNA, 12 bp, Homo sapiens
gacccctcacct

SEQ ID NO: 4262681 - DNA, 22 bp, Homo sapiens
gacccctcaccttgcaacacac

SEQ ID NO: 4262682 - DNA, 22 bp, Homo sapiens
gacccctggcttttcactgctg

SEQ ID NO: 4262683 - DNA, 11 bp, Homo sapiens
gacccggaggc

SEQ ID NO: 4262684 - DNA, 15 bp, Homo sapiens
gacccggaggccaca

SEQ ID NO: 4262685 - DNA, 18 bp, Homo sapiens
gacccggaggggcctggc

SEQ ID NO: 4262686 - DNA, 20 bp, Homo sapiens
gacccggaggggcctggcag

SEQ ID NO: 4262687 - DNA, 22 bp, Homo sapiens
gacccgttcaacttttcctttg

SEQ ID NO: 4262688 - DNA, 16 bp, Homo sapiens
gaccctcggggcagga

SEQ ID NO: 4262689 - DNA, 18 bp, Homo sapiens
gaccctgccaactttcca

SEQ ID NO: 4262690 - DNA, 20 bp, Homo sapiens
gaccctgccaactttccaga

SEQ ID NO: 4262691 - DNA, 22 bp, Homo sapiens
gaccctgccaactttccagact

SEQ ID NO: 4262692 - DNA, 12 bp, Homo sapiens
gaccctgggaga

SEQ ID NO: 4262693 - DNA, 18 bp, Homo sapiens
gaccctgggagagtgagg

SEQ ID NO: 4262694 - DNA, 21 bp, Homo sapiens
gaccctgggagagtgaggtca

SEQ ID NO: 4262695 - DNA, 21 bp, Homo sapiens
gaccctgggtcaccttcctgg

SEQ ID NO: 4262696 - DNA, 19 bp, Homo sapiens
gacccttctgtctgtaaga

SEQ ID NO: 4262697 - DNA, 17 bp, Homo sapiens
gaccgaggctggagctg

SEQ ID NO: 4262698 - DNA, 21 bp, Homo sapiens
gaccgagtgtggagctgcttc

SEQ ID NO: 4262699 - DNA, 16 bp, Homo sapiens
gaccgccagatggggc

SEQ ID NO: 4262700 - DNA, 17 bp, Homo sapiens
gaccggggtcctgaggc

SEQ ID NO: 4262701 - DNA, 15 bp, Homo sapiens
gacctcaacaaagaa

SEQ ID NO: 4262702 - DNA, 13 bp, Homo sapiens
gacctcaacctgt

SEQ ID NO: 4262703 - DNA, 17 bp, Homo sapiens
gacctcagagtccaggc

SEQ ID NO: 4262704 - DNA, 18 bp, Homo sapiens
gacctcagagtccaggcc

SEQ ID NO: 4262705 - DNA, 19 bp, Homo sapiens
gacctcagagtccaggccc

SEQ ID NO: 4262706 - DNA, 16 bp, Homo sapiens
gacctccacctgggag

SEQ ID NO: 4262707 - DNA, 17 bp, Homo sapiens
gacctccacctgggaga

SEQ ID NO: 4262708 - DNA, 19 bp, Homo sapiens
gacctgcagttggcctcag

SEQ ID NO: 4262709 - DNA, 17 bp, Homo sapiens
gacctgggccctggttc

SEQ ID NO: 4262710 - DNA, 16 bp, Homo sapiens
gaccttacaaccacat

SEQ ID NO: 4262711 - DNA, 15 bp, Homo sapiens
gaccttctgaagatc

SEQ ID NO: 4262712 - DNA, 22 bp, Homo sapiens
gaccttctgcggctccgggctg

SEQ ID NO: 4262713 - DNA, 18 bp, Homo sapiens
gacctttgtctgaaggat

SEQ ID NO: 4262714 - DNA, 23 bp, Homo sapiens
gacctttgtctgaaggattttaa

SEQ ID NO: 4262715 - DNA, 14 bp, Homo sapiens
gaccttttgctgcc

SEQ ID NO: 4262716 - DNA, 12 bp, Homo sapiens
gacgcagggaga

SEQ ID NO: 4262717 - DNA, 18 bp, Homo sapiens
gacgcagggagaccctgg

SEQ ID NO: 4262718 - DNA, 22 bp, Homo sapiens
gacgcagggagaccctgggaga

SEQ ID NO: 4262719 - DNA, 14 bp, Homo sapiens
gacggaagtggcct

SEQ ID NO: 4262720 - DNA, 20 bp, Homo sapiens
gacgtccacccgtttccaag

SEQ ID NO: 4262721 - DNA, 19 bp, Homo sapiens
gacgtgagtggggaggaga

SEQ ID NO: 4262722 - DNA, 18 bp, Homo sapiens
gactaaaccattgtgcat

SEQ ID NO: 4262723 - DNA, 18 bp, Homo sapiens
gactaccacttatttcta

SEQ ID NO: 4262724 - DNA, 14 bp, Homo sapiens
gactaggagcactg

SEQ ID NO: 4262725 - DNA, 16 bp, Homo sapiens
gactagggtcctcagg

SEQ ID NO: 4262726 - DNA, 17 bp, Homo sapiens
gactagggtcctcaggc

SEQ ID NO: 4262727 - DNA, 16 bp, Homo sapiens
gactataaacattaaa

SEQ ID NO: 4262728 - DNA, 20 bp, Homo sapiens
gactcacggctgcacctgca

SEQ ID NO: 4262729 - DNA, 18 bp, Homo sapiens
gactccatatcccgggag

SEQ ID NO: 4262730 - DNA, 21 bp, Homo sapiens
gactccatatcccgggagcag

SEQ ID NO: 4262731 - DNA, 17 bp, Homo sapiens
gactctctccatcagaa

SEQ ID NO: 4262732 - DNA, 13 bp, Homo sapiens
gactctgaggtgt

SEQ ID NO: 4262733 - DNA, 17 bp, Homo sapiens
gactcttctgagcacct

SEQ ID NO: 4262734 - DNA, 22 bp, Homo sapiens
gactgaatttaactactaagaa

SEQ ID NO: 4262735 - DNA, 20 bp, Homo sapiens
gactgacccattcacatttt

SEQ ID NO: 4262736 - DNA, 20 bp, Homo sapiens
gactgccgaccgaggctgga

SEQ ID NO: 4262737 - DNA, 19 bp, Homo sapiens
gactgctgcgctgtgctgg

SEQ ID NO: 4262738 - DNA, 13 bp, Homo sapiens
gactggcccaccc

SEQ ID NO: 4262739 - DNA, 16 bp, Homo sapiens
gactggcccacccctc

SEQ ID NO: 4262740 - DNA, 22 bp, Homo sapiens
gactgggaagggggcaggcccc

SEQ ID NO: 4262741 - DNA, 23 bp, Homo sapiens
gactgggaagggggcaggcccct

SEQ ID NO: 4262742 - DNA, 17 bp, Homo sapiens
gactgggctggctgcct

SEQ ID NO: 4262743 - DNA, 23 bp, Homo sapiens
gactgtactcctcccaggcgccc

SEQ ID NO: 4262744 - DNA, 21 bp, Homo sapiens
gactgttttttcctgagcttg

SEQ ID NO: 4262745 - DNA, 14 bp, Homo sapiens
gacttacatgattc

SEQ ID NO: 4262746 - DNA, 16 bp, Homo sapiens
gacttacatgattcat

SEQ ID NO: 4262747 - DNA, 12 bp, Homo sapiens
gacttaggccag

SEQ ID NO: 4262748 - DNA, 17 bp, Homo sapiens
gacttcaaaatattgag

SEQ ID NO: 4262749 - DNA, 19 bp, Homo sapiens
gacttcagactctctcctc

SEQ ID NO: 4262750 - DNA, 22 bp, Homo sapiens
gacttcagactctctcctctct

SEQ ID NO: 4262751 - DNA, 23 bp, Homo sapiens
gacttcagactctctcctctctc

SEQ ID NO: 4262752 - DNA, 18 bp, Homo sapiens
gacttcgactgtgacctg

SEQ ID NO: 4262753 - DNA, 16 bp, Homo sapiens
gacttggataggagct

SEQ ID NO: 4262754 - DNA, 23 bp, Homo sapiens
gacttggataggagcttccagat

SEQ ID NO: 4262755 - DNA, 19 bp, Homo sapiens
gacttgtagggatgccttt

SEQ ID NO: 4262756 - DNA, 16 bp, Homo sapiens
gacttgtgcctcttgg

SEQ ID NO: 4262757 - DNA, 20 bp, Homo sapiens
gacttgtgcctcttgggaga

SEQ ID NO: 4262758 - DNA, 21 bp, Homo sapiens
gacttgtgcctcttgggagac

SEQ ID NO: 4262759 - DNA, 13 bp, Homo sapiens
gagaaagaaggct

SEQ ID NO: 4262760 - DNA, 23 bp, Homo sapiens
gagaaatttttttccagaattga

SEQ ID NO: 4262761 - DNA, 21 bp, Homo sapiens
gagaacacaagccacgcctgc

SEQ ID NO: 4262762 - DNA, 17 bp, Homo sapiens
gagaacttgaacaaagt

SEQ ID NO: 4262763 - DNA, 15 bp, Homo sapiens
gagaagcaccccacc

SEQ ID NO: 4262764 - DNA, 22 bp, Homo sapiens
gagaaggacccggaggggcctg

SEQ ID NO: 4262765 - DNA, 18 bp, Homo sapiens
gagaaggcaagctggcag

SEQ ID NO: 4262766 - DNA, 12 bp, Homo sapiens
gagaaggcctgc

SEQ ID NO: 4262767 - DNA, 15 bp, Homo sapiens
gagaagtgcccctgc

SEQ ID NO: 4262768 - DNA, 17 bp, Homo sapiens
gagaagtgcccctgctg

SEQ ID NO: 4262769 - DNA, 20 bp, Homo sapiens
gagaagtgcccctgctgcct

SEQ ID NO: 4262770 - DNA, 20 bp, Homo sapiens
gagaatgcctaggccagctc

SEQ ID NO: 4262771 - DNA, 21 bp, Homo sapiens
gagaatgcctaggccagctcc

SEQ ID NO: 4262772 - DNA, 13 bp, Homo sapiens
gagaatggctctg

SEQ ID NO: 4262773 - DNA, 18 bp, Homo sapiens
gagacaaaattgctgagg

SEQ ID NO: 4262774 - DNA, 23 bp, Homo sapiens
gagaccctgccaactttccagac

SEQ ID NO: 4262775 - DNA, 15 bp, Homo sapiens
gagaccctgggagag

SEQ ID NO: 4262776 - DNA, 13 bp, Homo sapiens
gagaccttctctt

SEQ ID NO: 4262777 - DNA, 15 bp, Homo sapiens
gagactcagagggag

SEQ ID NO: 4262778 - DNA, 12 bp, Homo sapiens
gagactctgagg

SEQ ID NO: 4262779 - DNA, 20 bp, Homo sapiens
gagactgacccattcacatt

SEQ ID NO: 4262780 - DNA, 22 bp, Homo sapiens
gagactgacccattcacatttt

SEQ ID NO: 4262781 - DNA, 22 bp, Homo sapiens
gagactgtctcaagagggcact

SEQ ID NO: 4262782 - DNA, 14 bp, Homo sapiens
gagacttaggccag

SEQ ID NO: 4262783 - DNA, 18 bp, Homo sapiens
gagacttaggccagaggt

SEQ ID NO: 4262784 - DNA, 15 bp, Homo sapiens
gagagaacagggatg

SEQ ID NO: 4262785 - DNA, 14 bp, Homo sapiens
gagagagtgtggaa

SEQ ID NO: 4262786 - DNA, 13 bp, Homo sapiens
gagagcagaatga

SEQ ID NO: 4262787 - DNA, 20 bp, Homo sapiens
gagagccaaggcctatgcca

SEQ ID NO: 4262788 - DNA, 22 bp, Homo sapiens
gagagccaaggcctatgccacc

SEQ ID NO: 4262789 - DNA, 21 bp, Homo sapiens
gagagcccaatcactgcctat

SEQ ID NO: 4262790 - DNA, 16 bp, Homo sapiens
gagagcccccaccagc

SEQ ID NO: 4262791 - DNA, 23 bp, Homo sapiens
gagagcccccaccagcagcacaa

SEQ ID NO: 4262792 - DNA, 14 bp, Homo sapiens
gagagcgctggcct

SEQ ID NO: 4262793 - DNA, 15 bp, Homo sapiens
gagagcggcttcccc

SEQ ID NO: 4262794 - DNA, 16 bp, Homo sapiens
gagagcggcttcccca

SEQ ID NO: 4262795 - DNA, 19 bp, Homo sapiens
gagaggaagccacgtgctg

SEQ ID NO: 4262796 - DNA, 21 bp, Homo sapiens
gagaggaagccacgtgctgga

SEQ ID NO: 4262797 - DNA, 15 bp, Homo sapiens
gagaggagagaatga

SEQ ID NO: 4262798 - DNA, 15 bp, Homo sapiens
gagaggaggtgtgga

SEQ ID NO: 4262799 - DNA, 20 bp, Homo sapiens
gagaggaggtgtggagtgga

SEQ ID NO: 4262800 - DNA, 15 bp, Homo sapiens
gagaggggacttgga

SEQ ID NO: 4262801 - DNA, 16 bp, Homo sapiens
gagagtggctcctccc

SEQ ID NO: 4262802 - DNA, 22 bp, Homo sapiens
gagatattttgtaaaatgtatt

SEQ ID NO: 4262803 - DNA, 14 bp, Homo sapiens
gagatcagcattca

SEQ ID NO: 4262804 - DNA, 15 bp, Homo sapiens
gagatcagcattcaa

SEQ ID NO: 4262805 - DNA, 18 bp, Homo sapiens
gagatcagcattcaaaat

SEQ ID NO: 4262806 - DNA, 15 bp, Homo sapiens
gagatccgccctggg

SEQ ID NO: 4262807 - DNA, 15 bp, Homo sapiens
gagatcttccttccg

SEQ ID NO: 4262808 - DNA, 23 bp, Homo sapiens
gagatcttccttccgctctgagg

SEQ ID NO: 4262809 - DNA, 18 bp, Homo sapiens
gagatgctgggaccctcg

SEQ ID NO: 4262810 - DNA, 13 bp, Homo sapiens
gagattaatttgt

SEQ ID NO: 4262811 - DNA, 14 bp, Homo sapiens
gagattgctctggg

SEQ ID NO: 4262812 - DNA, 19 bp, Homo sapiens
gagattggatcaagtatta

SEQ ID NO: 4262813 - DNA, 13 bp, Homo sapiens
gagatttgtattt

SEQ ID NO: 4262814 - DNA, 17 bp, Homo sapiens
gagatttgtatttatat

SEQ ID NO: 4262815 - DNA, 20 bp, Homo sapiens
gagcaaactgaagcccacag

SEQ ID NO: 4262816 - DNA, 21 bp, Homo sapiens
gagcaccagatgacacataaa

SEQ ID NO: 4262817 - DNA, 17 bp, Homo sapiens
gagcaccgaatattgag

SEQ ID NO: 4262818 - DNA, 15 bp, Homo sapiens
gagcactggaggcct

SEQ ID NO: 4262819 - DNA, 18 bp, Homo sapiens
gagcactggaggcctctg

SEQ ID NO: 4262820 - DNA, 20 bp, Homo sapiens
gagcactggaggcctctgca

SEQ ID NO: 4262821 - DNA, 18 bp, Homo sapiens
gagcactgtgcagccggg

SEQ ID NO: 4262822 - DNA, 15 bp, Homo sapiens
gagcagcccacctgc

SEQ ID NO: 4262823 - DNA, 17 bp, Homo sapiens
gagcaggaagcaaggcc

SEQ ID NO: 4262824 - DNA, 10 bp, Homo sapiens
gagcagggtg

SEQ ID NO: 4262825 - DNA, 20 bp, Homo sapiens
gagcagttgttatattcatt

SEQ ID NO: 4262826 - DNA, 21 bp, Homo sapiens
gagcatgaaactatgcaccta

SEQ ID NO: 4262827 - DNA, 15 bp, Homo sapiens
gagcatgaagataaa

SEQ ID NO: 4262828 - DNA, 18 bp, Homo sapiens
gagcattctggggtgggg

SEQ ID NO: 4262829 - DNA, 19 bp, Homo sapiens
gagccagattaggcctgga

SEQ ID NO: 4262830 - DNA, 20 bp, Homo sapiens
gagccagattaggcctggag

SEQ ID NO: 4262831 - DNA, 11 bp, Homo sapiens
gagccagggct

SEQ ID NO: 4262832 - DNA, 15 bp, Homo sapiens
gagccagggctgtcc

SEQ ID NO: 4262833 - DNA, 14 bp, Homo sapiens
gagcccccaccagc

SEQ ID NO: 4262834 - DNA, 18 bp, Homo sapiens
gagcccccaccagcagca

SEQ ID NO: 4262835 - DNA, 23 bp, Homo sapiens
gagcccccaccagcagcacaatt

SEQ ID NO: 4262836 - DNA, 17 bp, Homo sapiens
gagcccccgccccgccc

SEQ ID NO: 4262837 - DNA, 22 bp, Homo sapiens
gagcccccgccccgccccacat

SEQ ID NO: 4262838 - DNA, 22 bp, Homo sapiens
gagccccctgtccttcccacgg

SEQ ID NO: 4262839 - DNA, 23 bp, Homo sapiens
gagcccgcacccccaccctttgg

SEQ ID NO: 4262840 - DNA, 15 bp, Homo sapiens
gagcccgcccacctg

SEQ ID NO: 4262841 - DNA, 13 bp, Homo sapiens
gagccctgccctc

SEQ ID NO: 4262842 - DNA, 24 bp, Homo sapiens
gagccctgccctcactccactccc

SEQ ID NO: 4262843 - DNA, 23 bp, Homo sapiens
gagccctggggtttccacacagg

SEQ ID NO: 4262844 - DNA, 17 bp, Homo sapiens
gagcctagaggaggaaa

SEQ ID NO: 4262845 - DNA, 16 bp, Homo sapiens
gagcctatggaaaggg

SEQ ID NO: 4262846 - DNA, 14 bp, Homo sapiens
gagcctcgcccctc

SEQ ID NO: 4262847 - DNA, 17 bp, Homo sapiens
gagcctgcgtggcctgg

SEQ ID NO: 4262848 - DNA, 21 bp, Homo sapiens
gagccttagtttcagctgacc

SEQ ID NO: 4262849 - DNA, 22 bp, Homo sapiens
gagccttagtttcagctgacca

SEQ ID NO: 4262850 - DNA, 16 bp, Homo sapiens
gagccttttattaaca

SEQ ID NO: 4262851 - DNA, 16 bp, Homo sapiens
gagcgacggctcctcc

SEQ ID NO: 4262852 - DNA, 15 bp, Homo sapiens
gagcgctcctctgcc

SEQ ID NO: 4262853 - DNA, 20 bp, Homo sapiens
gagcgctcctctgccttgga

SEQ ID NO: 4262854 - DNA, 21 bp, Homo sapiens
gagcggcttccccatcgcctt

SEQ ID NO: 4262855 - DNA, 16 bp, Homo sapiens
gagcgggacctgtggc

SEQ ID NO: 4262856 - DNA, 12 bp, Homo sapiens
gagcgtgtccta

SEQ ID NO: 4262857 - DNA, 19 bp, Homo sapiens
gagctaaattacaattgtc

SEQ ID NO: 4262858 - DNA, 14 bp, Homo sapiens
gagctaacactggc

SEQ ID NO: 4262859 - DNA, 19 bp, Homo sapiens
gagctcagcacagcctcac

SEQ ID NO: 4262860 - DNA, 20 bp, Homo sapiens
gagctcaggccctggtgagg

SEQ ID NO: 4262861 - DNA, 16 bp, Homo sapiens
gagctcagggctggat

SEQ ID NO: 4262862 - DNA, 13 bp, Homo sapiens
gagctccagaccc

SEQ ID NO: 4262863 - DNA, 17 bp, Homo sapiens
gagctccagacccccag

SEQ ID NO: 4262864 - DNA, 19 bp, Homo sapiens
gagctccagacccccagca

SEQ ID NO: 4262865 - DNA, 13 bp, Homo sapiens
gagctcccaggac

SEQ ID NO: 4262866 - DNA, 14 bp, Homo sapiens
gagctcccaggacg

SEQ ID NO: 4262867 - DNA, 20 bp, Homo sapiens
gagctcccaggacgcaggga

SEQ ID NO: 4262868 - DNA, 23 bp, Homo sapiens
gagctccccaatccaacccatgc

SEQ ID NO: 4262869 - DNA, 17 bp, Homo sapiens
gagctctcctgggccag

SEQ ID NO: 4262870 - DNA, 18 bp, Homo sapiens
gagctctcctgggccagg

SEQ ID NO: 4262871 - DNA, 20 bp, Homo sapiens
gagctctcctgggccagggt

SEQ ID NO: 4262872 - DNA, 22 bp, Homo sapiens
gagctctcctgggccagggtct

SEQ ID NO: 4262873 - DNA, 17 bp, Homo sapiens
gagctgcttccagttgg

SEQ ID NO: 4262874 - DNA, 17 bp, Homo sapiens
gagctggccgacggacc

SEQ ID NO: 4262875 - DNA, 16 bp, Homo sapiens
gagctgtgccagctgc

SEQ ID NO: 4262876 - DNA, 18 bp, Homo sapiens
gagctgtgccagctgctt

SEQ ID NO: 4262877 - DNA, 14 bp, Homo sapiens
gagcttctccagcc

SEQ ID NO: 4262878 - DNA, 14 bp, Homo sapiens
gaggaaactcacct

SEQ ID NO: 4262879 - DNA, 20 bp, Homo sapiens
gaggaactggtccaggccag

SEQ ID NO: 4262880 - DNA, 21 bp, Homo sapiens
gaggaagcacaagaagtggga

SEQ ID NO: 4262881 - DNA, 20 bp, Homo sapiens
ctgctaggtgggccagcccc

SEQ ID NO: 4262882 - DNA, 13 bp, Homo sapiens
ctgctatccagcc

SEQ ID NO: 4262883 - DNA, 16 bp, Homo sapiens
ctgctatccagccgca

SEQ ID NO: 4262884 - DNA, 18 bp, Homo sapiens
ctgctatgtctgtgatgt

SEQ ID NO: 4262885 - DNA, 16 bp, Homo sapiens
ctgctcagatgctggt

SEQ ID NO: 4262886 - DNA, 21 bp, Homo sapiens
ctgctcaggcctcacctggct

SEQ ID NO: 4262887 - DNA, 16 bp, Homo sapiens
ctgctccatgcagatc

SEQ ID NO: 4262888 - DNA, 17 bp, Homo sapiens
ctgctccatgcagatct

SEQ ID NO: 4262889 - DNA, 21 bp, Homo sapiens
ctgctccatgcagatctagcc

SEQ ID NO: 4262890 - DNA, 20 bp, Homo sapiens
ctgctcccggctctgaggct

SEQ ID NO: 4262891 - DNA, 14 bp, Homo sapiens
ctgctcctcgcagt

SEQ ID NO: 4262892 - DNA, 14 bp, Homo sapiens
ctgcacctgcttct

SEQ ID NO: 4262893 - DNA, 15 bp, Homo sapiens
ctgcacctgcttctc

SEQ ID NO: 4262894 - DNA, 18 bp, Homo sapiens
ctgcacctgcttctcagc

SEQ ID NO: 4262895 - DNA, 14 bp, Homo sapiens
ctgcacgtgcacac

SEQ ID NO: 4262896 - DNA, 20 bp, Homo sapiens
ctgcacgtgcacacacctgc

SEQ ID NO: 4262897 - DNA, 16 bp, Homo sapiens
ctgcacttggcctctt

SEQ ID NO: 4262898 - DNA, 18 bp, Homo sapiens
ctgcagaccacactctgc

SEQ ID NO: 4262899 - DNA, 20 bp, Homo sapiens
ctgcagcacattgccctgag

SEQ ID NO: 4262900 - DNA, 14 bp, Homo sapiens
ctgcagcagagcct

SEQ ID NO: 4262901 - DNA, 13 bp, Homo sapiens
ctgcagccccagg

SEQ ID NO: 4262902 - DNA, 14 bp, Homo sapiens
ctgcagccccaggc

SEQ ID NO: 4262903 - DNA, 15 bp, Homo sapiens
ctgcagccccaggcc

SEQ ID NO: 4262904 - DNA, 16 bp, Homo sapiens
ctgcagccccaggcct

SEQ ID NO: 4262905 - DNA, 15 bp, Homo sapiens
ctgcaggaatcaaaa

SEQ ID NO: 4262906 - DNA, 20 bp, Homo sapiens
ctgcaggaatcaaaaattga

SEQ ID NO: 4262907 - DNA, 20 bp, Homo sapiens
ctgcaggcggtatccagagg

SEQ ID NO: 4262908 - DNA, 21 bp, Homo sapiens
ctgcaggcggtatccagaggt

SEQ ID NO: 4262909 - DNA, 15 bp, Homo sapiens
ctgcagggcagcctg

SEQ ID NO: 4262910 - DNA, 23 bp, Homo sapiens
ctgcagggcagcctgtgggagaa

SEQ ID NO: 4262911 - DNA, 16 bp, Homo sapiens
ctgcagggtagggggc

SEQ ID NO: 4262912 - DNA, 13 bp, Homo sapiens
ctgcagtcagcac

SEQ ID NO: 4262913 - DNA, 18 bp, Homo sapiens
ctgcagtcagcacagaga

SEQ ID NO: 4262914 - DNA, 16 bp, Homo sapiens
ctgcagttagcacaga

SEQ ID NO: 4262915 - DNA, 17 bp, Homo sapiens
ctgcagttagcacagag

SEQ ID NO: 4262916 - DNA, 19 bp, Homo sapiens
ctgcagttggcctcagcag

SEQ ID NO: 4262917 - DNA, 20 bp, Homo sapiens
ctgcagttggcctcagcaga

SEQ ID NO: 4262918 - DNA, 14 bp, Homo sapiens
ctgcataaccgcac

SEQ ID NO: 4262919 - DNA, 21 bp, Homo sapiens
ctgcatatagataattatcca

SEQ ID NO: 4262920 - DNA, 19 bp, Homo sapiens
ctgcatccctccaccccag

SEQ ID NO: 4262921 - DNA, 15 bp, Homo sapiens
ctgcatcccttggcc

SEQ ID NO: 4262922 - DNA, 17 bp, Homo sapiens
ctgcatcctcagcccca

SEQ ID NO: 4262923 - DNA, 13 bp, Homo sapiens
ctgcatgcaagct

SEQ ID NO: 4262924 - DNA, 15 bp, Homo sapiens
ctgcatgcaagctca

SEQ ID NO: 4262925 - DNA, 17 bp, Homo sapiens
ctgcatgcaagctcagg

SEQ ID NO: 4262926 - DNA, 20 bp, Homo sapiens
ctgcatgcaagctcagggtg

SEQ ID NO: 4262927 - DNA, 13 bp, Homo sapiens
ctgcatgctcctc

SEQ ID NO: 4262928 - DNA, 15 bp, Homo sapiens
ctgcatgctcctctg

SEQ ID NO: 4262929 - DNA, 17 bp, Homo sapiens
ctgcatgctcctctgcc

SEQ ID NO: 4262930 - DNA, 19 bp, Homo sapiens
ctgcatgctcctctgcctg

SEQ ID NO: 4262931 - DNA, 14 bp, Homo sapiens
ctgccaactttcca

SEQ ID NO: 4262932 - DNA, 15 bp, Homo sapiens
ctgccaactttccag

SEQ ID NO: 4262933 - DNA, 13 bp, Homo sapiens
ctgccacacttca

SEQ ID NO: 4262934 - DNA, 21 bp, Homo sapiens
ctgccactcaggcagcctgtg

SEQ ID NO: 4262935 - DNA, 22 bp, Homo sapiens
ctgccactcaggcagcctgtgg

SEQ ID NO: 4262936 - DNA, 18 bp, Homo sapiens
ctgccactctcctgagga

SEQ ID NO: 4262937 - DNA, 21 bp, Homo sapiens
ctgccactctcctgaggagca

SEQ ID NO: 4262938 - DNA, 16 bp, Homo sapiens
ctgccagaagtgtgtt

SEQ ID NO: 4262939 - DNA, 20 bp, Homo sapiens
ctgccagagaagcatcggag

SEQ ID NO: 4262940 - DNA, 14 bp, Homo sapiens
ctgccagaggcctg

SEQ ID NO: 4262941 - DNA, 16 bp, Homo sapiens
ctgccagaggcctggt

SEQ ID NO: 4262942 - DNA, 17 bp, Homo sapiens
ctgccaggctcccactg

SEQ ID NO: 4262943 - DNA, 21 bp, Homo sapiens
ctgccaggctcccactgcccc

SEQ ID NO: 4262944 - DNA, 22 bp, Homo sapiens
ctgccaggctcccactgcccct

SEQ ID NO: 4262945 - DNA, 16 bp, Homo sapiens
ctgccatcagcccctg

SEQ ID NO: 4262946 - DNA, 18 bp, Homo sapiens
ctgcccaccccctgctgg

SEQ ID NO: 4262947 - DNA, 12 bp, Homo sapiens
ctgcccaccccg

SEQ ID NO: 4262948 - DNA, 18 bp, Homo sapiens
ctgcccaccccgcctctg

SEQ ID NO: 4262949 - DNA, 19 bp, Homo sapiens
ctgcccaccccgcctctgg

SEQ ID NO: 4262950 - DNA, 15 bp, Homo sapiens
ctgcccacgctcctg

SEQ ID NO: 4262951 - DNA, 15 bp, Homo sapiens
ctgccccagagaagc

SEQ ID NO: 4262952 - DNA, 20 bp, Homo sapiens
ctgccccagagaagcctcag

SEQ ID NO: 4262953 - DNA, 23 bp, Homo sapiens
ctgccccagagaagcctcagtcc

SEQ ID NO: 4262954 - DNA, 19 bp, Homo sapiens
ctgccccatcccatccctt

SEQ ID NO: 4262955 - DNA, 15 bp, Homo sapiens
ctgcccccagacccc

SEQ ID NO: 4262956 - DNA, 19 bp, Homo sapiens
ctgccccccacattctggc

SEQ ID NO: 4262957 - DNA, 21 bp, Homo sapiens
ctgccccccacattctggctc

SEQ ID NO: 4262958 - DNA, 20 bp, Homo sapiens
ctgccccccttcccacccct

SEQ ID NO: 4262959 - DNA, 19 bp, Homo sapiens
ctgcccccttctcccacac

SEQ ID NO: 4262960 - DNA, 23 bp, Homo sapiens
ctgcccccttctcccacactgct

SEQ ID NO: 4262961 - DNA, 14 bp, Homo sapiens
ctgccccgcccccc

SEQ ID NO: 4262962 - DNA, 16 bp, Homo sapiens
ctgccccgccccccag

SEQ ID NO: 4262963 - DNA, 17 bp, Homo sapiens
ctgccccgccccccaga

SEQ ID NO: 4262964 - DNA, 18 bp, Homo sapiens
ctgccccgccccccagag

SEQ ID NO: 4262965 - DNA, 18 bp, Homo sapiens
ctgccccggccactctgt

SEQ ID NO: 4262966 - DNA, 19 bp, Homo sapiens
ctgccccgtcaccatctca

SEQ ID NO: 4262967 - DNA, 20 bp, Homo sapiens
ctgcccctgcacctgcttct

SEQ ID NO: 4262968 - DNA, 14 bp, Homo sapiens
ctgcccctgccccg

SEQ ID NO: 4262969 - DNA, 17 bp, Homo sapiens
ctgcccctgccccgtca

SEQ ID NO: 4262970 - DNA, 18 bp, Homo sapiens
ctgcccgagggcaggggc

SEQ ID NO: 4262971 - DNA, 22 bp, Homo sapiens
ctgcccgagggcaggggccgtg

SEQ ID NO: 4262972 - DNA, 15 bp, Homo sapiens
ctgcccggggcagct

SEQ ID NO: 4262973 - DNA, 22 bp, Homo sapiens
ctgcccggggcagctgccagag

SEQ ID NO: 4262974 - DNA, 20 bp, Homo sapiens
ctgcccgtgaggagggggag

SEQ ID NO: 4262975 - DNA, 21 bp, Homo sapiens
ctgccctagcagtttgcctct

SEQ ID NO: 4262976 - DNA, 14 bp, Homo sapiens
ctgccctcactcca

SEQ ID NO: 4262977 - DNA, 16 bp, Homo sapiens
ctgccctcactccact

SEQ ID NO: 4262978 - DNA, 19 bp, Homo sapiens
ctgccctcactccactccc

SEQ ID NO: 4262979 - DNA, 20 bp, Homo sapiens
ctgccctccctcggccccac

SEQ ID NO: 4262980 - DNA, 21 bp, Homo sapiens
ctgccctccctcggccccacc

SEQ ID NO: 4262981 - DNA, 22 bp, Homo sapiens
ctgccctcgtctccctggccac

SEQ ID NO: 4262982 - DNA, 18 bp, Homo sapiens
ctgccctctgccactgac

SEQ ID NO: 4262983 - DNA, 11 bp, Homo sapiens
ctgccctgcaa

SEQ ID NO: 4262984 - DNA, 13 bp, Homo sapiens
ctgccctgcaaac

SEQ ID NO: 4262985 - DNA, 13 bp, Homo sapiens
ctgccctggtgct

SEQ ID NO: 4262986 - DNA, 16 bp, Homo sapiens
ctgccgtgagagccca

SEQ ID NO: 4262987 - DNA, 22 bp, Homo sapiens
ctgccgtgagagcccaatcact

SEQ ID NO: 4262988 - DNA, 23 bp, Homo sapiens
ctgccgtgagagcccaatcactg

SEQ ID NO: 4262989 - DNA, 18 bp, Homo sapiens
ctgccgtgcacggggcca

SEQ ID NO: 4262990 - DNA, 16 bp, Homo sapiens
ctgcctaggagctggg

SEQ ID NO: 4262991 - DNA, 19 bp, Homo sapiens
ctgcctaggagctggggag

SEQ ID NO: 4262992 - DNA, 12 bp, Homo sapiens
ctgcctccccaa

SEQ ID NO: 4262993 - DNA, 22 bp, Homo sapiens
ctgcctccccaaccctgcccct

SEQ ID NO: 4262994 - DNA, 17 bp, Homo sapiens
ctgcctccggccctgcc

SEQ ID NO: 4262995 - DNA, 16 bp, Homo sapiens
ctgcctctgaaaatat

SEQ ID NO: 4262996 - DNA, 19 bp, Homo sapiens
ctgcctctgaaaatatttt

SEQ ID NO: 4262997 - DNA, 12 bp, Homo sapiens
ctgcctggccct

SEQ ID NO: 4262998 - DNA, 13 bp, Homo sapiens
ctgcctggccttg

SEQ ID NO: 4262999 - DNA, 19 bp, Homo sapiens
ctgcctgtccctctcaggc

SEQ ID NO: 4263000 - DNA, 20 bp, Homo sapiens
ctgcctgtccctctcaggca

SEQ ID NO: 4263001 - DNA, 23 bp, Homo sapiens
ctgcctgtccctctcaggcatgc

SEQ ID NO: 4263002 - DNA, 14 bp, Homo sapiens
ctgcctgtgagtga

SEQ ID NO: 4263003 - DNA, 13 bp, Homo sapiens
ctgcctgtgcccg

SEQ ID NO: 4263004 - DNA, 23 bp, Homo sapiens
ctgccttccaggcgtagggccag

SEQ ID NO: 4263005 - DNA, 13 bp, Homo sapiens
ctgccttctgcgg

SEQ ID NO: 4263006 - DNA, 24 bp, Homo sapiens
ctgccttctgcggagcttctccag

SEQ ID NO: 4263007 - DNA, 16 bp, Homo sapiens
ctgccttctgtctctt

SEQ ID NO: 4263008 - DNA, 18 bp, Homo sapiens
ctgccttctgtctcttgc

SEQ ID NO: 4263009 - DNA, 13 bp, Homo sapiens
ctgccttggacac

SEQ ID NO: 4263010 - DNA, 14 bp, Homo sapiens
ctgcctttgctgcc

SEQ ID NO: 4263011 - DNA, 16 bp, Homo sapiens
ctgcctttgctgcctt

SEQ ID NO: 4263012 - DNA, 18 bp, Homo sapiens
ctgcctttgctgccttct

SEQ ID NO: 4263013 - DNA, 20 bp, Homo sapiens
ctgccttttagttcctgtgc

SEQ ID NO: 4263014 - DNA, 21 bp, Homo sapiens
ctgccttttagttcctgtgca

SEQ ID NO: 4263015 - DNA, 16 bp, Homo sapiens
ctgcgacaccaccaac

SEQ ID NO: 4263016 - DNA, 16 bp, Homo sapiens
ctgcgatggtgctgca

SEQ ID NO: 4263017 - DNA, 18 bp, Homo sapiens
ctgcgatggtgctgcacc

SEQ ID NO: 4263018 - DNA, 15 bp, Homo sapiens
ctgcgccctccctcc

SEQ ID NO: 4263019 - DNA, 14 bp, Homo sapiens
ctgcgctgccctgc

SEQ ID NO: 4263020 - DNA, 18 bp, Homo sapiens
ctgcgctgccctgcaaac

SEQ ID NO: 4263021 - DNA, 18 bp, Homo sapiens
ctgcggagcttctccagc

SEQ ID NO: 4263022 - DNA, 18 bp, Homo sapiens
ctgcgtcccactgagtct

SEQ ID NO: 4263023 - DNA, 16 bp, Homo sapiens
ctgctacctggttttc

SEQ ID NO: 4263024 - DNA, 15 bp, Homo sapiens
ctgctaggtgggcca

SEQ ID NO: 4263025 - DNA, 16 bp, Homo sapiens
ctgctaggtgggccag

SEQ ID NO: 4263026 - DNA, 19 bp, Homo sapiens
ctcttcccccttcccctgc

SEQ ID NO: 4263027 - DNA, 13 bp, Homo sapiens
ctcttctccactg

SEQ ID NO: 4263028 - DNA, 14 bp, Homo sapiens
ctcttctccactgg

SEQ ID NO: 4263029 - DNA, 21 bp, Homo sapiens
ctcttctcttacgctctctgt

SEQ ID NO: 4263030 - DNA, 12 bp, Homo sapiens
ctcttgcccccc

SEQ ID NO: 4263031 - DNA, 13 bp, Homo sapiens
ctcttgcccccca

SEQ ID NO: 4263032 - DNA, 20 bp, Homo sapiens
ctcttgccccccaccccagc

SEQ ID NO: 4263033 - DNA, 18 bp, Homo sapiens
ctcttgggctgagactgg

SEQ ID NO: 4263034 - DNA, 15 bp, Homo sapiens
ctgaaaactggaata

SEQ ID NO: 4263035 - DNA, 19 bp, Homo sapiens
ctgaaaactggaataagaa

SEQ ID NO: 4263036 - DNA, 22 bp, Homo sapiens
ctgaaaactggaataagaagca

SEQ ID NO: 4263037 - DNA, 23 bp, Homo sapiens
ctgaaaagaaatgctaatgtaat

SEQ ID NO: 4263038 - DNA, 18 bp, Homo sapiens
ctgaaacacacaggccat

SEQ ID NO: 4263039 - DNA, 15 bp, Homo sapiens
ctgaaaccagaagac

SEQ ID NO: 4263040 - DNA, 22 bp, Homo sapiens
ctgaaaccagaagactggatca

SEQ ID NO: 4263041 - DNA, 23 bp, Homo sapiens
ctgaaaggcccaaaccaggggga

SEQ ID NO: 4263042 - DNA, 14 bp, Homo sapiens
ctgaacaatgaatg

SEQ ID NO: 4263043 - DNA, 19 bp, Homo sapiens
ctgaacgatccttcaaagt

SEQ ID NO: 4263044 - DNA, 13 bp, Homo sapiens
ctgaactgctgct

SEQ ID NO: 4263045 - DNA, 21 bp, Homo sapiens
ctgaagagcgctcctctgcct

SEQ ID NO: 4263046 - DNA, 12 bp, Homo sapiens
ctgaagatctca

SEQ ID NO: 4263047 - DNA, 13 bp, Homo sapiens
ctgaaggctttca

SEQ ID NO: 4263048 - DNA, 18 bp, Homo sapiens
ctgaaggctttcagggcc

SEQ ID NO: 4263049 - DNA, 17 bp, Homo sapiens
ctgaagtcactgcacag

SEQ ID NO: 4263050 - DNA, 18 bp, Homo sapiens
ctgaagtgaatacatggt

SEQ ID NO: 4263051 - DNA, 17 bp, Homo sapiens
ctgaagtgaccccagct

SEQ ID NO: 4263052 - DNA, 19 bp, Homo sapiens
ctgaagtgaccccagctcc

SEQ ID NO: 4263053 - DNA, 15 bp, Homo sapiens
ctgaatccctttcag

SEQ ID NO: 4263054 - DNA, 16 bp, Homo sapiens
ctgaatgtagccagcc

SEQ ID NO: 4263055 - DNA, 18 bp, Homo sapiens
ctgaatgtagccagccca

SEQ ID NO: 4263056 - DNA, 16 bp, Homo sapiens
ctgaatgtatgtaaat

SEQ ID NO: 4263057 - DNA, 19 bp, Homo sapiens
ctgaattcgagacaggcag

SEQ ID NO: 4263058 - DNA, 12 bp, Homo sapiens
ctgaatttaact

SEQ ID NO: 4263059 - DNA, 15 bp, Homo sapiens
ctgaatttaactact

SEQ ID NO: 4263060 - DNA, 21 bp, Homo sapiens
ctgacaaccaccgctccccag

SEQ ID NO: 4263061 - DNA, 12 bp, Homo sapiens
ctgaccacactt

SEQ ID NO: 4263062 - DNA, 17 bp, Homo sapiens
ctgaccacacttcctgt

SEQ ID NO: 4263063 - DNA, 20 bp, Homo sapiens
ctgaccacacttcctgtcca

SEQ ID NO: 4263064 - DNA, 18 bp, Homo sapiens
ctgaccagaagtggcagg

SEQ ID NO: 4263065 - DNA, 15 bp, Homo sapiens
ctgaccatgcatttt

SEQ ID NO: 4263066 - DNA, 12 bp, Homo sapiens
ctgacccattca

SEQ ID NO: 4263067 - DNA, 18 bp, Homo sapiens
ctgacccattcacatttt

SEQ ID NO: 4263068 - DNA, 16 bp, Homo sapiens
ctgaccccacctagaa

SEQ ID NO: 4263069 - DNA, 20 bp, Homo sapiens
ctgaccccacttatgctgct

SEQ ID NO: 4263070 - DNA, 13 bp, Homo sapiens
ctgaccttctgcg

SEQ ID NO: 4263071 - DNA, 21 bp, Homo sapiens
ctgactgtttacacctttccg

SEQ ID NO: 4263072 - DNA, 18 bp, Homo sapiens
ctgagaagagtcgagtga

SEQ ID NO: 4263073 - DNA, 16 bp, Homo sapiens
ctgagaatgcctaggc

SEQ ID NO: 4263074 - DNA, 15 bp, Homo sapiens
ctgagagcagaatga

SEQ ID NO: 4263075 - DNA, 16 bp, Homo sapiens
ctgagagcagaatgaa

SEQ ID NO: 4263076 - DNA, 19 bp, Homo sapiens
ctgagaggagcgtgtccta

SEQ ID NO: 4263077 - DNA, 21 bp, Homo sapiens
ctgagcagttgttatattcat

SEQ ID NO: 4263078 - DNA, 21 bp, Homo sapiens
ctgagccttagtttcagctga

SEQ ID NO: 4263079 - DNA, 20 bp, Homo sapiens
ctgagctcctctgggcagga

SEQ ID NO: 4263080 - DNA, 23 bp, Homo sapiens
ctgagctcctctgggcaggacct

SEQ ID NO: 4263081 - DNA, 18 bp, Homo sapiens
ctgagctgtgccagctgc

SEQ ID NO: 4263082 - DNA, 23 bp, Homo sapiens
ctgagctgtgccagctgcttctg

SEQ ID NO: 4263083 - DNA, 17 bp, Homo sapiens
ctgagcttggccagaag

SEQ ID NO: 4263084 - DNA, 13 bp, Homo sapiens
ctgaggagcagcc

SEQ ID NO: 4263085 - DNA, 20 bp, Homo sapiens
ctgaggagcagcccacctgc

SEQ ID NO: 4263086 - DNA, 23 bp, Homo sapiens
ctgaggcaaccccctcggagcct

SEQ ID NO: 4263087 - DNA, 18 bp, Homo sapiens
ctgaggccattatttcaa

SEQ ID NO: 4263088 - DNA, 18 bp, Homo sapiens
ctgagggcccttcccaac

SEQ ID NO: 4263089 - DNA, 14 bp, Homo sapiens
ctgaggggcagggc

SEQ ID NO: 4263090 - DNA, 15 bp, Homo sapiens
ctgaggggcagggcc

SEQ ID NO: 4263091 - DNA, 19 bp, Homo sapiens
ctgaggtgggccttccatg

SEQ ID NO: 4263092 - DNA, 16 bp, Homo sapiens
ctgaggttaaggggat

SEQ ID NO: 4263093 - DNA, 22 bp, Homo sapiens
ctgagtctgtgaataaagccac

SEQ ID NO: 4263094 - DNA, 17 bp, Homo sapiens
ctgagtgaagtccagtg

SEQ ID NO: 4263095 - DNA, 22 bp, Homo sapiens
ctgagtggtccacattctgctg

SEQ ID NO: 4263096 - DNA, 23 bp, Homo sapiens
ctgagtggtccacattctgctgc

SEQ ID NO: 4263097 - DNA, 20 bp, Homo sapiens
ctgatattggtgtgaatgct

SEQ ID NO: 4263098 - DNA, 12 bp, Homo sapiens
ctgatggccagg

SEQ ID NO: 4263099 - DNA, 15 bp, Homo sapiens
ctgatggccaggcct

SEQ ID NO: 4263100 - DNA, 17 bp, Homo sapiens
ctgattaaatttaatat

SEQ ID NO: 4263101 - DNA, 14 bp, Homo sapiens
ctgattattgaatg

SEQ ID NO: 4263102 - DNA, 18 bp, Homo sapiens
ctgattattgaatgttat

SEQ ID NO: 4263103 - DNA, 14 bp, Homo sapiens
ctgattcagggccc

SEQ ID NO: 4263104 - DNA, 21 bp, Homo sapiens
ctgattcagggcccctgaagt

SEQ ID NO: 4263105 - DNA, 20 bp, Homo sapiens
ctgattctatgcctgtattt

SEQ ID NO: 4263106 - DNA, 21 bp, Homo sapiens
ctgattctatgcctgtatttc

SEQ ID NO: 4263107 - DNA, 14 bp, Homo sapiens
ctgatttattttgt

SEQ ID NO: 4263108 - DNA, 18 bp, Homo sapiens
ctgatttattttgtatga

SEQ ID NO: 4263109 - DNA, 13 bp, Homo sapiens
ctgatttcccctc

SEQ ID NO: 4263110 - DNA, 17 bp, Homo sapiens
ctgatttgcaaatgcac

SEQ ID NO: 4263111 - DNA, 23 bp, Homo sapiens
ctgcaaacatggggttggctggg

SEQ ID NO: 4263112 - DNA, 13 bp, Homo sapiens
ctgcaaaggactg

SEQ ID NO: 4263113 - DNA, 22 bp, Homo sapiens
ctgcaaaggactgttttttcct

SEQ ID NO: 4263114 - DNA, 13 bp, Homo sapiens
ctgcaacactgga

SEQ ID NO: 4263115 - DNA, 23 bp, Homo sapiens
ctgcaagtcccagggagctctgc

SEQ ID NO: 4263116 - DNA, 11 bp, Homo sapiens
ctgcacacacc

SEQ ID NO: 4263117 - DNA, 13 bp, Homo sapiens
ctgcacacacctg

SEQ ID NO: 4263118 - DNA, 17 bp, Homo sapiens
ctgcacacacctgcaca

SEQ ID NO: 4263119 - DNA, 22 bp, Homo sapiens
ctgcacacacctgcacaccgtc

SEQ ID NO: 4263120 - DNA, 16 bp, Homo sapiens
ctgcacacccctgcac

SEQ ID NO: 4263121 - DNA, 15 bp, Homo sapiens
ctgcacaccgtccct

SEQ ID NO: 4263122 - DNA, 18 bp, Homo sapiens
ctgcacaccgtccctctc

SEQ ID NO: 4263123 - DNA, 21 bp, Homo sapiens
ctgcacagtgcatctcagccc

SEQ ID NO: 4263124 - DNA, 14 bp, Homo sapiens
ctgcaccccacagg

SEQ ID NO: 4263125 - DNA, 20 bp, Homo sapiens
ctgcacccctggtgtccctg

SEQ ID NO: 4263126 - DNA, 16 bp, Homo sapiens
ctgcaccctctgctat

SEQ ID NO: 4263127 - DNA, 23 bp, Homo sapiens
ctgcaccctctgctatgtctgtg

SEQ ID NO: 4263128 - DNA, 19 bp, Homo sapiens
ctgcacctgcagggagcag

SEQ ID NO: 4263129 - DNA, 19 bp, Homo sapiens
ctcagcctccactccctgt

SEQ ID NO: 4263130 - DNA, 23 bp, Homo sapiens
ctcagcctccggatgacacaaat

SEQ ID NO: 4263131 - DNA, 16 bp, Homo sapiens
ctcagctgtctgtggc

SEQ ID NO: 4263132 - DNA, 13 bp, Homo sapiens
ctcaggagaaggc

SEQ ID NO: 4263133 - DNA, 18 bp, Homo sapiens
ctcaggcaattccttttg

SEQ ID NO: 4263134 - DNA, 14 bp, Homo sapiens
ctcaggcagcctgt

SEQ ID NO: 4263135 - DNA, 17 bp, Homo sapiens
ctcaggcagtggcccag

SEQ ID NO: 4263136 - DNA, 22 bp, Homo sapiens
ctcaggccacctgcccccttct

SEQ ID NO: 4263137 - DNA, 10 bp, Homo sapiens
ctcaggccca

SEQ ID NO: 4263138 - DNA, 22 bp, Homo sapiens
ctcaggcccacattgcccacac

SEQ ID NO: 4263139 - DNA, 15 bp, Homo sapiens
ctcaggcctggccct

SEQ ID NO: 4263140 - DNA, 19 bp, Homo sapiens
ctcaggcctggccctttca

SEQ ID NO: 4263141 - DNA, 13 bp, Homo sapiens
ctcaggctactgc

SEQ ID NO: 4263142 - DNA, 14 bp, Homo sapiens
ctcagggctggatt

SEQ ID NO: 4263143 - DNA, 13 bp, Homo sapiens
ctcaggggagact

SEQ ID NO: 4263144 - DNA, 22 bp, Homo sapiens
ctcaggttgtctgaagtcactg

SEQ ID NO: 4263145 - DNA, 18 bp, Homo sapiens
ctcagtccctccctcctg

SEQ ID NO: 4263146 - DNA, 19 bp, Homo sapiens
ctcagtccctccctcctgg

SEQ ID NO: 4263147 - DNA, 21 bp, Homo sapiens
ctcagtccctccctcctggct

SEQ ID NO: 4263148 - DNA, 22 bp, Homo sapiens
ctcagtctttgggggattcaaa

SEQ ID NO: 4263149 - DNA, 16 bp, Homo sapiens
ctcagtggactttcca

SEQ ID NO: 4263150 - DNA, 15 bp, Homo sapiens
ctcatcccaaaagct

SEQ ID NO: 4263151 - DNA, 15 bp, Homo sapiens
ctcatccccaaactg

SEQ ID NO: 4263152 - DNA, 15 bp, Homo sapiens
ctcatctcttctttt

SEQ ID NO: 4263153 - DNA, 14 bp, Homo sapiens
ctcatctgtcacca

SEQ ID NO: 4263154 - DNA, 12 bp, Homo sapiens
ctcatgaacctc

SEQ ID NO: 4263155 - DNA, 20 bp, Homo sapiens
ctcatgcactgcaaatactt

SEQ ID NO: 4263156 - DNA, 12 bp, Homo sapiens
ctcatgcctgag

SEQ ID NO: 4263157 - DNA, 14 bp, Homo sapiens
ctcatgcctgagaa

SEQ ID NO: 4263158 - DNA, 15 bp, Homo sapiens
ctcatgggagtcagg

SEQ ID NO: 4263159 - DNA, 18 bp, Homo sapiens
ctcattacagatttagtt

SEQ ID NO: 4263160 - DNA, 22 bp, Homo sapiens
ctcattcctctgtccccgagcc

SEQ ID NO: 4263161 - DNA, 22 bp, Homo sapiens
ctcattcttttcagcttgtttc

SEQ ID NO: 4263162 - DNA, 15 bp, Homo sapiens
ctccaaggcaaatgt

SEQ ID NO: 4263163 - DNA, 16 bp, Homo sapiens
ctccaaggcaaatgtc

SEQ ID NO: 4263164 - DNA, 18 bp, Homo sapiens
ctccaaggcaaatgtcca

SEQ ID NO: 4263165 - DNA, 21 bp, Homo sapiens
ctccaaggcaaatgtccaagc

SEQ ID NO: 4263166 - DNA, 22 bp, Homo sapiens
ctccaaggcaaatgtccaagca

SEQ ID NO: 4263167 - DNA, 22 bp, Homo sapiens
ctccaatcccaccaaccctcag

SEQ ID NO: 4263168 - DNA, 19 bp, Homo sapiens
ctccaccccagtccccggg

SEQ ID NO: 4263169 - DNA, 13 bp, Homo sapiens
ctccacccctcaa

SEQ ID NO: 4263170 - DNA, 18 bp, Homo sapiens
ctccacccctcaagccag

SEQ ID NO: 4263171 - DNA, 21 bp, Homo sapiens
ctccacccctcaagccaggag

SEQ ID NO: 4263172 - DNA, 20 bp, Homo sapiens
ctccacccgtcctggggtgg

SEQ ID NO: 4263173 - DNA, 14 bp, Homo sapiens
ctccacctgcagcc

SEQ ID NO: 4263174 - DNA, 18 bp, Homo sapiens
ctccacctgcagccccag

SEQ ID NO: 4263175 - DNA, 21 bp, Homo sapiens
ctccacctgcagccccaggcc

SEQ ID NO: 4263176 - DNA, 13 bp, Homo sapiens
ctccacctgggag

SEQ ID NO: 4263177 - DNA, 14 bp, Homo sapiens
ctccacctgggaga

SEQ ID NO: 4263178 - DNA, 21 bp, Homo sapiens
ctccacctgggagatgctggg

SEQ ID NO: 4263179 - DNA, 13 bp, Homo sapiens
ctccacgggggcc

SEQ ID NO: 4263180 - DNA, 18 bp, Homo sapiens
ctccacgggggcctagtg

SEQ ID NO: 4263181 - DNA, 12 bp, Homo sapiens
ctccactcagca

SEQ ID NO: 4263182 - DNA, 13 bp, Homo sapiens
ctccactcagcac

SEQ ID NO: 4263183 - DNA, 18 bp, Homo sapiens
ctccactcagcacaatta

SEQ ID NO: 4263184 - DNA, 16 bp, Homo sapiens
ctccactcccctcatc

SEQ ID NO: 4263185 - DNA, 16 bp, Homo sapiens
ctccactccctgtctg

SEQ ID NO: 4263186 - DNA, 13 bp, Homo sapiens
ctccactgccttc

SEQ ID NO: 4263187 - DNA, 16 bp, Homo sapiens
ctccactggatggagg

SEQ ID NO: 4263188 - DNA, 13 bp, Homo sapiens
ctccagacattgt

SEQ ID NO: 4263189 - DNA, 9 bp, Homo sapiens
ctccagacc

SEQ ID NO: 4263190 - DNA, 12 bp, Homo sapiens
ctccagaccccc

SEQ ID NO: 4263191 - DNA, 15 bp, Homo sapiens
ctccagacccctacc

SEQ ID NO: 4263192 - DNA, 22 bp, Homo sapiens
ctccagacccctaccctttccc

SEQ ID NO: 4263193 - DNA, 23 bp, Homo sapiens
ctccagacccctaccctttccca

SEQ ID NO: 4263194 - DNA, 15 bp, Homo sapiens
ctccagacccctggc

SEQ ID NO: 4263195 - DNA, 17 bp, Homo sapiens
ctccagacccctggctt

SEQ ID NO: 4263196 - DNA, 21 bp, Homo sapiens
ctccagacccctggcttttca

SEQ ID NO: 4263197 - DNA, 21 bp, Homo sapiens
ctccagagtaggtgggtcttg

SEQ ID NO: 4263198 - DNA, 13 bp, Homo sapiens
ctccagccaaccc

SEQ ID NO: 4263199 - DNA, 17 bp, Homo sapiens
ctccagccaacccctgt

SEQ ID NO: 4263200 - DNA, 16 bp, Homo sapiens
ctccaggaaaactgtt

SEQ ID NO: 4263201 - DNA, 14 bp, Homo sapiens
ctccaggagaggag

SEQ ID NO: 4263202 - DNA, 18 bp, Homo sapiens
ctccaggattgtccacaa

SEQ ID NO: 4263203 - DNA, 21 bp, Homo sapiens
ctccaggcccagcctggcccc

SEQ ID NO: 4263204 - DNA, 17 bp, Homo sapiens
ctccaggcttcctgccc

SEQ ID NO: 4263205 - DNA, 18 bp, Homo sapiens
ctccaggcttcctgccct

SEQ ID NO: 4263206 - DNA, 20 bp, Homo sapiens
ctccagtctgctgccctcca

SEQ ID NO: 4263207 - DNA, 17 bp, Homo sapiens
ctccagtgttttcttgt

SEQ ID NO: 4263208 - DNA, 19 bp, Homo sapiens
ctccatatcccgggagcag

SEQ ID NO: 4263209 - DNA, 22 bp, Homo sapiens
ctccatgattccaagggcccag

SEQ ID NO: 4263210 - DNA, 18 bp, Homo sapiens
ctccatgcagatctagcc

SEQ ID NO: 4263211 - DNA, 16 bp, Homo sapiens
ctccatgtagaagagg

SEQ ID NO: 4263212 - DNA, 21 bp, Homo sapiens
ctccatttcttggttttgtat

SEQ ID NO: 4263213 - DNA, 22 bp, Homo sapiens
ctcccaaatatgcccctcccca

SEQ ID NO: 4263214 - DNA, 16 bp, Homo sapiens
ctcccacaggcccttc

SEQ ID NO: 4263215 - DNA, 19 bp, Homo sapiens
ctcccaccacagcaggtgt

SEQ ID NO: 4263216 - DNA, 12 bp, Homo sapiens
ctcccacgccct

SEQ ID NO: 4263217 - DNA, 17 bp, Homo sapiens
ctcccactgcccctgca

SEQ ID NO: 4263218 - DNA, 14 bp, Homo sapiens
ctcccagcagaggc

SEQ ID NO: 4263219 - DNA, 15 bp, Homo sapiens
ctcccagcagaggcc

SEQ ID NO: 4263220 - DNA, 15 bp, Homo sapiens
ctcccagctctagac

SEQ ID NO: 4263221 - DNA, 16 bp, Homo sapiens
ctcccaggacgcaggg

SEQ ID NO: 4263222 - DNA, 14 bp, Homo sapiens
ctcccaggcgcccc

SEQ ID NO: 4263223 - DNA, 22 bp, Homo sapiens
ctcccaggcgccccttccccct

SEQ ID NO: 4263224 - DNA, 17 bp, Homo sapiens
ctcccaggggcctttgc

SEQ ID NO: 4263225 - DNA, 14 bp, Homo sapiens
ctcccatccagcgt

SEQ ID NO: 4263226 - DNA, 16 bp, Homo sapiens
ctcccatccagcgtct

SEQ ID NO: 4263227 - DNA, 18 bp, Homo sapiens
ctcccatgggggctccag

SEQ ID NO: 4263228 - DNA, 14 bp, Homo sapiens
ctcccatttgcaga

SEQ ID NO: 4263229 - DNA, 12 bp, Homo sapiens
ctccccaaccct

SEQ ID NO: 4263230 - DNA, 17 bp, Homo sapiens
ctccccaaccctgcccc

SEQ ID NO: 4263231 - DNA, 13 bp, Homo sapiens
ctccccaatcacg

SEQ ID NO: 4263232 - DNA, 21 bp, Homo sapiens
ctccccaatccaacccatgca

SEQ ID NO: 4263233 - DNA, 19 bp, Homo sapiens
ctccccagcaggtggggag

SEQ ID NO: 4263234 - DNA, 21 bp, Homo sapiens
ctccccatggctcctcaccac

SEQ ID NO: 4263235 - DNA, 15 bp, Homo sapiens
ctccccatggtgcag

SEQ ID NO: 4263236 - DNA, 12 bp, Homo sapiens
ctccccctgcca

SEQ ID NO: 4263237 - DNA, 17 bp, Homo sapiens
ctccccgatccccgaca

SEQ ID NO: 4263238 - DNA, 22 bp, Homo sapiens
ctccccggacaagcccaggaca

SEQ ID NO: 4263239 - DNA, 13 bp, Homo sapiens
ctcccctccaagt

SEQ ID NO: 4263240 - DNA, 11 bp, Homo sapiens
ctcccctccag

SEQ ID NO: 4263241 - DNA, 16 bp, Homo sapiens
ctcccctccagacccc

SEQ ID NO: 4263242 - DNA, 20 bp, Homo sapiens
ctcccctccagacccctacc

SEQ ID NO: 4263243 - DNA, 13 bp, Homo sapiens
ctcccctggtcct

SEQ ID NO: 4263244 - DNA, 16 bp, Homo sapiens
ctcccctggtcctgca

SEQ ID NO: 4263245 - DNA, 22 bp, Homo sapiens
ctccctagtgacccggaggcca

SEQ ID NO: 4263246 - DNA, 13 bp, Homo sapiens
ctccctcagccac

SEQ ID NO: 4263247 - DNA, 15 bp, Homo sapiens
ctccctcagcccctc

SEQ ID NO: 4263248 - DNA, 20 bp, Homo sapiens
ctccctccacacctccaccc

SEQ ID NO: 4263249 - DNA, 14 bp, Homo sapiens
ctccctccactcct

SEQ ID NO: 4263250 - DNA, 15 bp, Homo sapiens
ctccctccactcctc

SEQ ID NO: 4263251 - DNA, 21 bp, Homo sapiens
ctccctcccccggggtctcca

SEQ ID NO: 4263252 - DNA, 15 bp, Homo sapiens
ctccctccctccaca

SEQ ID NO: 4263253 - DNA, 18 bp, Homo sapiens
ctccctcctggctcacag

SEQ ID NO: 4263254 - DNA, 21 bp, Homo sapiens
ctccctcctggctcacagcca

SEQ ID NO: 4263255 - DNA, 20 bp, Homo sapiens
ctccctcggccccacccacc

SEQ ID NO: 4263256 - DNA, 18 bp, Homo sapiens
ctccctgcccctcccttc

SEQ ID NO: 4263257 - DNA, 14 bp, Homo sapiens
ctccctgctccctg

SEQ ID NO: 4263258 - DNA, 16 bp, Homo sapiens
ctccctgctccctgct

SEQ ID NO: 4263259 - DNA, 19 bp, Homo sapiens
ctccctgctccctgctccc

SEQ ID NO: 4263260 - DNA, 22 bp, Homo sapiens
ctccctggactctgtggggcca

SEQ ID NO: 4263261 - DNA, 16 bp, Homo sapiens
ctccctggcctgttct

SEQ ID NO: 4263262 - DNA, 15 bp, Homo sapiens
ctccctgggctggca

SEQ ID NO: 4263263 - DNA, 17 bp, Homo sapiens
ctccctgggctggcatg

SEQ ID NO: 4263264 - DNA, 19 bp, Homo sapiens
ccagccaacccctgtggag

SEQ ID NO: 4263265 - DNA, 19 bp, Homo sapiens
ccagccacccggatctcca

SEQ ID NO: 4263266 - DNA, 12 bp, Homo sapiens
ccagccagcagg

SEQ ID NO: 4263267 - DNA, 13 bp, Homo sapiens
ccagccagcaggt

SEQ ID NO: 4263268 - DNA, 12 bp, Homo sapiens
ccagcccagatg

SEQ ID NO: 4263269 - DNA, 18 bp, Homo sapiens
ccagcccagatggctccc

SEQ ID NO: 4263270 - DNA, 11 bp, Homo sapiens
ccagcccctcc

SEQ ID NO: 4263271 - DNA, 13 bp, Homo sapiens
ccagcccctccca

SEQ ID NO: 4263272 - DNA, 16 bp, Homo sapiens
ccagcccctcccacca

SEQ ID NO: 4263273 - DNA, 20 bp, Homo sapiens
ccagcccctcccaccacagc

SEQ ID NO: 4263274 - DNA, 11 bp, Homo sapiens
ccagcctcagt

SEQ ID NO: 4263275 - DNA, 14 bp, Homo sapiens
ccagcctggcccca

SEQ ID NO: 4263276 - DNA, 17 bp, Homo sapiens
ccagcgagtctggagac

SEQ ID NO: 4263277 - DNA, 17 bp, Homo sapiens
ccagcggatgctgccag

SEQ ID NO: 4263278 - DNA, 14 bp, Homo sapiens
ccagctccaggcag

SEQ ID NO: 4263279 - DNA, 9 bp, Homo sapiens
ccagctccc

SEQ ID NO: 4263280 - DNA, 18 bp, Homo sapiens
ccagctcctttccctgga

SEQ ID NO: 4263281 - DNA, 17 bp, Homo sapiens
ccagctctagacaaccc

SEQ ID NO: 4263282 - DNA, 22 bp, Homo sapiens
ccagctctagacaaccctgcaa

SEQ ID NO: 4263283 - DNA, 14 bp, Homo sapiens
ccagctctcccctg

SEQ ID NO: 4263284 - DNA, 17 bp, Homo sapiens
ccagctgctcctcgcag

SEQ ID NO: 4263285 - DNA, 12 bp, Homo sapiens
ccagctgcttct

SEQ ID NO: 4263286 - DNA, 15 bp, Homo sapiens
ccagctgcttctgcc

SEQ ID NO: 4263287 - DNA, 18 bp, Homo sapiens
ccagctggctctgcagca

SEQ ID NO: 4263288 - DNA, 17 bp, Homo sapiens
ccaggaagaaggcccgg

SEQ ID NO: 4263289 - DNA, 19 bp, Homo sapiens
ccaggaagaaggcccggga

SEQ ID NO: 4263290 - DNA, 20 bp, Homo sapiens
ccaggaagaaggcccgggag

SEQ ID NO: 4263291 - DNA, 19 bp, Homo sapiens
ccaggaaggaagagcaagc

SEQ ID NO: 4263292 - DNA, 18 bp, Homo sapiens
ccaggaaggcggggcttc

SEQ ID NO: 4263293 - DNA, 20 bp, Homo sapiens
ccaggaagtcatcctgcaat

SEQ ID NO: 4263294 - DNA, 12 bp, Homo sapiens
ccaggacactgc

SEQ ID NO: 4263295 - DNA, 19 bp, Homo sapiens
ccaggacactgcctttgct

SEQ ID NO: 4263296 - DNA, 13 bp, Homo sapiens
ccaggaccctgag

SEQ ID NO: 4263297 - DNA, 16 bp, Homo sapiens
ccaggaccctgagggt

SEQ ID NO: 4263298 - DNA, 13 bp, Homo sapiens
ccaggaccctggg

SEQ ID NO: 4263299 - DNA, 22 bp, Homo sapiens
ccaggaccctgggtcaccttcc

SEQ ID NO: 4263300 - DNA, 12 bp, Homo sapiens
ccaggacctctg

SEQ ID NO: 4263301 - DNA, 13 bp, Homo sapiens
ccaggacctctgg

SEQ ID NO: 4263302 - DNA, 13 bp, Homo sapiens
ccaggactctgcc

SEQ ID NO: 4263303 - DNA, 21 bp, Homo sapiens
ccaggactctgccttccaggc

SEQ ID NO: 4263304 - DNA, 12 bp, Homo sapiens
ccaggagaccct

SEQ ID NO: 4263305 - DNA, 13 bp, Homo sapiens
ccaggagaccctg

SEQ ID NO: 4263306 - DNA, 22 bp, Homo sapiens
ccaggagagcccccaccagcag

SEQ ID NO: 4263307 - DNA, 24 bp, Homo sapiens
ccaggagagcccccaccagcagca

SEQ ID NO: 4263308 - DNA, 21 bp, Homo sapiens
ccaggagtgggtgggacacag

SEQ ID NO: 4263309 - DNA, 16 bp, Homo sapiens
ccaggatggtcccagc

SEQ ID NO: 4263310 - DNA, 23 bp, Homo sapiens
ccaggattaatctctaaaattct

SEQ ID NO: 4263311 - DNA, 13 bp, Homo sapiens
ccaggattgtcca

SEQ ID NO: 4263312 - DNA, 22 bp, Homo sapiens
ccaggattgtccacaaatgtcc

SEQ ID NO: 4263313 - DNA, 23 bp, Homo sapiens
ccaggcaatggcctaaacttcag

SEQ ID NO: 4263314 - DNA, 18 bp, Homo sapiens
ccaggcagggagggaaac

SEQ ID NO: 4263315 - DNA, 19 bp, Homo sapiens
ccaggcatgaccctggagc

SEQ ID NO: 4263316 - DNA, 22 bp, Homo sapiens
ccaggcatgaccctggagcccg

SEQ ID NO: 4263317 - DNA, 16 bp, Homo sapiens
ccaggcatgggtccct

SEQ ID NO: 4263318 - DNA, 19 bp, Homo sapiens
ccaggcatgggtcccttcc

SEQ ID NO: 4263319 - DNA, 17 bp, Homo sapiens
ccaggcccagcctggcc

SEQ ID NO: 4263320 - DNA, 19 bp, Homo sapiens
ccaggcccagcctggcccc

SEQ ID NO: 4263321 - DNA, 16 bp, Homo sapiens
ccaggccccaggctgg

SEQ ID NO: 4263322 - DNA, 18 bp, Homo sapiens
ccaggccccaggctggat

SEQ ID NO: 4263323 - DNA, 18 bp, Homo sapiens
ccaggctcccactgcccc

SEQ ID NO: 4263324 - DNA, 15 bp, Homo sapiens
ccaggctggatgctg

SEQ ID NO: 4263325 - DNA, 21 bp, Homo sapiens
ccagggaatcagggagcactg

SEQ ID NO: 4263326 - DNA, 23 bp, Homo sapiens
ccagggaccacgggcgaggacgt

SEQ ID NO: 4263327 - DNA, 17 bp, Homo sapiens
ccagggagaggccatga

SEQ ID NO: 4263328 - DNA, 15 bp, Homo sapiens
ccagggccctgctca

SEQ ID NO: 4263329 - DNA, 19 bp, Homo sapiens
ccagggccctgctcaggcc

SEQ ID NO: 4263330 - DNA, 23 bp, Homo sapiens
ccagggctccacgggggcctagt

SEQ ID NO: 4263331 - DNA, 14 bp, Homo sapiens
ccagggctctggca

SEQ ID NO: 4263332 - DNA, 17 bp, Homo sapiens
ccagggctctggcaggt

SEQ ID NO: 4263333 - DNA, 12 bp, Homo sapiens
ccagggctgtcc

SEQ ID NO: 4263334 - DNA, 15 bp, Homo sapiens
ccagggctgtcctta

SEQ ID NO: 4263335 - DNA, 17 bp, Homo sapiens
ccaggggcacacttccc

SEQ ID NO: 4263336 - DNA, 17 bp, Homo sapiens
ccaggggcctttgcagc

SEQ ID NO: 4263337 - DNA, 23 bp, Homo sapiens
ccagggggaagcaccagcctcag

SEQ ID NO: 4263338 - DNA, 20 bp, Homo sapiens
ccagggttaaagaaaggcag

SEQ ID NO: 4263339 - DNA, 15 bp, Homo sapiens
ccagggttccagaca

SEQ ID NO: 4263340 - DNA, 17 bp, Homo sapiens
ccagggttccagacagg

SEQ ID NO: 4263341 - DNA, 14 bp, Homo sapiens
ccagggttccccca

SEQ ID NO: 4263342 - DNA, 13 bp, Homo sapiens
ccaggtctcctgg

SEQ ID NO: 4263343 - DNA, 21 bp, Homo sapiens
ccaggtggccactccagaccc

SEQ ID NO: 4263344 - DNA, 16 bp, Homo sapiens
ccaggtgtcctgactg

SEQ ID NO: 4263345 - DNA, 19 bp, Homo sapiens
ccaggtttaagtagatttc

SEQ ID NO: 4263346 - DNA, 15 bp, Homo sapiens
ccagtaactcatctg

SEQ ID NO: 4263347 - DNA, 16 bp, Homo sapiens
ccagtaactcatctgt

SEQ ID NO: 4263348 - DNA, 22 bp, Homo sapiens
ccagtagctacggttccctgcc

SEQ ID NO: 4263349 - DNA, 15 bp, Homo sapiens
ccagtcatggctgtc

SEQ ID NO: 4263350 - DNA, 17 bp, Homo sapiens
ccagtcatggctgtccc

SEQ ID NO: 4263351 - DNA, 18 bp, Homo sapiens
ccagtcatggctgtcccc

SEQ ID NO: 4263352 - DNA, 21 bp, Homo sapiens
ccagtcatggctgtcccctgc

SEQ ID NO: 4263353 - DNA, 23 bp, Homo sapiens
ccagtcttgagtgggccccctct

SEQ ID NO: 4263354 - DNA, 16 bp, Homo sapiens
ccagtcttttgaaaga

SEQ ID NO: 4263355 - DNA, 15 bp, Homo sapiens
ccagtgaccctggag

SEQ ID NO: 4263356 - DNA, 16 bp, Homo sapiens
ccagtgaccctggagc

SEQ ID NO: 4263357 - DNA, 17 bp, Homo sapiens
ccagtgaccctggagct

SEQ ID NO: 4263358 - DNA, 15 bp, Homo sapiens
ccagtgactccagga

SEQ ID NO: 4263359 - DNA, 21 bp, Homo sapiens
ccagtgactgctgcgctgtgc

SEQ ID NO: 4263360 - DNA, 13 bp, Homo sapiens
ccagtgtccccag

SEQ ID NO: 4263361 - DNA, 18 bp, Homo sapiens
ccagtgtccccaggggca

SEQ ID NO: 4263362 - DNA, 19 bp, Homo sapiens
ccagtgtctaccttcattt

SEQ ID NO: 4263363 - DNA, 22 bp, Homo sapiens
ccagtgtgggaatgcggcaaga

SEQ ID NO: 4263364 - DNA, 15 bp, Homo sapiens
ccagtgttttcttgt

SEQ ID NO: 4263365 - DNA, 13 bp, Homo sapiens
ccagttctctttg

SEQ ID NO: 4263366 - DNA, 14 bp, Homo sapiens
ccagttctgatgag

SEQ ID NO: 4263367 - DNA, 13 bp, Homo sapiens
ccataaaataaat

SEQ ID NO: 4263368 - DNA, 15 bp, Homo sapiens
ccataccccctgccc

SEQ ID NO: 4263369 - DNA, 22 bp, Homo sapiens
ccataccccctgccccagagaa

SEQ ID NO: 4263370 - DNA, 18 bp, Homo sapiens
ccatagtttgaattcatg

SEQ ID NO: 4263371 - DNA, 19 bp, Homo sapiens
ccatatgacaatttcaaaa

SEQ ID NO: 4263372 - DNA, 13 bp, Homo sapiens
ccatcagcagtga

SEQ ID NO: 4263373 - DNA, 20 bp, Homo sapiens
ccccacaggagcgtgtccta

SEQ ID NO: 4263374 - DNA, 11 bp, Homo sapiens
ccccacaggat

SEQ ID NO: 4263375 - DNA, 17 bp, Homo sapiens
ccccaccacacacaccc

SEQ ID NO: 4263376 - DNA, 18 bp, Homo sapiens
ccccaccagcagcacaat

SEQ ID NO: 4263377 - DNA, 13 bp, Homo sapiens
ccccaccccagcc

SEQ ID NO: 4263378 - DNA, 23 bp, Homo sapiens
ccccaccttccctccacctgctt

SEQ ID NO: 4263379 - DNA, 23 bp, Homo sapiens
ccccactctgctgaggccagagg

SEQ ID NO: 4263380 - DNA, 15 bp, Homo sapiens
ccccactgcctgccc

SEQ ID NO: 4263381 - DNA, 16 bp, Homo sapiens
ccccactgcctgccca

SEQ ID NO: 4263382 - DNA, 18 bp, Homo sapiens
ccccacttatgctgctgt

SEQ ID NO: 4263383 - DNA, 17 bp, Homo sapiens
ccccagagaagcctcag

SEQ ID NO: 4263384 - DNA, 21 bp, Homo sapiens
ccccagagccagggctgtcct

SEQ ID NO: 4263385 - DNA, 22 bp, Homo sapiens
ccccagagccagggctgtcctt

SEQ ID NO: 4263386 - DNA, 15 bp, Homo sapiens
ccccagcagtcctgg

SEQ ID NO: 4263387 - DNA, 18 bp, Homo sapiens
ccccagccccctggcccc

SEQ ID NO: 4263388 - DNA, 21 bp, Homo sapiens
ccccagcctaagatgaagagg

SEQ ID NO: 4263389 - DNA, 11 bp, Homo sapiens
ccccagctcca

SEQ ID NO: 4263390 - DNA, 14 bp, Homo sapiens
ccccaggaccctga

SEQ ID NO: 4263391 - DNA, 14 bp, Homo sapiens
ccccaggcaggctg

SEQ ID NO: 4263392 - DNA, 16 bp, Homo sapiens
ccccagggccctgctc

SEQ ID NO: 4263393 - DNA, 13 bp, Homo sapiens
ccccagtccccgg

SEQ ID NO: 4263394 - DNA, 16 bp, Homo sapiens
ccccagtgtccccagg

SEQ ID NO: 4263395 - DNA, 20 bp, Homo sapiens
ccccagtgtccccaggggca

SEQ ID NO: 4263396 - DNA, 14 bp, Homo sapiens
ccccagtgtggact

SEQ ID NO: 4263397 - DNA, 19 bp, Homo sapiens
ccccagtgtggactctgga

SEQ ID NO: 4263398 - DNA, 15 bp, Homo sapiens
ccccatccagccagg

SEQ ID NO: 4263399 - DNA, 13 bp, Homo sapiens
ccccatcctcccc

SEQ ID NO: 4263400 - DNA, 18 bp, Homo sapiens
ccccatcctccccttccc

SEQ ID NO: 4263401 - DNA, 16 bp, Homo sapiens
ccccatgccctccctg

SEQ ID NO: 4263402 - DNA, 19 bp, Homo sapiens
ccccattgccttctgggga

SEQ ID NO: 4263403 - DNA, 18 bp, Homo sapiens
ccccatttaggtttctga

SEQ ID NO: 4263404 - DNA, 15 bp, Homo sapiens
cccccaccccttccc

SEQ ID NO: 4263405 - DNA, 13 bp, Homo sapiens
cccccagagccag

SEQ ID NO: 4263406 - DNA, 12 bp, Homo sapiens
cccccagccctg

SEQ ID NO: 4263407 - DNA, 12 bp, Homo sapiens
cccccagctcct

SEQ ID NO: 4263408 - DNA, 13 bp, Homo sapiens
cccccccatgcag

SEQ ID NO: 4263409 - DNA, 13 bp, Homo sapiens
cccccctccccaa

SEQ ID NO: 4263410 - DNA, 19 bp, Homo sapiens
cccccgctctgccatcagc

SEQ ID NO: 4263411 - DNA, 24 bp, Homo sapiens
cccccgggtttggcgggccaagga

SEQ ID NO: 4263412 - DNA, 12 bp, Homo sapiens
ccccctccccaa

SEQ ID NO: 4263413 - DNA, 13 bp, Homo sapiens
ccccctcggagcc

SEQ ID NO: 4263414 - DNA, 19 bp, Homo sapiens
ccccctcggagcctgtgtt

SEQ ID NO: 4263415 - DNA, 10 bp, Homo sapiens
ccccctctct

SEQ ID NO: 4263416 - DNA, 21 bp, Homo sapiens
ccccctctcttaccccgtccc

SEQ ID NO: 4263417 - DNA, 18 bp, Homo sapiens
ccccctgccagaggcctg

SEQ ID NO: 4263418 - DNA, 19 bp, Homo sapiens
ccccctggggggcacagcc

SEQ ID NO: 4263419 - DNA, 20 bp, Homo sapiens
ccccctggggggcacagcca

SEQ ID NO: 4263420 - DNA, 12 bp, Homo sapiens
ccccctgtcctt

SEQ ID NO: 4263421 - DNA, 15 bp, Homo sapiens
ccccgacagtggctc

SEQ ID NO: 4263422 - DNA, 20 bp, Homo sapiens
ccccgagccgagctctcctg

SEQ ID NO: 4263423 - DNA, 13 bp, Homo sapiens
ccccgccccacat

SEQ ID NO: 4263424 - DNA, 13 bp, Homo sapiens
ccccgccccccag

SEQ ID NO: 4263425 - DNA, 13 bp, Homo sapiens
ccccgccccgccc

SEQ ID NO: 4263426 - DNA, 13 bp, Homo sapiens
ccccgcctctggg

SEQ ID NO: 4263427 - DNA, 14 bp, Homo sapiens
ccccgcctctgggc

SEQ ID NO: 4263428 - DNA, 12 bp, Homo sapiens
ccccgctctgcc

SEQ ID NO: 4263429 - DNA, 17 bp, Homo sapiens
ccccggacaagcccagg

SEQ ID NO: 4263430 - DNA, 18 bp, Homo sapiens
ccccggacaagcccagga

SEQ ID NO: 4263431 - DNA, 12 bp, Homo sapiens
ccccggagctgg

SEQ ID NO: 4263432 - DNA, 22 bp, Homo sapiens
ccccggagctgggaaggtcccg

SEQ ID NO: 4263433 - DNA, 16 bp, Homo sapiens
ccccggccactctgtt

SEQ ID NO: 4263434 - DNA, 15 bp, Homo sapiens
ccccggcccccctct

SEQ ID NO: 4263435 - DNA, 17 bp, Homo sapiens
ccccgggaaaggccggt

SEQ ID NO: 4263436 - DNA, 15 bp, Homo sapiens
ccccgggtgcctgtg

SEQ ID NO: 4263437 - DNA, 16 bp, Homo sapiens
ccccgtccctttccct

SEQ ID NO: 4263438 - DNA, 16 bp, Homo sapiens
ccccgttgttgtccct

SEQ ID NO: 4263439 - DNA, 14 bp, Homo sapiens
cccctacccggctc

SEQ ID NO: 4263440 - DNA, 15 bp, Homo sapiens
cccctatcctgcacc

SEQ ID NO: 4263441 - DNA, 17 bp, Homo sapiens
cccctatcctgcaccct

SEQ ID NO: 4263442 - DNA, 15 bp, Homo sapiens
cccctcacctgggca

SEQ ID NO: 4263443 - DNA, 15 bp, Homo sapiens
cccctcaccttgcaa

SEQ ID NO: 4263444 - DNA, 15 bp, Homo sapiens
cccctcactggctgg

SEQ ID NO: 4263445 - DNA, 23 bp, Homo sapiens
cccctccaatcccaccaaccctc

SEQ ID NO: 4263446 - DNA, 13 bp, Homo sapiens
cccctccagaccc

SEQ ID NO: 4263447 - DNA, 12 bp, Homo sapiens
cccctcccacca

SEQ ID NO: 4263448 - DNA, 16 bp, Homo sapiens
cccctcccaccacagc

SEQ ID NO: 4263449 - DNA, 12 bp, Homo sapiens
cccctccccaag

SEQ ID NO: 4263450 - DNA, 12 bp, Homo sapiens
cccctccccatg

SEQ ID NO: 4263451 - DNA, 12 bp, Homo sapiens
cccctccctggc

SEQ ID NO: 4263452 - DNA, 15 bp, Homo sapiens
cccctccctggcctg

SEQ ID NO: 4263453 - DNA, 15 bp, Homo sapiens
cccctcccttcaacc

SEQ ID NO: 4263454 - DNA, 11 bp, Homo sapiens
cccctccttct

SEQ ID NO: 4263455 - DNA, 15 bp, Homo sapiens
cccctccttgcctcc

SEQ ID NO: 4263456 - DNA, 13 bp, Homo sapiens
cccctcggagcct

SEQ ID NO: 4263457 - DNA, 15 bp, Homo sapiens
cccctcggagcctgt

SEQ ID NO: 4263458 - DNA, 21 bp, Homo sapiens
cccctctcgggctctctcacc

SEQ ID NO: 4263459 - DNA, 12 bp, Homo sapiens
cccctgcacaca

SEQ ID NO: 4263460 - DNA, 14 bp, Homo sapiens
cccctgcacacacc

SEQ ID NO: 4263461 - DNA, 18 bp, Homo sapiens
cccctgcacacacctgca

SEQ ID NO: 4263462 - DNA, 19 bp, Homo sapiens
cccctgcacacacctgcac

SEQ ID NO: 4263463 - DNA, 21 bp, Homo sapiens
cccctgcacacacctgcacac

SEQ ID NO: 4263464 - DNA, 14 bp, Homo sapiens
cccctgcacctgct

SEQ ID NO: 4263465 - DNA, 22 bp, Homo sapiens
cccctgcaggcggtatccagag

SEQ ID NO: 4263466 - DNA, 18 bp, Homo sapiens
cccctgccagaggcctgg

SEQ ID NO: 4263467 - DNA, 11 bp, Homo sapiens
aaaaaaaagaa

SEQ ID NO: 4263468 - DNA, 13 bp, Homo sapiens
aaaaaatgaatag

SEQ ID NO: 4263469 - DNA, 17 bp, Homo sapiens
aaaaaatgaatagtaca

SEQ ID NO: 4263470 - DNA, 19 bp, Homo sapiens
aaaaacattctatctactg

SEQ ID NO: 4263471 - DNA, 15 bp, Homo sapiens
aaaaagttgcacatt

SEQ ID NO: 4263472 - DNA, 11 bp, Homo sapiens
aaaaatataaa

SEQ ID NO: 4263473 - DNA, 15 bp, Homo sapiens
aaaaatattctccat

SEQ ID NO: 4263474 - DNA, 19 bp, Homo sapiens
aaaaatcatcaaagtgttt

SEQ ID NO: 4263475 - DNA, 13 bp, Homo sapiens
aaaaattgaagag

SEQ ID NO: 4263476 - DNA, 19 bp, Homo sapiens
aaaacaatggtaacatttt

SEQ ID NO: 4263477 - DNA, 21 bp, Homo sapiens
aaaacaccaccaaatgacaag

SEQ ID NO: 4263478 - DNA, 13 bp, Homo sapiens
aaaacatctcatc

SEQ ID NO: 4263479 - DNA, 16 bp, Homo sapiens
aaaacattctatctac

SEQ ID NO: 4263480 - DNA, 21 bp, Homo sapiens
aaaacccatcgtggtatgtga

SEQ ID NO: 4263481 - DNA, 16 bp, Homo sapiens
aaaacgatttaattta

SEQ ID NO: 4263482 - DNA, 13 bp, Homo sapiens
aaaactaagttct

SEQ ID NO: 4263483 - DNA, 17 bp, Homo sapiens
aaaactccactcagcac

SEQ ID NO: 4263484 - DNA, 17 bp, Homo sapiens
aaaactggaataagaag

SEQ ID NO: 4263485 - DNA, 18 bp, Homo sapiens
aaaacttgagcccactcc

SEQ ID NO: 4263486 - DNA, 15 bp, Homo sapiens
aaaagaagactggaa

SEQ ID NO: 4263487 - DNA, 14 bp, Homo sapiens
aaaagacatccaca

SEQ ID NO: 4263488 - DNA, 18 bp, Homo sapiens
aaaagagaaaaaccaatg

SEQ ID NO: 4263489 - DNA, 16 bp, Homo sapiens
aaaagctatcttcatg

SEQ ID NO: 4263490 - DNA, 16 bp, Homo sapiens
aaaaggttaagccata

SEQ ID NO: 4263491 - DNA, 13 bp, Homo sapiens
aaaataaccaaaa

SEQ ID NO: 4263492 - DNA, 21 bp, Homo sapiens
aaaatacttctttttcattat

SEQ ID NO: 4263493 - DNA, 17 bp, Homo sapiens
aaaatagttctatttct

SEQ ID NO: 4263494 - DNA, 17 bp, Homo sapiens
aaaatagttttctaaat

SEQ ID NO: 4263495 - DNA, 18 bp, Homo sapiens
aaaatagttttctaaatg

SEQ ID NO: 4263496 - DNA, 17 bp, Homo sapiens
aaaatatttctaagctt

SEQ ID NO: 4263497 - DNA, 21 bp, Homo sapiens
aaaatatttctaagcttattt

SEQ ID NO: 4263498 - DNA, 23 bp, Homo sapiens
aaaatatttctaagcttatttct

SEQ ID NO: 4263499 - DNA, 17 bp, Homo sapiens
aaaatcatatttacctg

SEQ ID NO: 4263500 - DNA, 14 bp, Homo sapiens
aaaatcatcaaagt

SEQ ID NO: 4263501 - DNA, 18 bp, Homo sapiens
aaaatctagaagagtcta

SEQ ID NO: 4263502 - DNA, 20 bp, Homo sapiens
aaaatggacttttgttcatg

SEQ ID NO: 4263503 - DNA, 23 bp, Homo sapiens
aaaatggacttttgttcatggga

SEQ ID NO: 4263504 - DNA, 13 bp, Homo sapiens
aaaattatactgt

SEQ ID NO: 4263505 - DNA, 15 bp, Homo sapiens
aaaattatactgtgt

SEQ ID NO: 4263506 - DNA, 18 bp, Homo sapiens
aaaattatactgtgtgtg

SEQ ID NO: 4263507 - DNA, 12 bp, Homo sapiens
aaaattcatagc

SEQ ID NO: 4263508 - DNA, 13 bp, Homo sapiens
aaacaaaatgatg

SEQ ID NO: 4263509 - DNA, 15 bp, Homo sapiens
aaacacacacacaca

SEQ ID NO: 4263510 - DNA, 19 bp, Homo sapiens
aaacacacaggccatttca

SEQ ID NO: 4263511 - DNA, 12 bp, Homo sapiens
aaacacagctgt

SEQ ID NO: 4263512 - DNA, 20 bp, Homo sapiens
aaacaccaccaaatgacaag

SEQ ID NO: 4263513 - DNA, 22 bp, Homo sapiens
aaacacctaagtgactaccact

SEQ ID NO: 4263514 - DNA, 16 bp, Homo sapiens
aaacacgtttagaaat

SEQ ID NO: 4263515 - DNA, 14 bp, Homo sapiens
aaacagaaacgaga

SEQ ID NO: 4263516 - DNA, 19 bp, Homo sapiens
aaacagggcatctccagga

SEQ ID NO: 4263517 - DNA, 16 bp, Homo sapiens
aaacagttgcacagca

SEQ ID NO: 4263518 - DNA, 19 bp, Homo sapiens
aaacagttgcacagcatct

SEQ ID NO: 4263519 - DNA, 18 bp, Homo sapiens
aaacatctcatcatgtct

SEQ ID NO: 4263520 - DNA, 23 bp, Homo sapiens
aaacatctcatcatgtctattgt

SEQ ID NO: 4263521 - DNA, 20 bp, Homo sapiens
aaacatgccctcaggcttgg

SEQ ID NO: 4263522 - DNA, 22 bp, Homo sapiens
aaacatggggttggctgggccc

SEQ ID NO: 4263523 - DNA, 13 bp, Homo sapiens
aaacattcttatt

SEQ ID NO: 4263524 - DNA, 14 bp, Homo sapiens
aaacattcttattt

SEQ ID NO: 4263525 - DNA, 17 bp, Homo sapiens
aaacattctttaacata

SEQ ID NO: 4263526 - DNA, 19 bp, Homo sapiens
aaacattctttaacataca

SEQ ID NO: 4263527 - DNA, 14 bp, Homo sapiens
aaaccaagccgtgg

SEQ ID NO: 4263528 - DNA, 17 bp, Homo sapiens
aaaccaatgattcataa

SEQ ID NO: 4263529 - DNA, 16 bp, Homo sapiens
aaaccagaagactgga

SEQ ID NO: 4263530 - DNA, 21 bp, Homo sapiens
aaaccataaaataaataatct

SEQ ID NO: 4263531 - DNA, 21 bp, Homo sapiens
aaacccatcgtggtatgtgaa

SEQ ID NO: 4263532 - DNA, 22 bp, Homo sapiens
aaacccatcgtggtatgtgaat

SEQ ID NO: 4263533 - DNA, 19 bp, Homo sapiens
aaacccggggaactggttt

SEQ ID NO: 4263534 - DNA, 15 bp, Homo sapiens
aaacctctatatgtt

SEQ ID NO: 4263535 - DNA, 13 bp, Homo sapiens
aaaccttaatatt

SEQ ID NO: 4263536 - DNA, 14 bp, Homo sapiens
aaaccttaatattt

SEQ ID NO: 4263537 - DNA, 16 bp, Homo sapiens
aaaccttcacccagca

SEQ ID NO: 4263538 - DNA, 17 bp, Homo sapiens
aaaccttcacccagcac

SEQ ID NO: 4263539 - DNA, 19 bp, Homo sapiens
aaacctttggctacacaat

SEQ ID NO: 4263540 - DNA, 14 bp, Homo sapiens
aaactggaataaga

SEQ ID NO: 4263541 - DNA, 15 bp, Homo sapiens
aaactggaataagaa

SEQ ID NO: 4263542 - DNA, 16 bp, Homo sapiens
aaactgtttatggtat

SEQ ID NO: 4263543 - DNA, 20 bp, Homo sapiens
aaactgtttatggtattttc

SEQ ID NO: 4263544 - DNA, 14 bp, Homo sapiens
aaactgttttcatg

SEQ ID NO: 4263545 - DNA, 14 bp, Homo sapiens
aaacttacacacaa

SEQ ID NO: 4263546 - DNA, 20 bp, Homo sapiens
aaacttggtgcttattgata

SEQ ID NO: 4263547 - DNA, 11 bp, Homo sapiens
aaactttcagc

SEQ ID NO: 4263548 - DNA, 18 bp, Homo sapiens
aaagaaagattttatgtg

SEQ ID NO: 4263549 - DNA, 22 bp, Homo sapiens
aaagaaattagggctctaattt

SEQ ID NO: 4263550 - DNA, 22 bp, Homo sapiens
acagtttgcaatcttatgttga

SEQ ID NO: 4263551 - DNA, 16 bp, Homo sapiens
acagtttttgtaacca

SEQ ID NO: 4263552 - DNA, 17 bp, Homo sapiens
acataaagtaaatgcta

SEQ ID NO: 4263553 - DNA, 13 bp, Homo sapiens
acataaatctgtc

SEQ ID NO: 4263554 - DNA, 15 bp, Homo sapiens
acataaatctgtctg

SEQ ID NO: 4263555 - DNA, 17 bp, Homo sapiens
acataatatcttgaaga

SEQ ID NO: 4263556 - DNA, 15 bp, Homo sapiens
acatacatctaagtc

SEQ ID NO: 4263557 - DNA, 21 bp, Homo sapiens
acatagatgcctgggcctgat

SEQ ID NO: 4263558 - DNA, 17 bp, Homo sapiens
acataggcaagaggagt

SEQ ID NO: 4263559 - DNA, 18 bp, Homo sapiens
acatatggaaatcctgtt

SEQ ID NO: 4263560 - DNA, 22 bp, Homo sapiens
acatattcccatggtagactgt

SEQ ID NO: 4263561 - DNA, 23 bp, Homo sapiens
acatattcttgctttcacaaata

SEQ ID NO: 4263562 - DNA, 19 bp, Homo sapiens
acatccaggcaatggccta

SEQ ID NO: 4263563 - DNA, 22 bp, Homo sapiens
acatcctgggggagcataccca

SEQ ID NO: 4263564 - DNA, 17 bp, Homo sapiens
acatcggttcaggagga

SEQ ID NO: 4263565 - DNA, 17 bp, Homo sapiens
acatctaagtcagtttc

SEQ ID NO: 4263566 - DNA, 22 bp, Homo sapiens
acatctaagtcagtttcacata

SEQ ID NO: 4263567 - DNA, 15 bp, Homo sapiens
acatctctgactttc

SEQ ID NO: 4263568 - DNA, 16 bp, Homo sapiens
acatctctgactttct

SEQ ID NO: 4263569 - DNA, 14 bp, Homo sapiens
acatctgaaaagaa

SEQ ID NO: 4263570 - DNA, 20 bp, Homo sapiens
acatgactctttattgtctg

SEQ ID NO: 4263571 - DNA, 21 bp, Homo sapiens
acatgactctttattgtctgt

SEQ ID NO: 4263572 - DNA, 15 bp, Homo sapiens
acatgagttcaaata

SEQ ID NO: 4263573 - DNA, 18 bp, Homo sapiens
acatgagttcaaatactt

SEQ ID NO: 4263574 - DNA, 18 bp, Homo sapiens
acatgcacttggctgcat

SEQ ID NO: 4263575 - DNA, 15 bp, Homo sapiens
acatgcagaaattga

SEQ ID NO: 4263576 - DNA, 20 bp, Homo sapiens
acatgcattactgcatgcac

SEQ ID NO: 4263577 - DNA, 15 bp, Homo sapiens
acatgccctcaggct

SEQ ID NO: 4263578 - DNA, 14 bp, Homo sapiens
acatgcctttccag

SEQ ID NO: 4263579 - DNA, 21 bp, Homo sapiens
acatgcctttccagtgctgct

SEQ ID NO: 4263580 - DNA, 22 bp, Homo sapiens
acatgctcatcccaaaagctag

SEQ ID NO: 4263581 - DNA, 14 bp, Homo sapiens
acatgctgcccacc

SEQ ID NO: 4263582 - DNA, 23 bp, Homo sapiens
acatgctgcccaccccctgctgg

SEQ ID NO: 4263583 - DNA, 22 bp, Homo sapiens
acatggacccggagctaacact

SEQ ID NO: 4263584 - DNA, 14 bp, Homo sapiens
acatggattcagtt

SEQ ID NO: 4263585 - DNA, 13 bp, Homo sapiens
acatgggttcaat

SEQ ID NO: 4263586 - DNA, 15 bp, Homo sapiens
acatgtatagtgagt

SEQ ID NO: 4263587 - DNA, 21 bp, Homo sapiens
acatgtctttggcttcagaat

SEQ ID NO: 4263588 - DNA, 23 bp, Homo sapiens
acatgtctttggcttcagaattg

SEQ ID NO: 4263589 - DNA, 19 bp, Homo sapiens
acatgtggaaaactcacag

SEQ ID NO: 4263590 - DNA, 23 bp, Homo sapiens
acattaagtattccttggcccag

SEQ ID NO: 4263591 - DNA, 16 bp, Homo sapiens
acattaattgaggctt

SEQ ID NO: 4263592 - DNA, 18 bp, Homo sapiens
acattagcagtttgcttt

SEQ ID NO: 4263593 - DNA, 18 bp, Homo sapiens
acattattaaatcagaat

SEQ ID NO: 4263594 - DNA, 12 bp, Homo sapiens
acattattactt

SEQ ID NO: 4263595 - DNA, 19 bp, Homo sapiens
acattcatgtgtaggaaga

SEQ ID NO: 4263596 - DNA, 20 bp, Homo sapiens
acattccagtgtattttctg

SEQ ID NO: 4263597 - DNA, 14 bp, Homo sapiens
acattctatctact

SEQ ID NO: 4263598 - DNA, 18 bp, Homo sapiens
acattctatctactgatt

SEQ ID NO: 4263599 - DNA, 17 bp, Homo sapiens
acattctgctgccccca

SEQ ID NO: 4263600 - DNA, 22 bp, Homo sapiens
acattgcccacacctgcctctg

SEQ ID NO: 4263601 - DNA, 22 bp, Homo sapiens
acattgccctgaggggcctgcc

SEQ ID NO: 4263602 - DNA, 23 bp, Homo sapiens
acattgccctgaggggcctgcca

SEQ ID NO: 4263603 - DNA, 23 bp, Homo sapiens
acattgtccccaatgaatatact

SEQ ID NO: 4263604 - DNA, 22 bp, Homo sapiens
acatttaaaatagttttctaaa

SEQ ID NO: 4263605 - DNA, 20 bp, Homo sapiens
acatttaatatcctgccttt

SEQ ID NO: 4263606 - DNA, 14 bp, Homo sapiens
acatttgtcactga

SEQ ID NO: 4263607 - DNA, 14 bp, Homo sapiens
acatttttaattga

SEQ ID NO: 4263608 - DNA, 17 bp, Homo sapiens
accaaaatatagttaat

SEQ ID NO: 4263609 - DNA, 15 bp, Homo sapiens
accaacctcactgcc

SEQ ID NO: 4263610 - DNA, 21 bp, Homo sapiens
accaactatgcgtaaatcaac

SEQ ID NO: 4263611 - DNA, 14 bp, Homo sapiens
accaactctctctg

SEQ ID NO: 4263612 - DNA, 13 bp, Homo sapiens
accaactgagcca

SEQ ID NO: 4263613 - DNA, 17 bp, Homo sapiens
accaagccgtggcttcc

SEQ ID NO: 4263614 - DNA, 18 bp, Homo sapiens
accaagccgtggcttccc

SEQ ID NO: 4263615 - DNA, 17 bp, Homo sapiens
accaagcttagaagcca

SEQ ID NO: 4263616 - DNA, 13 bp, Homo sapiens
accaaggacccct

SEQ ID NO: 4263617 - DNA, 14 bp, Homo sapiens
accaaggctgcctg

SEQ ID NO: 4263618 - DNA, 15 bp, Homo sapiens
accaaggctgcctgc

SEQ ID NO: 4263619 - DNA, 17 bp, Homo sapiens
accaagggtatctgctg

SEQ ID NO: 4263620 - DNA, 20 bp, Homo sapiens
accaatcaacagcatgtcta

SEQ ID NO: 4263621 - DNA, 14 bp, Homo sapiens
accaatctctgtga

SEQ ID NO: 4263622 - DNA, 21 bp, Homo sapiens
accaatgattcataacaatgt

SEQ ID NO: 4263623 - DNA, 22 bp, Homo sapiens
accaatgattcataacaatgta

SEQ ID NO: 4263624 - DNA, 20 bp, Homo sapiens
accacaaggctgaaaagtgc

SEQ ID NO: 4263625 - DNA, 13 bp, Homo sapiens
accacacacaccc

SEQ ID NO: 4263626 - DNA, 20 bp, Homo sapiens
accacacacacccttcccca

SEQ ID NO: 4263627 - DNA, 16 bp, Homo sapiens
accacactctgcctgg

SEQ ID NO: 4263628 - DNA, 13 bp, Homo sapiens
accacacttcctg

SEQ ID NO: 4263629 - DNA, 16 bp, Homo sapiens
accacacttcctgtcc

SEQ ID NO: 4263630 - DNA, 15 bp, Homo sapiens
accacagccctgtca

SEQ ID NO: 4263631 - DNA, 13 bp, Homo sapiens
accacatttctgg

SEQ ID NO: 4263632 - DNA, 15 bp, Homo sapiens
accaccgctccccag

SEQ ID NO: 4263633 - DNA, 21 bp, Homo sapiens
accaccgctccccagcccagg

SEQ ID NO: 4263634 - DNA, 23 bp, Homo sapiens
accaccgctccccagcccagggt

SEQ ID NO: 4263635 - DNA, 23 bp, Homo sapiens
accacctggatggatctgctcca

SEQ ID NO: 4263636 - DNA, 14 bp, Homo sapiens
accacttatttcta

SEQ ID NO: 4263637 - DNA, 13 bp, Homo sapiens
accacttgctgca

SEQ ID NO: 4263638 - DNA, 13 bp, Homo sapiens
accagagccatgg

SEQ ID NO: 4263639 - DNA, 17 bp, Homo sapiens
accagagccatggactc

SEQ ID NO: 4263640 - DNA, 20 bp, Homo sapiens
accagatgacacataaatct

SEQ ID NO: 4263641 - DNA, 11 bp, Homo sapiens
accagcctcag

SEQ ID NO: 4263642 - DNA, 12 bp, Homo sapiens
accagcctcagt

SEQ ID NO: 4263643 - DNA, 13 bp, Homo sapiens
accagcctcagtg

SEQ ID NO: 4263644 - DNA, 16 bp, Homo sapiens
accagctggctctgca

SEQ ID NO: 4263645 - DNA, 17 bp, Homo sapiens
accagctggctctgcag

SEQ ID NO: 4263646 - DNA, 18 bp, Homo sapiens
accagctggctctgcagc

SEQ ID NO: 4263647 - DNA, 17 bp, Homo sapiens
accaggaagaaggcccg

SEQ ID NO: 4263648 - DNA, 20 bp, Homo sapiens
accaggagccaggtgtcctg

SEQ ID NO: 4263649 - DNA, 13 bp, Homo sapiens
accagggggaagc

SEQ ID NO: 4263650 - DNA, 16 bp, Homo sapiens
accataaaataaataa

SEQ ID NO: 4263651 - DNA, 19 bp, Homo sapiens
accatccatccctggtgaa

SEQ ID NO: 4263652 - DNA, 16 bp, Homo sapiens
accatcggtcagcagg

SEQ ID NO: 4263653 - DNA, 19 bp, Homo sapiens
accattttgcgatgtgttt

SEQ ID NO: 4263654 - DNA, 21 bp, Homo sapiens
accattttgcgatgtgtttta

SEQ ID NO: 4263655 - DNA, 18 bp, Homo sapiens
acccaaggtggtcttgga

SEQ ID NO: 4263656 - DNA, 19 bp, Homo sapiens
acccaaggtggtcttggag

SEQ ID NO: 4263657 - DNA, 17 bp, Homo sapiens
acccaattttaaaaaat

SEQ ID NO: 4263658 - DNA, 21 bp, Homo sapiens
acccaattttaaaaaataaca

SEQ ID NO: 4263659 - DNA, 22 bp, Homo sapiens
acccaattttaaaaaataacat

SEQ ID NO: 4263660 - DNA, 20 bp, Homo sapiens
acccacactacgcagaagag

SEQ ID NO: 4263661 - DNA, 11 bp, Homo sapiens
acccagcctgg

SEQ ID NO: 4263662 - DNA, 16 bp, Homo sapiens
acccaggacctctggg

SEQ ID NO: 4263663 - DNA, 20 bp, Homo sapiens
acccatcgtggtatgtgaat

SEQ ID NO: 4263664 - DNA, 15 bp, Homo sapiens
acccatgcatggcct

SEQ ID NO: 4263665 - DNA, 20 bp, Homo sapiens
acccatgcatggcctcccag

SEQ ID NO: 4263666 - DNA, 23 bp, Homo sapiens
acccatgcatggcctcccagcca

SEQ ID NO: 4263667 - DNA, 16 bp, Homo sapiens
acccatgccccactct

SEQ ID NO: 4263668 - DNA, 19 bp, Homo sapiens
acccatgccccactctgct

SEQ ID NO: 4263669 - DNA, 20 bp, Homo sapiens
acccatgccccactctgctg

SEQ ID NO: 4263670 - DNA, 20 bp, Homo sapiens
accccaccacacacaccctt

SEQ ID NO: 4263671 - DNA, 11 bp, Homo sapiens
accccactgga

SEQ ID NO: 4263672 - DNA, 17 bp, Homo sapiens
accccacttatgctgct

SEQ ID NO: 4263673 - DNA, 18 bp, Homo sapiens
accccacttatgctgctg

SEQ ID NO: 4263674 - DNA, 19 bp, Homo sapiens
accccacttatgctgctgt

SEQ ID NO: 4263675 - DNA, 20 bp, Homo sapiens
accccacttatgctgctgtg

SEQ ID NO: 4263676 - DNA, 22 bp, Homo sapiens
accccagaacgcatgcagggcc

SEQ ID NO: 4263677 - DNA, 15 bp, Homo sapiens
accccagcagtcctg

SEQ ID NO: 4263678 - DNA, 13 bp, Homo sapiens
accccagctccag

SEQ ID NO: 4263679 - DNA, 17 bp, Homo sapiens
accccagctccaggcag

SEQ ID NO: 4263680 - DNA, 10 bp, Homo sapiens
agaaccatct

SEQ ID NO: 4263681 - DNA, 14 bp, Homo sapiens
agaacccccctccc

SEQ ID NO: 4263682 - DNA, 22 bp, Homo sapiens
agaacccccctccccaaggaag

SEQ ID NO: 4263683 - DNA, 16 bp, Homo sapiens
agaacgcatgcagggc

SEQ ID NO: 4263684 - DNA, 15 bp, Homo sapiens
agaactcagccttaa

SEQ ID NO: 4263685 - DNA, 19 bp, Homo sapiens
agaactcagccttaagaaa

SEQ ID NO: 4263686 - DNA, 23 bp, Homo sapiens
agaactcagccttaagaaagcta

SEQ ID NO: 4263687 - DNA, 18 bp, Homo sapiens
agaactcatgtgatttac

SEQ ID NO: 4263688 - DNA, 16 bp, Homo sapiens
agaactgagctcctct

SEQ ID NO: 4263689 - DNA, 20 bp, Homo sapiens
agaactgtcccacaaaatat

SEQ ID NO: 4263690 - DNA, 18 bp, Homo sapiens
agaactgttcatttccac

SEQ ID NO: 4263691 - DNA, 14 bp, Homo sapiens
agaagaaaataacc

SEQ ID NO: 4263692 - DNA, 14 bp, Homo sapiens
agaagaaccatctt

SEQ ID NO: 4263693 - DNA, 13 bp, Homo sapiens
agaagaatataaa

SEQ ID NO: 4263694 - DNA, 22 bp, Homo sapiens
agaagaatattgtattgttaga

SEQ ID NO: 4263695 - DNA, 15 bp, Homo sapiens
agaagaatttgaaga

SEQ ID NO: 4263696 - DNA, 16 bp, Homo sapiens
agaagacacgtgtttt

SEQ ID NO: 4263697 - DNA, 21 bp, Homo sapiens
agaagacacgtgtttttgtat

SEQ ID NO: 4263698 - DNA, 13 bp, Homo sapiens
agaagagggagaa

SEQ ID NO: 4263699 - DNA, 20 bp, Homo sapiens
agaagagggagaaggagagg

SEQ ID NO: 4263700 - DNA, 12 bp, Homo sapiens
agaagattctaa

SEQ ID NO: 4263701 - DNA, 19 bp, Homo sapiens
agaagctcctgaatccctt

SEQ ID NO: 4263702 - DNA, 17 bp, Homo sapiens
agaaggacttcctgcta

SEQ ID NO: 4263703 - DNA, 21 bp, Homo sapiens
agaaggacttcctgctacagt

SEQ ID NO: 4263704 - DNA, 13 bp, Homo sapiens
agaaggagaggct

SEQ ID NO: 4263705 - DNA, 21 bp, Homo sapiens
agaaggcctgccccccttccc

SEQ ID NO: 4263706 - DNA, 16 bp, Homo sapiens
agaaggccttgccttg

SEQ ID NO: 4263707 - DNA, 18 bp, Homo sapiens
agaaggccttgccttgtg

SEQ ID NO: 4263708 - DNA, 12 bp, Homo sapiens
agaagggaaatt

SEQ ID NO: 4263709 - DNA, 20 bp, Homo sapiens
agaagggaaattcacactgt

SEQ ID NO: 4263710 - DNA, 14 bp, Homo sapiens
agaaggggcgaggc

SEQ ID NO: 4263711 - DNA, 24 bp, Homo sapiens
agaagggttagacaagcctggagg

SEQ ID NO: 4263712 - DNA, 15 bp, Homo sapiens
agaagtagaatcctt

SEQ ID NO: 4263713 - DNA, 23 bp, Homo sapiens
agaagtagtgtctggatcagtaa

SEQ ID NO: 4263714 - DNA, 16 bp, Homo sapiens
agaagtggcaggagga

SEQ ID NO: 4263715 - DNA, 22 bp, Homo sapiens
agaagtgggagtgggagaggaa

SEQ ID NO: 4263716 - DNA, 22 bp, Homo sapiens
agaagttgttagtgatttgcta

SEQ ID NO: 4263717 - DNA, 23 bp, Homo sapiens
agaataaagccttgtgatcactt

SEQ ID NO: 4263718 - DNA, 12 bp, Homo sapiens
agaataaataaa

SEQ ID NO: 4263719 - DNA, 20 bp, Homo sapiens
agaataaataaagaagaaaa

SEQ ID NO: 4263720 - DNA, 17 bp, Homo sapiens
agaataaatgagcattt

SEQ ID NO: 4263721 - DNA, 22 bp, Homo sapiens
agaatacagtaagctgctctat

SEQ ID NO: 4263722 - DNA, 16 bp, Homo sapiens
agaatagatgctgact

SEQ ID NO: 4263723 - DNA, 19 bp, Homo sapiens
agaatatcctatactggtt

SEQ ID NO: 4263724 - DNA, 15 bp, Homo sapiens
agaatattgtattgt

SEQ ID NO: 4263725 - DNA, 19 bp, Homo sapiens
agaatcacctaattaattt

SEQ ID NO: 4263726 - DNA, 22 bp, Homo sapiens
agaatcacctaattaatttcag

SEQ ID NO: 4263727 - DNA, 18 bp, Homo sapiens
agaatcagtagctggaga

SEQ ID NO: 4263728 - DNA, 13 bp, Homo sapiens
agaatctcagcac

SEQ ID NO: 4263729 - DNA, 14 bp, Homo sapiens
agaatgagagagtg

SEQ ID NO: 4263730 - DNA, 15 bp, Homo sapiens
agaatgagagagtgt

SEQ ID NO: 4263731 - DNA, 17 bp, Homo sapiens
agaatgcctaggccagc

SEQ ID NO: 4263732 - DNA, 20 bp, Homo sapiens
agaatgcctaggccagctcc

SEQ ID NO: 4263733 - DNA, 13 bp, Homo sapiens
agaatggctctgg

SEQ ID NO: 4263734 - DNA, 13 bp, Homo sapiens
agaatggtgggct

SEQ ID NO: 4263735 - DNA, 20 bp, Homo sapiens
agaatggtgggctccagagt

SEQ ID NO: 4263736 - DNA, 23 bp, Homo sapiens
agaatggtgggctccagagtagg

SEQ ID NO: 4263737 - DNA, 13 bp, Homo sapiens
agaattaaaataa

SEQ ID NO: 4263738 - DNA, 16 bp, Homo sapiens
agaattctaagattgt

SEQ ID NO: 4263739 - DNA, 19 bp, Homo sapiens
agaatttgaagacttcaaa

SEQ ID NO: 4263740 - DNA, 21 bp, Homo sapiens
agaatttgaagacttcaaaat

SEQ ID NO: 4263741 - DNA, 22 bp, Homo sapiens
agacaaattcattcccttctct

SEQ ID NO: 4263742 - DNA, 13 bp, Homo sapiens
agacaagcctgga

SEQ ID NO: 4263743 - DNA, 14 bp, Homo sapiens
agacaagcctggag

SEQ ID NO: 4263744 - DNA, 17 bp, Homo sapiens
agacacacgcacacaca

SEQ ID NO: 4263745 - DNA, 19 bp, Homo sapiens
agacacctatcagagaagc

SEQ ID NO: 4263746 - DNA, 21 bp, Homo sapiens
agacacgcccgactctctcca

SEQ ID NO: 4263747 - DNA, 12 bp, Homo sapiens
agacagagtgga

SEQ ID NO: 4263748 - DNA, 18 bp, Homo sapiens
agacagagtggatctgga

SEQ ID NO: 4263749 - DNA, 16 bp, Homo sapiens
agacagcagtgtgagg

SEQ ID NO: 4263750 - DNA, 20 bp, Homo sapiens
agacagcagtgtgagggtgc

SEQ ID NO: 4263751 - DNA, 15 bp, Homo sapiens
agacaggcagaatca

SEQ ID NO: 4263752 - DNA, 21 bp, Homo sapiens
agacaggcagaatcagtagct

SEQ ID NO: 4263753 - DNA, 23 bp, Homo sapiens
agacagggtggggcttagaatgg

SEQ ID NO: 4263754 - DNA, 19 bp, Homo sapiens
agacatccccctccttgcc

SEQ ID NO: 4263755 - DNA, 23 bp, Homo sapiens
agacatccccctccttgccgctg

SEQ ID NO: 4263756 - DNA, 12 bp, Homo sapiens
agacatgctgcc

SEQ ID NO: 4263757 - DNA, 16 bp, Homo sapiens
agacatgctgcccacc

SEQ ID NO: 4263758 - DNA, 15 bp, Homo sapiens
agacatttaaaatag

SEQ ID NO: 4263759 - DNA, 17 bp, Homo sapiens
agaccacccatatcatg

SEQ ID NO: 4263760 - DNA, 18 bp, Homo sapiens
agaccacccatatcatgc

SEQ ID NO: 4263761 - DNA, 16 bp, Homo sapiens
agaccaggactctgcc

SEQ ID NO: 4263762 - DNA, 17 bp, Homo sapiens
agaccaggactctgcct

SEQ ID NO: 4263763 - DNA, 22 bp, Homo sapiens
agaccaggactctgccttccag

SEQ ID NO: 4263764 - DNA, 23 bp, Homo sapiens
agaccaggactctgccttccagg

SEQ ID NO: 4263765 - DNA, 21 bp, Homo sapiens
agaccatttagtcctcacctt

SEQ ID NO: 4263766 - DNA, 16 bp, Homo sapiens
agacccccaccccttc

SEQ ID NO: 4263767 - DNA, 19 bp, Homo sapiens
agacccctaccctttccca

SEQ ID NO: 4263768 - DNA, 14 bp, Homo sapiens
agacccctggcttt

SEQ ID NO: 4263769 - DNA, 15 bp, Homo sapiens
agacccctggctttt

SEQ ID NO: 4263770 - DNA, 20 bp, Homo sapiens
agaccctgccaactttccag

SEQ ID NO: 4263771 - DNA, 12 bp, Homo sapiens
agaccctgggag

SEQ ID NO: 4263772 - DNA, 14 bp, Homo sapiens
agacctgggccctg

SEQ ID NO: 4263773 - DNA, 13 bp, Homo sapiens
agaccttctctta

SEQ ID NO: 4263774 - DNA, 20 bp, Homo sapiens
agacctttgtctgaaggatt

SEQ ID NO: 4263775 - DNA, 21 bp, Homo sapiens
agacgtccacccgtttccaag

SEQ ID NO: 4263776 - DNA, 12 bp, Homo sapiens
agactatgtgtc

SEQ ID NO: 4263777 - DNA, 20 bp, Homo sapiens
agactatgtgtcatgatttc

SEQ ID NO: 4263778 - DNA, 21 bp, Homo sapiens
agactcaaggcctccagccac

SEQ ID NO: 4263779 - DNA, 12 bp, Homo sapiens
agactcaatcat

SEQ ID NO: 4263780 - DNA, 13 bp, Homo sapiens
agactccttctcc

SEQ ID NO: 4263781 - DNA, 16 bp, Homo sapiens
agactccttctcccca

SEQ ID NO: 4263782 - DNA, 17 bp, Homo sapiens
agactccttctccccaa

SEQ ID NO: 4263783 - DNA, 20 bp, Homo sapiens
agactctgtgagattctaaa

SEQ ID NO: 4263784 - DNA, 21 bp, Homo sapiens
agactgacccattcacatttt

SEQ ID NO: 4263785 - DNA, 22 bp, Homo sapiens
agactgacccattcacatttta

SEQ ID NO: 4263786 - DNA, 23 bp, Homo sapiens
agactgaccttgatgtcttgaga

SEQ ID NO: 4263787 - DNA, 14 bp, Homo sapiens
agactgctcagatt

SEQ ID NO: 4263788 - DNA, 16 bp, Homo sapiens
agactgggctggctgc

SEQ ID NO: 4263789 - DNA, 19 bp, Homo sapiens
agactgggctggctgcctt

SEQ ID NO: 4263790 - DNA, 17 bp, Homo sapiens
agacttaggccagaggt

SEQ ID NO: 4263791 - DNA, 18 bp, Homo sapiens
agacttcaaaatattgag

SEQ ID NO: 4263792 - DNA, 19 bp, Homo sapiens
agacttcgctattcccagg

SEQ ID NO: 4263793 - DNA, 20 bp, Homo sapiens
agacttcgctattcccaggc

SEQ ID NO: 4263794 - DNA, 16 bp, Homo sapiens
agagaaaaaccaatga

SEQ ID NO: 4263795 - DNA, 19 bp, Homo sapiens
agagaaagcatattgactt

SEQ ID NO: 4263796 - DNA, 12 bp, Homo sapiens
agagaaatgaaa

SEQ ID NO: 4263797 - DNA, 18 bp, Homo sapiens
agagaagtgcccctgctg

SEQ ID NO: 4263798 - DNA, 17 bp, Homo sapiens
agagaatgagagagtgt

SEQ ID NO: 4263799 - DNA, 13 bp, Homo sapiens
agagaccctgcca

SEQ ID NO: 4263800 - DNA, 23 bp, Homo sapiens
agagaccctgccaactttccaga

SEQ ID NO: 4263801 - DNA, 20 bp, Homo sapiens
agagaccttctcttaggaca

SEQ ID NO: 4263802 - DNA, 15 bp, Homo sapiens
agagagaaagcatat

SEQ ID NO: 4263803 - DNA, 13 bp, Homo sapiens
agagagacaaaat

SEQ ID NO: 4263804 - DNA, 15 bp, Homo sapiens
agagagaccctgcca

SEQ ID NO: 4263805 - DNA, 13 bp, Homo sapiens
agagagagaagtg

SEQ ID NO: 4263806 - DNA, 23 bp, Homo sapiens
agagagcggcttccccatcgcct

SEQ ID NO: 4263807 - DNA, 18 bp, Homo sapiens
agagagggaattctcttg

SEQ ID NO: 4263808 - DNA, 19 bp, Homo sapiens
agagatatatctgaaaact

SEQ ID NO: 4263809 - DNA, 23 bp, Homo sapiens
agagatatatctgaaaactggaa

SEQ ID NO: 4263810 - DNA, 15 bp, Homo sapiens
agcttcaaaacagaa

SEQ ID NO: 4263811 - DNA, 13 bp, Homo sapiens
agcttcaggtgag

SEQ ID NO: 4263812 - DNA, 16 bp, Homo sapiens
agcttcaggtgagcca

SEQ ID NO: 4263813 - DNA, 19 bp, Homo sapiens
agcttcagtcattaaatta

SEQ ID NO: 4263814 - DNA, 22 bp, Homo sapiens
agcttgaatgtccccattctat

SEQ ID NO: 4263815 - DNA, 13 bp, Homo sapiens
agcttgtttctat

SEQ ID NO: 4263816 - DNA, 19 bp, Homo sapiens
agctttcctgggtctggat

SEQ ID NO: 4263817 - DNA, 20 bp, Homo sapiens
agcttttttttcagccattc

SEQ ID NO: 4263818 - DNA, 23 bp, Homo sapiens
aggaaaaccaagccgtggcttcc

SEQ ID NO: 4263819 - DNA, 17 bp, Homo sapiens
aggaaaccttttcttgt

SEQ ID NO: 4263820 - DNA, 16 bp, Homo sapiens
aggaaactcacctgct

SEQ ID NO: 4263821 - DNA, 17 bp, Homo sapiens
aggaaactcacctgctg

SEQ ID NO: 4263822 - DNA, 20 bp, Homo sapiens
aggaaactcacctgctggcc

SEQ ID NO: 4263823 - DNA, 23 bp, Homo sapiens
aggaaactcacctgctggcccct

SEQ ID NO: 4263824 - DNA, 20 bp, Homo sapiens
aggaaagcctcactgatata

SEQ ID NO: 4263825 - DNA, 23 bp, Homo sapiens
aggaaatagtgttctttttaaaa

SEQ ID NO: 4263826 - DNA, 15 bp, Homo sapiens
aggaaccatggacct

SEQ ID NO: 4263827 - DNA, 20 bp, Homo sapiens
aggaacctcgaagctgttct

SEQ ID NO: 4263828 - DNA, 12 bp, Homo sapiens
aggaactggtcc

SEQ ID NO: 4263829 - DNA, 18 bp, Homo sapiens
aggaagaaggcccgggag

SEQ ID NO: 4263830 - DNA, 17 bp, Homo sapiens
aggaagacagttctaca

SEQ ID NO: 4263831 - DNA, 15 bp, Homo sapiens
aggaagaggccgctg

SEQ ID NO: 4263832 - DNA, 15 bp, Homo sapiens
aggaagcaaggccag

SEQ ID NO: 4263833 - DNA, 20 bp, Homo sapiens
aggaagcaaggccagccctg

SEQ ID NO: 4263834 - DNA, 20 bp, Homo sapiens
aggaagccacgtgctggaga

SEQ ID NO: 4263835 - DNA, 23 bp, Homo sapiens
aggaaggaagagcaagctgtaca

SEQ ID NO: 4263836 - DNA, 18 bp, Homo sapiens
aggaaggagccagctccc

SEQ ID NO: 4263837 - DNA, 20 bp, Homo sapiens
aggaagggactggtccaggc

SEQ ID NO: 4263838 - DNA, 17 bp, Homo sapiens
aggaagggaggcctgag

SEQ ID NO: 4263839 - DNA, 18 bp, Homo sapiens
aggaaggtctcatgcctg

SEQ ID NO: 4263840 - DNA, 20 bp, Homo sapiens
aggaagtcaggagccagcag

SEQ ID NO: 4263841 - DNA, 18 bp, Homo sapiens
aggaagtgataacactgg

SEQ ID NO: 4263842 - DNA, 22 bp, Homo sapiens
aggaatatacatagtctttgtt

SEQ ID NO: 4263843 - DNA, 20 bp, Homo sapiens
aggaatataccacaccgagg

SEQ ID NO: 4263844 - DNA, 19 bp, Homo sapiens
aggaatcgaggaaccagag

SEQ ID NO: 4263845 - DNA, 20 bp, Homo sapiens
aggaatcgaggaaccagagc

SEQ ID NO: 4263846 - DNA, 15 bp, Homo sapiens
aggaatgatattgct

SEQ ID NO: 4263847 - DNA, 13 bp, Homo sapiens
aggaatgctcccc

SEQ ID NO: 4263848 - DNA, 22 bp, Homo sapiens
aggaatgctcccccatcctccc

SEQ ID NO: 4263849 - DNA, 12 bp, Homo sapiens
aggaattgactt

SEQ ID NO: 4263850 - DNA, 17 bp, Homo sapiens
aggacaaaacagcggga

SEQ ID NO: 4263851 - DNA, 23 bp, Homo sapiens
aggacagaaccaacgggtctgtg

SEQ ID NO: 4263852 - DNA, 21 bp, Homo sapiens
aggacaggtggaggcgagcca

SEQ ID NO: 4263853 - DNA, 22 bp, Homo sapiens
aggacaggtggaggcgagccag

SEQ ID NO: 4263854 - DNA, 19 bp, Homo sapiens
aggacagtaaactcactag

SEQ ID NO: 4263855 - DNA, 14 bp, Homo sapiens
aggaccaggagcca

SEQ ID NO: 4263856 - DNA, 20 bp, Homo sapiens
aggacccaaggtggtcttgg

SEQ ID NO: 4263857 - DNA, 21 bp, Homo sapiens
aggacccaaggtggtcttgga

SEQ ID NO: 4263858 - DNA, 22 bp, Homo sapiens
aggaccccatctgctgagctct

SEQ ID NO: 4263859 - DNA, 13 bp, Homo sapiens
aggacccctcacc

SEQ ID NO: 4263860 - DNA, 22 bp, Homo sapiens
aggacccggaggggcctggcag

SEQ ID NO: 4263861 - DNA, 11 bp, Homo sapiens
aggaccctggg

SEQ ID NO: 4263862 - DNA, 19 bp, Homo sapiens
aggacgcagggagaccctg

SEQ ID NO: 4263863 - DNA, 13 bp, Homo sapiens
aggactgccgacc

SEQ ID NO: 4263864 - DNA, 21 bp, Homo sapiens
aggactgccgaccgaggctgg

SEQ ID NO: 4263865 - DNA, 22 bp, Homo sapiens
aggacttcctgctacagtagct

SEQ ID NO: 4263866 - DNA, 22 bp, Homo sapiens
aggacttgtgcctcttgggaga

SEQ ID NO: 4263867 - DNA, 16 bp, Homo sapiens
aggagaaggcctgccc

SEQ ID NO: 4263868 - DNA, 17 bp, Homo sapiens
aggagaaggcctgcccc

SEQ ID NO: 4263869 - DNA, 22 bp, Homo sapiens
aggagaaggcctgccccccttc

SEQ ID NO: 4263870 - DNA, 17 bp, Homo sapiens
aggagagaccttctctt

SEQ ID NO: 4263871 - DNA, 14 bp, Homo sapiens
aggagagagttgaa

SEQ ID NO: 4263872 - DNA, 17 bp, Homo sapiens
aggagatggggagggcg

SEQ ID NO: 4263873 - DNA, 15 bp, Homo sapiens
aggagattgctctgg

SEQ ID NO: 4263874 - DNA, 12 bp, Homo sapiens
aggagcagccca

SEQ ID NO: 4263875 - DNA, 18 bp, Homo sapiens
aggagcaggaagcaaggc

SEQ ID NO: 4263876 - DNA, 19 bp, Homo sapiens
aggagcagtgggccctggc

SEQ ID NO: 4263877 - DNA, 23 bp, Homo sapiens
aggagcagtgggccctggctctg

SEQ ID NO: 4263878 - DNA, 13 bp, Homo sapiens
aggagccagcagg

SEQ ID NO: 4263879 - DNA, 18 bp, Homo sapiens
aggagccagctcccagcc

SEQ ID NO: 4263880 - DNA, 16 bp, Homo sapiens
aggagcctagaggagg

SEQ ID NO: 4263881 - DNA, 17 bp, Homo sapiens
aggagcctagaggagga

SEQ ID NO: 4263882 - DNA, 10 bp, Homo sapiens
aggagctggg

SEQ ID NO: 4263883 - DNA, 12 bp, Homo sapiens
aggagctgggga

SEQ ID NO: 4263884 - DNA, 17 bp, Homo sapiens
aggagctggggagggag

SEQ ID NO: 4263885 - DNA, 16 bp, Homo sapiens
aggagcttccagatgg

SEQ ID NO: 4263886 - DNA, 18 bp, Homo sapiens
aggaggaaaaaggctggt

SEQ ID NO: 4263887 - DNA, 19 bp, Homo sapiens
aggaggaactggtccaggc

SEQ ID NO: 4263888 - DNA, 23 bp, Homo sapiens
aggaggaactggtccaggccagg

SEQ ID NO: 4263889 - DNA, 17 bp, Homo sapiens
aggaggaagggactggt

SEQ ID NO: 4263890 - DNA, 15 bp, Homo sapiens
aggaggacaggtgga

SEQ ID NO: 4263891 - DNA, 23 bp, Homo sapiens
aggaggacctggggggggcaaga

SEQ ID NO: 4263892 - DNA, 15 bp, Homo sapiens
aggagggaaaccttt

SEQ ID NO: 4263893 - DNA, 13 bp, Homo sapiens
aggagggggagaa

SEQ ID NO: 4263894 - DNA, 20 bp, Homo sapiens
aggagggggcccggctgggc

SEQ ID NO: 4263895 - DNA, 14 bp, Homo sapiens
aggagggtggcact

SEQ ID NO: 4263896 - DNA, 21 bp, Homo sapiens
aggaggtaacatagatgcctg

SEQ ID NO: 4263897 - DNA, 23 bp, Homo sapiens
aggaggtaacatagatgcctggg

SEQ ID NO: 4263898 - DNA, 19 bp, Homo sapiens
aggaggtgcccgggcaggg

SEQ ID NO: 4263899 - DNA, 13 bp, Homo sapiens
aggaggtgcctga

SEQ ID NO: 4263900 - DNA, 15 bp, Homo sapiens
aggaggtgtggagtg

SEQ ID NO: 4263901 - DNA, 16 bp, Homo sapiens
aggaggtgtggagtgg

SEQ ID NO: 4263902 - DNA, 20 bp, Homo sapiens
aggaggtgtggagtggaggg

SEQ ID NO: 4263903 - DNA, 17 bp, Homo sapiens
aggagtgcgctagagca

SEQ ID NO: 4263904 - DNA, 19 bp, Homo sapiens
aggagtgggtgggacacag

SEQ ID NO: 4263905 - DNA, 19 bp, Homo sapiens
aggagttctaacacatttc

SEQ ID NO: 4263906 - DNA, 23 bp, Homo sapiens
aggatattacaatggccagccca

SEQ ID NO: 4263907 - DNA, 14 bp, Homo sapiens
aggatgcatgcagg

SEQ ID NO: 4263908 - DNA, 17 bp, Homo sapiens
aggattaatctctaaaa

SEQ ID NO: 4263909 - DNA, 18 bp, Homo sapiens
aggattaatctctaaaat

SEQ ID NO: 4263910 - DNA, 16 bp, Homo sapiens
aggattttaaatgctg

SEQ ID NO: 4263911 - DNA, 14 bp, Homo sapiens
aggcaaatgtccaa

SEQ ID NO: 4263912 - DNA, 15 bp, Homo sapiens
aggcaagaagtggga

SEQ ID NO: 4263913 - DNA, 15 bp, Homo sapiens
aggcaagctggcagg

SEQ ID NO: 4263914 - DNA, 17 bp, Homo sapiens
aggcaagctggcaggag

SEQ ID NO: 4263915 - DNA, 22 bp, Homo sapiens
aggcaagctggcaggagggtgg

SEQ ID NO: 4263916 - DNA, 15 bp, Homo sapiens
aggcaatagtcaaaa

SEQ ID NO: 4263917 - DNA, 19 bp, Homo sapiens
aggcaatggcctaaacttc

SEQ ID NO: 4263918 - DNA, 15 bp, Homo sapiens
aggcagaatggtggg

SEQ ID NO: 4263919 - DNA, 17 bp, Homo sapiens
aggcagcaacaggacca

SEQ ID NO: 4263920 - DNA, 19 bp, Homo sapiens
aggcagcaacaggaccagg

SEQ ID NO: 4263921 - DNA, 20 bp, Homo sapiens
aggcagcaacaggaccagga

SEQ ID NO: 4263922 - DNA, 17 bp, Homo sapiens
aggcaggaagtcaggag

SEQ ID NO: 4263923 - DNA, 24 bp, Homo sapiens
aggcaggaagtcaggagccagcag

SEQ ID NO: 4263924 - DNA, 23 bp, Homo sapiens
aggcaggggctgggcagagggga

SEQ ID NO: 4263925 - DNA, 13 bp, Homo sapiens
aggcagtggccca

SEQ ID NO: 4263926 - DNA, 17 bp, Homo sapiens
aggcagtggcccaggga

SEQ ID NO: 4263927 - DNA, 18 bp, Homo sapiens
aggcatactctccaggat

SEQ ID NO: 4263928 - DNA, 19 bp, Homo sapiens
aggcatactctccaggatt

SEQ ID NO: 4263929 - DNA, 18 bp, Homo sapiens
aggcatcattttcacctc

SEQ ID NO: 4263930 - DNA, 20 bp, Homo sapiens
aggcatgaccctggagcccg

SEQ ID NO: 4263931 - DNA, 23 bp, Homo sapiens
aggcattcagcaattaaagacat

SEQ ID NO: 4263932 - DNA, 19 bp, Homo sapiens
aggccacatgagtcccagt

SEQ ID NO: 4263933 - DNA, 14 bp, Homo sapiens
aggccacctgcccc

SEQ ID NO: 4263934 - DNA, 22 bp, Homo sapiens
aggccacctgcccccttctccc

SEQ ID NO: 4263935 - DNA, 15 bp, Homo sapiens
aggccacgggggagg

SEQ ID NO: 4263936 - DNA, 22 bp, Homo sapiens
aggccacgggggaggccgaggc

SEQ ID NO: 4263937 - DNA, 23 bp, Homo sapiens
aggccagaggaagggaggcctga

SEQ ID NO: 4263938 - DNA, 19 bp, Homo sapiens
aggccagccctggttctcc

SEQ ID NO: 4263939 - DNA, 14 bp, Homo sapiens
ataaaggtcatatt

SEQ ID NO: 4263940 - DNA, 17 bp, Homo sapiens
ataaagttattaatagc

SEQ ID NO: 4263941 - DNA, 17 bp, Homo sapiens
ataaataaaaatattct

SEQ ID NO: 4263942 - DNA, 14 bp, Homo sapiens
ataaataaagaaga

SEQ ID NO: 4263943 - DNA, 21 bp, Homo sapiens
ataaataaagaagaaaataac

SEQ ID NO: 4263944 - DNA, 16 bp, Homo sapiens
ataaatactaaatatg

SEQ ID NO: 4263945 - DNA, 13 bp, Homo sapiens
ataaatatctatt

SEQ ID NO: 4263946 - DNA, 24 bp, Homo sapiens
ataaatatctatttatctgtctga

SEQ ID NO: 4263947 - DNA, 17 bp, Homo sapiens
ataaatcgcattaatga

SEQ ID NO: 4263948 - DNA, 17 bp, Homo sapiens
ataaatctgtctgattc

SEQ ID NO: 4263949 - DNA, 19 bp, Homo sapiens
ataaatggtgagaattaaa

SEQ ID NO: 4263950 - DNA, 22 bp, Homo sapiens
ataaattcaacacttattttct

SEQ ID NO: 4263951 - DNA, 19 bp, Homo sapiens
ataaattggtgataagtgg

SEQ ID NO: 4263952 - DNA, 20 bp, Homo sapiens
ataaattggtgataagtgga

SEQ ID NO: 4263953 - DNA, 21 bp, Homo sapiens
ataaattggtgataagtggaa

SEQ ID NO: 4263954 - DNA, 15 bp, Homo sapiens
ataacactggagtgg

SEQ ID NO: 4263955 - DNA, 13 bp, Homo sapiens
ataacatctgaaa

SEQ ID NO: 4263956 - DNA, 16 bp, Homo sapiens
ataacatctgaaaaga

SEQ ID NO: 4263957 - DNA, 17 bp, Homo sapiens
ataacatctgaaaagaa

SEQ ID NO: 4263958 - DNA, 14 bp, Homo sapiens
ataaccaaaaaatg

SEQ ID NO: 4263959 - DNA, 18 bp, Homo sapiens
ataactagatctcctgta

SEQ ID NO: 4263960 - DNA, 19 bp, Homo sapiens
ataactagatctcctgtaa

SEQ ID NO: 4263961 - DNA, 16 bp, Homo sapiens
ataactttagaaataa

SEQ ID NO: 4263962 - DNA, 16 bp, Homo sapiens
ataaggcctcatcctc

SEQ ID NO: 4263963 - DNA, 19 bp, Homo sapiens
ataagtaatatctttcagt

SEQ ID NO: 4263964 - DNA, 13 bp, Homo sapiens
ataagtggaaaaa

SEQ ID NO: 4263965 - DNA, 17 bp, Homo sapiens
ataagtggaaaaaagag

SEQ ID NO: 4263966 - DNA, 15 bp, Homo sapiens
ataataactagatct

SEQ ID NO: 4263967 - DNA, 15 bp, Homo sapiens
ataatactttgtata

SEQ ID NO: 4263968 - DNA, 18 bp, Homo sapiens
ataatagtaatggttcta

SEQ ID NO: 4263969 - DNA, 19 bp, Homo sapiens
ataatatcttgaagaatat

SEQ ID NO: 4263970 - DNA, 17 bp, Homo sapiens
ataatgacgtattgtga

SEQ ID NO: 4263971 - DNA, 21 bp, Homo sapiens
ataatgacgtattgtgaaatt

SEQ ID NO: 4263972 - DNA, 16 bp, Homo sapiens
ataatggaattatgta

SEQ ID NO: 4263973 - DNA, 15 bp, Homo sapiens
ataatgtgaaatgta

SEQ ID NO: 4263974 - DNA, 19 bp, Homo sapiens
ataattagatccattaatt

SEQ ID NO: 4263975 - DNA, 20 bp, Homo sapiens
ataattgtggagaggagaga

SEQ ID NO: 4263976 - DNA, 13 bp, Homo sapiens
atacaaacaggtg

SEQ ID NO: 4263977 - DNA, 15 bp, Homo sapiens
atacaaacaggtgct

SEQ ID NO: 4263978 - DNA, 18 bp, Homo sapiens
atacaaccttcatttaaa

SEQ ID NO: 4263979 - DNA, 14 bp, Homo sapiens
atacaccgggcctg

SEQ ID NO: 4263980 - DNA, 18 bp, Homo sapiens
atacaccgggcctggaga

SEQ ID NO: 4263981 - DNA, 16 bp, Homo sapiens
atacactgtatctaaa

SEQ ID NO: 4263982 - DNA, 23 bp, Homo sapiens
atacactgtatctaaaaaataac

SEQ ID NO: 4263983 - DNA, 19 bp, Homo sapiens
atacagtaagctgctctat

SEQ ID NO: 4263984 - DNA, 15 bp, Homo sapiens
atacatggtagcagg

SEQ ID NO: 4263985 - DNA, 13 bp, Homo sapiens
atacatgtatagt

SEQ ID NO: 4263986 - DNA, 13 bp, Homo sapiens
atacattaaaata

SEQ ID NO: 4263987 - DNA, 12 bp, Homo sapiens
atacatttttaa

SEQ ID NO: 4263988 - DNA, 16 bp, Homo sapiens
ataccccctgccccag

SEQ ID NO: 4263989 - DNA, 19 bp, Homo sapiens
ataccccctgccccagaga

SEQ ID NO: 4263990 - DNA, 13 bp, Homo sapiens
atactaaatatga

SEQ ID NO: 4263991 - DNA, 16 bp, Homo sapiens
atactcaccaaaatat

SEQ ID NO: 4263992 - DNA, 12 bp, Homo sapiens
atactctccagg

SEQ ID NO: 4263993 - DNA, 14 bp, Homo sapiens
atactctccaggat

SEQ ID NO: 4263994 - DNA, 20 bp, Homo sapiens
atactctgtgtaatctctga

SEQ ID NO: 4263995 - DNA, 22 bp, Homo sapiens
atactctgtgtaatctctgatt

SEQ ID NO: 4263996 - DNA, 22 bp, Homo sapiens
atactgactccaaccattcaaa

SEQ ID NO: 4263997 - DNA, 22 bp, Homo sapiens
atactgcatatcctggtgtcta

SEQ ID NO: 4263998 - DNA, 14 bp, Homo sapiens
atactggttatagt

SEQ ID NO: 4263999 - DNA, 23 bp, Homo sapiens
atactggttatagttgatatgta

SEQ ID NO: 4264000 - DNA, 14 bp, Homo sapiens
atactgtctaagaa

SEQ ID NO: 4264001 - DNA, 20 bp, Homo sapiens
atactgtctaagaataatga

SEQ ID NO: 4264002 - DNA, 18 bp, Homo sapiens
atacttaaaaatatgtga

SEQ ID NO: 4264003 - DNA, 12 bp, Homo sapiens
atacttcctgga

SEQ ID NO: 4264004 - DNA, 14 bp, Homo sapiens
atacttcctggatt

SEQ ID NO: 4264005 - DNA, 16 bp, Homo sapiens
atacttctttttcatt

SEQ ID NO: 4264006 - DNA, 17 bp, Homo sapiens
atacttctttttcatta

SEQ ID NO: 4264007 - DNA, 16 bp, Homo sapiens
atacttgaatattata

SEQ ID NO: 4264008 - DNA, 13 bp, Homo sapiens
atacttggtcctt

SEQ ID NO: 4264009 - DNA, 16 bp, Homo sapiens
atactttgcattgtct

SEQ ID NO: 4264010 - DNA, 19 bp, Homo sapiens
atacttttgtgtattctgt

SEQ ID NO: 4264011 - DNA, 23 bp, Homo sapiens
atagataaagtgcctataaagga

SEQ ID NO: 4264012 - DNA, 17 bp, Homo sapiens
atagcctcaccttccct

SEQ ID NO: 4264013 - DNA, 20 bp, Homo sapiens
ataggagcttccagatgggt

SEQ ID NO: 4264014 - DNA, 23 bp, Homo sapiens
ataggcccaaccaccagatgaga

SEQ ID NO: 4264015 - DNA, 22 bp, Homo sapiens
atagtactagagatattttgta

SEQ ID NO: 4264016 - DNA, 23 bp, Homo sapiens
atagtactagagatattttgtaa

SEQ ID NO: 4264017 - DNA, 20 bp, Homo sapiens
atagtagcagagtcattgtt

SEQ ID NO: 4264018 - DNA, 16 bp, Homo sapiens
atagtcaatcaaacag

SEQ ID NO: 4264019 - DNA, 18 bp, Homo sapiens
atagtcaatcaaacaggg

SEQ ID NO: 4264020 - DNA, 22 bp, Homo sapiens
atagtggctttcatttcttatt

SEQ ID NO: 4264021 - DNA, 14 bp, Homo sapiens
atagtgtgtccatg

SEQ ID NO: 4264022 - DNA, 22 bp, Homo sapiens
atagtgtgttgtgctttcaaga

SEQ ID NO: 4264023 - DNA, 19 bp, Homo sapiens
atagttaccgatggtgtcc

SEQ ID NO: 4264024 - DNA, 14 bp, Homo sapiens
atagttctatttct

SEQ ID NO: 4264025 - DNA, 15 bp, Homo sapiens
atagttctatttcta

SEQ ID NO: 4264026 - DNA, 16 bp, Homo sapiens
atagttctatttctat

SEQ ID NO: 4264027 - DNA, 16 bp, Homo sapiens
atagttgaacaagatt

SEQ ID NO: 4264028 - DNA, 13 bp, Homo sapiens
atagtttgttttc

SEQ ID NO: 4264029 - DNA, 21 bp, Homo sapiens
atagtttgttttctttttctg

SEQ ID NO: 4264030 - DNA, 16 bp, Homo sapiens
atataaatgtgtgtat

SEQ ID NO: 4264031 - DNA, 15 bp, Homo sapiens
atatacagctcagaa

SEQ ID NO: 4264032 - DNA, 17 bp, Homo sapiens
atatacagtttttgtaa

SEQ ID NO: 4264033 - DNA, 15 bp, Homo sapiens
atatacatgtatagt

SEQ ID NO: 4264034 - DNA, 21 bp, Homo sapiens
atatagttaattgtggcttta

SEQ ID NO: 4264035 - DNA, 17 bp, Homo sapiens
atatagttgaacaagat

SEQ ID NO: 4264036 - DNA, 17 bp, Homo sapiens
atatagtttgttttctt

SEQ ID NO: 4264037 - DNA, 19 bp, Homo sapiens
atatatacatgtatagtga

SEQ ID NO: 4264038 - DNA, 17 bp, Homo sapiens
atatatgaagtaagttc

SEQ ID NO: 4264039 - DNA, 14 bp, Homo sapiens
atatatggatattt

SEQ ID NO: 4264040 - DNA, 12 bp, Homo sapiens
atatatgtacag

SEQ ID NO: 4264041 - DNA, 13 bp, Homo sapiens
atatatgtacagt

SEQ ID NO: 4264042 - DNA, 18 bp, Homo sapiens
atatcaagtcccgaggca

SEQ ID NO: 4264043 - DNA, 16 bp, Homo sapiens
atatcactcattaatt

SEQ ID NO: 4264044 - DNA, 17 bp, Homo sapiens
atatcactcattaatta

SEQ ID NO: 4264045 - DNA, 18 bp, Homo sapiens
atatcatcacgtatgtta

SEQ ID NO: 4264046 - DNA, 16 bp, Homo sapiens
atatcattttcctggg

SEQ ID NO: 4264047 - DNA, 16 bp, Homo sapiens
atatcctatactggtt

SEQ ID NO: 4264048 - DNA, 19 bp, Homo sapiens
atatctatttatctgtctg

SEQ ID NO: 4264049 - DNA, 20 bp, Homo sapiens
atatctatttatctgtctga

SEQ ID NO: 4264050 - DNA, 16 bp, Homo sapiens
atatctgaaaactgga

SEQ ID NO: 4264051 - DNA, 17 bp, Homo sapiens
atatctgaaaactggaa

SEQ ID NO: 4264052 - DNA, 17 bp, Homo sapiens
atatctgtaaatttaac

SEQ ID NO: 4264053 - DNA, 17 bp, Homo sapiens
atatctgtgaaatatca

SEQ ID NO: 4264054 - DNA, 18 bp, Homo sapiens
atatctgtggtcttcaaa

SEQ ID NO: 4264055 - DNA, 17 bp, Homo sapiens
atatcttgaagaatatt

SEQ ID NO: 4264056 - DNA, 20 bp, Homo sapiens
atatgaagtaagttctgaaa

SEQ ID NO: 4264057 - DNA, 21 bp, Homo sapiens
atatgaagtaagttctgaaaa

SEQ ID NO: 4264058 - DNA, 16 bp, Homo sapiens
atatgaataattatgt

SEQ ID NO: 4264059 - DNA, 18 bp, Homo sapiens
atatgacaatttcaaaat

SEQ ID NO: 4264060 - DNA, 18 bp, Homo sapiens
atatgaggggactgcatg

SEQ ID NO: 4264061 - DNA, 22 bp, Homo sapiens
atatgattctcctctcccaaat

SEQ ID NO: 4264062 - DNA, 20 bp, Homo sapiens
atatgattgaaaagaagaaa

SEQ ID NO: 4264063 - DNA, 22 bp, Homo sapiens
atatgccagtgactgctgcgct

SEQ ID NO: 4264064 - DNA, 16 bp, Homo sapiens
atatggaaatcctgtt

SEQ ID NO: 4264065 - DNA, 17 bp, Homo sapiens
atatggcttgtagggtg

SEQ ID NO: 4264066 - DNA, 23 bp, Homo sapiens
atatggggggccaacaccaggga

SEQ ID NO: 4264067 - DNA, 22 bp, Homo sapiens
atatgtaacagttggtgatttt

SEQ ID NO: 4264068 - DNA, 19 bp, Homo sapiens
atatgtacagttatacata

SEQ ID NO: 4264069 - DNA, 18 bp, Homo sapiens
atgttaaacgtcacagca

SEQ ID NO: 4264070 - DNA, 19 bp, Homo sapiens
atgttaaacgtcacagcag

SEQ ID NO: 4264071 - DNA, 12 bp, Homo sapiens
atgttaaagagg

SEQ ID NO: 4264072 - DNA, 22 bp, Homo sapiens
atgttaaagaggcgtcttgtat

SEQ ID NO: 4264073 - DNA, 18 bp, Homo sapiens
atgttaacaatgcctatt

SEQ ID NO: 4264074 - DNA, 19 bp, Homo sapiens
atgttaattgatagaataa

SEQ ID NO: 4264075 - DNA, 19 bp, Homo sapiens
atgttcacgcaacttgaaa

SEQ ID NO: 4264076 - DNA, 16 bp, Homo sapiens
atgttctgaataattt

SEQ ID NO: 4264077 - DNA, 18 bp, Homo sapiens
atgttctgaataatttct

SEQ ID NO: 4264078 - DNA, 22 bp, Homo sapiens
atgttctttcctttcatcctca

SEQ ID NO: 4264079 - DNA, 13 bp, Homo sapiens
atgttgctgaaac

SEQ ID NO: 4264080 - DNA, 18 bp, Homo sapiens
atgtttaatcaagagaga

SEQ ID NO: 4264081 - DNA, 23 bp, Homo sapiens
atgtttacctcactggtgcattt

SEQ ID NO: 4264082 - DNA, 23 bp, Homo sapiens
atgtttccaggcatgaccctgga

SEQ ID NO: 4264083 - DNA, 22 bp, Homo sapiens
atgtttcccgctccaagagaat

SEQ ID NO: 4264084 - DNA, 13 bp, Homo sapiens
atgtttctttttc

SEQ ID NO: 4264085 - DNA, 15 bp, Homo sapiens
atgtttctttttctt

SEQ ID NO: 4264086 - DNA, 12 bp, Homo sapiens
atgtttgaatta

SEQ ID NO: 4264087 - DNA, 17 bp, Homo sapiens
atgtttgcgaatggctt

SEQ ID NO: 4264088 - DNA, 17 bp, Homo sapiens
attaaaaagttaatctt

SEQ ID NO: 4264089 - DNA, 13 bp, Homo sapiens
attaaactgttaa

SEQ ID NO: 4264090 - DNA, 13 bp, Homo sapiens
attaaagacattt

SEQ ID NO: 4264091 - DNA, 18 bp, Homo sapiens
attaaagacatttaaaat

SEQ ID NO: 4264092 - DNA, 19 bp, Homo sapiens
attaaatcagaatctttaa

SEQ ID NO: 4264093 - DNA, 14 bp, Homo sapiens
attaaatgtagctt

SEQ ID NO: 4264094 - DNA, 22 bp, Homo sapiens
attaaatgtagcttcagtcatt

SEQ ID NO: 4264095 - DNA, 24 bp, Homo sapiens
attaaatgtagcttcagtcattaa

SEQ ID NO: 4264096 - DNA, 15 bp, Homo sapiens
attaaatttaatata

SEQ ID NO: 4264097 - DNA, 16 bp, Homo sapiens
attaaattttaatgta

SEQ ID NO: 4264098 - DNA, 13 bp, Homo sapiens
attaacatatatt

SEQ ID NO: 4264099 - DNA, 21 bp, Homo sapiens
attaaccaaattaacctttca

SEQ ID NO: 4264100 - DNA, 18 bp, Homo sapiens
attaactccgtttccaaa

SEQ ID NO: 4264101 - DNA, 13 bp, Homo sapiens
attaagcttaaaa

SEQ ID NO: 4264102 - DNA, 17 bp, Homo sapiens
attaatatttgtttagt

SEQ ID NO: 4264103 - DNA, 14 bp, Homo sapiens
attaatctctaaaa

SEQ ID NO: 4264104 - DNA, 14 bp, Homo sapiens
attacaatggccag

SEQ ID NO: 4264105 - DNA, 15 bp, Homo sapiens
attacagatttagtt

SEQ ID NO: 4264106 - DNA, 21 bp, Homo sapiens
attacagggaagaaatcaagt

SEQ ID NO: 4264107 - DNA, 19 bp, Homo sapiens
attaccatttgttaatatc

SEQ ID NO: 4264108 - DNA, 17 bp, Homo sapiens
attactgcatgcacttc

SEQ ID NO: 4264109 - DNA, 19 bp, Homo sapiens
attactggatctcttaaga

SEQ ID NO: 4264110 - DNA, 15 bp, Homo sapiens
attagaattaccatt

SEQ ID NO: 4264111 - DNA, 17 bp, Homo sapiens
attagaattaccatttg

SEQ ID NO: 4264112 - DNA, 21 bp, Homo sapiens
attagaattaccatttgttaa

SEQ ID NO: 4264113 - DNA, 15 bp, Homo sapiens
attagactgaattta

SEQ ID NO: 4264114 - DNA, 18 bp, Homo sapiens
attagactgaatttaact

SEQ ID NO: 4264115 - DNA, 17 bp, Homo sapiens
attagagggacagccaa

SEQ ID NO: 4264116 - DNA, 18 bp, Homo sapiens
attagatccattaattta

SEQ ID NO: 4264117 - DNA, 17 bp, Homo sapiens
attagcagtttgctttg

SEQ ID NO: 4264118 - DNA, 17 bp, Homo sapiens
attagccctgcattttc

SEQ ID NO: 4264119 - DNA, 21 bp, Homo sapiens
attagctctcgcctcaggctt

SEQ ID NO: 4264120 - DNA, 12 bp, Homo sapiens
attaggcctgga

SEQ ID NO: 4264121 - DNA, 13 bp, Homo sapiens
attaggcctggag

SEQ ID NO: 4264122 - DNA, 14 bp, Homo sapiens
attaggcctggagt

SEQ ID NO: 4264123 - DNA, 12 bp, Homo sapiens
attagtaagatc

SEQ ID NO: 4264124 - DNA, 14 bp, Homo sapiens
attagtatcctgtt

SEQ ID NO: 4264125 - DNA, 15 bp, Homo sapiens
attagtatcctgtta

SEQ ID NO: 4264126 - DNA, 17 bp, Homo sapiens
attagtgagatttgtat

SEQ ID NO: 4264127 - DNA, 13 bp, Homo sapiens
attatactgtgtg

SEQ ID NO: 4264128 - DNA, 20 bp, Homo sapiens
attatgagtctctatgatct

SEQ ID NO: 4264129 - DNA, 14 bp, Homo sapiens
attatgtataacaa

SEQ ID NO: 4264130 - DNA, 15 bp, Homo sapiens
attatgtataacaag

SEQ ID NO: 4264131 - DNA, 22 bp, Homo sapiens
attatgtcctgtgagatgtgta

SEQ ID NO: 4264132 - DNA, 21 bp, Homo sapiens
attattaaatcggcaacaggg

SEQ ID NO: 4264133 - DNA, 23 bp, Homo sapiens
attattctagtcaactgctgttt

SEQ ID NO: 4264134 - DNA, 20 bp, Homo sapiens
attattgaatgttatatcat

SEQ ID NO: 4264135 - DNA, 17 bp, Homo sapiens
attcaaaatagttctat

SEQ ID NO: 4264136 - DNA, 13 bp, Homo sapiens
attcaaagagaaa

SEQ ID NO: 4264137 - DNA, 14 bp, Homo sapiens
attcaaagagaaaa

SEQ ID NO: 4264138 - DNA, 18 bp, Homo sapiens
attcaaatgcatgatatt

SEQ ID NO: 4264139 - DNA, 22 bp, Homo sapiens
attcaaatgcatgatattgtat

SEQ ID NO: 4264140 - DNA, 12 bp, Homo sapiens
attcaaatttat

SEQ ID NO: 4264141 - DNA, 13 bp, Homo sapiens
attcaaatttatt

SEQ ID NO: 4264142 - DNA, 13 bp, Homo sapiens
attcaacaaatga

SEQ ID NO: 4264143 - DNA, 19 bp, Homo sapiens
attcaactaatacatggtt

SEQ ID NO: 4264144 - DNA, 20 bp, Homo sapiens
attcaactaatacatggttt

SEQ ID NO: 4264145 - DNA, 12 bp, Homo sapiens
attcaagattcc

SEQ ID NO: 4264146 - DNA, 13 bp, Homo sapiens
attcacaacacaa

SEQ ID NO: 4264147 - DNA, 18 bp, Homo sapiens
attcacactgtgcgtttt

SEQ ID NO: 4264148 - DNA, 15 bp, Homo sapiens
attcacattttaaca

SEQ ID NO: 4264149 - DNA, 21 bp, Homo sapiens
attcagagatgtaccatgtta

SEQ ID NO: 4264150 - DNA, 15 bp, Homo sapiens
attcaggaccccatc

SEQ ID NO: 4264151 - DNA, 13 bp, Homo sapiens
attcagtttctaa

SEQ ID NO: 4264152 - DNA, 21 bp, Homo sapiens
attcatacttaaaaatttatt

SEQ ID NO: 4264153 - DNA, 15 bp, Homo sapiens
attcatactttccaa

SEQ ID NO: 4264154 - DNA, 21 bp, Homo sapiens
attcatagcatcctgattatt

SEQ ID NO: 4264155 - DNA, 15 bp, Homo sapiens
attcatgcctcaagt

SEQ ID NO: 4264156 - DNA, 21 bp, Homo sapiens
attcatggctttaacagtaat

SEQ ID NO: 4264157 - DNA, 16 bp, Homo sapiens
attcattcatacttaa

SEQ ID NO: 4264158 - DNA, 13 bp, Homo sapiens
attcattctttat

SEQ ID NO: 4264159 - DNA, 14 bp, Homo sapiens
attcattttgcaac

SEQ ID NO: 4264160 - DNA, 17 bp, Homo sapiens
attcattttgcaacttg

SEQ ID NO: 4264161 - DNA, 23 bp, Homo sapiens
attccaaataaaacttgagccca

SEQ ID NO: 4264162 - DNA, 17 bp, Homo sapiens
attccaagtgtttctgt

SEQ ID NO: 4264163 - DNA, 20 bp, Homo sapiens
attccaccaggattaatctc

SEQ ID NO: 4264164 - DNA, 16 bp, Homo sapiens
attccaggtttaagta

SEQ ID NO: 4264165 - DNA, 19 bp, Homo sapiens
attccagtgtattttctgt

SEQ ID NO: 4264166 - DNA, 18 bp, Homo sapiens
attccatccatatacttt

SEQ ID NO: 4264167 - DNA, 17 bp, Homo sapiens
attcccttctctcagcc

SEQ ID NO: 4264168 - DNA, 13 bp, Homo sapiens
attccttggccca

SEQ ID NO: 4264169 - DNA, 16 bp, Homo sapiens
attccttggcccagca

SEQ ID NO: 4264170 - DNA, 15 bp, Homo sapiens
attctaagattgtac

SEQ ID NO: 4264171 - DNA, 16 bp, Homo sapiens
attctagattaccatg

SEQ ID NO: 4264172 - DNA, 17 bp, Homo sapiens
attctagtcaactgctg

SEQ ID NO: 4264173 - DNA, 20 bp, Homo sapiens
attctagtcaactgctgttt

SEQ ID NO: 4264174 - DNA, 17 bp, Homo sapiens
attctagtctctgattt

SEQ ID NO: 4264175 - DNA, 23 bp, Homo sapiens
attctagtctctgatttgcaaat

SEQ ID NO: 4264176 - DNA, 14 bp, Homo sapiens
attctataaattca

SEQ ID NO: 4264177 - DNA, 15 bp, Homo sapiens
attctatatttcata

SEQ ID NO: 4264178 - DNA, 17 bp, Homo sapiens
attctatatttcatatt

SEQ ID NO: 4264179 - DNA, 17 bp, Homo sapiens
attctatctactgattt

SEQ ID NO: 4264180 - DNA, 16 bp, Homo sapiens
attctatgcctgtatt

SEQ ID NO: 4264181 - DNA, 17 bp, Homo sapiens
attctatgcctgtattt

SEQ ID NO: 4264182 - DNA, 23 bp, Homo sapiens
attctcatgcactgcaaatactt

SEQ ID NO: 4264183 - DNA, 17 bp, Homo sapiens
attctcttggctggctt

SEQ ID NO: 4264184 - DNA, 16 bp, Homo sapiens
attctgctgcccccag

SEQ ID NO: 4264185 - DNA, 13 bp, Homo sapiens
attctggctccac

SEQ ID NO: 4264186 - DNA, 20 bp, Homo sapiens
attctggggtggggcttgga

SEQ ID NO: 4264187 - DNA, 16 bp, Homo sapiens
attctgggtgttttca

SEQ ID NO: 4264188 - DNA, 16 bp, Homo sapiens
attctgtccctgtccc

SEQ ID NO: 4264189 - DNA, 18 bp, Homo sapiens
attctgtccctgtccctg

SEQ ID NO: 4264190 - DNA, 19 bp, Homo sapiens
attctgtggattctatatt

SEQ ID NO: 4264191 - DNA, 17 bp, Homo sapiens
attctgtgggcagctgg

SEQ ID NO: 4264192 - DNA, 21 bp, Homo sapiens
attctgtgggcagctggctct

SEQ ID NO: 4264193 - DNA, 13 bp, Homo sapiens
attcttccatctg

SEQ ID NO: 4264194 - DNA, 14 bp, Homo sapiens
attcttccatctga

SEQ ID NO: 4264195 - DNA, 23 bp, Homo sapiens
attcttttcagcttgtttctata

SEQ ID NO: 4264196 - DNA, 22 bp, Homo sapiens
attcttttgaaagatggtaatc

SEQ ID NO: 4264197 - DNA, 21 bp, Homo sapiens
attcttttttcttccccctcc

SEQ ID NO: 4264198 - DNA, 18 bp, Homo sapiens
attgaaaagaagaaagtc

SEQ ID NO: 4264199 - DNA, 21 bp, Homo sapiens
attgaaaagaagaaagtctat

SEQ ID NO: 4264200 - DNA, 18 bp, Homo sapiens
attttgacactgaaataa

SEQ ID NO: 4264201 - DNA, 15 bp, Homo sapiens
attttgcaacttgga

SEQ ID NO: 4264202 - DNA, 18 bp, Homo sapiens
attttgtaaaatgtatta

SEQ ID NO: 4264203 - DNA, 14 bp, Homo sapiens
attttgtatgaaat

SEQ ID NO: 4264204 - DNA, 16 bp, Homo sapiens
attttgtatgaaatat

SEQ ID NO: 4264205 - DNA, 20 bp, Homo sapiens
attttgtctgcttagtatct

SEQ ID NO: 4264206 - DNA, 12 bp, Homo sapiens
attttgtctggc

SEQ ID NO: 4264207 - DNA, 16 bp, Homo sapiens
atttttagagattaat

SEQ ID NO: 4264208 - DNA, 19 bp, Homo sapiens
atttttaggtgtcttttaa

SEQ ID NO: 4264209 - DNA, 19 bp, Homo sapiens
atttttcaatagcgtgtgt

SEQ ID NO: 4264210 - DNA, 17 bp, Homo sapiens
attttttacaaattatg

SEQ ID NO: 4264211 - DNA, 15 bp, Homo sapiens
attttttactacata

SEQ ID NO: 4264212 - DNA, 21 bp, Homo sapiens
attttttactacataattaaa

SEQ ID NO: 4264213 - DNA, 13 bp, Homo sapiens
atttttttccaga

SEQ ID NO: 4264214 - DNA, 15 bp, Homo sapiens
atttttttgttgctg

SEQ ID NO: 4264215 - DNA, 13 bp, Homo sapiens
caaaaaatctata

SEQ ID NO: 4264216 - DNA, 20 bp, Homo sapiens
caaaaaatgtgagctataat

SEQ ID NO: 4264217 - DNA, 14 bp, Homo sapiens
caaaaacaataaac

SEQ ID NO: 4264218 - DNA, 16 bp, Homo sapiens
caaaaacatggccaca

SEQ ID NO: 4264219 - DNA, 14 bp, Homo sapiens
caaaaacatttgtt

SEQ ID NO: 4264220 - DNA, 19 bp, Homo sapiens
caaaaacatttgtttatcc

SEQ ID NO: 4264221 - DNA, 12 bp, Homo sapiens
caaaacagaacg

SEQ ID NO: 4264222 - DNA, 13 bp, Homo sapiens
caaaaccacagcc

SEQ ID NO: 4264223 - DNA, 16 bp, Homo sapiens
caaaaccacagccctg

SEQ ID NO: 4264224 - DNA, 20 bp, Homo sapiens
caaaactatcggttcaagtt

SEQ ID NO: 4264225 - DNA, 23 bp, Homo sapiens
caaaactccactcagcacaatta

SEQ ID NO: 4264226 - DNA, 18 bp, Homo sapiens
caaaactgcctacccacc

SEQ ID NO: 4264227 - DNA, 19 bp, Homo sapiens
caaaatacatgatgatttc

SEQ ID NO: 4264228 - DNA, 17 bp, Homo sapiens
caaaatagttctatttc

SEQ ID NO: 4264229 - DNA, 18 bp, Homo sapiens
caaaatagttctatttct

SEQ ID NO: 4264230 - DNA, 22 bp, Homo sapiens
caaaatagttctatttctatct

SEQ ID NO: 4264231 - DNA, 20 bp, Homo sapiens
caaaatatttctaagcttat

SEQ ID NO: 4264232 - DNA, 22 bp, Homo sapiens
caaaatatttctaagcttattt

SEQ ID NO: 4264233 - DNA, 17 bp, Homo sapiens
caaaatcagtgatggga

SEQ ID NO: 4264234 - DNA, 12 bp, Homo sapiens
caaaatgcatgt

SEQ ID NO: 4264235 - DNA, 15 bp, Homo sapiens
caaaatgcatgtgat

SEQ ID NO: 4264236 - DNA, 12 bp, Homo sapiens
caaaattgctga

SEQ ID NO: 4264237 - DNA, 18 bp, Homo sapiens
caaacacacagactctgt

SEQ ID NO: 4264238 - DNA, 19 bp, Homo sapiens
caaacacacagactctgtg

SEQ ID NO: 4264239 - DNA, 12 bp, Homo sapiens
caaacaggtgct

SEQ ID NO: 4264240 - DNA, 23 bp, Homo sapiens
caaacatggggttggctgggccc

SEQ ID NO: 4264241 - DNA, 14 bp, Homo sapiens
caaacattcttatt

SEQ ID NO: 4264242 - DNA, 16 bp, Homo sapiens
caaacattcttatttt

SEQ ID NO: 4264243 - DNA, 19 bp, Homo sapiens
caaacattcttattttaga

SEQ ID NO: 4264244 - DNA, 23 bp, Homo sapiens
caaaccagggggaagcaccagcc

SEQ ID NO: 4264245 - DNA, 14 bp, Homo sapiens
caaagaacccccct

SEQ ID NO: 4264246 - DNA, 16 bp, Homo sapiens
caaagaacccccctcc

SEQ ID NO: 4264247 - DNA, 23 bp, Homo sapiens
caaagagaaaagattaaaattag

SEQ ID NO: 4264248 - DNA, 17 bp, Homo sapiens
caaagcaagcacctggg

SEQ ID NO: 4264249 - DNA, 20 bp, Homo sapiens
caaagcatttgactttctgt

SEQ ID NO: 4264250 - DNA, 20 bp, Homo sapiens
caaagggaagcagagcctgg

SEQ ID NO: 4264251 - DNA, 21 bp, Homo sapiens
caaagggaagcagagcctggg

SEQ ID NO: 4264252 - DNA, 22 bp, Homo sapiens
caaagggaagcagagcctgggg

SEQ ID NO: 4264253 - DNA, 20 bp, Homo sapiens
caaagtccaactacagccaa

SEQ ID NO: 4264254 - DNA, 19 bp, Homo sapiens
caaatatgattctcctctc

SEQ ID NO: 4264255 - DNA, 18 bp, Homo sapiens
caaatatgcccctcccca

SEQ ID NO: 4264256 - DNA, 17 bp, Homo sapiens
caaatccataccccctg

SEQ ID NO: 4264257 - DNA, 18 bp, Homo sapiens
caaatccataccccctgc

SEQ ID NO: 4264258 - DNA, 14 bp, Homo sapiens
caaatctgagcctt

SEQ ID NO: 4264259 - DNA, 21 bp, Homo sapiens
caaatgagtttaaaaaaataa

SEQ ID NO: 4264260 - DNA, 12 bp, Homo sapiens
caaatgcagctt

SEQ ID NO: 4264261 - DNA, 16 bp, Homo sapiens
caaatgcagcttcagg

SEQ ID NO: 4264262 - DNA, 16 bp, Homo sapiens
caaatgctactcagta

SEQ ID NO: 4264263 - DNA, 13 bp, Homo sapiens
caaattattctag

SEQ ID NO: 4264264 - DNA, 14 bp, Homo sapiens
caaattattctagt

SEQ ID NO: 4264265 - DNA, 20 bp, Homo sapiens
caaattgatgggtgggctag

SEQ ID NO: 4264266 - DNA, 14 bp, Homo sapiens
caaattgcagaaga

SEQ ID NO: 4264267 - DNA, 22 bp, Homo sapiens
caaattgtcttttgtcatgtgg

SEQ ID NO: 4264268 - DNA, 15 bp, Homo sapiens
caaatttatttccaa

SEQ ID NO: 4264269 - DNA, 19 bp, Homo sapiens
caaatttttctgggaagaa

SEQ ID NO: 4264270 - DNA, 14 bp, Homo sapiens
caacaaagaaatat

SEQ ID NO: 4264271 - DNA, 21 bp, Homo sapiens
caacactgccagaagtgtgtt

SEQ ID NO: 4264272 - DNA, 22 bp, Homo sapiens
caacactgccagaagtgtgttt

SEQ ID NO: 4264273 - DNA, 15 bp, Homo sapiens
caacacttattttct

SEQ ID NO: 4264274 - DNA, 15 bp, Homo sapiens
caacaggaccaggag

SEQ ID NO: 4264275 - DNA, 16 bp, Homo sapiens
caacaggaccaggagc

SEQ ID NO: 4264276 - DNA, 22 bp, Homo sapiens
caacaggcgttctcagcctccg

SEQ ID NO: 4264277 - DNA, 21 bp, Homo sapiens
caacagtgaacagcttcactt

SEQ ID NO: 4264278 - DNA, 17 bp, Homo sapiens
caacatgaattaagaac

SEQ ID NO: 4264279 - DNA, 19 bp, Homo sapiens
caacattatcctgtgtgat

SEQ ID NO: 4264280 - DNA, 17 bp, Homo sapiens
caaccaccgctccccag

SEQ ID NO: 4264281 - DNA, 20 bp, Homo sapiens
caaccaccgctccccagccc

SEQ ID NO: 4264282 - DNA, 14 bp, Homo sapiens
caaccacctctggc

SEQ ID NO: 4264283 - DNA, 15 bp, Homo sapiens
caaccacctctggcc

SEQ ID NO: 4264284 - DNA, 17 bp, Homo sapiens
caacccaggtgttgtcc

SEQ ID NO: 4264285 - DNA, 22 bp, Homo sapiens
caacccaggtgttgtccgtgtc

SEQ ID NO: 4264286 - DNA, 13 bp, Homo sapiens
caacccatgcatg

SEQ ID NO: 4264287 - DNA, 18 bp, Homo sapiens
caacccatgcatggcctc

SEQ ID NO: 4264288 - DNA, 12 bp, Homo sapiens
caacccctgtgg

SEQ ID NO: 4264289 - DNA, 16 bp, Homo sapiens
caacccctgtggagcc

SEQ ID NO: 4264290 - DNA, 21 bp, Homo sapiens
caacccctgtggagcccgcac

SEQ ID NO: 4264291 - DNA, 13 bp, Homo sapiens
caaccctcagagc

SEQ ID NO: 4264292 - DNA, 22 bp, Homo sapiens
caaccctccctcagcccctctt

SEQ ID NO: 4264293 - DNA, 15 bp, Homo sapiens
caaccctcctatcac

SEQ ID NO: 4264294 - DNA, 11 bp, Homo sapiens
caaccctgccc

SEQ ID NO: 4264295 - DNA, 14 bp, Homo sapiens
caaccctgcccctg

SEQ ID NO: 4264296 - DNA, 15 bp, Homo sapiens
caaccctgcccctgc

SEQ ID NO: 4264297 - DNA, 14 bp, Homo sapiens
caaccgatgctcca

SEQ ID NO: 4264298 - DNA, 17 bp, Homo sapiens
caaccgatgctccagcc

SEQ ID NO: 4264299 - DNA, 18 bp, Homo sapiens
caaccgatgctccagcca

SEQ ID NO: 4264300 - DNA, 19 bp, Homo sapiens
caaccggggagcccccgcc

SEQ ID NO: 4264301 - DNA, 17 bp, Homo sapiens
caacctacagtggaggg

SEQ ID NO: 4264302 - DNA, 21 bp, Homo sapiens
caacctacagtggagggagac

SEQ ID NO: 4264303 - DNA, 14 bp, Homo sapiens
caacctaggagcag

SEQ ID NO: 4264304 - DNA, 21 bp, Homo sapiens
caacctcactgccctccctcg

SEQ ID NO: 4264305 - DNA, 19 bp, Homo sapiens
caacctcccctggtcctgc

SEQ ID NO: 4264306 - DNA, 20 bp, Homo sapiens
caacctcccctggtcctgca

SEQ ID NO: 4264307 - DNA, 15 bp, Homo sapiens
caacctctttcctct

SEQ ID NO: 4264308 - DNA, 16 bp, Homo sapiens
caaccttctgtggctc

SEQ ID NO: 4264309 - DNA, 16 bp, Homo sapiens
caaccttgagacagct

SEQ ID NO: 4264310 - DNA, 12 bp, Homo sapiens
caacgcagccct

SEQ ID NO: 4264311 - DNA, 18 bp, Homo sapiens
caacgcagccctgctttg

SEQ ID NO: 4264312 - DNA, 21 bp, Homo sapiens
caactcatccagaactgtctt

SEQ ID NO: 4264313 - DNA, 15 bp, Homo sapiens
caactccaaggcaaa

SEQ ID NO: 4264314 - DNA, 18 bp, Homo sapiens
caactccaggaaaactgt

SEQ ID NO: 4264315 - DNA, 11 bp, Homo sapiens
caactctctct

SEQ ID NO: 4264316 - DNA, 18 bp, Homo sapiens
caactctgactgtaaaat

SEQ ID NO: 4264317 - DNA, 11 bp, Homo sapiens
caactctggcc

SEQ ID NO: 4264318 - DNA, 13 bp, Homo sapiens
caactgagccaaa

SEQ ID NO: 4264319 - DNA, 17 bp, Homo sapiens
caactgagccaaaaaca

SEQ ID NO: 4264320 - DNA, 23 bp, Homo sapiens
caactgagccaaaaacaataaac

SEQ ID NO: 4264321 - DNA, 16 bp, Homo sapiens
caactgctgttttatg

SEQ ID NO: 4264322 - DNA, 19 bp, Homo sapiens
caactgttggataataact

SEQ ID NO: 4264323 - DNA, 21 bp, Homo sapiens
caacttaatgttctgaataat

SEQ ID NO: 4264324 - DNA, 17 bp, Homo sapiens
caacttacatatgtctt

SEQ ID NO: 4264325 - DNA, 12 bp, Homo sapiens
caactttagaaa

SEQ ID NO: 4264326 - DNA, 14 bp, Homo sapiens
caactttagaaaga

SEQ ID NO: 4264327 - DNA, 16 bp, Homo sapiens
caactttagaaagaaa

SEQ ID NO: 4264328 - DNA, 15 bp, Homo sapiens
caactttccagactt

SEQ ID NO: 4264329 - DNA, 17 bp, Homo sapiens
caagaaaggaaaccttt

SEQ ID NO: 4264330 - DNA, 17 bp, Homo sapiens
caagaagaatttgaaga

SEQ ID NO: 4264331 - DNA, 16 bp, Homo sapiens
cagccccccagtgtcc

SEQ ID NO: 4264332 - DNA, 14 bp, Homo sapiens
cagccccctcctga

SEQ ID NO: 4264333 - DNA, 12 bp, Homo sapiens
cagccccctggc

SEQ ID NO: 4264334 - DNA, 13 bp, Homo sapiens
cagccccctggcc

SEQ ID NO: 4264335 - DNA, 14 bp, Homo sapiens
cagcccctcccacc

SEQ ID NO: 4264336 - DNA, 11 bp, Homo sapiens
cagcccctctt

SEQ ID NO: 4264337 - DNA, 13 bp, Homo sapiens
cagcccctggggt

SEQ ID NO: 4264338 - DNA, 15 bp, Homo sapiens
cagcccgtgtggccc

SEQ ID NO: 4264339 - DNA, 17 bp, Homo sapiens
cagcccgtgtggcccct

SEQ ID NO: 4264340 - DNA, 20 bp, Homo sapiens
cagcccgtgtggccccttca

SEQ ID NO: 4264341 - DNA, 15 bp, Homo sapiens
cagccctccctgccc

SEQ ID NO: 4264342 - DNA, 16 bp, Homo sapiens
cagccctccctgcccc

SEQ ID NO: 4264343 - DNA, 18 bp, Homo sapiens
cagccctctcactgtgtc

SEQ ID NO: 4264344 - DNA, 19 bp, Homo sapiens
cagccctgctttgggctgc

SEQ ID NO: 4264345 - DNA, 21 bp, Homo sapiens
cagccctgctttgggctgccc

SEQ ID NO: 4264346 - DNA, 15 bp, Homo sapiens
cagccctggtggcca

SEQ ID NO: 4264347 - DNA, 21 bp, Homo sapiens
cagccctggtggccaagcctg

SEQ ID NO: 4264348 - DNA, 22 bp, Homo sapiens
cagccctggttctccatcccca

SEQ ID NO: 4264349 - DNA, 16 bp, Homo sapiens
cagccctgtcagtgca

SEQ ID NO: 4264350 - DNA, 11 bp, Homo sapiens
cagccctgtgg

SEQ ID NO: 4264351 - DNA, 23 bp, Homo sapiens
cagccgcaaatccataccccctg

SEQ ID NO: 4264352 - DNA, 19 bp, Homo sapiens
cagccggggagctgagggg

SEQ ID NO: 4264353 - DNA, 9 bp, Homo sapiens
cagccgtgc

SEQ ID NO: 4264354 - DNA, 20 bp, Homo sapiens
cagccgtgccttcagctcta

SEQ ID NO: 4264355 - DNA, 18 bp, Homo sapiens
cagcctaggggtcaggga

SEQ ID NO: 4264356 - DNA, 19 bp, Homo sapiens
cagcctaggggtcagggac

SEQ ID NO: 4264357 - DNA, 18 bp, Homo sapiens
cagcctcacccctgcagg

SEQ ID NO: 4264358 - DNA, 13 bp, Homo sapiens
cagcctcagaggc

SEQ ID NO: 4264359 - DNA, 18 bp, Homo sapiens
cagcctccactccctgtc

SEQ ID NO: 4264360 - DNA, 22 bp, Homo sapiens
cagcctccggatgacacaaata

SEQ ID NO: 4264361 - DNA, 14 bp, Homo sapiens
cagcctggccccaa

SEQ ID NO: 4264362 - DNA, 12 bp, Homo sapiens
cagcctgtggcc

SEQ ID NO: 4264363 - DNA, 15 bp, Homo sapiens
cagcctgtggcctca

SEQ ID NO: 4264364 - DNA, 12 bp, Homo sapiens
cagcgagtctgg

SEQ ID NO: 4264365 - DNA, 20 bp, Homo sapiens
cagcgagtctggagaccagg

SEQ ID NO: 4264366 - DNA, 23 bp, Homo sapiens
cagcgcaacagctgtgtgtgccc

SEQ ID NO: 4264367 - DNA, 15 bp, Homo sapiens
cagcggcccagattg

SEQ ID NO: 4264368 - DNA, 13 bp, Homo sapiens
cagcggcctgggg

SEQ ID NO: 4264369 - DNA, 16 bp, Homo sapiens
cagcgtctgagcggcc

SEQ ID NO: 4264370 - DNA, 20 bp, Homo sapiens
cagcgtctgagcggccgcct

SEQ ID NO: 4264371 - DNA, 22 bp, Homo sapiens
cagcgtctttttaacctcagaa

SEQ ID NO: 4264372 - DNA, 23 bp, Homo sapiens
cagcgtctttttaacctcagaaa

SEQ ID NO: 4264373 - DNA, 19 bp, Homo sapiens
cagctaagcctgatgatgg

SEQ ID NO: 4264374 - DNA, 18 bp, Homo sapiens
cagctaggttaataggag

SEQ ID NO: 4264375 - DNA, 11 bp, Homo sapiens
cagctccaggc

SEQ ID NO: 4264376 - DNA, 14 bp, Homo sapiens
cagctccaggcagg

SEQ ID NO: 4264377 - DNA, 15 bp, Homo sapiens
cagctccaggcagga

SEQ ID NO: 4264378 - DNA, 20 bp, Homo sapiens
cagctctagacaaccctgca

SEQ ID NO: 4264379 - DNA, 21 bp, Homo sapiens
cagctctcccctgcgcaggcc

SEQ ID NO: 4264380 - DNA, 21 bp, Homo sapiens
cagctgaccagaagtggcagg

SEQ ID NO: 4264381 - DNA, 15 bp, Homo sapiens
cagctgagctggcct

SEQ ID NO: 4264382 - DNA, 15 bp, Homo sapiens
cagctgcaggaatca

SEQ ID NO: 4264383 - DNA, 19 bp, Homo sapiens
cagctgcagttagcacaga

SEQ ID NO: 4264384 - DNA, 21 bp, Homo sapiens
cagctgcagttagcacagagg

SEQ ID NO: 4264385 - DNA, 22 bp, Homo sapiens
cagctgcagttagcacagagga

SEQ ID NO: 4264386 - DNA, 13 bp, Homo sapiens
cagctgccagaga

SEQ ID NO: 4264387 - DNA, 17 bp, Homo sapiens
cagctgctcctcgcagt

SEQ ID NO: 4264388 - DNA, 15 bp, Homo sapiens
cagctgcttctgccc

SEQ ID NO: 4264389 - DNA, 17 bp, Homo sapiens
cagctgcttctgcccac

SEQ ID NO: 4264390 - DNA, 15 bp, Homo sapiens
cagctgctttcttct

SEQ ID NO: 4264391 - DNA, 15 bp, Homo sapiens
cagctggctctgaat

SEQ ID NO: 4264392 - DNA, 14 bp, Homo sapiens
cagctggctctgca

SEQ ID NO: 4264393 - DNA, 19 bp, Homo sapiens
cagctggctctgcagcaca

SEQ ID NO: 4264394 - DNA, 14 bp, Homo sapiens
cagctgtctgtggc

SEQ ID NO: 4264395 - DNA, 16 bp, Homo sapiens
cagctgtctgtggctt

SEQ ID NO: 4264396 - DNA, 17 bp, Homo sapiens
cagcttcaaaacagaac

SEQ ID NO: 4264397 - DNA, 14 bp, Homo sapiens
cagcttcacttaaa

SEQ ID NO: 4264398 - DNA, 22 bp, Homo sapiens
cagcttcacttaaaatcaaatt

SEQ ID NO: 4264399 - DNA, 19 bp, Homo sapiens
cagcttcaggtgagccaag

SEQ ID NO: 4264400 - DNA, 15 bp, Homo sapiens
cagctttgccttcca

SEQ ID NO: 4264401 - DNA, 21 bp, Homo sapiens
cagcttttttttcagccattc

SEQ ID NO: 4264402 - DNA, 15 bp, Homo sapiens
caggaaaactgtttt

SEQ ID NO: 4264403 - DNA, 18 bp, Homo sapiens
caggaaaactgtttttca

SEQ ID NO: 4264404 - DNA, 21 bp, Homo sapiens
caggaaattctgtttatgttc

SEQ ID NO: 4264405 - DNA, 18 bp, Homo sapiens
caggaacacccagcccca

SEQ ID NO: 4264406 - DNA, 18 bp, Homo sapiens
caggaagaaggcccggga

SEQ ID NO: 4264407 - DNA, 13 bp, Homo sapiens
caggaaggaagag

SEQ ID NO: 4264408 - DNA, 21 bp, Homo sapiens
caggaaggtctcatgcctgag

SEQ ID NO: 4264409 - DNA, 19 bp, Homo sapiens
caggaagtcaggagccagc

SEQ ID NO: 4264410 - DNA, 21 bp, Homo sapiens
caggaagtcaggagccagcag

SEQ ID NO: 4264411 - DNA, 22 bp, Homo sapiens
caggaagtcaggagccagcagg

SEQ ID NO: 4264412 - DNA, 23 bp, Homo sapiens
caggaagtcaggagccagcaggg

SEQ ID NO: 4264413 - DNA, 14 bp, Homo sapiens
caggaagtccctga

SEQ ID NO: 4264414 - DNA, 20 bp, Homo sapiens
caggaatgggccaagccagg

SEQ ID NO: 4264415 - DNA, 19 bp, Homo sapiens
caggaattctccctggcat

SEQ ID NO: 4264416 - DNA, 12 bp, Homo sapiens
caggacactgcc

SEQ ID NO: 4264417 - DNA, 13 bp, Homo sapiens
caggacactgcct

SEQ ID NO: 4264418 - DNA, 12 bp, Homo sapiens
caggaccaggag

SEQ ID NO: 4264419 - DNA, 14 bp, Homo sapiens
caggaccaggagcc

SEQ ID NO: 4264420 - DNA, 16 bp, Homo sapiens
caggaccaggagccag

SEQ ID NO: 4264421 - DNA, 18 bp, Homo sapiens
caggaccaggagccaggt

SEQ ID NO: 4264422 - DNA, 12 bp, Homo sapiens
caggaccccatc

SEQ ID NO: 4264423 - DNA, 13 bp, Homo sapiens
caggaccctgggt

SEQ ID NO: 4264424 - DNA, 15 bp, Homo sapiens
caggaccctgggtca

SEQ ID NO: 4264425 - DNA, 18 bp, Homo sapiens
caggaccctgggtcacct

SEQ ID NO: 4264426 - DNA, 19 bp, Homo sapiens
caggaccctgggtcacctt

SEQ ID NO: 4264427 - DNA, 22 bp, Homo sapiens
caggacctcagagtccaggccc

SEQ ID NO: 4264428 - DNA, 16 bp, Homo sapiens
caggacgcagggagac

SEQ ID NO: 4264429 - DNA, 17 bp, Homo sapiens
caggacgcagggagacc

SEQ ID NO: 4264430 - DNA, 18 bp, Homo sapiens
caggactctgccttccag

SEQ ID NO: 4264431 - DNA, 19 bp, Homo sapiens
caggactctgccttccagg

SEQ ID NO: 4264432 - DNA, 15 bp, Homo sapiens
caggagaaggcctgc

SEQ ID NO: 4264433 - DNA, 15 bp, Homo sapiens
caggagaccctgtct

SEQ ID NO: 4264434 - DNA, 19 bp, Homo sapiens
caggagagagttgaaccta

SEQ ID NO: 4264435 - DNA, 17 bp, Homo sapiens
caggagagcccccacca

SEQ ID NO: 4264436 - DNA, 12 bp, Homo sapiens
caggagccagca

SEQ ID NO: 4264437 - DNA, 14 bp, Homo sapiens
caggagccagcagg

SEQ ID NO: 4264438 - DNA, 15 bp, Homo sapiens
caggagccagcaggg

SEQ ID NO: 4264439 - DNA, 16 bp, Homo sapiens
caggagccaggtgtcc

SEQ ID NO: 4264440 - DNA, 15 bp, Homo sapiens
caggaggaactggtc

SEQ ID NO: 4264441 - DNA, 23 bp, Homo sapiens
caggaggacctggggggggcaag

SEQ ID NO: 4264442 - DNA, 17 bp, Homo sapiens
caggaggagacagtcag

SEQ ID NO: 4264443 - DNA, 22 bp, Homo sapiens
caggaggagacagtcaggaagc

SEQ ID NO: 4264444 - DNA, 13 bp, Homo sapiens
caggaggtgcctg

SEQ ID NO: 4264445 - DNA, 14 bp, Homo sapiens
caggaggtgcctga

SEQ ID NO: 4264446 - DNA, 16 bp, Homo sapiens
caggaggtgcctgaga

SEQ ID NO: 4264447 - DNA, 18 bp, Homo sapiens
caggagtgggctctgagc

SEQ ID NO: 4264448 - DNA, 17 bp, Homo sapiens
caggagtgggtgggaca

SEQ ID NO: 4264449 - DNA, 24 bp, Homo sapiens
caggagtgggtgggacacagagac

SEQ ID NO: 4264450 - DNA, 19 bp, Homo sapiens
caggatgaactagccatga

SEQ ID NO: 4264451 - DNA, 20 bp, Homo sapiens
caggatggcgtgtcccctgc

SEQ ID NO: 4264452 - DNA, 16 bp, Homo sapiens
caggatggtcccagcg

SEQ ID NO: 4264453 - DNA, 15 bp, Homo sapiens
caggcaatggcctaa

SEQ ID NO: 4264454 - DNA, 19 bp, Homo sapiens
caggcagcctgtgggtcct

SEQ ID NO: 4264455 - DNA, 20 bp, Homo sapiens
caggcagcctgtgggtcctt

SEQ ID NO: 4264456 - DNA, 22 bp, Homo sapiens
caggcagggagggaaacccggg

SEQ ID NO: 4264457 - DNA, 19 bp, Homo sapiens
caggcagtggcccagggaa

SEQ ID NO: 4264458 - DNA, 14 bp, Homo sapiens
caggcatgaccctg

SEQ ID NO: 4264459 - DNA, 18 bp, Homo sapiens
caggcatgaccctggagc

SEQ ID NO: 4264460 - DNA, 15 bp, Homo sapiens
caggcatgcctgtgt

SEQ ID NO: 4264461 - DNA, 16 bp, Homo sapiens
caggccacctgccccc

SEQ ID NO: 4264462 - DNA, 14 bp, Homo sapiens
ccacacctccaccc

SEQ ID NO: 4264463 - DNA, 23 bp, Homo sapiens
ccacactgctaggtgggccagcc

SEQ ID NO: 4264464 - DNA, 19 bp, Homo sapiens
ccacacttccacccccagc

SEQ ID NO: 4264465 - DNA, 21 bp, Homo sapiens
ccacacttccacccccagctc

SEQ ID NO: 4264466 - DNA, 20 bp, Homo sapiens
ccacacttcctgtccagaga

SEQ ID NO: 4264467 - DNA, 15 bp, Homo sapiens
ccacagaagacacgt

SEQ ID NO: 4264468 - DNA, 16 bp, Homo sapiens
ccacagaagacacgtg

SEQ ID NO: 4264469 - DNA, 18 bp, Homo sapiens
ccacagaagacacgtgtt

SEQ ID NO: 4264470 - DNA, 23 bp, Homo sapiens
ccacagataagcctgaaacagcc

SEQ ID NO: 4264471 - DNA, 13 bp, Homo sapiens
ccacagccctgtc

SEQ ID NO: 4264472 - DNA, 15 bp, Homo sapiens
ccacagccctgtcag

SEQ ID NO: 4264473 - DNA, 21 bp, Homo sapiens
ccacagccctgtcagtgcagc

SEQ ID NO: 4264474 - DNA, 18 bp, Homo sapiens
ccacaggagcatgtccta

SEQ ID NO: 4264475 - DNA, 18 bp, Homo sapiens
ccacaggagcgtgtccta

SEQ ID NO: 4264476 - DNA, 19 bp, Homo sapiens
ccacaggatgaactagcca

SEQ ID NO: 4264477 - DNA, 22 bp, Homo sapiens
ccacaggatgaactagccatga

SEQ ID NO: 4264478 - DNA, 17 bp, Homo sapiens
ccacaggcccttcctct

SEQ ID NO: 4264479 - DNA, 19 bp, Homo sapiens
ccacatagtgatggttccc

SEQ ID NO: 4264480 - DNA, 23 bp, Homo sapiens
ccacatgagtcccagtgggaggc

SEQ ID NO: 4264481 - DNA, 13 bp, Homo sapiens
ccacattctgctg

SEQ ID NO: 4264482 - DNA, 14 bp, Homo sapiens
ccacattctgctgc

SEQ ID NO: 4264483 - DNA, 15 bp, Homo sapiens
ccacattctggctcc

SEQ ID NO: 4264484 - DNA, 15 bp, Homo sapiens
ccacattgcccacac

SEQ ID NO: 4264485 - DNA, 23 bp, Homo sapiens
ccaccaagggtatctgctgcctc

SEQ ID NO: 4264486 - DNA, 19 bp, Homo sapiens
ccaccacacacacccttcc

SEQ ID NO: 4264487 - DNA, 11 bp, Homo sapiens
ccaccagcagc

SEQ ID NO: 4264488 - DNA, 14 bp, Homo sapiens
ccaccagcagcaca

SEQ ID NO: 4264489 - DNA, 19 bp, Homo sapiens
ccaccagctggctctgcag

SEQ ID NO: 4264490 - DNA, 20 bp, Homo sapiens
ccaccagctggctctgcagc

SEQ ID NO: 4264491 - DNA, 23 bp, Homo sapiens
ccaccagctggctctgcagcaca

SEQ ID NO: 4264492 - DNA, 23 bp, Homo sapiens
ccaccaggattaatctctaaaat

SEQ ID NO: 4264493 - DNA, 13 bp, Homo sapiens
ccacccctcaagc

SEQ ID NO: 4264494 - DNA, 13 bp, Homo sapiens
ccacccctcttcc

SEQ ID NO: 4264495 - DNA, 14 bp, Homo sapiens
ccacccctcttccc

SEQ ID NO: 4264496 - DNA, 17 bp, Homo sapiens
ccacccctcttccccct

SEQ ID NO: 4264497 - DNA, 21 bp, Homo sapiens
ccacccctcttcccccttccc

SEQ ID NO: 4264498 - DNA, 15 bp, Homo sapiens
ccaccccttccccac

SEQ ID NO: 4264499 - DNA, 16 bp, Homo sapiens
ccaccccttccccact

SEQ ID NO: 4264500 - DNA, 14 bp, Homo sapiens
ccaccctctgcagg

SEQ ID NO: 4264501 - DNA, 20 bp, Homo sapiens
ccaccctctgcagggcagcc

SEQ ID NO: 4264502 - DNA, 14 bp, Homo sapiens
ccaccctctggtcc

SEQ ID NO: 4264503 - DNA, 22 bp, Homo sapiens
ccacccttggcctgtccacctg

SEQ ID NO: 4264504 - DNA, 23 bp, Homo sapiens
ccaccctttggggggggcccgcc

SEQ ID NO: 4264505 - DNA, 17 bp, Homo sapiens
ccaccgctccccagccc

SEQ ID NO: 4264506 - DNA, 22 bp, Homo sapiens
ccacctgctgcccgtgaggagg

SEQ ID NO: 4264507 - DNA, 23 bp, Homo sapiens
ccacctgcttgtgttgggcccca

SEQ ID NO: 4264508 - DNA, 18 bp, Homo sapiens
ccacctgggagatgctgg

SEQ ID NO: 4264509 - DNA, 20 bp, Homo sapiens
ccacctgggagatgctggga

SEQ ID NO: 4264510 - DNA, 19 bp, Homo sapiens
ccacctgggccctaggcat

SEQ ID NO: 4264511 - DNA, 17 bp, Homo sapiens
ccacctgtgctgctgca

SEQ ID NO: 4264512 - DNA, 21 bp, Homo sapiens
ccacgcctctctcagcccagg

SEQ ID NO: 4264513 - DNA, 18 bp, Homo sapiens
ccacgcgctctgcatgct

SEQ ID NO: 4264514 - DNA, 22 bp, Homo sapiens
ccacgcgctctgcatgctcctc

SEQ ID NO: 4264515 - DNA, 18 bp, Homo sapiens
ccacgctgtctccagacc

SEQ ID NO: 4264516 - DNA, 21 bp, Homo sapiens
ccacgctgtctccagaccccc

SEQ ID NO: 4264517 - DNA, 20 bp, Homo sapiens
ccacggcagccaccctgcca

SEQ ID NO: 4264518 - DNA, 17 bp, Homo sapiens
ccacggccactgcagtc

SEQ ID NO: 4264519 - DNA, 23 bp, Homo sapiens
ccacgggggaggccgaggcaggg

SEQ ID NO: 4264520 - DNA, 14 bp, Homo sapiens
ccacgtgctggaga

SEQ ID NO: 4264521 - DNA, 21 bp, Homo sapiens
ccactaggccctggtctggct

SEQ ID NO: 4264522 - DNA, 11 bp, Homo sapiens
ccactcagcac

SEQ ID NO: 4264523 - DNA, 11 bp, Homo sapiens
ccactcagcat

SEQ ID NO: 4264524 - DNA, 22 bp, Homo sapiens
ccactccagacccctggctttt

SEQ ID NO: 4264525 - DNA, 15 bp, Homo sapiens
ccactccctgtctga

SEQ ID NO: 4264526 - DNA, 11 bp, Homo sapiens
ccactcctccc

SEQ ID NO: 4264527 - DNA, 18 bp, Homo sapiens
ccactcctcccaactctg

SEQ ID NO: 4264528 - DNA, 17 bp, Homo sapiens
ccactctcctgaggagc

SEQ ID NO: 4264529 - DNA, 22 bp, Homo sapiens
ccactctcctgaggagcagccc

SEQ ID NO: 4264530 - DNA, 12 bp, Homo sapiens
ccactctgctga

SEQ ID NO: 4264531 - DNA, 15 bp, Homo sapiens
ccactctgctgaggc

SEQ ID NO: 4264532 - DNA, 17 bp, Homo sapiens
ccactctgctgaggcca

SEQ ID NO: 4264533 - DNA, 21 bp, Homo sapiens
ccactctgctgaggccagagg

SEQ ID NO: 4264534 - DNA, 22 bp, Homo sapiens
ccactctgtttgctcacccagg

SEQ ID NO: 4264535 - DNA, 23 bp, Homo sapiens
ccactgaagtccccctttctcct

SEQ ID NO: 4264536 - DNA, 22 bp, Homo sapiens
ccactgagtctcattcctctgt

SEQ ID NO: 4264537 - DNA, 17 bp, Homo sapiens
ccactgcagtcacccct

SEQ ID NO: 4264538 - DNA, 22 bp, Homo sapiens
ccactgcagtcacccctgtctg

SEQ ID NO: 4264539 - DNA, 11 bp, Homo sapiens
ccactgcctgc

SEQ ID NO: 4264540 - DNA, 13 bp, Homo sapiens
ccactgcctgccc

SEQ ID NO: 4264541 - DNA, 15 bp, Homo sapiens
ccactgcctgcccac

SEQ ID NO: 4264542 - DNA, 17 bp, Homo sapiens
ccactgcctgcccaccc

SEQ ID NO: 4264543 - DNA, 21 bp, Homo sapiens
ccactgccttcgatacaccgg

SEQ ID NO: 4264544 - DNA, 15 bp, Homo sapiens
ccactggctcctcca

SEQ ID NO: 4264545 - DNA, 19 bp, Homo sapiens
ccacttagaaattgcattt

SEQ ID NO: 4264546 - DNA, 17 bp, Homo sapiens
ccacttatttccatgga

SEQ ID NO: 4264547 - DNA, 14 bp, Homo sapiens
ccacttatttctaa

SEQ ID NO: 4264548 - DNA, 21 bp, Homo sapiens
ccacttgctgcactcttgcac

SEQ ID NO: 4264549 - DNA, 15 bp, Homo sapiens
ccactttgcagacct

SEQ ID NO: 4264550 - DNA, 17 bp, Homo sapiens
ccactttgcagacctgg

SEQ ID NO: 4264551 - DNA, 22 bp, Homo sapiens
ccagaaactgaactggccgctg

SEQ ID NO: 4264552 - DNA, 19 bp, Homo sapiens
ccagaaatgccgctgtgtc

SEQ ID NO: 4264553 - DNA, 20 bp, Homo sapiens
ccagaaatgccgctgtgtcc

SEQ ID NO: 4264554 - DNA, 15 bp, Homo sapiens
ccagaagactggatc

SEQ ID NO: 4264555 - DNA, 21 bp, Homo sapiens
ccagaagtggcaggaggacag

SEQ ID NO: 4264556 - DNA, 18 bp, Homo sapiens
ccagacagagtggatctg

SEQ ID NO: 4264557 - DNA, 14 bp, Homo sapiens
ccagacagggtggg

SEQ ID NO: 4264558 - DNA, 17 bp, Homo sapiens
ccagacagggtggggct

SEQ ID NO: 4264559 - DNA, 13 bp, Homo sapiens
ccagacattgtat

SEQ ID NO: 4264560 - DNA, 19 bp, Homo sapiens
ccagaccccatccagccag

SEQ ID NO: 4264561 - DNA, 20 bp, Homo sapiens
ccagaccccatccagccagg

SEQ ID NO: 4264562 - DNA, 22 bp, Homo sapiens
ccagacccccagcaaccctcct

SEQ ID NO: 4264563 - DNA, 20 bp, Homo sapiens
ccagacccctaccctttccc

SEQ ID NO: 4264564 - DNA, 24 bp, Homo sapiens
ccagacccctggcttttcactgct

SEQ ID NO: 4264565 - DNA, 13 bp, Homo sapiens
ccagacctgggcc

SEQ ID NO: 4264566 - DNA, 22 bp, Homo sapiens
ccagacttcgctattcccaggc

SEQ ID NO: 4264567 - DNA, 23 bp, Homo sapiens
ccagagaaatgaaagtcagttta

SEQ ID NO: 4264568 - DNA, 15 bp, Homo sapiens
ccagagaagcctcag

SEQ ID NO: 4264569 - DNA, 22 bp, Homo sapiens
ccagagaagcctcagtccctcc

SEQ ID NO: 4264570 - DNA, 15 bp, Homo sapiens
ccagagactcagagg

SEQ ID NO: 4264571 - DNA, 22 bp, Homo sapiens
ccagagagagaagtgcccctgc

SEQ ID NO: 4264572 - DNA, 15 bp, Homo sapiens
ccagagagtggctcc

SEQ ID NO: 4264573 - DNA, 21 bp, Homo sapiens
ccagagccagggctgtcctta

SEQ ID NO: 4264574 - DNA, 13 bp, Homo sapiens
ccagagcctccct

SEQ ID NO: 4264575 - DNA, 15 bp, Homo sapiens
ccagagcctccctca

SEQ ID NO: 4264576 - DNA, 21 bp, Homo sapiens
ccagagcgcccctccctagtg

SEQ ID NO: 4264577 - DNA, 15 bp, Homo sapiens
ccagagctcccagga

SEQ ID NO: 4264578 - DNA, 18 bp, Homo sapiens
ccagagctcccaggacgc

SEQ ID NO: 4264579 - DNA, 17 bp, Homo sapiens
ccagaggaggtgcccgg

SEQ ID NO: 4264580 - DNA, 18 bp, Homo sapiens
ccagaggcctggtgccct

SEQ ID NO: 4264581 - DNA, 23 bp, Homo sapiens
ccagagggcccctcactggctgg

SEQ ID NO: 4264582 - DNA, 20 bp, Homo sapiens
ccagaggggcggggccagga

SEQ ID NO: 4264583 - DNA, 21 bp, Homo sapiens
ccagaggggcggggccaggat

SEQ ID NO: 4264584 - DNA, 17 bp, Homo sapiens
ccagaggtgagggaggc

SEQ ID NO: 4264585 - DNA, 19 bp, Homo sapiens
ccagaggtgagggaggcct

SEQ ID NO: 4264586 - DNA, 21 bp, Homo sapiens
ccagaggtgagggaggcctga

SEQ ID NO: 4264587 - DNA, 18 bp, Homo sapiens
ccagagtaggtgggtctt

SEQ ID NO: 4264588 - DNA, 15 bp, Homo sapiens
ccagatagcctaggg

SEQ ID NO: 4264589 - DNA, 23 bp, Homo sapiens
ccagatgacagggagctggggaa

SEQ ID NO: 4264590 - DNA, 22 bp, Homo sapiens
ccagatggctccctgggctggc

SEQ ID NO: 4264591 - DNA, 14 bp, Homo sapiens
cccagggagaggcc

SEQ ID NO: 4264592 - DNA, 17 bp, Homo sapiens
cccaggggcctttgcag

SEQ ID NO: 4264593 - DNA, 16 bp, Homo sapiens
cccaggggtgagcccc

SEQ ID NO: 4264594 - DNA, 20 bp, Homo sapiens
cccaggggtgagccccgccg

SEQ ID NO: 4264595 - DNA, 12 bp, Homo sapiens
cccagggtcctg

SEQ ID NO: 4264596 - DNA, 13 bp, Homo sapiens
cccagggtcctgg

SEQ ID NO: 4264597 - DNA, 22 bp, Homo sapiens
cccagggtggtcttcaagcctg

SEQ ID NO: 4264598 - DNA, 15 bp, Homo sapiens
cccagtaactcatct

SEQ ID NO: 4264599 - DNA, 15 bp, Homo sapiens
cccagtccccgggaa

SEQ ID NO: 4264600 - DNA, 16 bp, Homo sapiens
cccagtcttgagtggg

SEQ ID NO: 4264601 - DNA, 17 bp, Homo sapiens
cccagtcttgagtgggc

SEQ ID NO: 4264602 - DNA, 13 bp, Homo sapiens
cccagtggcctca

SEQ ID NO: 4264603 - DNA, 19 bp, Homo sapiens
cccagtggcctcaaccctc

SEQ ID NO: 4264604 - DNA, 21 bp, Homo sapiens
cccagtggcctcaaccctccc

SEQ ID NO: 4264605 - DNA, 12 bp, Homo sapiens
cccagtgggagg

SEQ ID NO: 4264606 - DNA, 15 bp, Homo sapiens
cccagtgggaggcgc

SEQ ID NO: 4264607 - DNA, 16 bp, Homo sapiens
cccagtgggaggcgcg

SEQ ID NO: 4264608 - DNA, 19 bp, Homo sapiens
cccagtgtatgtcttgtat

SEQ ID NO: 4264609 - DNA, 19 bp, Homo sapiens
cccagtgtccccaggggca

SEQ ID NO: 4264610 - DNA, 20 bp, Homo sapiens
cccagtgtccccaggggcac

SEQ ID NO: 4264611 - DNA, 15 bp, Homo sapiens
cccatccagccaggg

SEQ ID NO: 4264612 - DNA, 12 bp, Homo sapiens
cccatcctcccc

SEQ ID NO: 4264613 - DNA, 13 bp, Homo sapiens
cccatcctcccct

SEQ ID NO: 4264614 - DNA, 14 bp, Homo sapiens
cccatcctcccctt

SEQ ID NO: 4264615 - DNA, 15 bp, Homo sapiens
cccatcctccccttc

SEQ ID NO: 4264616 - DNA, 23 bp, Homo sapiens
cccatctccctcccatttgcaga

SEQ ID NO: 4264617 - DNA, 13 bp, Homo sapiens
cccatctgctgag

SEQ ID NO: 4264618 - DNA, 18 bp, Homo sapiens
cccatgcaggcagcctgc

SEQ ID NO: 4264619 - DNA, 16 bp, Homo sapiens
cccatgcatggcctcc

SEQ ID NO: 4264620 - DNA, 17 bp, Homo sapiens
cccatgccccactctgc

SEQ ID NO: 4264621 - DNA, 14 bp, Homo sapiens
cccatggtgcagtg

SEQ ID NO: 4264622 - DNA, 22 bp, Homo sapiens
cccatgtctttctccaaagtta

SEQ ID NO: 4264623 - DNA, 12 bp, Homo sapiens
cccatttgtaat

SEQ ID NO: 4264624 - DNA, 22 bp, Homo sapiens
ccccaaaaccacagccctgtca

SEQ ID NO: 4264625 - DNA, 13 bp, Homo sapiens
ccccaaccctgcc

SEQ ID NO: 4264626 - DNA, 16 bp, Homo sapiens
ccccaacgaaaagcac

SEQ ID NO: 4264627 - DNA, 13 bp, Homo sapiens
ccccaaggaagaa

SEQ ID NO: 4264628 - DNA, 20 bp, Homo sapiens
ccccacacaggcctggccca

SEQ ID NO: 4264629 - DNA, 17 bp, Homo sapiens
ccccaccccttccccac

SEQ ID NO: 4264630 - DNA, 20 bp, Homo sapiens
ccccaccttccctccacctg

SEQ ID NO: 4264631 - DNA, 12 bp, Homo sapiens
ccccactctgct

SEQ ID NO: 4264632 - DNA, 17 bp, Homo sapiens
ccccactgcctgcccac

SEQ ID NO: 4264633 - DNA, 20 bp, Homo sapiens
ccccacttatgctgctgtga

SEQ ID NO: 4264634 - DNA, 11 bp, Homo sapiens
ccccagagcca

SEQ ID NO: 4264635 - DNA, 14 bp, Homo sapiens
ccccagagccaggg

SEQ ID NO: 4264636 - DNA, 18 bp, Homo sapiens
ccccagagccagggctgt

SEQ ID NO: 4264637 - DNA, 12 bp, Homo sapiens
ccccagcaggtg

SEQ ID NO: 4264638 - DNA, 19 bp, Homo sapiens
ccccagcctaagatgaaga

SEQ ID NO: 4264639 - DNA, 15 bp, Homo sapiens
ccccagctccaggca

SEQ ID NO: 4264640 - DNA, 11 bp, Homo sapiens
ccccagctcct

SEQ ID NO: 4264641 - DNA, 14 bp, Homo sapiens
ccccagctgctcct

SEQ ID NO: 4264642 - DNA, 19 bp, Homo sapiens
ccccagctgctcctcgcag

SEQ ID NO: 4264643 - DNA, 13 bp, Homo sapiens
ccccagggccctg

SEQ ID NO: 4264644 - DNA, 17 bp, Homo sapiens
ccccagggccctgctca

SEQ ID NO: 4264645 - DNA, 24 bp, Homo sapiens
ccccagggccctgctcaggcctca

SEQ ID NO: 4264646 - DNA, 14 bp, Homo sapiens
ccccaggggcacac

SEQ ID NO: 4264647 - DNA, 20 bp, Homo sapiens
ccccaggggtgagccccgcc

SEQ ID NO: 4264648 - DNA, 19 bp, Homo sapiens
ccccatcgccttctgggga

SEQ ID NO: 4264649 - DNA, 13 bp, Homo sapiens
ccccatctgctga

SEQ ID NO: 4264650 - DNA, 14 bp, Homo sapiens
ccccatctgctgag

SEQ ID NO: 4264651 - DNA, 14 bp, Homo sapiens
ccccatgccctccc

SEQ ID NO: 4264652 - DNA, 20 bp, Homo sapiens
ccccattagtatcctgttag

SEQ ID NO: 4264653 - DNA, 17 bp, Homo sapiens
ccccattgccttctggg

SEQ ID NO: 4264654 - DNA, 12 bp, Homo sapiens
cccccacaggag

SEQ ID NO: 4264655 - DNA, 18 bp, Homo sapiens
cccccacattctggctcc

SEQ ID NO: 4264656 - DNA, 16 bp, Homo sapiens
cccccagagccagggc

SEQ ID NO: 4264657 - DNA, 17 bp, Homo sapiens
cccccagagccagggct

SEQ ID NO: 4264658 - DNA, 18 bp, Homo sapiens
cccccagagccagggctg

SEQ ID NO: 4264659 - DNA, 16 bp, Homo sapiens
cccccagcaaccctcc

SEQ ID NO: 4264660 - DNA, 19 bp, Homo sapiens
cccccatgccctccctgct

SEQ ID NO: 4264661 - DNA, 12 bp, Homo sapiens
ccccccagagcc

SEQ ID NO: 4264662 - DNA, 13 bp, Homo sapiens
ccccccagagcca

SEQ ID NO: 4264663 - DNA, 13 bp, Homo sapiens
ccccccatgccct

SEQ ID NO: 4264664 - DNA, 12 bp, Homo sapiens
ccccccttccca

SEQ ID NO: 4264665 - DNA, 13 bp, Homo sapiens
cccccgagctggg

SEQ ID NO: 4264666 - DNA, 21 bp, Homo sapiens
cccccgcacgcaagcctcagc

SEQ ID NO: 4264667 - DNA, 11 bp, Homo sapiens
cccccgccccg

SEQ ID NO: 4264668 - DNA, 12 bp, Homo sapiens
ccccctcctgac

SEQ ID NO: 4264669 - DNA, 14 bp, Homo sapiens
ccccctgccagagg

SEQ ID NO: 4264670 - DNA, 19 bp, Homo sapiens
ccccctgccagaggcctgg

SEQ ID NO: 4264671 - DNA, 15 bp, Homo sapiens
ccccctgccccagag

SEQ ID NO: 4264672 - DNA, 18 bp, Homo sapiens
ccccctggcccctcccac

SEQ ID NO: 4264673 - DNA, 21 bp, Homo sapiens
ccccctggggggcacagccag

SEQ ID NO: 4264674 - DNA, 13 bp, Homo sapiens
cccccttcccctg

SEQ ID NO: 4264675 - DNA, 13 bp, Homo sapiens
cccccttctccca

SEQ ID NO: 4264676 - DNA, 15 bp, Homo sapiens
cccccttctcccaca

SEQ ID NO: 4264677 - DNA, 12 bp, Homo sapiens
ccccgagctggg

SEQ ID NO: 4264678 - DNA, 22 bp, Homo sapiens
ccccgatccccgacagtggctc

SEQ ID NO: 4264679 - DNA, 16 bp, Homo sapiens
ccccgcacgcaagcct

SEQ ID NO: 4264680 - DNA, 20 bp, Homo sapiens
ccccgcacgcaagcctcagc

SEQ ID NO: 4264681 - DNA, 16 bp, Homo sapiens
ccccgccccacattcc

SEQ ID NO: 4264682 - DNA, 17 bp, Homo sapiens
ccccgccccccagagcc

SEQ ID NO: 4264683 - DNA, 14 bp, Homo sapiens
ccccgccctctgcc

SEQ ID NO: 4264684 - DNA, 19 bp, Homo sapiens
ccccggacaagcccaggac

SEQ ID NO: 4264685 - DNA, 17 bp, Homo sapiens
ccccggcctgatggcca

SEQ ID NO: 4264686 - DNA, 23 bp, Homo sapiens
ccccggggcatggacagggccag

SEQ ID NO: 4264687 - DNA, 13 bp, Homo sapiens
ccccgtgctcaca

SEQ ID NO: 4264688 - DNA, 18 bp, Homo sapiens
ccccgtgctcacagtagc

SEQ ID NO: 4264689 - DNA, 17 bp, Homo sapiens
ccccgtgggccatggca

SEQ ID NO: 4264690 - DNA, 17 bp, Homo sapiens
ccccgttgttgtccctg

SEQ ID NO: 4264691 - DNA, 22 bp, Homo sapiens
cccctaaagatggcgcacccgg

SEQ ID NO: 4264692 - DNA, 13 bp, Homo sapiens
cccctatcctgca

SEQ ID NO: 4264693 - DNA, 14 bp, Homo sapiens
cccctcaccttgca

SEQ ID NO: 4264694 - DNA, 12 bp, Homo sapiens
cccctccagacc

SEQ ID NO: 4264695 - DNA, 14 bp, Homo sapiens
cccctccagacccc

SEQ ID NO: 4264696 - DNA, 15 bp, Homo sapiens
cccctccagtgttgc

SEQ ID NO: 4264697 - DNA, 12 bp, Homo sapiens
cccctccccagt

SEQ ID NO: 4264698 - DNA, 17 bp, Homo sapiens
cccctccctggcctgtt

SEQ ID NO: 4264699 - DNA, 14 bp, Homo sapiens
cccctcgcttcata

SEQ ID NO: 4264700 - DNA, 20 bp, Homo sapiens
cccctctcttaccccgtccc

SEQ ID NO: 4264701 - DNA, 20 bp, Homo sapiens
cccctcttcccaccaactct

SEQ ID NO: 4264702 - DNA, 12 bp, Homo sapiens
cccctcttgccc

SEQ ID NO: 4264703 - DNA, 15 bp, Homo sapiens
cccctgcacacacct

SEQ ID NO: 4264704 - DNA, 19 bp, Homo sapiens
cccctgcacctgcttctca

SEQ ID NO: 4264705 - DNA, 15 bp, Homo sapiens
cccctgccccagaga

SEQ ID NO: 4264706 - DNA, 23 bp, Homo sapiens
cccctgccccagagaagcctcag

SEQ ID NO: 4264707 - DNA, 17 bp, Homo sapiens
cccctgcgccctccctc

SEQ ID NO: 4264708 - DNA, 19 bp, Homo sapiens
cccctgctccatgggcacc

SEQ ID NO: 4264709 - DNA, 17 bp, Homo sapiens
cccctgctggtgcccac

SEQ ID NO: 4264710 - DNA, 12 bp, Homo sapiens
cccctggcccct

SEQ ID NO: 4264711 - DNA, 20 bp, Homo sapiens
cccctggcttttcactgctg

SEQ ID NO: 4264712 - DNA, 15 bp, Homo sapiens
cccctggggggcaca

SEQ ID NO: 4264713 - DNA, 19 bp, Homo sapiens
cccctggggggcacagcca

SEQ ID NO: 4264714 - DNA, 15 bp, Homo sapiens
cccctggtcctgcac

SEQ ID NO: 4264715 - DNA, 17 bp, Homo sapiens
cccctggtcctgcactg

SEQ ID NO: 4264716 - DNA, 21 bp, Homo sapiens
cccctggtcctgcactgtccc

SEQ ID NO: 4264717 - DNA, 19 bp, Homo sapiens
cccctggtgcctgcaggcc

SEQ ID NO: 4264718 - DNA, 20 bp, Homo sapiens
cccctggtgtccctgcctgg

SEQ ID NO: 4264719 - DNA, 23 bp, Homo sapiens
cccctgtctgcgccgctgtgctg

SEQ ID NO: 4264720 - DNA, 17 bp, Homo sapiens
ccccttcacttctgacc

SEQ ID NO: 4264721 - DNA, 19 bp, Homo sapiens
ccccttcacttctgaccac

SEQ ID NO: 4264722 - DNA, 14 bp, Homo sapiens
ccccttcccacccc

SEQ ID NO: 4264723 - DNA, 19 bp, Homo sapiens
cctccagttctgatgaggc

SEQ ID NO: 4264724 - DNA, 19 bp, Homo sapiens
cctccatgattccaagggc

SEQ ID NO: 4264725 - DNA, 16 bp, Homo sapiens
cctcccaactctggcc

SEQ ID NO: 4264726 - DNA, 12 bp, Homo sapiens
cctcccaccaca

SEQ ID NO: 4264727 - DNA, 15 bp, Homo sapiens
cctcccaccacagca

SEQ ID NO: 4264728 - DNA, 12 bp, Homo sapiens
cctcccagccac

SEQ ID NO: 4264729 - DNA, 19 bp, Homo sapiens
cctcccatccagcgtctgc

SEQ ID NO: 4264730 - DNA, 15 bp, Homo sapiens
cctccccaaggaaga

SEQ ID NO: 4264731 - DNA, 12 bp, Homo sapiens
cctccccagcag

SEQ ID NO: 4264732 - DNA, 17 bp, Homo sapiens
cctccccagcaggtggg

SEQ ID NO: 4264733 - DNA, 22 bp, Homo sapiens
cctccccatggtgcagtgaaga

SEQ ID NO: 4264734 - DNA, 17 bp, Homo sapiens
cctcccctggtcctgca

SEQ ID NO: 4264735 - DNA, 18 bp, Homo sapiens
cctcccgcatgctgcctg

SEQ ID NO: 4264736 - DNA, 19 bp, Homo sapiens
cctcccgcatgctgcctgc

SEQ ID NO: 4264737 - DNA, 16 bp, Homo sapiens
cctcccggtgcccaag

SEQ ID NO: 4264738 - DNA, 15 bp, Homo sapiens
cctccctcagcccct

SEQ ID NO: 4264739 - DNA, 15 bp, Homo sapiens
cctccctccctgcag

SEQ ID NO: 4264740 - DNA, 13 bp, Homo sapiens
cctccctcctggc

SEQ ID NO: 4264741 - DNA, 12 bp, Homo sapiens
cctccctgcagg

SEQ ID NO: 4264742 - DNA, 13 bp, Homo sapiens
cctccctgcaggg

SEQ ID NO: 4264743 - DNA, 13 bp, Homo sapiens
cctccctgcccct

SEQ ID NO: 4264744 - DNA, 14 bp, Homo sapiens
cctccctgctccct

SEQ ID NO: 4264745 - DNA, 15 bp, Homo sapiens
cctccctgctccctg

SEQ ID NO: 4264746 - DNA, 21 bp, Homo sapiens
cctccctttttaaacaaatgg

SEQ ID NO: 4264747 - DNA, 17 bp, Homo sapiens
cctccggccctgcccca

SEQ ID NO: 4264748 - DNA, 16 bp, Homo sapiens
cctccgtcctggcagg

SEQ ID NO: 4264749 - DNA, 13 bp, Homo sapiens
cctcctccctccg

SEQ ID NO: 4264750 - DNA, 12 bp, Homo sapiens
cctcctggaccc

SEQ ID NO: 4264751 - DNA, 19 bp, Homo sapiens
cctcctggctcacagccac

SEQ ID NO: 4264752 - DNA, 12 bp, Homo sapiens
cctccttccagg

SEQ ID NO: 4264753 - DNA, 14 bp, Homo sapiens
cctccttgccgctg

SEQ ID NO: 4264754 - DNA, 21 bp, Homo sapiens
cctccttgccgctgggagagc

SEQ ID NO: 4264755 - DNA, 19 bp, Homo sapiens
cctccttgcctcctgtgta

SEQ ID NO: 4264756 - DNA, 17 bp, Homo sapiens
cctcgaagctgttctct

SEQ ID NO: 4264757 - DNA, 20 bp, Homo sapiens
cctcgaagctgttctctgct

SEQ ID NO: 4264758 - DNA, 21 bp, Homo sapiens
cctcgaagctgttctctgctt

SEQ ID NO: 4264759 - DNA, 13 bp, Homo sapiens
cctcgcccctcca

SEQ ID NO: 4264760 - DNA, 17 bp, Homo sapiens
cctcggccagagctccc

SEQ ID NO: 4264761 - DNA, 19 bp, Homo sapiens
cctcggccagagctcccag

SEQ ID NO: 4264762 - DNA, 14 bp, Homo sapiens
cctcggctgtgtgg

SEQ ID NO: 4264763 - DNA, 15 bp, Homo sapiens
cctcggctgtgtggg

SEQ ID NO: 4264764 - DNA, 19 bp, Homo sapiens
cctcggctgtgtggggagg

SEQ ID NO: 4264765 - DNA, 16 bp, Homo sapiens
cctcggggcaggaagt

SEQ ID NO: 4264766 - DNA, 19 bp, Homo sapiens
cctcggggcaggaagtccc

SEQ ID NO: 4264767 - DNA, 22 bp, Homo sapiens
cctcggggcaggaagtccctga

SEQ ID NO: 4264768 - DNA, 15 bp, Homo sapiens
cctctcactctggca

SEQ ID NO: 4264769 - DNA, 23 bp, Homo sapiens
cctctcactctggcagcctcaga

SEQ ID NO: 4264770 - DNA, 22 bp, Homo sapiens
cctctccccggacaagcccagg

SEQ ID NO: 4264771 - DNA, 15 bp, Homo sapiens
cctctcctgcatccc

SEQ ID NO: 4264772 - DNA, 19 bp, Homo sapiens
cctctcgggctctctcacc

SEQ ID NO: 4264773 - DNA, 13 bp, Homo sapiens
cctctctgtccaa

SEQ ID NO: 4264774 - DNA, 13 bp, Homo sapiens
cctctctgtttac

SEQ ID NO: 4264775 - DNA, 18 bp, Homo sapiens
cctctctgtttaccctcc

SEQ ID NO: 4264776 - DNA, 17 bp, Homo sapiens
cctctcttaccccgtcc

SEQ ID NO: 4264777 - DNA, 11 bp, Homo sapiens
cctctgaaaat

SEQ ID NO: 4264778 - DNA, 17 bp, Homo sapiens
cctctgaaaatattttt

SEQ ID NO: 4264779 - DNA, 17 bp, Homo sapiens
cctctgaactgctgctg

SEQ ID NO: 4264780 - DNA, 13 bp, Homo sapiens
cctctgcacgtgc

SEQ ID NO: 4264781 - DNA, 19 bp, Homo sapiens
cctctgcacgtgcacacac

SEQ ID NO: 4264782 - DNA, 14 bp, Homo sapiens
cctctgcagggcag

SEQ ID NO: 4264783 - DNA, 15 bp, Homo sapiens
cctctgcagggcagc

SEQ ID NO: 4264784 - DNA, 17 bp, Homo sapiens
cctctgcagggcagcct

SEQ ID NO: 4264785 - DNA, 18 bp, Homo sapiens
cctctgcagggcagcctg

SEQ ID NO: 4264786 - DNA, 15 bp, Homo sapiens
cctctgcctgtccct

SEQ ID NO: 4264787 - DNA, 13 bp, Homo sapiens
cctctgcctgtgc

SEQ ID NO: 4264788 - DNA, 12 bp, Homo sapiens
cctctgccttgg

SEQ ID NO: 4264789 - DNA, 15 bp, Homo sapiens
cctctgccttggaca

SEQ ID NO: 4264790 - DNA, 19 bp, Homo sapiens
cctctgctatgtctgtgat

SEQ ID NO: 4264791 - DNA, 20 bp, Homo sapiens
cctctgctatgtctgtgatg

SEQ ID NO: 4264792 - DNA, 14 bp, Homo sapiens
cctctggcctggga

SEQ ID NO: 4264793 - DNA, 11 bp, Homo sapiens
cctctggggag

SEQ ID NO: 4264794 - DNA, 22 bp, Homo sapiens
cctctgggggttgttgggagga

SEQ ID NO: 4264795 - DNA, 12 bp, Homo sapiens
cctctggtcctt

SEQ ID NO: 4264796 - DNA, 14 bp, Homo sapiens
cctctgtccccgag

SEQ ID NO: 4264797 - DNA, 22 bp, Homo sapiens
cctctgtccccgagccgagctc

SEQ ID NO: 4264798 - DNA, 22 bp, Homo sapiens
cctcttcctccctccctgcagg

SEQ ID NO: 4264799 - DNA, 16 bp, Homo sapiens
cctcttgccccccacc

SEQ ID NO: 4264800 - DNA, 21 bp, Homo sapiens
cctgaaaagatgttgtgtctt

SEQ ID NO: 4264801 - DNA, 17 bp, Homo sapiens
cctgaaatgtttccagg

SEQ ID NO: 4264802 - DNA, 19 bp, Homo sapiens
cctgaactaggtgctggca

SEQ ID NO: 4264803 - DNA, 21 bp, Homo sapiens
cctgaactaggtgctggcatg

SEQ ID NO: 4264804 - DNA, 20 bp, Homo sapiens
cctgaagagcgctcctctgc

SEQ ID NO: 4264805 - DNA, 16 bp, Homo sapiens
cctgaagtgaccccag

SEQ ID NO: 4264806 - DNA, 21 bp, Homo sapiens
cctgaagtgaccccagctcca

SEQ ID NO: 4264807 - DNA, 15 bp, Homo sapiens
cctgaattattccaa

SEQ ID NO: 4264808 - DNA, 17 bp, Homo sapiens
cctgagaatgcctaggc

SEQ ID NO: 4264809 - DNA, 16 bp, Homo sapiens
cctgagcttggccaga

SEQ ID NO: 4264810 - DNA, 14 bp, Homo sapiens
cctgaggctggggc

SEQ ID NO: 4264811 - DNA, 12 bp, Homo sapiens
cctgaggggcag

SEQ ID NO: 4264812 - DNA, 16 bp, Homo sapiens
cctgaggttaagggga

SEQ ID NO: 4264813 - DNA, 15 bp, Homo sapiens
cctgatttattctgg

SEQ ID NO: 4264814 - DNA, 13 bp, Homo sapiens
cctgcacacacct

SEQ ID NO: 4264815 - DNA, 19 bp, Homo sapiens
cctgcacacacctgcacac

SEQ ID NO: 4264816 - DNA, 17 bp, Homo sapiens
cctgcacacccctgcac

SEQ ID NO: 4264817 - DNA, 23 bp, Homo sapiens
cctgcacaccgtccctctccccg

SEQ ID NO: 4264818 - DNA, 12 bp, Homo sapiens
cctgcaccctct

SEQ ID NO: 4264819 - DNA, 14 bp, Homo sapiens
cctgcaccctctgc

SEQ ID NO: 4264820 - DNA, 17 bp, Homo sapiens
cctgcacctgcttctca

SEQ ID NO: 4264821 - DNA, 20 bp, Homo sapiens
cctgcactgtcccggagctc

SEQ ID NO: 4264822 - DNA, 13 bp, Homo sapiens
cctgcatccctcc

SEQ ID NO: 4264823 - DNA, 15 bp, Homo sapiens
cctgcatccctccac

SEQ ID NO: 4264824 - DNA, 16 bp, Homo sapiens
cctgcatccctccacc

SEQ ID NO: 4264825 - DNA, 19 bp, Homo sapiens
cctgcatccctccacccca

SEQ ID NO: 4264826 - DNA, 22 bp, Homo sapiens
cctgcatcccttggcccctctc

SEQ ID NO: 4264827 - DNA, 23 bp, Homo sapiens
cctgcatcccttggcccctctct

SEQ ID NO: 4264828 - DNA, 15 bp, Homo sapiens
cctgccaactttcca

SEQ ID NO: 4264829 - DNA, 12 bp, Homo sapiens
cctgccactctc

SEQ ID NO: 4264830 - DNA, 21 bp, Homo sapiens
cctgccactctcctgaggagc

SEQ ID NO: 4264831 - DNA, 22 bp, Homo sapiens
cctgccactctcctgaggagca

SEQ ID NO: 4264832 - DNA, 14 bp, Homo sapiens
cctgccagaggcct

SEQ ID NO: 4264833 - DNA, 12 bp, Homo sapiens
cctgcccacccg

SEQ ID NO: 4264834 - DNA, 22 bp, Homo sapiens
cctgccccagagaagcctcagt

SEQ ID NO: 4264835 - DNA, 18 bp, Homo sapiens
cctgccccccacattctg

SEQ ID NO: 4264836 - DNA, 14 bp, Homo sapiens
cctgccccgccccc

SEQ ID NO: 4264837 - DNA, 16 bp, Homo sapiens
cctgccccggccactc

SEQ ID NO: 4264838 - DNA, 22 bp, Homo sapiens
cctgccccgtcaccatctcagg

SEQ ID NO: 4264839 - DNA, 14 bp, Homo sapiens
cctgcccctccctt

SEQ ID NO: 4264840 - DNA, 20 bp, Homo sapiens
cctgccctagcagtttgcct

SEQ ID NO: 4264841 - DNA, 23 bp, Homo sapiens
cctgccctagcagtttgcctctg

SEQ ID NO: 4264842 - DNA, 12 bp, Homo sapiens
cctgccctcact

SEQ ID NO: 4264843 - DNA, 17 bp, Homo sapiens
cctgcccttcagcatcc

SEQ ID NO: 4264844 - DNA, 15 bp, Homo sapiens
cctgcctccggccct

SEQ ID NO: 4264845 - DNA, 21 bp, Homo sapiens
cctgcctccggccctgcccca

SEQ ID NO: 4264846 - DNA, 21 bp, Homo sapiens
cctgcctctgaactgctgctg

SEQ ID NO: 4264847 - DNA, 23 bp, Homo sapiens
cctgcctctgaactgctgctggt

SEQ ID NO: 4264848 - DNA, 20 bp, Homo sapiens
cctgcgatggtgctgcaccc

SEQ ID NO: 4264849 - DNA, 21 bp, Homo sapiens
cctgcgccctccctccctcca

SEQ ID NO: 4264850 - DNA, 19 bp, Homo sapiens
cctgcgtggcctggggctg

SEQ ID NO: 4264851 - DNA, 19 bp, Homo sapiens
cctgctacagtagctgtgg

SEQ ID NO: 4264852 - DNA, 13 bp, Homo sapiens
cctgctatccagc

SEQ ID NO: 4264853 - DNA, 14 bp, Homo sapiens
cctgctatccagcc

SEQ ID NO: 4264854 - DNA, 23 bp, Homo sapiens
cgttcccccaggggtgagccccg

SEQ ID NO: 4264855 - DNA, 16 bp, Homo sapiens
cgttgcctctctgcca

SEQ ID NO: 4264856 - DNA, 17 bp, Homo sapiens
cgttgcctctctgccag

SEQ ID NO: 4264857 - DNA, 21 bp, Homo sapiens
cgttgtgtgggtttactctgt

SEQ ID NO: 4264858 - DNA, 16 bp, Homo sapiens
cgttttgcctcatgaa

SEQ ID NO: 4264859 - DNA, 17 bp, Homo sapiens
cgttttgcctcatgaac

SEQ ID NO: 4264860 - DNA, 20 bp, Homo sapiens
ctaaaaaagctgaatcagac

SEQ ID NO: 4264861 - DNA, 13 bp, Homo sapiens
ctaaaaaataact

SEQ ID NO: 4264862 - DNA, 18 bp, Homo sapiens
ctaaaaaataactgtgca

SEQ ID NO: 4264863 - DNA, 18 bp, Homo sapiens
ctaaaacattaattgagg

SEQ ID NO: 4264864 - DNA, 18 bp, Homo sapiens
ctaaaaggaggacaggga

SEQ ID NO: 4264865 - DNA, 18 bp, Homo sapiens
ctaaaattcaacaaatga

SEQ ID NO: 4264866 - DNA, 12 bp, Homo sapiens
ctaaaattctag

SEQ ID NO: 4264867 - DNA, 14 bp, Homo sapiens
ctaaaattctagtc

SEQ ID NO: 4264868 - DNA, 17 bp, Homo sapiens
ctaaacattttgttatt

SEQ ID NO: 4264869 - DNA, 14 bp, Homo sapiens
ctaaactctgaaat

SEQ ID NO: 4264870 - DNA, 20 bp, Homo sapiens
ctaaacttggtgcttattga

SEQ ID NO: 4264871 - DNA, 15 bp, Homo sapiens
ctaaaggggacagat

SEQ ID NO: 4264872 - DNA, 19 bp, Homo sapiens
ctaaagggtgtgggtcagg

SEQ ID NO: 4264873 - DNA, 19 bp, Homo sapiens
ctaaagttagggcattttt

SEQ ID NO: 4264874 - DNA, 23 bp, Homo sapiens
ctaaatccattttctaaactgtt

SEQ ID NO: 4264875 - DNA, 23 bp, Homo sapiens
ctaaatcctcactatttttttgt

SEQ ID NO: 4264876 - DNA, 19 bp, Homo sapiens
ctaaatgcctaataaacaa

SEQ ID NO: 4264877 - DNA, 22 bp, Homo sapiens
ctaaatgtggacatcatgaagc

SEQ ID NO: 4264878 - DNA, 12 bp, Homo sapiens
ctaaatgttcat

SEQ ID NO: 4264879 - DNA, 13 bp, Homo sapiens
ctaaatgtttctt

SEQ ID NO: 4264880 - DNA, 14 bp, Homo sapiens
ctaaatgtttcttt

SEQ ID NO: 4264881 - DNA, 12 bp, Homo sapiens
ctaacacatttc

SEQ ID NO: 4264882 - DNA, 13 bp, Homo sapiens
ctaacactggccc

SEQ ID NO: 4264883 - DNA, 12 bp, Homo sapiens
ctaacactggct

SEQ ID NO: 4264884 - DNA, 13 bp, Homo sapiens
ctaacctctctga

SEQ ID NO: 4264885 - DNA, 14 bp, Homo sapiens
ctaacttggagccg

SEQ ID NO: 4264886 - DNA, 22 bp, Homo sapiens
ctaagaaatatctgtgaaatat

SEQ ID NO: 4264887 - DNA, 21 bp, Homo sapiens
ctaagaataaataaagaagaa

SEQ ID NO: 4264888 - DNA, 13 bp, Homo sapiens
ctaagaataatga

SEQ ID NO: 4264889 - DNA, 12 bp, Homo sapiens
ctaagattgtac

SEQ ID NO: 4264890 - DNA, 13 bp, Homo sapiens
ctaagcctggaca

SEQ ID NO: 4264891 - DNA, 13 bp, Homo sapiens
ctaagcttatttc

SEQ ID NO: 4264892 - DNA, 22 bp, Homo sapiens
ctaagtcagtttcacatatttg

SEQ ID NO: 4264893 - DNA, 14 bp, Homo sapiens
ctaagtccagctct

SEQ ID NO: 4264894 - DNA, 14 bp, Homo sapiens
ctaagtgactacca

SEQ ID NO: 4264895 - DNA, 19 bp, Homo sapiens
ctaatcagcattctcactc

SEQ ID NO: 4264896 - DNA, 15 bp, Homo sapiens
ctaattaaaaagtta

SEQ ID NO: 4264897 - DNA, 13 bp, Homo sapiens
ctaattaatttca

SEQ ID NO: 4264898 - DNA, 14 bp, Homo sapiens
ctacaaatcagtaa

SEQ ID NO: 4264899 - DNA, 15 bp, Homo sapiens
ctacaaatcagtaat

SEQ ID NO: 4264900 - DNA, 23 bp, Homo sapiens
ctacaatatcattttcctgggag

SEQ ID NO: 4264901 - DNA, 22 bp, Homo sapiens
ctacagccaaattgcagaagaa

SEQ ID NO: 4264902 - DNA, 21 bp, Homo sapiens
ctacagctaatcagcattctc

SEQ ID NO: 4264903 - DNA, 16 bp, Homo sapiens
ctacagtagctgtggg

SEQ ID NO: 4264904 - DNA, 18 bp, Homo sapiens
ctacagtagctgtgggga

SEQ ID NO: 4264905 - DNA, 22 bp, Homo sapiens
ctacagtagctgtggggagctg

SEQ ID NO: 4264906 - DNA, 16 bp, Homo sapiens
ctacagtggagggaga

SEQ ID NO: 4264907 - DNA, 14 bp, Homo sapiens
ctaccaaaatgaag

SEQ ID NO: 4264908 - DNA, 19 bp, Homo sapiens
ctaccacttatttctaaat

SEQ ID NO: 4264909 - DNA, 20 bp, Homo sapiens
ctaccccagaacgcatgcag

SEQ ID NO: 4264910 - DNA, 20 bp, Homo sapiens
ctaccccaggatgcatgcag

SEQ ID NO: 4264911 - DNA, 15 bp, Homo sapiens
ctaccctttcccaaa

SEQ ID NO: 4264912 - DNA, 17 bp, Homo sapiens
ctaccgagtctcttctc

SEQ ID NO: 4264913 - DNA, 19 bp, Homo sapiens
ctaccgagtctcttctcca

SEQ ID NO: 4264914 - DNA, 18 bp, Homo sapiens
ctacctgaaaattcaaca

SEQ ID NO: 4264915 - DNA, 19 bp, Homo sapiens
ctacctggttttcattatt

SEQ ID NO: 4264916 - DNA, 23 bp, Homo sapiens
ctacctggttttcattattttcc

SEQ ID NO: 4264917 - DNA, 20 bp, Homo sapiens
ctacgatgggatcattattt

SEQ ID NO: 4264918 - DNA, 11 bp, Homo sapiens
ctactcagcat

SEQ ID NO: 4264919 - DNA, 13 bp, Homo sapiens
ctactttcctgat

SEQ ID NO: 4264920 - DNA, 19 bp, Homo sapiens
ctagaagagtctattgtct

SEQ ID NO: 4264921 - DNA, 20 bp, Homo sapiens
ctagaagagtctattgtctc

SEQ ID NO: 4264922 - DNA, 23 bp, Homo sapiens
ctagaatggaagcctccacctgc

SEQ ID NO: 4264923 - DNA, 17 bp, Homo sapiens
ctagaatgtttcatttg

SEQ ID NO: 4264924 - DNA, 13 bp, Homo sapiens
ctagactgggctg

SEQ ID NO: 4264925 - DNA, 15 bp, Homo sapiens
ctagactgggctggc

SEQ ID NO: 4264926 - DNA, 18 bp, Homo sapiens
ctagactgggctggctgc

SEQ ID NO: 4264927 - DNA, 17 bp, Homo sapiens
ctagaggaggaaaaagg

SEQ ID NO: 4264928 - DNA, 20 bp, Homo sapiens
ctagaggaggaaaaaggctg

SEQ ID NO: 4264929 - DNA, 18 bp, Homo sapiens
ctagaggcttccttcatt

SEQ ID NO: 4264930 - DNA, 19 bp, Homo sapiens
ctagaggcttccttcattt

SEQ ID NO: 4264931 - DNA, 14 bp, Homo sapiens
ctagatctcctgta

SEQ ID NO: 4264932 - DNA, 13 bp, Homo sapiens
ctagattaccatg

SEQ ID NO: 4264933 - DNA, 14 bp, Homo sapiens
ctagcaactgttgg

SEQ ID NO: 4264934 - DNA, 16 bp, Homo sapiens
ctagcagtttgcctct

SEQ ID NO: 4264935 - DNA, 13 bp, Homo sapiens
ctagccaggcctc

SEQ ID NO: 4264936 - DNA, 13 bp, Homo sapiens
ctagccatatatt

SEQ ID NO: 4264937 - DNA, 21 bp, Homo sapiens
ctagctataacaactctattt

SEQ ID NO: 4264938 - DNA, 22 bp, Homo sapiens
ctagctataacaactctatttt

SEQ ID NO: 4264939 - DNA, 19 bp, Homo sapiens
ctagctatgctgtatctgt

SEQ ID NO: 4264940 - DNA, 23 bp, Homo sapiens
ctaggaggagaacttgaacaaag

SEQ ID NO: 4264941 - DNA, 16 bp, Homo sapiens
ctaggcatactctcca

SEQ ID NO: 4264942 - DNA, 22 bp, Homo sapiens
ctaggcatactctccaggattg

SEQ ID NO: 4264943 - DNA, 18 bp, Homo sapiens
ctaggccctggtctggct

SEQ ID NO: 4264944 - DNA, 18 bp, Homo sapiens
ctagggtcccccttcgtg

SEQ ID NO: 4264945 - DNA, 13 bp, Homo sapiens
ctagggtcctcag

SEQ ID NO: 4264946 - DNA, 19 bp, Homo sapiens
ctaggtctccacccctcaa

SEQ ID NO: 4264947 - DNA, 15 bp, Homo sapiens
ctaggtgcccagtct

SEQ ID NO: 4264948 - DNA, 19 bp, Homo sapiens
ctaggtgggccagcccctc

SEQ ID NO: 4264949 - DNA, 21 bp, Homo sapiens
ctaggtgggtcaactccaagg

SEQ ID NO: 4264950 - DNA, 23 bp, Homo sapiens
ctaggtgggtcaactccaaggca

SEQ ID NO: 4264951 - DNA, 15 bp, Homo sapiens
ctagtcaactgctgt

SEQ ID NO: 4264952 - DNA, 13 bp, Homo sapiens
ctagtcataacct

SEQ ID NO: 4264953 - DNA, 13 bp, Homo sapiens
ctagtctctgatt

SEQ ID NO: 4264954 - DNA, 14 bp, Homo sapiens
ctagtctctgattt

SEQ ID NO: 4264955 - DNA, 18 bp, Homo sapiens
ctagtctctgatttgcaa

SEQ ID NO: 4264956 - DNA, 17 bp, Homo sapiens
ctagttagcaggaaata

SEQ ID NO: 4264957 - DNA, 12 bp, Homo sapiens
ctagtttgcata

SEQ ID NO: 4264958 - DNA, 12 bp, Homo sapiens
ctataaacatta

SEQ ID NO: 4264959 - DNA, 18 bp, Homo sapiens
ctataacaactctatttt

SEQ ID NO: 4264960 - DNA, 11 bp, Homo sapiens
ctataatgtga

SEQ ID NO: 4264961 - DNA, 22 bp, Homo sapiens
ctataatgtgaaatgtaactgt

SEQ ID NO: 4264962 - DNA, 16 bp, Homo sapiens
ctatactgtttgtaat

SEQ ID NO: 4264963 - DNA, 17 bp, Homo sapiens
ctatagcaaagtagtac

SEQ ID NO: 4264964 - DNA, 22 bp, Homo sapiens
ctatagctgttctaatggatta

SEQ ID NO: 4264965 - DNA, 16 bp, Homo sapiens
ctatagttactgtcct

SEQ ID NO: 4264966 - DNA, 15 bp, Homo sapiens
ctatatatacatgta

SEQ ID NO: 4264967 - DNA, 22 bp, Homo sapiens
ctatattccaggtttaagtaga

SEQ ID NO: 4264968 - DNA, 13 bp, Homo sapiens
ctatatttcatat

SEQ ID NO: 4264969 - DNA, 14 bp, Homo sapiens
ctatatttcatatt

SEQ ID NO: 4264970 - DNA, 14 bp, Homo sapiens
ctatcacctcccct

SEQ ID NO: 4264971 - DNA, 16 bp, Homo sapiens
ctatcacctcccctcc

SEQ ID NO: 4264972 - DNA, 19 bp, Homo sapiens
ctatcagagaagcagcatc

SEQ ID NO: 4264973 - DNA, 17 bp, Homo sapiens
ctatccagccgcaaatc

SEQ ID NO: 4264974 - DNA, 19 bp, Homo sapiens
ctatccagccgcaaatcca

SEQ ID NO: 4264975 - DNA, 20 bp, Homo sapiens
ctatccccggacgcatgcag

SEQ ID NO: 4264976 - DNA, 20 bp, Homo sapiens
ctatccctggacgcatgcag

SEQ ID NO: 4264977 - DNA, 22 bp, Homo sapiens
ctatccctggacgcatgcaggg

SEQ ID NO: 4264978 - DNA, 15 bp, Homo sapiens
ctatcctgcaccctc

SEQ ID NO: 4264979 - DNA, 17 bp, Homo sapiens
ctatcctgcaccctctg

SEQ ID NO: 4264980 - DNA, 20 bp, Homo sapiens
ctatctgcaaatagtttcaa

SEQ ID NO: 4264981 - DNA, 16 bp, Homo sapiens
ctatctggtattaaat

SEQ ID NO: 4264982 - DNA, 20 bp, Homo sapiens
ctatctggtattaaatgcca

SEQ ID NO: 4264983 - DNA, 16 bp, Homo sapiens
ctatcttcatgtaaat

SEQ ID NO: 4264984 - DNA, 13 bp, Homo sapiens
ctatgaaggctgt

SEQ ID NO: 4264985 - DNA, 19 bp, Homo sapiens
ctgcctccggccctgcccc

SEQ ID NO: 4264986 - DNA, 20 bp, Homo sapiens
ctgcctccggccctgcccca

SEQ ID NO: 4264987 - DNA, 13 bp, Homo sapiens
ctgcctctgaaaa

SEQ ID NO: 4264988 - DNA, 15 bp, Homo sapiens
ctgcctctgaactgc

SEQ ID NO: 4264989 - DNA, 14 bp, Homo sapiens
ctgcctgcccaccc

SEQ ID NO: 4264990 - DNA, 15 bp, Homo sapiens
ctgcctgcccacccg

SEQ ID NO: 4264991 - DNA, 16 bp, Homo sapiens
ctgcctgcccacccgt

SEQ ID NO: 4264992 - DNA, 17 bp, Homo sapiens
ctgcctgcctccggccc

SEQ ID NO: 4264993 - DNA, 21 bp, Homo sapiens
ctgcctgcctccggccctgcc

SEQ ID NO: 4264994 - DNA, 20 bp, Homo sapiens
ctgcctggccctcctctggt

SEQ ID NO: 4264995 - DNA, 16 bp, Homo sapiens
ctgcctgtgagtgaca

SEQ ID NO: 4264996 - DNA, 15 bp, Homo sapiens
ctgcctgtgcccgct

SEQ ID NO: 4264997 - DNA, 22 bp, Homo sapiens
ctgcctgtggtgaggtcctgtc

SEQ ID NO: 4264998 - DNA, 22 bp, Homo sapiens
ctgccttccaggcgtagggcca

SEQ ID NO: 4264999 - DNA, 19 bp, Homo sapiens
ctgccttctcccctccaag

SEQ ID NO: 4265000 - DNA, 17 bp, Homo sapiens
ctgccttctgtctcttg

SEQ ID NO: 4265001 - DNA, 17 bp, Homo sapiens
ctgcctttgctgccttc

SEQ ID NO: 4265002 - DNA, 19 bp, Homo sapiens
ctgcctttgctgccttctg

SEQ ID NO: 4265003 - DNA, 17 bp, Homo sapiens
ctgccttttagttcctg

SEQ ID NO: 4265004 - DNA, 19 bp, Homo sapiens
ctgccttttagttcctgtg

SEQ ID NO: 4265005 - DNA, 23 bp, Homo sapiens
ctgccttttagttcctgtgcaca

SEQ ID NO: 4265006 - DNA, 17 bp, Homo sapiens
ctgcgatggtgctgcac

SEQ ID NO: 4265007 - DNA, 14 bp, Homo sapiens
ctgcgcaggccctc

SEQ ID NO: 4265008 - DNA, 20 bp, Homo sapiens
ctgcgccctccctccctcca

SEQ ID NO: 4265009 - DNA, 23 bp, Homo sapiens
ctgcgccctccctccctccacac

SEQ ID NO: 4265010 - DNA, 16 bp, Homo sapiens
ctgcgctgccctgcaa

SEQ ID NO: 4265011 - DNA, 16 bp, Homo sapiens
ctgcgctgtgctggtc

SEQ ID NO: 4265012 - DNA, 17 bp, Homo sapiens
ctgcggagcttctccag

SEQ ID NO: 4265013 - DNA, 16 bp, Homo sapiens
ctgcgtggcctggggc

SEQ ID NO: 4265014 - DNA, 21 bp, Homo sapiens
ctgcgtggcctggggctgccg

SEQ ID NO: 4265015 - DNA, 19 bp, Homo sapiens
ctgctacctggttttcatt

SEQ ID NO: 4265016 - DNA, 22 bp, Homo sapiens
ctgctaggtgggccagcccctc

SEQ ID NO: 4265017 - DNA, 14 bp, Homo sapiens
ctgctatgtctgtg

SEQ ID NO: 4265018 - DNA, 14 bp, Homo sapiens
ctgctcagatgctg

SEQ ID NO: 4265019 - DNA, 13 bp, Homo sapiens
ctgctcaggcctc

SEQ ID NO: 4265020 - DNA, 16 bp, Homo sapiens
ctgctcaggcctcacc

SEQ ID NO: 4265021 - DNA, 18 bp, Homo sapiens
ctgctcaggcctcacctg

SEQ ID NO: 4265022 - DNA, 24 bp, Homo sapiens
ctgctcaggcctcacctggcttcc

SEQ ID NO: 4265023 - DNA, 14 bp, Homo sapiens
ctgctccatgcaga

SEQ ID NO: 4265024 - DNA, 23 bp, Homo sapiens
ctgctccatgcagatctagccag

SEQ ID NO: 4265025 - DNA, 20 bp, Homo sapiens
ctgctcctcggccagagctc

SEQ ID NO: 4265026 - DNA, 22 bp, Homo sapiens
ctgctcctcggccagagctccc

SEQ ID NO: 4265027 - DNA, 12 bp, Homo sapiens
ctgctctgcaca

SEQ ID NO: 4265028 - DNA, 19 bp, Homo sapiens
ctgctgacagatgttccat

SEQ ID NO: 4265029 - DNA, 19 bp, Homo sapiens
ctgctgaccttctgcggct

SEQ ID NO: 4265030 - DNA, 21 bp, Homo sapiens
ctgctgagctctgacctgccc

SEQ ID NO: 4265031 - DNA, 21 bp, Homo sapiens
ctgctgcagtcagcacagaga

SEQ ID NO: 4265032 - DNA, 12 bp, Homo sapiens
ctgctgccaggc

SEQ ID NO: 4265033 - DNA, 15 bp, Homo sapiens
ctgctgcccccagac

SEQ ID NO: 4265034 - DNA, 18 bp, Homo sapiens
ctgctgcccccagacccc

SEQ ID NO: 4265035 - DNA, 20 bp, Homo sapiens
ctgctgcccgtgaggagggg

SEQ ID NO: 4265036 - DNA, 13 bp, Homo sapiens
ctgctgccctcca

SEQ ID NO: 4265037 - DNA, 14 bp, Homo sapiens
ctgctgcctcccca

SEQ ID NO: 4265038 - DNA, 14 bp, Homo sapiens
ctgctgctcctcgg

SEQ ID NO: 4265039 - DNA, 12 bp, Homo sapiens
ctgctggctccc

SEQ ID NO: 4265040 - DNA, 13 bp, Homo sapiens
ctgctggtgccca

SEQ ID NO: 4265041 - DNA, 14 bp, Homo sapiens
ctgctggtgcccac

SEQ ID NO: 4265042 - DNA, 20 bp, Homo sapiens
ctgctgtaagacggccttgg

SEQ ID NO: 4265043 - DNA, 14 bp, Homo sapiens
ctgctgtgaatttt

SEQ ID NO: 4265044 - DNA, 23 bp, Homo sapiens
ctgctgtggcatcaggaaaggaa

SEQ ID NO: 4265045 - DNA, 12 bp, Homo sapiens
ctgctgttttat

SEQ ID NO: 4265046 - DNA, 17 bp, Homo sapiens
ctgctgttttatgtcat

SEQ ID NO: 4265047 - DNA, 23 bp, Homo sapiens
ctgcttctgcccaccccgcctct

SEQ ID NO: 4265048 - DNA, 13 bp, Homo sapiens
ctgcttggatcca

SEQ ID NO: 4265049 - DNA, 18 bp, Homo sapiens
ctgcttggtttagctgtg

SEQ ID NO: 4265050 - DNA, 18 bp, Homo sapiens
ctgcttgtgttgggcccc

SEQ ID NO: 4265051 - DNA, 20 bp, Homo sapiens
ctgctttgggctgccctggt

SEQ ID NO: 4265052 - DNA, 21 bp, Homo sapiens
ctgctttgggctgccctggtg

SEQ ID NO: 4265053 - DNA, 17 bp, Homo sapiens
ctgcttttaggtcatcc

SEQ ID NO: 4265054 - DNA, 20 bp, Homo sapiens
ctgcttttccattctgggtg

SEQ ID NO: 4265055 - DNA, 14 bp, Homo sapiens
ctggacatattccc

SEQ ID NO: 4265056 - DNA, 17 bp, Homo sapiens
ctggactctgtggggcc

SEQ ID NO: 4265057 - DNA, 21 bp, Homo sapiens
ctggactctgtggggccacac

SEQ ID NO: 4265058 - DNA, 19 bp, Homo sapiens
ctggactggaggctgggtg

SEQ ID NO: 4265059 - DNA, 22 bp, Homo sapiens
ctggactggaggctgggtggcc

SEQ ID NO: 4265060 - DNA, 15 bp, Homo sapiens
ctggactgggaaggg

SEQ ID NO: 4265061 - DNA, 16 bp, Homo sapiens
ctggactgggaagggg

SEQ ID NO: 4265062 - DNA, 21 bp, Homo sapiens
ctggactgggaagggggcagg

SEQ ID NO: 4265063 - DNA, 14 bp, Homo sapiens
ctggagaactagag

SEQ ID NO: 4265064 - DNA, 23 bp, Homo sapiens
ctggagagtagacatccccctcc

SEQ ID NO: 4265065 - DNA, 19 bp, Homo sapiens
ctggagcatgagccagctc

SEQ ID NO: 4265066 - DNA, 12 bp, Homo sapiens
ctggagccccta

SEQ ID NO: 4265067 - DNA, 22 bp, Homo sapiens
ctggagcccctatcctgcaccc

SEQ ID NO: 4265068 - DNA, 12 bp, Homo sapiens
ctggaggaggag

SEQ ID NO: 4265069 - DNA, 12 bp, Homo sapiens
ctggaggcctct

SEQ ID NO: 4265070 - DNA, 15 bp, Homo sapiens
ctggaggcctctgca

SEQ ID NO: 4265071 - DNA, 13 bp, Homo sapiens
ctggaggtcccag

SEQ ID NO: 4265072 - DNA, 15 bp, Homo sapiens
ctggaggtcccagac

SEQ ID NO: 4265073 - DNA, 22 bp, Homo sapiens
ctggaggtcccagacatgctgc

SEQ ID NO: 4265074 - DNA, 16 bp, Homo sapiens
ctggagtcctgttctc

SEQ ID NO: 4265075 - DNA, 20 bp, Homo sapiens
ctggagtcctgttctcagag

SEQ ID NO: 4265076 - DNA, 22 bp, Homo sapiens
ctggagtcctgttctcagagct

SEQ ID NO: 4265077 - DNA, 16 bp, Homo sapiens
ctggagtctgaaggag

SEQ ID NO: 4265078 - DNA, 19 bp, Homo sapiens
ctggagtctgaaggagagg

SEQ ID NO: 4265079 - DNA, 14 bp, Homo sapiens
ctggagtgcagtgg

SEQ ID NO: 4265080 - DNA, 13 bp, Homo sapiens
ctggagttgggct

SEQ ID NO: 4265081 - DNA, 14 bp, Homo sapiens
ctggagttgggctg

SEQ ID NO: 4265082 - DNA, 15 bp, Homo sapiens
ctggagttgggctgg

SEQ ID NO: 4265083 - DNA, 16 bp, Homo sapiens
ctggagttgggctggt

SEQ ID NO: 4265084 - DNA, 18 bp, Homo sapiens
ctggatacagaatgaatc

SEQ ID NO: 4265085 - DNA, 23 bp, Homo sapiens
ctggatcagtaaaattatactgt

SEQ ID NO: 4265086 - DNA, 21 bp, Homo sapiens
ctggatgctgggttctggggc

SEQ ID NO: 4265087 - DNA, 18 bp, Homo sapiens
ctggatggatctgctcca

SEQ ID NO: 4265088 - DNA, 17 bp, Homo sapiens
ctggattcaaatttatt

SEQ ID NO: 4265089 - DNA, 21 bp, Homo sapiens
ctggattcccgtggctttgtg

SEQ ID NO: 4265090 - DNA, 17 bp, Homo sapiens
ctggattctaaattatg

SEQ ID NO: 4265091 - DNA, 21 bp, Homo sapiens
ctggattggcaggtgtgggct

SEQ ID NO: 4265092 - DNA, 22 bp, Homo sapiens
ctggattggcaggtgtgggctc

SEQ ID NO: 4265093 - DNA, 15 bp, Homo sapiens
ctggcacagggcagt

SEQ ID NO: 4265094 - DNA, 17 bp, Homo sapiens
ctggcagaactgagctc

SEQ ID NO: 4265095 - DNA, 13 bp, Homo sapiens
ctggcagccgtgc

SEQ ID NO: 4265096 - DNA, 15 bp, Homo sapiens
ctggcagcctcagag

SEQ ID NO: 4265097 - DNA, 16 bp, Homo sapiens
ctggcagcctcagagg

SEQ ID NO: 4265098 - DNA, 15 bp, Homo sapiens
ctggcagggcaggca

SEQ ID NO: 4265099 - DNA, 20 bp, Homo sapiens
ctggcagggcaggcagagct

SEQ ID NO: 4265100 - DNA, 21 bp, Homo sapiens
ctggcagggcaggcagagctc

SEQ ID NO: 4265101 - DNA, 16 bp, Homo sapiens
ctggcaggtggccagg

SEQ ID NO: 4265102 - DNA, 21 bp, Homo sapiens
ctggcaggtggccagggctcc

SEQ ID NO: 4265103 - DNA, 16 bp, Homo sapiens
ctggcatctctggagt

SEQ ID NO: 4265104 - DNA, 17 bp, Homo sapiens
ctggcatctctggagtg

SEQ ID NO: 4265105 - DNA, 21 bp, Homo sapiens
ctggcatggggaggggagaga

SEQ ID NO: 4265106 - DNA, 14 bp, Homo sapiens
ctggcatgtctggg

SEQ ID NO: 4265107 - DNA, 14 bp, Homo sapiens
ctggccacccttgg

SEQ ID NO: 4265108 - DNA, 17 bp, Homo sapiens
ctggcccacccctcttc

SEQ ID NO: 4265109 - DNA, 13 bp, Homo sapiens
ctggcccagccag

SEQ ID NO: 4265110 - DNA, 15 bp, Homo sapiens
ctggcccagccagca

SEQ ID NO: 4265111 - DNA, 17 bp, Homo sapiens
ctggcccagcctgtggc

SEQ ID NO: 4265112 - DNA, 18 bp, Homo sapiens
ctggcccagcctgtggcc

SEQ ID NO: 4265113 - DNA, 22 bp, Homo sapiens
ctggcccagcctgtggcctcag

SEQ ID NO: 4265114 - DNA, 13 bp, Homo sapiens
ctggcccagtgag

SEQ ID NO: 4265115 - DNA, 20 bp, Homo sapiens
cttctccctggactctgtgg

SEQ ID NO: 4265116 - DNA, 22 bp, Homo sapiens
cttctcctttcacaaccttctg

SEQ ID NO: 4265117 - DNA, 20 bp, Homo sapiens
cttctctaaatgaggggcct

SEQ ID NO: 4265118 - DNA, 13 bp, Homo sapiens
cttctctcagcct

SEQ ID NO: 4265119 - DNA, 21 bp, Homo sapiens
cttctctcagcctccactccc

SEQ ID NO: 4265120 - DNA, 15 bp, Homo sapiens
cttctctctgtgctg

SEQ ID NO: 4265121 - DNA, 17 bp, Homo sapiens
cttctctgttcatttcc

SEQ ID NO: 4265122 - DNA, 14 bp, Homo sapiens
cttctgaccacact

SEQ ID NO: 4265123 - DNA, 19 bp, Homo sapiens
cttctgaccacacttcctg

SEQ ID NO: 4265124 - DNA, 22 bp, Homo sapiens
cttctgaccccacttatgctgc

SEQ ID NO: 4265125 - DNA, 23 bp, Homo sapiens
cttctgaccccacttatgctgct

SEQ ID NO: 4265126 - DNA, 15 bp, Homo sapiens
cttctgactgtttac

SEQ ID NO: 4265127 - DNA, 21 bp, Homo sapiens
cttctgcccaccccgcctctg

SEQ ID NO: 4265128 - DNA, 22 bp, Homo sapiens
cttctgcggagcttctccagcc

SEQ ID NO: 4265129 - DNA, 23 bp, Homo sapiens
cttctgcggagcttctccagcca

SEQ ID NO: 4265130 - DNA, 21 bp, Homo sapiens
cttctggggaggggctccgtg

SEQ ID NO: 4265131 - DNA, 15 bp, Homo sapiens
cttctgtctgtaaga

SEQ ID NO: 4265132 - DNA, 14 bp, Homo sapiens
cttctgttctgcag

SEQ ID NO: 4265133 - DNA, 15 bp, Homo sapiens
cttcttactgtattt

SEQ ID NO: 4265134 - DNA, 18 bp, Homo sapiens
cttcttccattcccagac

SEQ ID NO: 4265135 - DNA, 13 bp, Homo sapiens
cttcttctgtaat

SEQ ID NO: 4265136 - DNA, 15 bp, Homo sapiens
cttcttctgtaatat

SEQ ID NO: 4265137 - DNA, 18 bp, Homo sapiens
cttctttactaacactgg

SEQ ID NO: 4265138 - DNA, 19 bp, Homo sapiens
cttcttttaaaccattttc

SEQ ID NO: 4265139 - DNA, 19 bp, Homo sapiens
cttgaaaacctcatttacc

SEQ ID NO: 4265140 - DNA, 10 bp, Homo sapiens
cttgaacaaa

SEQ ID NO: 4265141 - DNA, 23 bp, Homo sapiens
cttgaacattaatccacatgttt

SEQ ID NO: 4265142 - DNA, 13 bp, Homo sapiens
cttgaagaatatt

SEQ ID NO: 4265143 - DNA, 13 bp, Homo sapiens
cttgaagccaagt

SEQ ID NO: 4265144 - DNA, 21 bp, Homo sapiens
cttgaatgtccccattctata

SEQ ID NO: 4265145 - DNA, 17 bp, Homo sapiens
cttgagagcgctggcct

SEQ ID NO: 4265146 - DNA, 13 bp, Homo sapiens
cttgagatgtatt

SEQ ID NO: 4265147 - DNA, 14 bp, Homo sapiens
cttgagatgtatta

SEQ ID NO: 4265148 - DNA, 10 bp, Homo sapiens
cttgagctga

SEQ ID NO: 4265149 - DNA, 19 bp, Homo sapiens
cttgaggacctccacctgg

SEQ ID NO: 4265150 - DNA, 17 bp, Homo sapiens
cttgagtgggccccctc

SEQ ID NO: 4265151 - DNA, 18 bp, Homo sapiens
cttgagtgggccccctct

SEQ ID NO: 4265152 - DNA, 21 bp, Homo sapiens
cttgatgtcttgagagcgctg

SEQ ID NO: 4265153 - DNA, 14 bp, Homo sapiens
cttgatgttgctta

SEQ ID NO: 4265154 - DNA, 13 bp, Homo sapiens
cttgattctaaag

SEQ ID NO: 4265155 - DNA, 19 bp, Homo sapiens
cttgattttagccttctct

SEQ ID NO: 4265156 - DNA, 20 bp, Homo sapiens
cttgattttagccttctctg

SEQ ID NO: 4265157 - DNA, 13 bp, Homo sapiens
cttgcagcagaga

SEQ ID NO: 4265158 - DNA, 16 bp, Homo sapiens
cttgcagtcatcagaa

SEQ ID NO: 4265159 - DNA, 16 bp, Homo sapiens
cttgcattttagctaa

SEQ ID NO: 4265160 - DNA, 16 bp, Homo sapiens
cttgccccccacccca

SEQ ID NO: 4265161 - DNA, 19 bp, Homo sapiens
cttgccccccaccccagcc

SEQ ID NO: 4265162 - DNA, 14 bp, Homo sapiens
cttgccgctgggag

SEQ ID NO: 4265163 - DNA, 16 bp, Homo sapiens
cttgcctagggcctgg

SEQ ID NO: 4265164 - DNA, 19 bp, Homo sapiens
cttgctagtgatacactgt

SEQ ID NO: 4265165 - DNA, 18 bp, Homo sapiens
cttgctcaataaaggtca

SEQ ID NO: 4265166 - DNA, 17 bp, Homo sapiens
cttgctgcactcttgca

SEQ ID NO: 4265167 - DNA, 15 bp, Homo sapiens
cttgctgtgacttat

SEQ ID NO: 4265168 - DNA, 17 bp, Homo sapiens
cttgctttcacaaatat

SEQ ID NO: 4265169 - DNA, 13 bp, Homo sapiens
cttggagaggagg

SEQ ID NO: 4265170 - DNA, 21 bp, Homo sapiens
cttggagaggaggtgtggagt

SEQ ID NO: 4265171 - DNA, 15 bp, Homo sapiens
cttggataggagctt

SEQ ID NO: 4265172 - DNA, 16 bp, Homo sapiens
cttggatctttttgca

SEQ ID NO: 4265173 - DNA, 22 bp, Homo sapiens
cttggattggtaccagagccta

SEQ ID NO: 4265174 - DNA, 21 bp, Homo sapiens
cttggcaggagtgggctctga

SEQ ID NO: 4265175 - DNA, 22 bp, Homo sapiens
cttggccagaagggggccatga

SEQ ID NO: 4265176 - DNA, 14 bp, Homo sapiens
cttggcccagcagc

SEQ ID NO: 4265177 - DNA, 21 bp, Homo sapiens
cttggcccagcagcggcccag

SEQ ID NO: 4265178 - DNA, 23 bp, Homo sapiens
cttgggaccgccagatggggcct

SEQ ID NO: 4265179 - DNA, 17 bp, Homo sapiens
cttgggacggaagtggc

SEQ ID NO: 4265180 - DNA, 18 bp, Homo sapiens
cttgggatgggcacaggc

SEQ ID NO: 4265181 - DNA, 18 bp, Homo sapiens
cttggggaacaagggtgg

SEQ ID NO: 4265182 - DNA, 22 bp, Homo sapiens
cttggggatgcccttcttccat

SEQ ID NO: 4265183 - DNA, 13 bp, Homo sapiens
cttggttatattt

SEQ ID NO: 4265184 - DNA, 15 bp, Homo sapiens
cttggttcctccagc

SEQ ID NO: 4265185 - DNA, 22 bp, Homo sapiens
cttggttcctccagcaatgcct

SEQ ID NO: 4265186 - DNA, 21 bp, Homo sapiens
cttggttttgtattgtttaaa

SEQ ID NO: 4265187 - DNA, 17 bp, Homo sapiens
cttgtagggatgccttt

SEQ ID NO: 4265188 - DNA, 13 bp, Homo sapiens
cttgtcagagctg

SEQ ID NO: 4265189 - DNA, 17 bp, Homo sapiens
cttgtgaaacacagctg

SEQ ID NO: 4265190 - DNA, 18 bp, Homo sapiens
cttgtgaaacacagctgt

SEQ ID NO: 4265191 - DNA, 17 bp, Homo sapiens
cttgtgttgttttctct

SEQ ID NO: 4265192 - DNA, 13 bp, Homo sapiens
cttgttgtggagg

SEQ ID NO: 4265193 - DNA, 20 bp, Homo sapiens
cttgtttaaggttcttgctg

SEQ ID NO: 4265194 - DNA, 17 bp, Homo sapiens
cttgtttctatactgtt

SEQ ID NO: 4265195 - DNA, 20 bp, Homo sapiens
cttgttttttttttccactt

SEQ ID NO: 4265196 - DNA, 15 bp, Homo sapiens
ctttaaagacttgat

SEQ ID NO: 4265197 - DNA, 15 bp, Homo sapiens
ctttaacagtaatgt

SEQ ID NO: 4265198 - DNA, 17 bp, Homo sapiens
ctttaagcgaggcagaa

SEQ ID NO: 4265199 - DNA, 20 bp, Homo sapiens
ctttaagcgaggcagaatgg

SEQ ID NO: 4265200 - DNA, 22 bp, Homo sapiens
ctttacagttctggaggaggag

SEQ ID NO: 4265201 - DNA, 14 bp, Homo sapiens
ctttactaacactg

SEQ ID NO: 4265202 - DNA, 16 bp, Homo sapiens
ctttactaacactggc

SEQ ID NO: 4265203 - DNA, 23 bp, Homo sapiens
ctttaggtagtagaatctcagca

SEQ ID NO: 4265204 - DNA, 17 bp, Homo sapiens
ctttataagccaatgaa

SEQ ID NO: 4265205 - DNA, 24 bp, Homo sapiens
ctttataagccaatgaagcaaaca

SEQ ID NO: 4265206 - DNA, 17 bp, Homo sapiens
ctttatcatgtgtttct

SEQ ID NO: 4265207 - DNA, 18 bp, Homo sapiens
ctttatcatgtgtttctg

SEQ ID NO: 4265208 - DNA, 20 bp, Homo sapiens
ctttatgttactacatgcac

SEQ ID NO: 4265209 - DNA, 14 bp, Homo sapiens
ctttattgtctgta

SEQ ID NO: 4265210 - DNA, 21 bp, Homo sapiens
ctttcacccctcttcccacca

SEQ ID NO: 4265211 - DNA, 15 bp, Homo sapiens
ctttcactgaagtga

SEQ ID NO: 4265212 - DNA, 19 bp, Homo sapiens
ctttcactgaagtgaatac

SEQ ID NO: 4265213 - DNA, 22 bp, Homo sapiens
ctttcaggaaagtatctctact

SEQ ID NO: 4265214 - DNA, 20 bp, Homo sapiens
ctttccaccccctccctggc

SEQ ID NO: 4265215 - DNA, 12 bp, Homo sapiens
ctttcctgatgt

SEQ ID NO: 4265216 - DNA, 18 bp, Homo sapiens
ctttcctttcatcctcag

SEQ ID NO: 4265217 - DNA, 20 bp, Homo sapiens
ctttctagtcctattctatt

SEQ ID NO: 4265218 - DNA, 20 bp, Homo sapiens
ctttctccaaagttatccag

SEQ ID NO: 4265219 - DNA, 23 bp, Homo sapiens
ctttctccaaagttatccagagg

SEQ ID NO: 4265220 - DNA, 15 bp, Homo sapiens
ctttctgacaataaa

SEQ ID NO: 4265221 - DNA, 22 bp, Homo sapiens
ctttctgacaataaataatatt

SEQ ID NO: 4265222 - DNA, 18 bp, Homo sapiens
ctttgaatcctctctctg

SEQ ID NO: 4265223 - DNA, 23 bp, Homo sapiens
ctttgaatcctctctctgtgtta

SEQ ID NO: 4265224 - DNA, 21 bp, Homo sapiens
ctttgacctcaacctgtgatg

SEQ ID NO: 4265225 - DNA, 17 bp, Homo sapiens
ctttgattgtgaaacag

SEQ ID NO: 4265226 - DNA, 21 bp, Homo sapiens
ctttgcagacctgggacttta

SEQ ID NO: 4265227 - DNA, 22 bp, Homo sapiens
ctttgcagacctgggactttag

SEQ ID NO: 4265228 - DNA, 14 bp, Homo sapiens
ctttgctcccagtt

SEQ ID NO: 4265229 - DNA, 19 bp, Homo sapiens
ctttgctgatttcccctct

SEQ ID NO: 4265230 - DNA, 13 bp, Homo sapiens
ctttgctgccttc

SEQ ID NO: 4265231 - DNA, 16 bp, Homo sapiens
ctttgctgccttctgt

SEQ ID NO: 4265232 - DNA, 17 bp, Homo sapiens
ctttgctggagtcctgt

SEQ ID NO: 4265233 - DNA, 21 bp, Homo sapiens
ctttgctggagtcctgttctc

SEQ ID NO: 4265234 - DNA, 13 bp, Homo sapiens
ctttgctgtttat

SEQ ID NO: 4265235 - DNA, 23 bp, Homo sapiens
ctttggaatgactataaacatta

SEQ ID NO: 4265236 - DNA, 20 bp, Homo sapiens
ctttggctcgggacttcaaa

SEQ ID NO: 4265237 - DNA, 21 bp, Homo sapiens
ctttggcttaattccaatcat

SEQ ID NO: 4265238 - DNA, 16 bp, Homo sapiens
ctttgggggattcaaa

SEQ ID NO: 4265239 - DNA, 18 bp, Homo sapiens
ctttgggggattcaaatg

SEQ ID NO: 4265240 - DNA, 20 bp, Homo sapiens
ctttgggggattcaaatgca

SEQ ID NO: 4265241 - DNA, 22 bp, Homo sapiens
ctttgggggattcaaatgcatg

SEQ ID NO: 4265242 - DNA, 16 bp, Homo sapiens
ctttggtaatgtgtca

SEQ ID NO: 4265243 - DNA, 15 bp, Homo sapiens
ctttggtgttctggc

SEQ ID NO: 4265244 - DNA, 12 bp, Homo sapiens
gacatgcacagt

SEQ ID NO: 4265245 - DNA, 19 bp, Homo sapiens
gacatgctaacctctctga

SEQ ID NO: 4265246 - DNA, 12 bp, Homo sapiens
gacatgctgccc

SEQ ID NO: 4265247 - DNA, 13 bp, Homo sapiens
gacatgctgccca

SEQ ID NO: 4265248 - DNA, 14 bp, Homo sapiens
gacatgctgcccac

SEQ ID NO: 4265249 - DNA, 15 bp, Homo sapiens
gacatgctgcccacc

SEQ ID NO: 4265250 - DNA, 19 bp, Homo sapiens
gacatgctgcccaccccct

SEQ ID NO: 4265251 - DNA, 22 bp, Homo sapiens
gacatgctgcccaccccctgct

SEQ ID NO: 4265252 - DNA, 17 bp, Homo sapiens
gacatggacccggagct

SEQ ID NO: 4265253 - DNA, 18 bp, Homo sapiens
gacatttaaaatagtttt

SEQ ID NO: 4265254 - DNA, 15 bp, Homo sapiens
gacattttcttcaga

SEQ ID NO: 4265255 - DNA, 21 bp, Homo sapiens
gaccaagatgtcaagctggcc

SEQ ID NO: 4265256 - DNA, 13 bp, Homo sapiens
gaccaaggacccc

SEQ ID NO: 4265257 - DNA, 16 bp, Homo sapiens
gaccaaggacccctca

SEQ ID NO: 4265258 - DNA, 17 bp, Homo sapiens
gaccaagtataaacttt

SEQ ID NO: 4265259 - DNA, 14 bp, Homo sapiens
gaccaatctctgtg

SEQ ID NO: 4265260 - DNA, 23 bp, Homo sapiens
gaccacaaggctgaaaagtgctt

SEQ ID NO: 4265261 - DNA, 17 bp, Homo sapiens
gaccacacttcctgtcc

SEQ ID NO: 4265262 - DNA, 22 bp, Homo sapiens
gaccacacttcctgtccagaga

SEQ ID NO: 4265263 - DNA, 16 bp, Homo sapiens
gaccacccatatcatg

SEQ ID NO: 4265264 - DNA, 15 bp, Homo sapiens
gaccagaagtggcag

SEQ ID NO: 4265265 - DNA, 14 bp, Homo sapiens
gaccaggaaggaag

SEQ ID NO: 4265266 - DNA, 17 bp, Homo sapiens
gaccaggactctgcctt

SEQ ID NO: 4265267 - DNA, 20 bp, Homo sapiens
gaccaggctcacaactgttt

SEQ ID NO: 4265268 - DNA, 19 bp, Homo sapiens
gaccatttagtcctcacct

SEQ ID NO: 4265269 - DNA, 18 bp, Homo sapiens
gacccagggtggtcttca

SEQ ID NO: 4265270 - DNA, 19 bp, Homo sapiens
gaccccacttatgctgctg

SEQ ID NO: 4265271 - DNA, 16 bp, Homo sapiens
gaccccagctccaggc

SEQ ID NO: 4265272 - DNA, 20 bp, Homo sapiens
gaccccagctccaggcagga

SEQ ID NO: 4265273 - DNA, 17 bp, Homo sapiens
gaccccatccagccagg

SEQ ID NO: 4265274 - DNA, 21 bp, Homo sapiens
gaccccatccagccaggggtg

SEQ ID NO: 4265275 - DNA, 19 bp, Homo sapiens
gaccccatctgctgagctc

SEQ ID NO: 4265276 - DNA, 14 bp, Homo sapiens
gacccccacccctt

SEQ ID NO: 4265277 - DNA, 15 bp, Homo sapiens
gacccccaccccttc

SEQ ID NO: 4265278 - DNA, 18 bp, Homo sapiens
gacccccaccccttcccc

SEQ ID NO: 4265279 - DNA, 19 bp, Homo sapiens
gacccccaccccttcccca

SEQ ID NO: 4265280 - DNA, 22 bp, Homo sapiens
gacccccaccccttccccactg

SEQ ID NO: 4265281 - DNA, 20 bp, Homo sapiens
gacccccagcaaccctccta

SEQ ID NO: 4265282 - DNA, 15 bp, Homo sapiens
gacccctaccctttc

SEQ ID NO: 4265283 - DNA, 13 bp, Homo sapiens
gacccctcacctt

SEQ ID NO: 4265284 - DNA, 13 bp, Homo sapiens
gacccctcatctg

SEQ ID NO: 4265285 - DNA, 21 bp, Homo sapiens
gacccctggcttttcactgct

SEQ ID NO: 4265286 - DNA, 21 bp, Homo sapiens
gacccggagctaacactggcc

SEQ ID NO: 4265287 - DNA, 13 bp, Homo sapiens
gacccggaggcca

SEQ ID NO: 4265288 - DNA, 17 bp, Homo sapiens
gacccggaggccacatg

SEQ ID NO: 4265289 - DNA, 15 bp, Homo sapiens
gaccctcggggcagg

SEQ ID NO: 4265290 - DNA, 18 bp, Homo sapiens
gaccctcggggcaggaag

SEQ ID NO: 4265291 - DNA, 23 bp, Homo sapiens
gaccctggagcccggcagtgcac

SEQ ID NO: 4265292 - DNA, 20 bp, Homo sapiens
gaccctgggtcaccttcctg

SEQ ID NO: 4265293 - DNA, 22 bp, Homo sapiens
gaccctgggtcaccttcctggg

SEQ ID NO: 4265294 - DNA, 17 bp, Homo sapiens
gaccctgtctttgctgt

SEQ ID NO: 4265295 - DNA, 15 bp, Homo sapiens
gaccggacgcatgca

SEQ ID NO: 4265296 - DNA, 23 bp, Homo sapiens
gaccgggagcctgcgtggcctgg

SEQ ID NO: 4265297 - DNA, 12 bp, Homo sapiens
gaccggggtcct

SEQ ID NO: 4265298 - DNA, 21 bp, Homo sapiens
gacctcagagtccaggcccca

SEQ ID NO: 4265299 - DNA, 17 bp, Homo sapiens
gacctccttagaaaaga

SEQ ID NO: 4265300 - DNA, 22 bp, Homo sapiens
gacctcggctgtgtggggaggg

SEQ ID NO: 4265301 - DNA, 21 bp, Homo sapiens
gacctcgtctttgcttgtcct

SEQ ID NO: 4265302 - DNA, 23 bp, Homo sapiens
gacctgaagagcgctcctctgcc

SEQ ID NO: 4265303 - DNA, 18 bp, Homo sapiens
gacctgcagttggcctca

SEQ ID NO: 4265304 - DNA, 22 bp, Homo sapiens
gacctgcagttggcctcagcag

SEQ ID NO: 4265305 - DNA, 20 bp, Homo sapiens
gacctgcccccgctctgcca

SEQ ID NO: 4265306 - DNA, 15 bp, Homo sapiens
gacctgtgaggggaa

SEQ ID NO: 4265307 - DNA, 20 bp, Homo sapiens
gacctgtggggatttctccc

SEQ ID NO: 4265308 - DNA, 21 bp, Homo sapiens
gacctgtggggatttctccca

SEQ ID NO: 4265309 - DNA, 14 bp, Homo sapiens
gaccttacaaccac

SEQ ID NO: 4265310 - DNA, 22 bp, Homo sapiens
gaccttacaaccacatttctgg

SEQ ID NO: 4265311 - DNA, 14 bp, Homo sapiens
gaccttcaccaagc

SEQ ID NO: 4265312 - DNA, 20 bp, Homo sapiens
gaccttcaccaagcttagaa

SEQ ID NO: 4265313 - DNA, 20 bp, Homo sapiens
gaccttgatgtcttgagagc

SEQ ID NO: 4265314 - DNA, 19 bp, Homo sapiens
gacgatgtcaaccttgtgt

SEQ ID NO: 4265315 - DNA, 12 bp, Homo sapiens
gacgcatgcagg

SEQ ID NO: 4265316 - DNA, 13 bp, Homo sapiens
gacgcatgcaggg

SEQ ID NO: 4265317 - DNA, 16 bp, Homo sapiens
gacgcatgcagggccc

SEQ ID NO: 4265318 - DNA, 20 bp, Homo sapiens
gacgccttcaggcaccacag

SEQ ID NO: 4265319 - DNA, 21 bp, Homo sapiens
gacggaagtggcctgagaaga

SEQ ID NO: 4265320 - DNA, 20 bp, Homo sapiens
gacggcttccccatcgcctt

SEQ ID NO: 4265321 - DNA, 18 bp, Homo sapiens
gacgggggttggggtggg

SEQ ID NO: 4265322 - DNA, 19 bp, Homo sapiens
gactaaaccattgtgcatt

SEQ ID NO: 4265323 - DNA, 18 bp, Homo sapiens
gactagggtcctcaggca

SEQ ID NO: 4265324 - DNA, 15 bp, Homo sapiens
gactataaacattaa

SEQ ID NO: 4265325 - DNA, 18 bp, Homo sapiens
gactcacggctgcacctg

SEQ ID NO: 4265326 - DNA, 15 bp, Homo sapiens
gactcactcataaag

SEQ ID NO: 4265327 - DNA, 23 bp, Homo sapiens
gactcaggcccacattgcccaca

SEQ ID NO: 4265328 - DNA, 15 bp, Homo sapiens
gactcaggttgtctg

SEQ ID NO: 4265329 - DNA, 12 bp, Homo sapiens
gactccaggaga

SEQ ID NO: 4265330 - DNA, 16 bp, Homo sapiens
gactccaggagaggag

SEQ ID NO: 4265331 - DNA, 22 bp, Homo sapiens
gactccatatcccgggagcagt

SEQ ID NO: 4265332 - DNA, 17 bp, Homo sapiens
gactccttctccccaat

SEQ ID NO: 4265333 - DNA, 23 bp, Homo sapiens
gactccttctccccaatcacgag

SEQ ID NO: 4265334 - DNA, 19 bp, Homo sapiens
gactcgcttagctgaaacc

SEQ ID NO: 4265335 - DNA, 21 bp, Homo sapiens
gactcgggctaagtccagctc

SEQ ID NO: 4265336 - DNA, 16 bp, Homo sapiens
gactctacactgtgaa

SEQ ID NO: 4265337 - DNA, 14 bp, Homo sapiens
gactctctcctctc

SEQ ID NO: 4265338 - DNA, 23 bp, Homo sapiens
gactctctcctctctctccctcc

SEQ ID NO: 4265339 - DNA, 17 bp, Homo sapiens
gactctgccttccaggc

SEQ ID NO: 4265340 - DNA, 17 bp, Homo sapiens
gactctggactgggaag

SEQ ID NO: 4265341 - DNA, 18 bp, Homo sapiens
gactctggactgggaagg

SEQ ID NO: 4265342 - DNA, 18 bp, Homo sapiens
gactctgtggggccacac

SEQ ID NO: 4265343 - DNA, 16 bp, Homo sapiens
gactgacccattcaca

SEQ ID NO: 4265344 - DNA, 19 bp, Homo sapiens
gactgaccttgatgtcttg

SEQ ID NO: 4265345 - DNA, 14 bp, Homo sapiens
gactgcatgcaagc

SEQ ID NO: 4265346 - DNA, 23 bp, Homo sapiens
gactgccgaccgaggctggagct

SEQ ID NO: 4265347 - DNA, 17 bp, Homo sapiens
gactgctgcgctgtgct

SEQ ID NO: 4265348 - DNA, 15 bp, Homo sapiens
gactggaggctgggt

SEQ ID NO: 4265349 - DNA, 19 bp, Homo sapiens
gactgggaagggggcaggc

SEQ ID NO: 4265350 - DNA, 20 bp, Homo sapiens
gactgggaagggggcaggcc

SEQ ID NO: 4265351 - DNA, 16 bp, Homo sapiens
gactgggctggctgcc

SEQ ID NO: 4265352 - DNA, 14 bp, Homo sapiens
gactgggggtgcca

SEQ ID NO: 4265353 - DNA, 10 bp, Homo sapiens
gactggtcca

SEQ ID NO: 4265354 - DNA, 18 bp, Homo sapiens
gactgtactcctcccagg

SEQ ID NO: 4265355 - DNA, 23 bp, Homo sapiens
gactgtctcaagagggcactggt

SEQ ID NO: 4265356 - DNA, 16 bp, Homo sapiens
gactgtggcctcagga

SEQ ID NO: 4265357 - DNA, 14 bp, Homo sapiens
gactgttttttcct

SEQ ID NO: 4265358 - DNA, 19 bp, Homo sapiens
gactgttttttcctgagct

SEQ ID NO: 4265359 - DNA, 15 bp, Homo sapiens
gacttacatgattca

SEQ ID NO: 4265360 - DNA, 13 bp, Homo sapiens
gacttaggccaga

SEQ ID NO: 4265361 - DNA, 20 bp, Homo sapiens
gacttcagactctctcctct

SEQ ID NO: 4265362 - DNA, 16 bp, Homo sapiens
gacttcgctattccca

SEQ ID NO: 4265363 - DNA, 20 bp, Homo sapiens
gacttcgctattcccaggca

SEQ ID NO: 4265364 - DNA, 21 bp, Homo sapiens
gacttcgctattcccaggcag

SEQ ID NO: 4265365 - DNA, 18 bp, Homo sapiens
gacttctttactaacact

SEQ ID NO: 4265366 - DNA, 19 bp, Homo sapiens
gacttctttactaacactg

SEQ ID NO: 4265367 - DNA, 16 bp, Homo sapiens
gacttgatgaataaac

SEQ ID NO: 4265368 - DNA, 22 bp, Homo sapiens
gacttgatgaataaacactttt

SEQ ID NO: 4265369 - DNA, 16 bp, Homo sapiens
gactttccaccccctc

SEQ ID NO: 4265370 - DNA, 18 bp, Homo sapiens
gactttcggagttggggg

SEQ ID NO: 4265371 - DNA, 19 bp, Homo sapiens
gactttcggagttgggggt

SEQ ID NO: 4265372 - DNA, 17 bp, Homo sapiens
gagaaaaaccaatgatt

SEQ ID NO: 4265373 - DNA, 18 bp, Homo sapiens
gcacaattctgtccctgt

SEQ ID NO: 4265374 - DNA, 19 bp, Homo sapiens
gcacacacacacacaggag

SEQ ID NO: 4265375 - DNA, 20 bp, Homo sapiens
gcacacacacacacaggagg

SEQ ID NO: 4265376 - DNA, 11 bp, Homo sapiens
gcacacacact

SEQ ID NO: 4265377 - DNA, 17 bp, Homo sapiens
gcacacacactcttcaa

SEQ ID NO: 4265378 - DNA, 12 bp, Homo sapiens
gcacacacctgc

SEQ ID NO: 4265379 - DNA, 13 bp, Homo sapiens
gcacacacctgca

SEQ ID NO: 4265380 - DNA, 17 bp, Homo sapiens
gcacacacctgcacacc

SEQ ID NO: 4265381 - DNA, 23 bp, Homo sapiens
gcacacacctgcacacccctgca

SEQ ID NO: 4265382 - DNA, 19 bp, Homo sapiens
gcacacacctgcacaccgt

SEQ ID NO: 4265383 - DNA, 14 bp, Homo sapiens
gcacacccctgcac

SEQ ID NO: 4265384 - DNA, 11 bp, Homo sapiens
gcacagccaga

SEQ ID NO: 4265385 - DNA, 21 bp, Homo sapiens
gcacagcctcacccctgcagg

SEQ ID NO: 4265386 - DNA, 15 bp, Homo sapiens
gcacagtgcatctca

SEQ ID NO: 4265387 - DNA, 18 bp, Homo sapiens
gcacagtgcatctcagcc

SEQ ID NO: 4265388 - DNA, 20 bp, Homo sapiens
gcacagtgcatctcagccca

SEQ ID NO: 4265389 - DNA, 21 bp, Homo sapiens
gcacagtgcatctcagcccac

SEQ ID NO: 4265390 - DNA, 22 bp, Homo sapiens
gcacagtttgcaatcttatgtt

SEQ ID NO: 4265391 - DNA, 21 bp, Homo sapiens
gcacattaggaacagagtata

SEQ ID NO: 4265392 - DNA, 13 bp, Homo sapiens
gcacattgccctg

SEQ ID NO: 4265393 - DNA, 15 bp, Homo sapiens
gcacattgccctgag

SEQ ID NO: 4265394 - DNA, 17 bp, Homo sapiens
gcacattgccctgaggg

SEQ ID NO: 4265395 - DNA, 18 bp, Homo sapiens
gcaccaacctcactgccc

SEQ ID NO: 4265396 - DNA, 18 bp, Homo sapiens
gcaccagcctcagtgcag

SEQ ID NO: 4265397 - DNA, 20 bp, Homo sapiens
gcaccagcctcagtgcagcc

SEQ ID NO: 4265398 - DNA, 13 bp, Homo sapiens
gcacccatgcccc

SEQ ID NO: 4265399 - DNA, 21 bp, Homo sapiens
gcacccatgccccactctgct

SEQ ID NO: 4265400 - DNA, 16 bp, Homo sapiens
gcaccccaccacacac

SEQ ID NO: 4265401 - DNA, 14 bp, Homo sapiens
gcacccccaccctt

SEQ ID NO: 4265402 - DNA, 15 bp, Homo sapiens
gcacccgtgccacgc

SEQ ID NO: 4265403 - DNA, 20 bp, Homo sapiens
gcaccctctgctatgtctgt

SEQ ID NO: 4265404 - DNA, 13 bp, Homo sapiens
gcaccgccttctc

SEQ ID NO: 4265405 - DNA, 14 bp, Homo sapiens
gcaccgccttctct

SEQ ID NO: 4265406 - DNA, 23 bp, Homo sapiens
gcacctataaatactaaatatga

SEQ ID NO: 4265407 - DNA, 17 bp, Homo sapiens
gcacctcgccgtgtctt

SEQ ID NO: 4265408 - DNA, 14 bp, Homo sapiens
gcacctgcagggag

SEQ ID NO: 4265409 - DNA, 15 bp, Homo sapiens
gcacctgcagggagc

SEQ ID NO: 4265410 - DNA, 17 bp, Homo sapiens
gcacctgcagggagcag

SEQ ID NO: 4265411 - DNA, 21 bp, Homo sapiens
gcacctgcagggagcagcacg

SEQ ID NO: 4265412 - DNA, 18 bp, Homo sapiens
gcacctgggtgtgctcca

SEQ ID NO: 4265413 - DNA, 14 bp, Homo sapiens
gcacgcaagcctca

SEQ ID NO: 4265414 - DNA, 17 bp, Homo sapiens
gcacgccaaccccagca

SEQ ID NO: 4265415 - DNA, 18 bp, Homo sapiens
gcacgccaaccccagcag

SEQ ID NO: 4265416 - DNA, 13 bp, Homo sapiens
gcacgtgcacaca

SEQ ID NO: 4265417 - DNA, 19 bp, Homo sapiens
gcacgtgcacacacctgca

SEQ ID NO: 4265418 - DNA, 22 bp, Homo sapiens
gcacgtgcacacacctgcacac

SEQ ID NO: 4265419 - DNA, 21 bp, Homo sapiens
gcactgccattagactgaatt

SEQ ID NO: 4265420 - DNA, 13 bp, Homo sapiens
gcactgccctccg

SEQ ID NO: 4265421 - DNA, 15 bp, Homo sapiens
gcactgccctccgcc

SEQ ID NO: 4265422 - DNA, 17 bp, Homo sapiens
gcactggccttctgatg

SEQ ID NO: 4265423 - DNA, 14 bp, Homo sapiens
gcactgtggccttg

SEQ ID NO: 4265424 - DNA, 14 bp, Homo sapiens
gcacttggcctctt

SEQ ID NO: 4265425 - DNA, 17 bp, Homo sapiens
gcactttataagccaat

SEQ ID NO: 4265426 - DNA, 16 bp, Homo sapiens
gcagaactgagctcct

SEQ ID NO: 4265427 - DNA, 19 bp, Homo sapiens
gcagaaggccttgccttgt

SEQ ID NO: 4265428 - DNA, 22 bp, Homo sapiens
gcagaatggtgggctccagagt

SEQ ID NO: 4265429 - DNA, 21 bp, Homo sapiens
gcagaattcattcatacttaa

SEQ ID NO: 4265430 - DNA, 14 bp, Homo sapiens
gcagaccaggaagg

SEQ ID NO: 4265431 - DNA, 19 bp, Homo sapiens
gcagaccaggaaggaagag

SEQ ID NO: 4265432 - DNA, 20 bp, Homo sapiens
gcagaccaggaaggaagagc

SEQ ID NO: 4265433 - DNA, 14 bp, Homo sapiens
gcagacctgggact

SEQ ID NO: 4265434 - DNA, 18 bp, Homo sapiens
gcagagattgggggggct

SEQ ID NO: 4265435 - DNA, 22 bp, Homo sapiens
gcagagattgggggggcttggg

SEQ ID NO: 4265436 - DNA, 12 bp, Homo sapiens
gcagagcctggg

SEQ ID NO: 4265437 - DNA, 14 bp, Homo sapiens
gcagagcctggggt

SEQ ID NO: 4265438 - DNA, 15 bp, Homo sapiens
gcagagcctggggtg

SEQ ID NO: 4265439 - DNA, 16 bp, Homo sapiens
gcagagtgcacagctg

SEQ ID NO: 4265440 - DNA, 14 bp, Homo sapiens
gcagatctagccag

SEQ ID NO: 4265441 - DNA, 15 bp, Homo sapiens
gcagatctagccagg

SEQ ID NO: 4265442 - DNA, 19 bp, Homo sapiens
gcagattggttcatgcctg

SEQ ID NO: 4265443 - DNA, 22 bp, Homo sapiens
gcagattggttcatgcctgggg

SEQ ID NO: 4265444 - DNA, 14 bp, Homo sapiens
gcagcaacaggacc

SEQ ID NO: 4265445 - DNA, 15 bp, Homo sapiens
gcagcaacaggacca

SEQ ID NO: 4265446 - DNA, 20 bp, Homo sapiens
gcagcaacaggaccaggagc

SEQ ID NO: 4265447 - DNA, 15 bp, Homo sapiens
gcagcacgccaaccc

SEQ ID NO: 4265448 - DNA, 20 bp, Homo sapiens
gcagcacgccaaccccagca

SEQ ID NO: 4265449 - DNA, 15 bp, Homo sapiens
gcagccaccctgcca

SEQ ID NO: 4265450 - DNA, 17 bp, Homo sapiens
gcagcccacctgctgcc

SEQ ID NO: 4265451 - DNA, 14 bp, Homo sapiens
gcagcccagagaga

SEQ ID NO: 4265452 - DNA, 14 bp, Homo sapiens
gcagccccaggcct

SEQ ID NO: 4265453 - DNA, 15 bp, Homo sapiens
gcagccccaggcctc

SEQ ID NO: 4265454 - DNA, 18 bp, Homo sapiens
gcagccccctcctgaccc

SEQ ID NO: 4265455 - DNA, 20 bp, Homo sapiens
gcagccccctcctgacccca

SEQ ID NO: 4265456 - DNA, 12 bp, Homo sapiens
gcagcccctccc

SEQ ID NO: 4265457 - DNA, 17 bp, Homo sapiens
gcagcccgtgtggcccc

SEQ ID NO: 4265458 - DNA, 18 bp, Homo sapiens
gcagcccgtgtggcccct

SEQ ID NO: 4265459 - DNA, 13 bp, Homo sapiens
gcagccctgcttt

SEQ ID NO: 4265460 - DNA, 19 bp, Homo sapiens
gcagccggggagctgaggg

SEQ ID NO: 4265461 - DNA, 20 bp, Homo sapiens
gcagccggggagctgagggg

SEQ ID NO: 4265462 - DNA, 22 bp, Homo sapiens
gcagccggggagctgaggggca

SEQ ID NO: 4265463 - DNA, 23 bp, Homo sapiens
gcagccggggagctgaggggcag

SEQ ID NO: 4265464 - DNA, 14 bp, Homo sapiens
gcagccgtgccttc

SEQ ID NO: 4265465 - DNA, 17 bp, Homo sapiens
gcagccgtgccttcagc

SEQ ID NO: 4265466 - DNA, 12 bp, Homo sapiens
gcagcctcagag

SEQ ID NO: 4265467 - DNA, 23 bp, Homo sapiens
gcagcctgcagaccacactctgc

SEQ ID NO: 4265468 - DNA, 22 bp, Homo sapiens
gcagcgtctgagcggccgcctg

SEQ ID NO: 4265469 - DNA, 15 bp, Homo sapiens
gcagctgccagagaa

SEQ ID NO: 4265470 - DNA, 15 bp, Homo sapiens
gcagcttcaggtgag

SEQ ID NO: 4265471 - DNA, 18 bp, Homo sapiens
gcaggaaccatggacctg

SEQ ID NO: 4265472 - DNA, 19 bp, Homo sapiens
gcaggaaccatggacctgc

SEQ ID NO: 4265473 - DNA, 20 bp, Homo sapiens
gcaggaaggtctcatgcctg

SEQ ID NO: 4265474 - DNA, 23 bp, Homo sapiens
gcaggaagtcaggagccagcagg

SEQ ID NO: 4265475 - DNA, 14 bp, Homo sapiens
gcaggaagtccctg

SEQ ID NO: 4265476 - DNA, 23 bp, Homo sapiens
gcaggaagtccctgagaagcctc

SEQ ID NO: 4265477 - DNA, 23 bp, Homo sapiens
gcaggacctcagagtccaggccc

SEQ ID NO: 4265478 - DNA, 22 bp, Homo sapiens
gcaggagacactggtctcagag

SEQ ID NO: 4265479 - DNA, 23 bp, Homo sapiens
gcaggagacactggtctcagagg

SEQ ID NO: 4265480 - DNA, 15 bp, Homo sapiens
gcaggagcctagagg

SEQ ID NO: 4265481 - DNA, 18 bp, Homo sapiens
gcaggaggacaggtggag

SEQ ID NO: 4265482 - DNA, 13 bp, Homo sapiens
gcaggagggtggc

SEQ ID NO: 4265483 - DNA, 19 bp, Homo sapiens
gcaggagtgggctctgagc

SEQ ID NO: 4265484 - DNA, 18 bp, Homo sapiens
gcaggcagagctcagcac

SEQ ID NO: 4265485 - DNA, 22 bp, Homo sapiens
gcaggcagagctcagcacagcc

SEQ ID NO: 4265486 - DNA, 19 bp, Homo sapiens
gcaggcccctttggacctg

SEQ ID NO: 4265487 - DNA, 18 bp, Homo sapiens
gcaggcctttttgagcca

SEQ ID NO: 4265488 - DNA, 19 bp, Homo sapiens
gcaggcggtatccagaggt

SEQ ID NO: 4265489 - DNA, 20 bp, Homo sapiens
gcaggcggtatccagaggtg

SEQ ID NO: 4265490 - DNA, 22 bp, Homo sapiens
gcagggagggaaacccggggaa

SEQ ID NO: 4265491 - DNA, 13 bp, Homo sapiens
gcagggcagcctg

SEQ ID NO: 4265492 - DNA, 19 bp, Homo sapiens
gcagggcagcctgtgggag

SEQ ID NO: 4265493 - DNA, 17 bp, Homo sapiens
gcagggcgggccaggag

SEQ ID NO: 4265494 - DNA, 18 bp, Homo sapiens
gcaggggccgtgcagggc

SEQ ID NO: 4265495 - DNA, 21 bp, Homo sapiens
gcaggggctgggcagagggga

SEQ ID NO: 4265496 - DNA, 14 bp, Homo sapiens
gcaggggggttggg

SEQ ID NO: 4265497 - DNA, 17 bp, Homo sapiens
gcagggttctagaaggg

SEQ ID NO: 4265498 - DNA, 18 bp, Homo sapiens
gcaggtcccgagccccct

SEQ ID NO: 4265499 - DNA, 23 bp, Homo sapiens
gcaggtcccgagccccctgtcct

SEQ ID NO: 4265500 - DNA, 16 bp, Homo sapiens
gcaggtggccagggct

SEQ ID NO: 4265501 - DNA, 18 bp, Homo sapiens
gcaggtggccagggctcc

SEQ ID NO: 4265502 - DNA, 18 bp, Homo sapiens
gcaggttctctcctgtga

SEQ ID NO: 4265503 - DNA, 17 bp, Homo sapiens
gcctgagagcagaatga

SEQ ID NO: 4265504 - DNA, 21 bp, Homo sapiens
gcctgagaggagcgtgtccta

SEQ ID NO: 4265505 - DNA, 10 bp, Homo sapiens
gcctgagggg

SEQ ID NO: 4265506 - DNA, 16 bp, Homo sapiens
gcctgcagactcactg

SEQ ID NO: 4265507 - DNA, 21 bp, Homo sapiens
gcctgccactctcctgaggag

SEQ ID NO: 4265508 - DNA, 16 bp, Homo sapiens
gcctgccccccttccc

SEQ ID NO: 4265509 - DNA, 21 bp, Homo sapiens
gcctgccccccttcccacccc

SEQ ID NO: 4265510 - DNA, 17 bp, Homo sapiens
gcctgccccggccactc

SEQ ID NO: 4265511 - DNA, 14 bp, Homo sapiens
gcctgcctccggcc

SEQ ID NO: 4265512 - DNA, 22 bp, Homo sapiens
gcctgcctccggccctgcccca

SEQ ID NO: 4265513 - DNA, 23 bp, Homo sapiens
gcctgcctccggccctgccccac

SEQ ID NO: 4265514 - DNA, 18 bp, Homo sapiens
gcctgcgatggtgctgca

SEQ ID NO: 4265515 - DNA, 18 bp, Homo sapiens
gcctgctatccagccgca

SEQ ID NO: 4265516 - DNA, 22 bp, Homo sapiens
gcctgctggctcccttacttta

SEQ ID NO: 4265517 - DNA, 22 bp, Homo sapiens
gcctggacacagtcagggcggg

SEQ ID NO: 4265518 - DNA, 17 bp, Homo sapiens
gcctggagttgggctgg

SEQ ID NO: 4265519 - DNA, 18 bp, Homo sapiens
gcctggagttgggctggt

SEQ ID NO: 4265520 - DNA, 14 bp, Homo sapiens
gcctggcacagggc

SEQ ID NO: 4265521 - DNA, 19 bp, Homo sapiens
gcctggcacagggcagtgg

SEQ ID NO: 4265522 - DNA, 19 bp, Homo sapiens
gcctggcagaactgagctc

SEQ ID NO: 4265523 - DNA, 12 bp, Homo sapiens
gcctggcagccg

SEQ ID NO: 4265524 - DNA, 14 bp, Homo sapiens
gcctggcccagcca

SEQ ID NO: 4265525 - DNA, 15 bp, Homo sapiens
gcctggcccagccag

SEQ ID NO: 4265526 - DNA, 17 bp, Homo sapiens
gcctggccccaaatgtt

SEQ ID NO: 4265527 - DNA, 15 bp, Homo sapiens
gcctggccctcctct

SEQ ID NO: 4265528 - DNA, 17 bp, Homo sapiens
gcctggccctcctctgg

SEQ ID NO: 4265529 - DNA, 18 bp, Homo sapiens
gcctgggaaaagggcagg

SEQ ID NO: 4265530 - DNA, 19 bp, Homo sapiens
gcctgggaaaagggcagga

SEQ ID NO: 4265531 - DNA, 23 bp, Homo sapiens
gcctgggaaaagggcaggagcct

SEQ ID NO: 4265532 - DNA, 13 bp, Homo sapiens
gcctgggccactg

SEQ ID NO: 4265533 - DNA, 16 bp, Homo sapiens
gcctgggccactggca

SEQ ID NO: 4265534 - DNA, 13 bp, Homo sapiens
gcctgggcctgat

SEQ ID NO: 4265535 - DNA, 15 bp, Homo sapiens
gcctggggctgccgt

SEQ ID NO: 4265536 - DNA, 21 bp, Homo sapiens
gcctggggtgggtgtgagcag

SEQ ID NO: 4265537 - DNA, 22 bp, Homo sapiens
gcctggggtgggtgtgagcagg

SEQ ID NO: 4265538 - DNA, 14 bp, Homo sapiens
gcctggtctggagc

SEQ ID NO: 4265539 - DNA, 18 bp, Homo sapiens
gcctggtgccctggccca

SEQ ID NO: 4265540 - DNA, 13 bp, Homo sapiens
gcctgtgagtgac

SEQ ID NO: 4265541 - DNA, 14 bp, Homo sapiens
gcctgtgagtgaca

SEQ ID NO: 4265542 - DNA, 16 bp, Homo sapiens
gcctgtggcctcagca

SEQ ID NO: 4265543 - DNA, 15 bp, Homo sapiens
gcctgtgggagaagg

SEQ ID NO: 4265544 - DNA, 21 bp, Homo sapiens
gcctgtgtgacatcagtggca

SEQ ID NO: 4265545 - DNA, 22 bp, Homo sapiens
gcctgtgtgacatcagtggcat

SEQ ID NO: 4265546 - DNA, 21 bp, Homo sapiens
gcctgtgttagtgtctgtcca

SEQ ID NO: 4265547 - DNA, 16 bp, Homo sapiens
gccttaagaaagctat

SEQ ID NO: 4265548 - DNA, 17 bp, Homo sapiens
gccttaagaaagctata

SEQ ID NO: 4265549 - DNA, 17 bp, Homo sapiens
gccttagaacctttctt

SEQ ID NO: 4265550 - DNA, 19 bp, Homo sapiens
gccttcaggcaccacagat

SEQ ID NO: 4265551 - DNA, 23 bp, Homo sapiens
gccttccacgctgtctccagacc

SEQ ID NO: 4265552 - DNA, 20 bp, Homo sapiens
gccttccatgggcatggccg

SEQ ID NO: 4265553 - DNA, 12 bp, Homo sapiens
gccttcccctca

SEQ ID NO: 4265554 - DNA, 18 bp, Homo sapiens
gccttcgatacaccgggc

SEQ ID NO: 4265555 - DNA, 22 bp, Homo sapiens
gccttcgatacaccgggcctgg

SEQ ID NO: 4265556 - DNA, 14 bp, Homo sapiens
gccttctctgttca

SEQ ID NO: 4265557 - DNA, 21 bp, Homo sapiens
gccttctgcggagcttctcca

SEQ ID NO: 4265558 - DNA, 18 bp, Homo sapiens
gccttctggctgctgcag

SEQ ID NO: 4265559 - DNA, 14 bp, Homo sapiens
gccttgccttgtgt

SEQ ID NO: 4265560 - DNA, 16 bp, Homo sapiens
gccttggacaccatcc

SEQ ID NO: 4265561 - DNA, 18 bp, Homo sapiens
gccttggtctaacttttg

SEQ ID NO: 4265562 - DNA, 18 bp, Homo sapiens
gccttggttcctccagca

SEQ ID NO: 4265563 - DNA, 15 bp, Homo sapiens
gcctttaggcaggaa

SEQ ID NO: 4265564 - DNA, 19 bp, Homo sapiens
gcgacggctcctccccgat

SEQ ID NO: 4265565 - DNA, 20 bp, Homo sapiens
gcgagccagattaggcctgg

SEQ ID NO: 4265566 - DNA, 22 bp, Homo sapiens
gcgagccagattaggcctggag

SEQ ID NO: 4265567 - DNA, 23 bp, Homo sapiens
gcgagccagattaggcctggagt

SEQ ID NO: 4265568 - DNA, 12 bp, Homo sapiens
gcgaggcagagg

SEQ ID NO: 4265569 - DNA, 14 bp, Homo sapiens
gcgaggcagaggac

SEQ ID NO: 4265570 - DNA, 11 bp, Homo sapiens
gcgcaggccct

SEQ ID NO: 4265571 - DNA, 12 bp, Homo sapiens
gcgcaggccctc

SEQ ID NO: 4265572 - DNA, 12 bp, Homo sapiens
gcgccctccctc

SEQ ID NO: 4265573 - DNA, 16 bp, Homo sapiens
gcgccctccctccctc

SEQ ID NO: 4265574 - DNA, 13 bp, Homo sapiens
gcgcgcacacaca

SEQ ID NO: 4265575 - DNA, 17 bp, Homo sapiens
gcgcgcacacacactct

SEQ ID NO: 4265576 - DNA, 15 bp, Homo sapiens
gcgcgcgcacacaca

SEQ ID NO: 4265577 - DNA, 13 bp, Homo sapiens
gcgctcctctgcc

SEQ ID NO: 4265578 - DNA, 14 bp, Homo sapiens
gcgctctgcatgct

SEQ ID NO: 4265579 - DNA, 16 bp, Homo sapiens
gcgctctgcatgctcc

SEQ ID NO: 4265580 - DNA, 21 bp, Homo sapiens
gcgctctgcatgctcctctgc

SEQ ID NO: 4265581 - DNA, 22 bp, Homo sapiens
gcgctctgcatgctcctctgcc

SEQ ID NO: 4265582 - DNA, 18 bp, Homo sapiens
gcgctcttcaccaggaag

SEQ ID NO: 4265583 - DNA, 19 bp, Homo sapiens
gcgctcttcaccaggaaga

SEQ ID NO: 4265584 - DNA, 19 bp, Homo sapiens
gcgctgacaaccaccgctc

SEQ ID NO: 4265585 - DNA, 13 bp, Homo sapiens
gcgctgccctgca

SEQ ID NO: 4265586 - DNA, 14 bp, Homo sapiens
gcgctgccctgcaa

SEQ ID NO: 4265587 - DNA, 14 bp, Homo sapiens
gcgctgtgctggtc

SEQ ID NO: 4265588 - DNA, 17 bp, Homo sapiens
gcggccggcctggggcc

SEQ ID NO: 4265589 - DNA, 18 bp, Homo sapiens
gcggctgggagcctcgcc

SEQ ID NO: 4265590 - DNA, 14 bp, Homo sapiens
gcgggacctgtggc

SEQ ID NO: 4265591 - DNA, 20 bp, Homo sapiens
gcgggccaaggactgccgac

SEQ ID NO: 4265592 - DNA, 18 bp, Homo sapiens
gcggggctggccagctgt

SEQ ID NO: 4265593 - DNA, 14 bp, Homo sapiens
gcgggtaaaaagag

SEQ ID NO: 4265594 - DNA, 17 bp, Homo sapiens
gcgggtaaaaagagaag

SEQ ID NO: 4265595 - DNA, 22 bp, Homo sapiens
gcgggtaaaaagagaaggcaag

SEQ ID NO: 4265596 - DNA, 13 bp, Homo sapiens
gcggtatccagag

SEQ ID NO: 4265597 - DNA, 22 bp, Homo sapiens
gcggtccagaggaggtgcccgg

SEQ ID NO: 4265598 - DNA, 16 bp, Homo sapiens
gcggtcgcggctggga

SEQ ID NO: 4265599 - DNA, 15 bp, Homo sapiens
gcgtccaaccccggg

SEQ ID NO: 4265600 - DNA, 19 bp, Homo sapiens
gcgtctgagcggccgcctg

SEQ ID NO: 4265601 - DNA, 21 bp, Homo sapiens
gcgtctgagcggccgcctgtc

SEQ ID NO: 4265602 - DNA, 22 bp, Homo sapiens
gcgtctgagcggccgcctgtcc

SEQ ID NO: 4265603 - DNA, 16 bp, Homo sapiens
gcgtctgcgcggatgt

SEQ ID NO: 4265604 - DNA, 18 bp, Homo sapiens
gctaaaaaagctgaatca

SEQ ID NO: 4265605 - DNA, 17 bp, Homo sapiens
gctaacactggccccta

SEQ ID NO: 4265606 - DNA, 16 bp, Homo sapiens
gctaatcagcattctc

SEQ ID NO: 4265607 - DNA, 17 bp, Homo sapiens
gctacagtagctgtggg

SEQ ID NO: 4265608 - DNA, 14 bp, Homo sapiens
gctacctctgatca

SEQ ID NO: 4265609 - DNA, 15 bp, Homo sapiens
gctacctggttttca

SEQ ID NO: 4265610 - DNA, 18 bp, Homo sapiens
gctactttggtttctgtc

SEQ ID NO: 4265611 - DNA, 18 bp, Homo sapiens
gctagagaaattcttgtt

SEQ ID NO: 4265612 - DNA, 20 bp, Homo sapiens
gctaggtgggccagcccctc

SEQ ID NO: 4265613 - DNA, 21 bp, Homo sapiens
gctaggtgggccagcccctcc

SEQ ID NO: 4265614 - DNA, 18 bp, Homo sapiens
gctaggttaataggagga

SEQ ID NO: 4265615 - DNA, 13 bp, Homo sapiens
gctatccagccgc

SEQ ID NO: 4265616 - DNA, 15 bp, Homo sapiens
gctatcttcatgtaa

SEQ ID NO: 4265617 - DNA, 18 bp, Homo sapiens
gctatcttcatgtaaatt

SEQ ID NO: 4265618 - DNA, 15 bp, Homo sapiens
gctattcccaggcag

SEQ ID NO: 4265619 - DNA, 16 bp, Homo sapiens
gctattcccaggcagg

SEQ ID NO: 4265620 - DNA, 14 bp, Homo sapiens
gctcacaactgttt

SEQ ID NO: 4265621 - DNA, 14 bp, Homo sapiens
gctcacaccagccc

SEQ ID NO: 4265622 - DNA, 17 bp, Homo sapiens
gctcacaccagccctgg

SEQ ID NO: 4265623 - DNA, 12 bp, Homo sapiens
gctcacagccac

SEQ ID NO: 4265624 - DNA, 13 bp, Homo sapiens
gctcacagccacc

SEQ ID NO: 4265625 - DNA, 14 bp, Homo sapiens
gctcacagccacca

SEQ ID NO: 4265626 - DNA, 16 bp, Homo sapiens
gctcacttcaagctca

SEQ ID NO: 4265627 - DNA, 18 bp, Homo sapiens
gctcagatgctggtcatc

SEQ ID NO: 4265628 - DNA, 22 bp, Homo sapiens
gctcagcacagcctcacccctg

SEQ ID NO: 4265629 - DNA, 11 bp, Homo sapiens
gctcagcccac

SEQ ID NO: 4265630 - DNA, 18 bp, Homo sapiens
gctcagcccacccccctc

SEQ ID NO: 4265631 - DNA, 19 bp, Homo sapiens
gctcagccctccctgcccc

SEQ ID NO: 4265632 - DNA, 11 bp, Homo sapiens
gctcaggagaa

SEQ ID NO: 4265633 - DNA, 17 bp, Homo sapiens
gctcaggagaaggcctg

SEQ ID NO: 4265634 - DNA, 18 bp, Homo sapiens
ggaggggcctggcagccg

SEQ ID NO: 4265635 - DNA, 23 bp, Homo sapiens
ggaggggtcagcaggggggttgg

SEQ ID NO: 4265636 - DNA, 22 bp, Homo sapiens
ggaggtcccagacatgctgccc

SEQ ID NO: 4265637 - DNA, 22 bp, Homo sapiens
ggaggtgtggagtggaggggtc

SEQ ID NO: 4265638 - DNA, 16 bp, Homo sapiens
ggagtcaagtgtgcct

SEQ ID NO: 4265639 - DNA, 17 bp, Homo sapiens
ggagtcaagtgtgcctg

SEQ ID NO: 4265640 - DNA, 21 bp, Homo sapiens
ggagtcaagtgtgcctgctat

SEQ ID NO: 4265641 - DNA, 13 bp, Homo sapiens
ggagtcagggagc

SEQ ID NO: 4265642 - DNA, 21 bp, Homo sapiens
ggagtccagacctgggccctg

SEQ ID NO: 4265643 - DNA, 18 bp, Homo sapiens
ggagtctgattgcaggaa

SEQ ID NO: 4265644 - DNA, 17 bp, Homo sapiens
ggagtggaggggtcagc

SEQ ID NO: 4265645 - DNA, 15 bp, Homo sapiens
ggagtggggcagtag

SEQ ID NO: 4265646 - DNA, 18 bp, Homo sapiens
ggagtgggtgggacacag

SEQ ID NO: 4265647 - DNA, 21 bp, Homo sapiens
ggagtgtgggggtgccatggt

SEQ ID NO: 4265648 - DNA, 19 bp, Homo sapiens
ggagtgtgtgggggtctgg

SEQ ID NO: 4265649 - DNA, 23 bp, Homo sapiens
ggagtgtgtgggggtctgggagg

SEQ ID NO: 4265650 - DNA, 17 bp, Homo sapiens
ggataggagcttccaga

SEQ ID NO: 4265651 - DNA, 16 bp, Homo sapiens
ggatatttttaattta

SEQ ID NO: 4265652 - DNA, 18 bp, Homo sapiens
ggatcaagtattactaaa

SEQ ID NO: 4265653 - DNA, 12 bp, Homo sapiens
ggatccagagag

SEQ ID NO: 4265654 - DNA, 19 bp, Homo sapiens
ggatctaaaaggaggacag

SEQ ID NO: 4265655 - DNA, 11 bp, Homo sapiens
ggatctccagg

SEQ ID NO: 4265656 - DNA, 17 bp, Homo sapiens
ggatctccaggcccagc

SEQ ID NO: 4265657 - DNA, 18 bp, Homo sapiens
ggatctccaggcccagcc

SEQ ID NO: 4265658 - DNA, 22 bp, Homo sapiens
ggatctccaggcccagcctggc

SEQ ID NO: 4265659 - DNA, 16 bp, Homo sapiens
ggatctgctccatgca

SEQ ID NO: 4265660 - DNA, 19 bp, Homo sapiens
ggatctgctccatgcagat

SEQ ID NO: 4265661 - DNA, 14 bp, Homo sapiens
ggatgcatgcaggg

SEQ ID NO: 4265662 - DNA, 14 bp, Homo sapiens
ggatgcccttcttc

SEQ ID NO: 4265663 - DNA, 17 bp, Homo sapiens
ggatgctgggttctggg

SEQ ID NO: 4265664 - DNA, 22 bp, Homo sapiens
ggatgctgggttctggggctga

SEQ ID NO: 4265665 - DNA, 16 bp, Homo sapiens
ggattcccctggacat

SEQ ID NO: 4265666 - DNA, 15 bp, Homo sapiens
ggattgtccacaaat

SEQ ID NO: 4265667 - DNA, 15 bp, Homo sapiens
ggattttaaatgctg

SEQ ID NO: 4265668 - DNA, 18 bp, Homo sapiens
ggcaacagggcttctctt

SEQ ID NO: 4265669 - DNA, 21 bp, Homo sapiens
ggcaagaggagttctaacaca

SEQ ID NO: 4265670 - DNA, 15 bp, Homo sapiens
ggcaagctggcagga

SEQ ID NO: 4265671 - DNA, 15 bp, Homo sapiens
ggcaatcaatgttca

SEQ ID NO: 4265672 - DNA, 13 bp, Homo sapiens
ggcacagccagaa

SEQ ID NO: 4265673 - DNA, 22 bp, Homo sapiens
ggcacaggctgccccacccctc

SEQ ID NO: 4265674 - DNA, 15 bp, Homo sapiens
ggcagaactgagctc

SEQ ID NO: 4265675 - DNA, 15 bp, Homo sapiens
ggcagaatggtgggc

SEQ ID NO: 4265676 - DNA, 21 bp, Homo sapiens
ggcagaatggtgggctccaga

SEQ ID NO: 4265677 - DNA, 22 bp, Homo sapiens
ggcagaatggtgggctccagag

SEQ ID NO: 4265678 - DNA, 20 bp, Homo sapiens
ggcagagctcagcacagcct

SEQ ID NO: 4265679 - DNA, 14 bp, Homo sapiens
ggcagaggggagag

SEQ ID NO: 4265680 - DNA, 17 bp, Homo sapiens
ggcagaggggagaggaa

SEQ ID NO: 4265681 - DNA, 18 bp, Homo sapiens
ggcagaggggagaggaag

SEQ ID NO: 4265682 - DNA, 20 bp, Homo sapiens
ggcagaggggagaggaagca

SEQ ID NO: 4265683 - DNA, 22 bp, Homo sapiens
ggcagattggttcatgcctggg

SEQ ID NO: 4265684 - DNA, 19 bp, Homo sapiens
ggcagcaacaggaccagga

SEQ ID NO: 4265685 - DNA, 14 bp, Homo sapiens
ggcagccaccctgc

SEQ ID NO: 4265686 - DNA, 15 bp, Homo sapiens
ggcagccaccctgcc

SEQ ID NO: 4265687 - DNA, 18 bp, Homo sapiens
ggcagccaccctgccatg

SEQ ID NO: 4265688 - DNA, 18 bp, Homo sapiens
ggcagccccccagtgtcc

SEQ ID NO: 4265689 - DNA, 11 bp, Homo sapiens
ggcagcccctc

SEQ ID NO: 4265690 - DNA, 19 bp, Homo sapiens
ggcagccgtgccttcagct

SEQ ID NO: 4265691 - DNA, 15 bp, Homo sapiens
ggcagcctcagaggc

SEQ ID NO: 4265692 - DNA, 11 bp, Homo sapiens
ggcagcctgtg

SEQ ID NO: 4265693 - DNA, 16 bp, Homo sapiens
ggcagcctgtgggaga

SEQ ID NO: 4265694 - DNA, 21 bp, Homo sapiens
ggcagctgcagttagcacaga

SEQ ID NO: 4265695 - DNA, 23 bp, Homo sapiens
ggcagctgcagttagcacagagg

SEQ ID NO: 4265696 - DNA, 15 bp, Homo sapiens
ggcagctgccagaga

SEQ ID NO: 4265697 - DNA, 13 bp, Homo sapiens
ggcagctggctct

SEQ ID NO: 4265698 - DNA, 13 bp, Homo sapiens
ggcagcttcaaaa

SEQ ID NO: 4265699 - DNA, 18 bp, Homo sapiens
ggcaggaaccatggacct

SEQ ID NO: 4265700 - DNA, 10 bp, Homo sapiens
ggcaggaagt

SEQ ID NO: 4265701 - DNA, 14 bp, Homo sapiens
ggcaggaagtccct

SEQ ID NO: 4265702 - DNA, 15 bp, Homo sapiens
ggcaggacctcagag

SEQ ID NO: 4265703 - DNA, 14 bp, Homo sapiens
ggcaggagcctaga

SEQ ID NO: 4265704 - DNA, 16 bp, Homo sapiens
ggcaggagggtggcac

SEQ ID NO: 4265705 - DNA, 22 bp, Homo sapiens
ggcaggcagagctcagcacagc

SEQ ID NO: 4265706 - DNA, 20 bp, Homo sapiens
ggcaggcccctttggacctg

SEQ ID NO: 4265707 - DNA, 22 bp, Homo sapiens
ggcaggggctgcatcctcagcc

SEQ ID NO: 4265708 - DNA, 13 bp, Homo sapiens
ggcaggggctggg

SEQ ID NO: 4265709 - DNA, 17 bp, Homo sapiens
ggcaggggctgggcaga

SEQ ID NO: 4265710 - DNA, 17 bp, Homo sapiens
ggcagggttctagaagg

SEQ ID NO: 4265711 - DNA, 18 bp, Homo sapiens
ggcagggttctagaaggg

SEQ ID NO: 4265712 - DNA, 16 bp, Homo sapiens
ggcaggtgaccttctg

SEQ ID NO: 4265713 - DNA, 14 bp, Homo sapiens
ggcagtggagaggg

SEQ ID NO: 4265714 - DNA, 13 bp, Homo sapiens
ggcagtggcagca

SEQ ID NO: 4265715 - DNA, 23 bp, Homo sapiens
ggcagtggcttggagcagaggtg

SEQ ID NO: 4265716 - DNA, 21 bp, Homo sapiens
ggcagtgggacagggcatggc

SEQ ID NO: 4265717 - DNA, 15 bp, Homo sapiens
ggcatcaggaaagga

SEQ ID NO: 4265718 - DNA, 18 bp, Homo sapiens
ggcatccttgaggacctc

SEQ ID NO: 4265719 - DNA, 19 bp, Homo sapiens
ggcatccttgaggacctcc

SEQ ID NO: 4265720 - DNA, 12 bp, Homo sapiens
ggcatctccagg

SEQ ID NO: 4265721 - DNA, 14 bp, Homo sapiens
ggcatctccaggaa

SEQ ID NO: 4265722 - DNA, 15 bp, Homo sapiens
ggcatctggccctgc

SEQ ID NO: 4265723 - DNA, 16 bp, Homo sapiens
ggcatgcctgtgtgac

SEQ ID NO: 4265724 - DNA, 22 bp, Homo sapiens
ggcatggacagggccagggttg

SEQ ID NO: 4265725 - DNA, 18 bp, Homo sapiens
ggcatggggtgggcctct

SEQ ID NO: 4265726 - DNA, 21 bp, Homo sapiens
ggcatggggtgggcctctggt

SEQ ID NO: 4265727 - DNA, 18 bp, Homo sapiens
ggcatttgttccacagga

SEQ ID NO: 4265728 - DNA, 13 bp, Homo sapiens
ggcatttttcttg

SEQ ID NO: 4265729 - DNA, 23 bp, Homo sapiens
ggccaaacaacagtcttcatttt

SEQ ID NO: 4265730 - DNA, 17 bp, Homo sapiens
ggccaagcctgccccgg

SEQ ID NO: 4265731 - DNA, 23 bp, Homo sapiens
ggccacgggggaggccgaggcag

SEQ ID NO: 4265732 - DNA, 11 bp, Homo sapiens
ggccactctgc

SEQ ID NO: 4265733 - DNA, 15 bp, Homo sapiens
ggccactctgtttgc

SEQ ID NO: 4265734 - DNA, 20 bp, Homo sapiens
ggccactctgtttgctcacc

SEQ ID NO: 4265735 - DNA, 22 bp, Homo sapiens
ggccactggcatctctggagtg

SEQ ID NO: 4265736 - DNA, 15 bp, Homo sapiens
ggccagagctcccag

SEQ ID NO: 4265737 - DNA, 20 bp, Homo sapiens
ggccagaggaagggaggcct

SEQ ID NO: 4265738 - DNA, 13 bp, Homo sapiens
ggccagagggccc

SEQ ID NO: 4265739 - DNA, 15 bp, Homo sapiens
ggccagagggcccct

SEQ ID NO: 4265740 - DNA, 14 bp, Homo sapiens
ggccagcccctccc

SEQ ID NO: 4265741 - DNA, 12 bp, Homo sapiens
ggccagctgtgc

SEQ ID NO: 4265742 - DNA, 12 bp, Homo sapiens
ggccagggctct

SEQ ID NO: 4265743 - DNA, 15 bp, Homo sapiens
ggccatgaactttgt

SEQ ID NO: 4265744 - DNA, 22 bp, Homo sapiens
ggccatgagctccagaccccca

SEQ ID NO: 4265745 - DNA, 21 bp, Homo sapiens
ggccatgattcgcccaaagcc

SEQ ID NO: 4265746 - DNA, 19 bp, Homo sapiens
ggcccaccagagcctccct

SEQ ID NO: 4265747 - DNA, 20 bp, Homo sapiens
ggcccagaggggcggggcca

SEQ ID NO: 4265748 - DNA, 13 bp, Homo sapiens
ggcccagccagca

SEQ ID NO: 4265749 - DNA, 15 bp, Homo sapiens
ggcccagccagcagg

SEQ ID NO: 4265750 - DNA, 11 bp, Homo sapiens
ggcccagcctg

SEQ ID NO: 4265751 - DNA, 23 bp, Homo sapiens
ggcccagcctggccccaaatgtt

SEQ ID NO: 4265752 - DNA, 20 bp, Homo sapiens
ggcccagcctgtggcctcag

SEQ ID NO: 4265753 - DNA, 14 bp, Homo sapiens
ggcccatgccctcc

SEQ ID NO: 4265754 - DNA, 21 bp, Homo sapiens
ggccccaaaaccacagccctg

SEQ ID NO: 4265755 - DNA, 18 bp, Homo sapiens
ggccccaaatgttctttc

SEQ ID NO: 4265756 - DNA, 19 bp, Homo sapiens
ggccccacccaccctctgg

SEQ ID NO: 4265757 - DNA, 22 bp, Homo sapiens
ggccccacccaccctctggtcc

SEQ ID NO: 4265758 - DNA, 11 bp, Homo sapiens
ggccccagaga

SEQ ID NO: 4265759 - DNA, 23 bp, Homo sapiens
ggccccagagactcagagggagg

SEQ ID NO: 4265760 - DNA, 19 bp, Homo sapiens
ggccccaggctggatgctg

SEQ ID NO: 4265761 - DNA, 22 bp, Homo sapiens
ggccccaggctggatgctgggt

SEQ ID NO: 4265762 - DNA, 12 bp, Homo sapiens
ggcccccacagg

SEQ ID NO: 4265763 - DNA, 12 bp, Homo sapiens
ggcccccagagc

SEQ ID NO: 4265764 - DNA, 14 bp, Homo sapiens
ggtcctgaggctgg

SEQ ID NO: 4265765 - DNA, 18 bp, Homo sapiens
ggtcctgaggctggggct

SEQ ID NO: 4265766 - DNA, 21 bp, Homo sapiens
ggtcctgggggctgctgcact

SEQ ID NO: 4265767 - DNA, 16 bp, Homo sapiens
ggtcggaggcttggga

SEQ ID NO: 4265768 - DNA, 12 bp, Homo sapiens
ggtctatttctc

SEQ ID NO: 4265769 - DNA, 23 bp, Homo sapiens
ggtctcagaggagggatagagac

SEQ ID NO: 4265770 - DNA, 22 bp, Homo sapiens
ggtctcctgggcatctggccct

SEQ ID NO: 4265771 - DNA, 16 bp, Homo sapiens
ggtctctaggcctgaa

SEQ ID NO: 4265772 - DNA, 17 bp, Homo sapiens
ggtctctaggcctgaac

SEQ ID NO: 4265773 - DNA, 18 bp, Homo sapiens
ggtctgcaccccacagga

SEQ ID NO: 4265774 - DNA, 21 bp, Homo sapiens
ggtctgcaccccacaggatga

SEQ ID NO: 4265775 - DNA, 19 bp, Homo sapiens
ggtctgctgcctcaggaat

SEQ ID NO: 4265776 - DNA, 15 bp, Homo sapiens
ggtctggagccccta

SEQ ID NO: 4265777 - DNA, 15 bp, Homo sapiens
ggtctgggaggcagg

SEQ ID NO: 4265778 - DNA, 16 bp, Homo sapiens
ggtctgggaggcaggt

SEQ ID NO: 4265779 - DNA, 16 bp, Homo sapiens
ggtcttcaagcctggc

SEQ ID NO: 4265780 - DNA, 16 bp, Homo sapiens
ggtcttggagaggagg

SEQ ID NO: 4265781 - DNA, 15 bp, Homo sapiens
ggtctttgtgtgctg

SEQ ID NO: 4265782 - DNA, 13 bp, Homo sapiens
ggtgagactctga

SEQ ID NO: 4265783 - DNA, 13 bp, Homo sapiens
ggtgagccccgcc

SEQ ID NO: 4265784 - DNA, 15 bp, Homo sapiens
ggtgataagtggaaa

SEQ ID NO: 4265785 - DNA, 13 bp, Homo sapiens
ggtgcagtgaaga

SEQ ID NO: 4265786 - DNA, 18 bp, Homo sapiens
ggtgccaaccacctctgg

SEQ ID NO: 4265787 - DNA, 23 bp, Homo sapiens
ggtgccaaccacctctggccctg

SEQ ID NO: 4265788 - DNA, 14 bp, Homo sapiens
ggtgcccaccagct

SEQ ID NO: 4265789 - DNA, 19 bp, Homo sapiens
ggtgcccaccagctggctc

SEQ ID NO: 4265790 - DNA, 18 bp, Homo sapiens
ggtgccccctggggggca

SEQ ID NO: 4265791 - DNA, 13 bp, Homo sapiens
ggtgccctggccc

SEQ ID NO: 4265792 - DNA, 14 bp, Homo sapiens
ggtgccctggccca

SEQ ID NO: 4265793 - DNA, 22 bp, Homo sapiens
ggtgccctggcccagcctgtgg

SEQ ID NO: 4265794 - DNA, 15 bp, Homo sapiens
ggtgcctgagagcag

SEQ ID NO: 4265795 - DNA, 15 bp, Homo sapiens
ggtgctccctcctca

SEQ ID NO: 4265796 - DNA, 19 bp, Homo sapiens
ggtgctgcacccctggtgt

SEQ ID NO: 4265797 - DNA, 21 bp, Homo sapiens
ggtgctgcttccctctgcctg

SEQ ID NO: 4265798 - DNA, 15 bp, Homo sapiens
ggtgcttccctttca

SEQ ID NO: 4265799 - DNA, 14 bp, Homo sapiens
ggtgcttggcagga

SEQ ID NO: 4265800 - DNA, 20 bp, Homo sapiens
ggtggaacaggaggaactgg

SEQ ID NO: 4265801 - DNA, 13 bp, Homo sapiens
ggtggcatcccag

SEQ ID NO: 4265802 - DNA, 21 bp, Homo sapiens
ggtggccactccagacccctg

SEQ ID NO: 4265803 - DNA, 22 bp, Homo sapiens
ggtggccactccagacccctgg

SEQ ID NO: 4265804 - DNA, 23 bp, Homo sapiens
ggtggccactccagacccctggc

SEQ ID NO: 4265805 - DNA, 15 bp, Homo sapiens
ggtggccaggctggt

SEQ ID NO: 4265806 - DNA, 16 bp, Homo sapiens
ggtgggccagcccctc

SEQ ID NO: 4265807 - DNA, 20 bp, Homo sapiens
ggtgggccagcccctcccac

SEQ ID NO: 4265808 - DNA, 12 bp, Homo sapiens
ggtggggcggga

SEQ ID NO: 4265809 - DNA, 16 bp, Homo sapiens
ggtggggcgggaaagc

SEQ ID NO: 4265810 - DNA, 21 bp, Homo sapiens
ggtggtcttcaagcctggccc

SEQ ID NO: 4265811 - DNA, 22 bp, Homo sapiens
ggtggtcttcaagcctggccca

SEQ ID NO: 4265812 - DNA, 20 bp, Homo sapiens
ggtggtcttggagaggaggt

SEQ ID NO: 4265813 - DNA, 23 bp, Homo sapiens
ggtgtatttattttcctccccag

SEQ ID NO: 4265814 - DNA, 19 bp, Homo sapiens
ggtgtccctgcctggccct

SEQ ID NO: 4265815 - DNA, 20 bp, Homo sapiens
ggtgtccctgcctggccctc

SEQ ID NO: 4265816 - DNA, 11 bp, Homo sapiens
ggtgtggcttg

SEQ ID NO: 4265817 - DNA, 15 bp, Homo sapiens
ggtgtgggctcccac

SEQ ID NO: 4265818 - DNA, 23 bp, Homo sapiens
ggtgtgggctcccacgccctcct

SEQ ID NO: 4265819 - DNA, 22 bp, Homo sapiens
ggtgttctggcctctggcctgg

SEQ ID NO: 4265820 - DNA, 14 bp, Homo sapiens
ggtgtttctctgta

SEQ ID NO: 4265821 - DNA, 19 bp, Homo sapiens
ggttaaggggatctaaaag

SEQ ID NO: 4265822 - DNA, 19 bp, Homo sapiens
ggttaataggaggacagaa

SEQ ID NO: 4265823 - DNA, 15 bp, Homo sapiens
ggttcatgcctgggg

SEQ ID NO: 4265824 - DNA, 11 bp, Homo sapiens
ggttccagaca

SEQ ID NO: 4265825 - DNA, 18 bp, Homo sapiens
ggttccagacagagtgga

SEQ ID NO: 4265826 - DNA, 15 bp, Homo sapiens
ggttcccactggctc

SEQ ID NO: 4265827 - DNA, 13 bp, Homo sapiens
ggttcccccagga

SEQ ID NO: 4265828 - DNA, 14 bp, Homo sapiens
ggttccctgcctag

SEQ ID NO: 4265829 - DNA, 21 bp, Homo sapiens
ggttccctgcctaggagctgg

SEQ ID NO: 4265830 - DNA, 16 bp, Homo sapiens
ggttctagaaggggcg

SEQ ID NO: 4265831 - DNA, 18 bp, Homo sapiens
ggttctagaaggggcgag

SEQ ID NO: 4265832 - DNA, 12 bp, Homo sapiens
ggttctccatcc

SEQ ID NO: 4265833 - DNA, 17 bp, Homo sapiens
ggttggccagagggccc

SEQ ID NO: 4265834 - DNA, 14 bp, Homo sapiens
ggttgggctctgcg

SEQ ID NO: 4265835 - DNA, 14 bp, Homo sapiens
ggttgggttccaga

SEQ ID NO: 4265836 - DNA, 20 bp, Homo sapiens
ggttgtcaaaactccactca

SEQ ID NO: 4265837 - DNA, 17 bp, Homo sapiens
ggtttatttttctgtta

SEQ ID NO: 4265838 - DNA, 16 bp, Homo sapiens
ggtttccacacaggcc

SEQ ID NO: 4265839 - DNA, 16 bp, Homo sapiens
ggtttgcctgagggcg

SEQ ID NO: 4265840 - DNA, 17 bp, Homo sapiens
ggtttgggcagtggaga

SEQ ID NO: 4265841 - DNA, 18 bp, Homo sapiens
ggtttggtggccaggctg

SEQ ID NO: 4265842 - DNA, 20 bp, Homo sapiens
ggtttttctgttccctgctg

SEQ ID NO: 4265843 - DNA, 15 bp, Homo sapiens
gtaaaaagagaaggc

SEQ ID NO: 4265844 - DNA, 13 bp, Homo sapiens
gtaaaaccaaagg

SEQ ID NO: 4265845 - DNA, 21 bp, Homo sapiens
gtaaataggtttctaaaaagt

SEQ ID NO: 4265846 - DNA, 23 bp, Homo sapiens
gtaaataggtttctaaaaagtca

SEQ ID NO: 4265847 - DNA, 23 bp, Homo sapiens
gtaaatcaacttgtcacaaagtg

SEQ ID NO: 4265848 - DNA, 14 bp, Homo sapiens
gtaaatttaactgc

SEQ ID NO: 4265849 - DNA, 21 bp, Homo sapiens
gtaaatttaatagataaagtg

SEQ ID NO: 4265850 - DNA, 22 bp, Homo sapiens
gtaacatagatgcctgggcctg

SEQ ID NO: 4265851 - DNA, 18 bp, Homo sapiens
gtaacatgtctaaagtta

SEQ ID NO: 4265852 - DNA, 17 bp, Homo sapiens
gtaacattctatttcaa

SEQ ID NO: 4265853 - DNA, 20 bp, Homo sapiens
gtaactgtccgtagtatcag

SEQ ID NO: 4265854 - DNA, 15 bp, Homo sapiens
gtaagacggccttgg

SEQ ID NO: 4265855 - DNA, 17 bp, Homo sapiens
gtaagatctctttctaa

SEQ ID NO: 4265856 - DNA, 13 bp, Homo sapiens
gtaatagtggctt

SEQ ID NO: 4265857 - DNA, 15 bp, Homo sapiens
gtaatatagaaaaaa

SEQ ID NO: 4265858 - DNA, 17 bp, Homo sapiens
gtaatcatttatcttat

SEQ ID NO: 4265859 - DNA, 24 bp, Homo sapiens
gtaatcatttatcttatctagcaa

SEQ ID NO: 4265860 - DNA, 14 bp, Homo sapiens
gtaatgtatcttat

SEQ ID NO: 4265861 - DNA, 20 bp, Homo sapiens
gtaatgtatcttatttatat

SEQ ID NO: 4265862 - DNA, 17 bp, Homo sapiens
gtaattgttacaatttt

SEQ ID NO: 4265863 - DNA, 18 bp, Homo sapiens
gtacaaagggaagcagag

SEQ ID NO: 4265864 - DNA, 21 bp, Homo sapiens
gtacaagtgctcagttccaat

SEQ ID NO: 4265865 - DNA, 17 bp, Homo sapiens
gtacacccaattttaaa

SEQ ID NO: 4265866 - DNA, 15 bp, Homo sapiens
gtacatatggaaatc

SEQ ID NO: 4265867 - DNA, 21 bp, Homo sapiens
gtacatatggaaatcctgtta

SEQ ID NO: 4265868 - DNA, 14 bp, Homo sapiens
gtaccaactgagcc

SEQ ID NO: 4265869 - DNA, 20 bp, Homo sapiens
gtacctgcccccactcagca

SEQ ID NO: 4265870 - DNA, 21 bp, Homo sapiens
gtacctgcccccactcagcat

SEQ ID NO: 4265871 - DNA, 16 bp, Homo sapiens
gtacgttaattaaaca

SEQ ID NO: 4265872 - DNA, 22 bp, Homo sapiens
gtactaccccaggacgcatgca

SEQ ID NO: 4265873 - DNA, 19 bp, Homo sapiens
gtactatggctgtattttt

SEQ ID NO: 4265874 - DNA, 14 bp, Homo sapiens
gtactcctcccagg

SEQ ID NO: 4265875 - DNA, 18 bp, Homo sapiens
gtactcttgctttttcaa

SEQ ID NO: 4265876 - DNA, 19 bp, Homo sapiens
gtactggtaagattgttat

SEQ ID NO: 4265877 - DNA, 20 bp, Homo sapiens
gtacttgagaataaatgagc

SEQ ID NO: 4265878 - DNA, 23 bp, Homo sapiens
gtacttgccctgaccatgcattt

SEQ ID NO: 4265879 - DNA, 17 bp, Homo sapiens
gtacttgctcaataaag

SEQ ID NO: 4265880 - DNA, 22 bp, Homo sapiens
gtacttgtgaaacacagctgtt

SEQ ID NO: 4265881 - DNA, 12 bp, Homo sapiens
gtagaaaaattt

SEQ ID NO: 4265882 - DNA, 13 bp, Homo sapiens
gtagaaaagctat

SEQ ID NO: 4265883 - DNA, 22 bp, Homo sapiens
gtagaaattttatctcttcttc

SEQ ID NO: 4265884 - DNA, 14 bp, Homo sapiens
gtagaagagggaga

SEQ ID NO: 4265885 - DNA, 15 bp, Homo sapiens
gtagacatctgtcct

SEQ ID NO: 4265886 - DNA, 17 bp, Homo sapiens
gtagactcacggctgca

SEQ ID NO: 4265887 - DNA, 18 bp, Homo sapiens
gtagactcacggctgcac

SEQ ID NO: 4265888 - DNA, 11 bp, Homo sapiens
gtagagaggac

SEQ ID NO: 4265889 - DNA, 13 bp, Homo sapiens
gtagagtgcccat

SEQ ID NO: 4265890 - DNA, 16 bp, Homo sapiens
gtagagtgcccatggg

SEQ ID NO: 4265891 - DNA, 16 bp, Homo sapiens
gtagatagtatgcact

SEQ ID NO: 4265892 - DNA, 21 bp, Homo sapiens
gtagcagggtctttgtgtgct

SEQ ID NO: 4265893 - DNA, 21 bp, Homo sapiens
gtagctagaatatcctatact

SEQ ID NO: 4265894 - DNA, 17 bp, Homo sapiens
gtgttctggcctctggc

SEQ ID NO: 4265895 - DNA, 18 bp, Homo sapiens
gtgttctggcctctggcc

SEQ ID NO: 4265896 - DNA, 15 bp, Homo sapiens
gtgttggaggggcag

SEQ ID NO: 4265897 - DNA, 19 bp, Homo sapiens
gtgttgtccgtgtctgttg

SEQ ID NO: 4265898 - DNA, 13 bp, Homo sapiens
gtgttgttttctc

SEQ ID NO: 4265899 - DNA, 16 bp, Homo sapiens
gtgttgttttctctga

SEQ ID NO: 4265900 - DNA, 16 bp, Homo sapiens
gtgtttatgtgctatt

SEQ ID NO: 4265901 - DNA, 13 bp, Homo sapiens
gtgtttccagtga

SEQ ID NO: 4265902 - DNA, 13 bp, Homo sapiens
gtgttttcttgtg

SEQ ID NO: 4265903 - DNA, 19 bp, Homo sapiens
gttaacaatgcctattgta

SEQ ID NO: 4265904 - DNA, 23 bp, Homo sapiens
gttaacaatgcctattgtaatat

SEQ ID NO: 4265905 - DNA, 19 bp, Homo sapiens
gttaaggggatctaaaagg

SEQ ID NO: 4265906 - DNA, 18 bp, Homo sapiens
gttaagtctatctggtat

SEQ ID NO: 4265907 - DNA, 19 bp, Homo sapiens
gttaatcacttaacctgct

SEQ ID NO: 4265908 - DNA, 20 bp, Homo sapiens
gttaatcacttaacctgctt

SEQ ID NO: 4265909 - DNA, 14 bp, Homo sapiens
gttaatcttcatgg

SEQ ID NO: 4265910 - DNA, 16 bp, Homo sapiens
gttacaggtgtactat

SEQ ID NO: 4265911 - DNA, 22 bp, Homo sapiens
gttactggttggtgttcttccc

SEQ ID NO: 4265912 - DNA, 14 bp, Homo sapiens
gttagcaggaaata

SEQ ID NO: 4265913 - DNA, 15 bp, Homo sapiens
gttaggaacccggca

SEQ ID NO: 4265914 - DNA, 23 bp, Homo sapiens
gttagggaaatccaactccaggg

SEQ ID NO: 4265915 - DNA, 13 bp, Homo sapiens
gttaggggtgggg

SEQ ID NO: 4265916 - DNA, 20 bp, Homo sapiens
gttagtaatctgtataatac

SEQ ID NO: 4265917 - DNA, 18 bp, Homo sapiens
gttatacaaccttcattt

SEQ ID NO: 4265918 - DNA, 14 bp, Homo sapiens
gttatatcatcaat

SEQ ID NO: 4265919 - DNA, 18 bp, Homo sapiens
gttatatcatcaatactt

SEQ ID NO: 4265920 - DNA, 14 bp, Homo sapiens
gttatcactgtgca

SEQ ID NO: 4265921 - DNA, 16 bp, Homo sapiens
gttatcactgtgcagt

SEQ ID NO: 4265922 - DNA, 12 bp, Homo sapiens
gttattaaatgt

SEQ ID NO: 4265923 - DNA, 13 bp, Homo sapiens
gttattaaatgta

SEQ ID NO: 4265924 - DNA, 18 bp, Homo sapiens
gttattatgattagcttt

SEQ ID NO: 4265925 - DNA, 21 bp, Homo sapiens
gttattgggcaagtgattgaa

SEQ ID NO: 4265926 - DNA, 13 bp, Homo sapiens
gttatttttgtct

SEQ ID NO: 4265927 - DNA, 19 bp, Homo sapiens
gttcaaagaacccccctcc

SEQ ID NO: 4265928 - DNA, 22 bp, Homo sapiens
gttcaaagaacccccctcccca

SEQ ID NO: 4265929 - DNA, 18 bp, Homo sapiens
gttcaattggacaattat

SEQ ID NO: 4265930 - DNA, 22 bp, Homo sapiens
gttcaccgtagtaacacataaa

SEQ ID NO: 4265931 - DNA, 15 bp, Homo sapiens
gttcacgcaacttga

SEQ ID NO: 4265932 - DNA, 15 bp, Homo sapiens
gttcatgcctggggt

SEQ ID NO: 4265933 - DNA, 10 bp, Homo sapiens
gttccagaca

SEQ ID NO: 4265934 - DNA, 12 bp, Homo sapiens
gttccagacagg

SEQ ID NO: 4265935 - DNA, 22 bp, Homo sapiens
gttcccaagaaaggaaaccttt

SEQ ID NO: 4265936 - DNA, 14 bp, Homo sapiens
gttcccccagccct

SEQ ID NO: 4265937 - DNA, 20 bp, Homo sapiens
gttcccccagccctgtggaa

SEQ ID NO: 4265938 - DNA, 22 bp, Homo sapiens
gttcccccaggggtgagccccg

SEQ ID NO: 4265939 - DNA, 23 bp, Homo sapiens
gttcccccaggggtgagccccgc

SEQ ID NO: 4265940 - DNA, 15 bp, Homo sapiens
gttcccctgttcact

SEQ ID NO: 4265941 - DNA, 11 bp, Homo sapiens
gttcctccagc

SEQ ID NO: 4265942 - DNA, 18 bp, Homo sapiens
gttcctgcagcagagcct

SEQ ID NO: 4265943 - DNA, 15 bp, Homo sapiens
gttcctggctcagcc

SEQ ID NO: 4265944 - DNA, 20 bp, Homo sapiens
gttcctgggatgtttaatca

SEQ ID NO: 4265945 - DNA, 15 bp, Homo sapiens
gttcctgtgcacagc

SEQ ID NO: 4265946 - DNA, 16 bp, Homo sapiens
gttcctgtgcacagcc

SEQ ID NO: 4265947 - DNA, 23 bp, Homo sapiens
gttccttaagtggctgtgattaa

SEQ ID NO: 4265948 - DNA, 21 bp, Homo sapiens
gttcgtggagccacaggcaga

SEQ ID NO: 4265949 - DNA, 22 bp, Homo sapiens
gttcgtggagccacaggcagac

SEQ ID NO: 4265950 - DNA, 14 bp, Homo sapiens
gttctatttctatc

SEQ ID NO: 4265951 - DNA, 15 bp, Homo sapiens
gttctatttctatct

SEQ ID NO: 4265952 - DNA, 22 bp, Homo sapiens
gttctatttctatctgcaaata

SEQ ID NO: 4265953 - DNA, 14 bp, Homo sapiens
gttctccatcccca

SEQ ID NO: 4265954 - DNA, 14 bp, Homo sapiens
gttctctgcttttc

SEQ ID NO: 4265955 - DNA, 23 bp, Homo sapiens
gttctctgcttttccattctggg

SEQ ID NO: 4265956 - DNA, 15 bp, Homo sapiens
gttctgaataatttc

SEQ ID NO: 4265957 - DNA, 18 bp, Homo sapiens
gttctggcctctggcctg

SEQ ID NO: 4265958 - DNA, 14 bp, Homo sapiens
gttctggggctgag

SEQ ID NO: 4265959 - DNA, 15 bp, Homo sapiens
gttctggggctgaga

SEQ ID NO: 4265960 - DNA, 23 bp, Homo sapiens
gttctggggctgagagtggggct

SEQ ID NO: 4265961 - DNA, 15 bp, Homo sapiens
gttctgtgtctgctg

SEQ ID NO: 4265962 - DNA, 22 bp, Homo sapiens
gttcttagctgaacaatgaatg

SEQ ID NO: 4265963 - DNA, 24 bp, Homo sapiens
gttcttcccaaagcaagcacctgg

SEQ ID NO: 4265964 - DNA, 18 bp, Homo sapiens
gttcttcctcttacctgt

SEQ ID NO: 4265965 - DNA, 18 bp, Homo sapiens
gttcttgcagcagagaga

SEQ ID NO: 4265966 - DNA, 23 bp, Homo sapiens
gttctttcctttcatcctcagca

SEQ ID NO: 4265967 - DNA, 22 bp, Homo sapiens
gttctttttaaaaagttgcaca

SEQ ID NO: 4265968 - DNA, 15 bp, Homo sapiens
gttgacacggccatg

SEQ ID NO: 4265969 - DNA, 14 bp, Homo sapiens
gttgacatgcacag

SEQ ID NO: 4265970 - DNA, 13 bp, Homo sapiens
gttgagtttgctg

SEQ ID NO: 4265971 - DNA, 14 bp, Homo sapiens
gttgagtttgctgt

SEQ ID NO: 4265972 - DNA, 23 bp, Homo sapiens
gttgatattggttctatttattt

SEQ ID NO: 4265973 - DNA, 17 bp, Homo sapiens
gttgcaaattattctag

SEQ ID NO: 4265974 - DNA, 10 bp, Homo sapiens
gttgcacagc

SEQ ID NO: 4265975 - DNA, 19 bp, Homo sapiens
gttgcacagcatctcagct

SEQ ID NO: 4265976 - DNA, 20 bp, Homo sapiens
gttgcctcctcccatccagc

SEQ ID NO: 4265977 - DNA, 19 bp, Homo sapiens
gttgcttacggtttctttg

SEQ ID NO: 4265978 - DNA, 15 bp, Homo sapiens
gttggaactgctgcc

SEQ ID NO: 4265979 - DNA, 17 bp, Homo sapiens
gttggactgtggcctca

SEQ ID NO: 4265980 - DNA, 16 bp, Homo sapiens
gttggaggggcaggcc

SEQ ID NO: 4265981 - DNA, 12 bp, Homo sapiens
gttggcctcagc

SEQ ID NO: 4265982 - DNA, 13 bp, Homo sapiens
gttgggttccaga

SEQ ID NO: 4265983 - DNA, 16 bp, Homo sapiens
gttgggttccagacag

SEQ ID NO: 4265984 - DNA, 19 bp, Homo sapiens
gttgggttccagacagagt

SEQ ID NO: 4265985 - DNA, 22 bp, Homo sapiens
gttgtctgaagtcactgcacag

SEQ ID NO: 4265986 - DNA, 18 bp, Homo sapiens
gttgtgattccccggagc

SEQ ID NO: 4265987 - DNA, 22 bp, Homo sapiens
gttgtgattccccggagctggg

SEQ ID NO: 4265988 - DNA, 20 bp, Homo sapiens
gttgtgtgggtttactctgt

SEQ ID NO: 4265989 - DNA, 15 bp, Homo sapiens
gttgttagtgatttg

SEQ ID NO: 4265990 - DNA, 14 bp, Homo sapiens
gttgtttgatgtgt

SEQ ID NO: 4265991 - DNA, 14 bp, Homo sapiens
gtttaaaaaaataa

SEQ ID NO: 4265992 - DNA, 20 bp, Homo sapiens
gtttaaaaaaataacatctc

SEQ ID NO: 4265993 - DNA, 15 bp, Homo sapiens
gtttaagtagatttc

SEQ ID NO: 4265994 - DNA, 18 bp, Homo sapiens
gtttaagtagatttcatg

SEQ ID NO: 4265995 - DNA, 23 bp, Homo sapiens
gtttaccctccctgtcccctgag

SEQ ID NO: 4265996 - DNA, 17 bp, Homo sapiens
gtttacctcactggtgc

SEQ ID NO: 4265997 - DNA, 12 bp, Homo sapiens
gtttactctgtg

SEQ ID NO: 4265998 - DNA, 21 bp, Homo sapiens
gtttagaatcaagtctgtgaa

SEQ ID NO: 4265999 - DNA, 16 bp, Homo sapiens
gtttagtttgcattta

SEQ ID NO: 4266000 - DNA, 23 bp, Homo sapiens
gtttatgtgctattaatatttgt

SEQ ID NO: 4266001 - DNA, 15 bp, Homo sapiens
gtttcacatatttgt

SEQ ID NO: 4266002 - DNA, 13 bp, Homo sapiens
gtttcagaaaggg

SEQ ID NO: 4266003 - DNA, 24 bp, Homo sapiens
gtttccaagcctgggccactggca

SEQ ID NO: 4266004 - DNA, 23 bp, Homo sapiens
gtttccacacaggcccatgccct

SEQ ID NO: 4266005 - DNA, 11 bp, Homo sapiens
gtttccagtga

SEQ ID NO: 4266006 - DNA, 14 bp, Homo sapiens
gtttccatagttta

SEQ ID NO: 4266007 - DNA, 13 bp, Homo sapiens
gtttctatactgt

SEQ ID NO: 4266008 - DNA, 19 bp, Homo sapiens
gtttctatactgtttgtaa

SEQ ID NO: 4266009 - DNA, 20 bp, Homo sapiens
gtttctgagttcctgcatgc

SEQ ID NO: 4266010 - DNA, 23 bp, Homo sapiens
gtttgaattacagggaagaaatc

SEQ ID NO: 4266011 - DNA, 19 bp, Homo sapiens
gtttgatgtgtatgtgttt

SEQ ID NO: 4266012 - DNA, 17 bp, Homo sapiens
gtttgcaaacaaaatga

SEQ ID NO: 4266013 - DNA, 14 bp, Homo sapiens
gtttgcctgagggc

SEQ ID NO: 4266014 - DNA, 13 bp, Homo sapiens
gtttgctaatgtt

SEQ ID NO: 4266015 - DNA, 20 bp, Homo sapiens
gtttgctaatgtttccatag

SEQ ID NO: 4266016 - DNA, 19 bp, Homo sapiens
gtttgctcacccaggacct

SEQ ID NO: 4266017 - DNA, 22 bp, Homo sapiens
gtttgctcacccaggacctctg

SEQ ID NO: 4266018 - DNA, 19 bp, Homo sapiens
gtttgcttctaaaggtttc

SEQ ID NO: 4266019 - DNA, 20 bp, Homo sapiens
gtttgctttgtatgcacttt

SEQ ID NO: 4266020 - DNA, 14 bp, Homo sapiens
gtttgggcagtgga

SEQ ID NO: 4266021 - DNA, 18 bp, Homo sapiens
gtttgggcagtggagagg

SEQ ID NO: 4266022 - DNA, 16 bp, Homo sapiens
gtttggggcgaggcag

SEQ ID NO: 4266023 - DNA, 13 bp, Homo sapiens
gtttggtggccag

SEQ ID NO: 4266024 - DNA, 23 bp, Homo sapiens
tagtgagtgtggcttagtaatag

SEQ ID NO: 4266025 - DNA, 21 bp, Homo sapiens
tagtgatacactgtatctaaa

SEQ ID NO: 4266026 - DNA, 18 bp, Homo sapiens
tagtgatggttcccctgt

SEQ ID NO: 4266027 - DNA, 22 bp, Homo sapiens
tagtgcctgtgatcgtgtgttg

SEQ ID NO: 4266028 - DNA, 16 bp, Homo sapiens
tagtggcttcagcccc

SEQ ID NO: 4266029 - DNA, 22 bp, Homo sapiens
tagtggcttcagcccctggggt

SEQ ID NO: 4266030 - DNA, 18 bp, Homo sapiens
tagtgtctggatcagtaa

SEQ ID NO: 4266031 - DNA, 12 bp, Homo sapiens
tagtgtctgtcc

SEQ ID NO: 4266032 - DNA, 22 bp, Homo sapiens
tagtgtctgtccatctgtctgt

SEQ ID NO: 4266033 - DNA, 13 bp, Homo sapiens
tagtgtgtccatg

SEQ ID NO: 4266034 - DNA, 15 bp, Homo sapiens
tagttaaattggctt

SEQ ID NO: 4266035 - DNA, 15 bp, Homo sapiens
tagttagcaggaaat

SEQ ID NO: 4266036 - DNA, 14 bp, Homo sapiens
tagttctatttcta

SEQ ID NO: 4266037 - DNA, 14 bp, Homo sapiens
tagttgatgaccaa

SEQ ID NO: 4266038 - DNA, 20 bp, Homo sapiens
tagttgatgaccaatctctg

SEQ ID NO: 4266039 - DNA, 22 bp, Homo sapiens
tagtttcagctgaccagaagtg

SEQ ID NO: 4266040 - DNA, 21 bp, Homo sapiens
tagtttgcatttaagaattgc

SEQ ID NO: 4266041 - DNA, 14 bp, Homo sapiens
tagttttctaaatg

SEQ ID NO: 4266042 - DNA, 14 bp, Homo sapiens
tataaaggaaacac

SEQ ID NO: 4266043 - DNA, 17 bp, Homo sapiens
tataaagttattaatag

SEQ ID NO: 4266044 - DNA, 19 bp, Homo sapiens
tataaatggtgagaattaa

SEQ ID NO: 4266045 - DNA, 20 bp, Homo sapiens
tataaatggtgagaattaaa

SEQ ID NO: 4266046 - DNA, 21 bp, Homo sapiens
tataaatggtgagaattaaaa

SEQ ID NO: 4266047 - DNA, 16 bp, Homo sapiens
tataaatgtgtgtatg

SEQ ID NO: 4266048 - DNA, 17 bp, Homo sapiens
tataacaagccaaacat

SEQ ID NO: 4266049 - DNA, 21 bp, Homo sapiens
tataacaagccaaacattctt

SEQ ID NO: 4266050 - DNA, 23 bp, Homo sapiens
tataagcaacatgaattaagaac

SEQ ID NO: 4266051 - DNA, 21 bp, Homo sapiens
tataatactttgtatacaagt

SEQ ID NO: 4266052 - DNA, 16 bp, Homo sapiens
tataatgtgaaatgta

SEQ ID NO: 4266053 - DNA, 17 bp, Homo sapiens
tataattgttatacatt

SEQ ID NO: 4266054 - DNA, 13 bp, Homo sapiens
tatacaaacaggt

SEQ ID NO: 4266055 - DNA, 22 bp, Homo sapiens
tatacagtttttgtaaccatat

SEQ ID NO: 4266056 - DNA, 14 bp, Homo sapiens
tatacatacctctc

SEQ ID NO: 4266057 - DNA, 16 bp, Homo sapiens
tatacatgtatagtga

SEQ ID NO: 4266058 - DNA, 15 bp, Homo sapiens
tatactcattagaat

SEQ ID NO: 4266059 - DNA, 19 bp, Homo sapiens
tatactgtttgtaatatac

SEQ ID NO: 4266060 - DNA, 16 bp, Homo sapiens
tatagaaaaaaacatt

SEQ ID NO: 4266061 - DNA, 22 bp, Homo sapiens
tatagttaattgtggctttatg

SEQ ID NO: 4266062 - DNA, 21 bp, Homo sapiens
tatagtttgttttctttttct

SEQ ID NO: 4266063 - DNA, 13 bp, Homo sapiens
tatataataaatt

SEQ ID NO: 4266064 - DNA, 15 bp, Homo sapiens
tatataatacttaaa

SEQ ID NO: 4266065 - DNA, 21 bp, Homo sapiens
tatataatacttaaaaatatg

SEQ ID NO: 4266066 - DNA, 13 bp, Homo sapiens
tatatacatgtat

SEQ ID NO: 4266067 - DNA, 23 bp, Homo sapiens
tatatatgaagtaagttctgaaa

SEQ ID NO: 4266068 - DNA, 11 bp, Homo sapiens
tatatatgtac

SEQ ID NO: 4266069 - DNA, 13 bp, Homo sapiens
tatatatgtacag

SEQ ID NO: 4266070 - DNA, 21 bp, Homo sapiens
tatatatgtacagttatacat

SEQ ID NO: 4266071 - DNA, 20 bp, Homo sapiens
tatatatttatcatatttaa

SEQ ID NO: 4266072 - DNA, 21 bp, Homo sapiens
tatatcagactgctttgagaa

SEQ ID NO: 4266073 - DNA, 17 bp, Homo sapiens
tatatcgttatcactgt

SEQ ID NO: 4266074 - DNA, 20 bp, Homo sapiens
tatatcgttatcactgtgca

SEQ ID NO: 4266075 - DNA, 16 bp, Homo sapiens
tatatctgaaaactgg

SEQ ID NO: 4266076 - DNA, 14 bp, Homo sapiens
tatatctgtaaatt

SEQ ID NO: 4266077 - DNA, 21 bp, Homo sapiens
tatatctgtaaatttaactgc

SEQ ID NO: 4266078 - DNA, 14 bp, Homo sapiens
tatatgaaaactaa

SEQ ID NO: 4266079 - DNA, 20 bp, Homo sapiens
tatatgaataattatgttta

SEQ ID NO: 4266080 - DNA, 20 bp, Homo sapiens
tatatgtacagttatacata

SEQ ID NO: 4266081 - DNA, 12 bp, Homo sapiens
tatattatatat

SEQ ID NO: 4266082 - DNA, 17 bp, Homo sapiens
tatattcagagatgtac

SEQ ID NO: 4266083 - DNA, 21 bp, Homo sapiens
tatattcagagatgtaccatg

SEQ ID NO: 4266084 - DNA, 13 bp, Homo sapiens
tatatttcatatt

SEQ ID NO: 4266085 - DNA, 16 bp, Homo sapiens
tatatttccacttctt

SEQ ID NO: 4266086 - DNA, 14 bp, Homo sapiens
tatattttatcttg

SEQ ID NO: 4266087 - DNA, 18 bp, Homo sapiens
tatcaagtcccgaggcag

SEQ ID NO: 4266088 - DNA, 19 bp, Homo sapiens
tatcaagtcccgaggcagc

SEQ ID NO: 4266089 - DNA, 13 bp, Homo sapiens
tatcacctcccct

SEQ ID NO: 4266090 - DNA, 14 bp, Homo sapiens
tatcacctcccctc

SEQ ID NO: 4266091 - DNA, 14 bp, Homo sapiens
tatcagagatgtcc

SEQ ID NO: 4266092 - DNA, 17 bp, Homo sapiens
tatcagagtatgtcagt

SEQ ID NO: 4266093 - DNA, 15 bp, Homo sapiens
tatcagttacacatg

SEQ ID NO: 4266094 - DNA, 13 bp, Homo sapiens
tatcagtttgcta

SEQ ID NO: 4266095 - DNA, 18 bp, Homo sapiens
tatcatcacgtatgttat

SEQ ID NO: 4266096 - DNA, 13 bp, Homo sapiens
tatcatgtgtttc

SEQ ID NO: 4266097 - DNA, 24 bp, Homo sapiens
tatccctgatttattctggtgtct

SEQ ID NO: 4266098 - DNA, 13 bp, Homo sapiens
tatcctgcaccct

SEQ ID NO: 4266099 - DNA, 15 bp, Homo sapiens
tatcctggtgtctag

SEQ ID NO: 4266100 - DNA, 18 bp, Homo sapiens
tatcctggtgtctagttt

SEQ ID NO: 4266101 - DNA, 20 bp, Homo sapiens
tatcctggtgtctagtttgc

SEQ ID NO: 4266102 - DNA, 18 bp, Homo sapiens
tatcctgttaggggaaaa

SEQ ID NO: 4266103 - DNA, 18 bp, Homo sapiens
tatcgttatcactgtgca

SEQ ID NO: 4266104 - DNA, 19 bp, Homo sapiens
tatctagcaagaagattct

SEQ ID NO: 4266105 - DNA, 22 bp, Homo sapiens
tatctagcaagaagattctaaa

SEQ ID NO: 4266106 - DNA, 21 bp, Homo sapiens
tatctatttatctgtctgagc

SEQ ID NO: 4266107 - DNA, 15 bp, Homo sapiens
tatctcgaagtcttc

SEQ ID NO: 4266108 - DNA, 21 bp, Homo sapiens
tatctgcaaatagtttcaaat

SEQ ID NO: 4266109 - DNA, 22 bp, Homo sapiens
tatctgcaaatagtttcaaatg

SEQ ID NO: 4266110 - DNA, 18 bp, Homo sapiens
tatctgctgcctctgaaa

SEQ ID NO: 4266111 - DNA, 20 bp, Homo sapiens
tatctgctgcctctgaaaat

SEQ ID NO: 4266112 - DNA, 21 bp, Homo sapiens
tatctgggggactagaacaca

SEQ ID NO: 4266113 - DNA, 17 bp, Homo sapiens
tatctgtctgagccctg

SEQ ID NO: 4266114 - DNA, 17 bp, Homo sapiens
tatctgtgaaatatcat

SEQ ID NO: 4266115 - DNA, 14 bp, Homo sapiens
tatcttactttcct

SEQ ID NO: 4266116 - DNA, 17 bp, Homo sapiens
tatcttatttatatatg

SEQ ID NO: 4266117 - DNA, 14 bp, Homo sapiens
tatcttcatgtaaa

SEQ ID NO: 4266118 - DNA, 13 bp, Homo sapiens
tatcttgaagaat

SEQ ID NO: 4266119 - DNA, 16 bp, Homo sapiens
tatctttcagttatta

SEQ ID NO: 4266120 - DNA, 16 bp, Homo sapiens
tatgaaatatatgtga

SEQ ID NO: 4266121 - DNA, 17 bp, Homo sapiens
tatgaataattatgttt

SEQ ID NO: 4266122 - DNA, 18 bp, Homo sapiens
tatgaataattatgttta

SEQ ID NO: 4266123 - DNA, 19 bp, Homo sapiens
tatgaataattatgtttac

SEQ ID NO: 4266124 - DNA, 15 bp, Homo sapiens
tatgacaatttcaaa

SEQ ID NO: 4266125 - DNA, 21 bp, Homo sapiens
tatgacaatttcaaaatgcat

SEQ ID NO: 4266126 - DNA, 22 bp, Homo sapiens
tatgacaatttcaaaatgcatg

SEQ ID NO: 4266127 - DNA, 21 bp, Homo sapiens
tatgacctaaatccattttct

SEQ ID NO: 4266128 - DNA, 14 bp, Homo sapiens
tatgagatactttg

SEQ ID NO: 4266129 - DNA, 15 bp, Homo sapiens
tatgagctcttcatg

SEQ ID NO: 4266130 - DNA, 22 bp, Homo sapiens
tatgaggggactgcatgcaagc

SEQ ID NO: 4266131 - DNA, 16 bp, Homo sapiens
tatgattctcctctcc

SEQ ID NO: 4266132 - DNA, 14 bp, Homo sapiens
tatgattgaaaaga

SEQ ID NO: 4266133 - DNA, 20 bp, Homo sapiens
tatgccacctgcagcgtctg

SEQ ID NO: 4266134 - DNA, 16 bp, Homo sapiens
tatgccagtgactgct

SEQ ID NO: 4266135 - DNA, 22 bp, Homo sapiens
tatgccagtgactgctgcgctg

SEQ ID NO: 4266136 - DNA, 11 bp, Homo sapiens
tatgctgctgt

SEQ ID NO: 4266137 - DNA, 16 bp, Homo sapiens
tatggaaagggtgtgg

SEQ ID NO: 4266138 - DNA, 23 bp, Homo sapiens
tatggaaagggtgtggcttggaa

SEQ ID NO: 4266139 - DNA, 15 bp, Homo sapiens
tatggaaatcctgtt

SEQ ID NO: 4266140 - DNA, 23 bp, Homo sapiens
tatggaggagagtgtttaactga

SEQ ID NO: 4266141 - DNA, 20 bp, Homo sapiens
tatggctgtatttttagaga

SEQ ID NO: 4266142 - DNA, 14 bp, Homo sapiens
tatggctttgtgct

SEQ ID NO: 4266143 - DNA, 15 bp, Homo sapiens
tatggctttgtgctt

SEQ ID NO: 4266144 - DNA, 17 bp, Homo sapiens
tatggctttgtgcttgt

SEQ ID NO: 4266145 - DNA, 18 bp, Homo sapiens
tatgggtcattctcacct

SEQ ID NO: 4266146 - DNA, 16 bp, Homo sapiens
tatggtagaaaaattt

SEQ ID NO: 4266147 - DNA, 14 bp, Homo sapiens
tatgtaacatgtct

SEQ ID NO: 4266148 - DNA, 16 bp, Homo sapiens
tatgtcatactctgtg

SEQ ID NO: 4266149 - DNA, 16 bp, Homo sapiens
tatgtcatttcatttc

SEQ ID NO: 4266150 - DNA, 18 bp, Homo sapiens
tatgtcctgtgagatgtg

SEQ ID NO: 4266151 - DNA, 20 bp, Homo sapiens
tatgtcctgtgagatgtgta

SEQ ID NO: 4266152 - DNA, 22 bp, Homo sapiens
tatgtcctgtgagatgtgtatc

SEQ ID NO: 4266153 - DNA, 12 bp, Homo sapiens
tatgtctgtgat

SEQ ID NO: 4266154 - DNA, 13 bp, Homo sapiens
tcaccaaaaaatc

SEQ ID NO: 4266155 - DNA, 12 bp, Homo sapiens
tcaccaaaatat

SEQ ID NO: 4266156 - DNA, 21 bp, Homo sapiens
tcacccagcacccatgcccca

SEQ ID NO: 4266157 - DNA, 13 bp, Homo sapiens
tcacccagcctgg

SEQ ID NO: 4266158 - DNA, 15 bp, Homo sapiens
tcacccctcttccca

SEQ ID NO: 4266159 - DNA, 18 bp, Homo sapiens
tcacccctcttcccacca

SEQ ID NO: 4266160 - DNA, 16 bp, Homo sapiens
tcacctaattaatttc

SEQ ID NO: 4266161 - DNA, 15 bp, Homo sapiens
tcacctcccctcctt

SEQ ID NO: 4266162 - DNA, 12 bp, Homo sapiens
tcacctcctaat

SEQ ID NO: 4266163 - DNA, 20 bp, Homo sapiens
tcacctgctggcccctcacc

SEQ ID NO: 4266164 - DNA, 20 bp, Homo sapiens
tcacctggcttcccaggacc

SEQ ID NO: 4266165 - DNA, 23 bp, Homo sapiens
tcacctggcttcccaggaccctg

SEQ ID NO: 4266166 - DNA, 14 bp, Homo sapiens
tcacctgggcacct

SEQ ID NO: 4266167 - DNA, 20 bp, Homo sapiens
tcaccttcctgggcagccca

SEQ ID NO: 4266168 - DNA, 20 bp, Homo sapiens
tcaccttctgttttagagtt

SEQ ID NO: 4266169 - DNA, 19 bp, Homo sapiens
tcaccttgcaacacacaga

SEQ ID NO: 4266170 - DNA, 13 bp, Homo sapiens
tcacggctgcacc

SEQ ID NO: 4266171 - DNA, 12 bp, Homo sapiens
tcactcataaag

SEQ ID NO: 4266172 - DNA, 16 bp, Homo sapiens
tcactccactcccctc

SEQ ID NO: 4266173 - DNA, 17 bp, Homo sapiens
tcactccactcccctca

SEQ ID NO: 4266174 - DNA, 20 bp, Homo sapiens
tcactccactcccctcatcc

SEQ ID NO: 4266175 - DNA, 15 bp, Homo sapiens
tcactccctgtcata

SEQ ID NO: 4266176 - DNA, 16 bp, Homo sapiens
tcactctggcagcctc

SEQ ID NO: 4266177 - DNA, 15 bp, Homo sapiens
tcactgaagtgaata

SEQ ID NO: 4266178 - DNA, 19 bp, Homo sapiens
tcactgaagtgaatacatg

SEQ ID NO: 4266179 - DNA, 21 bp, Homo sapiens
tcactgaagtgaatacatggt

SEQ ID NO: 4266180 - DNA, 23 bp, Homo sapiens
tcactgaataatggaattatgta

SEQ ID NO: 4266181 - DNA, 15 bp, Homo sapiens
tcactgcacagtgca

SEQ ID NO: 4266182 - DNA, 17 bp, Homo sapiens
tcactgcctttttttct

SEQ ID NO: 4266183 - DNA, 14 bp, Homo sapiens
tcactgctggctgc

SEQ ID NO: 4266184 - DNA, 18 bp, Homo sapiens
tcactgctggctgcctta

SEQ ID NO: 4266185 - DNA, 14 bp, Homo sapiens
tcactggctggact

SEQ ID NO: 4266186 - DNA, 23 bp, Homo sapiens
tcacttaaaatcaaatttttctg

SEQ ID NO: 4266187 - DNA, 17 bp, Homo sapiens
tcacttcaaacatgccc

SEQ ID NO: 4266188 - DNA, 18 bp, Homo sapiens
tcacttcaaacatgccct

SEQ ID NO: 4266189 - DNA, 13 bp, Homo sapiens
tcacttgtgtttg

SEQ ID NO: 4266190 - DNA, 16 bp, Homo sapiens
tcactttaataataaa

SEQ ID NO: 4266191 - DNA, 19 bp, Homo sapiens
tcactttgacacttttcat

SEQ ID NO: 4266192 - DNA, 16 bp, Homo sapiens
tcagaaacaatttctg

SEQ ID NO: 4266193 - DNA, 18 bp, Homo sapiens
tcagaaagcatctattcc

SEQ ID NO: 4266194 - DNA, 21 bp, Homo sapiens
tcagaaagcatctattcccaa

SEQ ID NO: 4266195 - DNA, 21 bp, Homo sapiens
tcagaaagggcagcccctccc

SEQ ID NO: 4266196 - DNA, 19 bp, Homo sapiens
tcagaatcaaatctgagcc

SEQ ID NO: 4266197 - DNA, 22 bp, Homo sapiens
tcagaatggaagagagaaagca

SEQ ID NO: 4266198 - DNA, 21 bp, Homo sapiens
tcagacctttgtctgaaggat

SEQ ID NO: 4266199 - DNA, 16 bp, Homo sapiens
tcagactctctcctct

SEQ ID NO: 4266200 - DNA, 17 bp, Homo sapiens
tcagactctctcctctc

SEQ ID NO: 4266201 - DNA, 15 bp, Homo sapiens
tcagacttacttact

SEQ ID NO: 4266202 - DNA, 14 bp, Homo sapiens
tcagagatgtacca

SEQ ID NO: 4266203 - DNA, 19 bp, Homo sapiens
tcagagatgtccattttta

SEQ ID NO: 4266204 - DNA, 15 bp, Homo sapiens
tcagagctgggaggg

SEQ ID NO: 4266205 - DNA, 14 bp, Homo sapiens
tcagaggtatctta

SEQ ID NO: 4266206 - DNA, 22 bp, Homo sapiens
tcagatgctggtcatcctgggc

SEQ ID NO: 4266207 - DNA, 18 bp, Homo sapiens
tcagcaagacaatgacac

SEQ ID NO: 4266208 - DNA, 22 bp, Homo sapiens
tcagcacagcctcacccctgca

SEQ ID NO: 4266209 - DNA, 23 bp, Homo sapiens
tcagcaggggggttgggttccag

SEQ ID NO: 4266210 - DNA, 15 bp, Homo sapiens
tcagcattcaaaata

SEQ ID NO: 4266211 - DNA, 16 bp, Homo sapiens
tcagcattcaaaatag

SEQ ID NO: 4266212 - DNA, 21 bp, Homo sapiens
tcagccacgcctctctcagcc

SEQ ID NO: 4266213 - DNA, 22 bp, Homo sapiens
tcagccacgcctctctcagccc

SEQ ID NO: 4266214 - DNA, 12 bp, Homo sapiens
tcagcccacccc

SEQ ID NO: 4266215 - DNA, 17 bp, Homo sapiens
tcagcccacccccctca

SEQ ID NO: 4266216 - DNA, 13 bp, Homo sapiens
tcagcccaggtct

SEQ ID NO: 4266217 - DNA, 17 bp, Homo sapiens
tcagccccagggccctg

SEQ ID NO: 4266218 - DNA, 23 bp, Homo sapiens
tcagccccagggccctgctcagg

SEQ ID NO: 4266219 - DNA, 12 bp, Homo sapiens
tcagcccctctt

SEQ ID NO: 4266220 - DNA, 22 bp, Homo sapiens
tcagcccctcttgccccccacc

SEQ ID NO: 4266221 - DNA, 23 bp, Homo sapiens
tcagcccctcttgccccccaccc

SEQ ID NO: 4266222 - DNA, 19 bp, Homo sapiens
tcagccctccctgcccctc

SEQ ID NO: 4266223 - DNA, 18 bp, Homo sapiens
tcagcctccactccctgt

SEQ ID NO: 4266224 - DNA, 13 bp, Homo sapiens
tcagcggcctggg

SEQ ID NO: 4266225 - DNA, 14 bp, Homo sapiens
tcagcttgaatgtc

SEQ ID NO: 4266226 - DNA, 15 bp, Homo sapiens
tcagctttgccttcc

SEQ ID NO: 4266227 - DNA, 16 bp, Homo sapiens
tcaggaatgggccaag

SEQ ID NO: 4266228 - DNA, 14 bp, Homo sapiens
tcaggaccccatct

SEQ ID NO: 4266229 - DNA, 20 bp, Homo sapiens
tcaggaccccatctgctgag

SEQ ID NO: 4266230 - DNA, 22 bp, Homo sapiens
tcaggagaaggcctgcccccct

SEQ ID NO: 4266231 - DNA, 20 bp, Homo sapiens
tcaggagagagttgaaccta

SEQ ID NO: 4266232 - DNA, 20 bp, Homo sapiens
tcaggagagccctctgctgc

SEQ ID NO: 4266233 - DNA, 18 bp, Homo sapiens
tcaggaggagacagtcag

SEQ ID NO: 4266234 - DNA, 19 bp, Homo sapiens
tcaggaggagacagtcagg

SEQ ID NO: 4266235 - DNA, 19 bp, Homo sapiens
tcaggaggcagtggcttgg

SEQ ID NO: 4266236 - DNA, 15 bp, Homo sapiens
tcaggaggtgcctga

SEQ ID NO: 4266237 - DNA, 21 bp, Homo sapiens
tcaggaggtgcctgagagcag

SEQ ID NO: 4266238 - DNA, 14 bp, Homo sapiens
tcaggcagcctgtg

SEQ ID NO: 4266239 - DNA, 17 bp, Homo sapiens
tcaggcagtggcccagg

SEQ ID NO: 4266240 - DNA, 21 bp, Homo sapiens
tcaggccacctgcccccttct

SEQ ID NO: 4266241 - DNA, 23 bp, Homo sapiens
tcaggcctcacctggcttcccag

SEQ ID NO: 4266242 - DNA, 14 bp, Homo sapiens
tcaggcctggccct

SEQ ID NO: 4266243 - DNA, 15 bp, Homo sapiens
tcaggcctggccctt

SEQ ID NO: 4266244 - DNA, 15 bp, Homo sapiens
tcaggctcttctcct

SEQ ID NO: 4266245 - DNA, 18 bp, Homo sapiens
tcaggcttggggatgccc

SEQ ID NO: 4266246 - DNA, 19 bp, Homo sapiens
tcagggaccaaggagatgg

SEQ ID NO: 4266247 - DNA, 19 bp, Homo sapiens
tcagggagcactggaggcc

SEQ ID NO: 4266248 - DNA, 20 bp, Homo sapiens
tcagggagcactggaggcct

SEQ ID NO: 4266249 - DNA, 14 bp, Homo sapiens
tcagggagccctgg

SEQ ID NO: 4266250 - DNA, 15 bp, Homo sapiens
tcagggagccctggg

SEQ ID NO: 4266251 - DNA, 15 bp, Homo sapiens
tcagggcccctgaag

SEQ ID NO: 4266252 - DNA, 16 bp, Homo sapiens
tcagggcccctgaagt

SEQ ID NO: 4266253 - DNA, 18 bp, Homo sapiens
tcaggggagacttaggcc

SEQ ID NO: 4266254 - DNA, 22 bp, Homo sapiens
tcagggtgctccctcctcagtc

SEQ ID NO: 4266255 - DNA, 18 bp, Homo sapiens
tcaggtggaacaggagga

SEQ ID NO: 4266256 - DNA, 17 bp, Homo sapiens
tcaggtttgcctgaggg

SEQ ID NO: 4266257 - DNA, 13 bp, Homo sapiens
tcaggtttggggt

SEQ ID NO: 4266258 - DNA, 20 bp, Homo sapiens
tcagtaaaattatactgtgt

SEQ ID NO: 4266259 - DNA, 23 bp, Homo sapiens
tcagtaaaattatactgtgtgtg

SEQ ID NO: 4266260 - DNA, 17 bp, Homo sapiens
tcagtccctccctcctg

SEQ ID NO: 4266261 - DNA, 20 bp, Homo sapiens
tcagtccctccctcctggct

SEQ ID NO: 4266262 - DNA, 15 bp, Homo sapiens
tcagtctttggggga

SEQ ID NO: 4266263 - DNA, 21 bp, Homo sapiens
tcagtctttgggggattcaaa

SEQ ID NO: 4266264 - DNA, 19 bp, Homo sapiens
tcagtgaagcccaggagga

SEQ ID NO: 4266265 - DNA, 23 bp, Homo sapiens
tcagtgaagcccaggaggacctg

SEQ ID NO: 4266266 - DNA, 12 bp, Homo sapiens
tcagtgatggga

SEQ ID NO: 4266267 - DNA, 15 bp, Homo sapiens
tcagtgatgggagta

SEQ ID NO: 4266268 - DNA, 20 bp, Homo sapiens
tcagtgcagccccctcctga

SEQ ID NO: 4266269 - DNA, 15 bp, Homo sapiens
tcagtgcagcccgtg

SEQ ID NO: 4266270 - DNA, 23 bp, Homo sapiens
tcagtgcagcccgtgtggcccct

SEQ ID NO: 4266271 - DNA, 21 bp, Homo sapiens
tcagtggactttccaccccct

SEQ ID NO: 4266272 - DNA, 13 bp, Homo sapiens
tcagtgtgccacc

SEQ ID NO: 4266273 - DNA, 19 bp, Homo sapiens
tcagtgtgccaccctctgc

SEQ ID NO: 4266274 - DNA, 22 bp, Homo sapiens
tcagtgtgccaccctctgcagg

SEQ ID NO: 4266275 - DNA, 22 bp, Homo sapiens
tcagttaggattaggtttagaa

SEQ ID NO: 4266276 - DNA, 18 bp, Homo sapiens
tcagttcaatcaaacttt

SEQ ID NO: 4266277 - DNA, 21 bp, Homo sapiens
tcataaacaacttaatgttct

SEQ ID NO: 4266278 - DNA, 22 bp, Homo sapiens
tcataaagtgagaaaactgtga

SEQ ID NO: 4266279 - DNA, 17 bp, Homo sapiens
tcataaattatttctaa

SEQ ID NO: 4266280 - DNA, 24 bp, Homo sapiens
tcataaattcaaacctaagttgct

SEQ ID NO: 4266281 - DNA, 17 bp, Homo sapiens
tcataacaatgtatgtg

SEQ ID NO: 4266282 - DNA, 21 bp, Homo sapiens
tcatacaaaggacagtacaca

SEQ ID NO: 4266283 - DNA, 18 bp, Homo sapiens
tcgttagtaatctgtata

SEQ ID NO: 4266284 - DNA, 14 bp, Homo sapiens
tcgttcccccaggg

SEQ ID NO: 4266285 - DNA, 14 bp, Homo sapiens
tctaaaattctagt

SEQ ID NO: 4266286 - DNA, 15 bp, Homo sapiens
tctaaaattctagtc

SEQ ID NO: 4266287 - DNA, 23 bp, Homo sapiens
tctaaaattgagttcttcctgta

SEQ ID NO: 4266288 - DNA, 13 bp, Homo sapiens
tctaaactgtttt

SEQ ID NO: 4266289 - DNA, 18 bp, Homo sapiens
tctaaactgttttcatgt

SEQ ID NO: 4266290 - DNA, 14 bp, Homo sapiens
tctaaatgtttctt

SEQ ID NO: 4266291 - DNA, 20 bp, Homo sapiens
tctaaatgtttctttttctt

SEQ ID NO: 4266292 - DNA, 22 bp, Homo sapiens
tctaagaaatatctgtgaaata

SEQ ID NO: 4266293 - DNA, 23 bp, Homo sapiens
tctaagaaatatctgtgaaatat

SEQ ID NO: 4266294 - DNA, 14 bp, Homo sapiens
tctaagcttatttc

SEQ ID NO: 4266295 - DNA, 20 bp, Homo sapiens
tctaagcttatttctaacta

SEQ ID NO: 4266296 - DNA, 15 bp, Homo sapiens
tctaagtcagtttca

SEQ ID NO: 4266297 - DNA, 17 bp, Homo sapiens
tctaagtcagtttcaca

SEQ ID NO: 4266298 - DNA, 23 bp, Homo sapiens
tctaagtcagtttcacatatttg

SEQ ID NO: 4266299 - DNA, 16 bp, Homo sapiens
tctaatccatgtgctg

SEQ ID NO: 4266300 - DNA, 16 bp, Homo sapiens
tctaattctcttttca

SEQ ID NO: 4266301 - DNA, 13 bp, Homo sapiens
tctacactgtgaa

SEQ ID NO: 4266302 - DNA, 12 bp, Homo sapiens
tctacagaaaaa

SEQ ID NO: 4266303 - DNA, 16 bp, Homo sapiens
tctacctgcaggactc

SEQ ID NO: 4266304 - DNA, 20 bp, Homo sapiens
tctagaagagtctattgtct

SEQ ID NO: 4266305 - DNA, 17 bp, Homo sapiens
tctagacaaccctgcaa

SEQ ID NO: 4266306 - DNA, 22 bp, Homo sapiens
tctagagagggaattctcttgg

SEQ ID NO: 4266307 - DNA, 13 bp, Homo sapiens
tctagcaactgtt

SEQ ID NO: 4266308 - DNA, 21 bp, Homo sapiens
tctagcaactgttggataata

SEQ ID NO: 4266309 - DNA, 17 bp, Homo sapiens
tctagcaagaagattct

SEQ ID NO: 4266310 - DNA, 18 bp, Homo sapiens
tctagcaagaagattcta

SEQ ID NO: 4266311 - DNA, 13 bp, Homo sapiens
tctagccaggcct

SEQ ID NO: 4266312 - DNA, 14 bp, Homo sapiens
tctagccaggcctc

SEQ ID NO: 4266313 - DNA, 11 bp, Homo sapiens
tctaggcctga

SEQ ID NO: 4266314 - DNA, 23 bp, Homo sapiens
tctaggcctgaactaggtgctgg

SEQ ID NO: 4266315 - DNA, 18 bp, Homo sapiens
tctagtcaactgctgttt

SEQ ID NO: 4266316 - DNA, 21 bp, Homo sapiens
tctagtcaactgctgttttat

SEQ ID NO: 4266317 - DNA, 16 bp, Homo sapiens
tctagtcctattctat

SEQ ID NO: 4266318 - DNA, 17 bp, Homo sapiens
tctagttagcaggaaat

SEQ ID NO: 4266319 - DNA, 18 bp, Homo sapiens
tctagttagcaggaaata

SEQ ID NO: 4266320 - DNA, 16 bp, Homo sapiens
tctatactgtttgtaa

SEQ ID NO: 4266321 - DNA, 16 bp, Homo sapiens
tctatagtttgattct

SEQ ID NO: 4266322 - DNA, 20 bp, Homo sapiens
tctatagtttgattctgagt

SEQ ID NO: 4266323 - DNA, 22 bp, Homo sapiens
tctatatatacatgtatagtga

SEQ ID NO: 4266324 - DNA, 14 bp, Homo sapiens
tctatgcattttct

SEQ ID NO: 4266325 - DNA, 23 bp, Homo sapiens
tctattgcagttatagaaaatct

SEQ ID NO: 4266326 - DNA, 15 bp, Homo sapiens
tctattgtagcattt

SEQ ID NO: 4266327 - DNA, 19 bp, Homo sapiens
tctattgtagcatttcttg

SEQ ID NO: 4266328 - DNA, 13 bp, Homo sapiens
tctatttctatct

SEQ ID NO: 4266329 - DNA, 16 bp, Homo sapiens
tctattttgtctgata

SEQ ID NO: 4266330 - DNA, 16 bp, Homo sapiens
tctattttttactaca

SEQ ID NO: 4266331 - DNA, 22 bp, Homo sapiens
tctcaaagtttttacagtgtat

SEQ ID NO: 4266332 - DNA, 13 bp, Homo sapiens
tctcaatgaaata

SEQ ID NO: 4266333 - DNA, 16 bp, Homo sapiens
tctcaatgcttttcta

SEQ ID NO: 4266334 - DNA, 15 bp, Homo sapiens
tctcacaaataagta

SEQ ID NO: 4266335 - DNA, 17 bp, Homo sapiens
tctcactcctacctggt

SEQ ID NO: 4266336 - DNA, 13 bp, Homo sapiens
tctcactgtgtcc

SEQ ID NO: 4266337 - DNA, 18 bp, Homo sapiens
tctcagagctccacagaa

SEQ ID NO: 4266338 - DNA, 14 bp, Homo sapiens
tctcagatgggctg

SEQ ID NO: 4266339 - DNA, 13 bp, Homo sapiens
tctcagcactttg

SEQ ID NO: 4266340 - DNA, 13 bp, Homo sapiens
tctcagcccaggt

SEQ ID NO: 4266341 - DNA, 21 bp, Homo sapiens
tctcagcctccggatgacaca

SEQ ID NO: 4266342 - DNA, 20 bp, Homo sapiens
tctcagctcatcttcactgc

SEQ ID NO: 4266343 - DNA, 21 bp, Homo sapiens
tctcaggcatgcctgtgtgac

SEQ ID NO: 4266344 - DNA, 15 bp, Homo sapiens
tctcatcatgtctat

SEQ ID NO: 4266345 - DNA, 20 bp, Homo sapiens
tctcatgcactgcaaatact

SEQ ID NO: 4266346 - DNA, 15 bp, Homo sapiens
tctcatgcctgagaa

SEQ ID NO: 4266347 - DNA, 14 bp, Homo sapiens
tctccacccctcaa

SEQ ID NO: 4266348 - DNA, 20 bp, Homo sapiens
tctccacccctcaagccagg

SEQ ID NO: 4266349 - DNA, 13 bp, Homo sapiens
tctccacctcagg

SEQ ID NO: 4266350 - DNA, 17 bp, Homo sapiens
tctccacctgaagtgat

SEQ ID NO: 4266351 - DNA, 15 bp, Homo sapiens
tctccagacccccac

SEQ ID NO: 4266352 - DNA, 18 bp, Homo sapiens
tctccaggaaggcggggc

SEQ ID NO: 4266353 - DNA, 12 bp, Homo sapiens
tctccaggccca

SEQ ID NO: 4266354 - DNA, 14 bp, Homo sapiens
tctccaggcccagc

SEQ ID NO: 4266355 - DNA, 15 bp, Homo sapiens
tctccaggcccagcc

SEQ ID NO: 4266356 - DNA, 16 bp, Homo sapiens
tctccaggcccagcct

SEQ ID NO: 4266357 - DNA, 17 bp, Homo sapiens
tctccaggcccagcctg

SEQ ID NO: 4266358 - DNA, 16 bp, Homo sapiens
tctccaggggtttaca

SEQ ID NO: 4266359 - DNA, 19 bp, Homo sapiens
tctccaggggtttacagtg

SEQ ID NO: 4266360 - DNA, 21 bp, Homo sapiens
tctcccaaataaactccttaa

SEQ ID NO: 4266361 - DNA, 23 bp, Homo sapiens
tctcccaaataaactccttaacc

SEQ ID NO: 4266362 - DNA, 22 bp, Homo sapiens
tctccccggacaagcccaggac

SEQ ID NO: 4266363 - DNA, 11 bp, Homo sapiens
tctccctccac

SEQ ID NO: 4266364 - DNA, 15 bp, Homo sapiens
tctccctccactcct

SEQ ID NO: 4266365 - DNA, 12 bp, Homo sapiens
tctcctctccca

SEQ ID NO: 4266366 - DNA, 18 bp, Homo sapiens
tctcctctcccaaataaa

SEQ ID NO: 4266367 - DNA, 15 bp, Homo sapiens
tctcctctctctccc

SEQ ID NO: 4266368 - DNA, 19 bp, Homo sapiens
tctcctctctctccctcca

SEQ ID NO: 4266369 - DNA, 15 bp, Homo sapiens
tctcctgcatccctc

SEQ ID NO: 4266370 - DNA, 16 bp, Homo sapiens
tctcctgggcatctgg

SEQ ID NO: 4266371 - DNA, 15 bp, Homo sapiens
tctcctgtatcattt

SEQ ID NO: 4266372 - DNA, 13 bp, Homo sapiens
tctccttgttctg

SEQ ID NO: 4266373 - DNA, 16 bp, Homo sapiens
tctccttgttctgata

SEQ ID NO: 4266374 - DNA, 22 bp, Homo sapiens
tctcgaagtcttccatcagcag

SEQ ID NO: 4266375 - DNA, 16 bp, Homo sapiens
tctctaaaattctagt

SEQ ID NO: 4266376 - DNA, 14 bp, Homo sapiens
tctctcagcctcca

SEQ ID NO: 4266377 - DNA, 15 bp, Homo sapiens
tctctcagcctccac

SEQ ID NO: 4266378 - DNA, 17 bp, Homo sapiens
tctctcatgaacctcaa

SEQ ID NO: 4266379 - DNA, 13 bp, Homo sapiens
tctctccatcaga

SEQ ID NO: 4266380 - DNA, 15 bp, Homo sapiens
tctctccatcagaag

SEQ ID NO: 4266381 - DNA, 16 bp, Homo sapiens
tctctcctctctctcc

SEQ ID NO: 4266382 - DNA, 11 bp, Homo sapiens
tctctctccct

SEQ ID NO: 4266383 - DNA, 12 bp, Homo sapiens
tctctctggaaa

SEQ ID NO: 4266384 - DNA, 21 bp, Homo sapiens
tctctgaactgcaacactgga

SEQ ID NO: 4266385 - DNA, 20 bp, Homo sapiens
tctctgatcacaacttttct

SEQ ID NO: 4266386 - DNA, 23 bp, Homo sapiens
tctctgatcacaacttttctgct

SEQ ID NO: 4266387 - DNA, 22 bp, Homo sapiens
tctctgattaaatttaatatac

SEQ ID NO: 4266388 - DNA, 13 bp, Homo sapiens
tctctgccagccg

SEQ ID NO: 4266389 - DNA, 17 bp, Homo sapiens
tctctgccagccgctgg

SEQ ID NO: 4266390 - DNA, 15 bp, Homo sapiens
tctctggccactctg

SEQ ID NO: 4266391 - DNA, 17 bp, Homo sapiens
tctctggccactctgct

SEQ ID NO: 4266392 - DNA, 18 bp, Homo sapiens
tctctgtaaaatgaactg

SEQ ID NO: 4266393 - DNA, 14 bp, Homo sapiens
tctctgttcatttc

SEQ ID NO: 4266394 - DNA, 16 bp, Homo sapiens
tctctgttcatttcct

SEQ ID NO: 4266395 - DNA, 21 bp, Homo sapiens
tctctgtttaccctccctgtc

SEQ ID NO: 4266396 - DNA, 22 bp, Homo sapiens
tctcttaagacagcatgtgtta

SEQ ID NO: 4266397 - DNA, 19 bp, Homo sapiens
tctcttacgctctctgtct

SEQ ID NO: 4266398 - DNA, 13 bp, Homo sapiens
tctcttctccact

SEQ ID NO: 4266399 - DNA, 15 bp, Homo sapiens
tctcttctccactgg

SEQ ID NO: 4266400 - DNA, 16 bp, Homo sapiens
tctcttctccactgga

SEQ ID NO: 4266401 - DNA, 23 bp, Homo sapiens
tctcttgcataagcctcaggcct

SEQ ID NO: 4266402 - DNA, 13 bp, Homo sapiens
tctctttgtaagg

SEQ ID NO: 4266403 - DNA, 22 bp, Homo sapiens
tctctttgtaaggacttgtgcc

SEQ ID NO: 4266404 - DNA, 19 bp, Homo sapiens
tctcttttcaaacacacac

SEQ ID NO: 4266405 - DNA, 12 bp, Homo sapiens
tctgaaaactgg

SEQ ID NO: 4266406 - DNA, 18 bp, Homo sapiens
tctgaaaagaaatgctaa

SEQ ID NO: 4266407 - DNA, 21 bp, Homo sapiens
tctgaaaatatttttttctag

SEQ ID NO: 4266408 - DNA, 20 bp, Homo sapiens
tctgaactgctgctggtcac

SEQ ID NO: 4266409 - DNA, 15 bp, Homo sapiens
tctgaagatctcaga

SEQ ID NO: 4266410 - DNA, 14 bp, Homo sapiens
tctgaaggagagga

SEQ ID NO: 4266411 - DNA, 15 bp, Homo sapiens
tctgaaggagaggag

SEQ ID NO: 4266412 - DNA, 16 bp, Homo sapiens
tctgaaggagaggagt

SEQ ID NO: 4266413 - DNA, 12 bp, Homo sapiens
tctgaaggattt

SEQ ID NO: 4266414 - DNA, 23 bp, Homo sapiens
tgattggcagcttcaaaacagaa

SEQ ID NO: 4266415 - DNA, 16 bp, Homo sapiens
tgatttaagcatttta

SEQ ID NO: 4266416 - DNA, 18 bp, Homo sapiens
tgatttattttgtatgaa

SEQ ID NO: 4266417 - DNA, 14 bp, Homo sapiens
tgatttcaaaatga

SEQ ID NO: 4266418 - DNA, 21 bp, Homo sapiens
tgatttgggctgaatgtatgt

SEQ ID NO: 4266419 - DNA, 19 bp, Homo sapiens
tgatttttgttgattaaaa

SEQ ID NO: 4266420 - DNA, 19 bp, Homo sapiens
tgattttttacaaattatg

SEQ ID NO: 4266421 - DNA, 18 bp, Homo sapiens
tgcaaaaggttaagccat

SEQ ID NO: 4266422 - DNA, 22 bp, Homo sapiens
tgcaaagtaccaactgagccaa

SEQ ID NO: 4266423 - DNA, 17 bp, Homo sapiens
tgcaaatagtttcaaat

SEQ ID NO: 4266424 - DNA, 19 bp, Homo sapiens
tgcaaatgcacatttgtca

SEQ ID NO: 4266425 - DNA, 12 bp, Homo sapiens
tgcaaattattc

SEQ ID NO: 4266426 - DNA, 15 bp, Homo sapiens
tgcaaattattctag

SEQ ID NO: 4266427 - DNA, 17 bp, Homo sapiens
tgcaaattattctagtc

SEQ ID NO: 4266428 - DNA, 13 bp, Homo sapiens
tgcaagaagaata

SEQ ID NO: 4266429 - DNA, 17 bp, Homo sapiens
tgcaagaagaatataaa

SEQ ID NO: 4266430 - DNA, 22 bp, Homo sapiens
tgcaagaagtggggcagcagca

SEQ ID NO: 4266431 - DNA, 14 bp, Homo sapiens
tgcaagattctgtg

SEQ ID NO: 4266432 - DNA, 22 bp, Homo sapiens
tgcaagtggacgtgggctccag

SEQ ID NO: 4266433 - DNA, 13 bp, Homo sapiens
tgcaatatcttcg

SEQ ID NO: 4266434 - DNA, 15 bp, Homo sapiens
tgcaatatgtaacat

SEQ ID NO: 4266435 - DNA, 14 bp, Homo sapiens
tgcaatcttatgtt

SEQ ID NO: 4266436 - DNA, 17 bp, Homo sapiens
tgcacacaattagattt

SEQ ID NO: 4266437 - DNA, 10 bp, Homo sapiens
tgcacacacc

SEQ ID NO: 4266438 - DNA, 11 bp, Homo sapiens
tgcacacacct

SEQ ID NO: 4266439 - DNA, 14 bp, Homo sapiens
tgcacacacctgca

SEQ ID NO: 4266440 - DNA, 15 bp, Homo sapiens
tgcacacacctgcac

SEQ ID NO: 4266441 - DNA, 16 bp, Homo sapiens
tgcacacacctgcaca

SEQ ID NO: 4266442 - DNA, 18 bp, Homo sapiens
tgcacacacctgcacacc

SEQ ID NO: 4266443 - DNA, 17 bp, Homo sapiens
tgcacaccgtccctctc

SEQ ID NO: 4266444 - DNA, 10 bp, Homo sapiens
tgcacagctg

SEQ ID NO: 4266445 - DNA, 20 bp, Homo sapiens
tgcacattaggaacagagta

SEQ ID NO: 4266446 - DNA, 16 bp, Homo sapiens
tgcacccatgccatag

SEQ ID NO: 4266447 - DNA, 13 bp, Homo sapiens
tgcaccccacagg

SEQ ID NO: 4266448 - DNA, 24 bp, Homo sapiens
tgcaccctctgctatgtctgtgat

SEQ ID NO: 4266449 - DNA, 16 bp, Homo sapiens
tgcacctgcagggagc

SEQ ID NO: 4266450 - DNA, 18 bp, Homo sapiens
tgcacctgcagggagcag

SEQ ID NO: 4266451 - DNA, 21 bp, Homo sapiens
tgcacctgcagggagcagcac

SEQ ID NO: 4266452 - DNA, 15 bp, Homo sapiens
tgcacctgcttctca

SEQ ID NO: 4266453 - DNA, 14 bp, Homo sapiens
tgcactatatacat

SEQ ID NO: 4266454 - DNA, 20 bp, Homo sapiens
tgcacttggcctcttcggga

SEQ ID NO: 4266455 - DNA, 17 bp, Homo sapiens
tgcagatctagccaggc

SEQ ID NO: 4266456 - DNA, 19 bp, Homo sapiens
tgcagatctagccaggcct

SEQ ID NO: 4266457 - DNA, 13 bp, Homo sapiens
tgcagccccaggc

SEQ ID NO: 4266458 - DNA, 17 bp, Homo sapiens
tgcagccccaggcctcc

SEQ ID NO: 4266459 - DNA, 15 bp, Homo sapiens
tgcagccccctcctg

SEQ ID NO: 4266460 - DNA, 16 bp, Homo sapiens
tgcagccccctcctga

SEQ ID NO: 4266461 - DNA, 21 bp, Homo sapiens
tgcagccccctcctgacccca

SEQ ID NO: 4266462 - DNA, 16 bp, Homo sapiens
tgcagccggggagctg

SEQ ID NO: 4266463 - DNA, 21 bp, Homo sapiens
tgcagccggggagctgagggg

SEQ ID NO: 4266464 - DNA, 23 bp, Homo sapiens
tgcagcgtctgagcggccgcctg

SEQ ID NO: 4266465 - DNA, 23 bp, Homo sapiens
tgcagcgtctttttaacctcaga

SEQ ID NO: 4266466 - DNA, 14 bp, Homo sapiens
tgcaggaatcaaaa

SEQ ID NO: 4266467 - DNA, 21 bp, Homo sapiens
tgcaggaatcaaaaattgaag

SEQ ID NO: 4266468 - DNA, 17 bp, Homo sapiens
tgcaggcagcctgcaga

SEQ ID NO: 4266469 - DNA, 19 bp, Homo sapiens
tgcaggcggtatccagagg

SEQ ID NO: 4266470 - DNA, 20 bp, Homo sapiens
tgcaggcggtatccagaggt

SEQ ID NO: 4266471 - DNA, 21 bp, Homo sapiens
tgcaggcggtatccagaggtg

SEQ ID NO: 4266472 - DNA, 23 bp, Homo sapiens
tgcaggcggtatccagaggtgag

SEQ ID NO: 4266473 - DNA, 24 bp, Homo sapiens
tgcaggcggtatccagaggtgagg

SEQ ID NO: 4266474 - DNA, 23 bp, Homo sapiens
tgcaggctggcaccgccttctct

SEQ ID NO: 4266475 - DNA, 13 bp, Homo sapiens
tgcagggcagcct

SEQ ID NO: 4266476 - DNA, 18 bp, Homo sapiens
tgcagggcccccacagga

SEQ ID NO: 4266477 - DNA, 16 bp, Homo sapiens
tgcagtcatcagaagt

SEQ ID NO: 4266478 - DNA, 15 bp, Homo sapiens
tgcagtgtagatttt

SEQ ID NO: 4266479 - DNA, 14 bp, Homo sapiens
tgcagttggcctca

SEQ ID NO: 4266480 - DNA, 18 bp, Homo sapiens
tgcagttggcctcagcag

SEQ ID NO: 4266481 - DNA, 20 bp, Homo sapiens
tgcatacattcttcaagatc

SEQ ID NO: 4266482 - DNA, 23 bp, Homo sapiens
tgcataccaggggttccccagga

SEQ ID NO: 4266483 - DNA, 21 bp, Homo sapiens
tgcatacttcctggattttct

SEQ ID NO: 4266484 - DNA, 14 bp, Homo sapiens
tgcatccctccacc

SEQ ID NO: 4266485 - DNA, 15 bp, Homo sapiens
tgcatccctccaccc

SEQ ID NO: 4266486 - DNA, 23 bp, Homo sapiens
tgcatccctccaccccagtcccc

SEQ ID NO: 4266487 - DNA, 17 bp, Homo sapiens
tgcatcccttggcccct

SEQ ID NO: 4266488 - DNA, 18 bp, Homo sapiens
tgcatcccttggcccctc

SEQ ID NO: 4266489 - DNA, 12 bp, Homo sapiens
tgcatcctcagc

SEQ ID NO: 4266490 - DNA, 20 bp, Homo sapiens
tgcatcctcagccccagggc

SEQ ID NO: 4266491 - DNA, 14 bp, Homo sapiens
tgcatctcagccca

SEQ ID NO: 4266492 - DNA, 15 bp, Homo sapiens
tgcatctcagcccac

SEQ ID NO: 4266493 - DNA, 23 bp, Homo sapiens
tgcatctccacttggcattagct

SEQ ID NO: 4266494 - DNA, 14 bp, Homo sapiens
tgcatgatattgta

SEQ ID NO: 4266495 - DNA, 23 bp, Homo sapiens
tgcatgcagggcccccacaggag

SEQ ID NO: 4266496 - DNA, 22 bp, Homo sapiens
tgcatgctcctctgcctgtgcc

SEQ ID NO: 4266497 - DNA, 14 bp, Homo sapiens
tgcatggcctccca

SEQ ID NO: 4266498 - DNA, 15 bp, Homo sapiens
tgcatggcctcccag

SEQ ID NO: 4266499 - DNA, 17 bp, Homo sapiens
tgcatggcctcccagcc

SEQ ID NO: 4266500 - DNA, 19 bp, Homo sapiens
tgcatggcctcccagccac

SEQ ID NO: 4266501 - DNA, 14 bp, Homo sapiens
tgcatgtctgcatg

SEQ ID NO: 4266502 - DNA, 11 bp, Homo sapiens
tgcattgtctg

SEQ ID NO: 4266503 - DNA, 19 bp, Homo sapiens
tgcatttatgagctcttca

SEQ ID NO: 4266504 - DNA, 14 bp, Homo sapiens
tgcatttcctgaca

SEQ ID NO: 4266505 - DNA, 16 bp, Homo sapiens
tgcatttctgggcctt

SEQ ID NO: 4266506 - DNA, 17 bp, Homo sapiens
tgccaaccacctctggc

SEQ ID NO: 4266507 - DNA, 16 bp, Homo sapiens
tgccaactttccagac

SEQ ID NO: 4266508 - DNA, 17 bp, Homo sapiens
tgccaactttccagact

SEQ ID NO: 4266509 - DNA, 15 bp, Homo sapiens
tgccacacttcaggc

SEQ ID NO: 4266510 - DNA, 22 bp, Homo sapiens
tgccacacttcaggctcttctc

SEQ ID NO: 4266511 - DNA, 14 bp, Homo sapiens
tgccaccctctgca

SEQ ID NO: 4266512 - DNA, 16 bp, Homo sapiens
tgccaccctctgcagg

SEQ ID NO: 4266513 - DNA, 18 bp, Homo sapiens
tgccaccctctgcagggc

SEQ ID NO: 4266514 - DNA, 15 bp, Homo sapiens
tgccacgcgctctgc

SEQ ID NO: 4266515 - DNA, 21 bp, Homo sapiens
tgccacgcgctctgcatgctc

SEQ ID NO: 4266516 - DNA, 13 bp, Homo sapiens
tgccactaggccc

SEQ ID NO: 4266517 - DNA, 14 bp, Homo sapiens
tgccactctcctga

SEQ ID NO: 4266518 - DNA, 17 bp, Homo sapiens
tgccactctcctgagga

SEQ ID NO: 4266519 - DNA, 18 bp, Homo sapiens
tgccactctcctgaggag

SEQ ID NO: 4266520 - DNA, 22 bp, Homo sapiens
tgccactgacaggaaagtggat

SEQ ID NO: 4266521 - DNA, 21 bp, Homo sapiens
tgccagacgtgctcctgctga

SEQ ID NO: 4266522 - DNA, 16 bp, Homo sapiens
tgccagaggcctggtg

SEQ ID NO: 4266523 - DNA, 14 bp, Homo sapiens
tgccagctgcttct

SEQ ID NO: 4266524 - DNA, 17 bp, Homo sapiens
tgccagctgcttctgcc

SEQ ID NO: 4266525 - DNA, 21 bp, Homo sapiens
tgccagctgcttctgcccacc

SEQ ID NO: 4266526 - DNA, 21 bp, Homo sapiens
tgccaggagtgggtgggacac

SEQ ID NO: 4266527 - DNA, 16 bp, Homo sapiens
tgccagtgactgctgc

SEQ ID NO: 4266528 - DNA, 23 bp, Homo sapiens
tgccatggtgttggaggggcagg

SEQ ID NO: 4266529 - DNA, 19 bp, Homo sapiens
tgccattagactgaattta

SEQ ID NO: 4266530 - DNA, 16 bp, Homo sapiens
tgccattttgtctggc

SEQ ID NO: 4266531 - DNA, 19 bp, Homo sapiens
tgccattttgtctggctgt

SEQ ID NO: 4266532 - DNA, 22 bp, Homo sapiens
tgccattttgtctggctgtggc

SEQ ID NO: 4266533 - DNA, 21 bp, Homo sapiens
tgcccaagaatagatgctgac

SEQ ID NO: 4266534 - DNA, 23 bp, Homo sapiens
tgcccaagaatagatgctgactg

SEQ ID NO: 4266535 - DNA, 17 bp, Homo sapiens
tgcccacacctgcctct

SEQ ID NO: 4266536 - DNA, 18 bp, Homo sapiens
tgcccacacctgcctctg

SEQ ID NO: 4266537 - DNA, 19 bp, Homo sapiens
tgcccacacctgcctctga

SEQ ID NO: 4266538 - DNA, 18 bp, Homo sapiens
tgcccaccagctggctct

SEQ ID NO: 4266539 - DNA, 23 bp, Homo sapiens
tgcccaccagctggctctgcagc

SEQ ID NO: 4266540 - DNA, 18 bp, Homo sapiens
tgcccaccccgcctctgg

SEQ ID NO: 4266541 - DNA, 20 bp, Homo sapiens
tgcccaccccgcctctgggc

SEQ ID NO: 4266542 - DNA, 16 bp, Homo sapiens
tgccccacacaggcct

SEQ ID NO: 4266543 - DNA, 13 bp, Homo sapiens
tgccccacccctc

SEQ ID NO: 4266544 - DNA, 14 bp, Homo sapiens
tgggcagtggagag

SEQ ID NO: 4266545 - DNA, 17 bp, Homo sapiens
tgggcagtggagagggg

SEQ ID NO: 4266546 - DNA, 18 bp, Homo sapiens
tgggcagtggagagggga

SEQ ID NO: 4266547 - DNA, 21 bp, Homo sapiens
tgggcatccccagccccctgg

SEQ ID NO: 4266548 - DNA, 17 bp, Homo sapiens
tgggcatctggccctgc

SEQ ID NO: 4266549 - DNA, 22 bp, Homo sapiens
tgggcatctggccctgctgccc

SEQ ID NO: 4266550 - DNA, 23 bp, Homo sapiens
tgggcatctggccctgctgcccc

SEQ ID NO: 4266551 - DNA, 13 bp, Homo sapiens
tgggcatggggtg

SEQ ID NO: 4266552 - DNA, 21 bp, Homo sapiens
tgggcatgtccccagtgtgga

SEQ ID NO: 4266553 - DNA, 18 bp, Homo sapiens
tgggccagcccctcccac

SEQ ID NO: 4266554 - DNA, 20 bp, Homo sapiens
tgggccagcccctcccacca

SEQ ID NO: 4266555 - DNA, 22 bp, Homo sapiens
tgggccagcccctcccaccaca

SEQ ID NO: 4266556 - DNA, 14 bp, Homo sapiens
tgggccagtgtggg

SEQ ID NO: 4266557 - DNA, 16 bp, Homo sapiens
tgggccccagggaact

SEQ ID NO: 4266558 - DNA, 17 bp, Homo sapiens
tgggccccagggaacta

SEQ ID NO: 4266559 - DNA, 21 bp, Homo sapiens
tgggcccgagggtcccaaggc

SEQ ID NO: 4266560 - DNA, 18 bp, Homo sapiens
tgggccctaggcatactc

SEQ ID NO: 4266561 - DNA, 22 bp, Homo sapiens
tgggctatgccactaggccctg

SEQ ID NO: 4266562 - DNA, 11 bp, Homo sapiens
tgggctcacac

SEQ ID NO: 4266563 - DNA, 19 bp, Homo sapiens
tgggctcacaccagccctg

SEQ ID NO: 4266564 - DNA, 21 bp, Homo sapiens
tgggctcacaccagccctggt

SEQ ID NO: 4266565 - DNA, 13 bp, Homo sapiens
tgggctccagagt

SEQ ID NO: 4266566 - DNA, 13 bp, Homo sapiens
tgggctcccacgc

SEQ ID NO: 4266567 - DNA, 15 bp, Homo sapiens
tgggctgagactgga

SEQ ID NO: 4266568 - DNA, 23 bp, Homo sapiens
tgggctgagactggatactgccc

SEQ ID NO: 4266569 - DNA, 21 bp, Homo sapiens
tgggctgccctggtgctgcca

SEQ ID NO: 4266570 - DNA, 16 bp, Homo sapiens
tggggacggagcactg

SEQ ID NO: 4266571 - DNA, 22 bp, Homo sapiens
tggggagaccgagtgtggagct

SEQ ID NO: 4266572 - DNA, 21 bp, Homo sapiens
tggggaggagactcaggccca

SEQ ID NO: 4266573 - DNA, 18 bp, Homo sapiens
tggggagggacacagagg

SEQ ID NO: 4266574 - DNA, 17 bp, Homo sapiens
tggggagggagagatct

SEQ ID NO: 4266575 - DNA, 15 bp, Homo sapiens
tggggagggtgggcg

SEQ ID NO: 4266576 - DNA, 22 bp, Homo sapiens
tggggcccctttttactcccct

SEQ ID NO: 4266577 - DNA, 18 bp, Homo sapiens
tggggcgaggcagaggac

SEQ ID NO: 4266578 - DNA, 17 bp, Homo sapiens
tgggggattcaaatgca

SEQ ID NO: 4266579 - DNA, 16 bp, Homo sapiens
tgggggccatgagctc

SEQ ID NO: 4266580 - DNA, 15 bp, Homo sapiens
tggggggccaacacc

SEQ ID NO: 4266581 - DNA, 14 bp, Homo sapiens
tgggggggcttggg

SEQ ID NO: 4266582 - DNA, 20 bp, Homo sapiens
tgggggggcttggggtagag

SEQ ID NO: 4266583 - DNA, 13 bp, Homo sapiens
tgggggtctggga

SEQ ID NO: 4266584 - DNA, 16 bp, Homo sapiens
tgggggtctgggaggc

SEQ ID NO: 4266585 - DNA, 19 bp, Homo sapiens
tgggggtctgggaggcagg

SEQ ID NO: 4266586 - DNA, 14 bp, Homo sapiens
tgggggtgccatgg

SEQ ID NO: 4266587 - DNA, 20 bp, Homo sapiens
tggggtagaagtagaatcct

SEQ ID NO: 4266588 - DNA, 17 bp, Homo sapiens
tggggtagagaggacag

SEQ ID NO: 4266589 - DNA, 21 bp, Homo sapiens
tggggtggaggctaagcctgg

SEQ ID NO: 4266590 - DNA, 22 bp, Homo sapiens
tggggtggaggctaagcctgga

SEQ ID NO: 4266591 - DNA, 12 bp, Homo sapiens
tggggtgggcct

SEQ ID NO: 4266592 - DNA, 16 bp, Homo sapiens
tggggtgggcctctgg

SEQ ID NO: 4266593 - DNA, 23 bp, Homo sapiens
tggggtgggtgtgagcagggtga

SEQ ID NO: 4266594 - DNA, 15 bp, Homo sapiens
tggggtgttgaagac

SEQ ID NO: 4266595 - DNA, 14 bp, Homo sapiens
tggggttcgtggaa

SEQ ID NO: 4266596 - DNA, 17 bp, Homo sapiens
tggggttgggctctgcg

SEQ ID NO: 4266597 - DNA, 16 bp, Homo sapiens
tggggtttccacacag

SEQ ID NO: 4266598 - DNA, 20 bp, Homo sapiens
tggggtttccacacaggccc

SEQ ID NO: 4266599 - DNA, 16 bp, Homo sapiens
tgggtcaactccaagg

SEQ ID NO: 4266600 - DNA, 17 bp, Homo sapiens
tgggtcagtgtgccacc

SEQ ID NO: 4266601 - DNA, 21 bp, Homo sapiens
tgggtcccgggtgccccccat

SEQ ID NO: 4266602 - DNA, 16 bp, Homo sapiens
tgggtggccggccctg

SEQ ID NO: 4266603 - DNA, 22 bp, Homo sapiens
tgggtgtatttattttcctccc

SEQ ID NO: 4266604 - DNA, 15 bp, Homo sapiens
tgggtgtgagcaggg

SEQ ID NO: 4266605 - DNA, 12 bp, Homo sapiens
tgggttccagac

SEQ ID NO: 4266606 - DNA, 19 bp, Homo sapiens
tgggttccagacagagtgg

SEQ ID NO: 4266607 - DNA, 17 bp, Homo sapiens
tgggttctggggctgag

SEQ ID NO: 4266608 - DNA, 22 bp, Homo sapiens
tgggttctggggctgagagtgg

SEQ ID NO: 4266609 - DNA, 14 bp, Homo sapiens
tggtaacaagagga

SEQ ID NO: 4266610 - DNA, 16 bp, Homo sapiens
tggtaacaagaggagc

SEQ ID NO: 4266611 - DNA, 23 bp, Homo sapiens
tggtaacaagaggagcaggaagc

SEQ ID NO: 4266612 - DNA, 18 bp, Homo sapiens
tggtaagattgttattaa

SEQ ID NO: 4266613 - DNA, 19 bp, Homo sapiens
tggtaatgtgtcaaagaga

SEQ ID NO: 4266614 - DNA, 22 bp, Homo sapiens
tggtaatttaagattccagaga

SEQ ID NO: 4266615 - DNA, 13 bp, Homo sapiens
tggtaccagagcc

SEQ ID NO: 4266616 - DNA, 18 bp, Homo sapiens
tggtagcagggtctttgt

SEQ ID NO: 4266617 - DNA, 15 bp, Homo sapiens
tggtattaaatgcca

SEQ ID NO: 4266618 - DNA, 22 bp, Homo sapiens
tggtcacttcaaacatgccctc

SEQ ID NO: 4266619 - DNA, 18 bp, Homo sapiens
tggtcagcggcctgggga

SEQ ID NO: 4266620 - DNA, 22 bp, Homo sapiens
tggtcagtgaagcccaggagga

SEQ ID NO: 4266621 - DNA, 17 bp, Homo sapiens
tggtcatcctgggcatg

SEQ ID NO: 4266622 - DNA, 15 bp, Homo sapiens
tggtccacattctgc

SEQ ID NO: 4266623 - DNA, 17 bp, Homo sapiens
tggtccacattctgctg

SEQ ID NO: 4266624 - DNA, 15 bp, Homo sapiens
tggtccttctgaccc

SEQ ID NO: 4266625 - DNA, 16 bp, Homo sapiens
tggtctcagaggaggg

SEQ ID NO: 4266626 - DNA, 18 bp, Homo sapiens
tggtctctaggcctgaac

SEQ ID NO: 4266627 - DNA, 11 bp, Homo sapiens
tggtctgcacc

SEQ ID NO: 4266628 - DNA, 15 bp, Homo sapiens
tggtctggagcccct

SEQ ID NO: 4266629 - DNA, 17 bp, Homo sapiens
tggtctggagcccctat

SEQ ID NO: 4266630 - DNA, 20 bp, Homo sapiens
tggtctggagcccctatcct

SEQ ID NO: 4266631 - DNA, 17 bp, Homo sapiens
tggtcttcaagcctggc

SEQ ID NO: 4266632 - DNA, 11 bp, Homo sapiens
tggtcttggag

SEQ ID NO: 4266633 - DNA, 15 bp, Homo sapiens
tggtgataagtggaa

SEQ ID NO: 4266634 - DNA, 17 bp, Homo sapiens
tggtgataagtggaaaa

SEQ ID NO: 4266635 - DNA, 21 bp, Homo sapiens
tggtgcccaccagctggctct

SEQ ID NO: 4266636 - DNA, 17 bp, Homo sapiens
tggtgcccacccttcgc

SEQ ID NO: 4266637 - DNA, 13 bp, Homo sapiens
tggtgccctggcc

SEQ ID NO: 4266638 - DNA, 20 bp, Homo sapiens
tggtgccctggcccagcctg

SEQ ID NO: 4266639 - DNA, 21 bp, Homo sapiens
tggtgccctggcccagcctgt

SEQ ID NO: 4266640 - DNA, 14 bp, Homo sapiens
tggtgcctgcaggc

SEQ ID NO: 4266641 - DNA, 12 bp, Homo sapiens
tggtgccttcat

SEQ ID NO: 4266642 - DNA, 13 bp, Homo sapiens
tggtgctgccaca

SEQ ID NO: 4266643 - DNA, 18 bp, Homo sapiens
tggtgctgccacacttca

SEQ ID NO: 4266644 - DNA, 16 bp, Homo sapiens
tggtgcttggcaggaa

SEQ ID NO: 4266645 - DNA, 18 bp, Homo sapiens
tggtggacagacccaggg

SEQ ID NO: 4266646 - DNA, 20 bp, Homo sapiens
tggtggacagacccagggtg

SEQ ID NO: 4266647 - DNA, 19 bp, Homo sapiens
tggtggccaagcctgcccc

SEQ ID NO: 4266648 - DNA, 17 bp, Homo sapiens
tggtggccaggctggta

SEQ ID NO: 4266649 - DNA, 15 bp, Homo sapiens
tggtgggctccagag

SEQ ID NO: 4266650 - DNA, 16 bp, Homo sapiens
tggtgggctccagagt

SEQ ID NO: 4266651 - DNA, 19 bp, Homo sapiens
tggtgggctccagagtagg

SEQ ID NO: 4266652 - DNA, 17 bp, Homo sapiens
tggtggtttcagaaagg

SEQ ID NO: 4266653 - DNA, 18 bp, Homo sapiens
tggtggtttcagaaaggg

SEQ ID NO: 4266654 - DNA, 19 bp, Homo sapiens
tggtgtccctgcctggccc

SEQ ID NO: 4266655 - DNA, 20 bp, Homo sapiens
tggtgtccctgcctggccct

SEQ ID NO: 4266656 - DNA, 21 bp, Homo sapiens
tggtgtccctgcctggccctc

SEQ ID NO: 4266657 - DNA, 19 bp, Homo sapiens
tggtgttctggcctctggc

SEQ ID NO: 4266658 - DNA, 20 bp, Homo sapiens
tggttaagaatgtatatcag

SEQ ID NO: 4266659 - DNA, 21 bp, Homo sapiens
tggttatagttgatatgtaac

SEQ ID NO: 4266660 - DNA, 15 bp, Homo sapiens
tggttcatgcctggg

SEQ ID NO: 4266661 - DNA, 18 bp, Homo sapiens
tggttcatgcctggggtg

SEQ ID NO: 4266662 - DNA, 23 bp, Homo sapiens
tggttcccctgttcactctactt

SEQ ID NO: 4266663 - DNA, 14 bp, Homo sapiens
tggttggaggcctg

SEQ ID NO: 4266664 - DNA, 18 bp, Homo sapiens
tggttggtgttcttccca

SEQ ID NO: 4266665 - DNA, 19 bp, Homo sapiens
tggtttggggcgaggcaga

SEQ ID NO: 4266666 - DNA, 23 bp, Homo sapiens
tggtttggggcgaggcagaggac

SEQ ID NO: 4266667 - DNA, 20 bp, Homo sapiens
tggtttttctgttccctgct

SEQ ID NO: 4266668 - DNA, 21 bp, Homo sapiens
tggtttttctgttccctgctg

SEQ ID NO: 4266669 - DNA, 13 bp, Homo sapiens
tgtaaaattcata

SEQ ID NO: 4266670 - DNA, 12 bp, Homo sapiens
tgtaaataggtt

SEQ ID NO: 4266671 - DNA, 19 bp, Homo sapiens
tgtaaatctaacattatta

SEQ ID NO: 4266672 - DNA, 20 bp, Homo sapiens
tgtaaatttaactgcatata

SEQ ID NO: 4266673 - DNA, 22 bp, Homo sapiens
tgtaacagttggtgattttaga

SEQ ID NO: 4266674 - DNA, 14 bp, Homo sapiens
ttatgctgctgtga

SEQ ID NO: 4266675 - DNA, 16 bp, Homo sapiens
ttatgctgctgtgaat

SEQ ID NO: 4266676 - DNA, 15 bp, Homo sapiens
ttatggctttgtgct

SEQ ID NO: 4266677 - DNA, 13 bp, Homo sapiens
ttatggtattttc

SEQ ID NO: 4266678 - DNA, 13 bp, Homo sapiens
ttatgtcatactc

SEQ ID NO: 4266679 - DNA, 22 bp, Homo sapiens
ttattaaatcagaatctttaaa

SEQ ID NO: 4266680 - DNA, 24 bp, Homo sapiens
ttattaaatgtagcttcagtcatt

SEQ ID NO: 4266681 - DNA, 19 bp, Homo sapiens
ttattcaaagagaaaacat

SEQ ID NO: 4266682 - DNA, 20 bp, Homo sapiens
ttattcaaagagaaaacatc

SEQ ID NO: 4266683 - DNA, 17 bp, Homo sapiens
ttattcacttgtgtttg

SEQ ID NO: 4266684 - DNA, 16 bp, Homo sapiens
ttattcattagctgtg

SEQ ID NO: 4266685 - DNA, 16 bp, Homo sapiens
ttattctagtcaactg

SEQ ID NO: 4266686 - DNA, 17 bp, Homo sapiens
ttattgatattctaaga

SEQ ID NO: 4266687 - DNA, 19 bp, Homo sapiens
ttattgccaggaaaggaga

SEQ ID NO: 4266688 - DNA, 13 bp, Homo sapiens
ttattgtctgtaa

SEQ ID NO: 4266689 - DNA, 18 bp, Homo sapiens
ttatttaaaatgattttt

SEQ ID NO: 4266690 - DNA, 17 bp, Homo sapiens
ttatttaaattttcaga

SEQ ID NO: 4266691 - DNA, 16 bp, Homo sapiens
ttatttatatatgaag

SEQ ID NO: 4266692 - DNA, 15 bp, Homo sapiens
ttatttcaatgtaat

SEQ ID NO: 4266693 - DNA, 18 bp, Homo sapiens
ttatttcaatgtaattaa

SEQ ID NO: 4266694 - DNA, 13 bp, Homo sapiens
ttatttctaaatc

SEQ ID NO: 4266695 - DNA, 16 bp, Homo sapiens
ttattttcctccccag

SEQ ID NO: 4266696 - DNA, 13 bp, Homo sapiens
ttattttctgaat

SEQ ID NO: 4266697 - DNA, 23 bp, Homo sapiens
ttattttttaaagaaatctattt

SEQ ID NO: 4266698 - DNA, 21 bp, Homo sapiens
ttcaaagaacccccctcccca

SEQ ID NO: 4266699 - DNA, 11 bp, Homo sapiens
ttcaaatgcat

SEQ ID NO: 4266700 - DNA, 16 bp, Homo sapiens
ttcaaatgcatgatat

SEQ ID NO: 4266701 - DNA, 21 bp, Homo sapiens
ttcaaatgcatgatattgtat

SEQ ID NO: 4266702 - DNA, 16 bp, Homo sapiens
ttcaaattgtcttttg

SEQ ID NO: 4266703 - DNA, 11 bp, Homo sapiens
ttcaacaaatg

SEQ ID NO: 4266704 - DNA, 17 bp, Homo sapiens
ttcaacacttattttct

SEQ ID NO: 4266705 - DNA, 13 bp, Homo sapiens
ttcaacgcagccc

SEQ ID NO: 4266706 - DNA, 15 bp, Homo sapiens
ttcaacgcagccctg

SEQ ID NO: 4266707 - DNA, 16 bp, Homo sapiens
ttcaacgcagccctgc

SEQ ID NO: 4266708 - DNA, 19 bp, Homo sapiens
ttcaacgcagccctgcttt

SEQ ID NO: 4266709 - DNA, 23 bp, Homo sapiens
ttcaactgtataccgtgtgctcc

SEQ ID NO: 4266710 - DNA, 16 bp, Homo sapiens
ttcaacttcaggaaag

SEQ ID NO: 4266711 - DNA, 12 bp, Homo sapiens
ttcaacttttcc

SEQ ID NO: 4266712 - DNA, 17 bp, Homo sapiens
ttcaagatcccatttga

SEQ ID NO: 4266713 - DNA, 21 bp, Homo sapiens
ttcaagatctaaatcatatat

SEQ ID NO: 4266714 - DNA, 11 bp, Homo sapiens
ttcaagcaaat

SEQ ID NO: 4266715 - DNA, 14 bp, Homo sapiens
ttcaagcaaatatt

SEQ ID NO: 4266716 - DNA, 12 bp, Homo sapiens
ttcaagcctggc

SEQ ID NO: 4266717 - DNA, 16 bp, Homo sapiens
ttcaagtgcaatccat

SEQ ID NO: 4266718 - DNA, 15 bp, Homo sapiens
ttcaatgtaattaaa

SEQ ID NO: 4266719 - DNA, 16 bp, Homo sapiens
ttcaatgtaattaaac

SEQ ID NO: 4266720 - DNA, 18 bp, Homo sapiens
ttcaattggacaattatt

SEQ ID NO: 4266721 - DNA, 17 bp, Homo sapiens
ttcacatatttgtagct

SEQ ID NO: 4266722 - DNA, 14 bp, Homo sapiens
ttcaccctcctcat

SEQ ID NO: 4266723 - DNA, 15 bp, Homo sapiens
ttcacgattcatttt

SEQ ID NO: 4266724 - DNA, 14 bp, Homo sapiens
ttcacgcaacttga

SEQ ID NO: 4266725 - DNA, 18 bp, Homo sapiens
ttcactgaagtgaataca

SEQ ID NO: 4266726 - DNA, 13 bp, Homo sapiens
ttcactgctggct

SEQ ID NO: 4266727 - DNA, 16 bp, Homo sapiens
ttcacttaaaatcaaa

SEQ ID NO: 4266728 - DNA, 14 bp, Homo sapiens
ttcactttgacact

SEQ ID NO: 4266729 - DNA, 19 bp, Homo sapiens
ttcagaaagatgaagaaga

SEQ ID NO: 4266730 - DNA, 22 bp, Homo sapiens
ttcagaaagggcagcccctccc

SEQ ID NO: 4266731 - DNA, 22 bp, Homo sapiens
ttcagacctttgtctgaaggat

SEQ ID NO: 4266732 - DNA, 20 bp, Homo sapiens
ttcagactctctcctctctc

SEQ ID NO: 4266733 - DNA, 24 bp, Homo sapiens
ttcagactctctcctctctctccc

SEQ ID NO: 4266734 - DNA, 22 bp, Homo sapiens
ttcagagatgtaccatgttaaa

SEQ ID NO: 4266735 - DNA, 14 bp, Homo sapiens
ttcagccattcaca

SEQ ID NO: 4266736 - DNA, 15 bp, Homo sapiens
ttcagcttgtttcta

SEQ ID NO: 4266737 - DNA, 11 bp, Homo sapiens
ttcaggaaagt

SEQ ID NO: 4266738 - DNA, 12 bp, Homo sapiens
ttcagggcccct

SEQ ID NO: 4266739 - DNA, 16 bp, Homo sapiens
ttcagggcccctgaag

SEQ ID NO: 4266740 - DNA, 20 bp, Homo sapiens
ttcaggtggaacaggaggaa

SEQ ID NO: 4266741 - DNA, 15 bp, Homo sapiens
ttcagtaaacaccat

SEQ ID NO: 4266742 - DNA, 15 bp, Homo sapiens
ttcagtggtttgttc

SEQ ID NO: 4266743 - DNA, 13 bp, Homo sapiens
ttcataacaatgt

SEQ ID NO: 4266744 - DNA, 14 bp, Homo sapiens
ttcatacttaaaaa

SEQ ID NO: 4266745 - DNA, 18 bp, Homo sapiens
ttcatacttaaaaattta

SEQ ID NO: 4266746 - DNA, 13 bp, Homo sapiens
ttcatcctcagca

SEQ ID NO: 4266747 - DNA, 14 bp, Homo sapiens
ttcatctttccaaa

SEQ ID NO: 4266748 - DNA, 16 bp, Homo sapiens
ttcatctttccaaatt

SEQ ID NO: 4266749 - DNA, 13 bp, Homo sapiens
ttcatgcctgggg

SEQ ID NO: 4266750 - DNA, 15 bp, Homo sapiens
ttcatgggagaacct

SEQ ID NO: 4266751 - DNA, 22 bp, Homo sapiens
ttcatgtgttgcaaattattct

SEQ ID NO: 4266752 - DNA, 14 bp, Homo sapiens
ttcattagctgtga

SEQ ID NO: 4266753 - DNA, 14 bp, Homo sapiens
ttcattattttccc

SEQ ID NO: 4266754 - DNA, 16 bp, Homo sapiens
ttcattcatacttaaa

SEQ ID NO: 4266755 - DNA, 18 bp, Homo sapiens
ttcattcttaggctttca

SEQ ID NO: 4266756 - DNA, 13 bp, Homo sapiens
ttcatttcctcaa

SEQ ID NO: 4266757 - DNA, 18 bp, Homo sapiens
ttcattttttttaattga

SEQ ID NO: 4266758 - DNA, 18 bp, Homo sapiens
ttccaaagagtcatcatg

SEQ ID NO: 4266759 - DNA, 17 bp, Homo sapiens
ttccaaataaaacttga

SEQ ID NO: 4266760 - DNA, 22 bp, Homo sapiens
ttccaaataaaacttgagccca

SEQ ID NO: 4266761 - DNA, 16 bp, Homo sapiens
ttccaaattgatgggt

SEQ ID NO: 4266762 - DNA, 20 bp, Homo sapiens
ttccaacaaacttactgtca

SEQ ID NO: 4266763 - DNA, 16 bp, Homo sapiens
ttccaacacacaatta

SEQ ID NO: 4266764 - DNA, 13 bp, Homo sapiens
ttccaagggccca

SEQ ID NO: 4266765 - DNA, 14 bp, Homo sapiens
ttccaatgtgccca

SEQ ID NO: 4266766 - DNA, 16 bp, Homo sapiens
ttccaatgtgcccagt

SEQ ID NO: 4266767 - DNA, 13 bp, Homo sapiens
ttccacacaggcc

SEQ ID NO: 4266768 - DNA, 13 bp, Homo sapiens
ttccacccccagc

SEQ ID NO: 4266769 - DNA, 18 bp, Homo sapiens
ttccaccccctccctggc

SEQ ID NO: 4266770 - DNA, 20 bp, Homo sapiens
ttccaccccctccctggcct

SEQ ID NO: 4266771 - DNA, 23 bp, Homo sapiens
ttccaccccctggtgcctgcagg

SEQ ID NO: 4266772 - DNA, 12 bp, Homo sapiens
ttccaccttggc

SEQ ID NO: 4266773 - DNA, 15 bp, Homo sapiens
ttccacgctgtctcc

SEQ ID NO: 4266774 - DNA, 19 bp, Homo sapiens
ttccacgctgtctccagac

SEQ ID NO: 4266775 - DNA, 11 bp, Homo sapiens
ttccagaattg

SEQ ID NO: 4266776 - DNA, 12 bp, Homo sapiens
ttccagaattga

SEQ ID NO: 4266777 - DNA, 20 bp, Homo sapiens
ttccagacagggtggggctt

SEQ ID NO: 4266778 - DNA, 17 bp, Homo sapiens
ttccagacctgaagaat

SEQ ID NO: 4266779 - DNA, 19 bp, Homo sapiens
ttccaggcatgaccctgga

SEQ ID NO: 4266780 - DNA, 21 bp, Homo sapiens
ttccaggcatgaccctggagc

SEQ ID NO: 4266781 - DNA, 14 bp, Homo sapiens
ttccagggcaatca

SEQ ID NO: 4266782 - DNA, 15 bp, Homo sapiens
ttccaggtttaagta

SEQ ID NO: 4266783 - DNA, 18 bp, Homo sapiens
ttccagtgatgttgaaat

SEQ ID NO: 4266784 - DNA, 19 bp, Homo sapiens
ttccatcagcagtgattga

SEQ ID NO: 4266785 - DNA, 19 bp, Homo sapiens
ttccatcctgtacaagtgc

SEQ ID NO: 4266786 - DNA, 22 bp, Homo sapiens
ttccatcctgtacaagtgctca

SEQ ID NO: 4266787 - DNA, 12 bp, Homo sapiens
ttccatctaaaa

SEQ ID NO: 4266788 - DNA, 21 bp, Homo sapiens
ttccatgtcaagattcagcta

SEQ ID NO: 4266789 - DNA, 15 bp, Homo sapiens
ttcccaacctcccct

SEQ ID NO: 4266790 - DNA, 16 bp, Homo sapiens
ttcccaacctcccctg

SEQ ID NO: 4266791 - DNA, 16 bp, Homo sapiens
ttcccaacctgctcat

SEQ ID NO: 4266792 - DNA, 17 bp, Homo sapiens
ttcccacaattcttttg

SEQ ID NO: 4266793 - DNA, 19 bp, Homo sapiens
ttcccacaattcttttgaa

SEQ ID NO: 4266794 - DNA, 20 bp, Homo sapiens
ttcccacaattcttttgaaa

SEQ ID NO: 4266795 - DNA, 18 bp, Homo sapiens
ttcccaccaactctctct

SEQ ID NO: 4266796 - DNA, 21 bp, Homo sapiens
ttcccactggctcctccagca

SEQ ID NO: 4266797 - DNA, 21 bp, Homo sapiens
ttcccagcaaagttttcagat

SEQ ID NO: 4266798 - DNA, 16 bp, Homo sapiens
ttccccactcccgtga

SEQ ID NO: 4266799 - DNA, 18 bp, Homo sapiens
ttccccatcgccttctgg

SEQ ID NO: 4266800 - DNA, 18 bp, Homo sapiens
ttccccattgccttctgg

SEQ ID NO: 4266801 - DNA, 19 bp, Homo sapiens
ttccccattgccttctggg

SEQ ID NO: 4266802 - DNA, 15 bp, Homo sapiens
ttcccccagccctgt

SEQ ID NO: 4266803 - DNA, 20 bp, Homo sapiens
ttcccccagccctgtggaag

SEQ ID NO: 4266804 - DNA, 21 bp, Homo sapiens
ttcccccaggggtgagccccg

SEQ ID NO: 4266805 - DNA, 22 bp, Homo sapiens
ttcccccaggggtgagccccgc

SEQ ID NO: 4266806 - DNA, 18 bp, Homo sapiens
tttgcaaacaaaatgatg

SEQ ID NO: 4266807 - DNA, 20 bp, Homo sapiens
tttgcaagggaatgaatcca

SEQ ID NO: 4266808 - DNA, 18 bp, Homo sapiens
tttgcacccatgccatag

SEQ ID NO: 4266809 - DNA, 21 bp, Homo sapiens
tttgcatacttcctggatttt

SEQ ID NO: 4266810 - DNA, 14 bp, Homo sapiens
tttgcattgtctgt

SEQ ID NO: 4266811 - DNA, 19 bp, Homo sapiens
tttgctgccttctgtctct

SEQ ID NO: 4266812 - DNA, 22 bp, Homo sapiens
tttgctgccttctgtctcttgc

SEQ ID NO: 4266813 - DNA, 18 bp, Homo sapiens
tttgcttatttatattca

SEQ ID NO: 4266814 - DNA, 21 bp, Homo sapiens
tttggaaaacgatttaattta

SEQ ID NO: 4266815 - DNA, 16 bp, Homo sapiens
tttggacgtgtgagga

SEQ ID NO: 4266816 - DNA, 12 bp, Homo sapiens
tttggcccccga

SEQ ID NO: 4266817 - DNA, 20 bp, Homo sapiens
tttggcccccgagctggggg

SEQ ID NO: 4266818 - DNA, 19 bp, Homo sapiens
tttggcgggccaaggactg

SEQ ID NO: 4266819 - DNA, 16 bp, Homo sapiens
tttggtgttctggcct

SEQ ID NO: 4266820 - DNA, 14 bp, Homo sapiens
tttggttctggggc

SEQ ID NO: 4266821 - DNA, 15 bp, Homo sapiens
tttgtaaaatgtatt

SEQ ID NO: 4266822 - DNA, 20 bp, Homo sapiens
tttgtaaggacttgtgcctc

SEQ ID NO: 4266823 - DNA, 18 bp, Homo sapiens
tttgtaatgtatcttatt

SEQ ID NO: 4266824 - DNA, 21 bp, Homo sapiens
tttgtaatgtatcttatttat

SEQ ID NO: 4266825 - DNA, 20 bp, Homo sapiens
tttgtacgttaattaaacaa

SEQ ID NO: 4266826 - DNA, 17 bp, Homo sapiens
tttgtagtagttgatga

SEQ ID NO: 4266827 - DNA, 14 bp, Homo sapiens
tttgtatacaagta

SEQ ID NO: 4266828 - DNA, 12 bp, Homo sapiens
tttgtatcctcc

SEQ ID NO: 4266829 - DNA, 20 bp, Homo sapiens
tttgtatgaaatatatgtga

SEQ ID NO: 4266830 - DNA, 16 bp, Homo sapiens
tttgtatgcactttgt

SEQ ID NO: 4266831 - DNA, 14 bp, Homo sapiens
tttgtcactcggct

SEQ ID NO: 4266832 - DNA, 16 bp, Homo sapiens
tttgtctggctgtggc

SEQ ID NO: 4266833 - DNA, 22 bp, Homo sapiens
tttgtctggctgtggcccctcc

SEQ ID NO: 4266834 - DNA, 15 bp, Homo sapiens
tttgtgcttgttctt

SEQ ID NO: 4266835 - DNA, 15 bp, Homo sapiens
tttgtgtattctgtg

SEQ ID NO: 4266836 - DNA, 22 bp, Homo sapiens
tttgttaatatatataatactt

SEQ ID NO: 4266837 - DNA, 19 bp, Homo sapiens
ttttaattgaaaagaagta

SEQ ID NO: 4266838 - DNA, 23 bp, Homo sapiens
ttttaccatcacacatgttcaga

SEQ ID NO: 4266839 - DNA, 15 bp, Homo sapiens
ttttactttgtgcaa

SEQ ID NO: 4266840 - DNA, 23 bp, Homo sapiens
ttttagccttctctgttcatttc

SEQ ID NO: 4266841 - DNA, 17 bp, Homo sapiens
ttttagcggtttgcaaa

SEQ ID NO: 4266842 - DNA, 13 bp, Homo sapiens
ttttatagtgtgt

SEQ ID NO: 4266843 - DNA, 13 bp, Homo sapiens
ttttatatctgta

SEQ ID NO: 4266844 - DNA, 14 bp, Homo sapiens
ttttatatctgtaa

SEQ ID NO: 4266845 - DNA, 17 bp, Homo sapiens
ttttatctcttcttcct

SEQ ID NO: 4266846 - DNA, 16 bp, Homo sapiens
ttttatgtcatactct

SEQ ID NO: 4266847 - DNA, 20 bp, Homo sapiens
ttttattcacttgtgtttgt

SEQ ID NO: 4266848 - DNA, 22 bp, Homo sapiens
ttttcaacgcagccctgctttg

SEQ ID NO: 4266849 - DNA, 16 bp, Homo sapiens
ttttcaagcaaatatt

SEQ ID NO: 4266850 - DNA, 16 bp, Homo sapiens
ttttcatatcatttct

SEQ ID NO: 4266851 - DNA, 22 bp, Homo sapiens
ttttccatatagtttgttttct

SEQ ID NO: 4266852 - DNA, 17 bp, Homo sapiens
ttttcctcttagaagaa

SEQ ID NO: 4266853 - DNA, 14 bp, Homo sapiens
ttttcgtgcatttg

SEQ ID NO: 4266854 - DNA, 15 bp, Homo sapiens
ttttctaaactgttt

SEQ ID NO: 4266855 - DNA, 21 bp, Homo sapiens
ttttctagctataacaactct

SEQ ID NO: 4266856 - DNA, 20 bp, Homo sapiens
ttttctctgatcacaacttt

SEQ ID NO: 4266857 - DNA, 16 bp, Homo sapiens
ttttctgttccctgct

SEQ ID NO: 4266858 - DNA, 15 bp, Homo sapiens
ttttcttccccctcc

SEQ ID NO: 4266859 - DNA, 17 bp, Homo sapiens
ttttcttttatatctgt

SEQ ID NO: 4266860 - DNA, 13 bp, Homo sapiens
ttttctttttctg

SEQ ID NO: 4266861 - DNA, 16 bp, Homo sapiens
ttttgaaagatggtaa

SEQ ID NO: 4266862 - DNA, 20 bp, Homo sapiens
ttttgaagaagggaaattca

SEQ ID NO: 4266863 - DNA, 21 bp, Homo sapiens
ttttgagtgtgcaatatgtaa

SEQ ID NO: 4266864 - DNA, 14 bp, Homo sapiens
ttttgcctcatgaa

SEQ ID NO: 4266865 - DNA, 18 bp, Homo sapiens
ttttgcctcatgaacact

SEQ ID NO: 4266866 - DNA, 18 bp, Homo sapiens
ttttgcgatgtgttttat

SEQ ID NO: 4266867 - DNA, 21 bp, Homo sapiens
ttttgcgatgtgttttattca

SEQ ID NO: 4266868 - DNA, 21 bp, Homo sapiens
ttttgggaaatgctgatttaa

SEQ ID NO: 4266869 - DNA, 16 bp, Homo sapiens
ttttgtaaaatgtatt

SEQ ID NO: 4266870 - DNA, 18 bp, Homo sapiens
ttttgtaaaatgtattat

SEQ ID NO: 4266871 - DNA, 18 bp, Homo sapiens
ttttgtacgttaattaaa

SEQ ID NO: 4266872 - DNA, 19 bp, Homo sapiens
ttttgtacgttaattaaac

SEQ ID NO: 4266873 - DNA, 14 bp, Homo sapiens
ttttgtatctttaa

SEQ ID NO: 4266874 - DNA, 13 bp, Homo sapiens
ttttgtgtattct

SEQ ID NO: 4266875 - DNA, 13 bp, Homo sapiens
ttttgttgctgtt

SEQ ID NO: 4266876 - DNA, 17 bp, Homo sapiens
tttttaactttaccatg

SEQ ID NO: 4266877 - DNA, 21 bp, Homo sapiens
tttttaactttaccatgctca

SEQ ID NO: 4266878 - DNA, 15 bp, Homo sapiens
tttttacaaattatg

SEQ ID NO: 4266879 - DNA, 17 bp, Homo sapiens
tttttactacataatta

SEQ ID NO: 4266880 - DNA, 12 bp, Homo sapiens
tttttcctacca

SEQ ID NO: 4266881 - DNA, 19 bp, Homo sapiens
tttttctgttccctgctgg

SEQ ID NO: 4266882 - DNA, 21 bp, Homo sapiens
tttttgaagaagggaaattca

SEQ ID NO: 4266883 - DNA, 13 bp, Homo sapiens
tttttgtctcgaa

SEQ ID NO: 4266884 - DNA, 12 bp, Homo sapiens
ttttttacaaat

SEQ ID NO: 4266885 - DNA, 15 bp, Homo sapiens
ttttttcctgtcata

SEQ ID NO: 4266886 - DNA, 19 bp, Homo sapiens
tttttttaaatgattccaa

SEQ ID NO: 4266887 - DNA, 13 bp, Homo sapiens
tttttttctagct

SEQ ID NO: 4266888 - DNA, 13 bp, Homo sapiens
tgggcacaggctg

SEQ ID NO: 4266889 - DNA, 15 bp, Homo sapiens
tgggcacctctgctg

SEQ ID NO: 4266890 - DNA, 18 bp, Homo sapiens
tggcacaccctctctgtc

SEQ ID NO: 4266891 - DNA, 15 bp, Homo sapiens
tggcaccgccttctc

SEQ ID NO: 4266892 - DNA, 14 bp, Homo sapiens
tggcagaactgagc

SEQ ID NO: 4266893 - DNA, 16 bp, Homo sapiens
tggcagaactgagctc

SEQ ID NO: 4266894 - DNA, 13 bp, Homo sapiens
tggcagcctcaga

SEQ ID NO: 4266895 - DNA, 18 bp, Homo sapiens
tggcagcctcagaggccc

SEQ ID NO: 4266896 - DNA, 20 bp, Homo sapiens
tggcaggaaccatggacctg

SEQ ID NO: 4266897 - DNA, 14 bp, Homo sapiens
tggcaggaggacag

SEQ ID NO: 4266898 - DNA, 20 bp, Homo sapiens
aaagaacccccctccccaag

SEQ ID NO: 4266899 - DNA, 16 bp, Homo sapiens
aaagaagaaagtctat

SEQ ID NO: 4266900 - DNA, 16 bp, Homo sapiens
aaagaagaaccatctt

SEQ ID NO: 4266901 - DNA, 14 bp, Homo sapiens
aaagaagactggaa

SEQ ID NO: 4266902 - DNA, 19 bp, Homo sapiens
aaagacacctactgagtgg

SEQ ID NO: 4266903 - DNA, 14 bp, Homo sapiens
aaagacatgaaatt

SEQ ID NO: 4266904 - DNA, 16 bp, Homo sapiens
aaagacatttaaaata

SEQ ID NO: 4266905 - DNA, 22 bp, Homo sapiens
aaagacttgatgaataaacact

SEQ ID NO: 4266906 - DNA, 22 bp, Homo sapiens
aaagaggagcctttccagaact

SEQ ID NO: 4266907 - DNA, 19 bp, Homo sapiens
aaagaggcgtcttgtattt

SEQ ID NO: 4266908 - DNA, 20 bp, Homo sapiens
aaagaggcgtcttgtatttt

SEQ ID NO: 4266909 - DNA, 22 bp, Homo sapiens
aaagaggcgtcttgtattttct

SEQ ID NO: 4266910 - DNA, 20 bp, Homo sapiens
aaagatatctcatctcttct

SEQ ID NO: 4266911 - DNA, 16 bp, Homo sapiens
aaagatggtaatcttt

SEQ ID NO: 4266912 - DNA, 20 bp, Homo sapiens
aaagatggtaatcttttctg

SEQ ID NO: 4266913 - DNA, 11 bp, Homo sapiens
aaagattttat

SEQ ID NO: 4266914 - DNA, 19 bp, Homo sapiens
aaagattttatgtgcttga

SEQ ID NO: 4266915 - DNA, 10 bp, Homo sapiens
aaagccacat

SEQ ID NO: 4266916 - DNA, 18 bp, Homo sapiens
aaagctatcttcatgtaa

SEQ ID NO: 4266917 - DNA, 13 bp, Homo sapiens
aaaggaaaccttt

SEQ ID NO: 4266918 - DNA, 16 bp, Homo sapiens
aaaggaagacagttct

SEQ ID NO: 4266919 - DNA, 22 bp, Homo sapiens
aaaggaatataccacaccgagg

SEQ ID NO: 4266920 - DNA, 14 bp, Homo sapiens
aaaggagagtactt

SEQ ID NO: 4266921 - DNA, 15 bp, Homo sapiens
aaaggcagagattgg

SEQ ID NO: 4266922 - DNA, 13 bp, Homo sapiens
aaaggcttctcca

SEQ ID NO: 4266923 - DNA, 17 bp, Homo sapiens
aaagggcagcccctccc

SEQ ID NO: 4266924 - DNA, 22 bp, Homo sapiens
aaagggcagcccctccccatgg

SEQ ID NO: 4266925 - DNA, 18 bp, Homo sapiens
aaagggtgctgcttccct

SEQ ID NO: 4266926 - DNA, 17 bp, Homo sapiens
aaaggtaatctgaaaca

SEQ ID NO: 4266927 - DNA, 14 bp, Homo sapiens
aaaggtaggtgcat

SEQ ID NO: 4266928 - DNA, 16 bp, Homo sapiens
aaaggtgacccttctg

SEQ ID NO: 4266929 - DNA, 15 bp, Homo sapiens
aaaggttaagccata

SEQ ID NO: 4266930 - DNA, 16 bp, Homo sapiens
aaaggtttatttttct

SEQ ID NO: 4266931 - DNA, 16 bp, Homo sapiens
aaagtaaatgctacct

SEQ ID NO: 4266932 - DNA, 20 bp, Homo sapiens
aaagtaaatgctacctctga

SEQ ID NO: 4266933 - DNA, 22 bp, Homo sapiens
aaagtaagtggagcatttggaa

SEQ ID NO: 4266934 - DNA, 19 bp, Homo sapiens
aaagtatctctactttcct

SEQ ID NO: 4266935 - DNA, 13 bp, Homo sapiens
aaagtctatgctt

SEQ ID NO: 4266936 - DNA, 14 bp, Homo sapiens
aaagtctctgggtc

SEQ ID NO: 4266937 - DNA, 18 bp, Homo sapiens
aaagtcttgaatgttgaa

SEQ ID NO: 4266938 - DNA, 20 bp, Homo sapiens
aaagttaaacgtgatgtgct

SEQ ID NO: 4266939 - DNA, 18 bp, Homo sapiens
aaataaaaatattctcca

SEQ ID NO: 4266940 - DNA, 20 bp, Homo sapiens
aaataaaaatattctccatg

SEQ ID NO: 4266941 - DNA, 13 bp, Homo sapiens
aaataaaaattct

SEQ ID NO: 4266942 - DNA, 20 bp, Homo sapiens
aaataaagaagaaaataacc

SEQ ID NO: 4266943 - DNA, 22 bp, Homo sapiens
aaataaattggtgataagtgga

SEQ ID NO: 4266944 - DNA, 17 bp, Homo sapiens
aaataacatattcttgc

SEQ ID NO: 4266945 - DNA, 15 bp, Homo sapiens
aaataacatctgaaa

SEQ ID NO: 4266946 - DNA, 16 bp, Homo sapiens
aaataagtaatatctt

SEQ ID NO: 4266947 - DNA, 23 bp, Homo sapiens
aaataatctcatccccaaactgt

SEQ ID NO: 4266948 - DNA, 14 bp, Homo sapiens
aaatacatgatgat

SEQ ID NO: 4266949 - DNA, 15 bp, Homo sapiens
aaatacattccagtg

SEQ ID NO: 4266950 - DNA, 18 bp, Homo sapiens
aaatactcaccaaaatat

SEQ ID NO: 4266951 - DNA, 19 bp, Homo sapiens
aaatactcaccaaaatata

SEQ ID NO: 4266952 - DNA, 19 bp, Homo sapiens
aaatacttctttttcatta

SEQ ID NO: 4266953 - DNA, 18 bp, Homo sapiens
aaataggagggaaacctt

SEQ ID NO: 4266954 - DNA, 18 bp, Homo sapiens
aaatagtgtgtccatgca

SEQ ID NO: 4266955 - DNA, 17 bp, Homo sapiens
aaatagtgttcttttta

SEQ ID NO: 4266956 - DNA, 13 bp, Homo sapiens
aaatagttctatt

SEQ ID NO: 4266957 - DNA, 17 bp, Homo sapiens
aaatagttctatttcta

SEQ ID NO: 4266958 - DNA, 23 bp, Homo sapiens
aaatatatacccccccatgcagt

SEQ ID NO: 4266959 - DNA, 15 bp, Homo sapiens
aaatatctatttatc

SEQ ID NO: 4266960 - DNA, 21 bp, Homo sapiens
aaatatctatttatctgtctg

SEQ ID NO: 4266961 - DNA, 16 bp, Homo sapiens
aaatatctctatttaa

SEQ ID NO: 4266962 - DNA, 20 bp, Homo sapiens
aaatatgtgagcatgaaact

SEQ ID NO: 4266963 - DNA, 14 bp, Homo sapiens
aaatattagcaaag

SEQ ID NO: 4266964 - DNA, 23 bp, Homo sapiens
aaatattccatccatatactttg

SEQ ID NO: 4266965 - DNA, 17 bp, Homo sapiens
aaatatttatgacctca

SEQ ID NO: 4266966 - DNA, 20 bp, Homo sapiens
aaatatttctaagcttattt

SEQ ID NO: 4266967 - DNA, 22 bp, Homo sapiens
aaatatttttttctagctataa

SEQ ID NO: 4266968 - DNA, 15 bp, Homo sapiens
aaatcaaatttttct

SEQ ID NO: 4266969 - DNA, 12 bp, Homo sapiens
aaatcagaatct

SEQ ID NO: 4266970 - DNA, 14 bp, Homo sapiens
aaatcagaatcttt

SEQ ID NO: 4266971 - DNA, 22 bp, Homo sapiens
aaatcatgcttataagcaacat

SEQ ID NO: 4266972 - DNA, 19 bp, Homo sapiens
aaatccataccccctgccc

SEQ ID NO: 4266973 - DNA, 18 bp, Homo sapiens
aaatcctgttacttaaat

SEQ ID NO: 4266974 - DNA, 22 bp, Homo sapiens
aaatcgcattaatgaaatacca

SEQ ID NO: 4266975 - DNA, 14 bp, Homo sapiens
aaatcggcaacagg

SEQ ID NO: 4266976 - DNA, 15 bp, Homo sapiens
aaatctaacattatt

SEQ ID NO: 4266977 - DNA, 18 bp, Homo sapiens
aaatctatagtttgattc

SEQ ID NO: 4266978 - DNA, 14 bp, Homo sapiens
aaatctcatcccta

SEQ ID NO: 4266979 - DNA, 22 bp, Homo sapiens
aaatctgtctgattctatgcct

SEQ ID NO: 4266980 - DNA, 21 bp, Homo sapiens
aaatgaataatgcctttgtaa

SEQ ID NO: 4266981 - DNA, 12 bp, Homo sapiens
aaatgagcattt

SEQ ID NO: 4266982 - DNA, 14 bp, Homo sapiens
aaatgagcattttt

SEQ ID NO: 4266983 - DNA, 22 bp, Homo sapiens
aaatgagtttaaaaaaataaca

SEQ ID NO: 4266984 - DNA, 12 bp, Homo sapiens
aaatgatagata

SEQ ID NO: 4266985 - DNA, 11 bp, Homo sapiens
aaatgattcca

SEQ ID NO: 4266986 - DNA, 17 bp, Homo sapiens
aaatgatttcaaaatga

SEQ ID NO: 4266987 - DNA, 14 bp, Homo sapiens
aaatgcatgatatt

SEQ ID NO: 4266988 - DNA, 20 bp, Homo sapiens
aaatgcatgatattgtatgt

SEQ ID NO: 4266989 - DNA, 16 bp, Homo sapiens
aaatgccgctgtgtcc

SEQ ID NO: 4266990 - DNA, 15 bp, Homo sapiens
aaatgctacctctga

SEQ ID NO: 4266991 - DNA, 20 bp, Homo sapiens
aaatgctgtatgtcattaaa

SEQ ID NO: 4266992 - DNA, 22 bp, Homo sapiens
aaatgctgtatgtcattaaagt

SEQ ID NO: 4266993 - DNA, 19 bp, Homo sapiens
aaatgctgttggtgagaat

SEQ ID NO: 4266994 - DNA, 20 bp, Homo sapiens
aaatgctgttggtgagaatc

SEQ ID NO: 4266995 - DNA, 14 bp, Homo sapiens
aaatggacttttgt

SEQ ID NO: 4266996 - DNA, 20 bp, Homo sapiens
aaatggcttgttcagtcact

SEQ ID NO: 4266997 - DNA, 19 bp, Homo sapiens
aaatggtgagaattaaaat

SEQ ID NO: 4266998 - DNA, 13 bp, Homo sapiens
aaatgttaacaat

SEQ ID NO: 4266999 - DNA, 17 bp, Homo sapiens
aaatgtttctttttctt

SEQ ID NO: 4267000 - DNA, 20 bp, Homo sapiens
aaatgttttacaatggctgg

SEQ ID NO: 4267001 - DNA, 13 bp, Homo sapiens
aaattacagaaga

SEQ ID NO: 4267002 - DNA, 14 bp, Homo sapiens
aaattagcatctgg

SEQ ID NO: 4267003 - DNA, 23 bp, Homo sapiens
aaattagggctctaatttcctta

SEQ ID NO: 4267004 - DNA, 18 bp, Homo sapiens
aaattagtgagatttgta

SEQ ID NO: 4267005 - DNA, 19 bp, Homo sapiens
aaattagtgagatttgtat

SEQ ID NO: 4267006 - DNA, 12 bp, Homo sapiens
aaattattctag

SEQ ID NO: 4267007 - DNA, 14 bp, Homo sapiens
aaattattctagtc

SEQ ID NO: 4267008 - DNA, 14 bp, Homo sapiens
aaattcacactgtg

SEQ ID NO: 4267009 - DNA, 16 bp, Homo sapiens
aaattctagtctctga

SEQ ID NO: 4267010 - DNA, 19 bp, Homo sapiens
aaattctagtctctgattt

SEQ ID NO: 4267011 - DNA, 13 bp, Homo sapiens
aaattgactgtac

SEQ ID NO: 4267012 - DNA, 14 bp, Homo sapiens
aaattgactgtact

SEQ ID NO: 4267013 - DNA, 14 bp, Homo sapiens
aaattgatgggtgg

SEQ ID NO: 4267014 - DNA, 13 bp, Homo sapiens
aaattgcagaaga

SEQ ID NO: 4267015 - DNA, 18 bp, Homo sapiens
aaattgcagaagaaactc

SEQ ID NO: 4267016 - DNA, 20 bp, Homo sapiens
aaattgcagaagaaactcct

SEQ ID NO: 4267017 - DNA, 18 bp, Homo sapiens
aaattggtgataagtgga

SEQ ID NO: 4267018 - DNA, 16 bp, Homo sapiens
aaatttaactgcatat

SEQ ID NO: 4267019 - DNA, 15 bp, Homo sapiens
aaatttatttccaat

SEQ ID NO: 4267020 - DNA, 18 bp, Homo sapiens
aaatttcatctttccaaa

SEQ ID NO: 4267021 - DNA, 17 bp, Homo sapiens
aaatttgttaatatata

SEQ ID NO: 4267022 - DNA, 14 bp, Homo sapiens
aaattttaatgtaa

SEQ ID NO: 4267023 - DNA, 20 bp, Homo sapiens
aaattttatctcttcttcct

SEQ ID NO: 4267024 - DNA, 15 bp, Homo sapiens
aaatttttttccaga

SEQ ID NO: 4267025 - DNA, 16 bp, Homo sapiens
aaatttttttccagaa

SEQ ID NO: 4267026 - DNA, 12 bp, Homo sapiens
aacaaagaaata

SEQ ID NO: 4267027 - DNA, 22 bp, Homo sapiens
aacaaagcatttgactttctgt

SEQ ID NO: 4267028 - DNA, 14 bp, Homo sapiens
aacaaattaaaaac

SEQ ID NO: 4267029 - DNA, 13 bp, Homo sapiens
acaaatcagtaat

SEQ ID NO: 4267030 - DNA, 10 bp, Homo sapiens
acaaattatg

SEQ ID NO: 4267031 - DNA, 11 bp, Homo sapiens
acaaattatgt

SEQ ID NO: 4267032 - DNA, 16 bp, Homo sapiens
acaacacaatcaaaag

SEQ ID NO: 4267033 - DNA, 22 bp, Homo sapiens
acaaccgatgctccagccaacc

SEQ ID NO: 4267034 - DNA, 18 bp, Homo sapiens
acaaccttctgtggctca

SEQ ID NO: 4267035 - DNA, 12 bp, Homo sapiens
acaactgagtcc

SEQ ID NO: 4267036 - DNA, 21 bp, Homo sapiens
acaagcagagtgcacagctgt

SEQ ID NO: 4267037 - DNA, 21 bp, Homo sapiens
acaagccaaacattcttattt

SEQ ID NO: 4267038 - DNA, 12 bp, Homo sapiens
acaagcccagga

SEQ ID NO: 4267039 - DNA, 16 bp, Homo sapiens
acaagccccaggcagg

SEQ ID NO: 4267040 - DNA, 13 bp, Homo sapiens
acaaggagtgccc

SEQ ID NO: 4267041 - DNA, 15 bp, Homo sapiens
acaaggagtgcccgc

SEQ ID NO: 4267042 - DNA, 11 bp, Homo sapiens
acaaggcccca

SEQ ID NO: 4267043 - DNA, 20 bp, Homo sapiens
acaaggctgaaaagtgcttt

SEQ ID NO: 4267044 - DNA, 23 bp, Homo sapiens
acaagtatgaataaagacaccta

SEQ ID NO: 4267045 - DNA, 12 bp, Homo sapiens
acaataaacgaa

SEQ ID NO: 4267046 - DNA, 13 bp, Homo sapiens
acaataaacgaaa

SEQ ID NO: 4267047 - DNA, 18 bp, Homo sapiens
acaataaacgaaacacag

SEQ ID NO: 4267048 - DNA, 13 bp, Homo sapiens
acaataaataata

SEQ ID NO: 4267049 - DNA, 16 bp, Homo sapiens
acaatggccagcccag

SEQ ID NO: 4267050 - DNA, 18 bp, Homo sapiens
acaatggctgggtttggg

SEQ ID NO: 4267051 - DNA, 20 bp, Homo sapiens
acaatgtatgtgaaagtgta

SEQ ID NO: 4267052 - DNA, 14 bp, Homo sapiens
acaattctgtccct

SEQ ID NO: 4267053 - DNA, 15 bp, Homo sapiens
acaattctgtccctg

SEQ ID NO: 4267054 - DNA, 14 bp, Homo sapiens
acaattcttttgaa

SEQ ID NO: 4267055 - DNA, 15 bp, Homo sapiens
acaattcttttgaaa

SEQ ID NO: 4267056 - DNA, 18 bp, Homo sapiens
acaatttcaaaatgcatg

SEQ ID NO: 4267057 - DNA, 14 bp, Homo sapiens
acacaactcatcca

SEQ ID NO: 4267058 - DNA, 23 bp, Homo sapiens
acacaactcatccagaactgtct

SEQ ID NO: 4267059 - DNA, 22 bp, Homo sapiens
acacaagacagcagagccatct

SEQ ID NO: 4267060 - DNA, 14 bp, Homo sapiens
acacacacacacac

SEQ ID NO: 4267061 - DNA, 14 bp, Homo sapiens
acacacacacacag

SEQ ID NO: 4267062 - DNA, 13 bp, Homo sapiens
acacacacacagg

SEQ ID NO: 4267063 - DNA, 14 bp, Homo sapiens
acacacacaggagg

SEQ ID NO: 4267064 - DNA, 22 bp, Homo sapiens
acacacacccttccccactccc

SEQ ID NO: 4267065 - DNA, 11 bp, Homo sapiens
acacacctgca

SEQ ID NO: 4267066 - DNA, 13 bp, Homo sapiens
acacagctgcttt

SEQ ID NO: 4267067 - DNA, 12 bp, Homo sapiens
acacaggcccat

SEQ ID NO: 4267068 - DNA, 11 bp, Homo sapiens
acacaggcctg

SEQ ID NO: 4267069 - DNA, 16 bp, Homo sapiens
acacaggcctggccca

SEQ ID NO: 4267070 - DNA, 17 bp, Homo sapiens
acacaggcctggcccag

SEQ ID NO: 4267071 - DNA, 23 bp, Homo sapiens
acacaggcctggcccagccagca

SEQ ID NO: 4267072 - DNA, 24 bp, Homo sapiens
acacaggcctggcccagccagcag

SEQ ID NO: 4267073 - DNA, 20 bp, Homo sapiens
acacagtcagggcggggctg

SEQ ID NO: 4267074 - DNA, 22 bp, Homo sapiens
acacagtcagggcggggctggc

SEQ ID NO: 4267075 - DNA, 13 bp, Homo sapiens
acacagtcatgtg

SEQ ID NO: 4267076 - DNA, 14 bp, Homo sapiens
acacagtctggtgc

SEQ ID NO: 4267077 - DNA, 14 bp, Homo sapiens
acacataaagtaaa

SEQ ID NO: 4267078 - DNA, 14 bp, Homo sapiens
acacattatcttct

SEQ ID NO: 4267079 - DNA, 20 bp, Homo sapiens
acaccatgaagatgccattg

SEQ ID NO: 4267080 - DNA, 21 bp, Homo sapiens
acacccaattttaaaaaataa

SEQ ID NO: 4267081 - DNA, 14 bp, Homo sapiens
acacccagccccag

SEQ ID NO: 4267082 - DNA, 14 bp, Homo sapiens
acacccctgcacac

SEQ ID NO: 4267083 - DNA, 15 bp, Homo sapiens
acacccctgcacaca

SEQ ID NO: 4267084 - DNA, 16 bp, Homo sapiens
acaccctctctgtcca

SEQ ID NO: 4267085 - DNA, 15 bp, Homo sapiens
acacccttccccact

SEQ ID NO: 4267086 - DNA, 22 bp, Homo sapiens
acacctaagtgactaccactta

SEQ ID NO: 4267087 - DNA, 12 bp, Homo sapiens
acacctccaccc

SEQ ID NO: 4267088 - DNA, 16 bp, Homo sapiens
acacctgcacacccct

SEQ ID NO: 4267089 - DNA, 17 bp, Homo sapiens
acacctgcctctgaact

SEQ ID NO: 4267090 - DNA, 13 bp, Homo sapiens
acacgcacacaca

SEQ ID NO: 4267091 - DNA, 14 bp, Homo sapiens
acacgcacacacac

SEQ ID NO: 4267092 - DNA, 23 bp, Homo sapiens
acacgcgcgcgcgcgcacacaca

SEQ ID NO: 4267093 - DNA, 15 bp, Homo sapiens
acactacgcagaaga

SEQ ID NO: 4267094 - DNA, 19 bp, Homo sapiens
acactgccagaagtgtgtt

SEQ ID NO: 4267095 - DNA, 18 bp, Homo sapiens
acactgcctttgctgcct

SEQ ID NO: 4267096 - DNA, 19 bp, Homo sapiens
acactgcctttgctgcctt

SEQ ID NO: 4267097 - DNA, 22 bp, Homo sapiens
acactgcctttgctgccttctg

SEQ ID NO: 4267098 - DNA, 12 bp, Homo sapiens
acactggagtgg

SEQ ID NO: 4267099 - DNA, 12 bp, Homo sapiens
acactggcccct

SEQ ID NO: 4267100 - DNA, 15 bp, Homo sapiens
acactggctttacat

SEQ ID NO: 4267101 - DNA, 20 bp, Homo sapiens
acactgtatctaaaaaataa

SEQ ID NO: 4267102 - DNA, 18 bp, Homo sapiens
acactgtctgctgcccca

SEQ ID NO: 4267103 - DNA, 22 bp, Homo sapiens
acactgtgcgttttagagtatg

SEQ ID NO: 4267104 - DNA, 18 bp, Homo sapiens
acacttattttctgaatt

SEQ ID NO: 4267105 - DNA, 21 bp, Homo sapiens
acacttattttctgaattcat

SEQ ID NO: 4267106 - DNA, 21 bp, Homo sapiens
acacttccacccccagctcct

SEQ ID NO: 4267107 - DNA, 14 bp, Homo sapiens
acagacacacgcac

SEQ ID NO: 4267108 - DNA, 21 bp, Homo sapiens
acagagacccccgtgccaaat

SEQ ID NO: 4267109 - DNA, 18 bp, Homo sapiens
acagaggcagtggcagca

SEQ ID NO: 4267110 - DNA, 17 bp, Homo sapiens
acagagggacagtgggc

SEQ ID NO: 4267111 - DNA, 21 bp, Homo sapiens
acagagggacagtgggctatg

SEQ ID NO: 4267112 - DNA, 16 bp, Homo sapiens
acagagtatatatgta

SEQ ID NO: 4267113 - DNA, 11 bp, Homo sapiens
acagagtggat

SEQ ID NO: 4267114 - DNA, 15 bp, Homo sapiens
acagagtggatctgg

SEQ ID NO: 4267115 - DNA, 22 bp, Homo sapiens
acagatgttccatcctgtacaa

SEQ ID NO: 4267116 - DNA, 19 bp, Homo sapiens
acagatgtttgttttcaaa

SEQ ID NO: 4267117 - DNA, 20 bp, Homo sapiens
acagatgtttgttttcaaaa

SEQ ID NO: 4267118 - DNA, 11 bp, Homo sapiens
acagcaggtgt

SEQ ID NO: 4267119 - DNA, 15 bp, Homo sapiens
acagcagtacttgct

SEQ ID NO: 4267120 - DNA, 23 bp, Homo sapiens
acagcagtgtgagggtgcaggga

SEQ ID NO: 4267121 - DNA, 14 bp, Homo sapiens
acagcatgtctact

SEQ ID NO: 4267122 - DNA, 19 bp, Homo sapiens
acagccaaattgcagaaga

SEQ ID NO: 4267123 - DNA, 22 bp, Homo sapiens
acagccaaattgcagaagaaac

SEQ ID NO: 4267124 - DNA, 21 bp, Homo sapiens
acagccctgtcagtgcagccc

SEQ ID NO: 4267125 - DNA, 12 bp, Homo sapiens
acagcctggcac

SEQ ID NO: 4267126 - DNA, 15 bp, Homo sapiens
acagcctggcacagg

SEQ ID NO: 4267127 - DNA, 16 bp, Homo sapiens
acagctgttcttctgt

SEQ ID NO: 4267128 - DNA, 21 bp, Homo sapiens
acagctgttcttctgttctgc

SEQ ID NO: 4267129 - DNA, 22 bp, Homo sapiens
acagcttccccatcgccttctg

SEQ ID NO: 4267130 - DNA, 20 bp, Homo sapiens
acaggaacacccagccccag

SEQ ID NO: 4267131 - DNA, 12 bp, Homo sapiens
acaggaccagga

SEQ ID NO: 4267132 - DNA, 13 bp, Homo sapiens
acaggaccaggag

SEQ ID NO: 4267133 - DNA, 17 bp, Homo sapiens
acaggaccaggagccag

SEQ ID NO: 4267134 - DNA, 16 bp, Homo sapiens
acaggagcgtgtccta

SEQ ID NO: 4267135 - DNA, 18 bp, Homo sapiens
acaggaggaactggtcca

SEQ ID NO: 4267136 - DNA, 22 bp, Homo sapiens
acaggaggaactggtccaggcc

SEQ ID NO: 4267137 - DNA, 22 bp, Homo sapiens
acaggcccttcctctccactgc

SEQ ID NO: 4267138 - DNA, 17 bp, Homo sapiens
acaggcctggcccagcc

SEQ ID NO: 4267139 - DNA, 19 bp, Homo sapiens
acaggcctggcccagccag

SEQ ID NO: 4267140 - DNA, 21 bp, Homo sapiens
acaggcctggcccagccagca

SEQ ID NO: 4267141 - DNA, 22 bp, Homo sapiens
acaggcctggcccagccagcag

SEQ ID NO: 4267142 - DNA, 15 bp, Homo sapiens
acaggcgttctcagc

SEQ ID NO: 4267143 - DNA, 15 bp, Homo sapiens
acagggaagaaatca

SEQ ID NO: 4267144 - DNA, 17 bp, Homo sapiens
acagggaagaaatcaag

SEQ ID NO: 4267145 - DNA, 20 bp, Homo sapiens
acagggagggaacagacctc

SEQ ID NO: 4267146 - DNA, 17 bp, Homo sapiens
acagggcatctccagga

SEQ ID NO: 4267147 - DNA, 15 bp, Homo sapiens
acagggcttctcttt

SEQ ID NO: 4267148 - DNA, 17 bp, Homo sapiens
acagggtggggcttaga

SEQ ID NO: 4267149 - DNA, 14 bp, Homo sapiens
acagtaagctgctc

SEQ ID NO: 4267150 - DNA, 21 bp, Homo sapiens
acagtagctgtggggagctgg

SEQ ID NO: 4267151 - DNA, 17 bp, Homo sapiens
acagtatattttatttc

SEQ ID NO: 4267152 - DNA, 21 bp, Homo sapiens
acagtatattttatttcaatg

SEQ ID NO: 4267153 - DNA, 23 bp, Homo sapiens
acagtatattttatttcaatgta

SEQ ID NO: 4267154 - DNA, 18 bp, Homo sapiens
acagtctggaggtcccag

SEQ ID NO: 4267155 - DNA, 23 bp, Homo sapiens
acagtcttcattttttttaattg

SEQ ID NO: 4267156 - DNA, 15 bp, Homo sapiens
acagtgcatctcagc

SEQ ID NO: 4267157 - DNA, 12 bp, Homo sapiens
acagtggaggga

SEQ ID NO: 4267158 - DNA, 14 bp, Homo sapiens
acagtgtttccagt

SEQ ID NO: 4267159 - DNA, 19 bp, Homo sapiens
acagttgcacagcatctca

SEQ ID NO: 4267160 - DNA, 14 bp, Homo sapiens
actgcctgcccacc

SEQ ID NO: 4267161 - DNA, 16 bp, Homo sapiens
actgcctgcccacccg

SEQ ID NO: 4267162 - DNA, 16 bp, Homo sapiens
actgctgcgctgtgct

SEQ ID NO: 4267163 - DNA, 12 bp, Homo sapiens
actgctggctgc

SEQ ID NO: 4267164 - DNA, 13 bp, Homo sapiens
actgctgttttat

SEQ ID NO: 4267165 - DNA, 15 bp, Homo sapiens
actgctgttttatgt

SEQ ID NO: 4267166 - DNA, 14 bp, Homo sapiens
actgctttgagaaa

SEQ ID NO: 4267167 - DNA, 15 bp, Homo sapiens
actggaggcctctgc

SEQ ID NO: 4267168 - DNA, 16 bp, Homo sapiens
actggaggcctctgca

SEQ ID NO: 4267169 - DNA, 18 bp, Homo sapiens
actggaggcctctgcaag

SEQ ID NO: 4267170 - DNA, 18 bp, Homo sapiens
actggatactgcccgggg

SEQ ID NO: 4267171 - DNA, 23 bp, Homo sapiens
actggccttctgatgaaatgtta

SEQ ID NO: 4267172 - DNA, 19 bp, Homo sapiens
actggctcctccagcaaga

SEQ ID NO: 4267173 - DNA, 18 bp, Homo sapiens
actgggaagggggcaggc

SEQ ID NO: 4267174 - DNA, 21 bp, Homo sapiens
actgggctggctgccttctgc

SEQ ID NO: 4267175 - DNA, 16 bp, Homo sapiens
actggtaagattgtta

SEQ ID NO: 4267176 - DNA, 21 bp, Homo sapiens
actggtccaggcatgggtccc

SEQ ID NO: 4267177 - DNA, 13 bp, Homo sapiens
actggtggaagga

SEQ ID NO: 4267178 - DNA, 12 bp, Homo sapiens
actggtggcccg

SEQ ID NO: 4267179 - DNA, 21 bp, Homo sapiens
actggtggcccgacagcctgg

SEQ ID NO: 4267180 - DNA, 23 bp, Homo sapiens
actggtggcccgacagcctggca

SEQ ID NO: 4267181 - DNA, 16 bp, Homo sapiens
actgtaaatttaatag

SEQ ID NO: 4267182 - DNA, 20 bp, Homo sapiens
actgtactcctcccaggcgc

SEQ ID NO: 4267183 - DNA, 18 bp, Homo sapiens
actgtataccgtgtgctc

SEQ ID NO: 4267184 - DNA, 15 bp, Homo sapiens
actgtatatttgtat

SEQ ID NO: 4267185 - DNA, 17 bp, Homo sapiens
actgtatatttgtatga

SEQ ID NO: 4267186 - DNA, 18 bp, Homo sapiens
actgtcagagaatatgac

SEQ ID NO: 4267187 - DNA, 22 bp, Homo sapiens
actgtcccacaaaatatttcta

SEQ ID NO: 4267188 - DNA, 23 bp, Homo sapiens
actgtcccacaaaatatttctaa

SEQ ID NO: 4267189 - DNA, 22 bp, Homo sapiens
actgtcccggagctcaggccct

SEQ ID NO: 4267190 - DNA, 14 bp, Homo sapiens
actgtctaagaata

SEQ ID NO: 4267191 - DNA, 22 bp, Homo sapiens
actgtctaagaataatgacgta

SEQ ID NO: 4267192 - DNA, 19 bp, Homo sapiens
actgtctcaagagggcact

SEQ ID NO: 4267193 - DNA, 20 bp, Homo sapiens
actgtctcaagagggcactg

SEQ ID NO: 4267194 - DNA, 21 bp, Homo sapiens
actgtctcaagagggcactgg

SEQ ID NO: 4267195 - DNA, 15 bp, Homo sapiens
actgtctctcatgaa

SEQ ID NO: 4267196 - DNA, 16 bp, Homo sapiens
actgtgaccaagtata

SEQ ID NO: 4267197 - DNA, 22 bp, Homo sapiens
actgtgaccaagtataaacttt

SEQ ID NO: 4267198 - DNA, 12 bp, Homo sapiens
actgtgacctgt

SEQ ID NO: 4267199 - DNA, 22 bp, Homo sapiens
actgtgcagccggggagctgag

SEQ ID NO: 4267200 - DNA, 17 bp, Homo sapiens
actgtgcgttttagagt

SEQ ID NO: 4267201 - DNA, 18 bp, Homo sapiens
actgtgtccctctctctg

SEQ ID NO: 4267202 - DNA, 16 bp, Homo sapiens
actgttaacttattca

SEQ ID NO: 4267203 - DNA, 15 bp, Homo sapiens
actgttacagtaatg

SEQ ID NO: 4267204 - DNA, 16 bp, Homo sapiens
actgttacagtaatgt

SEQ ID NO: 4267205 - DNA, 20 bp, Homo sapiens
actgttacagtaatgtcata

SEQ ID NO: 4267206 - DNA, 15 bp, Homo sapiens
actgttcatttccac

SEQ ID NO: 4267207 - DNA, 18 bp, Homo sapiens
actgttgtttgatgtgta

SEQ ID NO: 4267208 - DNA, 19 bp, Homo sapiens
actgtttatggtattttcg

SEQ ID NO: 4267209 - DNA, 22 bp, Homo sapiens
actgtttgtaatatacagtttt

SEQ ID NO: 4267210 - DNA, 13 bp, Homo sapiens
actgttttcatgt

SEQ ID NO: 4267211 - DNA, 15 bp, Homo sapiens
actgttttcatgtgt

SEQ ID NO: 4267212 - DNA, 14 bp, Homo sapiens
actgttttttcctg

SEQ ID NO: 4267213 - DNA, 18 bp, Homo sapiens
actgttttttcctgagct

SEQ ID NO: 4267214 - DNA, 16 bp, Homo sapiens
acttaaaaatttatta

SEQ ID NO: 4267215 - DNA, 13 bp, Homo sapiens
acttaaaatcaaa

SEQ ID NO: 4267216 - DNA, 23 bp, Homo sapiens
acttaaccctgacaaattttaat

SEQ ID NO: 4267217 - DNA, 16 bp, Homo sapiens
acttactcccattttc

SEQ ID NO: 4267218 - DNA, 22 bp, Homo sapiens
acttactgtcagagaatatgac

SEQ ID NO: 4267219 - DNA, 16 bp, Homo sapiens
acttagaaattgcatt

SEQ ID NO: 4267220 - DNA, 16 bp, Homo sapiens
acttatgctgctgtga

SEQ ID NO: 4267221 - DNA, 20 bp, Homo sapiens
acttatgctgctgtgaattt

SEQ ID NO: 4267222 - DNA, 17 bp, Homo sapiens
acttattcaaagagaaa

SEQ ID NO: 4267223 - DNA, 13 bp, Homo sapiens
acttatttccatg

SEQ ID NO: 4267224 - DNA, 14 bp, Homo sapiens
acttatttctaaat

SEQ ID NO: 4267225 - DNA, 15 bp, Homo sapiens
acttcaaaatcagtg

SEQ ID NO: 4267226 - DNA, 19 bp, Homo sapiens
acttcaaaatcagtgatgg

SEQ ID NO: 4267227 - DNA, 18 bp, Homo sapiens
acttcaagctcaccctgc

SEQ ID NO: 4267228 - DNA, 13 bp, Homo sapiens
acttcagactctc

SEQ ID NO: 4267229 - DNA, 19 bp, Homo sapiens
acttcagactctctcctct

SEQ ID NO: 4267230 - DNA, 20 bp, Homo sapiens
acttcagactctctcctctc

SEQ ID NO: 4267231 - DNA, 16 bp, Homo sapiens
acttcaggctcttctc

SEQ ID NO: 4267232 - DNA, 18 bp, Homo sapiens
acttcaggctcttctcct

SEQ ID NO: 4267233 - DNA, 20 bp, Homo sapiens
acttccacccccagctcctt

SEQ ID NO: 4267234 - DNA, 17 bp, Homo sapiens
acttcctgtccagagag

SEQ ID NO: 4267235 - DNA, 16 bp, Homo sapiens
acttcgctattcccag

SEQ ID NO: 4267236 - DNA, 22 bp, Homo sapiens
acttcgctattcccaggcaggg

SEQ ID NO: 4267237 - DNA, 15 bp, Homo sapiens
acttctgaccacact

SEQ ID NO: 4267238 - DNA, 16 bp, Homo sapiens
acttcttctgtaatat

SEQ ID NO: 4267239 - DNA, 17 bp, Homo sapiens
acttgaaattatatctg

SEQ ID NO: 4267240 - DNA, 11 bp, Homo sapiens
acttgaacaaa

SEQ ID NO: 4267241 - DNA, 14 bp, Homo sapiens
acttgatgaataaa

SEQ ID NO: 4267242 - DNA, 20 bp, Homo sapiens
acttgccctgaccatgcatt

SEQ ID NO: 4267243 - DNA, 20 bp, Homo sapiens
acttgctagtgatacactgt

SEQ ID NO: 4267244 - DNA, 22 bp, Homo sapiens
acttgctagtgatacactgtat

SEQ ID NO: 4267245 - DNA, 21 bp, Homo sapiens
acttggataggagcttccaga

SEQ ID NO: 4267246 - DNA, 22 bp, Homo sapiens
acttggataggagcttccagat

SEQ ID NO: 4267247 - DNA, 22 bp, Homo sapiens
acttggtgcttattgatattct

SEQ ID NO: 4267248 - DNA, 19 bp, Homo sapiens
acttgtgaaacacagctgt

SEQ ID NO: 4267249 - DNA, 20 bp, Homo sapiens
acttgtgaaacacagctgtt

SEQ ID NO: 4267250 - DNA, 18 bp, Homo sapiens
acttgtgtttgtatataa

SEQ ID NO: 4267251 - DNA, 20 bp, Homo sapiens
acttgtgtttgtatataaat

SEQ ID NO: 4267252 - DNA, 23 bp, Homo sapiens
actttagggctaaccagttctct

SEQ ID NO: 4267253 - DNA, 16 bp, Homo sapiens
actttcactataatgt

SEQ ID NO: 4267254 - DNA, 16 bp, Homo sapiens
actttccaccccctcc

SEQ ID NO: 4267255 - DNA, 19 bp, Homo sapiens
actttccaccccctccctg

SEQ ID NO: 4267256 - DNA, 23 bp, Homo sapiens
actttgacacttttcatatcatt

SEQ ID NO: 4267257 - DNA, 16 bp, Homo sapiens
actttggatcaggaaa

SEQ ID NO: 4267258 - DNA, 12 bp, Homo sapiens
actttggtaatg

SEQ ID NO: 4267259 - DNA, 13 bp, Homo sapiens
actttggtaatgt

SEQ ID NO: 4267260 - DNA, 18 bp, Homo sapiens
actttggtttctgtctgt

SEQ ID NO: 4267261 - DNA, 17 bp, Homo sapiens
actttgtgcaatatgag

SEQ ID NO: 4267262 - DNA, 18 bp, Homo sapiens
acttttcatatcatttct

SEQ ID NO: 4267263 - DNA, 18 bp, Homo sapiens
acttttcctttgaatcct

SEQ ID NO: 4267264 - DNA, 16 bp, Homo sapiens
acttttgtgtattctg

SEQ ID NO: 4267265 - DNA, 18 bp, Homo sapiens
acttttgtgtattctgtg

SEQ ID NO: 4267266 - DNA, 20 bp, Homo sapiens
acttttgtgtattctgtgga

SEQ ID NO: 4267267 - DNA, 14 bp, Homo sapiens
acttttgtgtgaaa

SEQ ID NO: 4267268 - DNA, 19 bp, Homo sapiens
actttttttctatattatt

SEQ ID NO: 4267269 - DNA, 22 bp, Homo sapiens
agaaaaaaacattctatctact

SEQ ID NO: 4267270 - DNA, 16 bp, Homo sapiens
agaaaaatttcacgat

SEQ ID NO: 4267271 - DNA, 15 bp, Homo sapiens
agaaaagactgacct

SEQ ID NO: 4267272 - DNA, 14 bp, Homo sapiens
agaaaagctttgaa

SEQ ID NO: 4267273 - DNA, 16 bp, Homo sapiens
agaaaatggaacatta

SEQ ID NO: 4267274 - DNA, 16 bp, Homo sapiens
agaaacgagatttgcc

SEQ ID NO: 4267275 - DNA, 17 bp, Homo sapiens
agaaacgagatttgcca

SEQ ID NO: 4267276 - DNA, 15 bp, Homo sapiens
agaaagcatattgac

SEQ ID NO: 4267277 - DNA, 21 bp, Homo sapiens
agaaagcatctattcccaaag

SEQ ID NO: 4267278 - DNA, 18 bp, Homo sapiens
agaaagggcagcccctcc

SEQ ID NO: 4267279 - DNA, 17 bp, Homo sapiens
agaaaggttgattctca

SEQ ID NO: 4267280 - DNA, 13 bp, Homo sapiens
agaaagtctatgc

SEQ ID NO: 4267281 - DNA, 17 bp, Homo sapiens
agaaataaaccttaata

SEQ ID NO: 4267282 - DNA, 23 bp, Homo sapiens
agaaatatctgtgaaatatcatc

SEQ ID NO: 4267283 - DNA, 13 bp, Homo sapiens
agaaatctatttc

SEQ ID NO: 4267284 - DNA, 12 bp, Homo sapiens
agaaatgctaat

SEQ ID NO: 4267285 - DNA, 22 bp, Homo sapiens
agaaatgctaatgtaatcattt

SEQ ID NO: 4267286 - DNA, 13 bp, Homo sapiens
agaaattagggct

SEQ ID NO: 4267287 - DNA, 19 bp, Homo sapiens
agaaattagggctctaatt

SEQ ID NO: 4267288 - DNA, 16 bp, Homo sapiens
agaaattgtttttctg

SEQ ID NO: 4267289 - DNA, 20 bp, Homo sapiens
agaaccagtcttttgaaaga

SEQ ID NO: 4267290 - DNA, 13 bp, Homo sapiens
agcccccaccagc

SEQ ID NO: 4267291 - DNA, 16 bp, Homo sapiens
agcccccaccagcagc

SEQ ID NO: 4267292 - DNA, 22 bp, Homo sapiens
agcccccaccagcagcacaatt

SEQ ID NO: 4267293 - DNA, 19 bp, Homo sapiens
agccccccagtgtccccag

SEQ ID NO: 4267294 - DNA, 12 bp, Homo sapiens
agccccctcctg

SEQ ID NO: 4267295 - DNA, 13 bp, Homo sapiens
agccccctcctga

SEQ ID NO: 4267296 - DNA, 22 bp, Homo sapiens
agccccctgtccttcccacggc

SEQ ID NO: 4267297 - DNA, 22 bp, Homo sapiens
agcccctaagtcaacttagcat

SEQ ID NO: 4267298 - DNA, 17 bp, Homo sapiens
agcccctatcctgcacc

SEQ ID NO: 4267299 - DNA, 13 bp, Homo sapiens
agcccctcccacc

SEQ ID NO: 4267300 - DNA, 14 bp, Homo sapiens
agcccctcccacca

SEQ ID NO: 4267301 - DNA, 23 bp, Homo sapiens
agcccctcccaccacagcaggtg

SEQ ID NO: 4267302 - DNA, 20 bp, Homo sapiens
agcccctcttgccccccacc

SEQ ID NO: 4267303 - DNA, 16 bp, Homo sapiens
agcccctgctgctcct

SEQ ID NO: 4267304 - DNA, 18 bp, Homo sapiens
agcccgcacccccaccct

SEQ ID NO: 4267305 - DNA, 14 bp, Homo sapiens
agcccgcccacctg

SEQ ID NO: 4267306 - DNA, 18 bp, Homo sapiens
agcccgtgtggccccttc

SEQ ID NO: 4267307 - DNA, 13 bp, Homo sapiens
agccctccctgcc

SEQ ID NO: 4267308 - DNA, 16 bp, Homo sapiens
agccctccctgcccct

SEQ ID NO: 4267309 - DNA, 23 bp, Homo sapiens
agccctccctgcccctcccttca

SEQ ID NO: 4267310 - DNA, 16 bp, Homo sapiens
agccctctcactgtgt

SEQ ID NO: 4267311 - DNA, 18 bp, Homo sapiens
agccctctcactgtgtcc

SEQ ID NO: 4267312 - DNA, 19 bp, Homo sapiens
agccctctcactgtgtccc

SEQ ID NO: 4267313 - DNA, 16 bp, Homo sapiens
agccctgcattttcat

SEQ ID NO: 4267314 - DNA, 18 bp, Homo sapiens
agccctgccctcactcca

SEQ ID NO: 4267315 - DNA, 19 bp, Homo sapiens
agccctgccctcactccac

SEQ ID NO: 4267316 - DNA, 20 bp, Homo sapiens
agccctgccctcactccact

SEQ ID NO: 4267317 - DNA, 22 bp, Homo sapiens
agccctgctttgggctgccctg

SEQ ID NO: 4267318 - DNA, 22 bp, Homo sapiens
agccctggtggccaagcctgcc

SEQ ID NO: 4267319 - DNA, 12 bp, Homo sapiens
agccctgtggaa

SEQ ID NO: 4267320 - DNA, 13 bp, Homo sapiens
agccgagctctcc

SEQ ID NO: 4267321 - DNA, 18 bp, Homo sapiens
agccgctggtgcccacca

SEQ ID NO: 4267322 - DNA, 23 bp, Homo sapiens
agccgctggtgcccaccagctgg

SEQ ID NO: 4267323 - DNA, 14 bp, Homo sapiens
agccggggagctga

SEQ ID NO: 4267324 - DNA, 16 bp, Homo sapiens
agccggggagctgagg

SEQ ID NO: 4267325 - DNA, 16 bp, Homo sapiens
agccgtgacctccagg

SEQ ID NO: 4267326 - DNA, 15 bp, Homo sapiens
agccgtgccttcagc

SEQ ID NO: 4267327 - DNA, 23 bp, Homo sapiens
agccgtttgaatatattttatct

SEQ ID NO: 4267328 - DNA, 13 bp, Homo sapiens
agcctagggtgag

SEQ ID NO: 4267329 - DNA, 16 bp, Homo sapiens
agcctcacccctgcag

SEQ ID NO: 4267330 - DNA, 18 bp, Homo sapiens
agcctcacccctgcaggc

SEQ ID NO: 4267331 - DNA, 17 bp, Homo sapiens
agcctcactgatatatt

SEQ ID NO: 4267332 - DNA, 20 bp, Homo sapiens
agcctcagaggccccttgct

SEQ ID NO: 4267333 - DNA, 21 bp, Homo sapiens
agcctcagaggccccttgctg

SEQ ID NO: 4267334 - DNA, 11 bp, Homo sapiens
agcctcaggcc

SEQ ID NO: 4267335 - DNA, 19 bp, Homo sapiens
agcctcaggcctggccctt

SEQ ID NO: 4267336 - DNA, 14 bp, Homo sapiens
agcctccacctgca

SEQ ID NO: 4267337 - DNA, 17 bp, Homo sapiens
agcctccacctgcagcc

SEQ ID NO: 4267338 - DNA, 19 bp, Homo sapiens
agcctccactccctgtctg

SEQ ID NO: 4267339 - DNA, 22 bp, Homo sapiens
agcctccactccctgtctgaaa

SEQ ID NO: 4267340 - DNA, 23 bp, Homo sapiens
agcctccactttggatcaggaaa

SEQ ID NO: 4267341 - DNA, 21 bp, Homo sapiens
agcctcctgctgagtggtcca

SEQ ID NO: 4267342 - DNA, 19 bp, Homo sapiens
agcctcgcccctccagtgt

SEQ ID NO: 4267343 - DNA, 17 bp, Homo sapiens
agcctgatgatggaagg

SEQ ID NO: 4267344 - DNA, 21 bp, Homo sapiens
agcctgccccggccactctgt

SEQ ID NO: 4267345 - DNA, 15 bp, Homo sapiens
agcctgcgtggcctg

SEQ ID NO: 4267346 - DNA, 11 bp, Homo sapiens
agcctggccca

SEQ ID NO: 4267347 - DNA, 12 bp, Homo sapiens
agcctggcccag

SEQ ID NO: 4267348 - DNA, 16 bp, Homo sapiens
agcctggcccagtgag

SEQ ID NO: 4267349 - DNA, 15 bp, Homo sapiens
agcctgtgggagaag

SEQ ID NO: 4267350 - DNA, 13 bp, Homo sapiens
agcctgtgggtcc

SEQ ID NO: 4267351 - DNA, 23 bp, Homo sapiens
agcctgtgttagtgtctgtccat

SEQ ID NO: 4267352 - DNA, 15 bp, Homo sapiens
agccttaagaaagct

SEQ ID NO: 4267353 - DNA, 17 bp, Homo sapiens
agccttaagaaagctat

SEQ ID NO: 4267354 - DNA, 21 bp, Homo sapiens
agccttagtttcagctgacca

SEQ ID NO: 4267355 - DNA, 20 bp, Homo sapiens
agccttctctgttcatttcc

SEQ ID NO: 4267356 - DNA, 22 bp, Homo sapiens
agccttctctgttcatttcctc

SEQ ID NO: 4267357 - DNA, 16 bp, Homo sapiens
agccttggggattctt

SEQ ID NO: 4267358 - DNA, 20 bp, Homo sapiens
agcgacatctctgactttct

SEQ ID NO: 4267359 - DNA, 15 bp, Homo sapiens
agcgagtctggagac

SEQ ID NO: 4267360 - DNA, 16 bp, Homo sapiens
agcgagtctggagacc

SEQ ID NO: 4267361 - DNA, 17 bp, Homo sapiens
agcgagtctggagacca

SEQ ID NO: 4267362 - DNA, 16 bp, Homo sapiens
agcgctcctctgcctt

SEQ ID NO: 4267363 - DNA, 12 bp, Homo sapiens
agcgctggcctc

SEQ ID NO: 4267364 - DNA, 14 bp, Homo sapiens
agcggccgcctgtc

SEQ ID NO: 4267365 - DNA, 17 bp, Homo sapiens
agcggccgcctgtcctt

SEQ ID NO: 4267366 - DNA, 18 bp, Homo sapiens
agcggccgcctgtccttg

SEQ ID NO: 4267367 - DNA, 13 bp, Homo sapiens
agcggcctgggga

SEQ ID NO: 4267368 - DNA, 14 bp, Homo sapiens
agcgtgtcctatcc

SEQ ID NO: 4267369 - DNA, 21 bp, Homo sapiens
agcgtgtcctatccccggacg

SEQ ID NO: 4267370 - DNA, 21 bp, Homo sapiens
agctaaaataaaccagactca

SEQ ID NO: 4267371 - DNA, 19 bp, Homo sapiens
agctaacactggcccctag

SEQ ID NO: 4267372 - DNA, 16 bp, Homo sapiens
agctacggttccctgc

SEQ ID NO: 4267373 - DNA, 18 bp, Homo sapiens
agctacggttccctgcct

SEQ ID NO: 4267374 - DNA, 16 bp, Homo sapiens
agctagaatatcctat

SEQ ID NO: 4267375 - DNA, 20 bp, Homo sapiens
agctaggttaataggaggac

SEQ ID NO: 4267376 - DNA, 16 bp, Homo sapiens
agctatcttcatgtaa

SEQ ID NO: 4267377 - DNA, 18 bp, Homo sapiens
agctatcttcatgtaaat

SEQ ID NO: 4267378 - DNA, 20 bp, Homo sapiens
agctatcttcatgtaaattg

SEQ ID NO: 4267379 - DNA, 20 bp, Homo sapiens
agctatgctgtatctgtgct

SEQ ID NO: 4267380 - DNA, 20 bp, Homo sapiens
agctattactggatctctta

SEQ ID NO: 4267381 - DNA, 21 bp, Homo sapiens
agctcacttcaagctcaccct

SEQ ID NO: 4267382 - DNA, 19 bp, Homo sapiens
agctcagcccacccccctc

SEQ ID NO: 4267383 - DNA, 12 bp, Homo sapiens
agctcaggagaa

SEQ ID NO: 4267384 - DNA, 15 bp, Homo sapiens
agctcaggagaaggc

SEQ ID NO: 4267385 - DNA, 16 bp, Homo sapiens
agctcatcttcactgc

SEQ ID NO: 4267386 - DNA, 18 bp, Homo sapiens
agctccagacccccagca

SEQ ID NO: 4267387 - DNA, 23 bp, Homo sapiens
agctccagacccccagcaaccct

SEQ ID NO: 4267388 - DNA, 14 bp, Homo sapiens
agctccaggcagga

SEQ ID NO: 4267389 - DNA, 18 bp, Homo sapiens
agctccataattgcaagg

SEQ ID NO: 4267390 - DNA, 14 bp, Homo sapiens
agctcctctgggca

SEQ ID NO: 4267391 - DNA, 17 bp, Homo sapiens
agctcctctgggcagga

SEQ ID NO: 4267392 - DNA, 20 bp, Homo sapiens
agctcctctgggcaggacct

SEQ ID NO: 4267393 - DNA, 14 bp, Homo sapiens
agctcgtgtgctta

SEQ ID NO: 4267394 - DNA, 21 bp, Homo sapiens
agctcgtgtgcttagaaacct

SEQ ID NO: 4267395 - DNA, 12 bp, Homo sapiens
agctctcccctg

SEQ ID NO: 4267396 - DNA, 19 bp, Homo sapiens
agctctcccctgcgcaggc

SEQ ID NO: 4267397 - DNA, 23 bp, Homo sapiens
agctctcccctgcgcaggccctc

SEQ ID NO: 4267398 - DNA, 15 bp, Homo sapiens
agctctcctgggcca

SEQ ID NO: 4267399 - DNA, 16 bp, Homo sapiens
agctctcctgggccag

SEQ ID NO: 4267400 - DNA, 22 bp, Homo sapiens
agctctcctgggccagggtctc

SEQ ID NO: 4267401 - DNA, 18 bp, Homo sapiens
agctcttggcaggagtgg

SEQ ID NO: 4267402 - DNA, 20 bp, Homo sapiens
agctgaccagaagtggcagg

SEQ ID NO: 4267403 - DNA, 17 bp, Homo sapiens
agctgcagaaccagtcc

SEQ ID NO: 4267404 - DNA, 22 bp, Homo sapiens
agctgcaggaatcaaaaattga

SEQ ID NO: 4267405 - DNA, 20 bp, Homo sapiens
agctgcagttagcacagagg

SEQ ID NO: 4267406 - DNA, 13 bp, Homo sapiens
agctgccagagaa

SEQ ID NO: 4267407 - DNA, 19 bp, Homo sapiens
agctgcttctgcccacccc

SEQ ID NO: 4267408 - DNA, 23 bp, Homo sapiens
agctgcttctgcccaccccgcct

SEQ ID NO: 4267409 - DNA, 20 bp, Homo sapiens
agctgcttctgggggatttc

SEQ ID NO: 4267410 - DNA, 14 bp, Homo sapiens
agctggctctgaat

SEQ ID NO: 4267411 - DNA, 12 bp, Homo sapiens
agctggctctgc

SEQ ID NO: 4267412 - DNA, 14 bp, Homo sapiens
agctggctctgcag

SEQ ID NO: 4267413 - DNA, 20 bp, Homo sapiens
agctggctctgcagcacatt

SEQ ID NO: 4267414 - DNA, 18 bp, Homo sapiens
agctgggggccatgagct

SEQ ID NO: 4267415 - DNA, 20 bp, Homo sapiens
agctgggggccatgagctcc

SEQ ID NO: 4267416 - DNA, 17 bp, Homo sapiens
agctgtgacctctcccc

SEQ ID NO: 4267417 - DNA, 15 bp, Homo sapiens
agctgtggggagctg

SEQ ID NO: 4267418 - DNA, 16 bp, Homo sapiens
agctgttctctgcttt

SEQ ID NO: 4267419 - DNA, 12 bp, Homo sapiens
agcttatttcta

SEQ ID NO: 4267420 - DNA, 15 bp, Homo sapiens
agtctgctgccctcc

SEQ ID NO: 4267421 - DNA, 18 bp, Homo sapiens
agtctgctgccctccatc

SEQ ID NO: 4267422 - DNA, 19 bp, Homo sapiens
agtctggagaccaggactc

SEQ ID NO: 4267423 - DNA, 21 bp, Homo sapiens
agtctttgggggattcaaatg

SEQ ID NO: 4267424 - DNA, 22 bp, Homo sapiens
agtctttttagtgttttgcaag

SEQ ID NO: 4267425 - DNA, 22 bp, Homo sapiens
agtgaacattattaaatcagaa

SEQ ID NO: 4267426 - DNA, 13 bp, Homo sapiens
agtgaagaaaatg

SEQ ID NO: 4267427 - DNA, 22 bp, Homo sapiens
agtgaagccagctgcaggaatc

SEQ ID NO: 4267428 - DNA, 22 bp, Homo sapiens
agtgaatacatggtagcagggt

SEQ ID NO: 4267429 - DNA, 20 bp, Homo sapiens
agtgaatgagtttccagcta

SEQ ID NO: 4267430 - DNA, 18 bp, Homo sapiens
agtgacaaggccccagag

SEQ ID NO: 4267431 - DNA, 21 bp, Homo sapiens
agtgacatcggttcaggagga

SEQ ID NO: 4267432 - DNA, 21 bp, Homo sapiens
agtgaccaggctcacaactgt

SEQ ID NO: 4267433 - DNA, 19 bp, Homo sapiens
agtgaccccagctccaggc

SEQ ID NO: 4267434 - DNA, 20 bp, Homo sapiens
agtgaccccagctccaggca

SEQ ID NO: 4267435 - DNA, 16 bp, Homo sapiens
agtgacccggaggcca

SEQ ID NO: 4267436 - DNA, 18 bp, Homo sapiens
agtgaccctggagctagg

SEQ ID NO: 4267437 - DNA, 20 bp, Homo sapiens
agtgaccctggagctagggt

SEQ ID NO: 4267438 - DNA, 21 bp, Homo sapiens
agtgaccctggagctagggtc

SEQ ID NO: 4267439 - DNA, 16 bp, Homo sapiens
agtgacgtgagtgggg

SEQ ID NO: 4267440 - DNA, 17 bp, Homo sapiens
agtgactaaaccattgt

SEQ ID NO: 4267441 - DNA, 19 bp, Homo sapiens
agtgactgaacgatccttc

SEQ ID NO: 4267442 - DNA, 20 bp, Homo sapiens
agtgactgctgcgctgtgct

SEQ ID NO: 4267443 - DNA, 17 bp, Homo sapiens
agtgagaaaactgtgac

SEQ ID NO: 4267444 - DNA, 16 bp, Homo sapiens
agtgagaagataaaaa

SEQ ID NO: 4267445 - DNA, 12 bp, Homo sapiens
agtgagagtgag

SEQ ID NO: 4267446 - DNA, 19 bp, Homo sapiens
agtgagatttgtatttata

SEQ ID NO: 4267447 - DNA, 13 bp, Homo sapiens
agtgaggcccagg

SEQ ID NO: 4267448 - DNA, 15 bp, Homo sapiens
agtgaggcccaggga

SEQ ID NO: 4267449 - DNA, 23 bp, Homo sapiens
agtgaggcccccgcacgcaagcc

SEQ ID NO: 4267450 - DNA, 16 bp, Homo sapiens
agtgagtgtggctccc

SEQ ID NO: 4267451 - DNA, 21 bp, Homo sapiens
agtgagtgtggctcccctcta

SEQ ID NO: 4267452 - DNA, 19 bp, Homo sapiens
agtgataacactggagtgg

SEQ ID NO: 4267453 - DNA, 16 bp, Homo sapiens
agtgatacactgtatc

SEQ ID NO: 4267454 - DNA, 18 bp, Homo sapiens
agtgatacactgtatcta

SEQ ID NO: 4267455 - DNA, 17 bp, Homo sapiens
agtgcagccccctcctg

SEQ ID NO: 4267456 - DNA, 23 bp, Homo sapiens
agtgcagccccctcctgacccca

SEQ ID NO: 4267457 - DNA, 24 bp, Homo sapiens
agtgcagcccgtgtggccccttca

SEQ ID NO: 4267458 - DNA, 15 bp, Homo sapiens
agtgcaggctggcac

SEQ ID NO: 4267459 - DNA, 16 bp, Homo sapiens
agtgcatttctgggcc

SEQ ID NO: 4267460 - DNA, 22 bp, Homo sapiens
agtgcccatggggtagaagtag

SEQ ID NO: 4267461 - DNA, 20 bp, Homo sapiens
agtgcccctgctgcctcccc

SEQ ID NO: 4267462 - DNA, 22 bp, Homo sapiens
agtgcccctgctgcctccccaa

SEQ ID NO: 4267463 - DNA, 13 bp, Homo sapiens
agtgcctgtgatc

SEQ ID NO: 4267464 - DNA, 15 bp, Homo sapiens
agtgcttagcaaaaa

SEQ ID NO: 4267465 - DNA, 15 bp, Homo sapiens
agtggaaaaaagaga

SEQ ID NO: 4267466 - DNA, 20 bp, Homo sapiens
agtggaaaaaagagaaaaac

SEQ ID NO: 4267467 - DNA, 17 bp, Homo sapiens
agtggactttccacccc

SEQ ID NO: 4267468 - DNA, 13 bp, Homo sapiens
agtggatctggag

SEQ ID NO: 4267469 - DNA, 18 bp, Homo sapiens
agtggcaggaggacaggt

SEQ ID NO: 4267470 - DNA, 22 bp, Homo sapiens
agtggcctcaaccctccctcag

SEQ ID NO: 4267471 - DNA, 13 bp, Homo sapiens
agtggctcctccc

SEQ ID NO: 4267472 - DNA, 17 bp, Homo sapiens
agtggctcctcccggtg

SEQ ID NO: 4267473 - DNA, 15 bp, Homo sapiens
agtggcttcagcccc

SEQ ID NO: 4267474 - DNA, 18 bp, Homo sapiens
agtggcttcagcccctgg

SEQ ID NO: 4267475 - DNA, 19 bp, Homo sapiens
agtgggacagggcatggcc

SEQ ID NO: 4267476 - DNA, 13 bp, Homo sapiens
agtgggagaggaa

SEQ ID NO: 4267477 - DNA, 17 bp, Homo sapiens
agtgggagaggaagcca

SEQ ID NO: 4267478 - DNA, 16 bp, Homo sapiens
agtgggaggcgcgagc

SEQ ID NO: 4267479 - DNA, 23 bp, Homo sapiens
agtgggagtcaagtgtgcctgct

SEQ ID NO: 4267480 - DNA, 15 bp, Homo sapiens
agtgggagtgggaga

SEQ ID NO: 4267481 - DNA, 16 bp, Homo sapiens
agtgggccccctctct

SEQ ID NO: 4267482 - DNA, 14 bp, Homo sapiens
agtgggccctggct

SEQ ID NO: 4267483 - DNA, 22 bp, Homo sapiens
agtgggctatgccactaggccc

SEQ ID NO: 4267484 - DNA, 23 bp, Homo sapiens
agtggggaggagactcaggccca

SEQ ID NO: 4267485 - DNA, 19 bp, Homo sapiens
agtggggctagactgggct

SEQ ID NO: 4267486 - DNA, 20 bp, Homo sapiens
agtggggctagactgggctg

SEQ ID NO: 4267487 - DNA, 20 bp, Homo sapiens
agtgggtgggacacagagac

SEQ ID NO: 4267488 - DNA, 17 bp, Homo sapiens
agtggtaacaagaggag

SEQ ID NO: 4267489 - DNA, 15 bp, Homo sapiens
agtgtagattttata

SEQ ID NO: 4267490 - DNA, 21 bp, Homo sapiens
agtgtatctcgaagtcttcca

SEQ ID NO: 4267491 - DNA, 20 bp, Homo sapiens
agtgtcaaggggccctagga

SEQ ID NO: 4267492 - DNA, 18 bp, Homo sapiens
agtgtccccaaagactac

SEQ ID NO: 4267493 - DNA, 20 bp, Homo sapiens
agtgtctggatcagtaaaat

SEQ ID NO: 4267494 - DNA, 21 bp, Homo sapiens
agtgtgaatataaatgtgtgt

SEQ ID NO: 4267495 - DNA, 20 bp, Homo sapiens
agtgtgacgggggttggggt

SEQ ID NO: 4267496 - DNA, 17 bp, Homo sapiens
agtgtgccaccctctgc

SEQ ID NO: 4267497 - DNA, 19 bp, Homo sapiens
agtgtggaaaaaaaaagaa

SEQ ID NO: 4267498 - DNA, 17 bp, Homo sapiens
agtgtggctcccctcta

SEQ ID NO: 4267499 - DNA, 16 bp, Homo sapiens
agtgtttaattgtata

SEQ ID NO: 4267500 - DNA, 14 bp, Homo sapiens
agtgttttcttgtg

SEQ ID NO: 4267501 - DNA, 22 bp, Homo sapiens
agtgttttcttgtgttgttttc

SEQ ID NO: 4267502 - DNA, 23 bp, Homo sapiens
agttaacagtctcattacagatt

SEQ ID NO: 4267503 - DNA, 22 bp, Homo sapiens
agttaagtctatctggtattaa

SEQ ID NO: 4267504 - DNA, 21 bp, Homo sapiens
agttatccagagggttgtgat

SEQ ID NO: 4267505 - DNA, 14 bp, Homo sapiens
agttcaaatacttt

SEQ ID NO: 4267506 - DNA, 14 bp, Homo sapiens
agttccaatgtgcc

SEQ ID NO: 4267507 - DNA, 15 bp, Homo sapiens
agttccaatgtgccc

SEQ ID NO: 4267508 - DNA, 17 bp, Homo sapiens
agttctaacacatttcg

SEQ ID NO: 4267509 - DNA, 13 bp, Homo sapiens
agttctacagaaa

SEQ ID NO: 4267510 - DNA, 13 bp, Homo sapiens
agttctatttcta

SEQ ID NO: 4267511 - DNA, 12 bp, Homo sapiens
agttctgaaaac

SEQ ID NO: 4267512 - DNA, 16 bp, Homo sapiens
agttctgaaaactgtt

SEQ ID NO: 4267513 - DNA, 12 bp, Homo sapiens
agttctgatgag

SEQ ID NO: 4267514 - DNA, 18 bp, Homo sapiens
agttctggaggaggaggt

SEQ ID NO: 4267515 - DNA, 20 bp, Homo sapiens
agttgatgaccaatctctgt

SEQ ID NO: 4267516 - DNA, 23 bp, Homo sapiens
agttgatgaccaatctctgtgac

SEQ ID NO: 4267517 - DNA, 21 bp, Homo sapiens
agttgcaataaactcagtcaa

SEQ ID NO: 4267518 - DNA, 14 bp, Homo sapiens
agttgcacagcatc

SEQ ID NO: 4267519 - DNA, 17 bp, Homo sapiens
agttgcacagcatctca

SEQ ID NO: 4267520 - DNA, 19 bp, Homo sapiens
agttggagtgagtgtggct

SEQ ID NO: 4267521 - DNA, 23 bp, Homo sapiens
agttggcctcagcagaaggcctt

SEQ ID NO: 4267522 - DNA, 12 bp, Homo sapiens
agttgggctggt

SEQ ID NO: 4267523 - DNA, 15 bp, Homo sapiens
agtttaaaaaaataa

SEQ ID NO: 4267524 - DNA, 17 bp, Homo sapiens
agtttaaaaaaataaca

SEQ ID NO: 4267525 - DNA, 18 bp, Homo sapiens
agtttaaaaaaataacat

SEQ ID NO: 4267526 - DNA, 22 bp, Homo sapiens
agtttaatggtgccttcatttg

SEQ ID NO: 4267527 - DNA, 20 bp, Homo sapiens
agtttcacatatttgtagct

SEQ ID NO: 4267528 - DNA, 14 bp, Homo sapiens
agtttctttacatt

SEQ ID NO: 4267529 - DNA, 19 bp, Homo sapiens
agtttgcatacttcctgga

SEQ ID NO: 4267530 - DNA, 23 bp, Homo sapiens
agtttgcatacttcctggatttt

SEQ ID NO: 4267531 - DNA, 13 bp, Homo sapiens
agtttgcctctgc

SEQ ID NO: 4267532 - DNA, 15 bp, Homo sapiens
agtttgctaatgttt

SEQ ID NO: 4267533 - DNA, 14 bp, Homo sapiens
agtttgtccacaca

SEQ ID NO: 4267534 - DNA, 17 bp, Homo sapiens
agtttgtgcaagacacc

SEQ ID NO: 4267535 - DNA, 20 bp, Homo sapiens
agtttgttttctttttctgt

SEQ ID NO: 4267536 - DNA, 16 bp, Homo sapiens
agttttctaaatgttt

SEQ ID NO: 4267537 - DNA, 19 bp, Homo sapiens
agttttctaaatgtttctt

SEQ ID NO: 4267538 - DNA, 16 bp, Homo sapiens
agttttcttttaattt

SEQ ID NO: 4267539 - DNA, 18 bp, Homo sapiens
agttttttctcttgggct

SEQ ID NO: 4267540 - DNA, 21 bp, Homo sapiens
ataaaacagtgtttccagtga

SEQ ID NO: 4267541 - DNA, 18 bp, Homo sapiens
ataaaacgttatctcatt

SEQ ID NO: 4267542 - DNA, 20 bp, Homo sapiens
ataaaactccttgaaaccag

SEQ ID NO: 4267543 - DNA, 16 bp, Homo sapiens
ataaacattaaaagaa

SEQ ID NO: 4267544 - DNA, 14 bp, Homo sapiens
ataaagaaataata

SEQ ID NO: 4267545 - DNA, 17 bp, Homo sapiens
ataaagaagaaaataac

SEQ ID NO: 4267546 - DNA, 18 bp, Homo sapiens
ataaagaagaaaataacc

SEQ ID NO: 4267547 - DNA, 22 bp, Homo sapiens
ataaaggaaacacgtttagaaa

SEQ ID NO: 4267548 - DNA, 11 bp, Homo sapiens
ataaaggtcat

SEQ ID NO: 4267549 - DNA, 17 bp, Homo sapiens
atgcctaggccagctcc

SEQ ID NO: 4267550 - DNA, 18 bp, Homo sapiens
atgcctaggccagctcct

SEQ ID NO: 4267551 - DNA, 12 bp, Homo sapiens
atgcctattgta

SEQ ID NO: 4267552 - DNA, 21 bp, Homo sapiens
atgcctgagaatgcctaggcc

SEQ ID NO: 4267553 - DNA, 15 bp, Homo sapiens
atgcctgcctgaaca

SEQ ID NO: 4267554 - DNA, 18 bp, Homo sapiens
atgcctgggcctgatggt

SEQ ID NO: 4267555 - DNA, 15 bp, Homo sapiens
atgcctggggtggag

SEQ ID NO: 4267556 - DNA, 12 bp, Homo sapiens
atgcctgtattt

SEQ ID NO: 4267557 - DNA, 16 bp, Homo sapiens
atgcctgtatttccaa

SEQ ID NO: 4267558 - DNA, 22 bp, Homo sapiens
atgccttcataaattatttcta

SEQ ID NO: 4267559 - DNA, 21 bp, Homo sapiens
atgcctttctagtcctattct

SEQ ID NO: 4267560 - DNA, 13 bp, Homo sapiens
atgcctttgtaac

SEQ ID NO: 4267561 - DNA, 16 bp, Homo sapiens
atgcgctcttcaccag

SEQ ID NO: 4267562 - DNA, 19 bp, Homo sapiens
atgcgctcttcaccaggaa

SEQ ID NO: 4267563 - DNA, 17 bp, Homo sapiens
atgcgtaaatcaacttg

SEQ ID NO: 4267564 - DNA, 13 bp, Homo sapiens
atgctaatgtaat

SEQ ID NO: 4267565 - DNA, 13 bp, Homo sapiens
atgctacctctga

SEQ ID NO: 4267566 - DNA, 21 bp, Homo sapiens
atgctacctctgatcaaagca

SEQ ID NO: 4267567 - DNA, 16 bp, Homo sapiens
atgctactcagtatat

SEQ ID NO: 4267568 - DNA, 18 bp, Homo sapiens
atgctccagccaacccct

SEQ ID NO: 4267569 - DNA, 19 bp, Homo sapiens
atgctccagccaacccctg

SEQ ID NO: 4267570 - DNA, 21 bp, Homo sapiens
atgctcccccatcctcccctt

SEQ ID NO: 4267571 - DNA, 14 bp, Homo sapiens
atgctgcccacccc

SEQ ID NO: 4267572 - DNA, 20 bp, Homo sapiens
atgctgcccaccccctgctg

SEQ ID NO: 4267573 - DNA, 22 bp, Homo sapiens
atgctgcccaccccctgctggt

SEQ ID NO: 4267574 - DNA, 13 bp, Homo sapiens
atgctgcctgcct

SEQ ID NO: 4267575 - DNA, 12 bp, Homo sapiens
atgctgctgtga

SEQ ID NO: 4267576 - DNA, 15 bp, Homo sapiens
atgctgctgtgaatt

SEQ ID NO: 4267577 - DNA, 20 bp, Homo sapiens
atgctgtagacatctgtcct

SEQ ID NO: 4267578 - DNA, 14 bp, Homo sapiens
atgctgtatgtcat

SEQ ID NO: 4267579 - DNA, 17 bp, Homo sapiens
atgctgttggtgagaat

SEQ ID NO: 4267580 - DNA, 20 bp, Homo sapiens
atgcttgcctagggcctggt

SEQ ID NO: 4267581 - DNA, 14 bp, Homo sapiens
atggaaaaatgcca

SEQ ID NO: 4267582 - DNA, 22 bp, Homo sapiens
atggaaacaagatgaaattcca

SEQ ID NO: 4267583 - DNA, 20 bp, Homo sapiens
atggaaagggtgtggcttgg

SEQ ID NO: 4267584 - DNA, 13 bp, Homo sapiens
atggaaatcctgt

SEQ ID NO: 4267585 - DNA, 23 bp, Homo sapiens
atggaacccttttggcccccgag

SEQ ID NO: 4267586 - DNA, 22 bp, Homo sapiens
atggaagcctccacctgcagcc

SEQ ID NO: 4267587 - DNA, 23 bp, Homo sapiens
atggaagctggcaggagacactg

SEQ ID NO: 4267588 - DNA, 13 bp, Homo sapiens
atggacctgcact

SEQ ID NO: 4267589 - DNA, 18 bp, Homo sapiens
atggagactgtctcaaga

SEQ ID NO: 4267590 - DNA, 18 bp, Homo sapiens
atggaggcgccttcctgg

SEQ ID NO: 4267591 - DNA, 21 bp, Homo sapiens
atggagtccagacctgggccc

SEQ ID NO: 4267592 - DNA, 16 bp, Homo sapiens
atggattcagtttcta

SEQ ID NO: 4267593 - DNA, 23 bp, Homo sapiens
atggattgggtatcaaaatgaat

SEQ ID NO: 4267594 - DNA, 17 bp, Homo sapiens
atggccacatccaacat

SEQ ID NO: 4267595 - DNA, 14 bp, Homo sapiens
atggccagcccaga

SEQ ID NO: 4267596 - DNA, 16 bp, Homo sapiens
atggccagcccagatg

SEQ ID NO: 4267597 - DNA, 18 bp, Homo sapiens
atggccgttgcctctctg

SEQ ID NO: 4267598 - DNA, 24 bp, Homo sapiens
atggccgttgcctctctgccagcc

SEQ ID NO: 4267599 - DNA, 17 bp, Homo sapiens
atggcctcccagccacc

SEQ ID NO: 4267600 - DNA, 15 bp, Homo sapiens
atggcgtgtcccctg

SEQ ID NO: 4267601 - DNA, 18 bp, Homo sapiens
atggcgtgtcccctgcct

SEQ ID NO: 4267602 - DNA, 19 bp, Homo sapiens
atggcgtgtcccctgcctg

SEQ ID NO: 4267603 - DNA, 22 bp, Homo sapiens
atggctactttggtttctgtct

SEQ ID NO: 4267604 - DNA, 14 bp, Homo sapiens
atggctattaacaa

SEQ ID NO: 4267605 - DNA, 13 bp, Homo sapiens
atggctccagtct

SEQ ID NO: 4267606 - DNA, 22 bp, Homo sapiens
atggctccagtctgctgccctc

SEQ ID NO: 4267607 - DNA, 23 bp, Homo sapiens
atggctccagtctgctgccctcc

SEQ ID NO: 4267608 - DNA, 15 bp, Homo sapiens
atggctccctgggct

SEQ ID NO: 4267609 - DNA, 18 bp, Homo sapiens
atggcttgtagggtgagg

SEQ ID NO: 4267610 - DNA, 21 bp, Homo sapiens
atgggagtcagggagccctgg

SEQ ID NO: 4267611 - DNA, 15 bp, Homo sapiens
atgggatcattattt

SEQ ID NO: 4267612 - DNA, 19 bp, Homo sapiens
atgggcacaggctgcccca

SEQ ID NO: 4267613 - DNA, 17 bp, Homo sapiens
atgggcacctctgctgt

SEQ ID NO: 4267614 - DNA, 23 bp, Homo sapiens
atgggcatggggtgggcctctgg

SEQ ID NO: 4267615 - DNA, 12 bp, Homo sapiens
atggggagggga

SEQ ID NO: 4267616 - DNA, 14 bp, Homo sapiens
atggggcctctgtt

SEQ ID NO: 4267617 - DNA, 15 bp, Homo sapiens
atggggtgggcctct

SEQ ID NO: 4267618 - DNA, 18 bp, Homo sapiens
atggggttggctgggccc

SEQ ID NO: 4267619 - DNA, 13 bp, Homo sapiens
atggggttgggct

SEQ ID NO: 4267620 - DNA, 22 bp, Homo sapiens
atgggtcccttccccctgctcc

SEQ ID NO: 4267621 - DNA, 15 bp, Homo sapiens
atggtaatcttttct

SEQ ID NO: 4267622 - DNA, 16 bp, Homo sapiens
atggtagactgtgaca

SEQ ID NO: 4267623 - DNA, 19 bp, Homo sapiens
atggtattttcgtgcattt

SEQ ID NO: 4267624 - DNA, 20 bp, Homo sapiens
atggtattttcgtgcatttg

SEQ ID NO: 4267625 - DNA, 23 bp, Homo sapiens
atggtattttcgtgcatttgtga

SEQ ID NO: 4267626 - DNA, 16 bp, Homo sapiens
atggtgcagtgaagaa

SEQ ID NO: 4267627 - DNA, 13 bp, Homo sapiens
atggtgccccctg

SEQ ID NO: 4267628 - DNA, 17 bp, Homo sapiens
atggtgttggaggggca

SEQ ID NO: 4267629 - DNA, 21 bp, Homo sapiens
atggtgttggaggggcaggcc

SEQ ID NO: 4267630 - DNA, 21 bp, Homo sapiens
atggttacctctgcataaata

SEQ ID NO: 4267631 - DNA, 19 bp, Homo sapiens
atggttcccctgttcactc

SEQ ID NO: 4267632 - DNA, 15 bp, Homo sapiens
atggttctagaagga

SEQ ID NO: 4267633 - DNA, 18 bp, Homo sapiens
atgtaaataggtttctaa

SEQ ID NO: 4267634 - DNA, 17 bp, Homo sapiens
atgtaaattgactgtac

SEQ ID NO: 4267635 - DNA, 22 bp, Homo sapiens
atgtaacagttggtgattttag

SEQ ID NO: 4267636 - DNA, 14 bp, Homo sapiens
atgtaagaaataag

SEQ ID NO: 4267637 - DNA, 17 bp, Homo sapiens
atgtaatcatttatctt

SEQ ID NO: 4267638 - DNA, 17 bp, Homo sapiens
atgtagaactgttcatt

SEQ ID NO: 4267639 - DNA, 16 bp, Homo sapiens
atgtagaagagggaga

SEQ ID NO: 4267640 - DNA, 19 bp, Homo sapiens
atgtagcttcagtcattaa

SEQ ID NO: 4267641 - DNA, 23 bp, Homo sapiens
atgtataacaagccaaacattct

SEQ ID NO: 4267642 - DNA, 23 bp, Homo sapiens
atgtatgtgaaagtgtaaaatag

SEQ ID NO: 4267643 - DNA, 23 bp, Homo sapiens
atgtattaagcccacagtatatt

SEQ ID NO: 4267644 - DNA, 12 bp, Homo sapiens
atgtattatgtc

SEQ ID NO: 4267645 - DNA, 15 bp, Homo sapiens
atgtatttgtagtgt

SEQ ID NO: 4267646 - DNA, 19 bp, Homo sapiens
atgtatttgtagtgttatt

SEQ ID NO: 4267647 - DNA, 21 bp, Homo sapiens
atgtatttgtagtgttattgc

SEQ ID NO: 4267648 - DNA, 19 bp, Homo sapiens
atgtcaaccttgtgtgagt

SEQ ID NO: 4267649 - DNA, 16 bp, Homo sapiens
atgtcaagattcagct

SEQ ID NO: 4267650 - DNA, 17 bp, Homo sapiens
atgtcaagattcagcta

SEQ ID NO: 4267651 - DNA, 14 bp, Homo sapiens
atgtcatactctgt

SEQ ID NO: 4267652 - DNA, 16 bp, Homo sapiens
atgtcattaaagtgca

SEQ ID NO: 4267653 - DNA, 18 bp, Homo sapiens
atgtccataaaagagacc

SEQ ID NO: 4267654 - DNA, 22 bp, Homo sapiens
atgtccccattctataaattca

SEQ ID NO: 4267655 - DNA, 22 bp, Homo sapiens
atgtcctaggggccgagggaaa

SEQ ID NO: 4267656 - DNA, 14 bp, Homo sapiens
atgtcctcagaggg

SEQ ID NO: 4267657 - DNA, 13 bp, Homo sapiens
atgtctattgtcc

SEQ ID NO: 4267658 - DNA, 14 bp, Homo sapiens
atgtctattgtcca

SEQ ID NO: 4267659 - DNA, 19 bp, Homo sapiens
atgtctgtgaacttgatgt

SEQ ID NO: 4267660 - DNA, 22 bp, Homo sapiens
atgtcttgagatgtattatgca

SEQ ID NO: 4267661 - DNA, 18 bp, Homo sapiens
atgtctttctccaaagtt

SEQ ID NO: 4267662 - DNA, 22 bp, Homo sapiens
atgtctttctccaaagttatcc

SEQ ID NO: 4267663 - DNA, 20 bp, Homo sapiens
atgtgaattgaagtcatcat

SEQ ID NO: 4267664 - DNA, 16 bp, Homo sapiens
atgtgagcatgaaact

SEQ ID NO: 4267665 - DNA, 19 bp, Homo sapiens
atgtgattggcagcttcaa

SEQ ID NO: 4267666 - DNA, 17 bp, Homo sapiens
atgtgctattaatattt

SEQ ID NO: 4267667 - DNA, 12 bp, Homo sapiens
atgtgctgtgca

SEQ ID NO: 4267668 - DNA, 17 bp, Homo sapiens
atgtggaaaactcacag

SEQ ID NO: 4267669 - DNA, 14 bp, Homo sapiens
atgtggaagcaggt

SEQ ID NO: 4267670 - DNA, 19 bp, Homo sapiens
atgtgtcagctgtagaaag

SEQ ID NO: 4267671 - DNA, 21 bp, Homo sapiens
atgtgtcagctgtagaaaggt

SEQ ID NO: 4267672 - DNA, 17 bp, Homo sapiens
atgtgtccatgtgaaat

SEQ ID NO: 4267673 - DNA, 14 bp, Homo sapiens
atgtgtgaagctga

SEQ ID NO: 4267674 - DNA, 16 bp, Homo sapiens
atgtgtggctcattct

SEQ ID NO: 4267675 - DNA, 14 bp, Homo sapiens
atgtgttaatctta

SEQ ID NO: 4267676 - DNA, 14 bp, Homo sapiens
atgtgttgcaaatt

SEQ ID NO: 4267677 - DNA, 17 bp, Homo sapiens
atgtgtttataattgtt

SEQ ID NO: 4267678 - DNA, 20 bp, Homo sapiens
atgtgtttataattgttata

SEQ ID NO: 4267679 - DNA, 16 bp, Homo sapiens
cacacacctgcacacc

SEQ ID NO: 4267680 - DNA, 20 bp, Homo sapiens
cacacaggcctggcccagcc

SEQ ID NO: 4267681 - DNA, 15 bp, Homo sapiens
cacaccctctctgtc

SEQ ID NO: 4267682 - DNA, 15 bp, Homo sapiens
cacacccttccccac

SEQ ID NO: 4267683 - DNA, 18 bp, Homo sapiens
cacacccttccccactcc

SEQ ID NO: 4267684 - DNA, 13 bp, Homo sapiens
cacacctccaccc

SEQ ID NO: 4267685 - DNA, 14 bp, Homo sapiens
cacacctccacccg

SEQ ID NO: 4267686 - DNA, 18 bp, Homo sapiens
cacacctccacccgtcct

SEQ ID NO: 4267687 - DNA, 20 bp, Homo sapiens
cacacctgcacacccctgca

SEQ ID NO: 4267688 - DNA, 14 bp, Homo sapiens
cacacgcacacaca

SEQ ID NO: 4267689 - DNA, 20 bp, Homo sapiens
cacacgtgctctctgctgga

SEQ ID NO: 4267690 - DNA, 14 bp, Homo sapiens
cacactctcttctt

SEQ ID NO: 4267691 - DNA, 14 bp, Homo sapiens
cacactgccctctg

SEQ ID NO: 4267692 - DNA, 20 bp, Homo sapiens
cacactgtgcgttttagagt

SEQ ID NO: 4267693 - DNA, 14 bp, Homo sapiens
cacacttcaggctc

SEQ ID NO: 4267694 - DNA, 21 bp, Homo sapiens
cacacttcaggctcttctcct

SEQ ID NO: 4267695 - DNA, 22 bp, Homo sapiens
cacacttcaggctcttctcctt

SEQ ID NO: 4267696 - DNA, 12 bp, Homo sapiens
cacacttcccct

SEQ ID NO: 4267697 - DNA, 14 bp, Homo sapiens
cacacttcctgtcc

SEQ ID NO: 4267698 - DNA, 15 bp, Homo sapiens
cacacttcctgtcca

SEQ ID NO: 4267699 - DNA, 23 bp, Homo sapiens
cacacttcctgtccagagagaga

SEQ ID NO: 4267700 - DNA, 14 bp, Homo sapiens
cacagaagacacgt

SEQ ID NO: 4267701 - DNA, 17 bp, Homo sapiens
cacagaagacacgtgtt

SEQ ID NO: 4267702 - DNA, 11 bp, Homo sapiens
cacagactctg

SEQ ID NO: 4267703 - DNA, 20 bp, Homo sapiens
cacagactctgtgagattct

SEQ ID NO: 4267704 - DNA, 16 bp, Homo sapiens
cacagagagcggcttc

SEQ ID NO: 4267705 - DNA, 16 bp, Homo sapiens
cacagaggatggcttc

SEQ ID NO: 4267706 - DNA, 19 bp, Homo sapiens
cacagataagcctgaaaca

SEQ ID NO: 4267707 - DNA, 22 bp, Homo sapiens
cacagcagtacttgctcaataa

SEQ ID NO: 4267708 - DNA, 12 bp, Homo sapiens
cacagcatctca

SEQ ID NO: 4267709 - DNA, 11 bp, Homo sapiens
cacagccagaa

SEQ ID NO: 4267710 - DNA, 20 bp, Homo sapiens
cacagccagaaactgaactg

SEQ ID NO: 4267711 - DNA, 10 bp, Homo sapiens
cacagccctg

SEQ ID NO: 4267712 - DNA, 12 bp, Homo sapiens
cacagccctgtc

SEQ ID NO: 4267713 - DNA, 21 bp, Homo sapiens
cacagccctgtcagtgcagcc

SEQ ID NO: 4267714 - DNA, 22 bp, Homo sapiens
cacagctatgaaggctgtacac

SEQ ID NO: 4267715 - DNA, 17 bp, Homo sapiens
cacagctgagctggcct

SEQ ID NO: 4267716 - DNA, 15 bp, Homo sapiens
cacaggagcgtgtac

SEQ ID NO: 4267717 - DNA, 22 bp, Homo sapiens
cacaggagcgtgtcctatcccc

SEQ ID NO: 4267718 - DNA, 12 bp, Homo sapiens
cacaggcagacg

SEQ ID NO: 4267719 - DNA, 22 bp, Homo sapiens
cacaggcccttcctctccactg

SEQ ID NO: 4267720 - DNA, 13 bp, Homo sapiens
cacaggcctggcc

SEQ ID NO: 4267721 - DNA, 22 bp, Homo sapiens
cacaggcctggcccagccagca

SEQ ID NO: 4267722 - DNA, 23 bp, Homo sapiens
cacaggcctggcccagccagcag

SEQ ID NO: 4267723 - DNA, 13 bp, Homo sapiens
cacaggctgcccc

SEQ ID NO: 4267724 - DNA, 15 bp, Homo sapiens
cacaggctgccccac

SEQ ID NO: 4267725 - DNA, 13 bp, Homo sapiens
cacagtatatttt

SEQ ID NO: 4267726 - DNA, 21 bp, Homo sapiens
cacagtcagggcggggctggc

SEQ ID NO: 4267727 - DNA, 16 bp, Homo sapiens
cacagtcatgtgtcag

SEQ ID NO: 4267728 - DNA, 19 bp, Homo sapiens
cacagtgcatctcagccca

SEQ ID NO: 4267729 - DNA, 13 bp, Homo sapiens
cacataaatctgt

SEQ ID NO: 4267730 - DNA, 15 bp, Homo sapiens
cacataaatctgtct

SEQ ID NO: 4267731 - DNA, 19 bp, Homo sapiens
cacataaatctgtctgatt

SEQ ID NO: 4267732 - DNA, 21 bp, Homo sapiens
cacatatcaagtcccgaggca

SEQ ID NO: 4267733 - DNA, 22 bp, Homo sapiens
cacatccattccagagctgcag

SEQ ID NO: 4267734 - DNA, 17 bp, Homo sapiens
cacatgtatctatgcat

SEQ ID NO: 4267735 - DNA, 16 bp, Homo sapiens
cacattctgctgcccc

SEQ ID NO: 4267736 - DNA, 17 bp, Homo sapiens
cacattctggctccacc

SEQ ID NO: 4267737 - DNA, 20 bp, Homo sapiens
cacattgcacacacagtctg

SEQ ID NO: 4267738 - DNA, 22 bp, Homo sapiens
cacattgcccacacctgcctct

SEQ ID NO: 4267739 - DNA, 19 bp, Homo sapiens
cacattgccctgaggggcc

SEQ ID NO: 4267740 - DNA, 17 bp, Homo sapiens
caccaactctctctgcc

SEQ ID NO: 4267741 - DNA, 18 bp, Homo sapiens
caccaactctctctgccc

SEQ ID NO: 4267742 - DNA, 13 bp, Homo sapiens
caccaaggctgcc

SEQ ID NO: 4267743 - DNA, 18 bp, Homo sapiens
caccaaggctgcctgccc

SEQ ID NO: 4267744 - DNA, 15 bp, Homo sapiens
caccaagggtatctg

SEQ ID NO: 4267745 - DNA, 17 bp, Homo sapiens
caccaagggtatctgct

SEQ ID NO: 4267746 - DNA, 19 bp, Homo sapiens
caccaagggtatctgctgc

SEQ ID NO: 4267747 - DNA, 20 bp, Homo sapiens
caccacacacacccttcccc

SEQ ID NO: 4267748 - DNA, 20 bp, Homo sapiens
caccacctggatggatctgc

SEQ ID NO: 4267749 - DNA, 18 bp, Homo sapiens
caccagagcctccctcag

SEQ ID NO: 4267750 - DNA, 23 bp, Homo sapiens
caccagagcctccctcagccacg

SEQ ID NO: 4267751 - DNA, 14 bp, Homo sapiens
caccagcagcacaa

SEQ ID NO: 4267752 - DNA, 15 bp, Homo sapiens
caccagcagcacaat

SEQ ID NO: 4267753 - DNA, 17 bp, Homo sapiens
caccagcagcacaattc

SEQ ID NO: 4267754 - DNA, 23 bp, Homo sapiens
caccagcagcacaattctgtccc

SEQ ID NO: 4267755 - DNA, 19 bp, Homo sapiens
caccagcctcagtgcagcc

SEQ ID NO: 4267756 - DNA, 18 bp, Homo sapiens
caccagctggctctgcag

SEQ ID NO: 4267757 - DNA, 20 bp, Homo sapiens
caccagctggctctgcagca

SEQ ID NO: 4267758 - DNA, 11 bp, Homo sapiens
caccaggaaga

SEQ ID NO: 4267759 - DNA, 15 bp, Homo sapiens
cacccaattttaaaa

SEQ ID NO: 4267760 - DNA, 19 bp, Homo sapiens
cacccaattttaaaaaata

SEQ ID NO: 4267761 - DNA, 14 bp, Homo sapiens
cacccaccctctgg

SEQ ID NO: 4267762 - DNA, 15 bp, Homo sapiens
cacccaccctctggt

SEQ ID NO: 4267763 - DNA, 21 bp, Homo sapiens
cacccaggacctctgggggtt

SEQ ID NO: 4267764 - DNA, 13 bp, Homo sapiens
cacccatatcatg

SEQ ID NO: 4267765 - DNA, 14 bp, Homo sapiens
cacccatatcatgc

SEQ ID NO: 4267766 - DNA, 11 bp, Homo sapiens
caccccagcct

SEQ ID NO: 4267767 - DNA, 14 bp, Homo sapiens
caccccagtccccg

SEQ ID NO: 4267768 - DNA, 16 bp, Homo sapiens
caccccagtccccggg

SEQ ID NO: 4267769 - DNA, 14 bp, Homo sapiens
cacccccagctcct

SEQ ID NO: 4267770 - DNA, 14 bp, Homo sapiens
caccccctccctgg

SEQ ID NO: 4267771 - DNA, 23 bp, Homo sapiens
caccccctccctggcctgttctg

SEQ ID NO: 4267772 - DNA, 23 bp, Homo sapiens
caccccctgctggtgcccaccct

SEQ ID NO: 4267773 - DNA, 19 bp, Homo sapiens
caccccctggtgcctgcag

SEQ ID NO: 4267774 - DNA, 13 bp, Homo sapiens
cacccctcttccc

SEQ ID NO: 4267775 - DNA, 14 bp, Homo sapiens
cacccctcttcccc

SEQ ID NO: 4267776 - DNA, 18 bp, Homo sapiens
cacccctcttcccccttc

SEQ ID NO: 4267777 - DNA, 19 bp, Homo sapiens
cacccctcttcccccttcc

SEQ ID NO: 4267778 - DNA, 20 bp, Homo sapiens
cacccctcttcccccttccc

SEQ ID NO: 4267779 - DNA, 21 bp, Homo sapiens
cacccctcttcccccttcccc

SEQ ID NO: 4267780 - DNA, 13 bp, Homo sapiens
cacccctgcaggc

SEQ ID NO: 4267781 - DNA, 22 bp, Homo sapiens
cacccctggtgtccctgcctgg

SEQ ID NO: 4267782 - DNA, 20 bp, Homo sapiens
cacccctgtctgcgccgctg

SEQ ID NO: 4267783 - DNA, 16 bp, Homo sapiens
cacccggatctccagg

SEQ ID NO: 4267784 - DNA, 17 bp, Homo sapiens
cacccggatctccaggc

SEQ ID NO: 4267785 - DNA, 18 bp, Homo sapiens
cacccggatctccaggcc

SEQ ID NO: 4267786 - DNA, 19 bp, Homo sapiens
cacccggatctccaggccc

SEQ ID NO: 4267787 - DNA, 22 bp, Homo sapiens
cacccggatctccaggcccagc

SEQ ID NO: 4267788 - DNA, 23 bp, Homo sapiens
cacccggatctccaggcccagcc

SEQ ID NO: 4267789 - DNA, 21 bp, Homo sapiens
cacccggcagccccccagtgt

SEQ ID NO: 4267790 - DNA, 17 bp, Homo sapiens
cacccgtcctggggtgg

SEQ ID NO: 4267791 - DNA, 22 bp, Homo sapiens
cacccgtgccacgcgctctgca

SEQ ID NO: 4267792 - DNA, 23 bp, Homo sapiens
cacccgtgccacgcgctctgcat

SEQ ID NO: 4267793 - DNA, 14 bp, Homo sapiens
cacccgtttccaag

SEQ ID NO: 4267794 - DNA, 13 bp, Homo sapiens
caccctctgcagg

SEQ ID NO: 4267795 - DNA, 16 bp, Homo sapiens
caccctctgcagggca

SEQ ID NO: 4267796 - DNA, 18 bp, Homo sapiens
caccctctgcagggcagc

SEQ ID NO: 4267797 - DNA, 21 bp, Homo sapiens
caccctctgctatgtctgtga

SEQ ID NO: 4267798 - DNA, 13 bp, Homo sapiens
caccctctggtcc

SEQ ID NO: 4267799 - DNA, 16 bp, Homo sapiens
caccctctggtccttc

SEQ ID NO: 4267800 - DNA, 13 bp, Homo sapiens
cacccttccccac

SEQ ID NO: 4267801 - DNA, 13 bp, Homo sapiens
caccgctccccag

SEQ ID NO: 4267802 - DNA, 23 bp, Homo sapiens
caccgtagtaacacataaagtaa

SEQ ID NO: 4267803 - DNA, 12 bp, Homo sapiens
cacctataaata

SEQ ID NO: 4267804 - DNA, 22 bp, Homo sapiens
cacctataaatactaaatatga

SEQ ID NO: 4267805 - DNA, 15 bp, Homo sapiens
cacctatcagagaag

SEQ ID NO: 4267806 - DNA, 23 bp, Homo sapiens
cacctatgtcatttcatttccta

SEQ ID NO: 4267807 - DNA, 20 bp, Homo sapiens
cacctcagagacatacacct

SEQ ID NO: 4267808 - DNA, 15 bp, Homo sapiens
cacctcaggggagac

SEQ ID NO: 4267809 - DNA, 21 bp, Homo sapiens
cagacagcaacggggaggcca

SEQ ID NO: 4267810 - DNA, 15 bp, Homo sapiens
cagacagggtggggc

SEQ ID NO: 4267811 - DNA, 13 bp, Homo sapiens
cagacatgctgcc

SEQ ID NO: 4267812 - DNA, 14 bp, Homo sapiens
cagacatgctgccc

SEQ ID NO: 4267813 - DNA, 15 bp, Homo sapiens
cagacatgctgccca

SEQ ID NO: 4267814 - DNA, 14 bp, Homo sapiens
cagacattgtattt

SEQ ID NO: 4267815 - DNA, 17 bp, Homo sapiens
cagaccaggaaggaaga

SEQ ID NO: 4267816 - DNA, 20 bp, Homo sapiens
cagacccagggtggtcttca

SEQ ID NO: 4267817 - DNA, 17 bp, Homo sapiens
cagaccccatccagcca

SEQ ID NO: 4267818 - DNA, 14 bp, Homo sapiens
cagacccccacccc

SEQ ID NO: 4267819 - DNA, 19 bp, Homo sapiens
cagacccccaccccttccc

SEQ ID NO: 4267820 - DNA, 23 bp, Homo sapiens
cagacccccaccccttccccact

SEQ ID NO: 4267821 - DNA, 17 bp, Homo sapiens
cagacccccagcaaccc

SEQ ID NO: 4267822 - DNA, 14 bp, Homo sapiens
cagacctgggccct

SEQ ID NO: 4267823 - DNA, 16 bp, Homo sapiens
cagacctgggccctgg

SEQ ID NO: 4267824 - DNA, 17 bp, Homo sapiens
cagacctgggccctggt

SEQ ID NO: 4267825 - DNA, 19 bp, Homo sapiens
cagacctttgtctgaagga

SEQ ID NO: 4267826 - DNA, 18 bp, Homo sapiens
cagacttcgctattccca

SEQ ID NO: 4267827 - DNA, 21 bp, Homo sapiens
cagacttcgctattcccaggc

SEQ ID NO: 4267828 - DNA, 23 bp, Homo sapiens
cagacttcgctattcccaggcag

SEQ ID NO: 4267829 - DNA, 19 bp, Homo sapiens
cagagagaagcaccccacc

SEQ ID NO: 4267830 - DNA, 23 bp, Homo sapiens
cagagagagaagtgcccctgctg

SEQ ID NO: 4267831 - DNA, 14 bp, Homo sapiens
cagagagtggctcc

SEQ ID NO: 4267832 - DNA, 22 bp, Homo sapiens
cagagatgtccatttttacaag

SEQ ID NO: 4267833 - DNA, 15 bp, Homo sapiens
cagagcacagattca

SEQ ID NO: 4267834 - DNA, 10 bp, Homo sapiens
cagagccagg

SEQ ID NO: 4267835 - DNA, 11 bp, Homo sapiens
cagagccaggg

SEQ ID NO: 4267836 - DNA, 12 bp, Homo sapiens
cagagccagggc

SEQ ID NO: 4267837 - DNA, 18 bp, Homo sapiens
cagagccagggctgtcct

SEQ ID NO: 4267838 - DNA, 20 bp, Homo sapiens
cagagccagggctgtcctta

SEQ ID NO: 4267839 - DNA, 14 bp, Homo sapiens
cagagccatctgcg

SEQ ID NO: 4267840 - DNA, 21 bp, Homo sapiens
cagagcccgcccacctgggcc

SEQ ID NO: 4267841 - DNA, 15 bp, Homo sapiens
cagagcctccctcag

SEQ ID NO: 4267842 - DNA, 11 bp, Homo sapiens
cagagcctggg

SEQ ID NO: 4267843 - DNA, 15 bp, Homo sapiens
cagagcgcccctccc

SEQ ID NO: 4267844 - DNA, 13 bp, Homo sapiens
cagagctcagcac

SEQ ID NO: 4267845 - DNA, 20 bp, Homo sapiens
cagagctcccaggacgcagg

SEQ ID NO: 4267846 - DNA, 21 bp, Homo sapiens
cagagctggcatctatctggt

SEQ ID NO: 4267847 - DNA, 15 bp, Homo sapiens
cagaggaagggaggc

SEQ ID NO: 4267848 - DNA, 23 bp, Homo sapiens
cagaggaagggaggcctgagggg

SEQ ID NO: 4267849 - DNA, 13 bp, Homo sapiens
cagaggacagatc

SEQ ID NO: 4267850 - DNA, 20 bp, Homo sapiens
cagaggacggcttccccatc

SEQ ID NO: 4267851 - DNA, 19 bp, Homo sapiens
cagaggagggatagagacg

SEQ ID NO: 4267852 - DNA, 21 bp, Homo sapiens
cagaggaggtgcccgggcagg

SEQ ID NO: 4267853 - DNA, 12 bp, Homo sapiens
cagaggatggct

SEQ ID NO: 4267854 - DNA, 16 bp, Homo sapiens
cagaggcagtggcagc

SEQ ID NO: 4267855 - DNA, 18 bp, Homo sapiens
cagaggcagtggcagcaa

SEQ ID NO: 4267856 - DNA, 19 bp, Homo sapiens
cagaggccccttgctgctg

SEQ ID NO: 4267857 - DNA, 20 bp, Homo sapiens
cagaggccccttgctgctgg

SEQ ID NO: 4267858 - DNA, 23 bp, Homo sapiens
cagaggccccttgctgctggctc

SEQ ID NO: 4267859 - DNA, 11 bp, Homo sapiens
cagaggcctgg

SEQ ID NO: 4267860 - DNA, 13 bp, Homo sapiens
cagaggcctggtg

SEQ ID NO: 4267861 - DNA, 22 bp, Homo sapiens
cagagggaggaatcgaggaacc

SEQ ID NO: 4267862 - DNA, 23 bp, Homo sapiens
cagagggaggaatcgaggaacca

SEQ ID NO: 4267863 - DNA, 21 bp, Homo sapiens
cagagggcccctcactggctg

SEQ ID NO: 4267864 - DNA, 14 bp, Homo sapiens
cagaggggagagga

SEQ ID NO: 4267865 - DNA, 18 bp, Homo sapiens
cagaggggcggggccagg

SEQ ID NO: 4267866 - DNA, 14 bp, Homo sapiens
cagaggtgagggag

SEQ ID NO: 4267867 - DNA, 19 bp, Homo sapiens
cagaggtgagggaggcctg

SEQ ID NO: 4267868 - DNA, 20 bp, Homo sapiens
cagagtaaaattacagaaga

SEQ ID NO: 4267869 - DNA, 21 bp, Homo sapiens
cagagtaaaattacagaagaa

SEQ ID NO: 4267870 - DNA, 17 bp, Homo sapiens
cagagtaggtgggtctt

SEQ ID NO: 4267871 - DNA, 23 bp, Homo sapiens
cagagtatatatgtacagttata

SEQ ID NO: 4267872 - DNA, 12 bp, Homo sapiens
cagagtcattgt

SEQ ID NO: 4267873 - DNA, 14 bp, Homo sapiens
cagagtcattgtta

SEQ ID NO: 4267874 - DNA, 14 bp, Homo sapiens
cagagtccaggccc

SEQ ID NO: 4267875 - DNA, 20 bp, Homo sapiens
cagagtggatctggagtctg

SEQ ID NO: 4267876 - DNA, 18 bp, Homo sapiens
cagatcaatggcgcagtg

SEQ ID NO: 4267877 - DNA, 23 bp, Homo sapiens
cagatcaatggcgcagtgcctct

SEQ ID NO: 4267878 - DNA, 15 bp, Homo sapiens
cagatctagccaggc

SEQ ID NO: 4267879 - DNA, 20 bp, Homo sapiens
cagatctagccaggcctccc

SEQ ID NO: 4267880 - DNA, 22 bp, Homo sapiens
cagatctagccaggcctcccgc

SEQ ID NO: 4267881 - DNA, 21 bp, Homo sapiens
cagatgctggtcatcctgggc

SEQ ID NO: 4267882 - DNA, 14 bp, Homo sapiens
cagatggctccctg

SEQ ID NO: 4267883 - DNA, 15 bp, Homo sapiens
cagatgtctatattg

SEQ ID NO: 4267884 - DNA, 20 bp, Homo sapiens
cagattggttcatgcctggg

SEQ ID NO: 4267885 - DNA, 18 bp, Homo sapiens
cagattgtaaaggtaggt

SEQ ID NO: 4267886 - DNA, 15 bp, Homo sapiens
cagcaaagttttcag

SEQ ID NO: 4267887 - DNA, 17 bp, Homo sapiens
cagcacagagagcggct

SEQ ID NO: 4267888 - DNA, 14 bp, Homo sapiens
cagcacagcctcac

SEQ ID NO: 4267889 - DNA, 22 bp, Homo sapiens
cagcacattgccctgaggggcc

SEQ ID NO: 4267890 - DNA, 19 bp, Homo sapiens
cagcacgccaaccccagca

SEQ ID NO: 4267891 - DNA, 20 bp, Homo sapiens
cagcacgccaaccccagcag

SEQ ID NO: 4267892 - DNA, 14 bp, Homo sapiens
cagcactaaacttg

SEQ ID NO: 4267893 - DNA, 13 bp, Homo sapiens
cagcagcggccca

SEQ ID NO: 4267894 - DNA, 17 bp, Homo sapiens
cagcagcggcccagatt

SEQ ID NO: 4267895 - DNA, 14 bp, Homo sapiens
cagcaggggcagaa

SEQ ID NO: 4267896 - DNA, 16 bp, Homo sapiens
cagcaggggcagaagg

SEQ ID NO: 4267897 - DNA, 15 bp, Homo sapiens
cagcaggggggttgg

SEQ ID NO: 4267898 - DNA, 16 bp, Homo sapiens
cagcaggggggttggg

SEQ ID NO: 4267899 - DNA, 22 bp, Homo sapiens
cagcaggggggttgggttccag

SEQ ID NO: 4267900 - DNA, 18 bp, Homo sapiens
cagcaggttctctcctgt

SEQ ID NO: 4267901 - DNA, 19 bp, Homo sapiens
cagcaggttctctcctgtg

SEQ ID NO: 4267902 - DNA, 16 bp, Homo sapiens
cagcagtacttgctca

SEQ ID NO: 4267903 - DNA, 21 bp, Homo sapiens
cagcagtacttgctcaataaa

SEQ ID NO: 4267904 - DNA, 16 bp, Homo sapiens
cagcagtcctgggccc

SEQ ID NO: 4267905 - DNA, 23 bp, Homo sapiens
cagcagtcctgggccccctggga

SEQ ID NO: 4267906 - DNA, 22 bp, Homo sapiens
cagcatagggtccactttggta

SEQ ID NO: 4267907 - DNA, 18 bp, Homo sapiens
cagcatcaacctaggagc

SEQ ID NO: 4267908 - DNA, 13 bp, Homo sapiens
cagcatctcagct

SEQ ID NO: 4267909 - DNA, 14 bp, Homo sapiens
cagcatctcagctc

SEQ ID NO: 4267910 - DNA, 23 bp, Homo sapiens
cagcatgtgttaatcttaatgta

SEQ ID NO: 4267911 - DNA, 22 bp, Homo sapiens
cagcattcaaaatagttctatt

SEQ ID NO: 4267912 - DNA, 14 bp, Homo sapiens
cagcattctcactc

SEQ ID NO: 4267913 - DNA, 18 bp, Homo sapiens
cagccaaaagtaagtgga

SEQ ID NO: 4267914 - DNA, 15 bp, Homo sapiens
cagccaaattgcaga

SEQ ID NO: 4267915 - DNA, 18 bp, Homo sapiens
cagccaaattgcagaaga

SEQ ID NO: 4267916 - DNA, 19 bp, Homo sapiens
cagccaaattgcagaagaa

SEQ ID NO: 4267917 - DNA, 14 bp, Homo sapiens
cagccaacccctgt

SEQ ID NO: 4267918 - DNA, 15 bp, Homo sapiens
cagccaacccctgtg

SEQ ID NO: 4267919 - DNA, 15 bp, Homo sapiens
cagccacacccaggc

SEQ ID NO: 4267920 - DNA, 20 bp, Homo sapiens
cagccaccaaggctgcctgc

SEQ ID NO: 4267921 - DNA, 18 bp, Homo sapiens
cagccacccggatctcca

SEQ ID NO: 4267922 - DNA, 21 bp, Homo sapiens
cagccacccggatctccaggc

SEQ ID NO: 4267923 - DNA, 20 bp, Homo sapiens
cagccacgcctctctcagcc

SEQ ID NO: 4267924 - DNA, 15 bp, Homo sapiens
cagccagaaactgaa

SEQ ID NO: 4267925 - DNA, 20 bp, Homo sapiens
cagccagaaactgaactggc

SEQ ID NO: 4267926 - DNA, 15 bp, Homo sapiens
cagccattcacaaca

SEQ ID NO: 4267927 - DNA, 20 bp, Homo sapiens
cagccattcacaacacaatc

SEQ ID NO: 4267928 - DNA, 22 bp, Homo sapiens
cagccattcacaacacaatcaa

SEQ ID NO: 4267929 - DNA, 19 bp, Homo sapiens
cagcccacatagtgatggt

SEQ ID NO: 4267930 - DNA, 12 bp, Homo sapiens
cagcccaccccc

SEQ ID NO: 4267931 - DNA, 14 bp, Homo sapiens
cagcccacccccct

SEQ ID NO: 4267932 - DNA, 15 bp, Homo sapiens
cagcccacctgctgc

SEQ ID NO: 4267933 - DNA, 21 bp, Homo sapiens
cagcccagatggctccctggg

SEQ ID NO: 4267934 - DNA, 18 bp, Homo sapiens
cagcccagggttccccca

SEQ ID NO: 4267935 - DNA, 20 bp, Homo sapiens
cagcccaggtctcctgggca

SEQ ID NO: 4267936 - DNA, 14 bp, Homo sapiens
cagccccaggcctc

SEQ ID NO: 4267937 - DNA, 20 bp, Homo sapiens
cagccccagggccctgctca

SEQ ID NO: 4267938 - DNA, 14 bp, Homo sapiens
cagccccccagtgt

SEQ ID NO: 4267939 - DNA, 13 bp, Homo sapiens
catcctcctggac

SEQ ID NO: 4267940 - DNA, 17 bp, Homo sapiens
catcctcctggacccag

SEQ ID NO: 4267941 - DNA, 22 bp, Homo sapiens
catcctcctggacccagcaggg

SEQ ID NO: 4267942 - DNA, 14 bp, Homo sapiens
catcctgattattg

SEQ ID NO: 4267943 - DNA, 16 bp, Homo sapiens
catcctgccttcatgg

SEQ ID NO: 4267944 - DNA, 16 bp, Homo sapiens
catcctgtacaagtgc

SEQ ID NO: 4267945 - DNA, 14 bp, Homo sapiens
catccttgaggacc

SEQ ID NO: 4267946 - DNA, 21 bp, Homo sapiens
catccttgaggacctccacct

SEQ ID NO: 4267947 - DNA, 22 bp, Homo sapiens
catcgccttctggctgctgcag

SEQ ID NO: 4267948 - DNA, 22 bp, Homo sapiens
catcgccttctggggaggggct

SEQ ID NO: 4267949 - DNA, 14 bp, Homo sapiens
catcggtcagcagg

SEQ ID NO: 4267950 - DNA, 15 bp, Homo sapiens
catcggttcaggagg

SEQ ID NO: 4267951 - DNA, 23 bp, Homo sapiens
catctagaggcttccttcatttc

SEQ ID NO: 4267952 - DNA, 23 bp, Homo sapiens
catctagctccataattgcaagg

SEQ ID NO: 4267953 - DNA, 16 bp, Homo sapiens
catctattcccaaaga

SEQ ID NO: 4267954 - DNA, 17 bp, Homo sapiens
catctcactttaataat

SEQ ID NO: 4267955 - DNA, 17 bp, Homo sapiens
catctcaggccacctgc

SEQ ID NO: 4267956 - DNA, 22 bp, Homo sapiens
catctcaggccacctgccccct

SEQ ID NO: 4267957 - DNA, 13 bp, Homo sapiens
catctctgacttt

SEQ ID NO: 4267958 - DNA, 14 bp, Homo sapiens
catctgagaaaagc

SEQ ID NO: 4267959 - DNA, 18 bp, Homo sapiens
catctgctgagctctgac

SEQ ID NO: 4267960 - DNA, 12 bp, Homo sapiens
catctggccctg

SEQ ID NO: 4267961 - DNA, 21 bp, Homo sapiens
catctggccctgctgccccct

SEQ ID NO: 4267962 - DNA, 16 bp, Homo sapiens
catctgtctgtcctac

SEQ ID NO: 4267963 - DNA, 13 bp, Homo sapiens
catcttaaaagct

SEQ ID NO: 4267964 - DNA, 20 bp, Homo sapiens
catctttccaaattgatggg

SEQ ID NO: 4267965 - DNA, 23 bp, Homo sapiens
catcttttgttaagttcaccgta

SEQ ID NO: 4267966 - DNA, 18 bp, Homo sapiens
catgaaaggtaatctgaa

SEQ ID NO: 4267967 - DNA, 19 bp, Homo sapiens
catgaaaggtaatctgaaa

SEQ ID NO: 4267968 - DNA, 14 bp, Homo sapiens
catgaacactggct

SEQ ID NO: 4267969 - DNA, 16 bp, Homo sapiens
catgaaggtgtcatac

SEQ ID NO: 4267970 - DNA, 21 bp, Homo sapiens
catgaatacgtaaactgcgta

SEQ ID NO: 4267971 - DNA, 18 bp, Homo sapiens
catgacaagccccaggca

SEQ ID NO: 4267972 - DNA, 14 bp, Homo sapiens
catgaccctggagc

SEQ ID NO: 4267973 - DNA, 16 bp, Homo sapiens
catgaccctggagccc

SEQ ID NO: 4267974 - DNA, 22 bp, Homo sapiens
catgactagggtcctcaggcag

SEQ ID NO: 4267975 - DNA, 17 bp, Homo sapiens
catgactctttattgtc

SEQ ID NO: 4267976 - DNA, 21 bp, Homo sapiens
catgagccagctctgtcccag

SEQ ID NO: 4267977 - DNA, 14 bp, Homo sapiens
catgagctccagac

SEQ ID NO: 4267978 - DNA, 19 bp, Homo sapiens
catgagctccagaccccca

SEQ ID NO: 4267979 - DNA, 21 bp, Homo sapiens
catgagctccagacccccagc

SEQ ID NO: 4267980 - DNA, 23 bp, Homo sapiens
catgagctccagacccccagcaa

SEQ ID NO: 4267981 - DNA, 12 bp, Homo sapiens
catgagtcccag

SEQ ID NO: 4267982 - DNA, 16 bp, Homo sapiens
catgagtcccagtggg

SEQ ID NO: 4267983 - DNA, 19 bp, Homo sapiens
catgagtcccagtgggagg

SEQ ID NO: 4267984 - DNA, 15 bp, Homo sapiens
catgagttcaaatac

SEQ ID NO: 4267985 - DNA, 19 bp, Homo sapiens
catgagttttttctcttgg

SEQ ID NO: 4267986 - DNA, 15 bp, Homo sapiens
catgatataacttta

SEQ ID NO: 4267987 - DNA, 23 bp, Homo sapiens
catgatggagtcaggtttggggt

SEQ ID NO: 4267988 - DNA, 13 bp, Homo sapiens
catgattcatttt

SEQ ID NO: 4267989 - DNA, 20 bp, Homo sapiens
catgattccaagggcccaga

SEQ ID NO: 4267990 - DNA, 18 bp, Homo sapiens
catgatttcaatgattgt

SEQ ID NO: 4267991 - DNA, 16 bp, Homo sapiens
catgattttggccact

SEQ ID NO: 4267992 - DNA, 22 bp, Homo sapiens
catgcacacaattagatttctc

SEQ ID NO: 4267993 - DNA, 17 bp, Homo sapiens
catgcagatctagccag

SEQ ID NO: 4267994 - DNA, 18 bp, Homo sapiens
catgcaggcagcctgcag

SEQ ID NO: 4267995 - DNA, 12 bp, Homo sapiens
catgcagggccc

SEQ ID NO: 4267996 - DNA, 17 bp, Homo sapiens
catgcatggcctcccag

SEQ ID NO: 4267997 - DNA, 21 bp, Homo sapiens
catgcatggcctcccagccac

SEQ ID NO: 4267998 - DNA, 12 bp, Homo sapiens
catgccccactc

SEQ ID NO: 4267999 - DNA, 16 bp, Homo sapiens
catgccccactctgct

SEQ ID NO: 4268000 - DNA, 18 bp, Homo sapiens
catgccccactctgctga

SEQ ID NO: 4268001 - DNA, 21 bp, Homo sapiens
catgccccactctgctgaggc

SEQ ID NO: 4268002 - DNA, 13 bp, Homo sapiens
catgccctcaggc

SEQ ID NO: 4268003 - DNA, 11 bp, Homo sapiens
catgccctccc

SEQ ID NO: 4268004 - DNA, 11 bp, Homo sapiens
catgcctgaga

SEQ ID NO: 4268005 - DNA, 12 bp, Homo sapiens
catgcctggggt

SEQ ID NO: 4268006 - DNA, 18 bp, Homo sapiens
catgcctggggtggaggc

SEQ ID NO: 4268007 - DNA, 16 bp, Homo sapiens
catgcggctgcccacg

SEQ ID NO: 4268008 - DNA, 20 bp, Homo sapiens
catgctcccaaatgcagctt

SEQ ID NO: 4268009 - DNA, 13 bp, Homo sapiens
catgctcctctgc

SEQ ID NO: 4268010 - DNA, 17 bp, Homo sapiens
catgctcctctgcctgt

SEQ ID NO: 4268011 - DNA, 19 bp, Homo sapiens
catgctcctctgcctgtgc

SEQ ID NO: 4268012 - DNA, 19 bp, Homo sapiens
catgctcttacccacacta

SEQ ID NO: 4268013 - DNA, 10 bp, Homo sapiens
catgctgccc

SEQ ID NO: 4268014 - DNA, 20 bp, Homo sapiens
catgctgcccaccccctgct

SEQ ID NO: 4268015 - DNA, 15 bp, Homo sapiens
catgctgcctgcctc

SEQ ID NO: 4268016 - DNA, 19 bp, Homo sapiens
catgctgcctgcctccggc

SEQ ID NO: 4268017 - DNA, 22 bp, Homo sapiens
catgctgcctgcctccggccct

SEQ ID NO: 4268018 - DNA, 19 bp, Homo sapiens
catgctggctcccagggcc

SEQ ID NO: 4268019 - DNA, 23 bp, Homo sapiens
catgctgtctgtgtgaggctccc

SEQ ID NO: 4268020 - DNA, 21 bp, Homo sapiens
catggaaaaatgccatcaaat

SEQ ID NO: 4268021 - DNA, 14 bp, Homo sapiens
catggaagctggca

SEQ ID NO: 4268022 - DNA, 18 bp, Homo sapiens
catggacagggccagggt

SEQ ID NO: 4268023 - DNA, 12 bp, Homo sapiens
catggacccgga

SEQ ID NO: 4268024 - DNA, 16 bp, Homo sapiens
catggacctgcacttg

SEQ ID NO: 4268025 - DNA, 13 bp, Homo sapiens
catggaggcgcct

SEQ ID NO: 4268026 - DNA, 17 bp, Homo sapiens
catggaggcgccttcct

SEQ ID NO: 4268027 - DNA, 20 bp, Homo sapiens
catggaggcgccttcctggg

SEQ ID NO: 4268028 - DNA, 23 bp, Homo sapiens
catggccgttgcctctctgccag

SEQ ID NO: 4268029 - DNA, 15 bp, Homo sapiens
catggctccagtctg

SEQ ID NO: 4268030 - DNA, 22 bp, Homo sapiens
catggctccagtctgctgccct

SEQ ID NO: 4268031 - DNA, 15 bp, Homo sapiens
catggctgtcccctg

SEQ ID NO: 4268032 - DNA, 20 bp, Homo sapiens
catgggaaatgtcaacaagt

SEQ ID NO: 4268033 - DNA, 13 bp, Homo sapiens
catgggagaacct

SEQ ID NO: 4268034 - DNA, 20 bp, Homo sapiens
catgggagtcagggagccct

SEQ ID NO: 4268035 - DNA, 22 bp, Homo sapiens
catgggagtcagggagccctgg

SEQ ID NO: 4268036 - DNA, 14 bp, Homo sapiens
catgggcatggccg

SEQ ID NO: 4268037 - DNA, 16 bp, Homo sapiens
catggggaggggagag

SEQ ID NO: 4268038 - DNA, 17 bp, Homo sapiens
catggggaggggagaga

SEQ ID NO: 4268039 - DNA, 15 bp, Homo sapiens
catgggggctccaga

SEQ ID NO: 4268040 - DNA, 18 bp, Homo sapiens
catggggtgggcctctgg

SEQ ID NO: 4268041 - DNA, 22 bp, Homo sapiens
catggggttggctgggcccaga

SEQ ID NO: 4268042 - DNA, 16 bp, Homo sapiens
catgggtcccttcccc

SEQ ID NO: 4268043 - DNA, 19 bp, Homo sapiens
catggtgttggaggggcag

SEQ ID NO: 4268044 - DNA, 21 bp, Homo sapiens
catggtgttggaggggcaggc

SEQ ID NO: 4268045 - DNA, 15 bp, Homo sapiens
catggtttaaagtca

SEQ ID NO: 4268046 - DNA, 17 bp, Homo sapiens
catgtaatagtggcttt

SEQ ID NO: 4268047 - DNA, 18 bp, Homo sapiens
catgtagaagagggagaa

SEQ ID NO: 4268048 - DNA, 23 bp, Homo sapiens
catgtagaagagggagaaggaga

SEQ ID NO: 4268049 - DNA, 20 bp, Homo sapiens
catgtatctatgcattttct

SEQ ID NO: 4268050 - DNA, 23 bp, Homo sapiens
catgtatctatgcattttctgga

SEQ ID NO: 4268051 - DNA, 13 bp, Homo sapiens
catgtatgtggaa

SEQ ID NO: 4268052 - DNA, 16 bp, Homo sapiens
catgtccctaccgagt

SEQ ID NO: 4268053 - DNA, 22 bp, Homo sapiens
catgtccctaccgagtctcttc

SEQ ID NO: 4268054 - DNA, 23 bp, Homo sapiens
catgtccctaccgagtctcttct

SEQ ID NO: 4268055 - DNA, 15 bp, Homo sapiens
catgtcctatccctg

SEQ ID NO: 4268056 - DNA, 11 bp, Homo sapiens
catgtctgtga

SEQ ID NO: 4268057 - DNA, 13 bp, Homo sapiens
catgtctgtgaac

SEQ ID NO: 4268058 - DNA, 20 bp, Homo sapiens
catgtctttctccaaagtta

SEQ ID NO: 4268059 - DNA, 17 bp, Homo sapiens
catgtgctgctgtggca

SEQ ID NO: 4268060 - DNA, 16 bp, Homo sapiens
catgtgctgtgcaccc

SEQ ID NO: 4268061 - DNA, 23 bp, Homo sapiens
catgtgctgtgcacccgtgccac

SEQ ID NO: 4268062 - DNA, 16 bp, Homo sapiens
catgtgtcgcctctca

SEQ ID NO: 4268063 - DNA, 22 bp, Homo sapiens
catgtgtcgcctctcactctgg

SEQ ID NO: 4268064 - DNA, 20 bp, Homo sapiens
catgtgttgcaaattattct

SEQ ID NO: 4268065 - DNA, 21 bp, Homo sapiens
catgtgttgcaaattattcta

SEQ ID NO: 4268066 - DNA, 15 bp, Homo sapiens
catgtgtttctgtgt

SEQ ID NO: 4268067 - DNA, 13 bp, Homo sapiens
catgttaaagagg

SEQ ID NO: 4268068 - DNA, 16 bp, Homo sapiens
catgttcttgcagtca

SEQ ID NO: 4268069 - DNA, 13 bp, Homo sapiens
ccatctgctgagc

SEQ ID NO: 4268070 - DNA, 15 bp, Homo sapiens
ccatctgctgagctc

SEQ ID NO: 4268071 - DNA, 18 bp, Homo sapiens
ccatctgctgagctctga

SEQ ID NO: 4268072 - DNA, 12 bp, Homo sapiens
ccatctgtctgt

SEQ ID NO: 4268073 - DNA, 21 bp, Homo sapiens
ccatgactagggtcctcaggc

SEQ ID NO: 4268074 - DNA, 17 bp, Homo sapiens
ccatgagctccagaccc

SEQ ID NO: 4268075 - DNA, 18 bp, Homo sapiens
ccatgagctccagacccc

SEQ ID NO: 4268076 - DNA, 15 bp, Homo sapiens
ccatgaggcctcagt

SEQ ID NO: 4268077 - DNA, 22 bp, Homo sapiens
ccatgatgtggagtggggcagt

SEQ ID NO: 4268078 - DNA, 16 bp, Homo sapiens
ccatgattccaagggc

SEQ ID NO: 4268079 - DNA, 16 bp, Homo sapiens
ccatgattttggccac

SEQ ID NO: 4268080 - DNA, 23 bp, Homo sapiens
ccatgattttggccactttgcag

SEQ ID NO: 4268081 - DNA, 22 bp, Homo sapiens
ccatgcagatctagccaggcct

SEQ ID NO: 4268082 - DNA, 21 bp, Homo sapiens
ccatgcaggcagcctgcagac

SEQ ID NO: 4268083 - DNA, 17 bp, Homo sapiens
ccatgcatggcctccca

SEQ ID NO: 4268084 - DNA, 18 bp, Homo sapiens
ccatgcatggcctcccag

SEQ ID NO: 4268085 - DNA, 19 bp, Homo sapiens
ccatgccccactctgctga

SEQ ID NO: 4268086 - DNA, 22 bp, Homo sapiens
ccatgccccactctgctgaggc

SEQ ID NO: 4268087 - DNA, 24 bp, Homo sapiens
ccatgccccactctgctgaggcca

SEQ ID NO: 4268088 - DNA, 11 bp, Homo sapiens
ccatgccctcc

SEQ ID NO: 4268089 - DNA, 14 bp, Homo sapiens
ccatgccctccctg

SEQ ID NO: 4268090 - DNA, 17 bp, Homo sapiens
ccatgccctccctgctg

SEQ ID NO: 4268091 - DNA, 22 bp, Homo sapiens
ccatgccctccgtcctggcagg

SEQ ID NO: 4268092 - DNA, 18 bp, Homo sapiens
ccatgcggccggcctggg

SEQ ID NO: 4268093 - DNA, 16 bp, Homo sapiens
ccatggaaaaatgcca

SEQ ID NO: 4268094 - DNA, 17 bp, Homo sapiens
ccatggaagctggcagg

SEQ ID NO: 4268095 - DNA, 18 bp, Homo sapiens
ccatggaggcgccttcct

SEQ ID NO: 4268096 - DNA, 20 bp, Homo sapiens
ccatggattcccctggacat

SEQ ID NO: 4268097 - DNA, 15 bp, Homo sapiens
ccatggtagactgtg

SEQ ID NO: 4268098 - DNA, 17 bp, Homo sapiens
ccatggtagactgtgac

SEQ ID NO: 4268099 - DNA, 21 bp, Homo sapiens
ccatggtggtttcagaaaggg

SEQ ID NO: 4268100 - DNA, 19 bp, Homo sapiens
ccatggtgttggaggggca

SEQ ID NO: 4268101 - DNA, 17 bp, Homo sapiens
ccatgtcaagattcagc

SEQ ID NO: 4268102 - DNA, 15 bp, Homo sapiens
ccatgtctttctcca

SEQ ID NO: 4268103 - DNA, 21 bp, Homo sapiens
ccatgtctttctccaaagtta

SEQ ID NO: 4268104 - DNA, 21 bp, Homo sapiens
ccatgtgctgtgcacccgtgc

SEQ ID NO: 4268105 - DNA, 17 bp, Homo sapiens
ccattcacaacacaatc

SEQ ID NO: 4268106 - DNA, 14 bp, Homo sapiens
ccattcacatttta

SEQ ID NO: 4268107 - DNA, 15 bp, Homo sapiens
ccattccgaccttca

SEQ ID NO: 4268108 - DNA, 17 bp, Homo sapiens
ccattccgaccttcacc

SEQ ID NO: 4268109 - DNA, 16 bp, Homo sapiens
ccattctataaattca

SEQ ID NO: 4268110 - DNA, 19 bp, Homo sapiens
ccattgacaaggtgtttct

SEQ ID NO: 4268111 - DNA, 23 bp, Homo sapiens
ccattgacaaggtgtttctctgt

SEQ ID NO: 4268112 - DNA, 22 bp, Homo sapiens
ccattgcaaaaggttaagccat

SEQ ID NO: 4268113 - DNA, 23 bp, Homo sapiens
ccattgcaaaaggttaagccata

SEQ ID NO: 4268114 - DNA, 19 bp, Homo sapiens
ccatttaactagcacttta

SEQ ID NO: 4268115 - DNA, 18 bp, Homo sapiens
ccatttagtcctcacctt

SEQ ID NO: 4268116 - DNA, 22 bp, Homo sapiens
ccatttagtcctcaccttctgt

SEQ ID NO: 4268117 - DNA, 15 bp, Homo sapiens
ccatttgttaatatc

SEQ ID NO: 4268118 - DNA, 18 bp, Homo sapiens
ccattttgtctggctgtg

SEQ ID NO: 4268119 - DNA, 16 bp, Homo sapiens
cccaaaccagggggaa

SEQ ID NO: 4268120 - DNA, 20 bp, Homo sapiens
cccaaaccagggggaagcac

SEQ ID NO: 4268121 - DNA, 23 bp, Homo sapiens
cccaaactgtagtaattgttaca

SEQ ID NO: 4268122 - DNA, 14 bp, Homo sapiens
cccaaagccagaca

SEQ ID NO: 4268123 - DNA, 16 bp, Homo sapiens
cccaaatgcagcttca

SEQ ID NO: 4268124 - DNA, 21 bp, Homo sapiens
cccaagaatagatgctgactg

SEQ ID NO: 4268125 - DNA, 21 bp, Homo sapiens
cccaaggaagaacaaatatga

SEQ ID NO: 4268126 - DNA, 14 bp, Homo sapiens
cccaaggcgtgcag

SEQ ID NO: 4268127 - DNA, 21 bp, Homo sapiens
cccaatcacgagatcttcctt

SEQ ID NO: 4268128 - DNA, 23 bp, Homo sapiens
cccaatcacgagatcttccttcc

SEQ ID NO: 4268129 - DNA, 11 bp, Homo sapiens
cccaatcactg

SEQ ID NO: 4268130 - DNA, 18 bp, Homo sapiens
cccaatccaacccatgca

SEQ ID NO: 4268131 - DNA, 22 bp, Homo sapiens
cccaatccaacccatgcatggc

SEQ ID NO: 4268132 - DNA, 20 bp, Homo sapiens
cccaattttaaaaaataaca

SEQ ID NO: 4268133 - DNA, 12 bp, Homo sapiens
cccacaaaatat

SEQ ID NO: 4268134 - DNA, 12 bp, Homo sapiens
cccacacaggcc

SEQ ID NO: 4268135 - DNA, 16 bp, Homo sapiens
cccacacaggcctggc

SEQ ID NO: 4268136 - DNA, 18 bp, Homo sapiens
cccacacaggcctggccc

SEQ ID NO: 4268137 - DNA, 20 bp, Homo sapiens
cccacacaggcctggcccag

SEQ ID NO: 4268138 - DNA, 23 bp, Homo sapiens
cccacacaggcctggcccagcca

SEQ ID NO: 4268139 - DNA, 16 bp, Homo sapiens
cccacacctgcctctg

SEQ ID NO: 4268140 - DNA, 22 bp, Homo sapiens
cccacaggatgaactagccatg

SEQ ID NO: 4268141 - DNA, 16 bp, Homo sapiens
cccacaggcccttcct

SEQ ID NO: 4268142 - DNA, 18 bp, Homo sapiens
cccacaggcccttcctct

SEQ ID NO: 4268143 - DNA, 17 bp, Homo sapiens
cccaccaactctctctg

SEQ ID NO: 4268144 - DNA, 18 bp, Homo sapiens
cccaccaactctctctgc

SEQ ID NO: 4268145 - DNA, 14 bp, Homo sapiens
cccaccagctggct

SEQ ID NO: 4268146 - DNA, 14 bp, Homo sapiens
cccacccccgggtg

SEQ ID NO: 4268147 - DNA, 21 bp, Homo sapiens
cccacccccgggtgcctgtga

SEQ ID NO: 4268148 - DNA, 15 bp, Homo sapiens
cccaccccctgctgg

SEQ ID NO: 4268149 - DNA, 15 bp, Homo sapiens
cccaccccgcctctg

SEQ ID NO: 4268150 - DNA, 17 bp, Homo sapiens
cccaccccgcctctggg

SEQ ID NO: 4268151 - DNA, 21 bp, Homo sapiens
cccaccctctggtccttctga

SEQ ID NO: 4268152 - DNA, 22 bp, Homo sapiens
cccacctgggccctaggcatac

SEQ ID NO: 4268153 - DNA, 15 bp, Homo sapiens
cccacgctcctgccc

SEQ ID NO: 4268154 - DNA, 20 bp, Homo sapiens
cccacggccactgcagtcac

SEQ ID NO: 4268155 - DNA, 13 bp, Homo sapiens
cccactcagcatt

SEQ ID NO: 4268156 - DNA, 12 bp, Homo sapiens
cccactcccgtg

SEQ ID NO: 4268157 - DNA, 19 bp, Homo sapiens
cccactggctcctccagca

SEQ ID NO: 4268158 - DNA, 17 bp, Homo sapiens
cccacttatgctgctgt

SEQ ID NO: 4268159 - DNA, 20 bp, Homo sapiens
cccacttatgctgctgtgaa

SEQ ID NO: 4268160 - DNA, 18 bp, Homo sapiens
cccagaaatgccgctgtg

SEQ ID NO: 4268161 - DNA, 19 bp, Homo sapiens
cccagaaatgccgctgtgt

SEQ ID NO: 4268162 - DNA, 15 bp, Homo sapiens
cccagaacgcatgca

SEQ ID NO: 4268163 - DNA, 23 bp, Homo sapiens
cccagaacgcatgcagggccccc

SEQ ID NO: 4268164 - DNA, 20 bp, Homo sapiens
cccagacagcagtgtgaggg

SEQ ID NO: 4268165 - DNA, 13 bp, Homo sapiens
cccagacatgctg

SEQ ID NO: 4268166 - DNA, 21 bp, Homo sapiens
cccagacatgctgcccacccc

SEQ ID NO: 4268167 - DNA, 23 bp, Homo sapiens
cccagacatgctgcccaccccct

SEQ ID NO: 4268168 - DNA, 21 bp, Homo sapiens
cccagaccccatccagccagg

SEQ ID NO: 4268169 - DNA, 18 bp, Homo sapiens
cccagagaagcctcagtc

SEQ ID NO: 4268170 - DNA, 14 bp, Homo sapiens
cccagagagaccct

SEQ ID NO: 4268171 - DNA, 16 bp, Homo sapiens
cccagagagaccctgc

SEQ ID NO: 4268172 - DNA, 18 bp, Homo sapiens
cccagagagaccctgcca

SEQ ID NO: 4268173 - DNA, 14 bp, Homo sapiens
cccagagccagggc

SEQ ID NO: 4268174 - DNA, 20 bp, Homo sapiens
cccagagccagggctgtcct

SEQ ID NO: 4268175 - DNA, 16 bp, Homo sapiens
cccagatggctccctg

SEQ ID NO: 4268176 - DNA, 18 bp, Homo sapiens
cccagatggctccctggg

SEQ ID NO: 4268177 - DNA, 22 bp, Homo sapiens
cccagatggctccctgggctgg

SEQ ID NO: 4268178 - DNA, 17 bp, Homo sapiens
cccagcagcggcccaga

SEQ ID NO: 4268179 - DNA, 15 bp, Homo sapiens
cccagcaggtgggga

SEQ ID NO: 4268180 - DNA, 13 bp, Homo sapiens
cccagcagtcctg

SEQ ID NO: 4268181 - DNA, 11 bp, Homo sapiens
cccagccccag

SEQ ID NO: 4268182 - DNA, 16 bp, Homo sapiens
cccagccccctggccc

SEQ ID NO: 4268183 - DNA, 19 bp, Homo sapiens
cccagcctgtggcctcagc

SEQ ID NO: 4268184 - DNA, 21 bp, Homo sapiens
cccagcctgtggcctcagcat

SEQ ID NO: 4268185 - DNA, 17 bp, Homo sapiens
cccagctccaggcagga

SEQ ID NO: 4268186 - DNA, 10 bp, Homo sapiens
cccagctcct

SEQ ID NO: 4268187 - DNA, 14 bp, Homo sapiens
cccagctctagaca

SEQ ID NO: 4268188 - DNA, 15 bp, Homo sapiens
cccaggacactgcct

SEQ ID NO: 4268189 - DNA, 21 bp, Homo sapiens
cccaggacactgcctttgctg

SEQ ID NO: 4268190 - DNA, 22 bp, Homo sapiens
cccaggacactgcctttgctgc

SEQ ID NO: 4268191 - DNA, 13 bp, Homo sapiens
cccaggaccctga

SEQ ID NO: 4268192 - DNA, 15 bp, Homo sapiens
cccaggaccctgagg

SEQ ID NO: 4268193 - DNA, 17 bp, Homo sapiens
cccaggaccctgggtca

SEQ ID NO: 4268194 - DNA, 15 bp, Homo sapiens
cccaggacctctggg

SEQ ID NO: 4268195 - DNA, 15 bp, Homo sapiens
cccaggacgcatgca

SEQ ID NO: 4268196 - DNA, 23 bp, Homo sapiens
cccaggatgcatgcagggccccc

SEQ ID NO: 4268197 - DNA, 16 bp, Homo sapiens
cccagggaatcaggga

SEQ ID NO: 4268198 - DNA, 18 bp, Homo sapiens
ccggatctccaggcccag

SEQ ID NO: 4268199 - DNA, 19 bp, Homo sapiens
ccggatctccaggcccagc

SEQ ID NO: 4268200 - DNA, 17 bp, Homo sapiens
ccggcagccccccagtg

SEQ ID NO: 4268201 - DNA, 14 bp, Homo sapiens
ccggccactctgtt

SEQ ID NO: 4268202 - DNA, 13 bp, Homo sapiens
ccggcccccctct

SEQ ID NO: 4268203 - DNA, 11 bp, Homo sapiens
ccggccctgcc

SEQ ID NO: 4268204 - DNA, 22 bp, Homo sapiens
ccggccctgccccacacaggcc

SEQ ID NO: 4268205 - DNA, 14 bp, Homo sapiens
ccggccctgccccc

SEQ ID NO: 4268206 - DNA, 18 bp, Homo sapiens
ccggcctggggccgggct

SEQ ID NO: 4268207 - DNA, 19 bp, Homo sapiens
ccggcctggggccgggctg

SEQ ID NO: 4268208 - DNA, 15 bp, Homo sapiens
ccggctgagctgtgc

SEQ ID NO: 4268209 - DNA, 17 bp, Homo sapiens
ccggctgagctgtgcca

SEQ ID NO: 4268210 - DNA, 18 bp, Homo sapiens
ccggctgagctgtgccag

SEQ ID NO: 4268211 - DNA, 21 bp, Homo sapiens
ccggctgagctgtgccagctg

SEQ ID NO: 4268212 - DNA, 21 bp, Homo sapiens
ccgggagatccgccctgggct

SEQ ID NO: 4268213 - DNA, 19 bp, Homo sapiens
ccgggctggcttctccctg

SEQ ID NO: 4268214 - DNA, 20 bp, Homo sapiens
ccgggctggcttctccctgg

SEQ ID NO: 4268215 - DNA, 15 bp, Homo sapiens
ccggggagctgaggg

SEQ ID NO: 4268216 - DNA, 16 bp, Homo sapiens
ccggggagctgagggg

SEQ ID NO: 4268217 - DNA, 19 bp, Homo sapiens
ccggggcagctgccagaga

SEQ ID NO: 4268218 - DNA, 20 bp, Homo sapiens
ccggggcatggacagggcca

SEQ ID NO: 4268219 - DNA, 21 bp, Homo sapiens
ccggggcatggacagggccag

SEQ ID NO: 4268220 - DNA, 12 bp, Homo sapiens
ccggggccatgg

SEQ ID NO: 4268221 - DNA, 18 bp, Homo sapiens
ccggggccatggaagctg

SEQ ID NO: 4268222 - DNA, 12 bp, Homo sapiens
ccgggggtgggg

SEQ ID NO: 4268223 - DNA, 18 bp, Homo sapiens
ccggggtcctgaggctgg

SEQ ID NO: 4268224 - DNA, 23 bp, Homo sapiens
ccgggtgccccccatgccctccc

SEQ ID NO: 4268225 - DNA, 19 bp, Homo sapiens
ccgggtttggcgggccaag

SEQ ID NO: 4268226 - DNA, 21 bp, Homo sapiens
ccgggtttggcgggccaagga

SEQ ID NO: 4268227 - DNA, 15 bp, Homo sapiens
ccgtcagcctgtgaa

SEQ ID NO: 4268228 - DNA, 13 bp, Homo sapiens
ccgtccctttccc

SEQ ID NO: 4268229 - DNA, 16 bp, Homo sapiens
ccgtccctttccctgc

SEQ ID NO: 4268230 - DNA, 21 bp, Homo sapiens
ccgtcctggcagggcaggcag

SEQ ID NO: 4268231 - DNA, 14 bp, Homo sapiens
ccgtgaggaggggg

SEQ ID NO: 4268232 - DNA, 14 bp, Homo sapiens
ccgtgccttcagct

SEQ ID NO: 4268233 - DNA, 15 bp, Homo sapiens
ccgtgctcacagtag

SEQ ID NO: 4268234 - DNA, 18 bp, Homo sapiens
ccgtggagtcgagctggc

SEQ ID NO: 4268235 - DNA, 19 bp, Homo sapiens
ccgtgggcactgaaggctt

SEQ ID NO: 4268236 - DNA, 15 bp, Homo sapiens
ccgtgggccatggca

SEQ ID NO: 4268237 - DNA, 16 bp, Homo sapiens
ccgtgtggccccttca

SEQ ID NO: 4268238 - DNA, 19 bp, Homo sapiens
ccgttagggaaatccaact

SEQ ID NO: 4268239 - DNA, 23 bp, Homo sapiens
ccgttgcctctctgccagccgct

SEQ ID NO: 4268240 - DNA, 16 bp, Homo sapiens
ccgttgttgtccctgc

SEQ ID NO: 4268241 - DNA, 16 bp, Homo sapiens
cctaaatccattttct

SEQ ID NO: 4268242 - DNA, 17 bp, Homo sapiens
cctaaatccattttcta

SEQ ID NO: 4268243 - DNA, 22 bp, Homo sapiens
cctaaggcaacatttccgaaga

SEQ ID NO: 4268244 - DNA, 13 bp, Homo sapiens
cctacccgcccgc

SEQ ID NO: 4268245 - DNA, 17 bp, Homo sapiens
cctacccggctcgttcc

SEQ ID NO: 4268246 - DNA, 14 bp, Homo sapiens
cctaccctttccca

SEQ ID NO: 4268247 - DNA, 19 bp, Homo sapiens
cctaccgagtctcttctcc

SEQ ID NO: 4268248 - DNA, 21 bp, Homo sapiens
cctaccgagtctcttctccac

SEQ ID NO: 4268249 - DNA, 22 bp, Homo sapiens
cctaccgagtctcttctccact

SEQ ID NO: 4268250 - DNA, 23 bp, Homo sapiens
cctaccgagtctcttctccactg

SEQ ID NO: 4268251 - DNA, 12 bp, Homo sapiens
cctacctggtaa

SEQ ID NO: 4268252 - DNA, 13 bp, Homo sapiens
cctacgtgctgcc

SEQ ID NO: 4268253 - DNA, 21 bp, Homo sapiens
cctagaggaggaaaaaggctg

SEQ ID NO: 4268254 - DNA, 20 bp, Homo sapiens
cctagcacaaggagtgcccg

SEQ ID NO: 4268255 - DNA, 21 bp, Homo sapiens
cctagcacaaggagtgcccgc

SEQ ID NO: 4268256 - DNA, 19 bp, Homo sapiens
cctagcagtttgcctctgc

SEQ ID NO: 4268257 - DNA, 20 bp, Homo sapiens
cctagcagtttgcctctgca

SEQ ID NO: 4268258 - DNA, 20 bp, Homo sapiens
cctaggagcagtgggccctg

SEQ ID NO: 4268259 - DNA, 16 bp, Homo sapiens
cctaggagctggggag

SEQ ID NO: 4268260 - DNA, 23 bp, Homo sapiens
cctaggagctggggagggagaga

SEQ ID NO: 4268261 - DNA, 18 bp, Homo sapiens
cctaggcatactctccag

SEQ ID NO: 4268262 - DNA, 19 bp, Homo sapiens
cctaggcatactctccagg

SEQ ID NO: 4268263 - DNA, 12 bp, Homo sapiens
cctaggccagct

SEQ ID NO: 4268264 - DNA, 14 bp, Homo sapiens
cctaggccagctcc

SEQ ID NO: 4268265 - DNA, 14 bp, Homo sapiens
cctagggcctggtc

SEQ ID NO: 4268266 - DNA, 18 bp, Homo sapiens
cctaggggtcagggacca

SEQ ID NO: 4268267 - DNA, 20 bp, Homo sapiens
cctagggtgagggtgacaga

SEQ ID NO: 4268268 - DNA, 17 bp, Homo sapiens
cctaggtctccacccct

SEQ ID NO: 4268269 - DNA, 21 bp, Homo sapiens
cctaggtgggtcaactccaag

SEQ ID NO: 4268270 - DNA, 22 bp, Homo sapiens
cctaggtgggtcaactccaagg

SEQ ID NO: 4268271 - DNA, 18 bp, Homo sapiens
cctagtgacccggaggcc

SEQ ID NO: 4268272 - DNA, 20 bp, Homo sapiens
cctagtgacccggaggccac

SEQ ID NO: 4268273 - DNA, 13 bp, Homo sapiens
cctagttctttgc

SEQ ID NO: 4268274 - DNA, 22 bp, Homo sapiens
cctagttctttgcattcgtcct

SEQ ID NO: 4268275 - DNA, 16 bp, Homo sapiens
cctataaaggaaacac

SEQ ID NO: 4268276 - DNA, 20 bp, Homo sapiens
cctataccctaggtctccac

SEQ ID NO: 4268277 - DNA, 23 bp, Homo sapiens
cctatcatcagttaggattaggt

SEQ ID NO: 4268278 - DNA, 13 bp, Homo sapiens
cctatccctggac

SEQ ID NO: 4268279 - DNA, 18 bp, Homo sapiens
cctatcctgcaccctctg

SEQ ID NO: 4268280 - DNA, 20 bp, Homo sapiens
cctatgccacctgcagcgtc

SEQ ID NO: 4268281 - DNA, 18 bp, Homo sapiens
cctatggaaagggtgtgg

SEQ ID NO: 4268282 - DNA, 13 bp, Homo sapiens
cctattgtaatat

SEQ ID NO: 4268283 - DNA, 22 bp, Homo sapiens
cctcaaccctccctcagcccct

SEQ ID NO: 4268284 - DNA, 23 bp, Homo sapiens
cctcaaccctccctcagcccctc

SEQ ID NO: 4268285 - DNA, 13 bp, Homo sapiens
cctcaacctgtga

SEQ ID NO: 4268286 - DNA, 22 bp, Homo sapiens
cctcaagccaggagaccctgtc

SEQ ID NO: 4268287 - DNA, 15 bp, Homo sapiens
cctcaagctgcatct

SEQ ID NO: 4268288 - DNA, 16 bp, Homo sapiens
cctcacccctgcaggc

SEQ ID NO: 4268289 - DNA, 23 bp, Homo sapiens
cctcacctggcttcccaggaccc

SEQ ID NO: 4268290 - DNA, 14 bp, Homo sapiens
cctcacctgggcac

SEQ ID NO: 4268291 - DNA, 19 bp, Homo sapiens
cctcaccttgcaacacaca

SEQ ID NO: 4268292 - DNA, 15 bp, Homo sapiens
cctcactccactccc

SEQ ID NO: 4268293 - DNA, 18 bp, Homo sapiens
cctcactccactcccctc

SEQ ID NO: 4268294 - DNA, 19 bp, Homo sapiens
cctcactccactcccctca

SEQ ID NO: 4268295 - DNA, 16 bp, Homo sapiens
cctcactggtgcattt

SEQ ID NO: 4268296 - DNA, 21 bp, Homo sapiens
cctcactggtgcatttaaaat

SEQ ID NO: 4268297 - DNA, 20 bp, Homo sapiens
cctcagaggccccttgctgc

SEQ ID NO: 4268298 - DNA, 18 bp, Homo sapiens
cctcagagggtccctagg

SEQ ID NO: 4268299 - DNA, 15 bp, Homo sapiens
cctcagagtccaggc

SEQ ID NO: 4268300 - DNA, 16 bp, Homo sapiens
cctcagagtccaggcc

SEQ ID NO: 4268301 - DNA, 18 bp, Homo sapiens
cctcagagtccaggcccc

SEQ ID NO: 4268302 - DNA, 15 bp, Homo sapiens
cctcagcagaaggcc

SEQ ID NO: 4268303 - DNA, 18 bp, Homo sapiens
cctcagcagaaggccttg

SEQ ID NO: 4268304 - DNA, 16 bp, Homo sapiens
cctcagccacacccag

SEQ ID NO: 4268305 - DNA, 12 bp, Homo sapiens
cctcagccacgc

SEQ ID NO: 4268306 - DNA, 14 bp, Homo sapiens
cctcagccccaggg

SEQ ID NO: 4268307 - DNA, 13 bp, Homo sapiens
cctcaggaggcag

SEQ ID NO: 4268308 - DNA, 18 bp, Homo sapiens
cctcaggcagtggcccag

SEQ ID NO: 4268309 - DNA, 21 bp, Homo sapiens
cctcaggcttggggatgccct

SEQ ID NO: 4268310 - DNA, 13 bp, Homo sapiens
cctcaggggagac

SEQ ID NO: 4268311 - DNA, 21 bp, Homo sapiens
cctcagtccctccctcctggc

SEQ ID NO: 4268312 - DNA, 23 bp, Homo sapiens
cctcatcacacgtcacaatgtcc

SEQ ID NO: 4268313 - DNA, 15 bp, Homo sapiens
cctcatgggagtcag

SEQ ID NO: 4268314 - DNA, 22 bp, Homo sapiens
cctccaatcccaccaaccctca

SEQ ID NO: 4268315 - DNA, 17 bp, Homo sapiens
cctccacacctccaccc

SEQ ID NO: 4268316 - DNA, 16 bp, Homo sapiens
cctccaccccagtccc

SEQ ID NO: 4268317 - DNA, 15 bp, Homo sapiens
cctccacccgtcctg

SEQ ID NO: 4268318 - DNA, 15 bp, Homo sapiens
cctccacctgcagcc

SEQ ID NO: 4268319 - DNA, 18 bp, Homo sapiens
cctccacctgggagatgc

SEQ ID NO: 4268320 - DNA, 22 bp, Homo sapiens
cctccacctgggagatgctggg

SEQ ID NO: 4268321 - DNA, 17 bp, Homo sapiens
cctccactccctgtctg

SEQ ID NO: 4268322 - DNA, 18 bp, Homo sapiens
cctccactccctgtctga

SEQ ID NO: 4268323 - DNA, 14 bp, Homo sapiens
cctccactcctccc

SEQ ID NO: 4268324 - DNA, 13 bp, Homo sapiens
cctccagacccct

SEQ ID NO: 4268325 - DNA, 22 bp, Homo sapiens
cctccagacccctaccctttcc

SEQ ID NO: 4268326 - DNA, 15 bp, Homo sapiens
cctccagcaagacct

SEQ ID NO: 4268327 - DNA, 19 bp, Homo sapiens
cctccagcaagacctcgtc

SEQ ID NO: 4268328 - DNA, 17 bp, Homo sapiens
cgccttctacctgcagg

SEQ ID NO: 4268329 - DNA, 19 bp, Homo sapiens
cgccttctggccgctgcag

SEQ ID NO: 4268330 - DNA, 14 bp, Homo sapiens
cgccttctggggag

SEQ ID NO: 4268331 - DNA, 13 bp, Homo sapiens
cgcgcacacacac

SEQ ID NO: 4268332 - DNA, 13 bp, Homo sapiens
cgcgcgcacacac

SEQ ID NO: 4268333 - DNA, 14 bp, Homo sapiens
cgcgcgcacacaca

SEQ ID NO: 4268334 - DNA, 22 bp, Homo sapiens
cgcgggcagtgacgtgagtggg

SEQ ID NO: 4268335 - DNA, 24 bp, Homo sapiens
cgctaaggcttccggctgagctgt

SEQ ID NO: 4268336 - DNA, 22 bp, Homo sapiens
cgctagagcattctggggtggg

SEQ ID NO: 4268337 - DNA, 21 bp, Homo sapiens
cgctcagccctccctgcccct

SEQ ID NO: 4268338 - DNA, 23 bp, Homo sapiens
cgctctgaggcaaccccctcgga

SEQ ID NO: 4268339 - DNA, 12 bp, Homo sapiens
cgctctgcatgc

SEQ ID NO: 4268340 - DNA, 17 bp, Homo sapiens
cgctctgccatcagccc

SEQ ID NO: 4268341 - DNA, 18 bp, Homo sapiens
cgctcttcaccaggaaga

SEQ ID NO: 4268342 - DNA, 23 bp, Homo sapiens
cgctcttcaccaggaagaaggcc

SEQ ID NO: 4268343 - DNA, 23 bp, Homo sapiens
cgctgacaaccaccgctccccag

SEQ ID NO: 4268344 - DNA, 20 bp, Homo sapiens
cgctgcagtcagcacagaga

SEQ ID NO: 4268345 - DNA, 15 bp, Homo sapiens
cgctgccttgccatg

SEQ ID NO: 4268346 - DNA, 15 bp, Homo sapiens
cgctgcgctgccctg

SEQ ID NO: 4268347 - DNA, 17 bp, Homo sapiens
cgctgggagaaaagcca

SEQ ID NO: 4268348 - DNA, 21 bp, Homo sapiens
cgctgtgctggtctctaggcc

SEQ ID NO: 4268349 - DNA, 18 bp, Homo sapiens
cgcttcgccatgtgctgt

SEQ ID NO: 4268350 - DNA, 23 bp, Homo sapiens
cgcttttgtacgttaattaaaca

SEQ ID NO: 4268351 - DNA, 22 bp, Homo sapiens
cggacaagcccaggacactgcc

SEQ ID NO: 4268352 - DNA, 15 bp, Homo sapiens
cggacgcatgcaggg

SEQ ID NO: 4268353 - DNA, 14 bp, Homo sapiens
cggagacgggaccg

SEQ ID NO: 4268354 - DNA, 22 bp, Homo sapiens
cggagcactgtgcagccgggga

SEQ ID NO: 4268355 - DNA, 17 bp, Homo sapiens
cggagctaacactggcc

SEQ ID NO: 4268356 - DNA, 19 bp, Homo sapiens
cggagctaacactggcccc

SEQ ID NO: 4268357 - DNA, 21 bp, Homo sapiens
cggagctaacactggccccta

SEQ ID NO: 4268358 - DNA, 16 bp, Homo sapiens
cggagcttctccagcc

SEQ ID NO: 4268359 - DNA, 17 bp, Homo sapiens
cggagcttctccagcca

SEQ ID NO: 4268360 - DNA, 20 bp, Homo sapiens
cggagcttctccagccacca

SEQ ID NO: 4268361 - DNA, 21 bp, Homo sapiens
cggaggccacatgagtcccag

SEQ ID NO: 4268362 - DNA, 15 bp, Homo sapiens
cggaggcttgggacc

SEQ ID NO: 4268363 - DNA, 17 bp, Homo sapiens
cggaggcttgggaccgc

SEQ ID NO: 4268364 - DNA, 18 bp, Homo sapiens
cggaggcttgtcagagct

SEQ ID NO: 4268365 - DNA, 15 bp, Homo sapiens
cggaggggcctggca

SEQ ID NO: 4268366 - DNA, 14 bp, Homo sapiens
cggatctccaggcc

SEQ ID NO: 4268367 - DNA, 16 bp, Homo sapiens
cggatctccaggccca

SEQ ID NO: 4268368 - DNA, 12 bp, Homo sapiens
cggcagcccccc

SEQ ID NO: 4268369 - DNA, 22 bp, Homo sapiens
cggcagccccccagtgtcccca

SEQ ID NO: 4268370 - DNA, 16 bp, Homo sapiens
cggcagtgcaccccct

SEQ ID NO: 4268371 - DNA, 14 bp, Homo sapiens
cggccactgcagtc

SEQ ID NO: 4268372 - DNA, 12 bp, Homo sapiens
cggccagagctc

SEQ ID NO: 4268373 - DNA, 17 bp, Homo sapiens
cggccagagctcccagg

SEQ ID NO: 4268374 - DNA, 12 bp, Homo sapiens
cggcccccctct

SEQ ID NO: 4268375 - DNA, 18 bp, Homo sapiens
cggcccccgccctctgcc

SEQ ID NO: 4268376 - DNA, 18 bp, Homo sapiens
cggcctggggacggagca

SEQ ID NO: 4268377 - DNA, 21 bp, Homo sapiens
cggcctggggacggagcactg

SEQ ID NO: 4268378 - DNA, 20 bp, Homo sapiens
cggcctggggccgggctggc

SEQ ID NO: 4268379 - DNA, 21 bp, Homo sapiens
cggcgccttctacctgcagga

SEQ ID NO: 4268380 - DNA, 18 bp, Homo sapiens
cggctcctccccgatccc

SEQ ID NO: 4268381 - DNA, 17 bp, Homo sapiens
cggctctgaggctgccc

SEQ ID NO: 4268382 - DNA, 21 bp, Homo sapiens
cggctgagctgtgccagctgc

SEQ ID NO: 4268383 - DNA, 22 bp, Homo sapiens
cggctgagctgtgccagctgct

SEQ ID NO: 4268384 - DNA, 19 bp, Homo sapiens
cggctgcacctgcagggag

SEQ ID NO: 4268385 - DNA, 23 bp, Homo sapiens
cggctgggagcctcgcccctcca

SEQ ID NO: 4268386 - DNA, 15 bp, Homo sapiens
cgggagcagttgacc

SEQ ID NO: 4268387 - DNA, 15 bp, Homo sapiens
cgggagcctgcgtgg

SEQ ID NO: 4268388 - DNA, 12 bp, Homo sapiens
cgggaggaggat

SEQ ID NO: 4268389 - DNA, 19 bp, Homo sapiens
cgggagtgtgggggtgcca

SEQ ID NO: 4268390 - DNA, 22 bp, Homo sapiens
cgggcaggggccgcttcgccat

SEQ ID NO: 4268391 - DNA, 20 bp, Homo sapiens
cgggcagtgacgtgagtggg

SEQ ID NO: 4268392 - DNA, 14 bp, Homo sapiens
cgggccaaggactg

SEQ ID NO: 4268393 - DNA, 17 bp, Homo sapiens
cgggctctctcacccag

SEQ ID NO: 4268394 - DNA, 21 bp, Homo sapiens
cgggctctctcacccagcctg

SEQ ID NO: 4268395 - DNA, 17 bp, Homo sapiens
cggggacacggcctctg

SEQ ID NO: 4268396 - DNA, 16 bp, Homo sapiens
cggggagctgaggggc

SEQ ID NO: 4268397 - DNA, 17 bp, Homo sapiens
cggggagctgaggggca

SEQ ID NO: 4268398 - DNA, 14 bp, Homo sapiens
cggggaggccaagt

SEQ ID NO: 4268399 - DNA, 19 bp, Homo sapiens
cggggcagctgccagagaa

SEQ ID NO: 4268400 - DNA, 12 bp, Homo sapiens
cggggcaggaag

SEQ ID NO: 4268401 - DNA, 20 bp, Homo sapiens
cggggcatggacagggccag

SEQ ID NO: 4268402 - DNA, 15 bp, Homo sapiens
cggggctggccagct

SEQ ID NO: 4268403 - DNA, 23 bp, Homo sapiens
cggggcttcaaccttgagacagc

SEQ ID NO: 4268404 - DNA, 15 bp, Homo sapiens
cgggggcctagtggc

SEQ ID NO: 4268405 - DNA, 18 bp, Homo sapiens
cggggtcctgaggctggg

SEQ ID NO: 4268406 - DNA, 18 bp, Homo sapiens
cggggtctccacctcagg

SEQ ID NO: 4268407 - DNA, 17 bp, Homo sapiens
cgggtgccccccatgcc

SEQ ID NO: 4268408 - DNA, 19 bp, Homo sapiens
cggtcaataattgtggaga

SEQ ID NO: 4268409 - DNA, 22 bp, Homo sapiens
cggtcaataattgtggagagga

SEQ ID NO: 4268410 - DNA, 23 bp, Homo sapiens
cggtcaataattgtggagaggag

SEQ ID NO: 4268411 - DNA, 17 bp, Homo sapiens
cggtccagaggaggtgc

SEQ ID NO: 4268412 - DNA, 21 bp, Homo sapiens
cggtccagaggaggtgcccgg

SEQ ID NO: 4268413 - DNA, 14 bp, Homo sapiens
cggtgagactctga

SEQ ID NO: 4268414 - DNA, 17 bp, Homo sapiens
cggtgcagtggcaaagg

SEQ ID NO: 4268415 - DNA, 20 bp, Homo sapiens
cggtggctcacgcctgtaat

SEQ ID NO: 4268416 - DNA, 17 bp, Homo sapiens
cggtgtgagatggtgcc

SEQ ID NO: 4268417 - DNA, 22 bp, Homo sapiens
cggtgtgagatggtgccccctg

SEQ ID NO: 4268418 - DNA, 21 bp, Homo sapiens
cggttaattggttaatcactt

SEQ ID NO: 4268419 - DNA, 14 bp, Homo sapiens
cggttccctgccta

SEQ ID NO: 4268420 - DNA, 18 bp, Homo sapiens
cggtttctttgttacttt

SEQ ID NO: 4268421 - DNA, 20 bp, Homo sapiens
cgtatgcagtgtagatttta

SEQ ID NO: 4268422 - DNA, 15 bp, Homo sapiens
cgtattgtgaaattt

SEQ ID NO: 4268423 - DNA, 16 bp, Homo sapiens
cgtcaccatctcaggc

SEQ ID NO: 4268424 - DNA, 20 bp, Homo sapiens
cgtcaccatctcaggccacc

SEQ ID NO: 4268425 - DNA, 15 bp, Homo sapiens
cgtcagcctgtgaac

SEQ ID NO: 4268426 - DNA, 20 bp, Homo sapiens
cgtcaggaggtgcctgagag

SEQ ID NO: 4268427 - DNA, 14 bp, Homo sapiens
cgtcatgctcccaa

SEQ ID NO: 4268428 - DNA, 17 bp, Homo sapiens
cgtccaaccccggggca

SEQ ID NO: 4268429 - DNA, 22 bp, Homo sapiens
cgtccacggctctaggtggggc

SEQ ID NO: 4268430 - DNA, 23 bp, Homo sapiens
cgtcctggggtggttggaggcct

SEQ ID NO: 4268431 - DNA, 22 bp, Homo sapiens
cgtctagctatgctgtatctgt

SEQ ID NO: 4268432 - DNA, 13 bp, Homo sapiens
cgtctgagcggcc

SEQ ID NO: 4268433 - DNA, 23 bp, Homo sapiens
cgtctgagcggccgcctgtcctt

SEQ ID NO: 4268434 - DNA, 13 bp, Homo sapiens
cgtcttgtatttt

SEQ ID NO: 4268435 - DNA, 13 bp, Homo sapiens
cgtgaagcctccc

SEQ ID NO: 4268436 - DNA, 16 bp, Homo sapiens
cgtgacttcagactct

SEQ ID NO: 4268437 - DNA, 17 bp, Homo sapiens
cgtgacttcagactctc

SEQ ID NO: 4268438 - DNA, 14 bp, Homo sapiens
cgtgagagcccaat

SEQ ID NO: 4268439 - DNA, 14 bp, Homo sapiens
cgtgcacacacctg

SEQ ID NO: 4268440 - DNA, 15 bp, Homo sapiens
cgtgcacacacctgc

SEQ ID NO: 4268441 - DNA, 12 bp, Homo sapiens
cgtgcagggcca

SEQ ID NO: 4268442 - DNA, 13 bp, Homo sapiens
cgtgcagggccag

SEQ ID NO: 4268443 - DNA, 13 bp, Homo sapiens
cgtggagccacag

SEQ ID NO: 4268444 - DNA, 18 bp, Homo sapiens
cgtggagccacaggcaga

SEQ ID NO: 4268445 - DNA, 19 bp, Homo sapiens
cgtggagccacaggcagac

SEQ ID NO: 4268446 - DNA, 18 bp, Homo sapiens
cgtggagtcgagctggcc

SEQ ID NO: 4268447 - DNA, 15 bp, Homo sapiens
cgtggcctggggctg

SEQ ID NO: 4268448 - DNA, 15 bp, Homo sapiens
cgtggctcccagcag

SEQ ID NO: 4268449 - DNA, 15 bp, Homo sapiens
cgtgggatccagaga

SEQ ID NO: 4268450 - DNA, 13 bp, Homo sapiens
cgtgggccatggc

SEQ ID NO: 4268451 - DNA, 23 bp, Homo sapiens
cgtggtgaggttgtgctgcctgt

SEQ ID NO: 4268452 - DNA, 14 bp, Homo sapiens
cgtgtctgtggccc

SEQ ID NO: 4268453 - DNA, 14 bp, Homo sapiens
cgtgtgcttagaaa

SEQ ID NO: 4268454 - DNA, 14 bp, Homo sapiens
cgttaattaaacaa

SEQ ID NO: 4268455 - DNA, 16 bp, Homo sapiens
cgttagtaatctgtat

SEQ ID NO: 4268456 - DNA, 13 bp, Homo sapiens
cgttcccccaggg

SEQ ID NO: 4268457 - DNA, 22 bp, Homo sapiens
cgttcccccaggggtgagcccc

SEQ ID NO: 4268458 - DNA, 23 bp, Homo sapiens
ctctagacaaccctgcaaaggac

SEQ ID NO: 4268459 - DNA, 13 bp, Homo sapiens
ctctaggtggggc

SEQ ID NO: 4268460 - DNA, 17 bp, Homo sapiens
ctctatatatacatgta

SEQ ID NO: 4268461 - DNA, 16 bp, Homo sapiens
ctctcacccagcctgg

SEQ ID NO: 4268462 - DNA, 15 bp, Homo sapiens
ctctcactctggcag

SEQ ID NO: 4268463 - DNA, 16 bp, Homo sapiens
ctctcagcccaggtct

SEQ ID NO: 4268464 - DNA, 20 bp, Homo sapiens
ctctcagcccaggtctcctg

SEQ ID NO: 4268465 - DNA, 13 bp, Homo sapiens
ctctcagcctcca

SEQ ID NO: 4268466 - DNA, 19 bp, Homo sapiens
ctctcaggcatgcctgtgt

SEQ ID NO: 4268467 - DNA, 21 bp, Homo sapiens
ctctcaggcatgcctgtgtga

SEQ ID NO: 4268468 - DNA, 14 bp, Homo sapiens
ctctcatgaacctc

SEQ ID NO: 4268469 - DNA, 11 bp, Homo sapiens
ctctccactgc

SEQ ID NO: 4268470 - DNA, 14 bp, Homo sapiens
ctctccactgcctt

SEQ ID NO: 4268471 - DNA, 15 bp, Homo sapiens
ctctccactgccttc

SEQ ID NO: 4268472 - DNA, 15 bp, Homo sapiens
ctctcctctctctcc

SEQ ID NO: 4268473 - DNA, 17 bp, Homo sapiens
ctctcctctctctccct

SEQ ID NO: 4268474 - DNA, 18 bp, Homo sapiens
ctctcctctctctccctc

SEQ ID NO: 4268475 - DNA, 17 bp, Homo sapiens
ctctcgggctctctcac

SEQ ID NO: 4268476 - DNA, 19 bp, Homo sapiens
ctctcgggctctctcaccc

SEQ ID NO: 4268477 - DNA, 15 bp, Homo sapiens
ctctctatatataca

SEQ ID NO: 4268478 - DNA, 22 bp, Homo sapiens
ctctctatatatacatgtatag

SEQ ID NO: 4268479 - DNA, 13 bp, Homo sapiens
ctctctcacccag

SEQ ID NO: 4268480 - DNA, 17 bp, Homo sapiens
ctctctcagcccaggtc

SEQ ID NO: 4268481 - DNA, 17 bp, Homo sapiens
ctctctccctccactcc

SEQ ID NO: 4268482 - DNA, 13 bp, Homo sapiens
ctctctctatata

SEQ ID NO: 4268483 - DNA, 15 bp, Homo sapiens
ctctctctccctcca

SEQ ID NO: 4268484 - DNA, 12 bp, Homo sapiens
ctctctctgccc

SEQ ID NO: 4268485 - DNA, 13 bp, Homo sapiens
ctctctctgcccc

SEQ ID NO: 4268486 - DNA, 18 bp, Homo sapiens
ctctctgaactgcaacac

SEQ ID NO: 4268487 - DNA, 12 bp, Homo sapiens
ctctctgccccc

SEQ ID NO: 4268488 - DNA, 15 bp, Homo sapiens
ctctctgtttaccct

SEQ ID NO: 4268489 - DNA, 21 bp, Homo sapiens
ctctctgtttaccctccctgt

SEQ ID NO: 4268490 - DNA, 19 bp, Homo sapiens
ctctcttaatgccacggca

SEQ ID NO: 4268491 - DNA, 20 bp, Homo sapiens
ctctcttaccccgtcccttt

SEQ ID NO: 4268492 - DNA, 22 bp, Homo sapiens
ctctcttaccccgtccctttcc

SEQ ID NO: 4268493 - DNA, 13 bp, Homo sapiens
ctctcttcttact

SEQ ID NO: 4268494 - DNA, 15 bp, Homo sapiens
ctctgaaaatatttt

SEQ ID NO: 4268495 - DNA, 16 bp, Homo sapiens
ctctgaaagctgcttc

SEQ ID NO: 4268496 - DNA, 18 bp, Homo sapiens
ctctgaaagctgcttctg

SEQ ID NO: 4268497 - DNA, 20 bp, Homo sapiens
ctctgaactgcaacactgga

SEQ ID NO: 4268498 - DNA, 17 bp, Homo sapiens
ctctgaactgctgctgg

SEQ ID NO: 4268499 - DNA, 19 bp, Homo sapiens
ctctgaggatgatgtactt

SEQ ID NO: 4268500 - DNA, 19 bp, Homo sapiens
ctctgaggcaaccccctcg

SEQ ID NO: 4268501 - DNA, 18 bp, Homo sapiens
ctctgagtgaagtccagt

SEQ ID NO: 4268502 - DNA, 19 bp, Homo sapiens
ctctgcacgtgcacacacc

SEQ ID NO: 4268503 - DNA, 23 bp, Homo sapiens
ctctgcacgtgcacacacctgca

SEQ ID NO: 4268504 - DNA, 15 bp, Homo sapiens
ctctgcataccaggg

SEQ ID NO: 4268505 - DNA, 18 bp, Homo sapiens
ctctgcatgctcctctgc

SEQ ID NO: 4268506 - DNA, 14 bp, Homo sapiens
ctctgccatcagcc

SEQ ID NO: 4268507 - DNA, 16 bp, Homo sapiens
ctctgccatcagcccc

SEQ ID NO: 4268508 - DNA, 19 bp, Homo sapiens
ctctgcccccaaaagtgtc

SEQ ID NO: 4268509 - DNA, 18 bp, Homo sapiens
ctctgcctgtgcccgctg

SEQ ID NO: 4268510 - DNA, 13 bp, Homo sapiens
ctctgccttggac

SEQ ID NO: 4268511 - DNA, 15 bp, Homo sapiens
ctctgctgaggccag

SEQ ID NO: 4268512 - DNA, 17 bp, Homo sapiens
ctctgcttttccattct

SEQ ID NO: 4268513 - DNA, 18 bp, Homo sapiens
ctctgcttttccattctg

SEQ ID NO: 4268514 - DNA, 21 bp, Homo sapiens
ctctgcttttccattctgggt

SEQ ID NO: 4268515 - DNA, 17 bp, Homo sapiens
ctctggactgggaaggg

SEQ ID NO: 4268516 - DNA, 18 bp, Homo sapiens
ctctggagtgtgtggggg

SEQ ID NO: 4268517 - DNA, 23 bp, Homo sapiens
ctctggcagcctcagaggcccct

SEQ ID NO: 4268518 - DNA, 15 bp, Homo sapiens
ctctggccactctgc

SEQ ID NO: 4268519 - DNA, 23 bp, Homo sapiens
ctctggccttggttcctccagca

SEQ ID NO: 4268520 - DNA, 23 bp, Homo sapiens
ctctgggcaggacctcagagtcc

SEQ ID NO: 4268521 - DNA, 14 bp, Homo sapiens
ctctgggctcacac

SEQ ID NO: 4268522 - DNA, 17 bp, Homo sapiens
ctctgggctcacaccag

SEQ ID NO: 4268523 - DNA, 20 bp, Homo sapiens
ctctgggctcacaccagccc

SEQ ID NO: 4268524 - DNA, 21 bp, Homo sapiens
ctctggggagaccgagtgtgg

SEQ ID NO: 4268525 - DNA, 20 bp, Homo sapiens
ctctggtttggggcgaggca

SEQ ID NO: 4268526 - DNA, 14 bp, Homo sapiens
ctctgtaaaatgaa

SEQ ID NO: 4268527 - DNA, 15 bp, Homo sapiens
ctctgtaaaatgaac

SEQ ID NO: 4268528 - DNA, 10 bp, Homo sapiens
ctctgtggcc

SEQ ID NO: 4268529 - DNA, 13 bp, Homo sapiens
ctctgttcatttc

SEQ ID NO: 4268530 - DNA, 22 bp, Homo sapiens
ctctgttcctggctcagcctca

SEQ ID NO: 4268531 - DNA, 15 bp, Homo sapiens
ctctgtttgctcacc

SEQ ID NO: 4268532 - DNA, 21 bp, Homo sapiens
ctctgtttgctcacccaggac

SEQ ID NO: 4268533 - DNA, 23 bp, Homo sapiens
ctctgtttgctcacccaggacct

SEQ ID NO: 4268534 - DNA, 21 bp, Homo sapiens
ctcttaatgccacggcagcca

SEQ ID NO: 4268535 - DNA, 14 bp, Homo sapiens
ctcttaccccgtcc

SEQ ID NO: 4268536 - DNA, 20 bp, Homo sapiens
ctcttaccccgtccctttcc

SEQ ID NO: 4268537 - DNA, 21 bp, Homo sapiens
ctcttaccccgtccctttccc

SEQ ID NO: 4268538 - DNA, 22 bp, Homo sapiens
ctcttaccccgtccctttccct

SEQ ID NO: 4268539 - DNA, 16 bp, Homo sapiens
ctcttacgctctctgt

SEQ ID NO: 4268540 - DNA, 20 bp, Homo sapiens
ctcttcaagtttttttcaaa

SEQ ID NO: 4268541 - DNA, 15 bp, Homo sapiens
ctcttcaccaggaag

SEQ ID NO: 4268542 - DNA, 17 bp, Homo sapiens
ctcttcaccaggaagaa

SEQ ID NO: 4268543 - DNA, 13 bp, Homo sapiens
ctcttcccaccaa

SEQ ID NO: 4268544 - DNA, 22 bp, Homo sapiens
ctcttcccaccaactctctctg

SEQ ID NO: 4268545 - DNA, 14 bp, Homo sapiens
ctcttcccccttcc

SEQ ID NO: 4268546 - DNA, 15 bp, Homo sapiens
ctcttcctccctccc

SEQ ID NO: 4268547 - DNA, 12 bp, Homo sapiens
ctcttctccact

SEQ ID NO: 4268548 - DNA, 19 bp, Homo sapiens
ctcttctccactggatgga

SEQ ID NO: 4268549 - DNA, 15 bp, Homo sapiens
ctcttctcctttcac

SEQ ID NO: 4268550 - DNA, 21 bp, Homo sapiens
ctcttgcataagcctcaggcc

SEQ ID NO: 4268551 - DNA, 22 bp, Homo sapiens
ctcttgccccccaccccagcct

SEQ ID NO: 4268552 - DNA, 13 bp, Homo sapiens
ctgaaaactggaa

SEQ ID NO: 4268553 - DNA, 14 bp, Homo sapiens
ctgaaaactgttta

SEQ ID NO: 4268554 - DNA, 20 bp, Homo sapiens
ctgaaaatatttttttctag

SEQ ID NO: 4268555 - DNA, 18 bp, Homo sapiens
ctgaaaccagaagactgg

SEQ ID NO: 4268556 - DNA, 14 bp, Homo sapiens
ctgaaatgtttcca

SEQ ID NO: 4268557 - DNA, 16 bp, Homo sapiens
ctgaactgcaacactg

SEQ ID NO: 4268558 - DNA, 15 bp, Homo sapiens
ctgaactgctgctgg

SEQ ID NO: 4268559 - DNA, 16 bp, Homo sapiens
ctgaactgctgctggt

SEQ ID NO: 4268560 - DNA, 13 bp, Homo sapiens
ctgaactggccgc

SEQ ID NO: 4268561 - DNA, 22 bp, Homo sapiens
ctgaagagcgctcctctgcctt

SEQ ID NO: 4268562 - DNA, 13 bp, Homo sapiens
ctgaaggagagga

SEQ ID NO: 4268563 - DNA, 14 bp, Homo sapiens
ctgaaggattttaa

SEQ ID NO: 4268564 - DNA, 18 bp, Homo sapiens
ctgaagtgaccccagctc

SEQ ID NO: 4268565 - DNA, 22 bp, Homo sapiens
ctgaagtgaccccagctccagg

SEQ ID NO: 4268566 - DNA, 15 bp, Homo sapiens
ctgaataatttctta

SEQ ID NO: 4268567 - DNA, 22 bp, Homo sapiens
ctgaatgtagccagcccacatc

SEQ ID NO: 4268568 - DNA, 17 bp, Homo sapiens
ctgacaaattttaatta

SEQ ID NO: 4268569 - DNA, 20 bp, Homo sapiens
ctgacaaccaccgctcccca

SEQ ID NO: 4268570 - DNA, 19 bp, Homo sapiens
ctgacatcagaggtatctt

SEQ ID NO: 4268571 - DNA, 18 bp, Homo sapiens
ctgaccacacttcctgtc

SEQ ID NO: 4268572 - DNA, 21 bp, Homo sapiens
ctgaccagaagtggcaggagg

SEQ ID NO: 4268573 - DNA, 23 bp, Homo sapiens
ctgaccagaagtggcaggaggac

SEQ ID NO: 4268574 - DNA, 14 bp, Homo sapiens
ctgaccatgcattt

SEQ ID NO: 4268575 - DNA, 22 bp, Homo sapiens
ctgaccttctgcggctccgggc

SEQ ID NO: 4268576 - DNA, 22 bp, Homo sapiens
ctgagaagcctcatgggagtca

SEQ ID NO: 4268577 - DNA, 21 bp, Homo sapiens
ctgagaatgcctaggccagct

SEQ ID NO: 4268578 - DNA, 22 bp, Homo sapiens
ctgagaatgcctaggccagctc

SEQ ID NO: 4268579 - DNA, 20 bp, Homo sapiens
ctgagcacccagctctgtct

SEQ ID NO: 4268580 - DNA, 17 bp, Homo sapiens
ctgagcagttgttatat

SEQ ID NO: 4268581 - DNA, 12 bp, Homo sapiens
ctgagccctgcc

SEQ ID NO: 4268582 - DNA, 14 bp, Homo sapiens
ctgagccctgccct

SEQ ID NO: 4268583 - DNA, 20 bp, Homo sapiens
ctgagccttagtttcagctg

SEQ ID NO: 4268584 - DNA, 14 bp, Homo sapiens
ctgagcggccgcct

SEQ ID NO: 4268585 - DNA, 16 bp, Homo sapiens
ctgagctcctctgggc

SEQ ID NO: 4268586 - DNA, 19 bp, Homo sapiens
ctgagctgtgccagctgct

SEQ ID NO: 4268587 - DNA, 21 bp, Homo sapiens
ctgagctgtgccagctgcttc

SEQ ID NO: 4268588 - DNA, 20 bp, Homo sapiens
ctggttccttaagtggctgt

SEQ ID NO: 4268589 - DNA, 15 bp, Homo sapiens
ctggttggtgttctt

SEQ ID NO: 4268590 - DNA, 20 bp, Homo sapiens
ctggttttcattattttccc

SEQ ID NO: 4268591 - DNA, 16 bp, Homo sapiens
ctgtaaatttaactgc

SEQ ID NO: 4268592 - DNA, 17 bp, Homo sapiens
ctgtaaatttaactgca

SEQ ID NO: 4268593 - DNA, 21 bp, Homo sapiens
ctgtaaatttaatagataaag

SEQ ID NO: 4268594 - DNA, 12 bp, Homo sapiens
ctgtaactgtcc

SEQ ID NO: 4268595 - DNA, 17 bp, Homo sapiens
ctgtaactgttacagta

SEQ ID NO: 4268596 - DNA, 19 bp, Homo sapiens
ctgtaagattttattttca

SEQ ID NO: 4268597 - DNA, 18 bp, Homo sapiens
ctgtaatagcctcacctt

SEQ ID NO: 4268598 - DNA, 22 bp, Homo sapiens
ctgtaatatttacaatgtatta

SEQ ID NO: 4268599 - DNA, 20 bp, Homo sapiens
ctgtaatcacactctcttct

SEQ ID NO: 4268600 - DNA, 17 bp, Homo sapiens
ctgtaatcttgttgata

SEQ ID NO: 4268601 - DNA, 15 bp, Homo sapiens
ctgtacaaagggaag

SEQ ID NO: 4268602 - DNA, 14 bp, Homo sapiens
ctgtacaagtgctc

SEQ ID NO: 4268603 - DNA, 19 bp, Homo sapiens
ctgtactcctcccaggcgc

SEQ ID NO: 4268604 - DNA, 22 bp, Homo sapiens
ctgtagaaaggttgattctcat

SEQ ID NO: 4268605 - DNA, 17 bp, Homo sapiens
ctgtagtaattgttaca

SEQ ID NO: 4268606 - DNA, 12 bp, Homo sapiens
ctgtatatttgt

SEQ ID NO: 4268607 - DNA, 21 bp, Homo sapiens
ctgtatatttgtatgatattt

SEQ ID NO: 4268608 - DNA, 21 bp, Homo sapiens
ctgtatctaaaaaataactgt

SEQ ID NO: 4268609 - DNA, 12 bp, Homo sapiens
ctgtattttctt

SEQ ID NO: 4268610 - DNA, 20 bp, Homo sapiens
ctgtattttcttttatatct

SEQ ID NO: 4268611 - DNA, 21 bp, Homo sapiens
ctgtattttcttttatatctg

SEQ ID NO: 4268612 - DNA, 20 bp, Homo sapiens
ctgtcactaaatggcagtga

SEQ ID NO: 4268613 - DNA, 18 bp, Homo sapiens
ctgtcagagaatatgacc

SEQ ID NO: 4268614 - DNA, 15 bp, Homo sapiens
ctgtcagtgcagccc

SEQ ID NO: 4268615 - DNA, 18 bp, Homo sapiens
ctgtcagtgcagcccgtg

SEQ ID NO: 4268616 - DNA, 19 bp, Homo sapiens
ctgtcagtgcagcccgtgt

SEQ ID NO: 4268617 - DNA, 15 bp, Homo sapiens
ctgtccacctgtgct

SEQ ID NO: 4268618 - DNA, 20 bp, Homo sapiens
ctgtccacctgtgctgctgc

SEQ ID NO: 4268619 - DNA, 21 bp, Homo sapiens
ctgtccacctgtgctgctgca

SEQ ID NO: 4268620 - DNA, 12 bp, Homo sapiens
ctgtccatctgt

SEQ ID NO: 4268621 - DNA, 19 bp, Homo sapiens
ctgtccatctgtctgtcct

SEQ ID NO: 4268622 - DNA, 20 bp, Homo sapiens
ctgtccatctgtctgtccta

SEQ ID NO: 4268623 - DNA, 17 bp, Homo sapiens
ctgtcccacaaaatatt

SEQ ID NO: 4268624 - DNA, 17 bp, Homo sapiens
ctgtcccggagctcagg

SEQ ID NO: 4268625 - DNA, 15 bp, Homo sapiens
ctgtccctctcaggc

SEQ ID NO: 4268626 - DNA, 16 bp, Homo sapiens
ctgtccctctcaggca

SEQ ID NO: 4268627 - DNA, 21 bp, Homo sapiens
ctgtccctgccccgcccccca

SEQ ID NO: 4268628 - DNA, 13 bp, Homo sapiens
ctgtccctgtccc

SEQ ID NO: 4268629 - DNA, 17 bp, Homo sapiens
ctgtccctgtccctgcc

SEQ ID NO: 4268630 - DNA, 18 bp, Homo sapiens
ctgtccctgtccctgccc

SEQ ID NO: 4268631 - DNA, 14 bp, Homo sapiens
ctgtcctacccgcc

SEQ ID NO: 4268632 - DNA, 22 bp, Homo sapiens
ctgtcctacccgcccgcgtcca

SEQ ID NO: 4268633 - DNA, 14 bp, Homo sapiens
ctgtcctggctccc

SEQ ID NO: 4268634 - DNA, 17 bp, Homo sapiens
ctgtcctggctcccagg

SEQ ID NO: 4268635 - DNA, 16 bp, Homo sapiens
ctgtccttcccacggc

SEQ ID NO: 4268636 - DNA, 17 bp, Homo sapiens
ctgtccttcccacggcc

SEQ ID NO: 4268637 - DNA, 18 bp, Homo sapiens
ctgtctcaagagggcact

SEQ ID NO: 4268638 - DNA, 20 bp, Homo sapiens
ctgtctcaagagggcactgg

SEQ ID NO: 4268639 - DNA, 12 bp, Homo sapiens
ctgtctccagac

SEQ ID NO: 4268640 - DNA, 13 bp, Homo sapiens
ctgtctccagacc

SEQ ID NO: 4268641 - DNA, 18 bp, Homo sapiens
ctgtctccagacccccac

SEQ ID NO: 4268642 - DNA, 22 bp, Homo sapiens
ctgtctccagacccccacccct

SEQ ID NO: 4268643 - DNA, 21 bp, Homo sapiens
ctgtctcttgcataagcctca

SEQ ID NO: 4268644 - DNA, 18 bp, Homo sapiens
ctgtctgaaaccagaaga

SEQ ID NO: 4268645 - DNA, 13 bp, Homo sapiens
ctgtctgagccct

SEQ ID NO: 4268646 - DNA, 22 bp, Homo sapiens
ctgtctgagccctgccctcact

SEQ ID NO: 4268647 - DNA, 13 bp, Homo sapiens
ctgtctgattcta

SEQ ID NO: 4268648 - DNA, 16 bp, Homo sapiens
ctgtctgattctatgc

SEQ ID NO: 4268649 - DNA, 17 bp, Homo sapiens
ctgtctgcgccgctgtg

SEQ ID NO: 4268650 - DNA, 16 bp, Homo sapiens
ctgtctggctgtacgt

SEQ ID NO: 4268651 - DNA, 18 bp, Homo sapiens
ctgtctgtaagagaattc

SEQ ID NO: 4268652 - DNA, 22 bp, Homo sapiens
ctgtcttagtcataccatccat

SEQ ID NO: 4268653 - DNA, 14 bp, Homo sapiens
ctgtgaaatatcat

SEQ ID NO: 4268654 - DNA, 22 bp, Homo sapiens
ctgtgaacttgatgttcctggg

SEQ ID NO: 4268655 - DNA, 14 bp, Homo sapiens
ctgtgaacttgggg

SEQ ID NO: 4268656 - DNA, 16 bp, Homo sapiens
ctgtgaacttggggaa

SEQ ID NO: 4268657 - DNA, 18 bp, Homo sapiens
ctgtgaataaagccacat

SEQ ID NO: 4268658 - DNA, 19 bp, Homo sapiens
ctgtgaataaagccacata

SEQ ID NO: 4268659 - DNA, 17 bp, Homo sapiens
ctgtgacacagctgagc

SEQ ID NO: 4268660 - DNA, 21 bp, Homo sapiens
ctgtgaccggggtcctgaggc

SEQ ID NO: 4268661 - DNA, 17 bp, Homo sapiens
ctgtgacctctcccctg

SEQ ID NO: 4268662 - DNA, 17 bp, Homo sapiens
ctgtgactcgcttagct

SEQ ID NO: 4268663 - DNA, 14 bp, Homo sapiens
ctgtgagctcccca

SEQ ID NO: 4268664 - DNA, 22 bp, Homo sapiens
ctgtgagctccccaatccaacc

SEQ ID NO: 4268665 - DNA, 12 bp, Homo sapiens
ctgtgattaatt

SEQ ID NO: 4268666 - DNA, 13 bp, Homo sapiens
ctgtgcacagccc

SEQ ID NO: 4268667 - DNA, 14 bp, Homo sapiens
ctgtgcacccgtgc

SEQ ID NO: 4268668 - DNA, 20 bp, Homo sapiens
ctgtgcagccggggagctga

SEQ ID NO: 4268669 - DNA, 13 bp, Homo sapiens
ctgtgccagctgc

SEQ ID NO: 4268670 - DNA, 19 bp, Homo sapiens
ctgtgcccgctgcgctgcc

SEQ ID NO: 4268671 - DNA, 21 bp, Homo sapiens
ctgtgcccgctgcgctgccct

SEQ ID NO: 4268672 - DNA, 22 bp, Homo sapiens
ctgtgcccgctgcgctgccctg

SEQ ID NO: 4268673 - DNA, 23 bp, Homo sapiens
ctgtgcccgctgcgctgccctgc

SEQ ID NO: 4268674 - DNA, 14 bp, Homo sapiens
ctgtgcgttttaga

SEQ ID NO: 4268675 - DNA, 18 bp, Homo sapiens
ctgtgctggtctctaggc

SEQ ID NO: 4268676 - DNA, 20 bp, Homo sapiens
ctgtgctggtctctaggcct

SEQ ID NO: 4268677 - DNA, 13 bp, Homo sapiens
ctgtgctgttgtc

SEQ ID NO: 4268678 - DNA, 17 bp, Homo sapiens
ctgtgctgttgtctgcc

SEQ ID NO: 4268679 - DNA, 16 bp, Homo sapiens
ctgtggaagggactag

SEQ ID NO: 4268680 - DNA, 15 bp, Homo sapiens
ctgtggagcccgcac

SEQ ID NO: 4268681 - DNA, 12 bp, Homo sapiens
ctgtggattcta

SEQ ID NO: 4268682 - DNA, 14 bp, Homo sapiens
ctgtggattctata

SEQ ID NO: 4268683 - DNA, 15 bp, Homo sapiens
ctgtggattctatat

SEQ ID NO: 4268684 - DNA, 16 bp, Homo sapiens
ctgtggcccctccttc

SEQ ID NO: 4268685 - DNA, 22 bp, Homo sapiens
ctgtggcccctccttctcccct

SEQ ID NO: 4268686 - DNA, 13 bp, Homo sapiens
ctgtggccctctc

SEQ ID NO: 4268687 - DNA, 17 bp, Homo sapiens
ctgtggcctcagcatct

SEQ ID NO: 4268688 - DNA, 19 bp, Homo sapiens
ctgtggcctcaggaggcag

SEQ ID NO: 4268689 - DNA, 15 bp, Homo sapiens
ctgtggccttggtct

SEQ ID NO: 4268690 - DNA, 14 bp, Homo sapiens
ctgtggcggtgcag

SEQ ID NO: 4268691 - DNA, 17 bp, Homo sapiens
ctgtggcggtgcagtgg

SEQ ID NO: 4268692 - DNA, 20 bp, Homo sapiens
ctgtggcttcccatgtcttt

SEQ ID NO: 4268693 - DNA, 19 bp, Homo sapiens
ctgtgggactggcccaccc

SEQ ID NO: 4268694 - DNA, 15 bp, Homo sapiens
ctgtgggcagctggc

SEQ ID NO: 4268695 - DNA, 17 bp, Homo sapiens
ctgtggggagctggtgg

SEQ ID NO: 4268696 - DNA, 21 bp, Homo sapiens
ctgtggggatttctcccagct

SEQ ID NO: 4268697 - DNA, 23 bp, Homo sapiens
ctgtgtagtagctcgtgtgctta

SEQ ID NO: 4268698 - DNA, 16 bp, Homo sapiens
ctgtgtccctctctct

SEQ ID NO: 4268699 - DNA, 13 bp, Homo sapiens
ctgtgtctgctgt

SEQ ID NO: 4268700 - DNA, 19 bp, Homo sapiens
ctgtgtgacatcagtggca

SEQ ID NO: 4268701 - DNA, 13 bp, Homo sapiens
ctgtgtggggagg

SEQ ID NO: 4268702 - DNA, 18 bp, Homo sapiens
ctgtgtgtgagtgtgaat

SEQ ID NO: 4268703 - DNA, 15 bp, Homo sapiens
ctgtgttagtgtctg

SEQ ID NO: 4268704 - DNA, 16 bp, Homo sapiens
ctgtgttagtgtctgt

SEQ ID NO: 4268705 - DNA, 23 bp, Homo sapiens
ctgtgttgtgattccccggagct

SEQ ID NO: 4268706 - DNA, 14 bp, Homo sapiens
ctgtgttgttcata

SEQ ID NO: 4268707 - DNA, 14 bp, Homo sapiens
ctgttacagtaatg

SEQ ID NO: 4268708 - DNA, 15 bp, Homo sapiens
ctgttacagtaatgt

SEQ ID NO: 4268709 - DNA, 15 bp, Homo sapiens
ctgttcactctactt

SEQ ID NO: 4268710 - DNA, 14 bp, Homo sapiens
ctgttcatttccac

SEQ ID NO: 4268711 - DNA, 14 bp, Homo sapiens
ctgttcatttcctc

SEQ ID NO: 4268712 - DNA, 14 bp, Homo sapiens
ctgttccctgctgg

SEQ ID NO: 4268713 - DNA, 17 bp, Homo sapiens
ctgttctcagagctcca

SEQ ID NO: 4268714 - DNA, 21 bp, Homo sapiens
ctgttctcagagctccacaga

SEQ ID NO: 4268715 - DNA, 12 bp, Homo sapiens
ctgttctctgct

SEQ ID NO: 4268716 - DNA, 15 bp, Homo sapiens
ctgttctctgctttt

SEQ ID NO: 4268717 - DNA, 19 bp, Homo sapiens
ctgttctgtgtctgctgta

SEQ ID NO: 4268718 - DNA, 17 bp, Homo sapiens
ctgttctgttttgcctg

SEQ ID NO: 4268719 - DNA, 21 bp, Homo sapiens
gaagctcagcccacccccctc

SEQ ID NO: 4268720 - DNA, 18 bp, Homo sapiens
gaagctgttctctgcttt

SEQ ID NO: 4268721 - DNA, 14 bp, Homo sapiens
gaaggaatggtgct

SEQ ID NO: 4268722 - DNA, 15 bp, Homo sapiens
gaaggaattgacttc

SEQ ID NO: 4268723 - DNA, 23 bp, Homo sapiens
gaaggacccggaggggcctggca

SEQ ID NO: 4268724 - DNA, 16 bp, Homo sapiens
gaaggagaggagtgcg

SEQ ID NO: 4268725 - DNA, 13 bp, Homo sapiens
gaaggagaggctc

SEQ ID NO: 4268726 - DNA, 16 bp, Homo sapiens
gaaggagccagctccc

SEQ ID NO: 4268727 - DNA, 12 bp, Homo sapiens
gaaggaggaagg

SEQ ID NO: 4268728 - DNA, 19 bp, Homo sapiens
gaaggaggaagggactggt

SEQ ID NO: 4268729 - DNA, 12 bp, Homo sapiens
gaaggattttaa

SEQ ID NO: 4268730 - DNA, 18 bp, Homo sapiens
gaaggcccgggaggagga

SEQ ID NO: 4268731 - DNA, 16 bp, Homo sapiens
gaaggcctgcccccct

SEQ ID NO: 4268732 - DNA, 19 bp, Homo sapiens
gaaggcctgccccccttcc

SEQ ID NO: 4268733 - DNA, 17 bp, Homo sapiens
gaaggctttcagggcct

SEQ ID NO: 4268734 - DNA, 21 bp, Homo sapiens
gaagggaccgggagcctgcgt

SEQ ID NO: 4268735 - DNA, 21 bp, Homo sapiens
gaagggactaggagcactgta

SEQ ID NO: 4268736 - DNA, 18 bp, Homo sapiens
gaagggactggtccaggc

SEQ ID NO: 4268737 - DNA, 16 bp, Homo sapiens
gaagggaggcctgagg

SEQ ID NO: 4268738 - DNA, 14 bp, Homo sapiens
gaagggggcaggcc

SEQ ID NO: 4268739 - DNA, 22 bp, Homo sapiens
gaagggggcaggcccctttgga

SEQ ID NO: 4268740 - DNA, 20 bp, Homo sapiens
gaagggggccatgaggcctc

SEQ ID NO: 4268741 - DNA, 16 bp, Homo sapiens
gaagggttagacaagc

SEQ ID NO: 4268742 - DNA, 19 bp, Homo sapiens
gaagggttagacaagcctg

SEQ ID NO: 4268743 - DNA, 16 bp, Homo sapiens
gaaggtctcatgcctg

SEQ ID NO: 4268744 - DNA, 18 bp, Homo sapiens
gaaggtctcatgcctgag

SEQ ID NO: 4268745 - DNA, 19 bp, Homo sapiens
gaaggtctcatgcctgaga

SEQ ID NO: 4268746 - DNA, 15 bp, Homo sapiens
gaaggtggtctgcac

SEQ ID NO: 4268747 - DNA, 16 bp, Homo sapiens
gaagtatctgtacctg

SEQ ID NO: 4268748 - DNA, 15 bp, Homo sapiens
gaagtcactgcacag

SEQ ID NO: 4268749 - DNA, 19 bp, Homo sapiens
gaagtcaggagccagcagg

SEQ ID NO: 4268750 - DNA, 20 bp, Homo sapiens
gaagtcaggagccagcaggg

SEQ ID NO: 4268751 - DNA, 15 bp, Homo sapiens
gaagtcatcataaaa

SEQ ID NO: 4268752 - DNA, 20 bp, Homo sapiens
gaagtccagtgaccctggag

SEQ ID NO: 4268753 - DNA, 18 bp, Homo sapiens
gaagtcttccatcagcag

SEQ ID NO: 4268754 - DNA, 24 bp, Homo sapiens
gaagtgacaaggccccagagactc

SEQ ID NO: 4268755 - DNA, 21 bp, Homo sapiens
gaagtgataacactggagtgg

SEQ ID NO: 4268756 - DNA, 14 bp, Homo sapiens
gaagtggcctgaga

SEQ ID NO: 4268757 - DNA, 23 bp, Homo sapiens
gaagtgggagtgggagaggaagc

SEQ ID NO: 4268758 - DNA, 13 bp, Homo sapiens
gaagtgtgctgag

SEQ ID NO: 4268759 - DNA, 15 bp, Homo sapiens
gaagtgtgctgaggt

SEQ ID NO: 4268760 - DNA, 18 bp, Homo sapiens
gaagtgtgctgaggtggg

SEQ ID NO: 4268761 - DNA, 18 bp, Homo sapiens
gaagttaacagtctcatt

SEQ ID NO: 4268762 - DNA, 22 bp, Homo sapiens
gaagttggagtgagtgtggctc

SEQ ID NO: 4268763 - DNA, 15 bp, Homo sapiens
gaagttgttagtgat

SEQ ID NO: 4268764 - DNA, 14 bp, Homo sapiens
gaataaagacacct

SEQ ID NO: 4268765 - DNA, 17 bp, Homo sapiens
gaataatgcctttgtaa

SEQ ID NO: 4268766 - DNA, 17 bp, Homo sapiens
gaataatggaattatgt

SEQ ID NO: 4268767 - DNA, 15 bp, Homo sapiens
gaatagatgctgact

SEQ ID NO: 4268768 - DNA, 17 bp, Homo sapiens
gaatagtacatgcagaa

SEQ ID NO: 4268769 - DNA, 13 bp, Homo sapiens
gaatataaatgtg

SEQ ID NO: 4268770 - DNA, 14 bp, Homo sapiens
gaatatacatagtc

SEQ ID NO: 4268771 - DNA, 18 bp, Homo sapiens
gaatataccacaccgagg

SEQ ID NO: 4268772 - DNA, 20 bp, Homo sapiens
gaatatactcattagaatta

SEQ ID NO: 4268773 - DNA, 12 bp, Homo sapiens
gaatattgagca

SEQ ID NO: 4268774 - DNA, 20 bp, Homo sapiens
gaatattgagcaatatgtca

SEQ ID NO: 4268775 - DNA, 23 bp, Homo sapiens
gaatattgtattgttagatgttt

SEQ ID NO: 4268776 - DNA, 14 bp, Homo sapiens
gaatattgttaaaa

SEQ ID NO: 4268777 - DNA, 15 bp, Homo sapiens
gaatcaaaaattgaa

SEQ ID NO: 4268778 - DNA, 17 bp, Homo sapiens
gaatcaaatctgagcct

SEQ ID NO: 4268779 - DNA, 23 bp, Homo sapiens
gaatcacctaattaatttcagta

SEQ ID NO: 4268780 - DNA, 20 bp, Homo sapiens
gaatcagtcctagaatgttt

SEQ ID NO: 4268781 - DNA, 18 bp, Homo sapiens
gaatcccctcgcttcata

SEQ ID NO: 4268782 - DNA, 20 bp, Homo sapiens
gaatccctttcagtttgtcc

SEQ ID NO: 4268783 - DNA, 19 bp, Homo sapiens
gaatcctgccacacatgct

SEQ ID NO: 4268784 - DNA, 14 bp, Homo sapiens
gaatcgaggaacca

SEQ ID NO: 4268785 - DNA, 14 bp, Homo sapiens
gaatctacttaacc

SEQ ID NO: 4268786 - DNA, 18 bp, Homo sapiens
gaatgcctaggccagctc

SEQ ID NO: 4268787 - DNA, 20 bp, Homo sapiens
gaatgcgctcttcaccagga

SEQ ID NO: 4268788 - DNA, 23 bp, Homo sapiens
gaatgcgctcttcaccaggaaga

SEQ ID NO: 4268789 - DNA, 13 bp, Homo sapiens
gaatgctccccca

SEQ ID NO: 4268790 - DNA, 21 bp, Homo sapiens
gaatgctcccccatcctcccc

SEQ ID NO: 4268791 - DNA, 23 bp, Homo sapiens
gaatgctcccccatcctcccctt

SEQ ID NO: 4268792 - DNA, 22 bp, Homo sapiens
gaatggaagcctccacctgcag

SEQ ID NO: 4268793 - DNA, 19 bp, Homo sapiens
gaatgggccaagccagggt

SEQ ID NO: 4268794 - DNA, 18 bp, Homo sapiens
gaatggtgggctccagag

SEQ ID NO: 4268795 - DNA, 19 bp, Homo sapiens
gaatggtgggctccagagt

SEQ ID NO: 4268796 - DNA, 17 bp, Homo sapiens
gaatgtatatcagggtt

SEQ ID NO: 4268797 - DNA, 11 bp, Homo sapiens
gaatgtatgta

SEQ ID NO: 4268798 - DNA, 21 bp, Homo sapiens
gaatgtccccattctataaat

SEQ ID NO: 4268799 - DNA, 22 bp, Homo sapiens
gaatgttactttggaatgacta

SEQ ID NO: 4268800 - DNA, 15 bp, Homo sapiens
gaatgtttgaattac

SEQ ID NO: 4268801 - DNA, 15 bp, Homo sapiens
gaattaaaataaaac

SEQ ID NO: 4268802 - DNA, 18 bp, Homo sapiens
gaattcataaaaataacc

SEQ ID NO: 4268803 - DNA, 20 bp, Homo sapiens
gaattccctgaagcaacact

SEQ ID NO: 4268804 - DNA, 18 bp, Homo sapiens
gaattgacttcgactgtg

SEQ ID NO: 4268805 - DNA, 16 bp, Homo sapiens
gaattggcagaagcag

SEQ ID NO: 4268806 - DNA, 22 bp, Homo sapiens
gaattgtttttagaaatttatt

SEQ ID NO: 4268807 - DNA, 15 bp, Homo sapiens
gacaaaactagagac

SEQ ID NO: 4268808 - DNA, 16 bp, Homo sapiens
gacaaattcattccct

SEQ ID NO: 4268809 - DNA, 14 bp, Homo sapiens
gacaaattttaatt

SEQ ID NO: 4268810 - DNA, 19 bp, Homo sapiens
gacaaccaccgctccccag

SEQ ID NO: 4268811 - DNA, 20 bp, Homo sapiens
gacaaccctgcaaaggactg

SEQ ID NO: 4268812 - DNA, 19 bp, Homo sapiens
gacaaccgatgctccagcc

SEQ ID NO: 4268813 - DNA, 21 bp, Homo sapiens
gacaaccgatgctccagccaa

SEQ ID NO: 4268814 - DNA, 14 bp, Homo sapiens
gacaagcccaggac

SEQ ID NO: 4268815 - DNA, 15 bp, Homo sapiens
gacaagccccaggca

SEQ ID NO: 4268816 - DNA, 12 bp, Homo sapiens
gacaagcctgga

SEQ ID NO: 4268817 - DNA, 13 bp, Homo sapiens
gacaagcctggag

SEQ ID NO: 4268818 - DNA, 14 bp, Homo sapiens
gacaagcctggagg

SEQ ID NO: 4268819 - DNA, 18 bp, Homo sapiens
gacaagcctggaggacaa

SEQ ID NO: 4268820 - DNA, 19 bp, Homo sapiens
gacaaggtgtttctctgta

SEQ ID NO: 4268821 - DNA, 22 bp, Homo sapiens
gacaattagataaatgtccatt

SEQ ID NO: 4268822 - DNA, 21 bp, Homo sapiens
gacacagaggacggcttcccc

SEQ ID NO: 4268823 - DNA, 19 bp, Homo sapiens
gacacagctgagctggcct

SEQ ID NO: 4268824 - DNA, 13 bp, Homo sapiens
gacacagtcaggg

SEQ ID NO: 4268825 - DNA, 17 bp, Homo sapiens
gacacctactgagtggc

SEQ ID NO: 4268826 - DNA, 21 bp, Homo sapiens
gacacgccttcccctcagcca

SEQ ID NO: 4268827 - DNA, 14 bp, Homo sapiens
gacactacaaacat

SEQ ID NO: 4268828 - DNA, 18 bp, Homo sapiens
gacactgcctttgctgcc

SEQ ID NO: 4268829 - DNA, 20 bp, Homo sapiens
gacactgcctttgctgcctt

SEQ ID NO: 4268830 - DNA, 22 bp, Homo sapiens
gacactgcctttgctgccttct

SEQ ID NO: 4268831 - DNA, 14 bp, Homo sapiens
gacactgtctgctg

SEQ ID NO: 4268832 - DNA, 17 bp, Homo sapiens
gacacttttcatatcat

SEQ ID NO: 4268833 - DNA, 17 bp, Homo sapiens
gacagagtggatctgga

SEQ ID NO: 4268834 - DNA, 19 bp, Homo sapiens
gacagcaacggggaggcca

SEQ ID NO: 4268835 - DNA, 16 bp, Homo sapiens
gacagccaaaagtaag

SEQ ID NO: 4268836 - DNA, 12 bp, Homo sapiens
gacagcctggca

SEQ ID NO: 4268837 - DNA, 19 bp, Homo sapiens
gacagcgggtaaaaagaga

SEQ ID NO: 4268838 - DNA, 21 bp, Homo sapiens
gacagcgggtaaaaagagaag

SEQ ID NO: 4268839 - DNA, 18 bp, Homo sapiens
gacaggaacacccagccc

SEQ ID NO: 4268840 - DNA, 21 bp, Homo sapiens
gacaggaacacccagccccag

SEQ ID NO: 4268841 - DNA, 14 bp, Homo sapiens
gacaggcagaatca

SEQ ID NO: 4268842 - DNA, 14 bp, Homo sapiens
gacagggcatggcc

SEQ ID NO: 4268843 - DNA, 15 bp, Homo sapiens
gacagggcatggcca

SEQ ID NO: 4268844 - DNA, 22 bp, Homo sapiens
gacagggcatggccaggtggcc

SEQ ID NO: 4268845 - DNA, 20 bp, Homo sapiens
gacaggtggaggcgagccag

SEQ ID NO: 4268846 - DNA, 19 bp, Homo sapiens
gacagtcaggaagcctcct

SEQ ID NO: 4268847 - DNA, 15 bp, Homo sapiens
gacagtggctctcca

SEQ ID NO: 4268848 - DNA, 15 bp, Homo sapiens
gacatcggttcagga

SEQ ID NO: 4268849 - DNA, 13 bp, Homo sapiens
gataattatatca

SEQ ID NO: 4268850 - DNA, 19 bp, Homo sapiens
gatacaccgggcctggaga

SEQ ID NO: 4268851 - DNA, 22 bp, Homo sapiens
gatacactgtatctaaaaaata

SEQ ID NO: 4268852 - DNA, 21 bp, Homo sapiens
gatacagtattatagatataa

SEQ ID NO: 4268853 - DNA, 16 bp, Homo sapiens
gatataactttagaaa

SEQ ID NO: 4268854 - DNA, 20 bp, Homo sapiens
gatatctgtttgcttctaaa

SEQ ID NO: 4268855 - DNA, 17 bp, Homo sapiens
gatattcaatcttaaca

SEQ ID NO: 4268856 - DNA, 20 bp, Homo sapiens
gatattttgtaaaatgtatt

SEQ ID NO: 4268857 - DNA, 13 bp, Homo sapiens
gatcaagtattac

SEQ ID NO: 4268858 - DNA, 16 bp, Homo sapiens
gatcacaacttttctg

SEQ ID NO: 4268859 - DNA, 14 bp, Homo sapiens
gatcagtaaaatta

SEQ ID NO: 4268860 - DNA, 12 bp, Homo sapiens
gatcattatttc

SEQ ID NO: 4268861 - DNA, 17 bp, Homo sapiens
gatcattatttcatgac

SEQ ID NO: 4268862 - DNA, 15 bp, Homo sapiens
gatccagagagaagc

SEQ ID NO: 4268863 - DNA, 16 bp, Homo sapiens
gatccagagagaagca

SEQ ID NO: 4268864 - DNA, 18 bp, Homo sapiens
gatccagatagcctaggg

SEQ ID NO: 4268865 - DNA, 19 bp, Homo sapiens
gatccattaatttaaatga

SEQ ID NO: 4268866 - DNA, 21 bp, Homo sapiens
gatccccgacagtggctctcc

SEQ ID NO: 4268867 - DNA, 15 bp, Homo sapiens
gatccctagctgtga

SEQ ID NO: 4268868 - DNA, 14 bp, Homo sapiens
gatccgccctgggc

SEQ ID NO: 4268869 - DNA, 22 bp, Homo sapiens
gatcctcaaaaatcatcaaagt

SEQ ID NO: 4268870 - DNA, 17 bp, Homo sapiens
gatcctccttccaggcc

SEQ ID NO: 4268871 - DNA, 22 bp, Homo sapiens
gatcggaggcttgtcagagctg

SEQ ID NO: 4268872 - DNA, 16 bp, Homo sapiens
gatctagccaggcctc

SEQ ID NO: 4268873 - DNA, 20 bp, Homo sapiens
gatctcagataaagtgacca

SEQ ID NO: 4268874 - DNA, 11 bp, Homo sapiens
gatctccaggc

SEQ ID NO: 4268875 - DNA, 13 bp, Homo sapiens
gatctcctgtaat

SEQ ID NO: 4268876 - DNA, 13 bp, Homo sapiens
gatctggagtctg

SEQ ID NO: 4268877 - DNA, 21 bp, Homo sapiens
gatctgtgcagcgaggtccac

SEQ ID NO: 4268878 - DNA, 15 bp, Homo sapiens
gatcttccttccgct

SEQ ID NO: 4268879 - DNA, 15 bp, Homo sapiens
gatgacagggagctg

SEQ ID NO: 4268880 - DNA, 14 bp, Homo sapiens
gatgatttccaagc

SEQ ID NO: 4268881 - DNA, 13 bp, Homo sapiens
gatgctccagcca

SEQ ID NO: 4268882 - DNA, 16 bp, Homo sapiens
gatgctccagccaacc

SEQ ID NO: 4268883 - DNA, 18 bp, Homo sapiens
gatgctggtcatcctggg

SEQ ID NO: 4268884 - DNA, 24 bp, Homo sapiens
gatgcttgcctagggcctggtcca

SEQ ID NO: 4268885 - DNA, 21 bp, Homo sapiens
gatggcgcacccggcagcccc

SEQ ID NO: 4268886 - DNA, 17 bp, Homo sapiens
gatggcgtgtcccctgc

SEQ ID NO: 4268887 - DNA, 20 bp, Homo sapiens
gatggcgtgtcccctgcctg

SEQ ID NO: 4268888 - DNA, 22 bp, Homo sapiens
gatgggacaattagataaatgt

SEQ ID NO: 4268889 - DNA, 19 bp, Homo sapiens
gatgggcacaggctgcccc

SEQ ID NO: 4268890 - DNA, 17 bp, Homo sapiens
gatgggcatggggtggg

SEQ ID NO: 4268891 - DNA, 17 bp, Homo sapiens
gatggggttgggctctg

SEQ ID NO: 4268892 - DNA, 14 bp, Homo sapiens
gatggtgccccctg

SEQ ID NO: 4268893 - DNA, 17 bp, Homo sapiens
gatggtgccccctgggg

SEQ ID NO: 4268894 - DNA, 12 bp, Homo sapiens
gatggtgctgca

SEQ ID NO: 4268895 - DNA, 17 bp, Homo sapiens
gatgtaagaagcccgat

SEQ ID NO: 4268896 - DNA, 22 bp, Homo sapiens
gatgtcaaccttgtgtgagtgt

SEQ ID NO: 4268897 - DNA, 17 bp, Homo sapiens
gatgtcaagctggccgt

SEQ ID NO: 4268898 - DNA, 17 bp, Homo sapiens
gatgtggagtggggcag

SEQ ID NO: 4268899 - DNA, 21 bp, Homo sapiens
gattaatttctgccatttcat

SEQ ID NO: 4268900 - DNA, 16 bp, Homo sapiens
gattaatttgtgtaga

SEQ ID NO: 4268901 - DNA, 14 bp, Homo sapiens
gattaggcctggag

SEQ ID NO: 4268902 - DNA, 20 bp, Homo sapiens
gattattgaatgttatatca

SEQ ID NO: 4268903 - DNA, 13 bp, Homo sapiens
gattatttacaag

SEQ ID NO: 4268904 - DNA, 15 bp, Homo sapiens
gattcaaatgcatga

SEQ ID NO: 4268905 - DNA, 19 bp, Homo sapiens
gattcagtttctaaaattg

SEQ ID NO: 4268906 - DNA, 14 bp, Homo sapiens
gattcataacaatg

SEQ ID NO: 4268907 - DNA, 13 bp, Homo sapiens
gattccaaataaa

SEQ ID NO: 4268908 - DNA, 16 bp, Homo sapiens
gattccaagggcccag

SEQ ID NO: 4268909 - DNA, 20 bp, Homo sapiens
gattccaagggcccagaggg

SEQ ID NO: 4268910 - DNA, 19 bp, Homo sapiens
gattccagagagtggctcc

SEQ ID NO: 4268911 - DNA, 15 bp, Homo sapiens
gattccccggagctg

SEQ ID NO: 4268912 - DNA, 18 bp, Homo sapiens
gattccccggagctggga

SEQ ID NO: 4268913 - DNA, 19 bp, Homo sapiens
gattcccgtggctttgtgc

SEQ ID NO: 4268914 - DNA, 22 bp, Homo sapiens
gattcccgtggctttgtgctta

SEQ ID NO: 4268915 - DNA, 14 bp, Homo sapiens
gattctaaaacatt

SEQ ID NO: 4268916 - DNA, 20 bp, Homo sapiens
gattctaaaacattctttaa

SEQ ID NO: 4268917 - DNA, 15 bp, Homo sapiens
gattctaaaggggac

SEQ ID NO: 4268918 - DNA, 14 bp, Homo sapiens
gattctatatttca

SEQ ID NO: 4268919 - DNA, 14 bp, Homo sapiens
gattcttccatctg

SEQ ID NO: 4268920 - DNA, 21 bp, Homo sapiens
gattcttttttcttccccctc

SEQ ID NO: 4268921 - DNA, 12 bp, Homo sapiens
gattgaaaagaa

SEQ ID NO: 4268922 - DNA, 19 bp, Homo sapiens
gattgaagtatctgtacct

SEQ ID NO: 4268923 - DNA, 14 bp, Homo sapiens
gattggacattttc

SEQ ID NO: 4268924 - DNA, 19 bp, Homo sapiens
gattggcagcttcaaaaca

SEQ ID NO: 4268925 - DNA, 11 bp, Homo sapiens
gattggcaggt

SEQ ID NO: 4268926 - DNA, 16 bp, Homo sapiens
gattggtaccagagcc

SEQ ID NO: 4268927 - DNA, 17 bp, Homo sapiens
gattggttcatgcctgg

SEQ ID NO: 4268928 - DNA, 14 bp, Homo sapiens
gattgttattaaat

SEQ ID NO: 4268929 - DNA, 15 bp, Homo sapiens
gatttcaagggactg

SEQ ID NO: 4268930 - DNA, 13 bp, Homo sapiens
gatttcagatgta

SEQ ID NO: 4268931 - DNA, 19 bp, Homo sapiens
gatttgaaacttggtgtgt

SEQ ID NO: 4268932 - DNA, 18 bp, Homo sapiens
gatttgagtccattgcaa

SEQ ID NO: 4268933 - DNA, 22 bp, Homo sapiens
gatttgagtccattgcaaaagg

SEQ ID NO: 4268934 - DNA, 12 bp, Homo sapiens
gatttgcaactt

SEQ ID NO: 4268935 - DNA, 16 bp, Homo sapiens
gatttgcaactttaga

SEQ ID NO: 4268936 - DNA, 15 bp, Homo sapiens
gatttgccaaaaact

SEQ ID NO: 4268937 - DNA, 13 bp, Homo sapiens
gatttgtatttat

SEQ ID NO: 4268938 - DNA, 17 bp, Homo sapiens
gatttgtatttatatta

SEQ ID NO: 4268939 - DNA, 13 bp, Homo sapiens
gattttaaatgct

SEQ ID NO: 4268940 - DNA, 22 bp, Homo sapiens
gattttagatttctttgattgt

SEQ ID NO: 4268941 - DNA, 17 bp, Homo sapiens
gattttatgtgcttgaa

SEQ ID NO: 4268942 - DNA, 20 bp, Homo sapiens
gattttatgtgcttgaagat

SEQ ID NO: 4268943 - DNA, 22 bp, Homo sapiens
gattttattttcaagcaaatat

SEQ ID NO: 4268944 - DNA, 15 bp, Homo sapiens
gattttcatgttctt

SEQ ID NO: 4268945 - DNA, 16 bp, Homo sapiens
gattttctttctatgt

SEQ ID NO: 4268946 - DNA, 14 bp, Homo sapiens
gatttttacacatg

SEQ ID NO: 4268947 - DNA, 14 bp, Homo sapiens
gatttttgttgatt

SEQ ID NO: 4268948 - DNA, 19 bp, Homo sapiens
gcaaaaggttaagccatat

SEQ ID NO: 4268949 - DNA, 21 bp, Homo sapiens
gcaaaatacatgatgatttca

SEQ ID NO: 4268950 - DNA, 21 bp, Homo sapiens
gcaaaccgcatgctcttaccc

SEQ ID NO: 4268951 - DNA, 20 bp, Homo sapiens
gcaaagtaccaactgagcca

SEQ ID NO: 4268952 - DNA, 13 bp, Homo sapiens
gcaaagtagtact

SEQ ID NO: 4268953 - DNA, 18 bp, Homo sapiens
gcaaatccataccccctg

SEQ ID NO: 4268954 - DNA, 12 bp, Homo sapiens
gcaacacacaga

SEQ ID NO: 4268955 - DNA, 16 bp, Homo sapiens
gcaacagctgtgtgtg

SEQ ID NO: 4268956 - DNA, 19 bp, Homo sapiens
gcaacaggaccaggagcca

SEQ ID NO: 4268957 - DNA, 16 bp, Homo sapiens
gcaacatttccgaaga

SEQ ID NO: 4268958 - DNA, 23 bp, Homo sapiens
gcaaccctcctatcacctcccct

SEQ ID NO: 4268959 - DNA, 19 bp, Homo sapiens
gcaacttgaaattatatct

SEQ ID NO: 4268960 - DNA, 19 bp, Homo sapiens
gcaactttagaaagaaatt

SEQ ID NO: 4268961 - DNA, 19 bp, Homo sapiens
gcaagaagattctaaaaca

SEQ ID NO: 4268962 - DNA, 21 bp, Homo sapiens
gcaagaagattctaaaacatt

SEQ ID NO: 4268963 - DNA, 14 bp, Homo sapiens
gcaagattctgtgg

SEQ ID NO: 4268964 - DNA, 13 bp, Homo sapiens
gcaagcacctggg

SEQ ID NO: 4268965 - DNA, 17 bp, Homo sapiens
gcaagcacctgggtgtg

SEQ ID NO: 4268966 - DNA, 15 bp, Homo sapiens
gcaagctggcaggag

SEQ ID NO: 4268967 - DNA, 16 bp, Homo sapiens
gcaaggccagccctgg

SEQ ID NO: 4268968 - DNA, 14 bp, Homo sapiens
gcaagtatatttat

SEQ ID NO: 4268969 - DNA, 19 bp, Homo sapiens
gcaatacattaaaataact

SEQ ID NO: 4268970 - DNA, 19 bp, Homo sapiens
gcaatatgaggggactgca

SEQ ID NO: 4268971 - DNA, 20 bp, Homo sapiens
gcaatatgaggggactgcat

SEQ ID NO: 4268972 - DNA, 22 bp, Homo sapiens
gcaatatgaggggactgcatgc

SEQ ID NO: 4268973 - DNA, 14 bp, Homo sapiens
gcaatcttatgttg

SEQ ID NO: 4268974 - DNA, 19 bp, Homo sapiens
gcaattaaagacatttaaa

SEQ ID NO: 4268975 - DNA, 11 bp, Homo sapiens
gcaattcaact

SEQ ID NO: 4268976 - DNA, 14 bp, Homo sapiens
gcacaagcagagtg

SEQ ID NO: 4268977 - DNA, 14 bp, Homo sapiens
gcacaattctgtcc

SEQ ID NO: 4268978 - DNA, 16 bp, Homo sapiens
gcacaattctgtccct

SEQ ID NO: 4268979 - DNA, 17 bp, Homo sapiens
gcacaattctgtccctg

SEQ ID NO: 4268980 - DNA, 19 bp, Homo sapiens
gccatgagctccagacccc

SEQ ID NO: 4268981 - DNA, 17 bp, Homo sapiens
gccatgatgtggagtgg

SEQ ID NO: 4268982 - DNA, 19 bp, Homo sapiens
gccatgattttggccactt

SEQ ID NO: 4268983 - DNA, 16 bp, Homo sapiens
gccatggaagctggca

SEQ ID NO: 4268984 - DNA, 21 bp, Homo sapiens
gccatggtgttggaggggcag

SEQ ID NO: 4268985 - DNA, 23 bp, Homo sapiens
gccatggtgttggaggggcaggc

SEQ ID NO: 4268986 - DNA, 14 bp, Homo sapiens
gccatttcatgtcc

SEQ ID NO: 4268987 - DNA, 20 bp, Homo sapiens
gccattttgtctggctgtgg

SEQ ID NO: 4268988 - DNA, 17 bp, Homo sapiens
gcccaaaccagggggaa

SEQ ID NO: 4268989 - DNA, 16 bp, Homo sapiens
gcccaaagccagacag

SEQ ID NO: 4268990 - DNA, 23 bp, Homo sapiens
gcccaaccggggagcccccgccc

SEQ ID NO: 4268991 - DNA, 15 bp, Homo sapiens
gcccacacctgcctc

SEQ ID NO: 4268992 - DNA, 16 bp, Homo sapiens
gcccacacgtgctctc

SEQ ID NO: 4268993 - DNA, 15 bp, Homo sapiens
gcccacatccattcc

SEQ ID NO: 4268994 - DNA, 17 bp, Homo sapiens
gcccacatccattccag

SEQ ID NO: 4268995 - DNA, 17 bp, Homo sapiens
gcccacattgcccacac

SEQ ID NO: 4268996 - DNA, 21 bp, Homo sapiens
gcccaccagagcctccctcag

SEQ ID NO: 4268997 - DNA, 17 bp, Homo sapiens
gcccaccagctggctct

SEQ ID NO: 4268998 - DNA, 20 bp, Homo sapiens
gcccaccagctggctctgca

SEQ ID NO: 4268999 - DNA, 22 bp, Homo sapiens
gcccaccagctggctctgcagc

SEQ ID NO: 4269000 - DNA, 23 bp, Homo sapiens
gcccaccagctggctctgcagca

SEQ ID NO: 4269001 - DNA, 13 bp, Homo sapiens
gcccacccccctc

SEQ ID NO: 4269002 - DNA, 14 bp, Homo sapiens
gcccaccccctgct

SEQ ID NO: 4269003 - DNA, 18 bp, Homo sapiens
gcccaccccgcctctggg

SEQ ID NO: 4269004 - DNA, 16 bp, Homo sapiens
gcccacccctcttccc

SEQ ID NO: 4269005 - DNA, 19 bp, Homo sapiens
gcccacccgtggagatggg

SEQ ID NO: 4269006 - DNA, 13 bp, Homo sapiens
gcccacctgctgc

SEQ ID NO: 4269007 - DNA, 14 bp, Homo sapiens
gcccacctgctgcc

SEQ ID NO: 4269008 - DNA, 17 bp, Homo sapiens
gcccacctgctgcccgt

SEQ ID NO: 4269009 - DNA, 18 bp, Homo sapiens
gcccagagagaccctgcc

SEQ ID NO: 4269010 - DNA, 21 bp, Homo sapiens
gcccagagagaccctgccaac

SEQ ID NO: 4269011 - DNA, 15 bp, Homo sapiens
gcccagatggctccc

SEQ ID NO: 4269012 - DNA, 20 bp, Homo sapiens
gcccagatggctccctgggc

SEQ ID NO: 4269013 - DNA, 22 bp, Homo sapiens
gcccagatggctccctgggctg

SEQ ID NO: 4269014 - DNA, 11 bp, Homo sapiens
gcccagccagc

SEQ ID NO: 4269015 - DNA, 15 bp, Homo sapiens
gcccagccagcaggt

SEQ ID NO: 4269016 - DNA, 15 bp, Homo sapiens
gcccagcctggcccc

SEQ ID NO: 4269017 - DNA, 16 bp, Homo sapiens
gcccagcctggcccca

SEQ ID NO: 4269018 - DNA, 17 bp, Homo sapiens
gcccagcctggccccaa

SEQ ID NO: 4269019 - DNA, 21 bp, Homo sapiens
gcccagcctggccccaaatgt

SEQ ID NO: 4269020 - DNA, 20 bp, Homo sapiens
gcccagcctgtggcctcagc

SEQ ID NO: 4269021 - DNA, 21 bp, Homo sapiens
gcccagcctgtggcctcagca

SEQ ID NO: 4269022 - DNA, 17 bp, Homo sapiens
gcccagggaatcaggga

SEQ ID NO: 4269023 - DNA, 22 bp, Homo sapiens
gcccagggaatcagggagcact

SEQ ID NO: 4269024 - DNA, 17 bp, Homo sapiens
gcccagggttcccccag

SEQ ID NO: 4269025 - DNA, 22 bp, Homo sapiens
gcccagggttcccccagccctg

SEQ ID NO: 4269026 - DNA, 14 bp, Homo sapiens
gcccaggtctcctg

SEQ ID NO: 4269027 - DNA, 22 bp, Homo sapiens
gcccaggtctcctgggcatctg

SEQ ID NO: 4269028 - DNA, 23 bp, Homo sapiens
gcccaggtctcctgggcatctgg

SEQ ID NO: 4269029 - DNA, 23 bp, Homo sapiens
gcccagtcatgacatttctcaaa

SEQ ID NO: 4269030 - DNA, 18 bp, Homo sapiens
gcccatgatataacttta

SEQ ID NO: 4269031 - DNA, 13 bp, Homo sapiens
gcccatgccctcc

SEQ ID NO: 4269032 - DNA, 22 bp, Homo sapiens
gcccatgccctccgtcctggca

SEQ ID NO: 4269033 - DNA, 23 bp, Homo sapiens
gcccatgccctccgtcctggcag

SEQ ID NO: 4269034 - DNA, 13 bp, Homo sapiens
gcccattgtaact

SEQ ID NO: 4269035 - DNA, 18 bp, Homo sapiens
gccccacccaccctctgg

SEQ ID NO: 4269036 - DNA, 13 bp, Homo sapiens
gccccacccctcc

SEQ ID NO: 4269037 - DNA, 17 bp, Homo sapiens
gccccactctgctgagg

SEQ ID NO: 4269038 - DNA, 21 bp, Homo sapiens
gccccactctgctgaggccag

SEQ ID NO: 4269039 - DNA, 18 bp, Homo sapiens
gccccagaaatgccgctg

SEQ ID NO: 4269040 - DNA, 24 bp, Homo sapiens
gccccagaaatgccgctgtgtccc

SEQ ID NO: 4269041 - DNA, 24 bp, Homo sapiens
gccccagagaagcctcagtccctc

SEQ ID NO: 4269042 - DNA, 20 bp, Homo sapiens
gccccagcgagtctggagac

SEQ ID NO: 4269043 - DNA, 19 bp, Homo sapiens
gccccaggctggatgctgg

SEQ ID NO: 4269044 - DNA, 20 bp, Homo sapiens
gccccaggctggatgctggg

SEQ ID NO: 4269045 - DNA, 16 bp, Homo sapiens
gccccagggccctgct

SEQ ID NO: 4269046 - DNA, 14 bp, Homo sapiens
gcccccacaggagc

SEQ ID NO: 4269047 - DNA, 21 bp, Homo sapiens
gcccccacaggagcatgtcct

SEQ ID NO: 4269048 - DNA, 12 bp, Homo sapiens
gcccccactgga

SEQ ID NO: 4269049 - DNA, 18 bp, Homo sapiens
gcccccagctgctcctcg

SEQ ID NO: 4269050 - DNA, 14 bp, Homo sapiens
gcccccatgcaggc

SEQ ID NO: 4269051 - DNA, 20 bp, Homo sapiens
gcccccatgcaggcagcctg

SEQ ID NO: 4269052 - DNA, 11 bp, Homo sapiens
gccccccagag

SEQ ID NO: 4269053 - DNA, 15 bp, Homo sapiens
gccccccagagccag

SEQ ID NO: 4269054 - DNA, 17 bp, Homo sapiens
gccccccagagccaggg

SEQ ID NO: 4269055 - DNA, 21 bp, Homo sapiens
gccccccagagccagggctgt

SEQ ID NO: 4269056 - DNA, 24 bp, Homo sapiens
gccccccagagccagggctgtcct

SEQ ID NO: 4269057 - DNA, 16 bp, Homo sapiens
gccccccatgccctcc

SEQ ID NO: 4269058 - DNA, 21 bp, Homo sapiens
gccccccatgccctccctgct

SEQ ID NO: 4269059 - DNA, 19 bp, Homo sapiens
gcccccgcacgcaagcctc

SEQ ID NO: 4269060 - DNA, 15 bp, Homo sapiens
gcccccgccctctgc

SEQ ID NO: 4269061 - DNA, 16 bp, Homo sapiens
gccccctacccggctc

SEQ ID NO: 4269062 - DNA, 12 bp, Homo sapiens
gccccctgggag

SEQ ID NO: 4269063 - DNA, 13 bp, Homo sapiens
gccccctgtcctt

SEQ ID NO: 4269064 - DNA, 17 bp, Homo sapiens
gcccccttctcccacac

SEQ ID NO: 4269065 - DNA, 19 bp, Homo sapiens
gcccccttctcccacactg

SEQ ID NO: 4269066 - DNA, 14 bp, Homo sapiens
gccccgccccccag

SEQ ID NO: 4269067 - DNA, 15 bp, Homo sapiens
gccccgccccccaga

SEQ ID NO: 4269068 - DNA, 19 bp, Homo sapiens
gccccgccgtgtctgtggc

SEQ ID NO: 4269069 - DNA, 15 bp, Homo sapiens
gccccggccactctg

SEQ ID NO: 4269070 - DNA, 17 bp, Homo sapiens
gccccgtcaccatctca

SEQ ID NO: 4269071 - DNA, 20 bp, Homo sapiens
gccccgtcaccatctcaggc

SEQ ID NO: 4269072 - DNA, 21 bp, Homo sapiens
gccccgtcaccatctcaggcc

SEQ ID NO: 4269073 - DNA, 15 bp, Homo sapiens
gcccctatcctgcac

SEQ ID NO: 4269074 - DNA, 16 bp, Homo sapiens
gcccctatcctgcacc

SEQ ID NO: 4269075 - DNA, 14 bp, Homo sapiens
gcccctcacctggg

SEQ ID NO: 4269076 - DNA, 13 bp, Homo sapiens
gcccctcactggc

SEQ ID NO: 4269077 - DNA, 15 bp, Homo sapiens
gcccctccagtgttg

SEQ ID NO: 4269078 - DNA, 17 bp, Homo sapiens
gcccctcccacatcccc

SEQ ID NO: 4269079 - DNA, 12 bp, Homo sapiens
gcccctcccttc

SEQ ID NO: 4269080 - DNA, 14 bp, Homo sapiens
gcccctccttctcc

SEQ ID NO: 4269081 - DNA, 22 bp, Homo sapiens
gcccctccttctcccctccaga

SEQ ID NO: 4269082 - DNA, 23 bp, Homo sapiens
gcccctccttctcccctccagac

SEQ ID NO: 4269083 - DNA, 21 bp, Homo sapiens
gcccctcttgccccccacccc

SEQ ID NO: 4269084 - DNA, 21 bp, Homo sapiens
gcccctgaagtgaccccagct

SEQ ID NO: 4269085 - DNA, 22 bp, Homo sapiens
gcccctgaagtgaccccagctc

SEQ ID NO: 4269086 - DNA, 15 bp, Homo sapiens
gcccctgccccgtca

SEQ ID NO: 4269087 - DNA, 20 bp, Homo sapiens
gcccctgccccgtcaccatc

SEQ ID NO: 4269088 - DNA, 13 bp, Homo sapiens
gcccctgctgcct

SEQ ID NO: 4269089 - DNA, 15 bp, Homo sapiens
gccccttgctgctgg

SEQ ID NO: 4269090 - DNA, 17 bp, Homo sapiens
gccccttgctgctggct

SEQ ID NO: 4269091 - DNA, 21 bp, Homo sapiens
gcccctttttactccccttga

SEQ ID NO: 4269092 - DNA, 12 bp, Homo sapiens
gcccgacagcct

SEQ ID NO: 4269093 - DNA, 15 bp, Homo sapiens
gcccgacagcctggc

SEQ ID NO: 4269094 - DNA, 16 bp, Homo sapiens
gcccgacagcctggca

SEQ ID NO: 4269095 - DNA, 19 bp, Homo sapiens
gcccgacagcctggcacag

SEQ ID NO: 4269096 - DNA, 17 bp, Homo sapiens
gcccgcccacctgggcc

SEQ ID NO: 4269097 - DNA, 12 bp, Homo sapiens
gcccgctgcgct

SEQ ID NO: 4269098 - DNA, 20 bp, Homo sapiens
gcccgctgcgctgccctgca

SEQ ID NO: 4269099 - DNA, 21 bp, Homo sapiens
gcccgctgcgctgccctgcaa

SEQ ID NO: 4269100 - DNA, 18 bp, Homo sapiens
gcccggcagtgcaccccc

SEQ ID NO: 4269101 - DNA, 17 bp, Homo sapiens
gcccggggcagctgcca

SEQ ID NO: 4269102 - DNA, 22 bp, Homo sapiens
gcccggggcagctgccagagaa

SEQ ID NO: 4269103 - DNA, 13 bp, Homo sapiens
gcccgtgaggagg

SEQ ID NO: 4269104 - DNA, 22 bp, Homo sapiens
gcccgtggtgaggttgtgctgc

SEQ ID NO: 4269105 - DNA, 15 bp, Homo sapiens
gccctacgatgggat

SEQ ID NO: 4269106 - DNA, 21 bp, Homo sapiens
gccctagcagtttgcctctgc

SEQ ID NO: 4269107 - DNA, 22 bp, Homo sapiens
gccctagcagtttgcctctgca

SEQ ID NO: 4269108 - DNA, 18 bp, Homo sapiens
gccctcactccactcccc

SEQ ID NO: 4269109 - DNA, 16 bp, Homo sapiens
gctcaggcctcacctg

SEQ ID NO: 4269110 - DNA, 16 bp, Homo sapiens
gctcagggctggattg

SEQ ID NO: 4269111 - DNA, 14 bp, Homo sapiens
gctccagaccccca

SEQ ID NO: 4269112 - DNA, 17 bp, Homo sapiens
gctccagccaacccctg

SEQ ID NO: 4269113 - DNA, 18 bp, Homo sapiens
gctccagccaacccctgt

SEQ ID NO: 4269114 - DNA, 23 bp, Homo sapiens
gctccagccaacccctgtggagc

SEQ ID NO: 4269115 - DNA, 15 bp, Homo sapiens
gctccaggcttcctg

SEQ ID NO: 4269116 - DNA, 17 bp, Homo sapiens
gctccaggcttcctgcc

SEQ ID NO: 4269117 - DNA, 19 bp, Homo sapiens
gctccaggcttcctgccct

SEQ ID NO: 4269118 - DNA, 20 bp, Homo sapiens
gctccaggcttcctgcccta

SEQ ID NO: 4269119 - DNA, 20 bp, Homo sapiens
gctccagtctgctgccctcc

SEQ ID NO: 4269120 - DNA, 16 bp, Homo sapiens
gctccagtgttttctt

SEQ ID NO: 4269121 - DNA, 18 bp, Homo sapiens
gctccagtgttttcttgt

SEQ ID NO: 4269122 - DNA, 20 bp, Homo sapiens
gctccatgcagatctagcca

SEQ ID NO: 4269123 - DNA, 16 bp, Homo sapiens
gctcccacaggccctt

SEQ ID NO: 4269124 - DNA, 19 bp, Homo sapiens
gctcccacgccctcctccc

SEQ ID NO: 4269125 - DNA, 20 bp, Homo sapiens
gctcccacgccctcctccct

SEQ ID NO: 4269126 - DNA, 12 bp, Homo sapiens
gctcccactgcc

SEQ ID NO: 4269127 - DNA, 14 bp, Homo sapiens
gctcccaggacgca

SEQ ID NO: 4269128 - DNA, 23 bp, Homo sapiens
gctccccaatccaacccatgcat

SEQ ID NO: 4269129 - DNA, 14 bp, Homo sapiens
gctcccccatcctc

SEQ ID NO: 4269130 - DNA, 21 bp, Homo sapiens
gctcccctctatttagcatga

SEQ ID NO: 4269131 - DNA, 15 bp, Homo sapiens
gctcccggctctgag

SEQ ID NO: 4269132 - DNA, 18 bp, Homo sapiens
gctccctccctccctgct

SEQ ID NO: 4269133 - DNA, 10 bp, Homo sapiens
gctccctgct

SEQ ID NO: 4269134 - DNA, 16 bp, Homo sapiens
gctccctgggctggca

SEQ ID NO: 4269135 - DNA, 18 bp, Homo sapiens
gctccctgggctggcatg

SEQ ID NO: 4269136 - DNA, 21 bp, Homo sapiens
gctccctgggctggcatgggg

SEQ ID NO: 4269137 - DNA, 16 bp, Homo sapiens
gctcctcccggtgccc

SEQ ID NO: 4269138 - DNA, 19 bp, Homo sapiens
gctcctcccggtgcccaag

SEQ ID NO: 4269139 - DNA, 15 bp, Homo sapiens
gctcctcggccagag

SEQ ID NO: 4269140 - DNA, 16 bp, Homo sapiens
gctcctcggccagagc

SEQ ID NO: 4269141 - DNA, 24 bp, Homo sapiens
gctcctcggccagagctcccagga

SEQ ID NO: 4269142 - DNA, 13 bp, Homo sapiens
gctcctctgcctg

SEQ ID NO: 4269143 - DNA, 15 bp, Homo sapiens
gctcctctgcctgtg

SEQ ID NO: 4269144 - DNA, 14 bp, Homo sapiens
gctcctctgccttg

SEQ ID NO: 4269145 - DNA, 17 bp, Homo sapiens
gctcctctgccttggac

SEQ ID NO: 4269146 - DNA, 11 bp, Homo sapiens
gctcctctggg

SEQ ID NO: 4269147 - DNA, 16 bp, Homo sapiens
gctcctctgggcagga

SEQ ID NO: 4269148 - DNA, 19 bp, Homo sapiens
gctcctctgggcaggacct

SEQ ID NO: 4269149 - DNA, 15 bp, Homo sapiens
gctcctttccctgga

SEQ ID NO: 4269150 - DNA, 15 bp, Homo sapiens
gctcgggacttcaaa

SEQ ID NO: 4269151 - DNA, 14 bp, Homo sapiens
gctcgttcccccag

SEQ ID NO: 4269152 - DNA, 20 bp, Homo sapiens
gctctacagctaatcagcat

SEQ ID NO: 4269153 - DNA, 16 bp, Homo sapiens
gctctagacaaccctg

SEQ ID NO: 4269154 - DNA, 13 bp, Homo sapiens
gctctcccctgcg

SEQ ID NO: 4269155 - DNA, 14 bp, Homo sapiens
gctctcccctgcgc

SEQ ID NO: 4269156 - DNA, 19 bp, Homo sapiens
gctctgaaagctgcttctg

SEQ ID NO: 4269157 - DNA, 17 bp, Homo sapiens
gctctgaatgtagccag

SEQ ID NO: 4269158 - DNA, 12 bp, Homo sapiens
gctctgacctgc

SEQ ID NO: 4269159 - DNA, 15 bp, Homo sapiens
gctctgcatgctcct

SEQ ID NO: 4269160 - DNA, 16 bp, Homo sapiens
gctctgcatgctcctc

SEQ ID NO: 4269161 - DNA, 22 bp, Homo sapiens
gctctgcatgctcctctgcctg

SEQ ID NO: 4269162 - DNA, 20 bp, Homo sapiens
gctctgccatcagcccctgc

SEQ ID NO: 4269163 - DNA, 21 bp, Homo sapiens
gctctgccatcagcccctgct

SEQ ID NO: 4269164 - DNA, 22 bp, Homo sapiens
gctctgccatcagcccctgctg

SEQ ID NO: 4269165 - DNA, 23 bp, Homo sapiens
gctctgtcactaaatggcagtga

SEQ ID NO: 4269166 - DNA, 14 bp, Homo sapiens
gctcttcatgtttc

SEQ ID NO: 4269167 - DNA, 23 bp, Homo sapiens
gctcttctcctttcacaaccttc

SEQ ID NO: 4269168 - DNA, 15 bp, Homo sapiens
gctgaaaagtgcttt

SEQ ID NO: 4269169 - DNA, 16 bp, Homo sapiens
gctgaaagacagtaaa

SEQ ID NO: 4269170 - DNA, 19 bp, Homo sapiens
gctgacaaccaccgctccc

SEQ ID NO: 4269171 - DNA, 16 bp, Homo sapiens
gctgacagatgttcca

SEQ ID NO: 4269172 - DNA, 19 bp, Homo sapiens
gctgaccagaagtggcagg

SEQ ID NO: 4269173 - DNA, 23 bp, Homo sapiens
gctgaccagaagtggcaggagga

SEQ ID NO: 4269174 - DNA, 21 bp, Homo sapiens
gctgactgtactcctcccagg

SEQ ID NO: 4269175 - DNA, 22 bp, Homo sapiens
gctgagaatccccgtgctcaca

SEQ ID NO: 4269176 - DNA, 19 bp, Homo sapiens
gctgagactggatactgcc

SEQ ID NO: 4269177 - DNA, 16 bp, Homo sapiens
gctgagctctgacctg

SEQ ID NO: 4269178 - DNA, 19 bp, Homo sapiens
gctgagctctgacctgccc

SEQ ID NO: 4269179 - DNA, 13 bp, Homo sapiens
gctgagctgtgcc

SEQ ID NO: 4269180 - DNA, 17 bp, Homo sapiens
gctgagctgtgccagct

SEQ ID NO: 4269181 - DNA, 19 bp, Homo sapiens
gctgaggagctcagggctg

SEQ ID NO: 4269182 - DNA, 14 bp, Homo sapiens
gctgaggccagagg

SEQ ID NO: 4269183 - DNA, 15 bp, Homo sapiens
gctgaggccagagga

SEQ ID NO: 4269184 - DNA, 16 bp, Homo sapiens
gctgaggccagaggaa

SEQ ID NO: 4269185 - DNA, 19 bp, Homo sapiens
gctgaggtgggccttccat

SEQ ID NO: 4269186 - DNA, 23 bp, Homo sapiens
gctgcaagtggttaagaatgtat

SEQ ID NO: 4269187 - DNA, 13 bp, Homo sapiens
gctgcaatacatt

SEQ ID NO: 4269188 - DNA, 14 bp, Homo sapiens
gctgcacccctggt

SEQ ID NO: 4269189 - DNA, 22 bp, Homo sapiens
gctgcacccctggtgtccctgc

SEQ ID NO: 4269190 - DNA, 15 bp, Homo sapiens
gctgcacctgcaggg

SEQ ID NO: 4269191 - DNA, 19 bp, Homo sapiens
gctgcacctgcagggagca

SEQ ID NO: 4269192 - DNA, 16 bp, Homo sapiens
gctgcactgccctccg

SEQ ID NO: 4269193 - DNA, 22 bp, Homo sapiens
gctgcagaaccagtccctctga

SEQ ID NO: 4269194 - DNA, 21 bp, Homo sapiens
gctgcaggaatcaaaaattga

SEQ ID NO: 4269195 - DNA, 18 bp, Homo sapiens
gctgcagggtggcatctt

SEQ ID NO: 4269196 - DNA, 18 bp, Homo sapiens
gctgcagtcagcacagag

SEQ ID NO: 4269197 - DNA, 19 bp, Homo sapiens
gctgcagttagcacagagg

SEQ ID NO: 4269198 - DNA, 21 bp, Homo sapiens
gctgcatcctcagccccaggg

SEQ ID NO: 4269199 - DNA, 17 bp, Homo sapiens
gctgccacacttcaggc

SEQ ID NO: 4269200 - DNA, 23 bp, Homo sapiens
gctgccacacttcaggctcttct

SEQ ID NO: 4269201 - DNA, 12 bp, Homo sapiens
gctgccagagaa

SEQ ID NO: 4269202 - DNA, 15 bp, Homo sapiens
gctgccaggctccca

SEQ ID NO: 4269203 - DNA, 16 bp, Homo sapiens
gctgcccaccccctgc

SEQ ID NO: 4269204 - DNA, 19 bp, Homo sapiens
gctgcccaccccctgctgg

SEQ ID NO: 4269205 - DNA, 23 bp, Homo sapiens
gctgcccaccccctgctggtgcc

SEQ ID NO: 4269206 - DNA, 14 bp, Homo sapiens
gctgccccacccct

SEQ ID NO: 4269207 - DNA, 20 bp, Homo sapiens
gctgcccgtgaggaggggga

SEQ ID NO: 4269208 - DNA, 11 bp, Homo sapiens
gctgccctgca

SEQ ID NO: 4269209 - DNA, 14 bp, Homo sapiens
gctgccctggtgct

SEQ ID NO: 4269210 - DNA, 19 bp, Homo sapiens
gctgccctggtgctgccac

SEQ ID NO: 4269211 - DNA, 22 bp, Homo sapiens
gctgccgtgcacggggccagca

SEQ ID NO: 4269212 - DNA, 18 bp, Homo sapiens
gctgcctctgaaaatatt

SEQ ID NO: 4269213 - DNA, 16 bp, Homo sapiens
gctgcctgcctccggc

SEQ ID NO: 4269214 - DNA, 12 bp, Homo sapiens
gctgccttctgc

SEQ ID NO: 4269215 - DNA, 18 bp, Homo sapiens
gctgccttctgtctcttg

SEQ ID NO: 4269216 - DNA, 12 bp, Homo sapiens
gctgcgctgccc

SEQ ID NO: 4269217 - DNA, 16 bp, Homo sapiens
gctgcgctgccctgca

SEQ ID NO: 4269218 - DNA, 14 bp, Homo sapiens
gctgcgctgtgctg

SEQ ID NO: 4269219 - DNA, 16 bp, Homo sapiens
gctgcgctgtgctggt

SEQ ID NO: 4269220 - DNA, 20 bp, Homo sapiens
gctgctcctcggccagagct

SEQ ID NO: 4269221 - DNA, 23 bp, Homo sapiens
gctgctctattgtagcatttctt

SEQ ID NO: 4269222 - DNA, 14 bp, Homo sapiens
gctgctgcaccaac

SEQ ID NO: 4269223 - DNA, 12 bp, Homo sapiens
gctgctgcactg

SEQ ID NO: 4269224 - DNA, 13 bp, Homo sapiens
gctgctgtgaatt

SEQ ID NO: 4269225 - DNA, 12 bp, Homo sapiens
gctgcttccctc

SEQ ID NO: 4269226 - DNA, 14 bp, Homo sapiens
gctgcttctgccca

SEQ ID NO: 4269227 - DNA, 15 bp, Homo sapiens
gctgcttctggggga

SEQ ID NO: 4269228 - DNA, 22 bp, Homo sapiens
gctggagctggcgtctgtcttc

SEQ ID NO: 4269229 - DNA, 17 bp, Homo sapiens
gctggagtcctgttctc

SEQ ID NO: 4269230 - DNA, 15 bp, Homo sapiens
gctggagtgcagtgg

SEQ ID NO: 4269231 - DNA, 13 bp, Homo sapiens
gctggatgctggg

SEQ ID NO: 4269232 - DNA, 17 bp, Homo sapiens
gctggatgctgggttct

SEQ ID NO: 4269233 - DNA, 20 bp, Homo sapiens
gctggcaggagggtggcact

SEQ ID NO: 4269234 - DNA, 14 bp, Homo sapiens
gctggcatggggag

SEQ ID NO: 4269235 - DNA, 20 bp, Homo sapiens
gctggcatggggaggggaga

SEQ ID NO: 4269236 - DNA, 23 bp, Homo sapiens
gctggcatggggaggggagagaa

SEQ ID NO: 4269237 - DNA, 12 bp, Homo sapiens
gctggcatgtct

SEQ ID NO: 4269238 - DNA, 14 bp, Homo sapiens
gctggcatgtctgg

SEQ ID NO: 4269239 - DNA, 15 bp, Homo sapiens
gctggcatgtctggg

SEQ ID NO: 4269240 - DNA, 17 bp, Homo sapiens
ggcccccagagcgcccc

SEQ ID NO: 4269241 - DNA, 20 bp, Homo sapiens
ggcccccgcacgcaagcctc

SEQ ID NO: 4269242 - DNA, 23 bp, Homo sapiens
ggcccccgcacgcaagcctcagc

SEQ ID NO: 4269243 - DNA, 11 bp, Homo sapiens
ggcccctcctt

SEQ ID NO: 4269244 - DNA, 20 bp, Homo sapiens
ggcccctccttctcccctcc

SEQ ID NO: 4269245 - DNA, 17 bp, Homo sapiens
ggccccttgctgctggc

SEQ ID NO: 4269246 - DNA, 17 bp, Homo sapiens
ggcccgacagcctggca

SEQ ID NO: 4269247 - DNA, 17 bp, Homo sapiens
ggcccggctgggcccga

SEQ ID NO: 4269248 - DNA, 11 bp, Homo sapiens
ggccctaggca

SEQ ID NO: 4269249 - DNA, 18 bp, Homo sapiens
ggccctcctctggtcact

SEQ ID NO: 4269250 - DNA, 22 bp, Homo sapiens
ggccctgccccacacaggcctg

SEQ ID NO: 4269251 - DNA, 15 bp, Homo sapiens
ggccctgccccccac

SEQ ID NO: 4269252 - DNA, 24 bp, Homo sapiens
ggccctgctcaggcctcacctggc

SEQ ID NO: 4269253 - DNA, 14 bp, Homo sapiens
ggccctgctgcccc

SEQ ID NO: 4269254 - DNA, 22 bp, Homo sapiens
ggccctggttcccccaggaccc

SEQ ID NO: 4269255 - DNA, 15 bp, Homo sapiens
ggccctgttgtgggg

SEQ ID NO: 4269256 - DNA, 17 bp, Homo sapiens
ggccgaggcaggggctg

SEQ ID NO: 4269257 - DNA, 17 bp, Homo sapiens
ggccgagggaaatgctg

SEQ ID NO: 4269258 - DNA, 16 bp, Homo sapiens
ggccgctagatgggca

SEQ ID NO: 4269259 - DNA, 13 bp, Homo sapiens
ggccgctgcaggg

SEQ ID NO: 4269260 - DNA, 14 bp, Homo sapiens
ggccgctgcagggt

SEQ ID NO: 4269261 - DNA, 23 bp, Homo sapiens
ggccgctgcagtcagcacagaga

SEQ ID NO: 4269262 - DNA, 22 bp, Homo sapiens
ggccgctgggagaaaagccaga

SEQ ID NO: 4269263 - DNA, 16 bp, Homo sapiens
ggccgcttcgccatgt

SEQ ID NO: 4269264 - DNA, 17 bp, Homo sapiens
ggccgcttcgccatgtg

SEQ ID NO: 4269265 - DNA, 20 bp, Homo sapiens
ggccgcttcgccatgtgctg

SEQ ID NO: 4269266 - DNA, 16 bp, Homo sapiens
ggccggccctgccccc

SEQ ID NO: 4269267 - DNA, 18 bp, Homo sapiens
ggccggccctgcccccca

SEQ ID NO: 4269268 - DNA, 21 bp, Homo sapiens
ggccgtagactcacggctgca

SEQ ID NO: 4269269 - DNA, 20 bp, Homo sapiens
ggccgtcttcactcgccccc

SEQ ID NO: 4269270 - DNA, 20 bp, Homo sapiens
ggccgttgcctctctgccag

SEQ ID NO: 4269271 - DNA, 22 bp, Homo sapiens
ggcctagtggcttcagcccctg

SEQ ID NO: 4269272 - DNA, 18 bp, Homo sapiens
ggcctatgccacctgcag

SEQ ID NO: 4269273 - DNA, 17 bp, Homo sapiens
ggcctcaaccctccctc

SEQ ID NO: 4269274 - DNA, 19 bp, Homo sapiens
ggcctcaaccctccctcag

SEQ ID NO: 4269275 - DNA, 16 bp, Homo sapiens
ggcctcagcagaaggc

SEQ ID NO: 4269276 - DNA, 11 bp, Homo sapiens
ggcctcagcat

SEQ ID NO: 4269277 - DNA, 13 bp, Homo sapiens
ggcctcaggaggc

SEQ ID NO: 4269278 - DNA, 20 bp, Homo sapiens
ggcctcagtggactttccac

SEQ ID NO: 4269279 - DNA, 14 bp, Homo sapiens
ggcctcatcctcct

SEQ ID NO: 4269280 - DNA, 13 bp, Homo sapiens
ggcctcccagcca

SEQ ID NO: 4269281 - DNA, 14 bp, Homo sapiens
ggcctcccagccac

SEQ ID NO: 4269282 - DNA, 15 bp, Homo sapiens
ggcctcccagccacc

SEQ ID NO: 4269283 - DNA, 22 bp, Homo sapiens
ggcctcccgcatgctgcctgcc

SEQ ID NO: 4269284 - DNA, 16 bp, Homo sapiens
ggcctcttcctccctc

SEQ ID NO: 4269285 - DNA, 18 bp, Homo sapiens
ggcctgaactaggtgctg

SEQ ID NO: 4269286 - DNA, 24 bp, Homo sapiens
ggcctgaactaggtgctggcatgt

SEQ ID NO: 4269287 - DNA, 11 bp, Homo sapiens
ggcctgagggg

SEQ ID NO: 4269288 - DNA, 17 bp, Homo sapiens
ggcctgatggccaggcc

SEQ ID NO: 4269289 - DNA, 19 bp, Homo sapiens
ggcctgatggccaggcctc

SEQ ID NO: 4269290 - DNA, 13 bp, Homo sapiens
ggcctgccactct

SEQ ID NO: 4269291 - DNA, 19 bp, Homo sapiens
ggcctgccactctcctgag

SEQ ID NO: 4269292 - DNA, 12 bp, Homo sapiens
ggcctgcccccc

SEQ ID NO: 4269293 - DNA, 21 bp, Homo sapiens
ggcctgccccccttcccaccc

SEQ ID NO: 4269294 - DNA, 20 bp, Homo sapiens
ggcctgcctacgtgctgccc

SEQ ID NO: 4269295 - DNA, 18 bp, Homo sapiens
ggcctggagttgggctgg

SEQ ID NO: 4269296 - DNA, 14 bp, Homo sapiens
ggcctggcagccgt

SEQ ID NO: 4269297 - DNA, 15 bp, Homo sapiens
ggcctggcagccgtg

SEQ ID NO: 4269298 - DNA, 11 bp, Homo sapiens
ggcctggccca

SEQ ID NO: 4269299 - DNA, 12 bp, Homo sapiens
ggcctggccctt

SEQ ID NO: 4269300 - DNA, 21 bp, Homo sapiens
ggcctggccctttcacccctc

SEQ ID NO: 4269301 - DNA, 20 bp, Homo sapiens
ggcctgggaaaagggcagga

SEQ ID NO: 4269302 - DNA, 20 bp, Homo sapiens
ggcctggggacggagcactg

SEQ ID NO: 4269303 - DNA, 22 bp, Homo sapiens
ggcctggggccgggctggcttc

SEQ ID NO: 4269304 - DNA, 21 bp, Homo sapiens
ggcctggtccatgatggagtc

SEQ ID NO: 4269305 - DNA, 14 bp, Homo sapiens
ggcctggtctggag

SEQ ID NO: 4269306 - DNA, 16 bp, Homo sapiens
ggcctggtgccctggc

SEQ ID NO: 4269307 - DNA, 22 bp, Homo sapiens
ggcctgtccacctgtgctgctg

SEQ ID NO: 4269308 - DNA, 19 bp, Homo sapiens
ggccttgtgtgtgtgtttt

SEQ ID NO: 4269309 - DNA, 15 bp, Homo sapiens
ggcctttttgagcca

SEQ ID NO: 4269310 - DNA, 11 bp, Homo sapiens
ggcgaggcaga

SEQ ID NO: 4269311 - DNA, 15 bp, Homo sapiens
ggcgaggcagaggac

SEQ ID NO: 4269312 - DNA, 16 bp, Homo sapiens
ggcgcagtgcctctgg

SEQ ID NO: 4269313 - DNA, 16 bp, Homo sapiens
ggcgccttcctgggtt

SEQ ID NO: 4269314 - DNA, 19 bp, Homo sapiens
ggcgccttctacctgcagg

SEQ ID NO: 4269315 - DNA, 20 bp, Homo sapiens
ggcgccttctacctgcagga

SEQ ID NO: 4269316 - DNA, 13 bp, Homo sapiens
ggcgggccaggag

SEQ ID NO: 4269317 - DNA, 22 bp, Homo sapiens
ggcggggctggccagctgtgcg

SEQ ID NO: 4269318 - DNA, 17 bp, Homo sapiens
ggcggtatccagaggtg

SEQ ID NO: 4269319 - DNA, 21 bp, Homo sapiens
ggcggtatccagaggtgaggg

SEQ ID NO: 4269320 - DNA, 14 bp, Homo sapiens
ggcgtagggccagg

SEQ ID NO: 4269321 - DNA, 19 bp, Homo sapiens
ggcgtagggccagggctct

SEQ ID NO: 4269322 - DNA, 20 bp, Homo sapiens
ggcgtagggccagggctctg

SEQ ID NO: 4269323 - DNA, 14 bp, Homo sapiens
ggcgtgtcccctgc

SEQ ID NO: 4269324 - DNA, 13 bp, Homo sapiens
ggctaagcctgga

SEQ ID NO: 4269325 - DNA, 17 bp, Homo sapiens
ggctaagtccagctctc

SEQ ID NO: 4269326 - DNA, 18 bp, Homo sapiens
ggctaagtccagctctcc

SEQ ID NO: 4269327 - DNA, 15 bp, Homo sapiens
ggctagactgggctg

SEQ ID NO: 4269328 - DNA, 17 bp, Homo sapiens
ggctagactgggctggc

SEQ ID NO: 4269329 - DNA, 22 bp, Homo sapiens
ggctatgccactaggccctggt

SEQ ID NO: 4269330 - DNA, 15 bp, Homo sapiens
ggctcacaccagccc

SEQ ID NO: 4269331 - DNA, 19 bp, Homo sapiens
ggctcacaccagccctggt

SEQ ID NO: 4269332 - DNA, 13 bp, Homo sapiens
ggctcacagccac

SEQ ID NO: 4269333 - DNA, 16 bp, Homo sapiens
ggctcacagccaccac

SEQ ID NO: 4269334 - DNA, 19 bp, Homo sapiens
ggctcacagccaccacctg

SEQ ID NO: 4269335 - DNA, 20 bp, Homo sapiens
ggctcacagccaccacctgg

SEQ ID NO: 4269336 - DNA, 21 bp, Homo sapiens
ggctcacagccaccacctgga

SEQ ID NO: 4269337 - DNA, 20 bp, Homo sapiens
ggctcccacaggcccttcct

SEQ ID NO: 4269338 - DNA, 21 bp, Homo sapiens
ggctcccacaggcccttcctc

SEQ ID NO: 4269339 - DNA, 14 bp, Homo sapiens
ggctcccacgccct

SEQ ID NO: 4269340 - DNA, 16 bp, Homo sapiens
ggctcccagcagaggc

SEQ ID NO: 4269341 - DNA, 15 bp, Homo sapiens
ggctcccatctccct

SEQ ID NO: 4269342 - DNA, 15 bp, Homo sapiens
ggctccctgggctgg

SEQ ID NO: 4269343 - DNA, 17 bp, Homo sapiens
ggctccctgggctggca

SEQ ID NO: 4269344 - DNA, 14 bp, Homo sapiens
ggctcctccccgat

SEQ ID NO: 4269345 - DNA, 21 bp, Homo sapiens
ggctcctccccgatccccgac

SEQ ID NO: 4269346 - DNA, 18 bp, Homo sapiens
ggctcgttcccccagggg

SEQ ID NO: 4269347 - DNA, 21 bp, Homo sapiens
ggctctgaaagctgcttctgg

SEQ ID NO: 4269348 - DNA, 23 bp, Homo sapiens
ggctctggcaggtggccagggct

SEQ ID NO: 4269349 - DNA, 19 bp, Homo sapiens
ggctctgggttcgggaaga

SEQ ID NO: 4269350 - DNA, 16 bp, Homo sapiens
ggctgaatgtatgtaa

SEQ ID NO: 4269351 - DNA, 12 bp, Homo sapiens
ggctgagactgg

SEQ ID NO: 4269352 - DNA, 13 bp, Homo sapiens
ggctgagactgga

SEQ ID NO: 4269353 - DNA, 21 bp, Homo sapiens
ggctgagctgtgccagctgct

SEQ ID NO: 4269354 - DNA, 22 bp, Homo sapiens
ggctgagctgtgccagctgctt

SEQ ID NO: 4269355 - DNA, 20 bp, Homo sapiens
ggctgcacctgcagggagca

SEQ ID NO: 4269356 - DNA, 15 bp, Homo sapiens
ggctgcatcctcagc

SEQ ID NO: 4269357 - DNA, 17 bp, Homo sapiens
ggctgcatcctcagccc

SEQ ID NO: 4269358 - DNA, 19 bp, Homo sapiens
ggctgcccacgctcctgcc

SEQ ID NO: 4269359 - DNA, 16 bp, Homo sapiens
ggctgccttagaacct

SEQ ID NO: 4269360 - DNA, 12 bp, Homo sapiens
ggctgccttctg

SEQ ID NO: 4269361 - DNA, 21 bp, Homo sapiens
ggctgctgcagtcagcacaga

SEQ ID NO: 4269362 - DNA, 23 bp, Homo sapiens
ggctgctgcagtcagcacagaga

SEQ ID NO: 4269363 - DNA, 13 bp, Homo sapiens
ggctggagctggc

SEQ ID NO: 4269364 - DNA, 16 bp, Homo sapiens
ggctggatgctgggtt

SEQ ID NO: 4269365 - DNA, 20 bp, Homo sapiens
ggctggattggcaggtgtgg

SEQ ID NO: 4269366 - DNA, 19 bp, Homo sapiens
ggctggcaccgccttctct

SEQ ID NO: 4269367 - DNA, 22 bp, Homo sapiens
ggctggcatggggaggggagag

SEQ ID NO: 4269368 - DNA, 19 bp, Homo sapiens
ggctggctgccttctgcgg

SEQ ID NO: 4269369 - DNA, 16 bp, Homo sapiens
ggctggcttctccctg

SEQ ID NO: 4269370 - DNA, 14 bp, Homo sapiens
gtagctgtggggag

SEQ ID NO: 4269371 - DNA, 14 bp, Homo sapiens
gtagcttcagtcat

SEQ ID NO: 4269372 - DNA, 15 bp, Homo sapiens
gtaggctgtattttc

SEQ ID NO: 4269373 - DNA, 15 bp, Homo sapiens
gtagggccagggctc

SEQ ID NO: 4269374 - DNA, 17 bp, Homo sapiens
gtagtaacacataaagt

SEQ ID NO: 4269375 - DNA, 23 bp, Homo sapiens
gtagtagttgatgaccaatctct

SEQ ID NO: 4269376 - DNA, 20 bp, Homo sapiens
gtagttgatgaccaatctct

SEQ ID NO: 4269377 - DNA, 22 bp, Homo sapiens
gtagttgatgaccaatctctgt

SEQ ID NO: 4269378 - DNA, 24 bp, Homo sapiens
gtagttgatgaccaatctctgtga

SEQ ID NO: 4269379 - DNA, 21 bp, Homo sapiens
gtataaaacagtgtttccagt

SEQ ID NO: 4269380 - DNA, 12 bp, Homo sapiens
gtataaactttt

SEQ ID NO: 4269381 - DNA, 19 bp, Homo sapiens
gtataacaagccaaacatt

SEQ ID NO: 4269382 - DNA, 14 bp, Homo sapiens
gtatacaagtactg

SEQ ID NO: 4269383 - DNA, 15 bp, Homo sapiens
gtatataaatggtga

SEQ ID NO: 4269384 - DNA, 13 bp, Homo sapiens
gtatatatgtaca

SEQ ID NO: 4269385 - DNA, 19 bp, Homo sapiens
gtatcagtgtttatgtgct

SEQ ID NO: 4269386 - DNA, 24 bp, Homo sapiens
gtatcagtgtttatgtgctattaa

SEQ ID NO: 4269387 - DNA, 21 bp, Homo sapiens
gtatctggattcaaatttatt

SEQ ID NO: 4269388 - DNA, 17 bp, Homo sapiens
gtatcttactttcctct

SEQ ID NO: 4269389 - DNA, 13 bp, Homo sapiens
gtatcttatttat

SEQ ID NO: 4269390 - DNA, 16 bp, Homo sapiens
gtatgaaatatatgtg

SEQ ID NO: 4269391 - DNA, 18 bp, Homo sapiens
gtatgtgaaagtgtaaaa

SEQ ID NO: 4269392 - DNA, 23 bp, Homo sapiens
gtattatgtcctgtgagatgtgt

SEQ ID NO: 4269393 - DNA, 13 bp, Homo sapiens
gtattcaggaccc

SEQ ID NO: 4269394 - DNA, 17 bp, Homo sapiens
gtattccttggcccagc

SEQ ID NO: 4269395 - DNA, 20 bp, Homo sapiens
gtattccttggcccagcagc

SEQ ID NO: 4269396 - DNA, 18 bp, Homo sapiens
gtattctgtggattctat

SEQ ID NO: 4269397 - DNA, 21 bp, Homo sapiens
gtattctgtggattctatatt

SEQ ID NO: 4269398 - DNA, 13 bp, Homo sapiens
gtattgatatcac

SEQ ID NO: 4269399 - DNA, 17 bp, Homo sapiens
gtattgttagatgtttg

SEQ ID NO: 4269400 - DNA, 13 bp, Homo sapiens
gtatttatattag

SEQ ID NO: 4269401 - DNA, 17 bp, Homo sapiens
gtatttattttcctccc

SEQ ID NO: 4269402 - DNA, 20 bp, Homo sapiens
gtatttattttcctccccag

SEQ ID NO: 4269403 - DNA, 22 bp, Homo sapiens
gtatttattttcctccccagca

SEQ ID NO: 4269404 - DNA, 23 bp, Homo sapiens
gtattttcttcccatttgtaatg

SEQ ID NO: 4269405 - DNA, 15 bp, Homo sapiens
gtcaactccaaggca

SEQ ID NO: 4269406 - DNA, 22 bp, Homo sapiens
gtcaactccaaggcaaatgtcc

SEQ ID NO: 4269407 - DNA, 23 bp, Homo sapiens
gtcaactccaaggcaaatgtcca

SEQ ID NO: 4269408 - DNA, 16 bp, Homo sapiens
gtcaactgctgtttta

SEQ ID NO: 4269409 - DNA, 19 bp, Homo sapiens
gtcaactgctgttttatgt

SEQ ID NO: 4269410 - DNA, 17 bp, Homo sapiens
gtcaatgaaatatttgc

SEQ ID NO: 4269411 - DNA, 14 bp, Homo sapiens
gtcaatgtgtgcac

SEQ ID NO: 4269412 - DNA, 12 bp, Homo sapiens
gtcacagaggca

SEQ ID NO: 4269413 - DNA, 14 bp, Homo sapiens
gtcacagaggcagt

SEQ ID NO: 4269414 - DNA, 20 bp, Homo sapiens
gtcacagaggcagtggcagc

SEQ ID NO: 4269415 - DNA, 22 bp, Homo sapiens
gtcacagcagtacttgctcaat

SEQ ID NO: 4269416 - DNA, 19 bp, Homo sapiens
gtcacagccgtttgaatat

SEQ ID NO: 4269417 - DNA, 20 bp, Homo sapiens
gtcacatatcaagtcccgag

SEQ ID NO: 4269418 - DNA, 17 bp, Homo sapiens
gtcaccatctcaggcca

SEQ ID NO: 4269419 - DNA, 13 bp, Homo sapiens
gtcaccttcctgg

SEQ ID NO: 4269420 - DNA, 23 bp, Homo sapiens
gtcaccttcctgggcagcccaga

SEQ ID NO: 4269421 - DNA, 14 bp, Homo sapiens
gtcactgcctggag

SEQ ID NO: 4269422 - DNA, 15 bp, Homo sapiens
gtcacttatttcata

SEQ ID NO: 4269423 - DNA, 13 bp, Homo sapiens
gtcagcacagaga

SEQ ID NO: 4269424 - DNA, 15 bp, Homo sapiens
gtcagcttgaatgtc

SEQ ID NO: 4269425 - DNA, 18 bp, Homo sapiens
gtcagctttgccttccac

SEQ ID NO: 4269426 - DNA, 20 bp, Homo sapiens
gtcaggagagccctctgctg

SEQ ID NO: 4269427 - DNA, 13 bp, Homo sapiens
gtcagggaccaag

SEQ ID NO: 4269428 - DNA, 21 bp, Homo sapiens
gtcagggaccaaggacccctc

SEQ ID NO: 4269429 - DNA, 13 bp, Homo sapiens
gtcagggagccct

SEQ ID NO: 4269430 - DNA, 19 bp, Homo sapiens
gtcagtgaagcccaggagg

SEQ ID NO: 4269431 - DNA, 21 bp, Homo sapiens
gtcagtgaagcccaggaggac

SEQ ID NO: 4269432 - DNA, 16 bp, Homo sapiens
gtcatcccggggccat

SEQ ID NO: 4269433 - DNA, 20 bp, Homo sapiens
gtcatgtgtcagctgtagaa

SEQ ID NO: 4269434 - DNA, 21 bp, Homo sapiens
gtcatttcttctctctgtgct

SEQ ID NO: 4269435 - DNA, 22 bp, Homo sapiens
gtcatttcttctctctgtgctg

SEQ ID NO: 4269436 - DNA, 13 bp, Homo sapiens
gtccacaaatgtc

SEQ ID NO: 4269437 - DNA, 14 bp, Homo sapiens
gtccacaaatgtcc

SEQ ID NO: 4269438 - DNA, 15 bp, Homo sapiens
gtccacaaatgtcct

SEQ ID NO: 4269439 - DNA, 18 bp, Homo sapiens
gtccacaaatgtcctcag

SEQ ID NO: 4269440 - DNA, 20 bp, Homo sapiens
gtccacaaatgtcctcagag

SEQ ID NO: 4269441 - DNA, 22 bp, Homo sapiens
gtccacccgtttccaagcctgg

SEQ ID NO: 4269442 - DNA, 17 bp, Homo sapiens
gtccacctgtgctgctg

SEQ ID NO: 4269443 - DNA, 14 bp, Homo sapiens
gtccagacctgggc

SEQ ID NO: 4269444 - DNA, 16 bp, Homo sapiens
gtccagacctgggccc

SEQ ID NO: 4269445 - DNA, 19 bp, Homo sapiens
gtccagacctgggccctgg

SEQ ID NO: 4269446 - DNA, 20 bp, Homo sapiens
gtccagagagagaagtgccc

SEQ ID NO: 4269447 - DNA, 12 bp, Homo sapiens
gtccagctctcc

SEQ ID NO: 4269448 - DNA, 15 bp, Homo sapiens
gtccagctctcccct

SEQ ID NO: 4269449 - DNA, 17 bp, Homo sapiens
gtccagctctcccctgc

SEQ ID NO: 4269450 - DNA, 18 bp, Homo sapiens
gtccagctctcccctgcg

SEQ ID NO: 4269451 - DNA, 20 bp, Homo sapiens
gtccagctctcccctgcgca

SEQ ID NO: 4269452 - DNA, 18 bp, Homo sapiens
gtccaggcatgggtccct

SEQ ID NO: 4269453 - DNA, 19 bp, Homo sapiens
gtccatgaaaaacagcaga

SEQ ID NO: 4269454 - DNA, 20 bp, Homo sapiens
gtccatgaaaaacagcagag

SEQ ID NO: 4269455 - DNA, 13 bp, Homo sapiens
gtccattgcaaaa

SEQ ID NO: 4269456 - DNA, 23 bp, Homo sapiens
gtccattgcaaaaggttaagcca

SEQ ID NO: 4269457 - DNA, 19 bp, Homo sapiens
gtcccacaaaatatttcta

SEQ ID NO: 4269458 - DNA, 17 bp, Homo sapiens
gtcccagacatgctgcc

SEQ ID NO: 4269459 - DNA, 18 bp, Homo sapiens
gtcccagacatgctgccc

SEQ ID NO: 4269460 - DNA, 20 bp, Homo sapiens
gtcccagacatgctgcccac

SEQ ID NO: 4269461 - DNA, 16 bp, Homo sapiens
gtccccaggggcacac

SEQ ID NO: 4269462 - DNA, 19 bp, Homo sapiens
gtccccagtgtggactctg

SEQ ID NO: 4269463 - DNA, 23 bp, Homo sapiens
gtccccattctataaattcaaca

SEQ ID NO: 4269464 - DNA, 20 bp, Homo sapiens
gtccccgagccgagctctcc

SEQ ID NO: 4269465 - DNA, 14 bp, Homo sapiens
gtcccgagccccct

SEQ ID NO: 4269466 - DNA, 17 bp, Homo sapiens
gtcccgagccccctgtc

SEQ ID NO: 4269467 - DNA, 23 bp, Homo sapiens
gtcccgggtgccccccatgccct

SEQ ID NO: 4269468 - DNA, 20 bp, Homo sapiens
gtccctaagcacaataaaag

SEQ ID NO: 4269469 - DNA, 21 bp, Homo sapiens
gtccctaccgagtctcttctc

SEQ ID NO: 4269470 - DNA, 16 bp, Homo sapiens
gtccctaggtgggtca

SEQ ID NO: 4269471 - DNA, 20 bp, Homo sapiens
gtccctccctcctggctcac

SEQ ID NO: 4269472 - DNA, 16 bp, Homo sapiens
gtccctctcaggcatg

SEQ ID NO: 4269473 - DNA, 13 bp, Homo sapiens
gtccctctctctg

SEQ ID NO: 4269474 - DNA, 14 bp, Homo sapiens
gtccctctctctgg

SEQ ID NO: 4269475 - DNA, 23 bp, Homo sapiens
gtccctgagaagcctcatgggag

SEQ ID NO: 4269476 - DNA, 15 bp, Homo sapiens
gtccctgagggccct

SEQ ID NO: 4269477 - DNA, 17 bp, Homo sapiens
gtccctgccccgccccc

SEQ ID NO: 4269478 - DNA, 23 bp, Homo sapiens
gtccctgccccgccccccagagc

SEQ ID NO: 4269479 - DNA, 16 bp, Homo sapiens
gtccctgcctggccct

SEQ ID NO: 4269480 - DNA, 17 bp, Homo sapiens
gtccctgcctggccctc

SEQ ID NO: 4269481 - DNA, 16 bp, Homo sapiens
gtccctgtccctgccc

SEQ ID NO: 4269482 - DNA, 17 bp, Homo sapiens
gtcccttacctggctta

SEQ ID NO: 4269483 - DNA, 13 bp, Homo sapiens
gtcccttccccct

SEQ ID NO: 4269484 - DNA, 22 bp, Homo sapiens
gtccgtagtatcagagatgtcc

SEQ ID NO: 4269485 - DNA, 22 bp, Homo sapiens
gtcctaggggccgagggaaatg

SEQ ID NO: 4269486 - DNA, 14 bp, Homo sapiens
gtcctatccccgga

SEQ ID NO: 4269487 - DNA, 17 bp, Homo sapiens
gtcctatccccggacgc

SEQ ID NO: 4269488 - DNA, 22 bp, Homo sapiens
gtcctatccctggacgcatgca

SEQ ID NO: 4269489 - DNA, 19 bp, Homo sapiens
gtcctcaggcagtggccca

SEQ ID NO: 4269490 - DNA, 15 bp, Homo sapiens
gtcctgaggctgggg

SEQ ID NO: 4269491 - DNA, 17 bp, Homo sapiens
gtcctgaggctggggct

SEQ ID NO: 4269492 - DNA, 13 bp, Homo sapiens
gtcctgctcagat

SEQ ID NO: 4269493 - DNA, 18 bp, Homo sapiens
gtcctgggggctgctgca

SEQ ID NO: 4269494 - DNA, 17 bp, Homo sapiens
gtcctgttctcagagct

SEQ ID NO: 4269495 - DNA, 16 bp, Homo sapiens
gtccttcccacggcca

SEQ ID NO: 4269496 - DNA, 22 bp, Homo sapiens
gtccttggtggccgggggtggg

SEQ ID NO: 4269497 - DNA, 23 bp, Homo sapiens
gtccttggtggccgggggtgggg

SEQ ID NO: 4269498 - DNA, 18 bp, Homo sapiens
gtcgagtgatatggcttg

SEQ ID NO: 4269499 - DNA, 19 bp, Homo sapiens
gtttgttgagctggtaaca

SEQ ID NO: 4269500 - DNA, 17 bp, Homo sapiens
gttttacaataaaattt

SEQ ID NO: 4269501 - DNA, 18 bp, Homo sapiens
gttttacaatggctgggt

SEQ ID NO: 4269502 - DNA, 17 bp, Homo sapiens
gttttatgtcatactct

SEQ ID NO: 4269503 - DNA, 14 bp, Homo sapiens
gttttcaaaatact

SEQ ID NO: 4269504 - DNA, 21 bp, Homo sapiens
gttttctaaatgtttcttttt

SEQ ID NO: 4269505 - DNA, 10 bp, Homo sapiens
gttttctctg

SEQ ID NO: 4269506 - DNA, 18 bp, Homo sapiens
gtttttctgttccctgct

SEQ ID NO: 4269507 - DNA, 12 bp, Homo sapiens
gtttttgaagaa

SEQ ID NO: 4269508 - DNA, 20 bp, Homo sapiens
gtttttgaagaagggaaatt

SEQ ID NO: 4269509 - DNA, 21 bp, Homo sapiens
gttttttcctgagcttggcca

SEQ ID NO: 4269510 - DNA, 14 bp, Homo sapiens
taaaaaaataacat

SEQ ID NO: 4269511 - DNA, 16 bp, Homo sapiens
taaaaaaataacatct

SEQ ID NO: 4269512 - DNA, 14 bp, Homo sapiens
taaaaaataacata

SEQ ID NO: 4269513 - DNA, 15 bp, Homo sapiens
taaaaaataacatat

SEQ ID NO: 4269514 - DNA, 12 bp, Homo sapiens
taaaaaataact

SEQ ID NO: 4269515 - DNA, 15 bp, Homo sapiens
taaaaaataactgtg

SEQ ID NO: 4269516 - DNA, 15 bp, Homo sapiens
taaaaacacctaagt

SEQ ID NO: 4269517 - DNA, 19 bp, Homo sapiens
taaaaactgcccattgtaa

SEQ ID NO: 4269518 - DNA, 14 bp, Homo sapiens
taaaaagagaaggc

SEQ ID NO: 4269519 - DNA, 19 bp, Homo sapiens
taaaaagccaagtgtcctg

SEQ ID NO: 4269520 - DNA, 15 bp, Homo sapiens
taaaaagttgcacat

SEQ ID NO: 4269521 - DNA, 16 bp, Homo sapiens
taaaaatatgtgagca

SEQ ID NO: 4269522 - DNA, 19 bp, Homo sapiens
taaaaatatgtgagcatga

SEQ ID NO: 4269523 - DNA, 20 bp, Homo sapiens
taaaaatatgtgagcatgaa

SEQ ID NO: 4269524 - DNA, 15 bp, Homo sapiens
taaaaatattctcca

SEQ ID NO: 4269525 - DNA, 14 bp, Homo sapiens
taaaaattccacca

SEQ ID NO: 4269526 - DNA, 21 bp, Homo sapiens
taaaaattctagattaccatg

SEQ ID NO: 4269527 - DNA, 14 bp, Homo sapiens
taaaacaaattaaa

SEQ ID NO: 4269528 - DNA, 16 bp, Homo sapiens
taaaacagtgtttcca

SEQ ID NO: 4269529 - DNA, 18 bp, Homo sapiens
taaaacagtgtttccagt

SEQ ID NO: 4269530 - DNA, 16 bp, Homo sapiens
taaaacttttctgctg

SEQ ID NO: 4269531 - DNA, 22 bp, Homo sapiens
taaaagctatcttcatgtaaat

SEQ ID NO: 4269532 - DNA, 16 bp, Homo sapiens
taaaagtgtccattga

SEQ ID NO: 4269533 - DNA, 18 bp, Homo sapiens
taaaataatgatttaagc

SEQ ID NO: 4269534 - DNA, 20 bp, Homo sapiens
taaaatacatggtatctctt

SEQ ID NO: 4269535 - DNA, 22 bp, Homo sapiens
taaaatacttctttttacaatg

SEQ ID NO: 4269536 - DNA, 14 bp, Homo sapiens
taaaatagttttct

SEQ ID NO: 4269537 - DNA, 18 bp, Homo sapiens
taaaatagttttctaaat

SEQ ID NO: 4269538 - DNA, 22 bp, Homo sapiens
taaaatagttttctaaatgttt

SEQ ID NO: 4269539 - DNA, 21 bp, Homo sapiens
taaaatcaaatttttctggga

SEQ ID NO: 4269540 - DNA, 15 bp, Homo sapiens
taaaattacagaaga

SEQ ID NO: 4269541 - DNA, 16 bp, Homo sapiens
taaaattacagaagaa

SEQ ID NO: 4269542 - DNA, 14 bp, Homo sapiens
taaaattatactgt

SEQ ID NO: 4269543 - DNA, 18 bp, Homo sapiens
taaaattcaacaaatgat

SEQ ID NO: 4269544 - DNA, 12 bp, Homo sapiens
taaaattctagt

SEQ ID NO: 4269545 - DNA, 13 bp, Homo sapiens
taaaattctagtc

SEQ ID NO: 4269546 - DNA, 19 bp, Homo sapiens
taaaattctagtctctgat

SEQ ID NO: 4269547 - DNA, 17 bp, Homo sapiens
taaaattcttgggagtg

SEQ ID NO: 4269548 - DNA, 17 bp, Homo sapiens
taaacacagattatttg

SEQ ID NO: 4269549 - DNA, 22 bp, Homo sapiens
taaacagttgcacagcatctca

SEQ ID NO: 4269550 - DNA, 14 bp, Homo sapiens
taaaccattgtgca

SEQ ID NO: 4269551 - DNA, 14 bp, Homo sapiens
taaactgttaactt

SEQ ID NO: 4269552 - DNA, 15 bp, Homo sapiens
taaactgttttcatg

SEQ ID NO: 4269553 - DNA, 16 bp, Homo sapiens
taaagaaaggcagaga

SEQ ID NO: 4269554 - DNA, 17 bp, Homo sapiens
taaagaaaggcagagat

SEQ ID NO: 4269555 - DNA, 17 bp, Homo sapiens
taaagaagaaaataacc

SEQ ID NO: 4269556 - DNA, 15 bp, Homo sapiens
taaagacacctactg

SEQ ID NO: 4269557 - DNA, 13 bp, Homo sapiens
taaagacatttaa

SEQ ID NO: 4269558 - DNA, 18 bp, Homo sapiens
taaagaccatttagtcct

SEQ ID NO: 4269559 - DNA, 17 bp, Homo sapiens
taaagacttgatgaata

SEQ ID NO: 4269560 - DNA, 19 bp, Homo sapiens
taaagaggagcctttccag

SEQ ID NO: 4269561 - DNA, 20 bp, Homo sapiens
taaaggggacagatcttgag

SEQ ID NO: 4269562 - DNA, 23 bp, Homo sapiens
taaagggtgtgggtcagggaggg

SEQ ID NO: 4269563 - DNA, 13 bp, Homo sapiens
taaagtgaccagg

SEQ ID NO: 4269564 - DNA, 21 bp, Homo sapiens
taaagttagggcatttttctt

SEQ ID NO: 4269565 - DNA, 14 bp, Homo sapiens
taaataatctcatc

SEQ ID NO: 4269566 - DNA, 16 bp, Homo sapiens
taaatagcatctgctc

SEQ ID NO: 4269567 - DNA, 14 bp, Homo sapiens
taaatatatattta

SEQ ID NO: 4269568 - DNA, 13 bp, Homo sapiens
taaatatgaaatt

SEQ ID NO: 4269569 - DNA, 15 bp, Homo sapiens
taaatccattttcta

SEQ ID NO: 4269570 - DNA, 17 bp, Homo sapiens
taaatccattttctaaa

SEQ ID NO: 4269571 - DNA, 20 bp, Homo sapiens
taaatccattttctaaactg

SEQ ID NO: 4269572 - DNA, 16 bp, Homo sapiens
taaatctgtctgattc

SEQ ID NO: 4269573 - DNA, 18 bp, Homo sapiens
taaatctgtctgattcta

SEQ ID NO: 4269574 - DNA, 16 bp, Homo sapiens
taaatgattccaaata

SEQ ID NO: 4269575 - DNA, 21 bp, Homo sapiens
taaatgctttgtgtgattgaa

SEQ ID NO: 4269576 - DNA, 15 bp, Homo sapiens
taaatggtgagaatt

SEQ ID NO: 4269577 - DNA, 21 bp, Homo sapiens
taaatgtagcttcagtcatta

SEQ ID NO: 4269578 - DNA, 12 bp, Homo sapiens
taaatgtttctt

SEQ ID NO: 4269579 - DNA, 19 bp, Homo sapiens
taaattacaattgtcattt

SEQ ID NO: 4269580 - DNA, 16 bp, Homo sapiens
taaattatttctaaaa

SEQ ID NO: 4269581 - DNA, 21 bp, Homo sapiens
taaattcaacacttattttct

SEQ ID NO: 4269582 - DNA, 12 bp, Homo sapiens
taaattgactgt

SEQ ID NO: 4269583 - DNA, 20 bp, Homo sapiens
taaattggtgataagtggaa

SEQ ID NO: 4269584 - DNA, 23 bp, Homo sapiens
taaattggtgataagtggaaaaa

SEQ ID NO: 4269585 - DNA, 16 bp, Homo sapiens
taaatttaatatactg

SEQ ID NO: 4269586 - DNA, 14 bp, Homo sapiens
taaattttaatgta

SEQ ID NO: 4269587 - DNA, 16 bp, Homo sapiens
taaattttaatgtaaa

SEQ ID NO: 4269588 - DNA, 22 bp, Homo sapiens
taaattttaatgtaaaattcat

SEQ ID NO: 4269589 - DNA, 13 bp, Homo sapiens
taaattttcagaa

SEQ ID NO: 4269590 - DNA, 17 bp, Homo sapiens
taacaattaattgtctt

SEQ ID NO: 4269591 - DNA, 15 bp, Homo sapiens
taacataggcaagag

SEQ ID NO: 4269592 - DNA, 18 bp, Homo sapiens
taacataggcaagaggag

SEQ ID NO: 4269593 - DNA, 23 bp, Homo sapiens
taacatattcttgctttcacaaa

SEQ ID NO: 4269594 - DNA, 17 bp, Homo sapiens
taacatctctttcatct

SEQ ID NO: 4269595 - DNA, 17 bp, Homo sapiens
taacatctgaaaagaaa

SEQ ID NO: 4269596 - DNA, 18 bp, Homo sapiens
taacatctgaaaagaaat

SEQ ID NO: 4269597 - DNA, 19 bp, Homo sapiens
taacattctatttcaactt

SEQ ID NO: 4269598 - DNA, 15 bp, Homo sapiens
taacatttttcaata

SEQ ID NO: 4269599 - DNA, 14 bp, Homo sapiens
taaccaaaaaatgt

SEQ ID NO: 4269600 - DNA, 21 bp, Homo sapiens
taaccacaactttcactataa

SEQ ID NO: 4269601 - DNA, 20 bp, Homo sapiens
taaccatatgattgaaaaga

SEQ ID NO: 4269602 - DNA, 15 bp, Homo sapiens
taactactaagaata

SEQ ID NO: 4269603 - DNA, 13 bp, Homo sapiens
taactagatctcc

SEQ ID NO: 4269604 - DNA, 14 bp, Homo sapiens
taactcatctgtca

SEQ ID NO: 4269605 - DNA, 14 bp, Homo sapiens
taactgcatataga

SEQ ID NO: 4269606 - DNA, 17 bp, Homo sapiens
taactgcatatagataa

SEQ ID NO: 4269607 - DNA, 16 bp, Homo sapiens
taactgtatatttgta

SEQ ID NO: 4269608 - DNA, 17 bp, Homo sapiens
taactgtatatttgtat

SEQ ID NO: 4269609 - DNA, 19 bp, Homo sapiens
taactgtatatttgtatga

SEQ ID NO: 4269610 - DNA, 20 bp, Homo sapiens
taactgttacagtaatgtca

SEQ ID NO: 4269611 - DNA, 16 bp, Homo sapiens
taacttttgtgtgaaa

SEQ ID NO: 4269612 - DNA, 19 bp, Homo sapiens
taagaaagctatatatgaa

SEQ ID NO: 4269613 - DNA, 18 bp, Homo sapiens
taagaaatatctgtgaaa

SEQ ID NO: 4269614 - DNA, 19 bp, Homo sapiens
taagaaatatctgtgaaat

SEQ ID NO: 4269615 - DNA, 17 bp, Homo sapiens
taagaataaataaagaa

SEQ ID NO: 4269616 - DNA, 17 bp, Homo sapiens
taagacagcatgtgtta

SEQ ID NO: 4269617 - DNA, 18 bp, Homo sapiens
taagaggacgccttcagg

SEQ ID NO: 4269618 - DNA, 18 bp, Homo sapiens
taagattgtacatatgga

SEQ ID NO: 4269619 - DNA, 18 bp, Homo sapiens
taagattttattttcaag

SEQ ID NO: 4269620 - DNA, 17 bp, Homo sapiens
taagccactggtatctg

SEQ ID NO: 4269621 - DNA, 20 bp, Homo sapiens
taagccatatgacaatttca

SEQ ID NO: 4269622 - DNA, 22 bp, Homo sapiens
taagccatatgacaatttcaaa

SEQ ID NO: 4269623 - DNA, 19 bp, Homo sapiens
taagcctcaggcctggccc

SEQ ID NO: 4269624 - DNA, 13 bp, Homo sapiens
taagcctgatgat

SEQ ID NO: 4269625 - DNA, 16 bp, Homo sapiens
taagctgctctattgt

SEQ ID NO: 4269626 - DNA, 14 bp, Homo sapiens
taagcttatttcta

SEQ ID NO: 4269627 - DNA, 15 bp, Homo sapiens
taagcttatttctaa

SEQ ID NO: 4269628 - DNA, 22 bp, Homo sapiens
taaggacttgtgcctcttggga

SEQ ID NO: 4269629 - DNA, 20 bp, Homo sapiens
taaggcaacatttccgaaga

SEQ ID NO: 4269630 - DNA, 21 bp, Homo sapiens
tatgtgaaagtgtaaaataga

SEQ ID NO: 4269631 - DNA, 14 bp, Homo sapiens
tatgtgagcatgaa

SEQ ID NO: 4269632 - DNA, 22 bp, Homo sapiens
tatgtgagcatgaaactatgca

SEQ ID NO: 4269633 - DNA, 18 bp, Homo sapiens
tatgtgtgtttctgtcct

SEQ ID NO: 4269634 - DNA, 14 bp, Homo sapiens
tatgttaagctctt

SEQ ID NO: 4269635 - DNA, 19 bp, Homo sapiens
tatgttaagctctttatga

SEQ ID NO: 4269636 - DNA, 13 bp, Homo sapiens
tatgttgctgaaa

SEQ ID NO: 4269637 - DNA, 16 bp, Homo sapiens
tatgttgctgaaacac

SEQ ID NO: 4269638 - DNA, 19 bp, Homo sapiens
tattacaatggccagccca

SEQ ID NO: 4269639 - DNA, 17 bp, Homo sapiens
tattactaaattgacct

SEQ ID NO: 4269640 - DNA, 21 bp, Homo sapiens
tattagagtgcccttaaaata

SEQ ID NO: 4269641 - DNA, 19 bp, Homo sapiens
tattagccaaagaggcatt

SEQ ID NO: 4269642 - DNA, 21 bp, Homo sapiens
tattatgtcctgtgagatgtg

SEQ ID NO: 4269643 - DNA, 19 bp, Homo sapiens
tattcaactaatacatggt

SEQ ID NO: 4269644 - DNA, 17 bp, Homo sapiens
tattcagagatgtacca

SEQ ID NO: 4269645 - DNA, 24 bp, Homo sapiens
tattcaggaccccatctgctgagc

SEQ ID NO: 4269646 - DNA, 15 bp, Homo sapiens
tattcatactttcca

SEQ ID NO: 4269647 - DNA, 15 bp, Homo sapiens
tattcccaggcaggg

SEQ ID NO: 4269648 - DNA, 23 bp, Homo sapiens
tattcccatggtagactgtgaca

SEQ ID NO: 4269649 - DNA, 19 bp, Homo sapiens
tattctaagaaatatctgt

SEQ ID NO: 4269650 - DNA, 20 bp, Homo sapiens
tattctagtcaactgctgtt

SEQ ID NO: 4269651 - DNA, 21 bp, Homo sapiens
tattctagtcaactgctgttt

SEQ ID NO: 4269652 - DNA, 21 bp, Homo sapiens
tattgagatcagcattcaaaa

SEQ ID NO: 4269653 - DNA, 19 bp, Homo sapiens
tattgagcaatatgtcagt

SEQ ID NO: 4269654 - DNA, 21 bp, Homo sapiens
tattgagcagaattcattcat

SEQ ID NO: 4269655 - DNA, 15 bp, Homo sapiens
tattgcagttataga

SEQ ID NO: 4269656 - DNA, 22 bp, Homo sapiens
tattgccaggaaaggagagtac

SEQ ID NO: 4269657 - DNA, 17 bp, Homo sapiens
tattgtagcatttcttg

SEQ ID NO: 4269658 - DNA, 18 bp, Homo sapiens
tattgtctgacttctcag

SEQ ID NO: 4269659 - DNA, 16 bp, Homo sapiens
tattgtctgtaaatct

SEQ ID NO: 4269660 - DNA, 14 bp, Homo sapiens
tattgtgaaatttg

SEQ ID NO: 4269661 - DNA, 16 bp, Homo sapiens
tatttaaaatgatttt

SEQ ID NO: 4269662 - DNA, 18 bp, Homo sapiens
tatttaaattttcagaaa

SEQ ID NO: 4269663 - DNA, 11 bp, Homo sapiens
tatttacaaga

SEQ ID NO: 4269664 - DNA, 16 bp, Homo sapiens
tatttacaatgtatta

SEQ ID NO: 4269665 - DNA, 11 bp, Homo sapiens
tatttagcatg

SEQ ID NO: 4269666 - DNA, 21 bp, Homo sapiens
tatttattgtatatatggata

SEQ ID NO: 4269667 - DNA, 22 bp, Homo sapiens
tatttattgtatatatggatat

SEQ ID NO: 4269668 - DNA, 17 bp, Homo sapiens
tatttattttcctcccc

SEQ ID NO: 4269669 - DNA, 15 bp, Homo sapiens
tatttcaatgtaatt

SEQ ID NO: 4269670 - DNA, 15 bp, Homo sapiens
tatttcatattgaga

SEQ ID NO: 4269671 - DNA, 13 bp, Homo sapiens
tatttccaacaaa

SEQ ID NO: 4269672 - DNA, 11 bp, Homo sapiens
tatttccatgg

SEQ ID NO: 4269673 - DNA, 20 bp, Homo sapiens
tatttctaagcttatttcta

SEQ ID NO: 4269674 - DNA, 17 bp, Homo sapiens
tatttgtagctagaata

SEQ ID NO: 4269675 - DNA, 20 bp, Homo sapiens
tatttgtcagtgtagatcaa

SEQ ID NO: 4269676 - DNA, 21 bp, Homo sapiens
tatttgtttagttcagcaaaa

SEQ ID NO: 4269677 - DNA, 20 bp, Homo sapiens
tattttagacaaccatagaa

SEQ ID NO: 4269678 - DNA, 16 bp, Homo sapiens
tattttatttcaatgt

SEQ ID NO: 4269679 - DNA, 21 bp, Homo sapiens
tattttcaacgcagccctgct

SEQ ID NO: 4269680 - DNA, 21 bp, Homo sapiens
tattttcccacaattcttttg

SEQ ID NO: 4269681 - DNA, 20 bp, Homo sapiens
tattttcgtgcatttgtgag

SEQ ID NO: 4269682 - DNA, 12 bp, Homo sapiens
tattttctgaat

SEQ ID NO: 4269683 - DNA, 22 bp, Homo sapiens
tattttctgaattcataaaaat

SEQ ID NO: 4269684 - DNA, 22 bp, Homo sapiens
tattttcttcccatttgtaatg

SEQ ID NO: 4269685 - DNA, 17 bp, Homo sapiens
tattttgtaaaatgtat

SEQ ID NO: 4269686 - DNA, 13 bp, Homo sapiens
tatttttagagat

SEQ ID NO: 4269687 - DNA, 14 bp, Homo sapiens
tattttttactaca

SEQ ID NO: 4269688 - DNA, 16 bp, Homo sapiens
tatttttttctagcta

SEQ ID NO: 4269689 - DNA, 16 bp, Homo sapiens
tatttttttgttgctg

SEQ ID NO: 4269690 - DNA, 20 bp, Homo sapiens
tatttttttgttgctgttgt

SEQ ID NO: 4269691 - DNA, 14 bp, Homo sapiens
tcaaaaacatttgt

SEQ ID NO: 4269692 - DNA, 14 bp, Homo sapiens
tcaaaaatcatcaa

SEQ ID NO: 4269693 - DNA, 18 bp, Homo sapiens
tcaaaaattgaagagaga

SEQ ID NO: 4269694 - DNA, 15 bp, Homo sapiens
tcaaaactccactca

SEQ ID NO: 4269695 - DNA, 17 bp, Homo sapiens
tcaaaagattaacaaca

SEQ ID NO: 4269696 - DNA, 15 bp, Homo sapiens
tcaaaatacttcttt

SEQ ID NO: 4269697 - DNA, 14 bp, Homo sapiens
tcaaaatattgagc

SEQ ID NO: 4269698 - DNA, 20 bp, Homo sapiens
tcaaaatattgagcagaatt

SEQ ID NO: 4269699 - DNA, 15 bp, Homo sapiens
tcaaaatgcatgtga

SEQ ID NO: 4269700 - DNA, 15 bp, Homo sapiens
tcaaacacacacaca

SEQ ID NO: 4269701 - DNA, 19 bp, Homo sapiens
tcaaacatgccctcaggct

SEQ ID NO: 4269702 - DNA, 22 bp, Homo sapiens
tcaaacatgccctcaggcttgg

SEQ ID NO: 4269703 - DNA, 17 bp, Homo sapiens
tcaaagaacccccctcc

SEQ ID NO: 4269704 - DNA, 21 bp, Homo sapiens
tcaaagagatgaggaaataag

SEQ ID NO: 4269705 - DNA, 18 bp, Homo sapiens
tcaaagtctcaatgaaat

SEQ ID NO: 4269706 - DNA, 17 bp, Homo sapiens
tcaaatctgagccttag

SEQ ID NO: 4269707 - DNA, 12 bp, Homo sapiens
tcaaatgcatga

SEQ ID NO: 4269708 - DNA, 18 bp, Homo sapiens
tcaaatttatttccaatg

SEQ ID NO: 4269709 - DNA, 16 bp, Homo sapiens
tcaaatttttctggga

SEQ ID NO: 4269710 - DNA, 14 bp, Homo sapiens
tcaacaaagaaata

SEQ ID NO: 4269711 - DNA, 20 bp, Homo sapiens
tcaacacttattttctgaat

SEQ ID NO: 4269712 - DNA, 16 bp, Homo sapiens
tcaacagtgaacagct

SEQ ID NO: 4269713 - DNA, 18 bp, Homo sapiens
tcaaccattccccatggg

SEQ ID NO: 4269714 - DNA, 19 bp, Homo sapiens
tcaacctaggagcagtggg

SEQ ID NO: 4269715 - DNA, 15 bp, Homo sapiens
tcaacgcagccctgc

SEQ ID NO: 4269716 - DNA, 17 bp, Homo sapiens
tcaactaatacatggtt

SEQ ID NO: 4269717 - DNA, 22 bp, Homo sapiens
tcaactgctgttttatgtcata

SEQ ID NO: 4269718 - DNA, 21 bp, Homo sapiens
tcaacttttcctttgaatcct

SEQ ID NO: 4269719 - DNA, 20 bp, Homo sapiens
tcaagagggcactggtggcc

SEQ ID NO: 4269720 - DNA, 13 bp, Homo sapiens
tcaagattcagct

SEQ ID NO: 4269721 - DNA, 23 bp, Homo sapiens
tcaagcaaatatttatgacctca

SEQ ID NO: 4269722 - DNA, 13 bp, Homo sapiens
tcaagccaggaga

SEQ ID NO: 4269723 - DNA, 18 bp, Homo sapiens
tcaagccaggagaccctg

SEQ ID NO: 4269724 - DNA, 13 bp, Homo sapiens
tcaagcctggccc

SEQ ID NO: 4269725 - DNA, 15 bp, Homo sapiens
tcaagcctggcccag

SEQ ID NO: 4269726 - DNA, 18 bp, Homo sapiens
tcaagctccatcttattt

SEQ ID NO: 4269727 - DNA, 18 bp, Homo sapiens
tcaagctggccgtggagt

SEQ ID NO: 4269728 - DNA, 23 bp, Homo sapiens
tcaaggaagtgataacactggag

SEQ ID NO: 4269729 - DNA, 17 bp, Homo sapiens
tcaagggactgggggtg

SEQ ID NO: 4269730 - DNA, 22 bp, Homo sapiens
tcaagggactgggggtgccaac

SEQ ID NO: 4269731 - DNA, 15 bp, Homo sapiens
tcaaggggccctagg

SEQ ID NO: 4269732 - DNA, 15 bp, Homo sapiens
tcaagtatccttgtt

SEQ ID NO: 4269733 - DNA, 15 bp, Homo sapiens
tcaagtgcatttctg

SEQ ID NO: 4269734 - DNA, 16 bp, Homo sapiens
tcaagtgcatttctgg

SEQ ID NO: 4269735 - DNA, 18 bp, Homo sapiens
tcaagtgcatttctgggc

SEQ ID NO: 4269736 - DNA, 16 bp, Homo sapiens
tcaagtttttttcaaa

SEQ ID NO: 4269737 - DNA, 20 bp, Homo sapiens
tcaataaaggtcatattgga

SEQ ID NO: 4269738 - DNA, 20 bp, Homo sapiens
tcaataattgtggagaggag

SEQ ID NO: 4269739 - DNA, 14 bp, Homo sapiens
tcaatcaaacaggg

SEQ ID NO: 4269740 - DNA, 19 bp, Homo sapiens
tcaatcaaactttcagctt

SEQ ID NO: 4269741 - DNA, 14 bp, Homo sapiens
tcaatcctgtcaat

SEQ ID NO: 4269742 - DNA, 16 bp, Homo sapiens
tcaatgaaatatttgc

SEQ ID NO: 4269743 - DNA, 17 bp, Homo sapiens
tcaatgaaatatttgct

SEQ ID NO: 4269744 - DNA, 21 bp, Homo sapiens
tcaatgaaatatttgcttatt

SEQ ID NO: 4269745 - DNA, 21 bp, Homo sapiens
tcaatgttcacgcaacttgaa

SEQ ID NO: 4269746 - DNA, 22 bp, Homo sapiens
tcacaaagtgagaaattatgaa

SEQ ID NO: 4269747 - DNA, 16 bp, Homo sapiens
tcacaacttttctgct

SEQ ID NO: 4269748 - DNA, 15 bp, Homo sapiens
tcacaataaagtgta

SEQ ID NO: 4269749 - DNA, 16 bp, Homo sapiens
tcacaataattttcta

SEQ ID NO: 4269750 - DNA, 21 bp, Homo sapiens
tcacactctaactgtatattt

SEQ ID NO: 4269751 - DNA, 16 bp, Homo sapiens
tcacactctcttctta

SEQ ID NO: 4269752 - DNA, 15 bp, Homo sapiens
tcacagcagtacttg

SEQ ID NO: 4269753 - DNA, 17 bp, Homo sapiens
tcacagcagtacttgct

SEQ ID NO: 4269754 - DNA, 21 bp, Homo sapiens
tcacatatcaagtcccgaggc

SEQ ID NO: 4269755 - DNA, 22 bp, Homo sapiens
tcacatatcaagtcccgaggca

SEQ ID NO: 4269756 - DNA, 23 bp, Homo sapiens
tcacatatttgtagctagaatat

SEQ ID NO: 4269757 - DNA, 17 bp, Homo sapiens
tcacatcatgtaatagt

SEQ ID NO: 4269758 - DNA, 19 bp, Homo sapiens
tcacatgtcctattactga

SEQ ID NO: 4269759 - DNA, 23 bp, Homo sapiens
tcacatttaatatcctgcctttt

SEQ ID NO: 4269760 - DNA, 15 bp, Homo sapiens
tccctgcagggtagg

SEQ ID NO: 4269761 - DNA, 22 bp, Homo sapiens
tccctgcagggtagggggcctg

SEQ ID NO: 4269762 - DNA, 15 bp, Homo sapiens
tccctgccccgcccc

SEQ ID NO: 4269763 - DNA, 11 bp, Homo sapiens
tccctgcctgg

SEQ ID NO: 4269764 - DNA, 12 bp, Homo sapiens
tccctgcctggc

SEQ ID NO: 4269765 - DNA, 18 bp, Homo sapiens
tccctggacgcatgcagg

SEQ ID NO: 4269766 - DNA, 22 bp, Homo sapiens
tccctggacgcatgcagggccc

SEQ ID NO: 4269767 - DNA, 13 bp, Homo sapiens
tccctggactctg

SEQ ID NO: 4269768 - DNA, 13 bp, Homo sapiens
tccctgtcatagt

SEQ ID NO: 4269769 - DNA, 14 bp, Homo sapiens
tccctgtcccctga

SEQ ID NO: 4269770 - DNA, 21 bp, Homo sapiens
tcccttcaaccattccccatg

SEQ ID NO: 4269771 - DNA, 15 bp, Homo sapiens
tcccttcaactgtat

SEQ ID NO: 4269772 - DNA, 16 bp, Homo sapiens
tcccttggcccctctc

SEQ ID NO: 4269773 - DNA, 17 bp, Homo sapiens
tccgactcttctgagca

SEQ ID NO: 4269774 - DNA, 11 bp, Homo sapiens
tccgccctggg

SEQ ID NO: 4269775 - DNA, 13 bp, Homo sapiens
tccgcccttccct

SEQ ID NO: 4269776 - DNA, 15 bp, Homo sapiens
tccgctaaggcttcc

SEQ ID NO: 4269777 - DNA, 16 bp, Homo sapiens
tccgctaaggcttccg

SEQ ID NO: 4269778 - DNA, 13 bp, Homo sapiens
tccgctctgaggc

SEQ ID NO: 4269779 - DNA, 12 bp, Homo sapiens
tccggccctgcc

SEQ ID NO: 4269780 - DNA, 15 bp, Homo sapiens
tccggccctgcccca

SEQ ID NO: 4269781 - DNA, 18 bp, Homo sapiens
tccggctgagctgtgcca

SEQ ID NO: 4269782 - DNA, 24 bp, Homo sapiens
tccggctgagctgtgccagctgct

SEQ ID NO: 4269783 - DNA, 13 bp, Homo sapiens
tccgtcatgctcc

SEQ ID NO: 4269784 - DNA, 12 bp, Homo sapiens
tccgtgtctgtt

SEQ ID NO: 4269785 - DNA, 18 bp, Homo sapiens
tcctacccgcccgcgtcc

SEQ ID NO: 4269786 - DNA, 22 bp, Homo sapiens
tcctacccgcccgcgtccaacc

SEQ ID NO: 4269787 - DNA, 18 bp, Homo sapiens
tcctagaatgtttcattt

SEQ ID NO: 4269788 - DNA, 21 bp, Homo sapiens
tcctagcacaaggagtgcccg

SEQ ID NO: 4269789 - DNA, 14 bp, Homo sapiens
tcctatcacctccc

SEQ ID NO: 4269790 - DNA, 17 bp, Homo sapiens
tcctatcacctcccctc

SEQ ID NO: 4269791 - DNA, 21 bp, Homo sapiens
tcctatgagagaagagagtat

SEQ ID NO: 4269792 - DNA, 14 bp, Homo sapiens
tcctcaaaaatcat

SEQ ID NO: 4269793 - DNA, 19 bp, Homo sapiens
tcctcagcaagtgctgagt

SEQ ID NO: 4269794 - DNA, 12 bp, Homo sapiens
tcctcagcccca

SEQ ID NO: 4269795 - DNA, 23 bp, Homo sapiens
tcctcagccccagggccctgctc

SEQ ID NO: 4269796 - DNA, 20 bp, Homo sapiens
tcctcaggcagtggcccagg

SEQ ID NO: 4269797 - DNA, 21 bp, Homo sapiens
tcctcaggcagtggcccaggg

SEQ ID NO: 4269798 - DNA, 19 bp, Homo sapiens
tcctcccaactctggcctt

SEQ ID NO: 4269799 - DNA, 19 bp, Homo sapiens
tcctcccaggcgccccttc

SEQ ID NO: 4269800 - DNA, 10 bp, Homo sapiens
tcctccccag

SEQ ID NO: 4269801 - DNA, 23 bp, Homo sapiens
tcctccccgatccccgacagtgg

SEQ ID NO: 4269802 - DNA, 13 bp, Homo sapiens
tcctccccttccc

SEQ ID NO: 4269803 - DNA, 15 bp, Homo sapiens
tcctccccttccctg

SEQ ID NO: 4269804 - DNA, 18 bp, Homo sapiens
tcctccccttccctgcaa

SEQ ID NO: 4269805 - DNA, 17 bp, Homo sapiens
tcctccgtcacctcaga

SEQ ID NO: 4269806 - DNA, 19 bp, Homo sapiens
tcctccttccaggccccag

SEQ ID NO: 4269807 - DNA, 14 bp, Homo sapiens
tcctcggccagagc

SEQ ID NO: 4269808 - DNA, 16 bp, Homo sapiens
tcctcggccagagctc

SEQ ID NO: 4269809 - DNA, 18 bp, Homo sapiens
tcctcggccagagctccc

SEQ ID NO: 4269810 - DNA, 13 bp, Homo sapiens
tcctctccactgc

SEQ ID NO: 4269811 - DNA, 18 bp, Homo sapiens
tcctctccactgccttcg

SEQ ID NO: 4269812 - DNA, 15 bp, Homo sapiens
tcctctctctccctc

SEQ ID NO: 4269813 - DNA, 21 bp, Homo sapiens
tcctctgaggatgatgtactt

SEQ ID NO: 4269814 - DNA, 22 bp, Homo sapiens
tcctctgccttggacaccatcc

SEQ ID NO: 4269815 - DNA, 13 bp, Homo sapiens
tcctgaggagcag

SEQ ID NO: 4269816 - DNA, 14 bp, Homo sapiens
tcctgattattgaa

SEQ ID NO: 4269817 - DNA, 17 bp, Homo sapiens
tcctgcactgtcccgga

SEQ ID NO: 4269818 - DNA, 15 bp, Homo sapiens
tcctgcagcagagcc

SEQ ID NO: 4269819 - DNA, 18 bp, Homo sapiens
tcctgcatccctccaccc

SEQ ID NO: 4269820 - DNA, 21 bp, Homo sapiens
tcctgccttttaccttcagta

SEQ ID NO: 4269821 - DNA, 20 bp, Homo sapiens
tcctgctacagtagctgtgg

SEQ ID NO: 4269822 - DNA, 13 bp, Homo sapiens
tcctgctcagatg

SEQ ID NO: 4269823 - DNA, 14 bp, Homo sapiens
tcctggatcccttt

SEQ ID NO: 4269824 - DNA, 14 bp, Homo sapiens
tcctggattttctt

SEQ ID NO: 4269825 - DNA, 20 bp, Homo sapiens
tcctggattttctttctatg

SEQ ID NO: 4269826 - DNA, 21 bp, Homo sapiens
tcctggattttctttctatgt

SEQ ID NO: 4269827 - DNA, 19 bp, Homo sapiens
tcctggcagggcaggcaga

SEQ ID NO: 4269828 - DNA, 22 bp, Homo sapiens
tcctggcagggcaggcagagct

SEQ ID NO: 4269829 - DNA, 14 bp, Homo sapiens
tcctggctcccagg

SEQ ID NO: 4269830 - DNA, 16 bp, Homo sapiens
tcctggctcccagggt

SEQ ID NO: 4269831 - DNA, 14 bp, Homo sapiens
tcctgggcatctgg

SEQ ID NO: 4269832 - DNA, 15 bp, Homo sapiens
tcctgggcatctggc

SEQ ID NO: 4269833 - DNA, 23 bp, Homo sapiens
tcctgggcatctggccctgctgc

SEQ ID NO: 4269834 - DNA, 17 bp, Homo sapiens
tcctgggggctgctgca

SEQ ID NO: 4269835 - DNA, 19 bp, Homo sapiens
tcctggggtggttggaggc

SEQ ID NO: 4269836 - DNA, 13 bp, Homo sapiens
tcctggtgtctag

SEQ ID NO: 4269837 - DNA, 16 bp, Homo sapiens
tcctggtgtctagttt

SEQ ID NO: 4269838 - DNA, 13 bp, Homo sapiens
tcctgtaactgtt

SEQ ID NO: 4269839 - DNA, 15 bp, Homo sapiens
tcctgtaattttgta

SEQ ID NO: 4269840 - DNA, 14 bp, Homo sapiens
tcctgtccagagag

SEQ ID NO: 4269841 - DNA, 17 bp, Homo sapiens
tcctgtcctggctccca

SEQ ID NO: 4269842 - DNA, 15 bp, Homo sapiens
tcctgtgagatgtgt

SEQ ID NO: 4269843 - DNA, 17 bp, Homo sapiens
tcctgtgagatgtgtat

SEQ ID NO: 4269844 - DNA, 14 bp, Homo sapiens
tcctgtgcacagcc

SEQ ID NO: 4269845 - DNA, 21 bp, Homo sapiens
tcctgtggcggtgcagtggca

SEQ ID NO: 4269846 - DNA, 16 bp, Homo sapiens
tcctgttctcagagct

SEQ ID NO: 4269847 - DNA, 17 bp, Homo sapiens
tcctgttctgtgtctgc

SEQ ID NO: 4269848 - DNA, 20 bp, Homo sapiens
tccttagaaaagactgacct

SEQ ID NO: 4269849 - DNA, 13 bp, Homo sapiens
tccttccaggccc

SEQ ID NO: 4269850 - DNA, 16 bp, Homo sapiens
tccttccaggccccag

SEQ ID NO: 4269851 - DNA, 14 bp, Homo sapiens
tccttcccacggcc

SEQ ID NO: 4269852 - DNA, 13 bp, Homo sapiens
tccttcctgttct

SEQ ID NO: 4269853 - DNA, 20 bp, Homo sapiens
tccttcctgttctgtgtctg

SEQ ID NO: 4269854 - DNA, 19 bp, Homo sapiens
tccttctcccctccagacc

SEQ ID NO: 4269855 - DNA, 21 bp, Homo sapiens
tccttctcccctccagacccc

SEQ ID NO: 4269856 - DNA, 14 bp, Homo sapiens
tccttctgacccca

SEQ ID NO: 4269857 - DNA, 22 bp, Homo sapiens
tccttgattttagccttctctg

SEQ ID NO: 4269858 - DNA, 16 bp, Homo sapiens
tccttgccgctgggag

SEQ ID NO: 4269859 - DNA, 16 bp, Homo sapiens
tccttggcccagcagc

SEQ ID NO: 4269860 - DNA, 13 bp, Homo sapiens
tccttgtcagttg

SEQ ID NO: 4269861 - DNA, 18 bp, Homo sapiens
tcctttcacaaccttctg

SEQ ID NO: 4269862 - DNA, 19 bp, Homo sapiens
tcgaagctcagcccacccc

SEQ ID NO: 4269863 - DNA, 16 bp, Homo sapiens
tcgaagctgttctctg

SEQ ID NO: 4269864 - DNA, 18 bp, Homo sapiens
tcgaagctgttctctgct

SEQ ID NO: 4269865 - DNA, 14 bp, Homo sapiens
tcgaagtcttccat

SEQ ID NO: 4269866 - DNA, 20 bp, Homo sapiens
tcgaagtcttccatcagcag

SEQ ID NO: 4269867 - DNA, 15 bp, Homo sapiens
tcgacctcactgtca

SEQ ID NO: 4269868 - DNA, 18 bp, Homo sapiens
tcgccatgtgctgtgcac

SEQ ID NO: 4269869 - DNA, 13 bp, Homo sapiens
tcgcccctccagt

SEQ ID NO: 4269870 - DNA, 18 bp, Homo sapiens
tcgcctcaggctttttcc

SEQ ID NO: 4269871 - DNA, 20 bp, Homo sapiens
tcgcctcaggctttttccat

SEQ ID NO: 4269872 - DNA, 17 bp, Homo sapiens
tcgcctctcactctggc

SEQ ID NO: 4269873 - DNA, 12 bp, Homo sapiens
tcgccttctggc

SEQ ID NO: 4269874 - DNA, 15 bp, Homo sapiens
tcgccttctggctgc

SEQ ID NO: 4269875 - DNA, 14 bp, Homo sapiens
tcgcggctgggagc

SEQ ID NO: 4269876 - DNA, 21 bp, Homo sapiens
tcgcggctgggagcctcgccc

SEQ ID NO: 4269877 - DNA, 15 bp, Homo sapiens
tcgctattcccaggc

SEQ ID NO: 4269878 - DNA, 22 bp, Homo sapiens
tcgctattcccaggcagggagg

SEQ ID NO: 4269879 - DNA, 20 bp, Homo sapiens
tcggcaacagggcttctctt

SEQ ID NO: 4269880 - DNA, 21 bp, Homo sapiens
tcggcaacagggcttctcttt

SEQ ID NO: 4269881 - DNA, 15 bp, Homo sapiens
tcggccagagctccc

SEQ ID NO: 4269882 - DNA, 18 bp, Homo sapiens
tcggccagagctcccagg

SEQ ID NO: 4269883 - DNA, 14 bp, Homo sapiens
tcggccgaggcctg

SEQ ID NO: 4269884 - DNA, 20 bp, Homo sapiens
tcggcgccttctacctgcag

SEQ ID NO: 4269885 - DNA, 21 bp, Homo sapiens
tcgggaagatcctccttccag

SEQ ID NO: 4269886 - DNA, 13 bp, Homo sapiens
tcgggacttcaaa

SEQ ID NO: 4269887 - DNA, 20 bp, Homo sapiens
tcgggctaagtccagctctc

SEQ ID NO: 4269888 - DNA, 23 bp, Homo sapiens
tcggtgggagccgtcagcctgtg

SEQ ID NO: 4269889 - DNA, 17 bp, Homo sapiens
tcggttcaggaggagac

SEQ ID NO: 4269890 - DNA, 23 bp, Homo sapiens
tcgtggaaagggtgctgcttccc

SEQ ID NO: 4269891 - DNA, 16 bp, Homo sapiens
tgaccaatctctgtga

SEQ ID NO: 4269892 - DNA, 19 bp, Homo sapiens
tgaccaatctctgtgactc

SEQ ID NO: 4269893 - DNA, 18 bp, Homo sapiens
tgaccacacttcctgtcc

SEQ ID NO: 4269894 - DNA, 18 bp, Homo sapiens
tgaccagaagtggcagga

SEQ ID NO: 4269895 - DNA, 20 bp, Homo sapiens
tgaccagaagtggcaggagg

SEQ ID NO: 4269896 - DNA, 13 bp, Homo sapiens
tgaccccagctcc

SEQ ID NO: 4269897 - DNA, 17 bp, Homo sapiens
tgaccccagctccaggc

SEQ ID NO: 4269898 - DNA, 13 bp, Homo sapiens
tgacccctcatct

SEQ ID NO: 4269899 - DNA, 17 bp, Homo sapiens
tgacccggaggccacat

SEQ ID NO: 4269900 - DNA, 22 bp, Homo sapiens
tgacccggcccccgccctctgc

SEQ ID NO: 4269901 - DNA, 12 bp, Homo sapiens
tgaccctggagc

SEQ ID NO: 4269902 - DNA, 16 bp, Homo sapiens
tgaccctggagcccgg

SEQ ID NO: 4269903 - DNA, 18 bp, Homo sapiens
tgacccttctgtctgtaa

SEQ ID NO: 4269904 - DNA, 20 bp, Homo sapiens
tgacctaaatccattttcta

SEQ ID NO: 4269905 - DNA, 21 bp, Homo sapiens
tgacctaaatccattttctaa

SEQ ID NO: 4269906 - DNA, 23 bp, Homo sapiens
tgacctgtggggatttctcccag

SEQ ID NO: 4269907 - DNA, 17 bp, Homo sapiens
tgaccttctgcggctcc

SEQ ID NO: 4269908 - DNA, 15 bp, Homo sapiens
tgactaaaccattgt

SEQ ID NO: 4269909 - DNA, 20 bp, Homo sapiens
tgactaccacttatttctaa

SEQ ID NO: 4269910 - DNA, 15 bp, Homo sapiens
tgactccaaccattc

SEQ ID NO: 4269911 - DNA, 14 bp, Homo sapiens
tgactccaggagag

SEQ ID NO: 4269912 - DNA, 18 bp, Homo sapiens
tgactctttattgtctgt

SEQ ID NO: 4269913 - DNA, 19 bp, Homo sapiens
tgactggtgcgttcctaaa

SEQ ID NO: 4269914 - DNA, 17 bp, Homo sapiens
tgacttcagactctctc

SEQ ID NO: 4269915 - DNA, 19 bp, Homo sapiens
tgacttcagactctctcct

SEQ ID NO: 4269916 - DNA, 22 bp, Homo sapiens
tgacttcagactctctcctctc

SEQ ID NO: 4269917 - DNA, 14 bp, Homo sapiens
tgactttagaaaca

SEQ ID NO: 4269918 - DNA, 19 bp, Homo sapiens
tgagaaaagctttgaaccc

SEQ ID NO: 4269919 - DNA, 19 bp, Homo sapiens
tgagaaatttttttccaga

SEQ ID NO: 4269920 - DNA, 19 bp, Homo sapiens
tgagaagcctcatgggagt

SEQ ID NO: 4269921 - DNA, 17 bp, Homo sapiens
tgagaatgcctaggcca

SEQ ID NO: 4269922 - DNA, 21 bp, Homo sapiens
tgagaatgcctaggccagctc

SEQ ID NO: 4269923 - DNA, 22 bp, Homo sapiens
tgagaatgcctaggccagctcc

SEQ ID NO: 4269924 - DNA, 15 bp, Homo sapiens
tgagaattaaaataa

SEQ ID NO: 4269925 - DNA, 16 bp, Homo sapiens
tgagagaagagagtat

SEQ ID NO: 4269926 - DNA, 15 bp, Homo sapiens
tgagagagtgtggaa

SEQ ID NO: 4269927 - DNA, 16 bp, Homo sapiens
tgagagcgctggcctc

SEQ ID NO: 4269928 - DNA, 13 bp, Homo sapiens
tgagagtgaggcc

SEQ ID NO: 4269929 - DNA, 20 bp, Homo sapiens
tgagatcagcattcaaaata

SEQ ID NO: 4269930 - DNA, 15 bp, Homo sapiens
tgagatgtgtatcag

SEQ ID NO: 4269931 - DNA, 17 bp, Homo sapiens
tgagatgtgtatcagtg

SEQ ID NO: 4269932 - DNA, 13 bp, Homo sapiens
tgagattctaaat

SEQ ID NO: 4269933 - DNA, 14 bp, Homo sapiens
tgagatttgtattt

SEQ ID NO: 4269934 - DNA, 19 bp, Homo sapiens
tgagcaaggcaagaagtgg

SEQ ID NO: 4269935 - DNA, 21 bp, Homo sapiens
tgagcaaggcaagaagtggga

SEQ ID NO: 4269936 - DNA, 21 bp, Homo sapiens
tgagcagttgttatattcatt

SEQ ID NO: 4269937 - DNA, 19 bp, Homo sapiens
tgagccagctctgtcccag

SEQ ID NO: 4269938 - DNA, 13 bp, Homo sapiens
tgagccctgccct

SEQ ID NO: 4269939 - DNA, 21 bp, Homo sapiens
tgagcggccgcctgtccttgg

SEQ ID NO: 4269940 - DNA, 12 bp, Homo sapiens
tgagctccagac

SEQ ID NO: 4269941 - DNA, 16 bp, Homo sapiens
tgagctccagaccccc

SEQ ID NO: 4269942 - DNA, 18 bp, Homo sapiens
tgagctccagacccccag

SEQ ID NO: 4269943 - DNA, 20 bp, Homo sapiens
tgagctccagacccccagca

SEQ ID NO: 4269944 - DNA, 13 bp, Homo sapiens
tgagctcctctgg

SEQ ID NO: 4269945 - DNA, 14 bp, Homo sapiens
tgagctcctctggg

SEQ ID NO: 4269946 - DNA, 19 bp, Homo sapiens
tgagctcctctgggcagga

SEQ ID NO: 4269947 - DNA, 23 bp, Homo sapiens
tgagctctgacctgcccccgctc

SEQ ID NO: 4269948 - DNA, 18 bp, Homo sapiens
tgagctcttcatgtttca

SEQ ID NO: 4269949 - DNA, 15 bp, Homo sapiens
tgagctgtgccagct

SEQ ID NO: 4269950 - DNA, 16 bp, Homo sapiens
tgagctgtgccagctg

SEQ ID NO: 4269951 - DNA, 24 bp, Homo sapiens
tgagctgtgccagctgcttctgcc

SEQ ID NO: 4269952 - DNA, 13 bp, Homo sapiens
tgagcttggccag

SEQ ID NO: 4269953 - DNA, 19 bp, Homo sapiens
tgagcttggccagaagggg

SEQ ID NO: 4269954 - DNA, 12 bp, Homo sapiens
tgagctttgggc

SEQ ID NO: 4269955 - DNA, 20 bp, Homo sapiens
tgaggaaataagacttttag

SEQ ID NO: 4269956 - DNA, 13 bp, Homo sapiens
tgaggagctcagg

SEQ ID NO: 4269957 - DNA, 15 bp, Homo sapiens
tgaggagctcagggc

SEQ ID NO: 4269958 - DNA, 22 bp, Homo sapiens
tgaggagctcagggctggattg

SEQ ID NO: 4269959 - DNA, 15 bp, Homo sapiens
tgaggagggggagaa

SEQ ID NO: 4269960 - DNA, 13 bp, Homo sapiens
tgaggccagagga

SEQ ID NO: 4269961 - DNA, 16 bp, Homo sapiens
tgaggccattatttca

SEQ ID NO: 4269962 - DNA, 13 bp, Homo sapiens
tgaggcccaggga

SEQ ID NO: 4269963 - DNA, 20 bp, Homo sapiens
tgaggcccagggagaggcca

SEQ ID NO: 4269964 - DNA, 23 bp, Homo sapiens
tgaggcccagggagaggccatga

SEQ ID NO: 4269965 - DNA, 16 bp, Homo sapiens
tgagggcagggttcta

SEQ ID NO: 4269966 - DNA, 21 bp, Homo sapiens
tgagggcagggttctagaagg

SEQ ID NO: 4269967 - DNA, 14 bp, Homo sapiens
tgaggggcttccct

SEQ ID NO: 4269968 - DNA, 15 bp, Homo sapiens
tgaggtcatcccggg

SEQ ID NO: 4269969 - DNA, 19 bp, Homo sapiens
tgaggtcatcccggggcca

SEQ ID NO: 4269970 - DNA, 22 bp, Homo sapiens
tgaggtcatcccggggccatgg

SEQ ID NO: 4269971 - DNA, 15 bp, Homo sapiens
tgaggtctgctcggc

SEQ ID NO: 4269972 - DNA, 23 bp, Homo sapiens
tgaggtctgctcggccgtcttca

SEQ ID NO: 4269973 - DNA, 12 bp, Homo sapiens
tgaggtgggcct

SEQ ID NO: 4269974 - DNA, 22 bp, Homo sapiens
tgagtattcattttgcaacttg

SEQ ID NO: 4269975 - DNA, 15 bp, Homo sapiens
tgagtcccagtggga

SEQ ID NO: 4269976 - DNA, 14 bp, Homo sapiens
tgagtccttaaaca

SEQ ID NO: 4269977 - DNA, 20 bp, Homo sapiens
tgagtgacatcggttcagga

SEQ ID NO: 4269978 - DNA, 18 bp, Homo sapiens
tgagtgagaagataaaaa

SEQ ID NO: 4269979 - DNA, 18 bp, Homo sapiens
tgagtggtccacattctg

SEQ ID NO: 4269980 - DNA, 20 bp, Homo sapiens
tgagtggtccacattctgct

SEQ ID NO: 4269981 - DNA, 14 bp, Homo sapiens
tgagtgtggctccc

SEQ ID NO: 4269982 - DNA, 17 bp, Homo sapiens
tgagtgtggctcccctc

SEQ ID NO: 4269983 - DNA, 18 bp, Homo sapiens
tgagtgtggctcccctct

SEQ ID NO: 4269984 - DNA, 15 bp, Homo sapiens
tgagttcttcctgta

SEQ ID NO: 4269985 - DNA, 19 bp, Homo sapiens
tgagtttaaaaaaataaca

SEQ ID NO: 4269986 - DNA, 16 bp, Homo sapiens
tgataacactggagtg

SEQ ID NO: 4269987 - DNA, 12 bp, Homo sapiens
tgataagtggaa

SEQ ID NO: 4269988 - DNA, 13 bp, Homo sapiens
tgataagtggaaa

SEQ ID NO: 4269989 - DNA, 15 bp, Homo sapiens
tgataagtggaaaaa

SEQ ID NO: 4269990 - DNA, 14 bp, Homo sapiens
tgatacactgtatc

SEQ ID NO: 4269991 - DNA, 15 bp, Homo sapiens
tgatacactgtatct

SEQ ID NO: 4269992 - DNA, 19 bp, Homo sapiens
tgatacactgtatctaaaa

SEQ ID NO: 4269993 - DNA, 20 bp, Homo sapiens
tgatacactgtatctaaaaa

SEQ ID NO: 4269994 - DNA, 16 bp, Homo sapiens
tgatactgtctaagaa

SEQ ID NO: 4269995 - DNA, 16 bp, Homo sapiens
tgatataactttagaa

SEQ ID NO: 4269996 - DNA, 17 bp, Homo sapiens
tgatataactttagaaa

SEQ ID NO: 4269997 - DNA, 14 bp, Homo sapiens
tgatatattttcca

SEQ ID NO: 4269998 - DNA, 19 bp, Homo sapiens
tgatatctgtttgcttcta

SEQ ID NO: 4269999 - DNA, 14 bp, Homo sapiens
tgatattggtgtga

SEQ ID NO: 4270000 - DNA, 13 bp, Homo sapiens
tgatattttaaaa

SEQ ID NO: 4270001 - DNA, 20 bp, Homo sapiens
tgatgaagaaaagtgggcca

SEQ ID NO: 4270002 - DNA, 13 bp, Homo sapiens
tgatgaataaaca

SEQ ID NO: 4270003 - DNA, 17 bp, Homo sapiens
tgatgaataaacacttt

SEQ ID NO: 4270004 - DNA, 13 bp, Homo sapiens
tgatgatccatta

SEQ ID NO: 4270005 - DNA, 15 bp, Homo sapiens
tgatgatttcagaaa

SEQ ID NO: 4270006 - DNA, 16 bp, Homo sapiens
tgatggatgagaaaaa

SEQ ID NO: 4270007 - DNA, 15 bp, Homo sapiens
tgatggccaggcctc

SEQ ID NO: 4270008 - DNA, 12 bp, Homo sapiens
tgatgggtgggc

SEQ ID NO: 4270009 - DNA, 18 bp, Homo sapiens
tgatgtggagtggggcag

SEQ ID NO: 4270010 - DNA, 14 bp, Homo sapiens
tgatgtgtatgtgt

SEQ ID NO: 4270011 - DNA, 16 bp, Homo sapiens
tgatgtgtatgtgttt

SEQ ID NO: 4270012 - DNA, 13 bp, Homo sapiens
tgattattgaatg

SEQ ID NO: 4270013 - DNA, 17 bp, Homo sapiens
tgattattgaatgttat

SEQ ID NO: 4270014 - DNA, 20 bp, Homo sapiens
tgattcattttaacatctga

SEQ ID NO: 4270015 - DNA, 11 bp, Homo sapiens
tgattccaaat

SEQ ID NO: 4270016 - DNA, 16 bp, Homo sapiens
tgattcgcccaaagcc

SEQ ID NO: 4270017 - DNA, 15 bp, Homo sapiens
tgattctaaagggga

SEQ ID NO: 4270018 - DNA, 22 bp, Homo sapiens
tgattctatgcctgtatttcca

SEQ ID NO: 4270019 - DNA, 14 bp, Homo sapiens
tgattctcctctcc

SEQ ID NO: 4270020 - DNA, 22 bp, Homo sapiens
tgattgaaaagaagaaagtcta

SEQ ID NO: 4270021 - DNA, 19 bp, Homo sapiens
tgattggcagcttcaaaac

SEQ ID NO: 4270022 - DNA, 18 bp, Homo sapiens
tggatgctgggttctggg

SEQ ID NO: 4270023 - DNA, 20 bp, Homo sapiens
tggatgctgggttctggggc

SEQ ID NO: 4270024 - DNA, 21 bp, Homo sapiens
tggatgctgggttctggggct

SEQ ID NO: 4270025 - DNA, 22 bp, Homo sapiens
tggatgctgggttctggggctg

SEQ ID NO: 4270026 - DNA, 17 bp, Homo sapiens
tggatggaggtgatgaa

SEQ ID NO: 4270027 - DNA, 15 bp, Homo sapiens
tggattctatatttc

SEQ ID NO: 4270028 - DNA, 13 bp, Homo sapiens
tggattggcaggt

SEQ ID NO: 4270029 - DNA, 17 bp, Homo sapiens
tggattggcaggtgtgg

SEQ ID NO: 4270030 - DNA, 12 bp, Homo sapiens
tggatttagaga

SEQ ID NO: 4270031 - DNA, 13 bp, Homo sapiens
tggatttagagac

SEQ ID NO: 4270032 - DNA, 14 bp, Homo sapiens
tggattttctttct

SEQ ID NO: 4270033 - DNA, 23 bp, Homo sapiens
tggattttctttctatgtagaac

SEQ ID NO: 4270034 - DNA, 14 bp, Homo sapiens
tggattttgtggct

SEQ ID NO: 4270035 - DNA, 14 bp, Homo sapiens
tggcaaaggatcca

SEQ ID NO: 4270036 - DNA, 15 bp, Homo sapiens
tggcacagggcagtg

SEQ ID NO: 4270037 - DNA, 16 bp, Homo sapiens
tggcaccgccttctct

SEQ ID NO: 4270038 - DNA, 20 bp, Homo sapiens
tggcagaactgagctcctct

SEQ ID NO: 4270039 - DNA, 19 bp, Homo sapiens
tggcagaagcagttgcaat

SEQ ID NO: 4270040 - DNA, 17 bp, Homo sapiens
tggcagccgtgccttca

SEQ ID NO: 4270041 - DNA, 20 bp, Homo sapiens
tggcagccgtgccttcagct

SEQ ID NO: 4270042 - DNA, 21 bp, Homo sapiens
tggcagccgtgccttcagctc

SEQ ID NO: 4270043 - DNA, 22 bp, Homo sapiens
tggcagccgtgccttcagctct

SEQ ID NO: 4270044 - DNA, 14 bp, Homo sapiens
tggcagctgtctca

SEQ ID NO: 4270045 - DNA, 23 bp, Homo sapiens
tggcagcttcaaaacagaacggg

SEQ ID NO: 4270046 - DNA, 20 bp, Homo sapiens
tggcaggagacactggtctc

SEQ ID NO: 4270047 - DNA, 17 bp, Homo sapiens
tggcagggcaggcagag

SEQ ID NO: 4270048 - DNA, 16 bp, Homo sapiens
tggcaggtgtgggctc

SEQ ID NO: 4270049 - DNA, 17 bp, Homo sapiens
tggcaggtgtgggctcc

SEQ ID NO: 4270050 - DNA, 15 bp, Homo sapiens
tggcatcccagtggc

SEQ ID NO: 4270051 - DNA, 18 bp, Homo sapiens
tggcatctctggagtgtg

SEQ ID NO: 4270052 - DNA, 18 bp, Homo sapiens
tggcatcttaaaagctat

SEQ ID NO: 4270053 - DNA, 16 bp, Homo sapiens
tggcatggctccagtc

SEQ ID NO: 4270054 - DNA, 12 bp, Homo sapiens
tggcatgtctgg

SEQ ID NO: 4270055 - DNA, 17 bp, Homo sapiens
tggcattgtttccaccc

SEQ ID NO: 4270056 - DNA, 15 bp, Homo sapiens
tggccaaacaacagt

SEQ ID NO: 4270057 - DNA, 20 bp, Homo sapiens
tggccactttgcagacctgg

SEQ ID NO: 4270058 - DNA, 23 bp, Homo sapiens
tggccactttgcagacctgggac

SEQ ID NO: 4270059 - DNA, 20 bp, Homo sapiens
tggccagaagggggccatga

SEQ ID NO: 4270060 - DNA, 13 bp, Homo sapiens
tggccagagggcc

SEQ ID NO: 4270061 - DNA, 12 bp, Homo sapiens
tggccagcccag

SEQ ID NO: 4270062 - DNA, 13 bp, Homo sapiens
tggccagcccaga

SEQ ID NO: 4270063 - DNA, 16 bp, Homo sapiens
tggccaggcctcaggg

SEQ ID NO: 4270064 - DNA, 13 bp, Homo sapiens
tggccaggctggt

SEQ ID NO: 4270065 - DNA, 16 bp, Homo sapiens
tggccaggtggccact

SEQ ID NO: 4270066 - DNA, 20 bp, Homo sapiens
tggcccacccctcttccccc

SEQ ID NO: 4270067 - DNA, 19 bp, Homo sapiens
tggcccagcagcggcccag

SEQ ID NO: 4270068 - DNA, 22 bp, Homo sapiens
tggcccagcagcggcccagatt

SEQ ID NO: 4270069 - DNA, 15 bp, Homo sapiens
tggcccagcctgtgg

SEQ ID NO: 4270070 - DNA, 21 bp, Homo sapiens
tggcccagtgagagtgaggcc

SEQ ID NO: 4270071 - DNA, 21 bp, Homo sapiens
tggcccctcacctgggcacct

SEQ ID NO: 4270072 - DNA, 17 bp, Homo sapiens
tggcccctccttctccc

SEQ ID NO: 4270073 - DNA, 21 bp, Homo sapiens
tggcccctccttctcccctcc

SEQ ID NO: 4270074 - DNA, 23 bp, Homo sapiens
tggcccctccttctcccctccag

SEQ ID NO: 4270075 - DNA, 18 bp, Homo sapiens
tggcccgacagcctggca

SEQ ID NO: 4270076 - DNA, 12 bp, Homo sapiens
tggccctctctt

SEQ ID NO: 4270077 - DNA, 18 bp, Homo sapiens
tggccctgctgcccccta

SEQ ID NO: 4270078 - DNA, 23 bp, Homo sapiens
tggccctttcacccctcttccca

SEQ ID NO: 4270079 - DNA, 23 bp, Homo sapiens
tggccgctgggagaaaagccaga

SEQ ID NO: 4270080 - DNA, 13 bp, Homo sapiens
tggccggccctgc

SEQ ID NO: 4270081 - DNA, 18 bp, Homo sapiens
tggccggccctgcccccc

SEQ ID NO: 4270082 - DNA, 15 bp, Homo sapiens
tggccgggggtgggg

SEQ ID NO: 4270083 - DNA, 23 bp, Homo sapiens
tggcctattttggacgtgtgagg

SEQ ID NO: 4270084 - DNA, 17 bp, Homo sapiens
tggcctcaaccctccct

SEQ ID NO: 4270085 - DNA, 15 bp, Homo sapiens
tggcctcagcagaag

SEQ ID NO: 4270086 - DNA, 19 bp, Homo sapiens
tggcctcagcagaaggcct

SEQ ID NO: 4270087 - DNA, 12 bp, Homo sapiens
tggcctcccagc

SEQ ID NO: 4270088 - DNA, 17 bp, Homo sapiens
tggcctctggcctggga

SEQ ID NO: 4270089 - DNA, 18 bp, Homo sapiens
tggcctctggcctgggaa

SEQ ID NO: 4270090 - DNA, 15 bp, Homo sapiens
tggcctgagaagagt

SEQ ID NO: 4270091 - DNA, 20 bp, Homo sapiens
tggcctggggctgccgtgca

SEQ ID NO: 4270092 - DNA, 13 bp, Homo sapiens
tggcctgttctgt

SEQ ID NO: 4270093 - DNA, 19 bp, Homo sapiens
tggcgcacccggcagcccc

SEQ ID NO: 4270094 - DNA, 13 bp, Homo sapiens
tggcgcagtgcct

SEQ ID NO: 4270095 - DNA, 15 bp, Homo sapiens
tggcgcagtgcctct

SEQ ID NO: 4270096 - DNA, 18 bp, Homo sapiens
tggcgcagtgcctctggt

SEQ ID NO: 4270097 - DNA, 15 bp, Homo sapiens
tggcgcgcagcccgg

SEQ ID NO: 4270098 - DNA, 20 bp, Homo sapiens
tggctaaatgcctaataaac

SEQ ID NO: 4270099 - DNA, 22 bp, Homo sapiens
tggctagtcacatatcaagtcc

SEQ ID NO: 4270100 - DNA, 20 bp, Homo sapiens
tggctcacagccaccacctg

SEQ ID NO: 4270101 - DNA, 15 bp, Homo sapiens
tggctccagtctgct

SEQ ID NO: 4270102 - DNA, 19 bp, Homo sapiens
tggctccagtctgctgccc

SEQ ID NO: 4270103 - DNA, 16 bp, Homo sapiens
tggctcccagcagagg

SEQ ID NO: 4270104 - DNA, 13 bp, Homo sapiens
tggctccctgggc

SEQ ID NO: 4270105 - DNA, 22 bp, Homo sapiens
tggctccctgggctggcatggg

SEQ ID NO: 4270106 - DNA, 16 bp, Homo sapiens
tggctcccttacttta

SEQ ID NO: 4270107 - DNA, 19 bp, Homo sapiens
tggctcctcccggtgccca

SEQ ID NO: 4270108 - DNA, 15 bp, Homo sapiens
tggctcgggacttca

SEQ ID NO: 4270109 - DNA, 18 bp, Homo sapiens
tggctctgaatgtagcca

SEQ ID NO: 4270110 - DNA, 23 bp, Homo sapiens
tggctctgaatgtagccagccca

SEQ ID NO: 4270111 - DNA, 18 bp, Homo sapiens
tggctctgcagcacattg

SEQ ID NO: 4270112 - DNA, 12 bp, Homo sapiens
tggctgggccca

SEQ ID NO: 4270113 - DNA, 15 bp, Homo sapiens
tggctgggcccagaa

SEQ ID NO: 4270114 - DNA, 16 bp, Homo sapiens
tggctgggcccagaag

SEQ ID NO: 4270115 - DNA, 20 bp, Homo sapiens
tggctgggtttgggcagtgg

SEQ ID NO: 4270116 - DNA, 16 bp, Homo sapiens
tggctgtcccctgcaa

SEQ ID NO: 4270117 - DNA, 15 bp, Homo sapiens
tggcttcagaattgt

SEQ ID NO: 4270118 - DNA, 16 bp, Homo sapiens
tggcttcagcccctgg

SEQ ID NO: 4270119 - DNA, 15 bp, Homo sapiens
tggcttcccatgtct

SEQ ID NO: 4270120 - DNA, 15 bp, Homo sapiens
tggcttggagcagag

SEQ ID NO: 4270121 - DNA, 13 bp, Homo sapiens
tggctttcatttc

SEQ ID NO: 4270122 - DNA, 13 bp, Homo sapiens
tggctttgtgctt

SEQ ID NO: 4270123 - DNA, 21 bp, Homo sapiens
tggcttttcactgctggctgc

SEQ ID NO: 4270124 - DNA, 22 bp, Homo sapiens
tggcttttcactgctggctgcc

SEQ ID NO: 4270125 - DNA, 16 bp, Homo sapiens
tgggaatgcggcaaga

SEQ ID NO: 4270126 - DNA, 14 bp, Homo sapiens
tgggacggaagtgg

SEQ ID NO: 4270127 - DNA, 16 bp, Homo sapiens
tgggactggcccaccc

SEQ ID NO: 4270128 - DNA, 18 bp, Homo sapiens
tgggactggcccacccct

SEQ ID NO: 4270129 - DNA, 17 bp, Homo sapiens
tgggagaaaagccagat

SEQ ID NO: 4270130 - DNA, 15 bp, Homo sapiens
tgggagaggaagcca

SEQ ID NO: 4270131 - DNA, 13 bp, Homo sapiens
tgggagagtgctc

SEQ ID NO: 4270132 - DNA, 22 bp, Homo sapiens
tgggagagtgctcaacctacag

SEQ ID NO: 4270133 - DNA, 20 bp, Homo sapiens
tgggagccgtcagcctgtga

SEQ ID NO: 4270134 - DNA, 17 bp, Homo sapiens
tgggagcctcgcccctc

SEQ ID NO: 4270135 - DNA, 20 bp, Homo sapiens
tgggagcctcgcccctccag

SEQ ID NO: 4270136 - DNA, 23 bp, Homo sapiens
tgggagcctcgcccctccagtgt

SEQ ID NO: 4270137 - DNA, 20 bp, Homo sapiens
tgggaggagggggcccggct

SEQ ID NO: 4270138 - DNA, 21 bp, Homo sapiens
tgggaggagggggcccggctg

SEQ ID NO: 4270139 - DNA, 15 bp, Homo sapiens
tgggagtcagggagc

SEQ ID NO: 4270140 - DNA, 16 bp, Homo sapiens
tgggagtgggagagga

SEQ ID NO: 4270141 - DNA, 17 bp, Homo sapiens
tgggagtgggagaggaa

SEQ ID NO: 4270142 - DNA, 17 bp, Homo sapiens
tgggatccagagagaag

SEQ ID NO: 4270143 - DNA, 16 bp, Homo sapiens
tgggatgggcacaggc

SEQ ID NO: 4270144 - DNA, 17 bp, Homo sapiens
tgggatgggcacaggct

SEQ ID NO: 4270145 - DNA, 18 bp, Homo sapiens
tgggatgggcacaggctg

SEQ ID NO: 4270146 - DNA, 22 bp, Homo sapiens
tgggatgtttaatcaagagaga

SEQ ID NO: 4270147 - DNA, 16 bp, Homo sapiens
tgggcaaggcctttgg

SEQ ID NO: 4270148 - DNA, 17 bp, Homo sapiens
tgggcagaggggagagg

SEQ ID NO: 4270149 - DNA, 22 bp, Homo sapiens
tgggcagaggggagaggaagca

SEQ ID NO: 4270150 - DNA, 14 bp, Homo sapiens
tgggcagcccagag

SEQ ID NO: 4270151 - DNA, 16 bp, Homo sapiens
tgggcaggacctcaga

SEQ ID NO: 4270152 - DNA, 20 bp, Homo sapiens
ttaaaaagttaatcttcatg

SEQ ID NO: 4270153 - DNA, 18 bp, Homo sapiens
ttaaaaagttgcacatta

SEQ ID NO: 4270154 - DNA, 14 bp, Homo sapiens
ttaaaaatatgtga

SEQ ID NO: 4270155 - DNA, 16 bp, Homo sapiens
ttaaaacaaattaaaa

SEQ ID NO: 4270156 - DNA, 18 bp, Homo sapiens
ttaaaacaaattaaaaac

SEQ ID NO: 4270157 - DNA, 16 bp, Homo sapiens
ttaaaagaagactgga

SEQ ID NO: 4270158 - DNA, 18 bp, Homo sapiens
ttaaaagaagactggaag

SEQ ID NO: 4270159 - DNA, 13 bp, Homo sapiens
ttaaaatagtttt

SEQ ID NO: 4270160 - DNA, 23 bp, Homo sapiens
ttaaaatagttttctaaatgttt

SEQ ID NO: 4270161 - DNA, 23 bp, Homo sapiens
ttaaaatcatatttacctgtgaa

SEQ ID NO: 4270162 - DNA, 15 bp, Homo sapiens
ttaaaattagtgaga

SEQ ID NO: 4270163 - DNA, 21 bp, Homo sapiens
ttaaacagggcatctccagga

SEQ ID NO: 4270164 - DNA, 21 bp, Homo sapiens
ttaaacagttgcacagcatct

SEQ ID NO: 4270165 - DNA, 13 bp, Homo sapiens
ttaaagacattta

SEQ ID NO: 4270166 - DNA, 12 bp, Homo sapiens
ttaaagacttga

SEQ ID NO: 4270167 - DNA, 18 bp, Homo sapiens
ttaaagacttgatgaata

SEQ ID NO: 4270168 - DNA, 17 bp, Homo sapiens
ttaaagaggagcctttc

SEQ ID NO: 4270169 - DNA, 22 bp, Homo sapiens
ttaaagaggagcctttccagaa

SEQ ID NO: 4270170 - DNA, 20 bp, Homo sapiens
ttaaagaggcgtcttgtatt

SEQ ID NO: 4270171 - DNA, 15 bp, Homo sapiens
ttaaatgattccaaa

SEQ ID NO: 4270172 - DNA, 16 bp, Homo sapiens
ttaaatgattccaaat

SEQ ID NO: 4270173 - DNA, 13 bp, Homo sapiens
ttaaatgctgtat

SEQ ID NO: 4270174 - DNA, 15 bp, Homo sapiens
ttaaatgctgtatgt

SEQ ID NO: 4270175 - DNA, 19 bp, Homo sapiens
ttaaatgtagcttcagtca

SEQ ID NO: 4270176 - DNA, 22 bp, Homo sapiens
ttaaatgtagcttcagtcatta

SEQ ID NO: 4270177 - DNA, 14 bp, Homo sapiens
ttaaattttcagaa

SEQ ID NO: 4270178 - DNA, 19 bp, Homo sapiens
ttaacaatgcctattgtaa

SEQ ID NO: 4270179 - DNA, 15 bp, Homo sapiens
ttaacataggcaaga

SEQ ID NO: 4270180 - DNA, 18 bp, Homo sapiens
ttaaccccataattagat

SEQ ID NO: 4270181 - DNA, 13 bp, Homo sapiens
ttaacctcagaaa

SEQ ID NO: 4270182 - DNA, 23 bp, Homo sapiens
ttaagaatgtatatcagggttta

SEQ ID NO: 4270183 - DNA, 18 bp, Homo sapiens
ttaagcattttactgtct

SEQ ID NO: 4270184 - DNA, 16 bp, Homo sapiens
ttaaggggatctaaaa

SEQ ID NO: 4270185 - DNA, 21 bp, Homo sapiens
ttaagtattccttggcccagc

SEQ ID NO: 4270186 - DNA, 13 bp, Homo sapiens
ttaataataaaaa

SEQ ID NO: 4270187 - DNA, 17 bp, Homo sapiens
ttaataggaggacagaa

SEQ ID NO: 4270188 - DNA, 22 bp, Homo sapiens
ttaatatatataatacttaaaa

SEQ ID NO: 4270189 - DNA, 15 bp, Homo sapiens
ttaatatcactcatt

SEQ ID NO: 4270190 - DNA, 17 bp, Homo sapiens
ttaatatcactcattaa

SEQ ID NO: 4270191 - DNA, 12 bp, Homo sapiens
ttaatctctaaa

SEQ ID NO: 4270192 - DNA, 15 bp, Homo sapiens
ttaatctctaaaatt

SEQ ID NO: 4270193 - DNA, 13 bp, Homo sapiens
ttaatcttcatgg

SEQ ID NO: 4270194 - DNA, 20 bp, Homo sapiens
ttaatgatactgtctaagaa

SEQ ID NO: 4270195 - DNA, 20 bp, Homo sapiens
ttaatggtgccttcatttgg

SEQ ID NO: 4270196 - DNA, 13 bp, Homo sapiens
ttaatgtaaaatt

SEQ ID NO: 4270197 - DNA, 23 bp, Homo sapiens
ttaattgaaaagaagtagtgtct

SEQ ID NO: 4270198 - DNA, 13 bp, Homo sapiens
ttaatttaaatga

SEQ ID NO: 4270199 - DNA, 14 bp, Homo sapiens
ttaatttaaatgat

SEQ ID NO: 4270200 - DNA, 19 bp, Homo sapiens
ttaattttgacactgaaat

SEQ ID NO: 4270201 - DNA, 13 bp, Homo sapiens
ttacaagaagaac

SEQ ID NO: 4270202 - DNA, 15 bp, Homo sapiens
ttacaagttatagta

SEQ ID NO: 4270203 - DNA, 15 bp, Homo sapiens
ttacaatggccagcc

SEQ ID NO: 4270204 - DNA, 23 bp, Homo sapiens
ttacacgtggaggaatgctcccc

SEQ ID NO: 4270205 - DNA, 23 bp, Homo sapiens
ttacacttctcaaatgctactca

SEQ ID NO: 4270206 - DNA, 11 bp, Homo sapiens
ttacagaagaa

SEQ ID NO: 4270207 - DNA, 16 bp, Homo sapiens
ttacagggaagaaatc

SEQ ID NO: 4270208 - DNA, 17 bp, Homo sapiens
ttacaggtgtactatgg

SEQ ID NO: 4270209 - DNA, 14 bp, Homo sapiens
ttacagtgaagaaa

SEQ ID NO: 4270210 - DNA, 19 bp, Homo sapiens
ttacatgagttcaaatact

SEQ ID NO: 4270211 - DNA, 21 bp, Homo sapiens
ttacatgagttcaaatacttt

SEQ ID NO: 4270212 - DNA, 23 bp, Homo sapiens
ttacattgccgtggcatcttaaa

SEQ ID NO: 4270213 - DNA, 21 bp, Homo sapiens
ttacccacactacgcagaaga

SEQ ID NO: 4270214 - DNA, 22 bp, Homo sapiens
ttaccccgtccctttccctgca

SEQ ID NO: 4270215 - DNA, 18 bp, Homo sapiens
ttaccctaaaacatgtgt

SEQ ID NO: 4270216 - DNA, 15 bp, Homo sapiens
ttaccctccctgtcc

SEQ ID NO: 4270217 - DNA, 17 bp, Homo sapiens
ttaccctccctgtcccc

SEQ ID NO: 4270218 - DNA, 16 bp, Homo sapiens
ttacctggaatcaaat

SEQ ID NO: 4270219 - DNA, 22 bp, Homo sapiens
ttacctgtaatagcctcacctt

SEQ ID NO: 4270220 - DNA, 14 bp, Homo sapiens
ttactaacactggc

SEQ ID NO: 4270221 - DNA, 23 bp, Homo sapiens
ttactacataattaaattttaat

SEQ ID NO: 4270222 - DNA, 17 bp, Homo sapiens
ttactatagcaaagtag

SEQ ID NO: 4270223 - DNA, 22 bp, Homo sapiens
ttactatagcaaagtagtactt

SEQ ID NO: 4270224 - DNA, 20 bp, Homo sapiens
ttactccccttgagctgaga

SEQ ID NO: 4270225 - DNA, 17 bp, Homo sapiens
ttactggaaatgagccc

SEQ ID NO: 4270226 - DNA, 23 bp, Homo sapiens
ttactgtatttgggatatgagtt

SEQ ID NO: 4270227 - DNA, 14 bp, Homo sapiens
ttactgtcagagaa

SEQ ID NO: 4270228 - DNA, 20 bp, Homo sapiens
ttactgtcctgttgattaat

SEQ ID NO: 4270229 - DNA, 18 bp, Homo sapiens
ttacttaaagcttgtttg

SEQ ID NO: 4270230 - DNA, 22 bp, Homo sapiens
ttacttcgtgtccgactcttct

SEQ ID NO: 4270231 - DNA, 18 bp, Homo sapiens
ttacttttcctcttagaa

SEQ ID NO: 4270232 - DNA, 13 bp, Homo sapiens
ttagaaagaaatt

SEQ ID NO: 4270233 - DNA, 16 bp, Homo sapiens
ttagaaatgatttcaa

SEQ ID NO: 4270234 - DNA, 17 bp, Homo sapiens
ttagaaattgcatttcc

SEQ ID NO: 4270235 - DNA, 13 bp, Homo sapiens
ttagaatggggct

SEQ ID NO: 4270236 - DNA, 15 bp, Homo sapiens
ttagacaagcctgga

SEQ ID NO: 4270237 - DNA, 16 bp, Homo sapiens
ttagacaagcctggag

SEQ ID NO: 4270238 - DNA, 22 bp, Homo sapiens
ttagagtatgcaagaagaatat

SEQ ID NO: 4270239 - DNA, 22 bp, Homo sapiens
ttagagtgcccttaaaataatg

SEQ ID NO: 4270240 - DNA, 14 bp, Homo sapiens
ttagatttctttga

SEQ ID NO: 4270241 - DNA, 22 bp, Homo sapiens
ttagcaggaaatagtgttcttt

SEQ ID NO: 4270242 - DNA, 16 bp, Homo sapiens
ttagcagtttgctttg

SEQ ID NO: 4270243 - DNA, 15 bp, Homo sapiens
ttagccttctctgtt

SEQ ID NO: 4270244 - DNA, 15 bp, Homo sapiens
ttagcgttctgtttc

SEQ ID NO: 4270245 - DNA, 16 bp, Homo sapiens
ttagctttgtcactgt

SEQ ID NO: 4270246 - DNA, 20 bp, Homo sapiens
ttaggaatatacatagtctt

SEQ ID NO: 4270247 - DNA, 22 bp, Homo sapiens
ttaggcaggaagtcaggagcca

SEQ ID NO: 4270248 - DNA, 11 bp, Homo sapiens
ttaggcctgga

SEQ ID NO: 4270249 - DNA, 12 bp, Homo sapiens
ttaggcctggag

SEQ ID NO: 4270250 - DNA, 13 bp, Homo sapiens
ttaggcctggagt

SEQ ID NO: 4270251 - DNA, 16 bp, Homo sapiens
ttagggcatttttctt

SEQ ID NO: 4270252 - DNA, 13 bp, Homo sapiens
ttaggtcatccaa

SEQ ID NO: 4270253 - DNA, 15 bp, Homo sapiens
ttaggtgtcttttaa

SEQ ID NO: 4270254 - DNA, 15 bp, Homo sapiens
ttagtaatctgtata

SEQ ID NO: 4270255 - DNA, 15 bp, Homo sapiens
ttagtatcctgttag

SEQ ID NO: 4270256 - DNA, 13 bp, Homo sapiens
ttagtcctcacct

SEQ ID NO: 4270257 - DNA, 14 bp, Homo sapiens
ttagtcctcacctt

SEQ ID NO: 4270258 - DNA, 15 bp, Homo sapiens
ttagtgactaaacca

SEQ ID NO: 4270259 - DNA, 14 bp, Homo sapiens
ttagtgatttgcta

SEQ ID NO: 4270260 - DNA, 11 bp, Homo sapiens
ttagtgtctgt

SEQ ID NO: 4270261 - DNA, 19 bp, Homo sapiens
ttagttaaaatctattttg

SEQ ID NO: 4270262 - DNA, 23 bp, Homo sapiens
ttagttaaaatctattttgtctg

SEQ ID NO: 4270263 - DNA, 12 bp, Homo sapiens
ttagttcctgtg

SEQ ID NO: 4270264 - DNA, 18 bp, Homo sapiens
ttagtttcagctgaccag

SEQ ID NO: 4270265 - DNA, 14 bp, Homo sapiens
ttagtttgcattta

SEQ ID NO: 4270266 - DNA, 15 bp, Homo sapiens
ttataagcaacatga

SEQ ID NO: 4270267 - DNA, 14 bp, Homo sapiens
ttatatataaatat

SEQ ID NO: 4270268 - DNA, 17 bp, Homo sapiens
ttatatcagactgcttt

SEQ ID NO: 4270269 - DNA, 12 bp, Homo sapiens
ttatatctgtaa

SEQ ID NO: 4270270 - DNA, 22 bp, Homo sapiens
ttatcagaatcaaatctgagcc

SEQ ID NO: 4270271 - DNA, 23 bp, Homo sapiens
ttatcagaatcaaatctgagcct

SEQ ID NO: 4270272 - DNA, 15 bp, Homo sapiens
ttatcagagtcatga

SEQ ID NO: 4270273 - DNA, 11 bp, Homo sapiens
ttatcatgtgt

SEQ ID NO: 4270274 - DNA, 15 bp, Homo sapiens
ttatcctgtgtgatt

SEQ ID NO: 4270275 - DNA, 15 bp, Homo sapiens
ttatccttttatctc

SEQ ID NO: 4270276 - DNA, 16 bp, Homo sapiens
ttatccttttatctca

SEQ ID NO: 4270277 - DNA, 14 bp, Homo sapiens
ttatctagcaagaa

SEQ ID NO: 4270278 - DNA, 13 bp, Homo sapiens
ttatctcacaaat

SEQ ID NO: 4270279 - DNA, 11 bp, Homo sapiens
ttatctgtctg

SEQ ID NO: 4270280 - DNA, 20 bp, Homo sapiens
ttatctgtctgagccctgcc

SEQ ID NO: 4270281 - DNA, 18 bp, Homo sapiens
ttatcttgggaccaaaac

SEQ ID NO: 4270282 - DNA, 15 bp, Homo sapiens
ttatgacctcaacaa

SEQ ID NO: 4270283 - DNA, 18 bp, Homo sapiens
ttgtgcctcttgggagac

SEQ ID NO: 4270284 - DNA, 15 bp, Homo sapiens
ttgtgcggtgtgtct

SEQ ID NO: 4270285 - DNA, 19 bp, Homo sapiens
ttgtgcttatgtcatttct

SEQ ID NO: 4270286 - DNA, 15 bp, Homo sapiens
ttgtgcttgttcttc

SEQ ID NO: 4270287 - DNA, 13 bp, Homo sapiens
ttgtggagaggag

SEQ ID NO: 4270288 - DNA, 19 bp, Homo sapiens
ttgtgtgggtttactctgt

SEQ ID NO: 4270289 - DNA, 15 bp, Homo sapiens
ttgtgttgttttctc

SEQ ID NO: 4270290 - DNA, 18 bp, Homo sapiens
ttgtgtttgtatataaat

SEQ ID NO: 4270291 - DNA, 15 bp, Homo sapiens
ttgttaagttcaccg

SEQ ID NO: 4270292 - DNA, 19 bp, Homo sapiens
ttgttaatatatataatac

SEQ ID NO: 4270293 - DNA, 23 bp, Homo sapiens
ttgttaatatatataatacttaa

SEQ ID NO: 4270294 - DNA, 22 bp, Homo sapiens
ttgttaatatcactcattaatt

SEQ ID NO: 4270295 - DNA, 14 bp, Homo sapiens
ttgttactttaggt

SEQ ID NO: 4270296 - DNA, 17 bp, Homo sapiens
ttgttagtgatttgcta

SEQ ID NO: 4270297 - DNA, 14 bp, Homo sapiens
ttgttattaaatgt

SEQ ID NO: 4270298 - DNA, 20 bp, Homo sapiens
ttgttctagttagcaggaaa

SEQ ID NO: 4270299 - DNA, 22 bp, Homo sapiens
ttgttctagttagcaggaaata

SEQ ID NO: 4270300 - DNA, 19 bp, Homo sapiens
ttgttgatattggttctat

SEQ ID NO: 4270301 - DNA, 17 bp, Homo sapiens
ttgtttatccttaagaa

SEQ ID NO: 4270302 - DNA, 22 bp, Homo sapiens
ttgtttctatactgtttgtaat

SEQ ID NO: 4270303 - DNA, 14 bp, Homo sapiens
ttgttttctttttc

SEQ ID NO: 4270304 - DNA, 18 bp, Homo sapiens
tttaaaaaataatttaga

SEQ ID NO: 4270305 - DNA, 17 bp, Homo sapiens
tttaaaatagttttcta

SEQ ID NO: 4270306 - DNA, 21 bp, Homo sapiens
tttaaaatggacttttgttca

SEQ ID NO: 4270307 - DNA, 15 bp, Homo sapiens
tttaaatgattccaa

SEQ ID NO: 4270308 - DNA, 19 bp, Homo sapiens
tttaaatgattccaaataa

SEQ ID NO: 4270309 - DNA, 14 bp, Homo sapiens
tttaacagtaatgt

SEQ ID NO: 4270310 - DNA, 15 bp, Homo sapiens
tttaacatacatcta

SEQ ID NO: 4270311 - DNA, 21 bp, Homo sapiens
tttaactactaagaataaata

SEQ ID NO: 4270312 - DNA, 15 bp, Homo sapiens
tttaatcaagagaga

SEQ ID NO: 4270313 - DNA, 18 bp, Homo sapiens
tttaattccaagtgtttc

SEQ ID NO: 4270314 - DNA, 21 bp, Homo sapiens
tttaattgtataaaacagtgt

SEQ ID NO: 4270315 - DNA, 15 bp, Homo sapiens
tttacaatgtattaa

SEQ ID NO: 4270316 - DNA, 19 bp, Homo sapiens
tttacagtgaagaaagcct

SEQ ID NO: 4270317 - DNA, 16 bp, Homo sapiens
tttaccacttgctgca

SEQ ID NO: 4270318 - DNA, 20 bp, Homo sapiens
tttacctcactggtgcattt

SEQ ID NO: 4270319 - DNA, 19 bp, Homo sapiens
tttacctctctgtcatgtg

SEQ ID NO: 4270320 - DNA, 21 bp, Homo sapiens
tttactacataattaaatttt

SEQ ID NO: 4270321 - DNA, 13 bp, Homo sapiens
tttactgtctgta

SEQ ID NO: 4270322 - DNA, 18 bp, Homo sapiens
tttacttgaatagtattg

SEQ ID NO: 4270323 - DNA, 15 bp, Homo sapiens
tttactttgtgcaat

SEQ ID NO: 4270324 - DNA, 22 bp, Homo sapiens
tttagaaagaaattgtttttct

SEQ ID NO: 4270325 - DNA, 20 bp, Homo sapiens
tttagaaataaaccttaata

SEQ ID NO: 4270326 - DNA, 15 bp, Homo sapiens
tttagaaatgatttc

SEQ ID NO: 4270327 - DNA, 18 bp, Homo sapiens
tttagagattaatttgtg

SEQ ID NO: 4270328 - DNA, 22 bp, Homo sapiens
tttagagtatgcaagaagaata

SEQ ID NO: 4270329 - DNA, 23 bp, Homo sapiens
tttagagtatgcaagaagaatat

SEQ ID NO: 4270330 - DNA, 23 bp, Homo sapiens
tttagcatgacaagccccaggca

SEQ ID NO: 4270331 - DNA, 12 bp, Homo sapiens
tttagcatgtgt

SEQ ID NO: 4270332 - DNA, 13 bp, Homo sapiens
tttaggtgtcttt

SEQ ID NO: 4270333 - DNA, 13 bp, Homo sapiens
tttataaggtctg

SEQ ID NO: 4270334 - DNA, 22 bp, Homo sapiens
tttatattcagagatgtaccat

SEQ ID NO: 4270335 - DNA, 15 bp, Homo sapiens
tttatccttaagaat

SEQ ID NO: 4270336 - DNA, 23 bp, Homo sapiens
tttatctgtctgagccctgccct

SEQ ID NO: 4270337 - DNA, 18 bp, Homo sapiens
tttattaacatatattgt

SEQ ID NO: 4270338 - DNA, 20 bp, Homo sapiens
tttattcacttgtgtttgta

SEQ ID NO: 4270339 - DNA, 12 bp, Homo sapiens
tttattgtctgt

SEQ ID NO: 4270340 - DNA, 15 bp, Homo sapiens
tttattttgtatgaa

SEQ ID NO: 4270341 - DNA, 21 bp, Homo sapiens
tttattttgtatgaaatatat

SEQ ID NO: 4270342 - DNA, 18 bp, Homo sapiens
tttcaaaatgcatgtgat

SEQ ID NO: 4270343 - DNA, 19 bp, Homo sapiens
tttcaaaatgcatgtgatt

SEQ ID NO: 4270344 - DNA, 15 bp, Homo sapiens
tttcaacgcagccct

SEQ ID NO: 4270345 - DNA, 20 bp, Homo sapiens
tttcaacgcagccctgcttt

SEQ ID NO: 4270346 - DNA, 21 bp, Homo sapiens
tttcaatgattgtttaattgt

SEQ ID NO: 4270347 - DNA, 15 bp, Homo sapiens
tttcaatgtaattaa

SEQ ID NO: 4270348 - DNA, 18 bp, Homo sapiens
tttcacatatttgtagct

SEQ ID NO: 4270349 - DNA, 17 bp, Homo sapiens
tttcacccctcttccca

SEQ ID NO: 4270350 - DNA, 15 bp, Homo sapiens
tttcacgattcattt

SEQ ID NO: 4270351 - DNA, 20 bp, Homo sapiens
tttcactataatgtgaaatg

SEQ ID NO: 4270352 - DNA, 14 bp, Homo sapiens
tttcactgctggct

SEQ ID NO: 4270353 - DNA, 17 bp, Homo sapiens
tttcactgctggctgcc

SEQ ID NO: 4270354 - DNA, 22 bp, Homo sapiens
tttcactgctggctgccttaga

SEQ ID NO: 4270355 - DNA, 16 bp, Homo sapiens
tttcagaaagatgaag

SEQ ID NO: 4270356 - DNA, 20 bp, Homo sapiens
tttcagaaagggcagcccct

SEQ ID NO: 4270357 - DNA, 22 bp, Homo sapiens
tttcagaaagggcagcccctcc

SEQ ID NO: 4270358 - DNA, 19 bp, Homo sapiens
tttcagacctttgtctgaa

SEQ ID NO: 4270359 - DNA, 18 bp, Homo sapiens
tttcagattgtaaaggta

SEQ ID NO: 4270360 - DNA, 17 bp, Homo sapiens
tttcagcttgtttctat

SEQ ID NO: 4270361 - DNA, 13 bp, Homo sapiens
tttcaggaaagta

SEQ ID NO: 4270362 - DNA, 16 bp, Homo sapiens
tttcagtaagatcaag

SEQ ID NO: 4270363 - DNA, 12 bp, Homo sapiens
tttcatatcatt

SEQ ID NO: 4270364 - DNA, 13 bp, Homo sapiens
tttcatcctcagc

SEQ ID NO: 4270365 - DNA, 15 bp, Homo sapiens
tttcatctttccaaa

SEQ ID NO: 4270366 - DNA, 20 bp, Homo sapiens
tttcatgtgttgcaaattat

SEQ ID NO: 4270367 - DNA, 16 bp, Homo sapiens
tttcattgagggaaaa

SEQ ID NO: 4270368 - DNA, 22 bp, Homo sapiens
tttcattgagggaaaacataat

SEQ ID NO: 4270369 - DNA, 23 bp, Homo sapiens
tttcattgagggaaaacataata

SEQ ID NO: 4270370 - DNA, 13 bp, Homo sapiens
tttccaaatacat

SEQ ID NO: 4270371 - DNA, 11 bp, Homo sapiens
tttccaagcct

SEQ ID NO: 4270372 - DNA, 13 bp, Homo sapiens
tttccacacaggc

SEQ ID NO: 4270373 - DNA, 15 bp, Homo sapiens
tttccacttcttcat

SEQ ID NO: 4270374 - DNA, 16 bp, Homo sapiens
tttccacttcttcatt

SEQ ID NO: 4270375 - DNA, 21 bp, Homo sapiens
tttccagaactaccaaaatga

SEQ ID NO: 4270376 - DNA, 21 bp, Homo sapiens
tttccagtaaggaatgatatt

SEQ ID NO: 4270377 - DNA, 14 bp, Homo sapiens
tttccatatagttt

SEQ ID NO: 4270378 - DNA, 18 bp, Homo sapiens
tttccgaagaccttctga

SEQ ID NO: 4270379 - DNA, 18 bp, Homo sapiens
tttcctgagcttggccag

SEQ ID NO: 4270380 - DNA, 16 bp, Homo sapiens
tttcctgatgttgata

SEQ ID NO: 4270381 - DNA, 22 bp, Homo sapiens
tttcctgccttttagttcctgt

SEQ ID NO: 4270382 - DNA, 12 bp, Homo sapiens
tttcctgggagt

SEQ ID NO: 4270383 - DNA, 19 bp, Homo sapiens
tttcctttcatcctcagca

SEQ ID NO: 4270384 - DNA, 16 bp, Homo sapiens
tttcgtgcatttgtga

SEQ ID NO: 4270385 - DNA, 15 bp, Homo sapiens
tttctaaaaagtcag

SEQ ID NO: 4270386 - DNA, 17 bp, Homo sapiens
tttctaaaaagtcagat

SEQ ID NO: 4270387 - DNA, 16 bp, Homo sapiens
tttctaaatgtttctt

SEQ ID NO: 4270388 - DNA, 14 bp, Homo sapiens
tttctatactgttt

SEQ ID NO: 4270389 - DNA, 17 bp, Homo sapiens
tttctatactgtttgta

SEQ ID NO: 4270390 - DNA, 15 bp, Homo sapiens
tttctatgtagaact

SEQ ID NO: 4270391 - DNA, 17 bp, Homo sapiens
tttctatgtagaactgt

SEQ ID NO: 4270392 - DNA, 19 bp, Homo sapiens
tttctatgtagaactgttc

SEQ ID NO: 4270393 - DNA, 13 bp, Homo sapiens
tttctcaaagttt

SEQ ID NO: 4270394 - DNA, 21 bp, Homo sapiens
tttctcaaagtttttacagtg

SEQ ID NO: 4270395 - DNA, 19 bp, Homo sapiens
tttctcacactctaactgt

SEQ ID NO: 4270396 - DNA, 14 bp, Homo sapiens
tttctccgttgtgg

SEQ ID NO: 4270397 - DNA, 13 bp, Homo sapiens
tttctcttgggct

SEQ ID NO: 4270398 - DNA, 21 bp, Homo sapiens
tttctcttgggctgagactgg

SEQ ID NO: 4270399 - DNA, 20 bp, Homo sapiens
tttctgaggtttagcgtttt

SEQ ID NO: 4270400 - DNA, 22 bp, Homo sapiens
tttctgagtagcatatataatt

SEQ ID NO: 4270401 - DNA, 23 bp, Homo sapiens
tttctgctacctggttttcatta

SEQ ID NO: 4270402 - DNA, 12 bp, Homo sapiens
tttcttcccatt

SEQ ID NO: 4270403 - DNA, 15 bp, Homo sapiens
tttcttcccatttgt

SEQ ID NO: 4270404 - DNA, 17 bp, Homo sapiens
tttcttgagatctgctg

SEQ ID NO: 4270405 - DNA, 17 bp, Homo sapiens
tttcttggtatgatcat

SEQ ID NO: 4270406 - DNA, 13 bp, Homo sapiens
tttcttgtgttgt

SEQ ID NO: 4270407 - DNA, 14 bp, Homo sapiens
tttctttctatgta

SEQ ID NO: 4270408 - DNA, 14 bp, Homo sapiens
tttcttttatatct

SEQ ID NO: 4270409 - DNA, 16 bp, Homo sapiens
tttgaaagatggtaat

SEQ ID NO: 4270410 - DNA, 23 bp, Homo sapiens
tttgaaagatggtaatcttttct

SEQ ID NO: 4270411 - DNA, 17 bp, Homo sapiens
tttgaagacttcaaaat

SEQ ID NO: 4270412 - DNA, 13 bp, Homo sapiens
tttgagtgtgcaa

SEQ ID NO: 4270413 - DNA, 12 bp, Homo sapiens
aaaaaagaaaga

SEQ ID NO: 4270414 - DNA, 18 bp, Homo sapiens
aaaaaagaataatgaccc

SEQ ID NO: 4270415 - DNA, 21 bp, Homo sapiens
aaaaaagagaaaaaccaatga

SEQ ID NO: 4270416 - DNA, 12 bp, Homo sapiens
aaaaaatatttt

SEQ ID NO: 4270417 - DNA, 13 bp, Homo sapiens
aaaaaatatttta

SEQ ID NO: 4270418 - DNA, 17 bp, Homo sapiens
aaaaaccaatgattcat

SEQ ID NO: 4270419 - DNA, 20 bp, Homo sapiens
aaaaagagaaaaaccaatga

SEQ ID NO: 4270420 - DNA, 12 bp, Homo sapiens
aaaaatataaag

SEQ ID NO: 4270421 - DNA, 17 bp, Homo sapiens
aaaaatgtgagctataa

SEQ ID NO: 4270422 - DNA, 19 bp, Homo sapiens
aaaacattctatctactga

SEQ ID NO: 4270423 - DNA, 13 bp, Homo sapiens
aaaaccaatgatt

SEQ ID NO: 4270424 - DNA, 20 bp, Homo sapiens
aaaaccacagccctgtcagt

SEQ ID NO: 4270425 - DNA, 20 bp, Homo sapiens
aaaaccatcaaaaatattcc

SEQ ID NO: 4270426 - DNA, 15 bp, Homo sapiens
aaaactaaaattcaa

SEQ ID NO: 4270427 - DNA, 16 bp, Homo sapiens
aaaactccactcagca

SEQ ID NO: 4270428 - DNA, 21 bp, Homo sapiens
aaaactggaataagaagcaaa

SEQ ID NO: 4270429 - DNA, 17 bp, Homo sapiens
aaaactgtgaccaagta

SEQ ID NO: 4270430 - DNA, 12 bp, Homo sapiens
aaaactgtttat

SEQ ID NO: 4270431 - DNA, 21 bp, Homo sapiens
aaaagaagaaagtctatgctt

SEQ ID NO: 4270432 - DNA, 16 bp, Homo sapiens
aaaagagaaaaaccaa

SEQ ID NO: 4270433 - DNA, 21 bp, Homo sapiens
aaaagagaccacccatatcat

SEQ ID NO: 4270434 - DNA, 22 bp, Homo sapiens
aaaagagaccacccatatcatg

SEQ ID NO: 4270435 - DNA, 18 bp, Homo sapiens
aaaagattaaaattagtg

SEQ ID NO: 4270436 - DNA, 16 bp, Homo sapiens
aaaagattaacaacac

SEQ ID NO: 4270437 - DNA, 20 bp, Homo sapiens
aagcaaatatttatgacctc

SEQ ID NO: 4270438 - DNA, 19 bp, Homo sapiens
aagcaagcacctgggtgtg

SEQ ID NO: 4270439 - DNA, 15 bp, Homo sapiens
aagcaaggccagccc

SEQ ID NO: 4270440 - DNA, 17 bp, Homo sapiens
aagcaaggccagccctg

SEQ ID NO: 4270441 - DNA, 15 bp, Homo sapiens
aagcatgaagataaa

SEQ ID NO: 4270442 - DNA, 19 bp, Homo sapiens
aagcatgccaatttctctt

SEQ ID NO: 4270443 - DNA, 18 bp, Homo sapiens
aagcattctccccagtgt

SEQ ID NO: 4270444 - DNA, 23 bp, Homo sapiens
aagcattctccccagtgtatgtc

SEQ ID NO: 4270445 - DNA, 14 bp, Homo sapiens
aagccaagtgtcct

SEQ ID NO: 4270446 - DNA, 20 bp, Homo sapiens
aagccaccatgtatgtggaa

SEQ ID NO: 4270447 - DNA, 14 bp, Homo sapiens
aagccacgtgctgg

SEQ ID NO: 4270448 - DNA, 17 bp, Homo sapiens
aagccacgtgctggaga

SEQ ID NO: 4270449 - DNA, 11 bp, Homo sapiens
aagccagacag

SEQ ID NO: 4270450 - DNA, 13 bp, Homo sapiens
aagccaggagacc

SEQ ID NO: 4270451 - DNA, 19 bp, Homo sapiens
aagccagggttccagacag

SEQ ID NO: 4270452 - DNA, 21 bp, Homo sapiens
aagccatatgacaatttcaaa

SEQ ID NO: 4270453 - DNA, 23 bp, Homo sapiens
aagccatatgacaatttcaaaat

SEQ ID NO: 4270454 - DNA, 24 bp, Homo sapiens
aagccatatgacaatttcaaaatg

SEQ ID NO: 4270455 - DNA, 12 bp, Homo sapiens
aagcccaggagg

SEQ ID NO: 4270456 - DNA, 15 bp, Homo sapiens
aagcccaggaggacc

SEQ ID NO: 4270457 - DNA, 21 bp, Homo sapiens
aagccccaggcaggctgtgcg

SEQ ID NO: 4270458 - DNA, 10 bp, Homo sapiens
aagcctcagc

SEQ ID NO: 4270459 - DNA, 11 bp, Homo sapiens
aagcctcagcc

SEQ ID NO: 4270460 - DNA, 11 bp, Homo sapiens
aagcctcaggc

SEQ ID NO: 4270461 - DNA, 14 bp, Homo sapiens
aagcctcaggcctg

SEQ ID NO: 4270462 - DNA, 23 bp, Homo sapiens
aagcctcagtccctccctcctgg

SEQ ID NO: 4270463 - DNA, 17 bp, Homo sapiens
aagcctccacctgcagc

SEQ ID NO: 4270464 - DNA, 18 bp, Homo sapiens
aagcctccacctgcagcc

SEQ ID NO: 4270465 - DNA, 22 bp, Homo sapiens
aagcctccacctgcagccccag

SEQ ID NO: 4270466 - DNA, 19 bp, Homo sapiens
aagcctgccccggccactc

SEQ ID NO: 4270467 - DNA, 12 bp, Homo sapiens
aagcctggccca

SEQ ID NO: 4270468 - DNA, 15 bp, Homo sapiens
aagcctgggccactg

SEQ ID NO: 4270469 - DNA, 14 bp, Homo sapiens
aagcgggaaacatg

SEQ ID NO: 4270470 - DNA, 17 bp, Homo sapiens
aagctatatatgaataa

SEQ ID NO: 4270471 - DNA, 21 bp, Homo sapiens
aagctcctgaatccctttcag

SEQ ID NO: 4270472 - DNA, 14 bp, Homo sapiens
aagctgcttctggg

SEQ ID NO: 4270473 - DNA, 15 bp, Homo sapiens
aagctggcaggagac

SEQ ID NO: 4270474 - DNA, 16 bp, Homo sapiens
aagctggcaggagaca

SEQ ID NO: 4270475 - DNA, 14 bp, Homo sapiens
aagcttagaagcca

SEQ ID NO: 4270476 - DNA, 19 bp, Homo sapiens
aaggaaacacgtttagaaa

SEQ ID NO: 4270477 - DNA, 12 bp, Homo sapiens
aaggaaaccttt

SEQ ID NO: 4270478 - DNA, 22 bp, Homo sapiens
aaggactgccgaccgaggctgg

SEQ ID NO: 4270479 - DNA, 22 bp, Homo sapiens
aaggagatggggagggcgcttt

SEQ ID NO: 4270480 - DNA, 16 bp, Homo sapiens
aaggaggaaggagcct

SEQ ID NO: 4270481 - DNA, 17 bp, Homo sapiens
aaggaggaagggactgg

SEQ ID NO: 4270482 - DNA, 11 bp, Homo sapiens
aaggattttaa

SEQ ID NO: 4270483 - DNA, 18 bp, Homo sapiens
aaggattttaaatgctgt

SEQ ID NO: 4270484 - DNA, 15 bp, Homo sapiens
aaggcaagaagtggg

SEQ ID NO: 4270485 - DNA, 19 bp, Homo sapiens
aaggcccaaaccaggggga

SEQ ID NO: 4270486 - DNA, 14 bp, Homo sapiens
aaggccgttaggga

SEQ ID NO: 4270487 - DNA, 19 bp, Homo sapiens
aaggcgtgcaggggcggtc

SEQ ID NO: 4270488 - DNA, 18 bp, Homo sapiens
aaggctgaaaagtgcttt

SEQ ID NO: 4270489 - DNA, 11 bp, Homo sapiens
aaggctgcctg

SEQ ID NO: 4270490 - DNA, 21 bp, Homo sapiens
aaggctggtggacagacccag

SEQ ID NO: 4270491 - DNA, 19 bp, Homo sapiens
aaggcttccggctgagctg

SEQ ID NO: 4270492 - DNA, 23 bp, Homo sapiens
aaggcttccggctgagctgtgcc

SEQ ID NO: 4270493 - DNA, 17 bp, Homo sapiens
aaggctttcagggcctc

SEQ ID NO: 4270494 - DNA, 15 bp, Homo sapiens
aagggacatgtcttt

SEQ ID NO: 4270495 - DNA, 20 bp, Homo sapiens
aagggactggtccaggcatg

SEQ ID NO: 4270496 - DNA, 15 bp, Homo sapiens
aagggaggcctgagg

SEQ ID NO: 4270497 - DNA, 16 bp, Homo sapiens
aagggagtaggctgta

SEQ ID NO: 4270498 - DNA, 14 bp, Homo sapiens
aagggcagcccctc

SEQ ID NO: 4270499 - DNA, 13 bp, Homo sapiens
aagggcaggagcc

SEQ ID NO: 4270500 - DNA, 18 bp, Homo sapiens
aagggcaggagcctagag

SEQ ID NO: 4270501 - DNA, 16 bp, Homo sapiens
aaggggatctaaaagg

SEQ ID NO: 4270502 - DNA, 14 bp, Homo sapiens
aaggggccctagga

SEQ ID NO: 4270503 - DNA, 18 bp, Homo sapiens
aaggggtctgctcctgtg

SEQ ID NO: 4270504 - DNA, 20 bp, Homo sapiens
aaggggtctgctcctgtggc

SEQ ID NO: 4270505 - DNA, 20 bp, Homo sapiens
aaggggttcccactggctcc

SEQ ID NO: 4270506 - DNA, 19 bp, Homo sapiens
aagggtccggcttggctag

SEQ ID NO: 4270507 - DNA, 22 bp, Homo sapiens
aagggtgtgggtcagggagggg

SEQ ID NO: 4270508 - DNA, 19 bp, Homo sapiens
aagggttagacaagcctgg

SEQ ID NO: 4270509 - DNA, 17 bp, Homo sapiens
aaggtaatctgaaacac

SEQ ID NO: 4270510 - DNA, 14 bp, Homo sapiens
aaggtggtctgcac

SEQ ID NO: 4270511 - DNA, 21 bp, Homo sapiens
aaggtggtcttggagaggagg

SEQ ID NO: 4270512 - DNA, 14 bp, Homo sapiens
aaggttaagccata

SEQ ID NO: 4270513 - DNA, 17 bp, Homo sapiens
aaggttggaactgctgc

SEQ ID NO: 4270514 - DNA, 18 bp, Homo sapiens
aaggtttaaaactagtta

SEQ ID NO: 4270515 - DNA, 17 bp, Homo sapiens
aaggtttatttttctgt

SEQ ID NO: 4270516 - DNA, 16 bp, Homo sapiens
aaggtttcactgttca

SEQ ID NO: 4270517 - DNA, 18 bp, Homo sapiens
aagtatatttatttctag

SEQ ID NO: 4270518 - DNA, 15 bp, Homo sapiens
aagtatctgtacctg

SEQ ID NO: 4270519 - DNA, 16 bp, Homo sapiens
aagtatgttttagcat

SEQ ID NO: 4270520 - DNA, 20 bp, Homo sapiens
aagtattccttggcccagca

SEQ ID NO: 4270521 - DNA, 13 bp, Homo sapiens
aagtcagatgttt

SEQ ID NO: 4270522 - DNA, 12 bp, Homo sapiens
aagtcaggagcc

SEQ ID NO: 4270523 - DNA, 17 bp, Homo sapiens
aagtcaggagccagcag

SEQ ID NO: 4270524 - DNA, 19 bp, Homo sapiens
aagtccagtgaccctggag

SEQ ID NO: 4270525 - DNA, 22 bp, Homo sapiens
aagtcccagggagctctgcata

SEQ ID NO: 4270526 - DNA, 19 bp, Homo sapiens
aagtcccgaggcagcaaca

SEQ ID NO: 4270527 - DNA, 11 bp, Homo sapiens
aagtctatgct

SEQ ID NO: 4270528 - DNA, 12 bp, Homo sapiens
aagtctatgctt

SEQ ID NO: 4270529 - DNA, 16 bp, Homo sapiens
aagtctgtctgcactg

SEQ ID NO: 4270530 - DNA, 20 bp, Homo sapiens
aagtcttccatcagcagtga

SEQ ID NO: 4270531 - DNA, 20 bp, Homo sapiens
aagtgacaaggccccagaga

SEQ ID NO: 4270532 - DNA, 17 bp, Homo sapiens
aagtgaccccagctcca

SEQ ID NO: 4270533 - DNA, 20 bp, Homo sapiens
aagtgaccccagctccaggc

SEQ ID NO: 4270534 - DNA, 20 bp, Homo sapiens
aagtgactaccacttatttc

SEQ ID NO: 4270535 - DNA, 22 bp, Homo sapiens
aagtgactaccacttatttcta

SEQ ID NO: 4270536 - DNA, 17 bp, Homo sapiens
aagtgcaggctggcacc

SEQ ID NO: 4270537 - DNA, 20 bp, Homo sapiens
aagtgcatttctgggcctta

SEQ ID NO: 4270538 - DNA, 19 bp, Homo sapiens
aagtgcccctgctgcctcc

SEQ ID NO: 4270539 - DNA, 11 bp, Homo sapiens
aagtggaaaaa

SEQ ID NO: 4270540 - DNA, 17 bp, Homo sapiens
aagtggaaaaaagagaa

SEQ ID NO: 4270541 - DNA, 12 bp, Homo sapiens
aagtggacccag

SEQ ID NO: 4270542 - DNA, 15 bp, Homo sapiens
aagtggcaggaggac

SEQ ID NO: 4270543 - DNA, 17 bp, Homo sapiens
aagtggcaggaggacag

SEQ ID NO: 4270544 - DNA, 18 bp, Homo sapiens
aagtggcctgagaagagt

SEQ ID NO: 4270545 - DNA, 20 bp, Homo sapiens
aagtgggagtgggagaggaa

SEQ ID NO: 4270546 - DNA, 23 bp, Homo sapiens
aagtgggagtgggagaggaagcc

SEQ ID NO: 4270547 - DNA, 16 bp, Homo sapiens
aagtggttaagaatgt

SEQ ID NO: 4270548 - DNA, 19 bp, Homo sapiens
aagtgtcaaggggccctag

SEQ ID NO: 4270549 - DNA, 21 bp, Homo sapiens
aagtgtcaaggggccctagga

SEQ ID NO: 4270550 - DNA, 20 bp, Homo sapiens
aagtgtgctgaggtgggcct

SEQ ID NO: 4270551 - DNA, 18 bp, Homo sapiens
aagttagggcatttttct

SEQ ID NO: 4270552 - DNA, 19 bp, Homo sapiens
aagttagggcatttttctt

SEQ ID NO: 4270553 - DNA, 19 bp, Homo sapiens
aagttctgaaaactgttta

SEQ ID NO: 4270554 - DNA, 20 bp, Homo sapiens
aagtttaatggtgccttcat

SEQ ID NO: 4270555 - DNA, 22 bp, Homo sapiens
aagttttcagattgtaaaggta

SEQ ID NO: 4270556 - DNA, 13 bp, Homo sapiens
aataaacactttt

SEQ ID NO: 4270557 - DNA, 17 bp, Homo sapiens
aataaacgaaacacaga

SEQ ID NO: 4270558 - DNA, 14 bp, Homo sapiens
aataaactccttaa

SEQ ID NO: 4270559 - DNA, 13 bp, Homo sapiens
aataaagaagaaa

SEQ ID NO: 4270560 - DNA, 19 bp, Homo sapiens
aataaagaagaaaataacc

SEQ ID NO: 4270561 - DNA, 20 bp, Homo sapiens
aataaagtctgtctgcactg

SEQ ID NO: 4270562 - DNA, 17 bp, Homo sapiens
aataaataaagaagaaa

SEQ ID NO: 4270563 - DNA, 23 bp, Homo sapiens
aataaattggtgataagtggaaa

SEQ ID NO: 4270564 - DNA, 15 bp, Homo sapiens
aataacatctgaaaa

SEQ ID NO: 4270565 - DNA, 19 bp, Homo sapiens
aataacatctgaaaagaaa

SEQ ID NO: 4270566 - DNA, 18 bp, Homo sapiens
aataactagatctcctgt

SEQ ID NO: 4270567 - DNA, 13 bp, Homo sapiens
aataagtaatatc

SEQ ID NO: 4270568 - DNA, 22 bp, Homo sapiens
aataatgacgtattgtgaaatt

SEQ ID NO: 4270569 - DNA, 16 bp, Homo sapiens
aataatgcctttgtaa

SEQ ID NO: 4270570 - DNA, 18 bp, Homo sapiens
aataatgcctttgtaacc

SEQ ID NO: 4270571 - DNA, 12 bp, Homo sapiens
aacatacatcta

SEQ ID NO: 4270572 - DNA, 23 bp, Homo sapiens
aacatacatctaagtcagtttca

SEQ ID NO: 4270573 - DNA, 19 bp, Homo sapiens
aacatagatgcctgggcct

SEQ ID NO: 4270574 - DNA, 22 bp, Homo sapiens
aacatagatgcctgggcctgat

SEQ ID NO: 4270575 - DNA, 13 bp, Homo sapiens
aacataggcaaga

SEQ ID NO: 4270576 - DNA, 12 bp, Homo sapiens
aacatggccaca

SEQ ID NO: 4270577 - DNA, 20 bp, Homo sapiens
aacattattacttttcctct

SEQ ID NO: 4270578 - DNA, 21 bp, Homo sapiens
aacattcaaaaacatggccac

SEQ ID NO: 4270579 - DNA, 19 bp, Homo sapiens
aacattctatctactgatt

SEQ ID NO: 4270580 - DNA, 21 bp, Homo sapiens
aacatttgggacctggataat

SEQ ID NO: 4270581 - DNA, 23 bp, Homo sapiens
aaccaatgattcataacaatgta

SEQ ID NO: 4270582 - DNA, 15 bp, Homo sapiens
aaccacaaattcatg

SEQ ID NO: 4270583 - DNA, 13 bp, Homo sapiens
aaccacagccctg

SEQ ID NO: 4270584 - DNA, 14 bp, Homo sapiens
aaccacagccctgt

SEQ ID NO: 4270585 - DNA, 16 bp, Homo sapiens
aaccacagccctgtca

SEQ ID NO: 4270586 - DNA, 15 bp, Homo sapiens
aaccaccgctcccca

SEQ ID NO: 4270587 - DNA, 16 bp, Homo sapiens
aaccaccgctccccag

SEQ ID NO: 4270588 - DNA, 18 bp, Homo sapiens
aaccaccgctccccagcc

SEQ ID NO: 4270589 - DNA, 13 bp, Homo sapiens
aaccacctctggc

SEQ ID NO: 4270590 - DNA, 17 bp, Homo sapiens
aaccacctctggccctg

SEQ ID NO: 4270591 - DNA, 23 bp, Homo sapiens
aaccacctctggccctgttgtgg

SEQ ID NO: 4270592 - DNA, 18 bp, Homo sapiens
aaccagagccatggactc

SEQ ID NO: 4270593 - DNA, 16 bp, Homo sapiens
aaccagggggaagcac

SEQ ID NO: 4270594 - DNA, 18 bp, Homo sapiens
aaccagtcttttgaaaga

SEQ ID NO: 4270595 - DNA, 18 bp, Homo sapiens
aaccataaaataaataat

SEQ ID NO: 4270596 - DNA, 18 bp, Homo sapiens
aaccatatgattgaaaag

SEQ ID NO: 4270597 - DNA, 20 bp, Homo sapiens
aaccatatgattgaaaagaa

SEQ ID NO: 4270598 - DNA, 19 bp, Homo sapiens
aaccatggacctgcacttg

SEQ ID NO: 4270599 - DNA, 19 bp, Homo sapiens
aacccaggtgttgtccgtg

SEQ ID NO: 4270600 - DNA, 21 bp, Homo sapiens
aacccatcgtggtatgtgaat

SEQ ID NO: 4270601 - DNA, 23 bp, Homo sapiens
aacccatgcatggcctcccagcc

SEQ ID NO: 4270602 - DNA, 12 bp, Homo sapiens
aaccccagcagt

SEQ ID NO: 4270603 - DNA, 22 bp, Homo sapiens
aacccccctccccaaggaagaa

SEQ ID NO: 4270604 - DNA, 16 bp, Homo sapiens
aaccccctcggagcct

SEQ ID NO: 4270605 - DNA, 12 bp, Homo sapiens
aaccctcagagc

SEQ ID NO: 4270606 - DNA, 14 bp, Homo sapiens
aaccctccctcagc

SEQ ID NO: 4270607 - DNA, 20 bp, Homo sapiens
aaccctccctcagcccctct

SEQ ID NO: 4270608 - DNA, 14 bp, Homo sapiens
aaccctgcccctgc

SEQ ID NO: 4270609 - DNA, 19 bp, Homo sapiens
aaccctgcccctgccccgt

SEQ ID NO: 4270610 - DNA, 21 bp, Homo sapiens
aacccttggagccaatggaga

SEQ ID NO: 4270611 - DNA, 15 bp, Homo sapiens
aaccgatgctccagc

SEQ ID NO: 4270612 - DNA, 23 bp, Homo sapiens
aaccggggagcccccgccccgcc

SEQ ID NO: 4270613 - DNA, 22 bp, Homo sapiens
aaccgtaaaggtttatttttct

SEQ ID NO: 4270614 - DNA, 20 bp, Homo sapiens
aacctcactgccctccctcg

SEQ ID NO: 4270615 - DNA, 14 bp, Homo sapiens
aacctcccctggtc

SEQ ID NO: 4270616 - DNA, 18 bp, Homo sapiens
aacctcccctggtcctgc

SEQ ID NO: 4270617 - DNA, 17 bp, Homo sapiens
aacctctactgaaaaca

SEQ ID NO: 4270618 - DNA, 14 bp, Homo sapiens
aacctctatatgtt

SEQ ID NO: 4270619 - DNA, 22 bp, Homo sapiens
aacctctctgaactgcaacact

SEQ ID NO: 4270620 - DNA, 17 bp, Homo sapiens
aacctcttagcttttct

SEQ ID NO: 4270621 - DNA, 18 bp, Homo sapiens
aacctctttcctctctgg

SEQ ID NO: 4270622 - DNA, 14 bp, Homo sapiens
aacctgaattattc

SEQ ID NO: 4270623 - DNA, 11 bp, Homo sapiens
aacgcagccct

SEQ ID NO: 4270624 - DNA, 12 bp, Homo sapiens
aacgcagccctg

SEQ ID NO: 4270625 - DNA, 20 bp, Homo sapiens
aacgggtctgtgggactggc

SEQ ID NO: 4270626 - DNA, 16 bp, Homo sapiens
aacgggttctcccatg

SEQ ID NO: 4270627 - DNA, 17 bp, Homo sapiens
aactaaaattcaacaaa

SEQ ID NO: 4270628 - DNA, 20 bp, Homo sapiens
aatcacgagatcttccttcc

SEQ ID NO: 4270629 - DNA, 12 bp, Homo sapiens
aatcactgccta

SEQ ID NO: 4270630 - DNA, 12 bp, Homo sapiens
aatcagggagca

SEQ ID NO: 4270631 - DNA, 13 bp, Homo sapiens
aatcatatataat

SEQ ID NO: 4270632 - DNA, 14 bp, Homo sapiens
aatcatcaaagtgt

SEQ ID NO: 4270633 - DNA, 18 bp, Homo sapiens
aatccattttctaaactg

SEQ ID NO: 4270634 - DNA, 22 bp, Homo sapiens
aatccattttctaaactgtttt

SEQ ID NO: 4270635 - DNA, 15 bp, Homo sapiens
aatccctttcagttt

SEQ ID NO: 4270636 - DNA, 21 bp, Homo sapiens
aatcctgggcatccccagccc

SEQ ID NO: 4270637 - DNA, 20 bp, Homo sapiens
aatcctgtcaatgtttgctt

SEQ ID NO: 4270638 - DNA, 16 bp, Homo sapiens
aatcctgttacttaaa

SEQ ID NO: 4270639 - DNA, 20 bp, Homo sapiens
aatcgcattaatgaaatacc

SEQ ID NO: 4270640 - DNA, 23 bp, Homo sapiens
aatcggcaacagggcttctcttt

SEQ ID NO: 4270641 - DNA, 16 bp, Homo sapiens
aatctacgatgttaaa

SEQ ID NO: 4270642 - DNA, 15 bp, Homo sapiens
aatctactagaacct

SEQ ID NO: 4270643 - DNA, 13 bp, Homo sapiens
aatctagaagagt

SEQ ID NO: 4270644 - DNA, 11 bp, Homo sapiens
aatctcagcac

SEQ ID NO: 4270645 - DNA, 18 bp, Homo sapiens
aatctctaaaattctagt

SEQ ID NO: 4270646 - DNA, 13 bp, Homo sapiens
aatctctgtgact

SEQ ID NO: 4270647 - DNA, 20 bp, Homo sapiens
aatctctgtgactcgcttag

SEQ ID NO: 4270648 - DNA, 13 bp, Homo sapiens
aatctgaaacaca

SEQ ID NO: 4270649 - DNA, 18 bp, Homo sapiens
aatctgattggacatttt

SEQ ID NO: 4270650 - DNA, 14 bp, Homo sapiens
aatctgtctgattc

SEQ ID NO: 4270651 - DNA, 13 bp, Homo sapiens
aatcttaacaaaa

SEQ ID NO: 4270652 - DNA, 19 bp, Homo sapiens
aatgaaataggagggaaac

SEQ ID NO: 4270653 - DNA, 13 bp, Homo sapiens
aatgaaatatttg

SEQ ID NO: 4270654 - DNA, 21 bp, Homo sapiens
aatgaaatatttgcttattta

SEQ ID NO: 4270655 - DNA, 19 bp, Homo sapiens
aatgaataatgcctttgta

SEQ ID NO: 4270656 - DNA, 16 bp, Homo sapiens
aatgagagagtgtgga

SEQ ID NO: 4270657 - DNA, 17 bp, Homo sapiens
aatgagagagtgtggaa

SEQ ID NO: 4270658 - DNA, 13 bp, Homo sapiens
aatgagcattttt

SEQ ID NO: 4270659 - DNA, 22 bp, Homo sapiens
aatgagtttaaaaaaataacat

SEQ ID NO: 4270660 - DNA, 18 bp, Homo sapiens
aatgatactgtctaagaa

SEQ ID NO: 4270661 - DNA, 21 bp, Homo sapiens
aatgatactgtctaagaataa

SEQ ID NO: 4270662 - DNA, 19 bp, Homo sapiens
aatgatcttccaaatatta

SEQ ID NO: 4270663 - DNA, 12 bp, Homo sapiens
aatgattgttta

SEQ ID NO: 4270664 - DNA, 16 bp, Homo sapiens
aatgatttcaaaatga

SEQ ID NO: 4270665 - DNA, 14 bp, Homo sapiens
aatgcatgtgattg

SEQ ID NO: 4270666 - DNA, 22 bp, Homo sapiens
aatgccacggcagccaccctgc

SEQ ID NO: 4270667 - DNA, 15 bp, Homo sapiens
aatgcctaataaaca

SEQ ID NO: 4270668 - DNA, 17 bp, Homo sapiens
aatgcctaggccagctc

SEQ ID NO: 4270669 - DNA, 15 bp, Homo sapiens
aatgcctattgtaat

SEQ ID NO: 4270670 - DNA, 13 bp, Homo sapiens
aatgcctttgtaa

SEQ ID NO: 4270671 - DNA, 23 bp, Homo sapiens
aatgcctttgtaaccacaacttt

SEQ ID NO: 4270672 - DNA, 19 bp, Homo sapiens
aatgcgctcttcaccagga

SEQ ID NO: 4270673 - DNA, 13 bp, Homo sapiens
aatgctaatgtaa

SEQ ID NO: 4270674 - DNA, 22 bp, Homo sapiens
aatgctagcacaatattcctat

SEQ ID NO: 4270675 - DNA, 20 bp, Homo sapiens
aatgctcccccatcctcccc

SEQ ID NO: 4270676 - DNA, 13 bp, Homo sapiens
aatgctgtatgtc

SEQ ID NO: 4270677 - DNA, 16 bp, Homo sapiens
aatgctgtatgtcatt

SEQ ID NO: 4270678 - DNA, 17 bp, Homo sapiens
aatggaagcctccacct

SEQ ID NO: 4270679 - DNA, 13 bp, Homo sapiens
aatggcagtgaga

SEQ ID NO: 4270680 - DNA, 14 bp, Homo sapiens
aatggccagcccag

SEQ ID NO: 4270681 - DNA, 23 bp, Homo sapiens
aatggccagcccagatggctccc

SEQ ID NO: 4270682 - DNA, 14 bp, Homo sapiens
aatggctattaaca

SEQ ID NO: 4270683 - DNA, 22 bp, Homo sapiens
aatggctgggtttgggcagtgg

SEQ ID NO: 4270684 - DNA, 20 bp, Homo sapiens
aatggtaacatttttcaata

SEQ ID NO: 4270685 - DNA, 22 bp, Homo sapiens
aatggtgaactgtcattacaga

SEQ ID NO: 4270686 - DNA, 18 bp, Homo sapiens
aatggtgagaattaaaat

SEQ ID NO: 4270687 - DNA, 16 bp, Homo sapiens
aatggtgggctccaga

SEQ ID NO: 4270688 - DNA, 20 bp, Homo sapiens
aatgtaactgtccgtagtat

SEQ ID NO: 4270689 - DNA, 13 bp, Homo sapiens
aatgtaatcattt

SEQ ID NO: 4270690 - DNA, 14 bp, Homo sapiens
aatgtagccagccc

SEQ ID NO: 4270691 - DNA, 11 bp, Homo sapiens
aatgtatctta

SEQ ID NO: 4270692 - DNA, 14 bp, Homo sapiens
aatgtatcttattt

SEQ ID NO: 4270693 - DNA, 17 bp, Homo sapiens
aatgtatgtgaaagtgt

SEQ ID NO: 4270694 - DNA, 23 bp, Homo sapiens
aatgtattaagcccacagtatat

SEQ ID NO: 4270695 - DNA, 17 bp, Homo sapiens
aatgtccccattctata

SEQ ID NO: 4270696 - DNA, 19 bp, Homo sapiens
aatgtgaatatgccagtga

SEQ ID NO: 4270697 - DNA, 21 bp, Homo sapiens
aatgtgcccagtcatgacatt

SEQ ID NO: 4270698 - DNA, 15 bp, Homo sapiens
aatgtgcttttccat

SEQ ID NO: 4270699 - DNA, 16 bp, Homo sapiens
aatgtgtgtatgtgtg

SEQ ID NO: 4270700 - DNA, 17 bp, Homo sapiens
aatgttatatcatcaat

SEQ ID NO: 4270701 - DNA, 21 bp, Homo sapiens
aatgtttccaggcatgaccct

SEQ ID NO: 4270702 - DNA, 13 bp, Homo sapiens
aatgtttcttttt

SEQ ID NO: 4270703 - DNA, 14 bp, Homo sapiens
aatgtttctttttc

SEQ ID NO: 4270704 - DNA, 23 bp, Homo sapiens
aatgtttctttttcttttttgag

SEQ ID NO: 4270705 - DNA, 14 bp, Homo sapiens
aattaaattttaat

SEQ ID NO: 4270706 - DNA, 19 bp, Homo sapiens
aattaactccgtttccaaa

SEQ ID NO: 4270707 - DNA, 22 bp, Homo sapiens
aattaatgagttttatccaaga

SEQ ID NO: 4270708 - DNA, 12 bp, Homo sapiens
aattaatttcag

SEQ ID NO: 4270709 - DNA, 13 bp, Homo sapiens
aattaatttcagt

SEQ ID NO: 4270710 - DNA, 12 bp, Homo sapiens
aattacagaaga

SEQ ID NO: 4270711 - DNA, 23 bp, Homo sapiens
aattagctctcgcctcaggcttt

SEQ ID NO: 4270712 - DNA, 20 bp, Homo sapiens
aattagggctctaatttcct

SEQ ID NO: 4270713 - DNA, 17 bp, Homo sapiens
aattagtgagatttgta

SEQ ID NO: 4270714 - DNA, 16 bp, Homo sapiens
aattatactgtgtgtg

SEQ ID NO: 4270715 - DNA, 12 bp, Homo sapiens
aattatatctgt

SEQ ID NO: 4270716 - DNA, 15 bp, Homo sapiens
acaggaggaactggt

SEQ ID NO: 4270717 - DNA, 19 bp, Homo sapiens
acaggatgaactagccatg

SEQ ID NO: 4270718 - DNA, 21 bp, Homo sapiens
acaggatgaactagccatgac

SEQ ID NO: 4270719 - DNA, 13 bp, Homo sapiens
acaggcccttcct

SEQ ID NO: 4270720 - DNA, 12 bp, Homo sapiens
acaggcctggcc

SEQ ID NO: 4270721 - DNA, 12 bp, Homo sapiens
acaggctgcccc

SEQ ID NO: 4270722 - DNA, 20 bp, Homo sapiens
acaggctgccccacccctcc

SEQ ID NO: 4270723 - DNA, 22 bp, Homo sapiens
acaggctgccccacccctccat

SEQ ID NO: 4270724 - DNA, 14 bp, Homo sapiens
acagggaagaaatc

SEQ ID NO: 4270725 - DNA, 20 bp, Homo sapiens
acagggacacagtctggtgc

SEQ ID NO: 4270726 - DNA, 16 bp, Homo sapiens
acagggcatctccagg

SEQ ID NO: 4270727 - DNA, 13 bp, Homo sapiens
acagggccagggt

SEQ ID NO: 4270728 - DNA, 15 bp, Homo sapiens
acagggccagggttg

SEQ ID NO: 4270729 - DNA, 14 bp, Homo sapiens
acagggcttctctt

SEQ ID NO: 4270730 - DNA, 18 bp, Homo sapiens
acagggcttctcttttta

SEQ ID NO: 4270731 - DNA, 19 bp, Homo sapiens
acaggtggaggcgagccag

SEQ ID NO: 4270732 - DNA, 16 bp, Homo sapiens
acagtaatgtcataaa

SEQ ID NO: 4270733 - DNA, 13 bp, Homo sapiens
acagtatatttta

SEQ ID NO: 4270734 - DNA, 15 bp, Homo sapiens
acagtatattttatt

SEQ ID NO: 4270735 - DNA, 22 bp, Homo sapiens
acagtattatagatataaatat

SEQ ID NO: 4270736 - DNA, 13 bp, Homo sapiens
acagtcaggaagc

SEQ ID NO: 4270737 - DNA, 21 bp, Homo sapiens
acagtcagggcggggctggcc

SEQ ID NO: 4270738 - DNA, 22 bp, Homo sapiens
acagtcagggcggggctggcca

SEQ ID NO: 4270739 - DNA, 14 bp, Homo sapiens
acagtctcattaca

SEQ ID NO: 4270740 - DNA, 19 bp, Homo sapiens
acagtctcattacagattt

SEQ ID NO: 4270741 - DNA, 14 bp, Homo sapiens
acagttctggagga

SEQ ID NO: 4270742 - DNA, 23 bp, Homo sapiens
acagttgcacagcatctcagctc

SEQ ID NO: 4270743 - DNA, 23 bp, Homo sapiens
acagttggttttgcatgtctgca

SEQ ID NO: 4270744 - DNA, 21 bp, Homo sapiens
acagtttttgtaaccatatga

SEQ ID NO: 4270745 - DNA, 12 bp, Homo sapiens
acataaagtaaa

SEQ ID NO: 4270746 - DNA, 14 bp, Homo sapiens
acataaatctgtct

SEQ ID NO: 4270747 - DNA, 22 bp, Homo sapiens
acataaatctgtctgattctat

SEQ ID NO: 4270748 - DNA, 14 bp, Homo sapiens
acataaccagcggg

SEQ ID NO: 4270749 - DNA, 14 bp, Homo sapiens
acatagatgcctgg

SEQ ID NO: 4270750 - DNA, 16 bp, Homo sapiens
acatagatgcctgggc

SEQ ID NO: 4270751 - DNA, 17 bp, Homo sapiens
acatagatgcctgggcc

SEQ ID NO: 4270752 - DNA, 18 bp, Homo sapiens
acatagtctgaagtgaag

SEQ ID NO: 4270753 - DNA, 16 bp, Homo sapiens
acatagtgatggttcc

SEQ ID NO: 4270754 - DNA, 21 bp, Homo sapiens
acatattcttgctttcacaaa

SEQ ID NO: 4270755 - DNA, 21 bp, Homo sapiens
acatatttgtagctagaatat

SEQ ID NO: 4270756 - DNA, 22 bp, Homo sapiens
acatcagtggcatggctccagt

SEQ ID NO: 4270757 - DNA, 17 bp, Homo sapiens
acatgactctttattgt

SEQ ID NO: 4270758 - DNA, 18 bp, Homo sapiens
acatgccctcaggcttgg

SEQ ID NO: 4270759 - DNA, 19 bp, Homo sapiens
acatgccctcaggcttggg

SEQ ID NO: 4270760 - DNA, 20 bp, Homo sapiens
acatgctaacctctctgaac

SEQ ID NO: 4270761 - DNA, 11 bp, Homo sapiens
acatgctgccc

SEQ ID NO: 4270762 - DNA, 12 bp, Homo sapiens
acatgctgccca

SEQ ID NO: 4270763 - DNA, 20 bp, Homo sapiens
acatggggttggctgggccc

SEQ ID NO: 4270764 - DNA, 13 bp, Homo sapiens
acatgtatagtga

SEQ ID NO: 4270765 - DNA, 18 bp, Homo sapiens
acatgtatctatgcattt

SEQ ID NO: 4270766 - DNA, 21 bp, Homo sapiens
acatgtatctatgcattttct

SEQ ID NO: 4270767 - DNA, 14 bp, Homo sapiens
acattaaaataact

SEQ ID NO: 4270768 - DNA, 22 bp, Homo sapiens
acattagcagtttgctttgtat

SEQ ID NO: 4270769 - DNA, 18 bp, Homo sapiens
acattaggaacagagtat

SEQ ID NO: 4270770 - DNA, 12 bp, Homo sapiens
acattctgctgc

SEQ ID NO: 4270771 - DNA, 14 bp, Homo sapiens
acattctggctcca

SEQ ID NO: 4270772 - DNA, 15 bp, Homo sapiens
acattctggctccac

SEQ ID NO: 4270773 - DNA, 18 bp, Homo sapiens
acattctttaacatacat

SEQ ID NO: 4270774 - DNA, 20 bp, Homo sapiens
acattgcataagtggaccca

SEQ ID NO: 4270775 - DNA, 16 bp, Homo sapiens
acattgcccacacctg

SEQ ID NO: 4270776 - DNA, 17 bp, Homo sapiens
acattgcccacacctgc

SEQ ID NO: 4270777 - DNA, 15 bp, Homo sapiens
acattgccctgaggg

SEQ ID NO: 4270778 - DNA, 16 bp, Homo sapiens
acattgccctgagggg

SEQ ID NO: 4270779 - DNA, 19 bp, Homo sapiens
acattgtattttactttgt

SEQ ID NO: 4270780 - DNA, 20 bp, Homo sapiens
acatttaaaatagttttcta

SEQ ID NO: 4270781 - DNA, 23 bp, Homo sapiens
acatttaaaatagttttctaaat

SEQ ID NO: 4270782 - DNA, 14 bp, Homo sapiens
acatttcctcaggc

SEQ ID NO: 4270783 - DNA, 12 bp, Homo sapiens
acatttctcaaa

SEQ ID NO: 4270784 - DNA, 20 bp, Homo sapiens
acatttctggccatttaact

SEQ ID NO: 4270785 - DNA, 22 bp, Homo sapiens
acatttgggagactgagcttga

SEQ ID NO: 4270786 - DNA, 18 bp, Homo sapiens
acatttgtcactgaataa

SEQ ID NO: 4270787 - DNA, 22 bp, Homo sapiens
accaaaacccatcgtggtatgt

SEQ ID NO: 4270788 - DNA, 15 bp, Homo sapiens
accaaccctcagagc

SEQ ID NO: 4270789 - DNA, 14 bp, Homo sapiens
accaacgggtctgt

SEQ ID NO: 4270790 - DNA, 16 bp, Homo sapiens
accaacgggtctgtgg

SEQ ID NO: 4270791 - DNA, 22 bp, Homo sapiens
accaacgggtctgtgggactgg

SEQ ID NO: 4270792 - DNA, 23 bp, Homo sapiens
accaacgggtctgtgggactggc

SEQ ID NO: 4270793 - DNA, 12 bp, Homo sapiens
accaactctctc

SEQ ID NO: 4270794 - DNA, 17 bp, Homo sapiens
accaactctctctgccc

SEQ ID NO: 4270795 - DNA, 18 bp, Homo sapiens
accaactctctctgcccc

SEQ ID NO: 4270796 - DNA, 14 bp, Homo sapiens
accaactgagccaa

SEQ ID NO: 4270797 - DNA, 15 bp, Homo sapiens
accaagccgtggctt

SEQ ID NO: 4270798 - DNA, 16 bp, Homo sapiens
accaagccgtggcttc

SEQ ID NO: 4270799 - DNA, 14 bp, Homo sapiens
accaagcttagaag

SEQ ID NO: 4270800 - DNA, 18 bp, Homo sapiens
accaagggtatctgctgc

SEQ ID NO: 4270801 - DNA, 15 bp, Homo sapiens
accaatctctgtgac

SEQ ID NO: 4270802 - DNA, 16 bp, Homo sapiens
accaatctctgtgact

SEQ ID NO: 4270803 - DNA, 12 bp, Homo sapiens
accaatgattca

SEQ ID NO: 4270804 - DNA, 18 bp, Homo sapiens
accacacacacccttccc

SEQ ID NO: 4270805 - DNA, 21 bp, Homo sapiens
accacacacacccttccccac

SEQ ID NO: 4270806 - DNA, 19 bp, Homo sapiens
accacagcaggtgtcatat

SEQ ID NO: 4270807 - DNA, 16 bp, Homo sapiens
accacagccctgtcag

SEQ ID NO: 4270808 - DNA, 14 bp, Homo sapiens
accacccatatcat

SEQ ID NO: 4270809 - DNA, 23 bp, Homo sapiens
accaccctatcatcagttaggat

SEQ ID NO: 4270810 - DNA, 19 bp, Homo sapiens
accaccgctccccagccca

SEQ ID NO: 4270811 - DNA, 13 bp, Homo sapiens
accacctctggcc

SEQ ID NO: 4270812 - DNA, 15 bp, Homo sapiens
accactatcttttgt

SEQ ID NO: 4270813 - DNA, 15 bp, Homo sapiens
accacttatttctaa

SEQ ID NO: 4270814 - DNA, 21 bp, Homo sapiens
accagagcctatggaaagggt

SEQ ID NO: 4270815 - DNA, 15 bp, Homo sapiens
accagagcctccctc

SEQ ID NO: 4270816 - DNA, 17 bp, Homo sapiens
accagagcctccctcag

SEQ ID NO: 4270817 - DNA, 15 bp, Homo sapiens
accattatggctttg

SEQ ID NO: 4270818 - DNA, 13 bp, Homo sapiens
accattgtgcatt

SEQ ID NO: 4270819 - DNA, 23 bp, Homo sapiens
acccaaggtggtcttggagagga

SEQ ID NO: 4270820 - DNA, 18 bp, Homo sapiens
acccaattttaaaaaata

SEQ ID NO: 4270821 - DNA, 23 bp, Homo sapiens
acccacactacgcagaagagaaa

SEQ ID NO: 4270822 - DNA, 16 bp, Homo sapiens
acccaccctctggtcc

SEQ ID NO: 4270823 - DNA, 15 bp, Homo sapiens
acccaggtgttgtcc

SEQ ID NO: 4270824 - DNA, 15 bp, Homo sapiens
acccagtggaaccaa

SEQ ID NO: 4270825 - DNA, 18 bp, Homo sapiens
acccatggaaaaatgcca

SEQ ID NO: 4270826 - DNA, 22 bp, Homo sapiens
accccacttatgctgctgtgaa

SEQ ID NO: 4270827 - DNA, 19 bp, Homo sapiens
accccagcagtcctgggcc

SEQ ID NO: 4270828 - DNA, 12 bp, Homo sapiens
accccagcctaa

SEQ ID NO: 4270829 - DNA, 13 bp, Homo sapiens
accccatctgctg

SEQ ID NO: 4270830 - DNA, 14 bp, Homo sapiens
accccatctgctga

SEQ ID NO: 4270831 - DNA, 15 bp, Homo sapiens
acccccaccccttcc

SEQ ID NO: 4270832 - DNA, 11 bp, Homo sapiens
acccccagcaa

SEQ ID NO: 4270833 - DNA, 13 bp, Homo sapiens
acccccagctcct

SEQ ID NO: 4270834 - DNA, 22 bp, Homo sapiens
acccccagctcctttccctgga

SEQ ID NO: 4270835 - DNA, 12 bp, Homo sapiens
acccccctcatt

SEQ ID NO: 4270836 - DNA, 23 bp, Homo sapiens
acccccgtgccaaatcctgggca

SEQ ID NO: 4270837 - DNA, 15 bp, Homo sapiens
accccctccctggcc

SEQ ID NO: 4270838 - DNA, 15 bp, Homo sapiens
accccctcggagcct

SEQ ID NO: 4270839 - DNA, 16 bp, Homo sapiens
accccctcggagcctg

SEQ ID NO: 4270840 - DNA, 20 bp, Homo sapiens
accccctcggagcctgtgtt

SEQ ID NO: 4270841 - DNA, 15 bp, Homo sapiens
accccctgctggtgc

SEQ ID NO: 4270842 - DNA, 18 bp, Homo sapiens
accccgcctctgggctca

SEQ ID NO: 4270843 - DNA, 21 bp, Homo sapiens
accccgcctctgggctcacac

SEQ ID NO: 4270844 - DNA, 24 bp, Homo sapiens
accccggggcatggacagggccag

SEQ ID NO: 4270845 - DNA, 15 bp, Homo sapiens
accccgtccctttcc

SEQ ID NO: 4270846 - DNA, 20 bp, Homo sapiens
accccgttgttgtccctgca

SEQ ID NO: 4270847 - DNA, 21 bp, Homo sapiens
accccgttgttgtccctgcag

SEQ ID NO: 4270848 - DNA, 16 bp, Homo sapiens
acccctcaagccagga

SEQ ID NO: 4270849 - DNA, 16 bp, Homo sapiens
acccctcaccttgcaa

SEQ ID NO: 4270850 - DNA, 22 bp, Homo sapiens
acccctcaccttgcaacacaca

SEQ ID NO: 4270851 - DNA, 19 bp, Homo sapiens
acccctcttcccccttccc

SEQ ID NO: 4270852 - DNA, 15 bp, Homo sapiens
acccctgcacacacc

SEQ ID NO: 4270853 - DNA, 22 bp, Homo sapiens
acccctgcacacacctgcacac

SEQ ID NO: 4270854 - DNA, 23 bp, Homo sapiens
acccctgcacacacctgcacacc

SEQ ID NO: 4270855 - DNA, 20 bp, Homo sapiens
accccttccccactgcctgc

SEQ ID NO: 4270856 - DNA, 23 bp, Homo sapiens
accccttccccactgcctgccca

SEQ ID NO: 4270857 - DNA, 22 bp, Homo sapiens
acccggagctaacactggcccc

SEQ ID NO: 4270858 - DNA, 15 bp, Homo sapiens
acccggaggccacat

SEQ ID NO: 4270859 - DNA, 19 bp, Homo sapiens
acccggaggccacatgagt

SEQ ID NO: 4270860 - DNA, 18 bp, Homo sapiens
acccggaggggcctggca

SEQ ID NO: 4270861 - DNA, 20 bp, Homo sapiens
acccggatctccaggcccag

SEQ ID NO: 4270862 - DNA, 15 bp, Homo sapiens
acccggcagcccccc

SEQ ID NO: 4270863 - DNA, 20 bp, Homo sapiens
acccggctcgttcccccagg

SEQ ID NO: 4270864 - DNA, 12 bp, Homo sapiens
acccgtcctggg

SEQ ID NO: 4270865 - DNA, 13 bp, Homo sapiens
acccgtgccacgc

SEQ ID NO: 4270866 - DNA, 22 bp, Homo sapiens
acccgtgccacgcgctctgcat

SEQ ID NO: 4270867 - DNA, 13 bp, Homo sapiens
acccgtttccaag

SEQ ID NO: 4270868 - DNA, 16 bp, Homo sapiens
acccgtttccaagcct

SEQ ID NO: 4270869 - DNA, 18 bp, Homo sapiens
accctaggtctccacccc

SEQ ID NO: 4270870 - DNA, 17 bp, Homo sapiens
accctccctcagcccct

SEQ ID NO: 4270871 - DNA, 10 bp, Homo sapiens
accctccctg

SEQ ID NO: 4270872 - DNA, 15 bp, Homo sapiens
accctccctgtcccc

SEQ ID NO: 4270873 - DNA, 21 bp, Homo sapiens
accctcctatcacctcccctc

SEQ ID NO: 4270874 - DNA, 12 bp, Homo sapiens
accctctctgtc

SEQ ID NO: 4270875 - DNA, 23 bp, Homo sapiens
accctctctgtccaatctgcaag

SEQ ID NO: 4270876 - DNA, 13 bp, Homo sapiens
accctctgcaggg

SEQ ID NO: 4270877 - DNA, 17 bp, Homo sapiens
accctctgcagggcagc

SEQ ID NO: 4270878 - DNA, 21 bp, Homo sapiens
accctgacaaattttaattat

SEQ ID NO: 4270879 - DNA, 19 bp, Homo sapiens
accctgccaactttccaga

SEQ ID NO: 4270880 - DNA, 20 bp, Homo sapiens
accctgccaactttccagac

SEQ ID NO: 4270881 - DNA, 16 bp, Homo sapiens
accctgccatggaggc

SEQ ID NO: 4270882 - DNA, 21 bp, Homo sapiens
acccttaaacagttgcacagc

SEQ ID NO: 4270883 - DNA, 15 bp, Homo sapiens
acccttccccactcc

SEQ ID NO: 4270884 - DNA, 16 bp, Homo sapiens
acccttggcctgtcca

SEQ ID NO: 4270885 - DNA, 21 bp, Homo sapiens
accgagaggaaaaaggcttct

SEQ ID NO: 4270886 - DNA, 17 bp, Homo sapiens
accgagtctcttctcca

SEQ ID NO: 4270887 - DNA, 20 bp, Homo sapiens
accgagtctcttctccactg

SEQ ID NO: 4270888 - DNA, 17 bp, Homo sapiens
accgagtgtggagctgc

SEQ ID NO: 4270889 - DNA, 22 bp, Homo sapiens
accgagtgtggagctgcttcca

SEQ ID NO: 4270890 - DNA, 15 bp, Homo sapiens
accgatgctccagcc

SEQ ID NO: 4270891 - DNA, 23 bp, Homo sapiens
accgatgctccagccaacccctg

SEQ ID NO: 4270892 - DNA, 12 bp, Homo sapiens
accgccttctct

SEQ ID NO: 4270893 - DNA, 15 bp, Homo sapiens
accgctccccagccc

SEQ ID NO: 4270894 - DNA, 22 bp, Homo sapiens
accgggagcctgcgtggcctgg

SEQ ID NO: 4270895 - DNA, 23 bp, Homo sapiens
accgggagcctgcgtggcctggg

SEQ ID NO: 4270896 - DNA, 17 bp, Homo sapiens
accgtccctctccccgg

SEQ ID NO: 4270897 - DNA, 11 bp, Homo sapiens
accgtgtgctc

SEQ ID NO: 4270898 - DNA, 18 bp, Homo sapiens
acctaaatccattttcta

SEQ ID NO: 4270899 - DNA, 14 bp, Homo sapiens
acctaagtgactac

SEQ ID NO: 4270900 - DNA, 17 bp, Homo sapiens
acctaggagcagtgggc

SEQ ID NO: 4270901 - DNA, 23 bp, Homo sapiens
acctataaatactaaatatgaaa

SEQ ID NO: 4270902 - DNA, 19 bp, Homo sapiens
acctatgtcatttcatttc

SEQ ID NO: 4270903 - DNA, 16 bp, Homo sapiens
acctcaacaagaagaa

SEQ ID NO: 4270904 - DNA, 16 bp, Homo sapiens
acctcactggtgcatt

SEQ ID NO: 4270905 - DNA, 23 bp, Homo sapiens
acctcaggggagacttaggccag

SEQ ID NO: 4270906 - DNA, 14 bp, Homo sapiens
acctccacccgtcc

SEQ ID NO: 4270907 - DNA, 17 bp, Homo sapiens
acctcccctccttgcct

SEQ ID NO: 4270908 - DNA, 20 bp, Homo sapiens
acctcccctccttgcctcct

SEQ ID NO: 4270909 - DNA, 21 bp, Homo sapiens
acctcccctccttgcctcctg

SEQ ID NO: 4270910 - DNA, 17 bp, Homo sapiens
acctcccctggtcctgc

SEQ ID NO: 4270911 - DNA, 16 bp, Homo sapiens
acctcctataaagctt

SEQ ID NO: 4270912 - DNA, 21 bp, Homo sapiens
acctcgaagctgttctctgct

SEQ ID NO: 4270913 - DNA, 22 bp, Homo sapiens
acctctatatgttgctgaaaca

SEQ ID NO: 4270914 - DNA, 17 bp, Homo sapiens
acctctcccctggaact

SEQ ID NO: 4270915 - DNA, 14 bp, Homo sapiens
acctctctgtcatg

SEQ ID NO: 4270916 - DNA, 18 bp, Homo sapiens
acctctgatttattttgt

SEQ ID NO: 4270917 - DNA, 17 bp, Homo sapiens
acctctttcctctctgg

SEQ ID NO: 4270918 - DNA, 16 bp, Homo sapiens
acctgaagaatcacaa

SEQ ID NO: 4270919 - DNA, 21 bp, Homo sapiens
acctgaattcgagacaggcag

SEQ ID NO: 4270920 - DNA, 21 bp, Homo sapiens
acctgatttccatttgcaaca

SEQ ID NO: 4270921 - DNA, 16 bp, Homo sapiens
acctgcacacccctgc

SEQ ID NO: 4270922 - DNA, 17 bp, Homo sapiens
acctgcacacccctgca

SEQ ID NO: 4270923 - DNA, 17 bp, Homo sapiens
acctggatggatctgct

SEQ ID NO: 4270924 - DNA, 20 bp, Homo sapiens
acctggatggatctgctcca

SEQ ID NO: 4270925 - DNA, 15 bp, Homo sapiens
acctggcttcccagg

SEQ ID NO: 4270926 - DNA, 17 bp, Homo sapiens
acctggcttcccaggac

SEQ ID NO: 4270927 - DNA, 19 bp, Homo sapiens
acctggcttcccaggaccc

SEQ ID NO: 4270928 - DNA, 20 bp, Homo sapiens
acctggcttcccaggaccct

SEQ ID NO: 4270929 - DNA, 14 bp, Homo sapiens
acctgggcacctgg

SEQ ID NO: 4270930 - DNA, 18 bp, Homo sapiens
acctgggcacctggggag

SEQ ID NO: 4270931 - DNA, 19 bp, Homo sapiens
acctgggcacctggggagt

SEQ ID NO: 4270932 - DNA, 22 bp, Homo sapiens
acctgggccctggttcccccag

SEQ ID NO: 4270933 - DNA, 24 bp, Homo sapiens
acctggggagtgggacagagtctg

SEQ ID NO: 4270934 - DNA, 16 bp, Homo sapiens
acctgggtgtgctcca

SEQ ID NO: 4270935 - DNA, 13 bp, Homo sapiens
acctggttttcat

SEQ ID NO: 4270936 - DNA, 17 bp, Homo sapiens
acctggttttcattatt

SEQ ID NO: 4270937 - DNA, 22 bp, Homo sapiens
acctggttttcattattttccc

SEQ ID NO: 4270938 - DNA, 14 bp, Homo sapiens
acctgtgaggggaa

SEQ ID NO: 4270939 - DNA, 14 bp, Homo sapiens
acctgtgctgctgc

SEQ ID NO: 4270940 - DNA, 20 bp, Homo sapiens
acctgtggggatttctccca

SEQ ID NO: 4270941 - DNA, 21 bp, Homo sapiens
acctgtggggatttctcccag

SEQ ID NO: 4270942 - DNA, 22 bp, Homo sapiens
acctgtggggatttctcccagc

SEQ ID NO: 4270943 - DNA, 20 bp, Homo sapiens
accttacaaccacatttctg

SEQ ID NO: 4270944 - DNA, 19 bp, Homo sapiens
accttcagtaaacaccatg

SEQ ID NO: 4270945 - DNA, 17 bp, Homo sapiens
accttccctccacctgc

SEQ ID NO: 4270946 - DNA, 12 bp, Homo sapiens
accttcctgggc

SEQ ID NO: 4270947 - DNA, 19 bp, Homo sapiens
accttcctgggcagcccag

SEQ ID NO: 4270948 - DNA, 23 bp, Homo sapiens
accttcctgggcagcccagagag

SEQ ID NO: 4270949 - DNA, 12 bp, Homo sapiens
accttctgaaga

SEQ ID NO: 4270950 - DNA, 15 bp, Homo sapiens
accttctgtggctca

SEQ ID NO: 4270951 - DNA, 16 bp, Homo sapiens
accttctgtggctcac

SEQ ID NO: 4270952 - DNA, 15 bp, Homo sapiens
accttgagacagctt

SEQ ID NO: 4270953 - DNA, 16 bp, Homo sapiens
accttgatgtcttgag

SEQ ID NO: 4270954 - DNA, 20 bp, Homo sapiens
accttgatgtcttgagagcg

SEQ ID NO: 4270955 - DNA, 16 bp, Homo sapiens
accttgcaacacacag

SEQ ID NO: 4270956 - DNA, 17 bp, Homo sapiens
accttgcaacacacaga

SEQ ID NO: 4270957 - DNA, 19 bp, Homo sapiens
accttgcaacacacagaca

SEQ ID NO: 4270958 - DNA, 18 bp, Homo sapiens
acctttcatgtgcctgaa

SEQ ID NO: 4270959 - DNA, 16 bp, Homo sapiens
acctttgtctgaagga

SEQ ID NO: 4270960 - DNA, 22 bp, Homo sapiens
acctttgtctgaaggattttaa

SEQ ID NO: 4270961 - DNA, 13 bp, Homo sapiens
acgaaacacagaa

SEQ ID NO: 4270962 - DNA, 21 bp, Homo sapiens
acgaaacacagaactcagcct

SEQ ID NO: 4270963 - DNA, 11 bp, Homo sapiens
acgagatttgc

SEQ ID NO: 4270964 - DNA, 14 bp, Homo sapiens
acgatccttcaaag

SEQ ID NO: 4270965 - DNA, 22 bp, Homo sapiens
acgatgggatcattatttcatg

SEQ ID NO: 4270966 - DNA, 22 bp, Homo sapiens
acgatgtcaaccttgtgtgagt

SEQ ID NO: 4270967 - DNA, 14 bp, Homo sapiens
acgcaagcctcagc

SEQ ID NO: 4270968 - DNA, 18 bp, Homo sapiens
acgcacacacacacacag

SEQ ID NO: 4270969 - DNA, 23 bp, Homo sapiens
acgcagccctgctttgggctgcc

SEQ ID NO: 4270970 - DNA, 16 bp, Homo sapiens
acgcatgcagggcccc

SEQ ID NO: 4270971 - DNA, 16 bp, Homo sapiens
acgccaaccccagcag

SEQ ID NO: 4270972 - DNA, 17 bp, Homo sapiens
acgccaaccccagcagt

SEQ ID NO: 4270973 - DNA, 16 bp, Homo sapiens
acgcccgactctctcc

SEQ ID NO: 4270974 - DNA, 16 bp, Homo sapiens
acgccctcctccctcc

SEQ ID NO: 4270975 - DNA, 12 bp, Homo sapiens
acgcctctctca

SEQ ID NO: 4270976 - DNA, 19 bp, Homo sapiens
acgcctctctcagcccagg

SEQ ID NO: 4270977 - DNA, 12 bp, Homo sapiens
acgcctgcgatg

SEQ ID NO: 4270978 - DNA, 20 bp, Homo sapiens
acgcctgcgatggtgctgca

SEQ ID NO: 4270979 - DNA, 19 bp, Homo sapiens
acgccttcaggcaccacag

SEQ ID NO: 4270980 - DNA, 22 bp, Homo sapiens
acgcgcgcgcgcgcacacacac

SEQ ID NO: 4270981 - DNA, 14 bp, Homo sapiens
acgctgtctccaga

SEQ ID NO: 4270982 - DNA, 14 bp, Homo sapiens
acggaagtggcctg

SEQ ID NO: 4270983 - DNA, 14 bp, Homo sapiens
acggcactgtggcc

SEQ ID NO: 4270984 - DNA, 15 bp, Homo sapiens
acggcactgtggcct

SEQ ID NO: 4270985 - DNA, 18 bp, Homo sapiens
acggcagccaccctgcca

SEQ ID NO: 4270986 - DNA, 17 bp, Homo sapiens
acggctctaggtggggc

SEQ ID NO: 4270987 - DNA, 17 bp, Homo sapiens
acggctgcacctgcagg

SEQ ID NO: 4270988 - DNA, 19 bp, Homo sapiens
acggggacacggcctctgg

SEQ ID NO: 4270989 - DNA, 15 bp, Homo sapiens
acggggccagcatcc

SEQ ID NO: 4270990 - DNA, 18 bp, Homo sapiens
acgggggttggggtgggg

SEQ ID NO: 4270991 - DNA, 16 bp, Homo sapiens
acggtgagactctgag

SEQ ID NO: 4270992 - DNA, 19 bp, Homo sapiens
acgtccacccgtttccaag

SEQ ID NO: 4270993 - DNA, 14 bp, Homo sapiens
acgtgcacacacct

SEQ ID NO: 4270994 - DNA, 16 bp, Homo sapiens
acgtgcacacacctgc

SEQ ID NO: 4270995 - DNA, 17 bp, Homo sapiens
acgtgcacacacctgca

SEQ ID NO: 4270996 - DNA, 19 bp, Homo sapiens
acgtgcacacacctgcaca

SEQ ID NO: 4270997 - DNA, 14 bp, Homo sapiens
acgtgctggagagt

SEQ ID NO: 4270998 - DNA, 15 bp, Homo sapiens
acgtgtttttgtatc

SEQ ID NO: 4270999 - DNA, 14 bp, Homo sapiens
acgttaattaaaca

SEQ ID NO: 4271000 - DNA, 23 bp, Homo sapiens
acgttatctcattgcaaaaatat

SEQ ID NO: 4271001 - DNA, 12 bp, Homo sapiens
actaaaattcaa

SEQ ID NO: 4271002 - DNA, 17 bp, Homo sapiens
actaaaattcaacaaat

SEQ ID NO: 4271003 - DNA, 18 bp, Homo sapiens
actaaaattcaacaaatg

SEQ ID NO: 4271004 - DNA, 19 bp, Homo sapiens
actaaacttggtgcttatt

SEQ ID NO: 4271005 - DNA, 22 bp, Homo sapiens
actaaataatgatcttccaaat

SEQ ID NO: 4271006 - DNA, 13 bp, Homo sapiens
actaaatatgaaa

SEQ ID NO: 4271007 - DNA, 17 bp, Homo sapiens
actaaatggcagtgaga

SEQ ID NO: 4271008 - DNA, 22 bp, Homo sapiens
actacagccaaattgcagaaga

SEQ ID NO: 4271009 - DNA, 12 bp, Homo sapiens
actacatgcact

SEQ ID NO: 4271010 - DNA, 21 bp, Homo sapiens
actaccccaggacgcatgcag

SEQ ID NO: 4271011 - DNA, 16 bp, Homo sapiens
actagaatattcctta

SEQ ID NO: 4271012 - DNA, 21 bp, Homo sapiens
actagagatattttgtaaaat

SEQ ID NO: 4271013 - DNA, 15 bp, Homo sapiens
actaggccctggtct

SEQ ID NO: 4271014 - DNA, 22 bp, Homo sapiens
actaggtgctggcatgtctggg

SEQ ID NO: 4271015 - DNA, 20 bp, Homo sapiens
actataaacattaaaagaag

SEQ ID NO: 4271016 - DNA, 15 bp, Homo sapiens
actataatgtgaaat

SEQ ID NO: 4271017 - DNA, 22 bp, Homo sapiens
actatatacatcacgttaaagt

SEQ ID NO: 4271018 - DNA, 19 bp, Homo sapiens
actatgcacctataaatac

SEQ ID NO: 4271019 - DNA, 17 bp, Homo sapiens
actatggctgtattttt

SEQ ID NO: 4271020 - DNA, 16 bp, Homo sapiens
actatgtgtcatgatt

SEQ ID NO: 4271021 - DNA, 13 bp, Homo sapiens
actcaaggcctcc

SEQ ID NO: 4271022 - DNA, 16 bp, Homo sapiens
actcacctgctggccc

SEQ ID NO: 4271023 - DNA, 17 bp, Homo sapiens
actcacctgctggcccc

SEQ ID NO: 4271024 - DNA, 19 bp, Homo sapiens
actcacctgctggcccctc

SEQ ID NO: 4271025 - DNA, 20 bp, Homo sapiens
actcacggctgcacctgcag

SEQ ID NO: 4271026 - DNA, 12 bp, Homo sapiens
actcagccttaa

SEQ ID NO: 4271027 - DNA, 18 bp, Homo sapiens
actcagctgtctgtggct

SEQ ID NO: 4271028 - DNA, 17 bp, Homo sapiens
actcaggcagcctgtgg

SEQ ID NO: 4271029 - DNA, 14 bp, Homo sapiens
actcagtcaaatgt

SEQ ID NO: 4271030 - DNA, 13 bp, Homo sapiens
actcatgtgattt

SEQ ID NO: 4271031 - DNA, 17 bp, Homo sapiens
actccaaggcaaatgtc

SEQ ID NO: 4271032 - DNA, 18 bp, Homo sapiens
actccaaggcaaatgtcc

SEQ ID NO: 4271033 - DNA, 22 bp, Homo sapiens
actccaaggcaaatgtccaagc

SEQ ID NO: 4271034 - DNA, 13 bp, Homo sapiens
actccactcccct

SEQ ID NO: 4271035 - DNA, 15 bp, Homo sapiens
actccactcccctca

SEQ ID NO: 4271036 - DNA, 18 bp, Homo sapiens
aggaaacacgtttagaaa

SEQ ID NO: 4271037 - DNA, 18 bp, Homo sapiens
aggaaaccccgagaagga

SEQ ID NO: 4271038 - DNA, 21 bp, Homo sapiens
aggaaactcacctgctggccc

SEQ ID NO: 4271039 - DNA, 16 bp, Homo sapiens
aggaaagcctcactga

SEQ ID NO: 4271040 - DNA, 16 bp, Homo sapiens
aggaaatagtgttctt

SEQ ID NO: 4271041 - DNA, 18 bp, Homo sapiens
aggaaatagtgttctttt

SEQ ID NO: 4271042 - DNA, 16 bp, Homo sapiens
aggaacacccagcccc

SEQ ID NO: 4271043 - DNA, 17 bp, Homo sapiens
aggaacacccagcccca

SEQ ID NO: 4271044 - DNA, 16 bp, Homo sapiens
aggaaccatggacctg

SEQ ID NO: 4271045 - DNA, 17 bp, Homo sapiens
aggaacctctgatttat

SEQ ID NO: 4271046 - DNA, 18 bp, Homo sapiens
aggaacctctgatttatt

SEQ ID NO: 4271047 - DNA, 21 bp, Homo sapiens
gttgggctggtttggtggcca

SEQ ID NO: 4271048 - DNA, 23 bp, Homo sapiens
gttggggtggtttttgagccatg

SEQ ID NO: 4271049 - DNA, 15 bp, Homo sapiens
gttgggttccagaca

SEQ ID NO: 4271050 - DNA, 22 bp, Homo sapiens
gttgggttccagacagagtgga

SEQ ID NO: 4271051 - DNA, 19 bp, Homo sapiens
gttgtctgaagtcactgca

SEQ ID NO: 4271052 - DNA, 13 bp, Homo sapiens
gttgtctgccgtg

SEQ ID NO: 4271053 - DNA, 23 bp, Homo sapiens
gttgtgattccccggagctggga

SEQ ID NO: 4271054 - DNA, 16 bp, Homo sapiens
gttgttcagaagttgt

SEQ ID NO: 4271055 - DNA, 15 bp, Homo sapiens
gttgttgtccctgca

SEQ ID NO: 4271056 - DNA, 15 bp, Homo sapiens
gttgtttgatgtgta

SEQ ID NO: 4271057 - DNA, 19 bp, Homo sapiens
gtttaaaaaaataacatct

SEQ ID NO: 4271058 - DNA, 17 bp, Homo sapiens
gtttacagtgaagaaag

SEQ ID NO: 4271059 - DNA, 18 bp, Homo sapiens
gtttaccctccctgtccc

SEQ ID NO: 4271060 - DNA, 18 bp, Homo sapiens
gtttacctcactggtgca

SEQ ID NO: 4271061 - DNA, 23 bp, Homo sapiens
gtttacctcactggtgcatttaa

SEQ ID NO: 4271062 - DNA, 15 bp, Homo sapiens
gtttagtttgcattt

SEQ ID NO: 4271063 - DNA, 22 bp, Homo sapiens
gtttcagaaagggcagcccctc

SEQ ID NO: 4271064 - DNA, 22 bp, Homo sapiens
gtttcaggagagagttgaacct

SEQ ID NO: 4271065 - DNA, 23 bp, Homo sapiens
gtttcaggagagagttgaaccta

SEQ ID NO: 4271066 - DNA, 20 bp, Homo sapiens
gtttcaggtggaacaggagg

SEQ ID NO: 4271067 - DNA, 15 bp, Homo sapiens
gtttccaagcctggg

SEQ ID NO: 4271068 - DNA, 16 bp, Homo sapiens
gtttccaagcctgggc

SEQ ID NO: 4271069 - DNA, 17 bp, Homo sapiens
gtttccaagcctgggcc

SEQ ID NO: 4271070 - DNA, 17 bp, Homo sapiens
gtttccacacaggccca

SEQ ID NO: 4271071 - DNA, 20 bp, Homo sapiens
gtttccacacaggcccatgc

SEQ ID NO: 4271072 - DNA, 16 bp, Homo sapiens
gtttccaggcatgacc

SEQ ID NO: 4271073 - DNA, 22 bp, Homo sapiens
gtttccaggcatgaccctggag

SEQ ID NO: 4271074 - DNA, 15 bp, Homo sapiens
gtttctgtcctgtaa

SEQ ID NO: 4271075 - DNA, 19 bp, Homo sapiens
gtttctgtcctgtaactgt

SEQ ID NO: 4271076 - DNA, 21 bp, Homo sapiens
gtttctttttcttttttgagt

SEQ ID NO: 4271077 - DNA, 18 bp, Homo sapiens
gtttgcctttaggcagga

SEQ ID NO: 4271078 - DNA, 13 bp, Homo sapiens
gtttgcttctaaa

SEQ ID NO: 4271079 - DNA, 18 bp, Homo sapiens
gtttggcgggccaaggac

SEQ ID NO: 4271080 - DNA, 16 bp, Homo sapiens
gtttgggcagtggaga

SEQ ID NO: 4271081 - DNA, 14 bp, Homo sapiens
gtttggttctgggg

SEQ ID NO: 4271082 - DNA, 18 bp, Homo sapiens
gtttgtccacacaagaca

SEQ ID NO: 4271083 - DNA, 17 bp, Homo sapiens
gtttgttttcaaaatac

SEQ ID NO: 4271084 - DNA, 16 bp, Homo sapiens
gttttaaaaaagcatt

SEQ ID NO: 4271085 - DNA, 21 bp, Homo sapiens
gttttataaggtctgacatca

SEQ ID NO: 4271086 - DNA, 22 bp, Homo sapiens
gttttattcacttgtgtttgta

SEQ ID NO: 4271087 - DNA, 16 bp, Homo sapiens
gttttcaaaatacttc

SEQ ID NO: 4271088 - DNA, 18 bp, Homo sapiens
gttttcagacctttgtct

SEQ ID NO: 4271089 - DNA, 17 bp, Homo sapiens
gttttcattattttccc

SEQ ID NO: 4271090 - DNA, 23 bp, Homo sapiens
gttttcgaagctcagcccacccc

SEQ ID NO: 4271091 - DNA, 17 bp, Homo sapiens
gttttctaaatgtttct

SEQ ID NO: 4271092 - DNA, 16 bp, Homo sapiens
gttttcttttaatttt

SEQ ID NO: 4271093 - DNA, 22 bp, Homo sapiens
gttttgcaagggaatgaatcca

SEQ ID NO: 4271094 - DNA, 16 bp, Homo sapiens
gttttgcatgtctgca

SEQ ID NO: 4271095 - DNA, 13 bp, Homo sapiens
gtttttacagtgt

SEQ ID NO: 4271096 - DNA, 18 bp, Homo sapiens
taaaaaaaaacattcaaa

SEQ ID NO: 4271097 - DNA, 17 bp, Homo sapiens
taaaaaaataacatctc

SEQ ID NO: 4271098 - DNA, 13 bp, Homo sapiens
taaaaaagcatta

SEQ ID NO: 4271099 - DNA, 12 bp, Homo sapiens
taaaaaataaca

SEQ ID NO: 4271100 - DNA, 22 bp, Homo sapiens
taaaaaataacatattcttgct

SEQ ID NO: 4271101 - DNA, 21 bp, Homo sapiens
taaaaaataactgtgcactat

SEQ ID NO: 4271102 - DNA, 12 bp, Homo sapiens
taaaaaatgaat

SEQ ID NO: 4271103 - DNA, 12 bp, Homo sapiens
taaaaagttaat

SEQ ID NO: 4271104 - DNA, 18 bp, Homo sapiens
taaaaataaccaaaaaat

SEQ ID NO: 4271105 - DNA, 22 bp, Homo sapiens
taaaaataaccaaaaaatgtga

SEQ ID NO: 4271106 - DNA, 19 bp, Homo sapiens
taaaacagtgtttccagtg

SEQ ID NO: 4271107 - DNA, 13 bp, Homo sapiens
taaaaccaaaggt

SEQ ID NO: 4271108 - DNA, 23 bp, Homo sapiens
taaaaccttacttaaagcttgtt

SEQ ID NO: 4271109 - DNA, 22 bp, Homo sapiens
taaaaccttccatgtcaagatt

SEQ ID NO: 4271110 - DNA, 19 bp, Homo sapiens
taaaaggtgacccttctgt

SEQ ID NO: 4271111 - DNA, 14 bp, Homo sapiens
taaaataaataatc

SEQ ID NO: 4271112 - DNA, 15 bp, Homo sapiens
taaaataaataatct

SEQ ID NO: 4271113 - DNA, 15 bp, Homo sapiens
taaaatagttttcta

SEQ ID NO: 4271114 - DNA, 16 bp, Homo sapiens
taaaatagttttctaa

SEQ ID NO: 4271115 - DNA, 17 bp, Homo sapiens
taaaatctattttgtct

SEQ ID NO: 4271116 - DNA, 19 bp, Homo sapiens
taaaatctattttgtctga

SEQ ID NO: 4271117 - DNA, 15 bp, Homo sapiens
taaaatctcctaaat

SEQ ID NO: 4271118 - DNA, 12 bp, Homo sapiens
taaaattagtga

SEQ ID NO: 4271119 - DNA, 17 bp, Homo sapiens
taaaattagtgagattt

SEQ ID NO: 4271120 - DNA, 22 bp, Homo sapiens
taaaattagtgagatttgtatt

SEQ ID NO: 4271121 - DNA, 16 bp, Homo sapiens
taaaattatactgtgt

SEQ ID NO: 4271122 - DNA, 19 bp, Homo sapiens
taaaattatactgtgtgtg

SEQ ID NO: 4271123 - DNA, 13 bp, Homo sapiens
taaaattcaacaa

SEQ ID NO: 4271124 - DNA, 15 bp, Homo sapiens
taaacaccatgaaga

SEQ ID NO: 4271125 - DNA, 13 bp, Homo sapiens
taaacactttttc

SEQ ID NO: 4271126 - DNA, 15 bp, Homo sapiens
taaacactttttctg

SEQ ID NO: 4271127 - DNA, 19 bp, Homo sapiens
taaacagggcatctccagg

SEQ ID NO: 4271128 - DNA, 20 bp, Homo sapiens
taaacagggcatctccagga

SEQ ID NO: 4271129 - DNA, 20 bp, Homo sapiens
taaaccataaaataaataat

SEQ ID NO: 4271130 - DNA, 19 bp, Homo sapiens
taaaccttaatatttcttc

SEQ ID NO: 4271131 - DNA, 21 bp, Homo sapiens
taaactgttaacttattcaaa

SEQ ID NO: 4271132 - DNA, 22 bp, Homo sapiens
taaacttggtgcttattgatat

SEQ ID NO: 4271133 - DNA, 14 bp, Homo sapiens
taaacttttaccac

SEQ ID NO: 4271134 - DNA, 14 bp, Homo sapiens
taaagaagaaaata

SEQ ID NO: 4271135 - DNA, 16 bp, Homo sapiens
taaagacttgatgaat

SEQ ID NO: 4271136 - DNA, 21 bp, Homo sapiens
taaagacttgatgaataaaca

SEQ ID NO: 4271137 - DNA, 23 bp, Homo sapiens
taaagacttgatgaataaacact

SEQ ID NO: 4271138 - DNA, 21 bp, Homo sapiens
taaagaggagcctttccagaa

SEQ ID NO: 4271139 - DNA, 19 bp, Homo sapiens
taaagaggcgtcttgtatt

SEQ ID NO: 4271140 - DNA, 21 bp, Homo sapiens
taaagcaagctcacttgcttt

SEQ ID NO: 4271141 - DNA, 21 bp, Homo sapiens
taaaggtttatttttctgtta

SEQ ID NO: 4271142 - DNA, 21 bp, Homo sapiens
taaaggtttcactgttcatga

SEQ ID NO: 4271143 - DNA, 13 bp, Homo sapiens
taaagtctgtctg

SEQ ID NO: 4271144 - DNA, 17 bp, Homo sapiens
taaagtgagaaaactgt

SEQ ID NO: 4271145 - DNA, 21 bp, Homo sapiens
taaataaagaagaaaataacc

SEQ ID NO: 4271146 - DNA, 14 bp, Homo sapiens
taaataatgatctt

SEQ ID NO: 4271147 - DNA, 13 bp, Homo sapiens
taaatagcatctg

SEQ ID NO: 4271148 - DNA, 17 bp, Homo sapiens
taaatagcatctgctct

SEQ ID NO: 4271149 - DNA, 20 bp, Homo sapiens
taaatatatatatatttctc

SEQ ID NO: 4271150 - DNA, 20 bp, Homo sapiens
taaatcatatataataaatt

SEQ ID NO: 4271151 - DNA, 16 bp, Homo sapiens
taaatccattttctaa

SEQ ID NO: 4271152 - DNA, 18 bp, Homo sapiens
taaatccattttctaaac

SEQ ID NO: 4271153 - DNA, 21 bp, Homo sapiens
taaatccattttctaaactgt

SEQ ID NO: 4271154 - DNA, 14 bp, Homo sapiens
taaatctgtctgat

SEQ ID NO: 4271155 - DNA, 17 bp, Homo sapiens
taaatctgtctgattct

SEQ ID NO: 4271156 - DNA, 20 bp, Homo sapiens
taaatctgtctgattctatg

SEQ ID NO: 4271157 - DNA, 12 bp, Homo sapiens
taaatgattcca

SEQ ID NO: 4271158 - DNA, 13 bp, Homo sapiens
taaatgattccaa

SEQ ID NO: 4271159 - DNA, 16 bp, Homo sapiens
taaatgctacctctga

SEQ ID NO: 4271160 - DNA, 21 bp, Homo sapiens
taaatgctacctctgatcaaa

SEQ ID NO: 4271161 - DNA, 15 bp, Homo sapiens
taaatgctgtatgtc

SEQ ID NO: 4271162 - DNA, 23 bp, Homo sapiens
taaatgtagcttcagtcattaaa

SEQ ID NO: 4271163 - DNA, 14 bp, Homo sapiens
taaatgtgtgtatg

SEQ ID NO: 4271164 - DNA, 15 bp, Homo sapiens
taaatgtgtgtatgt

SEQ ID NO: 4271165 - DNA, 16 bp, Homo sapiens
taaatgtgtgtatgtg

SEQ ID NO: 4271166 - DNA, 18 bp, Homo sapiens
taaatgtttctttttctt

SEQ ID NO: 4271167 - DNA, 23 bp, Homo sapiens
taaattcaacacttattttctga

SEQ ID NO: 4271168 - DNA, 16 bp, Homo sapiens
taaattggtgataagt

SEQ ID NO: 4271169 - DNA, 23 bp, Homo sapiens
taaatttaagtaagttttataag

SEQ ID NO: 4271170 - DNA, 19 bp, Homo sapiens
taaatttaatatactgcat

SEQ ID NO: 4271171 - DNA, 20 bp, Homo sapiens
taaatttaatatactgcata

SEQ ID NO: 4271172 - DNA, 23 bp, Homo sapiens
taaattttaatgtaaaattcata

SEQ ID NO: 4271173 - DNA, 15 bp, Homo sapiens
taaattttcagaaag

SEQ ID NO: 4271174 - DNA, 18 bp, Homo sapiens
taacaatgcctattgtaa

SEQ ID NO: 4271175 - DNA, 16 bp, Homo sapiens
taacaatgtatgtgaa

SEQ ID NO: 4271176 - DNA, 22 bp, Homo sapiens
taacaatgtatgtgaaagtgta

SEQ ID NO: 4271177 - DNA, 14 bp, Homo sapiens
taacaattaattgt

SEQ ID NO: 4271178 - DNA, 17 bp, Homo sapiens
taacacataaagtaaat

SEQ ID NO: 4271179 - DNA, 21 bp, Homo sapiens
taacacataaagtaaatgcta

SEQ ID NO: 4271180 - DNA, 17 bp, Homo sapiens
gtggtcttggagaggag

SEQ ID NO: 4271181 - DNA, 20 bp, Homo sapiens
gtggtcttggagaggaggtg

SEQ ID NO: 4271182 - DNA, 21 bp, Homo sapiens
gtggtgaggttgtgctgcctg

SEQ ID NO: 4271183 - DNA, 22 bp, Homo sapiens
gtggttggaggcctggtctgga

SEQ ID NO: 4271184 - DNA, 16 bp, Homo sapiens
gtggtttttgagccat

SEQ ID NO: 4271185 - DNA, 19 bp, Homo sapiens
gtgtaatcatttcttgggc

SEQ ID NO: 4271186 - DNA, 16 bp, Homo sapiens
gtgtaatctctgatta

SEQ ID NO: 4271187 - DNA, 20 bp, Homo sapiens
gtgtactatggctgtatttt

SEQ ID NO: 4271188 - DNA, 15 bp, Homo sapiens
gtgtaggaagaggcc

SEQ ID NO: 4271189 - DNA, 22 bp, Homo sapiens
gtgtaggaagaggccgctgcag

SEQ ID NO: 4271190 - DNA, 19 bp, Homo sapiens
gtgtatcagtgtttatgtg

SEQ ID NO: 4271191 - DNA, 20 bp, Homo sapiens
gtgtatctcgaagtcttcca

SEQ ID NO: 4271192 - DNA, 19 bp, Homo sapiens
gtgtatgtgtttataattg

SEQ ID NO: 4271193 - DNA, 20 bp, Homo sapiens
gtgtattctgtggattctat

SEQ ID NO: 4271194 - DNA, 15 bp, Homo sapiens
gtgtcaaggggccct

SEQ ID NO: 4271195 - DNA, 14 bp, Homo sapiens
gtgtcacagaggca

SEQ ID NO: 4271196 - DNA, 23 bp, Homo sapiens
gtgtcacagaggcagtggcagca

SEQ ID NO: 4271197 - DNA, 19 bp, Homo sapiens
gtgtccccaggggcacact

SEQ ID NO: 4271198 - DNA, 16 bp, Homo sapiens
gtgtccctctctctgg

SEQ ID NO: 4271199 - DNA, 18 bp, Homo sapiens
gtgtccctctctctggaa

SEQ ID NO: 4271200 - DNA, 16 bp, Homo sapiens
gtgtccctgcctggcc

SEQ ID NO: 4271201 - DNA, 18 bp, Homo sapiens
gtgtccctgcctggccct

SEQ ID NO: 4271202 - DNA, 21 bp, Homo sapiens
gtgtcgcctctcactctggca

SEQ ID NO: 4271203 - DNA, 20 bp, Homo sapiens
gtgtctgtccatctgtctgt

SEQ ID NO: 4271204 - DNA, 14 bp, Homo sapiens
gtgtgaatgctgta

SEQ ID NO: 4271205 - DNA, 15 bp, Homo sapiens
gtgtgacatcagtgg

SEQ ID NO: 4271206 - DNA, 12 bp, Homo sapiens
gtgtgagcaggg

SEQ ID NO: 4271207 - DNA, 15 bp, Homo sapiens
gtgtgagcagggtga

SEQ ID NO: 4271208 - DNA, 16 bp, Homo sapiens
gtgtgagcagggtgac

SEQ ID NO: 4271209 - DNA, 14 bp, Homo sapiens
gtgtgaggctccct

SEQ ID NO: 4271210 - DNA, 16 bp, Homo sapiens
gtgtgattgaatctga

SEQ ID NO: 4271211 - DNA, 18 bp, Homo sapiens
gtgtgccaccctctgcag

SEQ ID NO: 4271212 - DNA, 20 bp, Homo sapiens
gtgtgccaccctctgcaggg

SEQ ID NO: 4271213 - DNA, 16 bp, Homo sapiens
gtgtgctccaggcttc

SEQ ID NO: 4271214 - DNA, 22 bp, Homo sapiens
gtgtgctccaggcttcctgccc

SEQ ID NO: 4271215 - DNA, 15 bp, Homo sapiens
gtgtgctgaggtggg

SEQ ID NO: 4271216 - DNA, 14 bp, Homo sapiens
gtgtggactctgga

SEQ ID NO: 4271217 - DNA, 16 bp, Homo sapiens
gtgtggactctggact

SEQ ID NO: 4271218 - DNA, 12 bp, Homo sapiens
gtgtggagctgc

SEQ ID NO: 4271219 - DNA, 19 bp, Homo sapiens
gtgtggagctgcttccagt

SEQ ID NO: 4271220 - DNA, 12 bp, Homo sapiens
gtgtggagtgga

SEQ ID NO: 4271221 - DNA, 13 bp, Homo sapiens
gtgtggagtggag

SEQ ID NO: 4271222 - DNA, 14 bp, Homo sapiens
gtgtggagtggagg

SEQ ID NO: 4271223 - DNA, 19 bp, Homo sapiens
gtgtggagtggaggggtca

SEQ ID NO: 4271224 - DNA, 12 bp, Homo sapiens
gtgtggcttgga

SEQ ID NO: 4271225 - DNA, 15 bp, Homo sapiens
gtgtggcttggaaca

SEQ ID NO: 4271226 - DNA, 11 bp, Homo sapiens
gtgtgggctcc

SEQ ID NO: 4271227 - DNA, 15 bp, Homo sapiens
gtgtggggagggtgg

SEQ ID NO: 4271228 - DNA, 21 bp, Homo sapiens
gtgtggtcagcggcctgggga

SEQ ID NO: 4271229 - DNA, 16 bp, Homo sapiens
gtgtgtagatagtatg

SEQ ID NO: 4271230 - DNA, 23 bp, Homo sapiens
gtgtgtatgtgtgtttctgtcct

SEQ ID NO: 4271231 - DNA, 14 bp, Homo sapiens
gtgtgttttggtat

SEQ ID NO: 4271232 - DNA, 20 bp, Homo sapiens
gtgttaatcttaatgtatat

SEQ ID NO: 4271233 - DNA, 16 bp, Homo sapiens
gtgttagtgtctgtcc

SEQ ID NO: 4271234 - DNA, 16 bp, Homo sapiens
gtgttcgtggagccac

SEQ ID NO: 4271235 - DNA, 23 bp, Homo sapiens
gtgttcgtggagccacaggcaga

SEQ ID NO: 4271236 - DNA, 19 bp, Homo sapiens
gtgttctcaatgcttttct

SEQ ID NO: 4271237 - DNA, 14 bp, Homo sapiens
gtgttctggcctct

SEQ ID NO: 4271238 - DNA, 12 bp, Homo sapiens
gtgttcttccca

SEQ ID NO: 4271239 - DNA, 17 bp, Homo sapiens
gtgttctttttaaaaag

SEQ ID NO: 4271240 - DNA, 21 bp, Homo sapiens
gtgttgggccccagggaacta

SEQ ID NO: 4271241 - DNA, 16 bp, Homo sapiens
gtgttgtgctttcaag

SEQ ID NO: 4271242 - DNA, 15 bp, Homo sapiens
gtgttgttttctctg

SEQ ID NO: 4271243 - DNA, 23 bp, Homo sapiens
gtgtttaacggcactgtggcctt

SEQ ID NO: 4271244 - DNA, 22 bp, Homo sapiens
gtgtttcaggtggaacaggagg

SEQ ID NO: 4271245 - DNA, 11 bp, Homo sapiens
gtgtttccagt

SEQ ID NO: 4271246 - DNA, 20 bp, Homo sapiens
gtgtttctgtcctgtaactg

SEQ ID NO: 4271247 - DNA, 17 bp, Homo sapiens
gtgtttgaattgatttt

SEQ ID NO: 4271248 - DNA, 16 bp, Homo sapiens
gttaaacgtcacagca

SEQ ID NO: 4271249 - DNA, 13 bp, Homo sapiens
gttaagaatgtat

SEQ ID NO: 4271250 - DNA, 20 bp, Homo sapiens
gttaaggggatctaaaagga

SEQ ID NO: 4271251 - DNA, 14 bp, Homo sapiens
gttaatcttaatgt

SEQ ID NO: 4271252 - DNA, 17 bp, Homo sapiens
gttaatcttaatgtata

SEQ ID NO: 4271253 - DNA, 13 bp, Homo sapiens
gttaattaaacaa

SEQ ID NO: 4271254 - DNA, 22 bp, Homo sapiens
gttacagtaatgtcataaagtg

SEQ ID NO: 4271255 - DNA, 15 bp, Homo sapiens
gttactacatgcact

SEQ ID NO: 4271256 - DNA, 17 bp, Homo sapiens
gttagacaagcctggag

SEQ ID NO: 4271257 - DNA, 19 bp, Homo sapiens
gttagacaagcctggagga

SEQ ID NO: 4271258 - DNA, 16 bp, Homo sapiens
gttagcacagaggatg

SEQ ID NO: 4271259 - DNA, 16 bp, Homo sapiens
gttaggggtgggggag

SEQ ID NO: 4271260 - DNA, 13 bp, Homo sapiens
gttagtaatctgt

SEQ ID NO: 4271261 - DNA, 17 bp, Homo sapiens
gttagtaatctgtataa

SEQ ID NO: 4271262 - DNA, 16 bp, Homo sapiens
gttagtgatttgctat

SEQ ID NO: 4271263 - DNA, 18 bp, Homo sapiens
gttagtgatttgctatca

SEQ ID NO: 4271264 - DNA, 15 bp, Homo sapiens
gttatatcatcaata

SEQ ID NO: 4271265 - DNA, 20 bp, Homo sapiens
gttatggtagaaaaatttca

SEQ ID NO: 4271266 - DNA, 20 bp, Homo sapiens
gttcatagtcaatcaaacag

SEQ ID NO: 4271267 - DNA, 12 bp, Homo sapiens
gttcatgaatac

SEQ ID NO: 4271268 - DNA, 13 bp, Homo sapiens
gttcatgcctggg

SEQ ID NO: 4271269 - DNA, 14 bp, Homo sapiens
gttcatgcctgggg

SEQ ID NO: 4271270 - DNA, 19 bp, Homo sapiens
gttcatgtgtaacttctag

SEQ ID NO: 4271271 - DNA, 12 bp, Homo sapiens
gttcatttccac

SEQ ID NO: 4271272 - DNA, 13 bp, Homo sapiens
gttcatttcctca

SEQ ID NO: 4271273 - DNA, 22 bp, Homo sapiens
gttccagacagagtggatctgg

SEQ ID NO: 4271274 - DNA, 21 bp, Homo sapiens
gttccagacagggtggggctt

SEQ ID NO: 4271275 - DNA, 21 bp, Homo sapiens
gttccatcctgtacaagtgct

SEQ ID NO: 4271276 - DNA, 15 bp, Homo sapiens
gttcccactggctcc

SEQ ID NO: 4271277 - DNA, 16 bp, Homo sapiens
gttcccactggctcct

SEQ ID NO: 4271278 - DNA, 15 bp, Homo sapiens
gttcccccagccctg

SEQ ID NO: 4271279 - DNA, 16 bp, Homo sapiens
gttcccccagccctgt

SEQ ID NO: 4271280 - DNA, 18 bp, Homo sapiens
gttcccctgttcactcta

SEQ ID NO: 4271281 - DNA, 12 bp, Homo sapiens
gttccctgctgg

SEQ ID NO: 4271282 - DNA, 18 bp, Homo sapiens
gttcctaaactctgaaat

SEQ ID NO: 4271283 - DNA, 17 bp, Homo sapiens
gttcctgcagcagagcc

SEQ ID NO: 4271284 - DNA, 16 bp, Homo sapiens
gttcctggctcagcct

SEQ ID NO: 4271285 - DNA, 16 bp, Homo sapiens
gttcgtggagccacag

SEQ ID NO: 4271286 - DNA, 15 bp, Homo sapiens
gttctaacacatttc

SEQ ID NO: 4271287 - DNA, 12 bp, Homo sapiens
gttctagaagga

SEQ ID NO: 4271288 - DNA, 17 bp, Homo sapiens
gttctatttctatctgc

SEQ ID NO: 4271289 - DNA, 14 bp, Homo sapiens
gttctcagagctcc

SEQ ID NO: 4271290 - DNA, 19 bp, Homo sapiens
gttctcagagctccacaga

SEQ ID NO: 4271291 - DNA, 15 bp, Homo sapiens
gttctcccatggggg

SEQ ID NO: 4271292 - DNA, 16 bp, Homo sapiens
gttctcccatgggggc

SEQ ID NO: 4271293 - DNA, 23 bp, Homo sapiens
gttctcccatgggggctccagac

SEQ ID NO: 4271294 - DNA, 15 bp, Homo sapiens
gttctgaaaactgtt

SEQ ID NO: 4271295 - DNA, 20 bp, Homo sapiens
gttctgcagacacgccttcc

SEQ ID NO: 4271296 - DNA, 21 bp, Homo sapiens
gttctgcagacacgccttccc

SEQ ID NO: 4271297 - DNA, 14 bp, Homo sapiens
gttctggaggagga

SEQ ID NO: 4271298 - DNA, 16 bp, Homo sapiens
gttctggcctctggcc

SEQ ID NO: 4271299 - DNA, 19 bp, Homo sapiens
gttctggcctctggcctgg

SEQ ID NO: 4271300 - DNA, 15 bp, Homo sapiens
gttctggggcccctt

SEQ ID NO: 4271301 - DNA, 16 bp, Homo sapiens
gttctggggctgagag

SEQ ID NO: 4271302 - DNA, 11 bp, Homo sapiens
gttctgtgtct

SEQ ID NO: 4271303 - DNA, 16 bp, Homo sapiens
gttctgtgtctgctgt

SEQ ID NO: 4271304 - DNA, 17 bp, Homo sapiens
gttctgtgtctgctgta

SEQ ID NO: 4271305 - DNA, 22 bp, Homo sapiens
gttctttcctttcatcctcagc

SEQ ID NO: 4271306 - DNA, 12 bp, Homo sapiens
gttgatgaccaa

SEQ ID NO: 4271307 - DNA, 11 bp, Homo sapiens
gttgcacagca

SEQ ID NO: 4271308 - DNA, 16 bp, Homo sapiens
gttgcacagctatgaa

SEQ ID NO: 4271309 - DNA, 16 bp, Homo sapiens
gttgccattttgtctg

SEQ ID NO: 4271310 - DNA, 17 bp, Homo sapiens
gttgcctctctgccagc

SEQ ID NO: 4271311 - DNA, 19 bp, Homo sapiens
gttgctgttgttcagaagt

SEQ ID NO: 4271312 - DNA, 18 bp, Homo sapiens
gttggaactgctgccatg

SEQ ID NO: 4271313 - DNA, 14 bp, Homo sapiens
gttggactgtggcc

SEQ ID NO: 4271314 - DNA, 14 bp, Homo sapiens
gttggaggggcagg

SEQ ID NO: 4271315 - DNA, 14 bp, Homo sapiens
gttggcctcagcag

SEQ ID NO: 4271316 - DNA, 16 bp, Homo sapiens
gtgaggagggggagaa

SEQ ID NO: 4271317 - DNA, 15 bp, Homo sapiens
gtgagggaggcctga

SEQ ID NO: 4271318 - DNA, 17 bp, Homo sapiens
gtgagggtgacagaggg

SEQ ID NO: 4271319 - DNA, 18 bp, Homo sapiens
gtgagggtgacagaggga

SEQ ID NO: 4271320 - DNA, 16 bp, Homo sapiens
gtgagggtgcagggac

SEQ ID NO: 4271321 - DNA, 17 bp, Homo sapiens
gtgaggttgtgctgcct

SEQ ID NO: 4271322 - DNA, 16 bp, Homo sapiens
gtgagtgtggctcccc

SEQ ID NO: 4271323 - DNA, 11 bp, Homo sapiens
gtgataagtgg

SEQ ID NO: 4271324 - DNA, 13 bp, Homo sapiens
gtgataagtggaa

SEQ ID NO: 4271325 - DNA, 14 bp, Homo sapiens
gtgatgggagtaag

SEQ ID NO: 4271326 - DNA, 16 bp, Homo sapiens
gtgatggttcccctgt

SEQ ID NO: 4271327 - DNA, 22 bp, Homo sapiens
gtgatggttcccctgttcactc

SEQ ID NO: 4271328 - DNA, 15 bp, Homo sapiens
gtgatgtgagttgca

SEQ ID NO: 4271329 - DNA, 18 bp, Homo sapiens
gtgattccccggagctgg

SEQ ID NO: 4271330 - DNA, 23 bp, Homo sapiens
gtgatttttttttttttcctgtc

SEQ ID NO: 4271331 - DNA, 15 bp, Homo sapiens
gtgcaatatgagggg

SEQ ID NO: 4271332 - DNA, 23 bp, Homo sapiens
gtgcaatatgaggggactgcatg

SEQ ID NO: 4271333 - DNA, 24 bp, Homo sapiens
gtgcaatatgaggggactgcatgc

SEQ ID NO: 4271334 - DNA, 15 bp, Homo sapiens
gtgcaatatgtaaca

SEQ ID NO: 4271335 - DNA, 12 bp, Homo sapiens
gtgcacacacct

SEQ ID NO: 4271336 - DNA, 14 bp, Homo sapiens
gtgcacacacctgc

SEQ ID NO: 4271337 - DNA, 14 bp, Homo sapiens
gtgcacagccccta

SEQ ID NO: 4271338 - DNA, 15 bp, Homo sapiens
gtgcacccgtgccac

SEQ ID NO: 4271339 - DNA, 14 bp, Homo sapiens
gtgcacggggccag

SEQ ID NO: 4271340 - DNA, 18 bp, Homo sapiens
gtgcagccggggagctga

SEQ ID NO: 4271341 - DNA, 23 bp, Homo sapiens
gtgcagccggggagctgaggggc

SEQ ID NO: 4271342 - DNA, 13 bp, Homo sapiens
gtgcatctcagcc

SEQ ID NO: 4271343 - DNA, 17 bp, Homo sapiens
gtgcatttaaaatggac

SEQ ID NO: 4271344 - DNA, 19 bp, Homo sapiens
gtgcatttctgggccttat

SEQ ID NO: 4271345 - DNA, 24 bp, Homo sapiens
gtgccaaatcctgggcatccccag

SEQ ID NO: 4271346 - DNA, 23 bp, Homo sapiens
gtgccaaccacctctggccctgt

SEQ ID NO: 4271347 - DNA, 14 bp, Homo sapiens
gtgccaccctctgc

SEQ ID NO: 4271348 - DNA, 15 bp, Homo sapiens
gtgccaccctctgca

SEQ ID NO: 4271349 - DNA, 16 bp, Homo sapiens
gtgccaccctctgcag

SEQ ID NO: 4271350 - DNA, 19 bp, Homo sapiens
gtgccaccctctgcagggc

SEQ ID NO: 4271351 - DNA, 17 bp, Homo sapiens
gtgccacgcgctctgca

SEQ ID NO: 4271352 - DNA, 15 bp, Homo sapiens
gtgccagacgtgctc

SEQ ID NO: 4271353 - DNA, 20 bp, Homo sapiens
gtgccatggtgttggagggg

SEQ ID NO: 4271354 - DNA, 20 bp, Homo sapiens
gtgcccaagaatagatgctg

SEQ ID NO: 4271355 - DNA, 20 bp, Homo sapiens
gtgcccaccagctggctctg

SEQ ID NO: 4271356 - DNA, 13 bp, Homo sapiens
gtgcccctgctgc

SEQ ID NO: 4271357 - DNA, 19 bp, Homo sapiens
gtgcccctgctgcctcccc

SEQ ID NO: 4271358 - DNA, 16 bp, Homo sapiens
gtgcccgctgcgctgc

SEQ ID NO: 4271359 - DNA, 21 bp, Homo sapiens
gtgcccgctgcgctgccctgc

SEQ ID NO: 4271360 - DNA, 23 bp, Homo sapiens
gtgcccgctgcgctgccctgcaa

SEQ ID NO: 4271361 - DNA, 18 bp, Homo sapiens
gtgcccttaaaataatga

SEQ ID NO: 4271362 - DNA, 15 bp, Homo sapiens
gtgcctcttgggaga

SEQ ID NO: 4271363 - DNA, 21 bp, Homo sapiens
gtgcctcttgggagacgtcca

SEQ ID NO: 4271364 - DNA, 18 bp, Homo sapiens
gtgcctgctatccagccg

SEQ ID NO: 4271365 - DNA, 20 bp, Homo sapiens
gtgcctgtgaccggggtcct

SEQ ID NO: 4271366 - DNA, 22 bp, Homo sapiens
gtgcctgtgaccggggtcctga

SEQ ID NO: 4271367 - DNA, 19 bp, Homo sapiens
gtgcgctagagcattctgg

SEQ ID NO: 4271368 - DNA, 14 bp, Homo sapiens
gtgctattaatatt

SEQ ID NO: 4271369 - DNA, 19 bp, Homo sapiens
gtgctcaacctacagtgga

SEQ ID NO: 4271370 - DNA, 16 bp, Homo sapiens
gtgctccaggcttcct

SEQ ID NO: 4271371 - DNA, 22 bp, Homo sapiens
gtgctccaggcttcctgcccta

SEQ ID NO: 4271372 - DNA, 16 bp, Homo sapiens
gtgctccagtgttttc

SEQ ID NO: 4271373 - DNA, 17 bp, Homo sapiens
gtgctccctcctcagtc

SEQ ID NO: 4271374 - DNA, 15 bp, Homo sapiens
gtgctgaggtgggcc

SEQ ID NO: 4271375 - DNA, 18 bp, Homo sapiens
gtgctgcacccctggtgt

SEQ ID NO: 4271376 - DNA, 18 bp, Homo sapiens
gtgctgcccgagggcagg

SEQ ID NO: 4271377 - DNA, 20 bp, Homo sapiens
gtgctggtctctaggcctga

SEQ ID NO: 4271378 - DNA, 22 bp, Homo sapiens
gtgctgtgcacccgtgccacgc

SEQ ID NO: 4271379 - DNA, 17 bp, Homo sapiens
gtgcttagaaacctcac

SEQ ID NO: 4271380 - DNA, 21 bp, Homo sapiens
gtgcttatgtcatttcttctc

SEQ ID NO: 4271381 - DNA, 21 bp, Homo sapiens
gtgcttattgatattctaaga

SEQ ID NO: 4271382 - DNA, 12 bp, Homo sapiens
gtgcttgaagat

SEQ ID NO: 4271383 - DNA, 21 bp, Homo sapiens
gtgctttgctggagtcctgtt

SEQ ID NO: 4271384 - DNA, 17 bp, Homo sapiens
gtggaaaaaagagaaaa

SEQ ID NO: 4271385 - DNA, 19 bp, Homo sapiens
gtggaaaaaagagaaaaac

SEQ ID NO: 4271386 - DNA, 22 bp, Homo sapiens
gtggaaagggtgctgcttccct

SEQ ID NO: 4271387 - DNA, 14 bp, Homo sapiens
gtggaacaggagga

SEQ ID NO: 4271388 - DNA, 17 bp, Homo sapiens
gtggaacaggaggaact

SEQ ID NO: 4271389 - DNA, 19 bp, Homo sapiens
gtggaacaggaggaactgg

SEQ ID NO: 4271390 - DNA, 20 bp, Homo sapiens
gtggaacaggaggaactggt

SEQ ID NO: 4271391 - DNA, 22 bp, Homo sapiens
gtggaaccaaaacccatcgtgg

SEQ ID NO: 4271392 - DNA, 20 bp, Homo sapiens
gtggacagacccagggtggt

SEQ ID NO: 4271393 - DNA, 16 bp, Homo sapiens
gtggacatcatgaagc

SEQ ID NO: 4271394 - DNA, 12 bp, Homo sapiens
gtggactctgga

SEQ ID NO: 4271395 - DNA, 22 bp, Homo sapiens
gtggactttccaccccctccct

SEQ ID NO: 4271396 - DNA, 14 bp, Homo sapiens
gtggagaggagaga

SEQ ID NO: 4271397 - DNA, 15 bp, Homo sapiens
gtggagaggagagaa

SEQ ID NO: 4271398 - DNA, 18 bp, Homo sapiens
gtggagaggagagaatga

SEQ ID NO: 4271399 - DNA, 18 bp, Homo sapiens
gtggagccacaggcagac

SEQ ID NO: 4271400 - DNA, 23 bp, Homo sapiens
gtggagcccgcacccccaccctt

SEQ ID NO: 4271401 - DNA, 21 bp, Homo sapiens
gtggaggcgagccagattagg

SEQ ID NO: 4271402 - DNA, 14 bp, Homo sapiens
gtggagtcgagctg

SEQ ID NO: 4271403 - DNA, 16 bp, Homo sapiens
gtggagtcgagctggc

SEQ ID NO: 4271404 - DNA, 16 bp, Homo sapiens
gtggcacttcgtggat

SEQ ID NO: 4271405 - DNA, 12 bp, Homo sapiens
gtggcaggagga

SEQ ID NO: 4271406 - DNA, 13 bp, Homo sapiens
gtggcaggaggac

SEQ ID NO: 4271407 - DNA, 15 bp, Homo sapiens
gtggccaggctggta

SEQ ID NO: 4271408 - DNA, 12 bp, Homo sapiens
gtggcccctcct

SEQ ID NO: 4271409 - DNA, 17 bp, Homo sapiens
gtggccggccctgcccc

SEQ ID NO: 4271410 - DNA, 16 bp, Homo sapiens
gtggccgggggtgggg

SEQ ID NO: 4271411 - DNA, 19 bp, Homo sapiens
gtggcctacaaatcagtaa

SEQ ID NO: 4271412 - DNA, 19 bp, Homo sapiens
gtggcctcaaccctccctc

SEQ ID NO: 4271413 - DNA, 20 bp, Homo sapiens
gtggcctcaaccctccctca

SEQ ID NO: 4271414 - DNA, 11 bp, Homo sapiens
gtggcctcagc

SEQ ID NO: 4271415 - DNA, 13 bp, Homo sapiens
gtggcctcagcat

SEQ ID NO: 4271416 - DNA, 15 bp, Homo sapiens
gtggcctcaggaggc

SEQ ID NO: 4271417 - DNA, 15 bp, Homo sapiens
gtggcctgagaagag

SEQ ID NO: 4271418 - DNA, 16 bp, Homo sapiens
gtggctcccagcagag

SEQ ID NO: 4271419 - DNA, 23 bp, Homo sapiens
gtggctcccctctatttagcatg

SEQ ID NO: 4271420 - DNA, 20 bp, Homo sapiens
gtggctcctcccggtgccca

SEQ ID NO: 4271421 - DNA, 15 bp, Homo sapiens
gtggcttcagcccct

SEQ ID NO: 4271422 - DNA, 20 bp, Homo sapiens
gtggcttcccgctcagccct

SEQ ID NO: 4271423 - DNA, 18 bp, Homo sapiens
gtggcttggaacatttgg

SEQ ID NO: 4271424 - DNA, 19 bp, Homo sapiens
gtggcttggagcagaggtg

SEQ ID NO: 4271425 - DNA, 18 bp, Homo sapiens
gtggctttcatttcttat

SEQ ID NO: 4271426 - DNA, 17 bp, Homo sapiens
gtgggaagagggcaggg

SEQ ID NO: 4271427 - DNA, 15 bp, Homo sapiens
gtgggacacagagac

SEQ ID NO: 4271428 - DNA, 15 bp, Homo sapiens
gtgggacagagtctg

SEQ ID NO: 4271429 - DNA, 21 bp, Homo sapiens
gtgggactggcccacccctct

SEQ ID NO: 4271430 - DNA, 17 bp, Homo sapiens
gtgggagaagggacagc

SEQ ID NO: 4271431 - DNA, 10 bp, Homo sapiens
gtgggagagg

SEQ ID NO: 4271432 - DNA, 18 bp, Homo sapiens
gtgggagtgggagaggaa

SEQ ID NO: 4271433 - DNA, 13 bp, Homo sapiens
gtgggatccagag

SEQ ID NO: 4271434 - DNA, 17 bp, Homo sapiens
gtgggatccagagagaa

SEQ ID NO: 4271435 - DNA, 20 bp, Homo sapiens
gtgggatccagagagaagca

SEQ ID NO: 4271436 - DNA, 17 bp, Homo sapiens
gtgggattcaggaatgg

SEQ ID NO: 4271437 - DNA, 12 bp, Homo sapiens
gtgggccagccc

SEQ ID NO: 4271438 - DNA, 15 bp, Homo sapiens
gtgggccatggcaat

SEQ ID NO: 4271439 - DNA, 12 bp, Homo sapiens
gtgggcctctgg

SEQ ID NO: 4271440 - DNA, 15 bp, Homo sapiens
gtggggagggtgggc

SEQ ID NO: 4271441 - DNA, 19 bp, Homo sapiens
gtgggggagaatggctctg

SEQ ID NO: 4271442 - DNA, 13 bp, Homo sapiens
gtgggggcctgct

SEQ ID NO: 4271443 - DNA, 18 bp, Homo sapiens
gtgggggcctgctgtggg

SEQ ID NO: 4271444 - DNA, 13 bp, Homo sapiens
gtgggtcagtgtg

SEQ ID NO: 4271445 - DNA, 18 bp, Homo sapiens
gtgggtgtgagcagggtg

SEQ ID NO: 4271446 - DNA, 13 bp, Homo sapiens
gtggtatgtgaat

SEQ ID NO: 4271447 - DNA, 18 bp, Homo sapiens
gtggtcttcaagcctggc

SEQ ID NO: 4271448 - DNA, 15 bp, Homo sapiens
gtggtcttggagagg

SEQ ID NO: 4271449 - DNA, 16 bp, Homo sapiens
gtggtcttggagagga

SEQ ID NO: 4271450 - DNA, 12 bp, Homo sapiens
gtcagatgtttg

SEQ ID NO: 4271451 - DNA, 16 bp, Homo sapiens
gtcagcggcctgggga

SEQ ID NO: 4271452 - DNA, 15 bp, Homo sapiens
gtcagctgtagaaag

SEQ ID NO: 4271453 - DNA, 13 bp, Homo sapiens
gtcaggaggtgcc

SEQ ID NO: 4271454 - DNA, 20 bp, Homo sapiens
gtcaggaggtgcctgagagc

SEQ ID NO: 4271455 - DNA, 16 bp, Homo sapiens
gtcagggaccaaggac

SEQ ID NO: 4271456 - DNA, 23 bp, Homo sapiens
gtcagtgaggcccagggagaggc

SEQ ID NO: 4271457 - DNA, 16 bp, Homo sapiens
gtcagtgtagatcaac

SEQ ID NO: 4271458 - DNA, 19 bp, Homo sapiens
gtcagtgtgccaccctctg

SEQ ID NO: 4271459 - DNA, 23 bp, Homo sapiens
gtcagtgtgccaccctctgcagg

SEQ ID NO: 4271460 - DNA, 15 bp, Homo sapiens
gtcatcataaaaggt

SEQ ID NO: 4271461 - DNA, 21 bp, Homo sapiens
gtcatcataaaaggtgaccct

SEQ ID NO: 4271462 - DNA, 18 bp, Homo sapiens
gtcatcccggggccatgg

SEQ ID NO: 4271463 - DNA, 13 bp, Homo sapiens
gtcatcctgggca

SEQ ID NO: 4271464 - DNA, 16 bp, Homo sapiens
gtcatgacatttctca

SEQ ID NO: 4271465 - DNA, 17 bp, Homo sapiens
gtcatgacatttctcaa

SEQ ID NO: 4271466 - DNA, 18 bp, Homo sapiens
gtcatgacatttctcaaa

SEQ ID NO: 4271467 - DNA, 14 bp, Homo sapiens
gtcatgatgaatca

SEQ ID NO: 4271468 - DNA, 12 bp, Homo sapiens
gtcatgtggcta

SEQ ID NO: 4271469 - DNA, 16 bp, Homo sapiens
gtcattaaagtgcact

SEQ ID NO: 4271470 - DNA, 14 bp, Homo sapiens
gtcattctcacctg

SEQ ID NO: 4271471 - DNA, 18 bp, Homo sapiens
gtccaagcatcagcaaga

SEQ ID NO: 4271472 - DNA, 21 bp, Homo sapiens
gtccaatctgcaagtcccagg

SEQ ID NO: 4271473 - DNA, 17 bp, Homo sapiens
gtccacaaatgtcctca

SEQ ID NO: 4271474 - DNA, 21 bp, Homo sapiens
gtccacaaatgtcctcagagg

SEQ ID NO: 4271475 - DNA, 16 bp, Homo sapiens
gtccacattctgctgc

SEQ ID NO: 4271476 - DNA, 19 bp, Homo sapiens
gtccacccgtttccaagcc

SEQ ID NO: 4271477 - DNA, 15 bp, Homo sapiens
gtccacctgtgctgc

SEQ ID NO: 4271478 - DNA, 15 bp, Homo sapiens
gtccacggctctagg

SEQ ID NO: 4271479 - DNA, 17 bp, Homo sapiens
gtccagacctgggccct

SEQ ID NO: 4271480 - DNA, 20 bp, Homo sapiens
gtccagacctgggccctggt

SEQ ID NO: 4271481 - DNA, 23 bp, Homo sapiens
gtccagagagagaagtgcccctg

SEQ ID NO: 4271482 - DNA, 13 bp, Homo sapiens
gtccagaggaggt

SEQ ID NO: 4271483 - DNA, 13 bp, Homo sapiens
gtccagctctccc

SEQ ID NO: 4271484 - DNA, 16 bp, Homo sapiens
gtccagctctcccctg

SEQ ID NO: 4271485 - DNA, 15 bp, Homo sapiens
gtccaggccaggcct

SEQ ID NO: 4271486 - DNA, 17 bp, Homo sapiens
gtccaggccccaaaacc

SEQ ID NO: 4271487 - DNA, 16 bp, Homo sapiens
gtccagtgaccctgga

SEQ ID NO: 4271488 - DNA, 17 bp, Homo sapiens
gtccagtttgtgcaaga

SEQ ID NO: 4271489 - DNA, 14 bp, Homo sapiens
gtccatctgtctgt

SEQ ID NO: 4271490 - DNA, 21 bp, Homo sapiens
gtcccagacatgctgcccacc

SEQ ID NO: 4271491 - DNA, 19 bp, Homo sapiens
gtcccagggagctctgcat

SEQ ID NO: 4271492 - DNA, 17 bp, Homo sapiens
gtcccagtgggaggcgc

SEQ ID NO: 4271493 - DNA, 16 bp, Homo sapiens
gtccccaatgaatata

SEQ ID NO: 4271494 - DNA, 23 bp, Homo sapiens
gtccccaggggcacacttcccct

SEQ ID NO: 4271495 - DNA, 20 bp, Homo sapiens
gtcccgagccccctgtcctt

SEQ ID NO: 4271496 - DNA, 14 bp, Homo sapiens
gtcccgaggcagca

SEQ ID NO: 4271497 - DNA, 14 bp, Homo sapiens
gtccctccctcctg

SEQ ID NO: 4271498 - DNA, 15 bp, Homo sapiens
gtccctccctcctgg

SEQ ID NO: 4271499 - DNA, 24 bp, Homo sapiens
gtccctccctcctggctcacagcc

SEQ ID NO: 4271500 - DNA, 13 bp, Homo sapiens
gtccctctcaggc

SEQ ID NO: 4271501 - DNA, 20 bp, Homo sapiens
gtccctgagggcccttccca

SEQ ID NO: 4271502 - DNA, 22 bp, Homo sapiens
gtccctgccccgccccccagag

SEQ ID NO: 4271503 - DNA, 14 bp, Homo sapiens
gtccctgtccctgc

SEQ ID NO: 4271504 - DNA, 15 bp, Homo sapiens
gtcccttccccctgc

SEQ ID NO: 4271505 - DNA, 10 bp, Homo sapiens
gtccctttcc

SEQ ID NO: 4271506 - DNA, 16 bp, Homo sapiens
gtccctttccctgcat

SEQ ID NO: 4271507 - DNA, 15 bp, Homo sapiens
gtcctaaatgcaaag

SEQ ID NO: 4271508 - DNA, 17 bp, Homo sapiens
gtcctcaccttctgttt

SEQ ID NO: 4271509 - DNA, 18 bp, Homo sapiens
gtcctcagagggtcccta

SEQ ID NO: 4271510 - DNA, 20 bp, Homo sapiens
gtcctgctcagatgctggtc

SEQ ID NO: 4271511 - DNA, 15 bp, Homo sapiens
gtcctggcagggcag

SEQ ID NO: 4271512 - DNA, 19 bp, Homo sapiens
gtcctggcagggcaggcag

SEQ ID NO: 4271513 - DNA, 23 bp, Homo sapiens
gtcctggcagggcaggcagagct

SEQ ID NO: 4271514 - DNA, 17 bp, Homo sapiens
gtcctgggccccctggg

SEQ ID NO: 4271515 - DNA, 19 bp, Homo sapiens
gtcctgggccccctgggag

SEQ ID NO: 4271516 - DNA, 20 bp, Homo sapiens
gtcctgggggctgctgcact

SEQ ID NO: 4271517 - DNA, 16 bp, Homo sapiens
gtcctgtgagatgtgt

SEQ ID NO: 4271518 - DNA, 23 bp, Homo sapiens
gtcctgttctcagagctccacag

SEQ ID NO: 4271519 - DNA, 18 bp, Homo sapiens
gtccttagaatactgtat

SEQ ID NO: 4271520 - DNA, 17 bp, Homo sapiens
gtccttagactccttct

SEQ ID NO: 4271521 - DNA, 17 bp, Homo sapiens
gtcggaggcttgggacc

SEQ ID NO: 4271522 - DNA, 22 bp, Homo sapiens
gtctacataactaatacagctg

SEQ ID NO: 4271523 - DNA, 21 bp, Homo sapiens
gtctagaggctattcctaggc

SEQ ID NO: 4271524 - DNA, 22 bp, Homo sapiens
gtctagctatgctgtatctgtg

SEQ ID NO: 4271525 - DNA, 17 bp, Homo sapiens
gtctcaagagggcactg

SEQ ID NO: 4271526 - DNA, 15 bp, Homo sapiens
gtctcaatgaaatag

SEQ ID NO: 4271527 - DNA, 15 bp, Homo sapiens
gtctccacccctcaa

SEQ ID NO: 4271528 - DNA, 14 bp, Homo sapiens
gtctccacctcagg

SEQ ID NO: 4271529 - DNA, 21 bp, Homo sapiens
gtctcctgggcatctggccct

SEQ ID NO: 4271530 - DNA, 15 bp, Homo sapiens
gtctcgtcaggaggt

SEQ ID NO: 4271531 - DNA, 20 bp, Homo sapiens
gtctcgtcaggaggtgcctg

SEQ ID NO: 4271532 - DNA, 16 bp, Homo sapiens
gtctctcatgaacctc

SEQ ID NO: 4271533 - DNA, 16 bp, Homo sapiens
gtctcttctccactgg

SEQ ID NO: 4271534 - DNA, 20 bp, Homo sapiens
gtctgaaaccagaagactgg

SEQ ID NO: 4271535 - DNA, 16 bp, Homo sapiens
gtctgaagtcactgca

SEQ ID NO: 4271536 - DNA, 12 bp, Homo sapiens
gtctgagccctg

SEQ ID NO: 4271537 - DNA, 15 bp, Homo sapiens
gtctgagccctgccc

SEQ ID NO: 4271538 - DNA, 24 bp, Homo sapiens
gtctgagccctgccctcactccac

SEQ ID NO: 4271539 - DNA, 17 bp, Homo sapiens
gtctgagcggccgcctg

SEQ ID NO: 4271540 - DNA, 21 bp, Homo sapiens
gtctgagcggccgcctgtcct

SEQ ID NO: 4271541 - DNA, 16 bp, Homo sapiens
gtctgcaccccacagg

SEQ ID NO: 4271542 - DNA, 14 bp, Homo sapiens
gtctgcgccgctgt

SEQ ID NO: 4271543 - DNA, 17 bp, Homo sapiens
gtctgcgccgctgtgct

SEQ ID NO: 4271544 - DNA, 14 bp, Homo sapiens
gtctgctcctgtgg

SEQ ID NO: 4271545 - DNA, 22 bp, Homo sapiens
gtctgctcctgtggcggtgcag

SEQ ID NO: 4271546 - DNA, 16 bp, Homo sapiens
gtctgctgccctccat

SEQ ID NO: 4271547 - DNA, 18 bp, Homo sapiens
gtctgctgccctccatcc

SEQ ID NO: 4271548 - DNA, 23 bp, Homo sapiens
gtctgctgtaagacggccttgga

SEQ ID NO: 4271549 - DNA, 23 bp, Homo sapiens
gtctggagaccaggactctgcct

SEQ ID NO: 4271550 - DNA, 14 bp, Homo sapiens
gtctggctgtggcc

SEQ ID NO: 4271551 - DNA, 15 bp, Homo sapiens
gtctggctgtggccc

SEQ ID NO: 4271552 - DNA, 21 bp, Homo sapiens
gtctggctgtggcccctcctt

SEQ ID NO: 4271553 - DNA, 13 bp, Homo sapiens
gtcttcaagcctg

SEQ ID NO: 4271554 - DNA, 16 bp, Homo sapiens
gtcttcaagcctggcc

SEQ ID NO: 4271555 - DNA, 20 bp, Homo sapiens
gtcttgagagcgctggcctc

SEQ ID NO: 4271556 - DNA, 21 bp, Homo sapiens
gtcttgagagcgctggcctct

SEQ ID NO: 4271557 - DNA, 13 bp, Homo sapiens
gtcttgagtgggc

SEQ ID NO: 4271558 - DNA, 16 bp, Homo sapiens
gtctttagctattact

SEQ ID NO: 4271559 - DNA, 23 bp, Homo sapiens
gtctttgggggattcaaatgcat

SEQ ID NO: 4271560 - DNA, 15 bp, Homo sapiens
gtctttgtgtgctgt

SEQ ID NO: 4271561 - DNA, 18 bp, Homo sapiens
gtctttttaacctcagaa

SEQ ID NO: 4271562 - DNA, 14 bp, Homo sapiens
gtgaaacacagctg

SEQ ID NO: 4271563 - DNA, 19 bp, Homo sapiens
gtgaaagtgtaaaatagaa

SEQ ID NO: 4271564 - DNA, 22 bp, Homo sapiens
gtgaaatttacagttactgcct

SEQ ID NO: 4271565 - DNA, 17 bp, Homo sapiens
gtgaaatttgttaatat

SEQ ID NO: 4271566 - DNA, 11 bp, Homo sapiens
gtgaacagctt

SEQ ID NO: 4271567 - DNA, 20 bp, Homo sapiens
gtgaacttggggaacaaggg

SEQ ID NO: 4271568 - DNA, 21 bp, Homo sapiens
gtgaacttggtgcctaatgtt

SEQ ID NO: 4271569 - DNA, 16 bp, Homo sapiens
gtgaataaagccacat

SEQ ID NO: 4271570 - DNA, 12 bp, Homo sapiens
gtgaatacatgg

SEQ ID NO: 4271571 - DNA, 10 bp, Homo sapiens
gtgaatgtag

SEQ ID NO: 4271572 - DNA, 16 bp, Homo sapiens
gtgacacaactcatcc

SEQ ID NO: 4271573 - DNA, 18 bp, Homo sapiens
gtgacatcagtggcatgg

SEQ ID NO: 4271574 - DNA, 13 bp, Homo sapiens
gtgacatgcggct

SEQ ID NO: 4271575 - DNA, 14 bp, Homo sapiens
gtgaccccagctcc

SEQ ID NO: 4271576 - DNA, 19 bp, Homo sapiens
gtgaccccagctccaggca

SEQ ID NO: 4271577 - DNA, 13 bp, Homo sapiens
gtgaccctggagc

SEQ ID NO: 4271578 - DNA, 20 bp, Homo sapiens
gtgacccttctgtctgtaag

SEQ ID NO: 4271579 - DNA, 14 bp, Homo sapiens
gtgactccaggaga

SEQ ID NO: 4271580 - DNA, 22 bp, Homo sapiens
gtgactccatatcccgggagca

SEQ ID NO: 4271581 - DNA, 14 bp, Homo sapiens
gtgactgctgcgct

SEQ ID NO: 4271582 - DNA, 23 bp, Homo sapiens
gtgacttcagactctctcctctc

SEQ ID NO: 4271583 - DNA, 15 bp, Homo sapiens
gtgaggagggggaga

SEQ ID NO: 4271584 - DNA, 21 bp, Homo sapiens
ggttcccccagccctgtggaa

SEQ ID NO: 4271585 - DNA, 12 bp, Homo sapiens
ggttcctccagc

SEQ ID NO: 4271586 - DNA, 16 bp, Homo sapiens
ggttccttaagtggct

SEQ ID NO: 4271587 - DNA, 11 bp, Homo sapiens
ggttctagaag

SEQ ID NO: 4271588 - DNA, 16 bp, Homo sapiens
ggttctggggctgaga

SEQ ID NO: 4271589 - DNA, 21 bp, Homo sapiens
ggttggccagagggcccctca

SEQ ID NO: 4271590 - DNA, 23 bp, Homo sapiens
ggttgggttccagacagagtgga

SEQ ID NO: 4271591 - DNA, 18 bp, Homo sapiens
ggttgtcaaaactccact

SEQ ID NO: 4271592 - DNA, 23 bp, Homo sapiens
ggttgtcaaaactccactcagca

SEQ ID NO: 4271593 - DNA, 21 bp, Homo sapiens
ggtttaaaactagttagattc

SEQ ID NO: 4271594 - DNA, 16 bp, Homo sapiens
ggtttaagtagatttc

SEQ ID NO: 4271595 - DNA, 22 bp, Homo sapiens
ggtttactctgtgctaagttgt

SEQ ID NO: 4271596 - DNA, 15 bp, Homo sapiens
ggtttcagaaagggc

SEQ ID NO: 4271597 - DNA, 19 bp, Homo sapiens
ggtttccacacaggcccat

SEQ ID NO: 4271598 - DNA, 17 bp, Homo sapiens
ggtttctgagttcctgc

SEQ ID NO: 4271599 - DNA, 20 bp, Homo sapiens
ggtttgggcagtggagaggg

SEQ ID NO: 4271600 - DNA, 17 bp, Homo sapiens
ggtttggtggccaggct

SEQ ID NO: 4271601 - DNA, 19 bp, Homo sapiens
ggttttcgaagctcagccc

SEQ ID NO: 4271602 - DNA, 17 bp, Homo sapiens
ggttttgcatgtctgca

SEQ ID NO: 4271603 - DNA, 15 bp, Homo sapiens
gtaaaattacagaag

SEQ ID NO: 4271604 - DNA, 15 bp, Homo sapiens
gtaaaggtaggtgca

SEQ ID NO: 4271605 - DNA, 20 bp, Homo sapiens
gtaaatctaacattattact

SEQ ID NO: 4271606 - DNA, 18 bp, Homo sapiens
gtaacacataaagtaaat

SEQ ID NO: 4271607 - DNA, 22 bp, Homo sapiens
gtaacacataaagtaaatgcta

SEQ ID NO: 4271608 - DNA, 16 bp, Homo sapiens
gtaacagttggtgatt

SEQ ID NO: 4271609 - DNA, 18 bp, Homo sapiens
gtaacatagatgcctggg

SEQ ID NO: 4271610 - DNA, 16 bp, Homo sapiens
gtaacatgtctaaagt

SEQ ID NO: 4271611 - DNA, 21 bp, Homo sapiens
gtaagaagcccgatccacatt

SEQ ID NO: 4271612 - DNA, 17 bp, Homo sapiens
gtaagctgctctattgt

SEQ ID NO: 4271613 - DNA, 15 bp, Homo sapiens
gtaagttctgaaaac

SEQ ID NO: 4271614 - DNA, 13 bp, Homo sapiens
gtaatatctttca

SEQ ID NO: 4271615 - DNA, 12 bp, Homo sapiens
gtaatatttaca

SEQ ID NO: 4271616 - DNA, 19 bp, Homo sapiens
gtaatatttacaatgtatt

SEQ ID NO: 4271617 - DNA, 20 bp, Homo sapiens
gtaatcatttatcttatcta

SEQ ID NO: 4271618 - DNA, 12 bp, Homo sapiens
gtaatcttttct

SEQ ID NO: 4271619 - DNA, 13 bp, Homo sapiens
gtaatcttttctg

SEQ ID NO: 4271620 - DNA, 12 bp, Homo sapiens
gtaatgtatctt

SEQ ID NO: 4271621 - DNA, 17 bp, Homo sapiens
gtaatgtatcttattta

SEQ ID NO: 4271622 - DNA, 17 bp, Homo sapiens
gtaatgtgtcaaagaga

SEQ ID NO: 4271623 - DNA, 21 bp, Homo sapiens
gtacaaaaaaataatcaagtg

SEQ ID NO: 4271624 - DNA, 23 bp, Homo sapiens
gtacaaagggaagcagagcctgg

SEQ ID NO: 4271625 - DNA, 23 bp, Homo sapiens
gtacaagtgctcagttccaatgt

SEQ ID NO: 4271626 - DNA, 20 bp, Homo sapiens
gtacacccaattttaaaaaa

SEQ ID NO: 4271627 - DNA, 20 bp, Homo sapiens
gtacagttatacatacctct

SEQ ID NO: 4271628 - DNA, 21 bp, Homo sapiens
gtacatgtggaaaactcacag

SEQ ID NO: 4271629 - DNA, 13 bp, Homo sapiens
gtaccaactgagc

SEQ ID NO: 4271630 - DNA, 16 bp, Homo sapiens
gtaccatgttaaagag

SEQ ID NO: 4271631 - DNA, 18 bp, Homo sapiens
gtactaccccaggacgca

SEQ ID NO: 4271632 - DNA, 14 bp, Homo sapiens
gtactggatttaac

SEQ ID NO: 4271633 - DNA, 16 bp, Homo sapiens
gtacttcttctgtaat

SEQ ID NO: 4271634 - DNA, 16 bp, Homo sapiens
gtacttgctcaataaa

SEQ ID NO: 4271635 - DNA, 21 bp, Homo sapiens
gtacttgctcaataaaggtca

SEQ ID NO: 4271636 - DNA, 20 bp, Homo sapiens
gtacttgtgaaacacagctg

SEQ ID NO: 4271637 - DNA, 16 bp, Homo sapiens
gtagaactgttcattt

SEQ ID NO: 4271638 - DNA, 16 bp, Homo sapiens
gtagaagagggagaag

SEQ ID NO: 4271639 - DNA, 23 bp, Homo sapiens
gtagatagtatgcactatataca

SEQ ID NO: 4271640 - DNA, 13 bp, Homo sapiens
gtagcatatataa

SEQ ID NO: 4271641 - DNA, 16 bp, Homo sapiens
gtagctgtggggagct

SEQ ID NO: 4271642 - DNA, 17 bp, Homo sapiens
gtagctgtggggagctg

SEQ ID NO: 4271643 - DNA, 18 bp, Homo sapiens
gtagctgtggggagctgg

SEQ ID NO: 4271644 - DNA, 19 bp, Homo sapiens
gtaggctgtattttctttt

SEQ ID NO: 4271645 - DNA, 22 bp, Homo sapiens
gtaggctgtattttcttttata

SEQ ID NO: 4271646 - DNA, 23 bp, Homo sapiens
gtagggaacggcctgagaggagc

SEQ ID NO: 4271647 - DNA, 17 bp, Homo sapiens
gtagggccagggctctg

SEQ ID NO: 4271648 - DNA, 20 bp, Homo sapiens
gtaggggaagtgtgctgagg

SEQ ID NO: 4271649 - DNA, 17 bp, Homo sapiens
gtagggtgaggcgtggg

SEQ ID NO: 4271650 - DNA, 17 bp, Homo sapiens
gtagtacttcttctgta

SEQ ID NO: 4271651 - DNA, 22 bp, Homo sapiens
gtagtacttcttctgtaatatt

SEQ ID NO: 4271652 - DNA, 17 bp, Homo sapiens
gtagtagaatctcagca

SEQ ID NO: 4271653 - DNA, 13 bp, Homo sapiens
gtagtatgatggg

SEQ ID NO: 4271654 - DNA, 21 bp, Homo sapiens
gtagtgttattgccaggaaag

SEQ ID NO: 4271655 - DNA, 19 bp, Homo sapiens
gtataaaacagtgtttcca

SEQ ID NO: 4271656 - DNA, 21 bp, Homo sapiens
gtataacaagccaaacattct

SEQ ID NO: 4271657 - DNA, 11 bp, Homo sapiens
gtatacaaaca

SEQ ID NO: 4271658 - DNA, 14 bp, Homo sapiens
gtatacaaacaggt

SEQ ID NO: 4271659 - DNA, 17 bp, Homo sapiens
gtatacaaacaggtgct

SEQ ID NO: 4271660 - DNA, 15 bp, Homo sapiens
gtataccgtgtgctc

SEQ ID NO: 4271661 - DNA, 12 bp, Homo sapiens
gtatatatgtac

SEQ ID NO: 4271662 - DNA, 15 bp, Homo sapiens
gtatatatgtacagt

SEQ ID NO: 4271663 - DNA, 14 bp, Homo sapiens
gtatatcagggttt

SEQ ID NO: 4271664 - DNA, 18 bp, Homo sapiens
gtatatttgtatgatatt

SEQ ID NO: 4271665 - DNA, 22 bp, Homo sapiens
gtatcagagatgtccattttta

SEQ ID NO: 4271666 - DNA, 14 bp, Homo sapiens
gtatccagaggtga

SEQ ID NO: 4271667 - DNA, 19 bp, Homo sapiens
gtatcgctgccttgccatg

SEQ ID NO: 4271668 - DNA, 15 bp, Homo sapiens
gtatctaaaaaataa

SEQ ID NO: 4271669 - DNA, 23 bp, Homo sapiens
gtatctgatatctgtttgcttct

SEQ ID NO: 4271670 - DNA, 19 bp, Homo sapiens
gtatctgctgcctctgaaa

SEQ ID NO: 4271671 - DNA, 23 bp, Homo sapiens
gtatctgtacctgcccccactca

SEQ ID NO: 4271672 - DNA, 14 bp, Homo sapiens
gtatcttatttata

SEQ ID NO: 4271673 - DNA, 17 bp, Homo sapiens
gtatctttaaagacttg

SEQ ID NO: 4271674 - DNA, 11 bp, Homo sapiens
gtatgaaatat

SEQ ID NO: 4271675 - DNA, 18 bp, Homo sapiens
gtatgaataaagacacct

SEQ ID NO: 4271676 - DNA, 17 bp, Homo sapiens
gtatgcaagaagaatat

SEQ ID NO: 4271677 - DNA, 20 bp, Homo sapiens
gtatgcaagaagaatataaa

SEQ ID NO: 4271678 - DNA, 19 bp, Homo sapiens
gtatgcagtgtagatttta

SEQ ID NO: 4271679 - DNA, 14 bp, Homo sapiens
gtatgtggaagcag

SEQ ID NO: 4271680 - DNA, 13 bp, Homo sapiens
gtattaaatgcca

SEQ ID NO: 4271681 - DNA, 14 bp, Homo sapiens
gtattatgcaaagt

SEQ ID NO: 4271682 - DNA, 18 bp, Homo sapiens
gtattcaggaccccatct

SEQ ID NO: 4271683 - DNA, 20 bp, Homo sapiens
gtattgtctgacttctcagg

SEQ ID NO: 4271684 - DNA, 16 bp, Homo sapiens
gtattgttagatgttt

SEQ ID NO: 4271685 - DNA, 15 bp, Homo sapiens
gtattttcgtgcatt

SEQ ID NO: 4271686 - DNA, 19 bp, Homo sapiens
gtattttcgtgcatttgtg

SEQ ID NO: 4271687 - DNA, 19 bp, Homo sapiens
gtattttcttcccatttgt

SEQ ID NO: 4271688 - DNA, 22 bp, Homo sapiens
gtattttcttcccatttgtaat

SEQ ID NO: 4271689 - DNA, 22 bp, Homo sapiens
gtattttcttttatatctgtaa

SEQ ID NO: 4271690 - DNA, 13 bp, Homo sapiens
gtatttttagaga

SEQ ID NO: 4271691 - DNA, 14 bp, Homo sapiens
gtatttttagagat

SEQ ID NO: 4271692 - DNA, 20 bp, Homo sapiens
gtcaaaactccactcagcac

SEQ ID NO: 4271693 - DNA, 22 bp, Homo sapiens
gtcaacatttgttagaaccagt

SEQ ID NO: 4271694 - DNA, 16 bp, Homo sapiens
gtcaactccaaggcaa

SEQ ID NO: 4271695 - DNA, 21 bp, Homo sapiens
gtcaactccaaggcaaatgtc

SEQ ID NO: 4271696 - DNA, 23 bp, Homo sapiens
gtcaactgctgttttatgtcata

SEQ ID NO: 4271697 - DNA, 15 bp, Homo sapiens
gtcaagattcagcta

SEQ ID NO: 4271698 - DNA, 19 bp, Homo sapiens
gtcaagattcagctagtgg

SEQ ID NO: 4271699 - DNA, 16 bp, Homo sapiens
gtcaagtgtgcctgct

SEQ ID NO: 4271700 - DNA, 13 bp, Homo sapiens
gtcaatcaaacag

SEQ ID NO: 4271701 - DNA, 15 bp, Homo sapiens
gtcaatcaaacaggg

SEQ ID NO: 4271702 - DNA, 20 bp, Homo sapiens
gtcaatgaaatatttgctta

SEQ ID NO: 4271703 - DNA, 22 bp, Homo sapiens
gtcaatgaaatatttgcttatt

SEQ ID NO: 4271704 - DNA, 16 bp, Homo sapiens
gtcaatgtttgcttta

SEQ ID NO: 4271705 - DNA, 16 bp, Homo sapiens
gtcacaataaagtgta

SEQ ID NO: 4271706 - DNA, 15 bp, Homo sapiens
gtcacagaggcagtg

SEQ ID NO: 4271707 - DNA, 21 bp, Homo sapiens
gtcacagaggcagtggcagca

SEQ ID NO: 4271708 - DNA, 22 bp, Homo sapiens
gtcacatatcaagtcccgaggc

SEQ ID NO: 4271709 - DNA, 22 bp, Homo sapiens
gtcacccccacccccgggtgcc

SEQ ID NO: 4271710 - DNA, 13 bp, Homo sapiens
gtcacccctgtct

SEQ ID NO: 4271711 - DNA, 14 bp, Homo sapiens
gtcaccttcctggg

SEQ ID NO: 4271712 - DNA, 17 bp, Homo sapiens
gtcaccttcctgggcag

SEQ ID NO: 4271713 - DNA, 22 bp, Homo sapiens
gtcaccttcctgggcagcccag

SEQ ID NO: 4271714 - DNA, 20 bp, Homo sapiens
gtcactaaatggcagtgaga

SEQ ID NO: 4271715 - DNA, 23 bp, Homo sapiens
gtcactgcacagtgcatctcagc

SEQ ID NO: 4271716 - DNA, 16 bp, Homo sapiens
gtcacttatttcataa

SEQ ID NO: 4271717 - DNA, 19 bp, Homo sapiens
ggccctttcacccctcttc

SEQ ID NO: 4271718 - DNA, 22 bp, Homo sapiens
ggccctttcacccctcttccca

SEQ ID NO: 4271719 - DNA, 22 bp, Homo sapiens
ggccgaggcaggggctgggcag

SEQ ID NO: 4271720 - DNA, 13 bp, Homo sapiens
ggccgaggcctgc

SEQ ID NO: 4271721 - DNA, 13 bp, Homo sapiens
ggccgcctgtcct

SEQ ID NO: 4271722 - DNA, 15 bp, Homo sapiens
ggccgcctgtccttg

SEQ ID NO: 4271723 - DNA, 19 bp, Homo sapiens
ggccgctagatgggcatgg

SEQ ID NO: 4271724 - DNA, 15 bp, Homo sapiens
ggccgctgcagggtg

SEQ ID NO: 4271725 - DNA, 17 bp, Homo sapiens
ggccgctgcagtcagca

SEQ ID NO: 4271726 - DNA, 15 bp, Homo sapiens
ggccgcttcgccatg

SEQ ID NO: 4271727 - DNA, 12 bp, Homo sapiens
ggccggccctgc

SEQ ID NO: 4271728 - DNA, 14 bp, Homo sapiens
ggccgggctggctt

SEQ ID NO: 4271729 - DNA, 20 bp, Homo sapiens
ggccgtggagtcgagctggc

SEQ ID NO: 4271730 - DNA, 16 bp, Homo sapiens
ggcctacaaatcagta

SEQ ID NO: 4271731 - DNA, 18 bp, Homo sapiens
ggcctactggggatcaga

SEQ ID NO: 4271732 - DNA, 21 bp, Homo sapiens
ggcctagtggcttcagcccct

SEQ ID NO: 4271733 - DNA, 17 bp, Homo sapiens
ggcctatgccacctgca

SEQ ID NO: 4271734 - DNA, 20 bp, Homo sapiens
ggcctcacctggcttcccag

SEQ ID NO: 4271735 - DNA, 21 bp, Homo sapiens
ggcctcagcagaaggccttgc

SEQ ID NO: 4271736 - DNA, 16 bp, Homo sapiens
ggcctcagggaccaag

SEQ ID NO: 4271737 - DNA, 22 bp, Homo sapiens
ggcctcagggaccaaggagatg

SEQ ID NO: 4271738 - DNA, 14 bp, Homo sapiens
ggcctctggcctgg

SEQ ID NO: 4271739 - DNA, 15 bp, Homo sapiens
ggcctctggcctggg

SEQ ID NO: 4271740 - DNA, 16 bp, Homo sapiens
ggcctctggcctggga

SEQ ID NO: 4271741 - DNA, 23 bp, Homo sapiens
ggcctcttcctccctccctgcag

SEQ ID NO: 4271742 - DNA, 21 bp, Homo sapiens
ggcctgaactaggtgctggca

SEQ ID NO: 4271743 - DNA, 14 bp, Homo sapiens
ggcctgagaagagt

SEQ ID NO: 4271744 - DNA, 14 bp, Homo sapiens
ggcctgatggccag

SEQ ID NO: 4271745 - DNA, 16 bp, Homo sapiens
ggcctgatggtggggc

SEQ ID NO: 4271746 - DNA, 22 bp, Homo sapiens
ggcctgccccccttcccacccc

SEQ ID NO: 4271747 - DNA, 15 bp, Homo sapiens
ggcctgctgtgggtc

SEQ ID NO: 4271748 - DNA, 10 bp, Homo sapiens
ggcctggccc

SEQ ID NO: 4271749 - DNA, 13 bp, Homo sapiens
ggcctggcccagc

SEQ ID NO: 4271750 - DNA, 14 bp, Homo sapiens
ggcctggcccagcc

SEQ ID NO: 4271751 - DNA, 15 bp, Homo sapiens
ggcctggcccagcca

SEQ ID NO: 4271752 - DNA, 17 bp, Homo sapiens
ggcctggcccagccagc

SEQ ID NO: 4271753 - DNA, 11 bp, Homo sapiens
ggcctggccct

SEQ ID NO: 4271754 - DNA, 13 bp, Homo sapiens
ggcctggcccttt

SEQ ID NO: 4271755 - DNA, 21 bp, Homo sapiens
ggcctgggaaaagggcaggag

SEQ ID NO: 4271756 - DNA, 15 bp, Homo sapiens
ggcctggggacggag

SEQ ID NO: 4271757 - DNA, 16 bp, Homo sapiens
ggcctggggacggagc

SEQ ID NO: 4271758 - DNA, 17 bp, Homo sapiens
ggcctggggccgggctg

SEQ ID NO: 4271759 - DNA, 16 bp, Homo sapiens
ggcctggtctggagcc

SEQ ID NO: 4271760 - DNA, 17 bp, Homo sapiens
ggcctggtgccctggcc

SEQ ID NO: 4271761 - DNA, 21 bp, Homo sapiens
ggcctggtgccctggcccagc

SEQ ID NO: 4271762 - DNA, 17 bp, Homo sapiens
ggcctgtccacctgtgc

SEQ ID NO: 4271763 - DNA, 19 bp, Homo sapiens
ggcctgtccacctgtgctg

SEQ ID NO: 4271764 - DNA, 22 bp, Homo sapiens
ggccttctttctagagagggaa

SEQ ID NO: 4271765 - DNA, 20 bp, Homo sapiens
ggccttggacggggacacgg

SEQ ID NO: 4271766 - DNA, 18 bp, Homo sapiens
ggccttggttcctccagc

SEQ ID NO: 4271767 - DNA, 21 bp, Homo sapiens
ggcgagccagattaggcctgg

SEQ ID NO: 4271768 - DNA, 12 bp, Homo sapiens
ggcgaggcagag

SEQ ID NO: 4271769 - DNA, 13 bp, Homo sapiens
ggcgaggcagagg

SEQ ID NO: 4271770 - DNA, 21 bp, Homo sapiens
ggcgaggggagggtggcaggt

SEQ ID NO: 4271771 - DNA, 18 bp, Homo sapiens
ggcgcacccggcagcccc

SEQ ID NO: 4271772 - DNA, 17 bp, Homo sapiens
ggcgcagtgcctctggt

SEQ ID NO: 4271773 - DNA, 13 bp, Homo sapiens
ggcggggccagga

SEQ ID NO: 4271774 - DNA, 22 bp, Homo sapiens
ggcggtcaataattgtggagag

SEQ ID NO: 4271775 - DNA, 23 bp, Homo sapiens
ggcggtcaataattgtggagagg

SEQ ID NO: 4271776 - DNA, 21 bp, Homo sapiens
ggcggtccagaggaggtgccc

SEQ ID NO: 4271777 - DNA, 13 bp, Homo sapiens
ggcgtagggccag

SEQ ID NO: 4271778 - DNA, 17 bp, Homo sapiens
ggcgtgggatccagaga

SEQ ID NO: 4271779 - DNA, 18 bp, Homo sapiens
ggcgtgggatccagagag

SEQ ID NO: 4271780 - DNA, 19 bp, Homo sapiens
ggcgtgggatccagagaga

SEQ ID NO: 4271781 - DNA, 21 bp, Homo sapiens
ggctaaaaaagctgaatcaga

SEQ ID NO: 4271782 - DNA, 20 bp, Homo sapiens
ggctaaatgcctaataaaca

SEQ ID NO: 4271783 - DNA, 12 bp, Homo sapiens
ggctaagcctgg

SEQ ID NO: 4271784 - DNA, 16 bp, Homo sapiens
ggctaagcctggacac

SEQ ID NO: 4271785 - DNA, 14 bp, Homo sapiens
ggctagactgggct

SEQ ID NO: 4271786 - DNA, 20 bp, Homo sapiens
ggctattcctaggcctcagg

SEQ ID NO: 4271787 - DNA, 14 bp, Homo sapiens
ggctcacaccagcc

SEQ ID NO: 4271788 - DNA, 16 bp, Homo sapiens
ggctcacaccagccct

SEQ ID NO: 4271789 - DNA, 17 bp, Homo sapiens
ggctcacaccagccctg

SEQ ID NO: 4271790 - DNA, 12 bp, Homo sapiens
ggctcacagcca

SEQ ID NO: 4271791 - DNA, 14 bp, Homo sapiens
ggctcattcttttc

SEQ ID NO: 4271792 - DNA, 18 bp, Homo sapiens
ggctccagagtaggtggg

SEQ ID NO: 4271793 - DNA, 15 bp, Homo sapiens
ggctccagtctgctg

SEQ ID NO: 4271794 - DNA, 18 bp, Homo sapiens
ggctccagtctgctgccc

SEQ ID NO: 4271795 - DNA, 24 bp, Homo sapiens
ggctccagtctgctgccctccatc

SEQ ID NO: 4271796 - DNA, 18 bp, Homo sapiens
ggctcccacaggcccttc

SEQ ID NO: 4271797 - DNA, 17 bp, Homo sapiens
ggctcccacgccctcct

SEQ ID NO: 4271798 - DNA, 22 bp, Homo sapiens
ggctcccacgccctcctccctc

SEQ ID NO: 4271799 - DNA, 19 bp, Homo sapiens
ggctcccactgcccctgca

SEQ ID NO: 4271800 - DNA, 14 bp, Homo sapiens
ggctcccagcagag

SEQ ID NO: 4271801 - DNA, 11 bp, Homo sapiens
ggctcccctct

SEQ ID NO: 4271802 - DNA, 12 bp, Homo sapiens
ggctcccctcta

SEQ ID NO: 4271803 - DNA, 13 bp, Homo sapiens
ggctcctcaccac

SEQ ID NO: 4271804 - DNA, 20 bp, Homo sapiens
ggctcctccagcaagacctc

SEQ ID NO: 4271805 - DNA, 13 bp, Homo sapiens
ggctcctccccga

SEQ ID NO: 4271806 - DNA, 13 bp, Homo sapiens
ggctctaatttcc

SEQ ID NO: 4271807 - DNA, 18 bp, Homo sapiens
ggctctacaactgagtcc

SEQ ID NO: 4271808 - DNA, 19 bp, Homo sapiens
ggctctacaactgagtcct

SEQ ID NO: 4271809 - DNA, 19 bp, Homo sapiens
ggctctctcacccagcctg

SEQ ID NO: 4271810 - DNA, 20 bp, Homo sapiens
ggctctctcacccagcctgg

SEQ ID NO: 4271811 - DNA, 21 bp, Homo sapiens
ggctctgcagcacattgccct

SEQ ID NO: 4271812 - DNA, 22 bp, Homo sapiens
ggctctgcagcacattgccctg

SEQ ID NO: 4271813 - DNA, 18 bp, Homo sapiens
ggctctgcgtcccactga

SEQ ID NO: 4271814 - DNA, 18 bp, Homo sapiens
ggctctggcaggtggcca

SEQ ID NO: 4271815 - DNA, 12 bp, Homo sapiens
ggctcttctcct

SEQ ID NO: 4271816 - DNA, 14 bp, Homo sapiens
ggctcttctccttt

SEQ ID NO: 4271817 - DNA, 15 bp, Homo sapiens
ggctcttctcctttc

SEQ ID NO: 4271818 - DNA, 23 bp, Homo sapiens
ggctcttctcctttcacaacctt

SEQ ID NO: 4271819 - DNA, 13 bp, Homo sapiens
ggctgaaaagtgc

SEQ ID NO: 4271820 - DNA, 19 bp, Homo sapiens
ggctgaaaagtgctttgct

SEQ ID NO: 4271821 - DNA, 21 bp, Homo sapiens
ggctgagactggatactgccc

SEQ ID NO: 4271822 - DNA, 18 bp, Homo sapiens
ggctgagctgtgccagct

SEQ ID NO: 4271823 - DNA, 17 bp, Homo sapiens
ggctgcacctgcaggga

SEQ ID NO: 4271824 - DNA, 16 bp, Homo sapiens
ggctgcatcctcagcc

SEQ ID NO: 4271825 - DNA, 23 bp, Homo sapiens
ggctgcatcctcagccccagggc

SEQ ID NO: 4271826 - DNA, 12 bp, Homo sapiens
ggctgccctggt

SEQ ID NO: 4271827 - DNA, 15 bp, Homo sapiens
ggctgccctggtgct

SEQ ID NO: 4271828 - DNA, 22 bp, Homo sapiens
ggctgccctggtgctgccacac

SEQ ID NO: 4271829 - DNA, 10 bp, Homo sapiens
ggctgcctgc

SEQ ID NO: 4271830 - DNA, 11 bp, Homo sapiens
ggctgcctgcc

SEQ ID NO: 4271831 - DNA, 14 bp, Homo sapiens
ggctgcctgcccca

SEQ ID NO: 4271832 - DNA, 17 bp, Homo sapiens
ggctgccttctgcggag

SEQ ID NO: 4271833 - DNA, 22 bp, Homo sapiens
ggctgctgcagtcagcacagag

SEQ ID NO: 4271834 - DNA, 14 bp, Homo sapiens
ggctggactggagg

SEQ ID NO: 4271835 - DNA, 15 bp, Homo sapiens
ggctggactggaggc

SEQ ID NO: 4271836 - DNA, 17 bp, Homo sapiens
ggctggattggcaggtg

SEQ ID NO: 4271837 - DNA, 12 bp, Homo sapiens
ggctggcatggg

SEQ ID NO: 4271838 - DNA, 12 bp, Homo sapiens
ggctggccagct

SEQ ID NO: 4271839 - DNA, 14 bp, Homo sapiens
ggctggccagctgt

SEQ ID NO: 4271840 - DNA, 13 bp, Homo sapiens
ggctggctgcctt

SEQ ID NO: 4271841 - DNA, 22 bp, Homo sapiens
ggctgggagcctcgcccctcca

SEQ ID NO: 4271842 - DNA, 22 bp, Homo sapiens
ggctgggtttgggcagtggaga

SEQ ID NO: 4271843 - DNA, 21 bp, Homo sapiens
ggctggtttggtggccaggct

SEQ ID NO: 4271844 - DNA, 16 bp, Homo sapiens
ggctgtattttctttt

SEQ ID NO: 4271845 - DNA, 15 bp, Homo sapiens
ggctgtcccctgcaa

SEQ ID NO: 4271846 - DNA, 19 bp, Homo sapiens
ggctgtgcgctgacaacca

SEQ ID NO: 4271847 - DNA, 14 bp, Homo sapiens
ggctgtggcccctc

SEQ ID NO: 4271848 - DNA, 16 bp, Homo sapiens
ggctgtggcccctcct

SEQ ID NO: 4271849 - DNA, 20 bp, Homo sapiens
ggctgtgtcctaaatgcaaa

SEQ ID NO: 4271850 - DNA, 17 bp, Homo sapiens
ggcttccatggtggttt

SEQ ID NO: 4271851 - DNA, 14 bp, Homo sapiens
ggcttcccaggacc

SEQ ID NO: 4271852 - DNA, 15 bp, Homo sapiens
ggcttcccaggaccc

SEQ ID NO: 4271853 - DNA, 14 bp, Homo sapiens
ggcttcccgctcag

SEQ ID NO: 4271854 - DNA, 18 bp, Homo sapiens
ggcttcccgctcagccct

SEQ ID NO: 4271855 - DNA, 22 bp, Homo sapiens
ggcttcccgctcagccctccct

SEQ ID NO: 4271856 - DNA, 14 bp, Homo sapiens
ggcttccctctgct

SEQ ID NO: 4271857 - DNA, 15 bp, Homo sapiens
ggcttccggctgagc

SEQ ID NO: 4271858 - DNA, 14 bp, Homo sapiens
ggcttcctgcccta

SEQ ID NO: 4271859 - DNA, 20 bp, Homo sapiens
ggcttctccctggactctgt

SEQ ID NO: 4271860 - DNA, 23 bp, Homo sapiens
ggcttgcaagtatgttttagcat

SEQ ID NO: 4271861 - DNA, 19 bp, Homo sapiens
ggcttgcattaaaagactg

SEQ ID NO: 4271862 - DNA, 16 bp, Homo sapiens
ggcttgtagggtgagg

SEQ ID NO: 4271863 - DNA, 21 bp, Homo sapiens
ggctttggaaagacctgtgag

SEQ ID NO: 4271864 - DNA, 18 bp, Homo sapiens
ggctttggctcgggactt

SEQ ID NO: 4271865 - DNA, 13 bp, Homo sapiens
ggcttttcactgc

SEQ ID NO: 4271866 - DNA, 17 bp, Homo sapiens
ggcttttgtgccaggag

SEQ ID NO: 4271867 - DNA, 22 bp, Homo sapiens
gggaaagccagtgactccagga

SEQ ID NO: 4271868 - DNA, 18 bp, Homo sapiens
gggaaatgctgatttaaa

SEQ ID NO: 4271869 - DNA, 16 bp, Homo sapiens
gggaagcagagcctgg

SEQ ID NO: 4271870 - DNA, 17 bp, Homo sapiens
gggaagggggcaggccc

SEQ ID NO: 4271871 - DNA, 17 bp, Homo sapiens
gggaagtgtgctgaggt

SEQ ID NO: 4271872 - DNA, 14 bp, Homo sapiens
gggaatcagggagc

SEQ ID NO: 4271873 - DNA, 22 bp, Homo sapiens
gggaatgcgctcttcaccagga

SEQ ID NO: 4271874 - DNA, 14 bp, Homo sapiens
gggaattctcttgg

SEQ ID NO: 4271875 - DNA, 22 bp, Homo sapiens
gggaattgaggtctgctcggcc

SEQ ID NO: 4271876 - DNA, 21 bp, Homo sapiens
gggactggcccacccctcttc

SEQ ID NO: 4271877 - DNA, 18 bp, Homo sapiens
gggactggtccaggcatg

SEQ ID NO: 4271878 - DNA, 15 bp, Homo sapiens
gggagaaggagaggc

SEQ ID NO: 4271879 - DNA, 17 bp, Homo sapiens
gggagaaggagaggctc

SEQ ID NO: 4271880 - DNA, 12 bp, Homo sapiens
gggagaccctgg

SEQ ID NO: 4271881 - DNA, 13 bp, Homo sapiens
gggagactgagct

SEQ ID NO: 4271882 - DNA, 14 bp, Homo sapiens
gggagaggaagcca

SEQ ID NO: 4271883 - DNA, 18 bp, Homo sapiens
gggagagtgaggtcatcc

SEQ ID NO: 4271884 - DNA, 22 bp, Homo sapiens
gggagcccccgccccgccccac

SEQ ID NO: 4271885 - DNA, 22 bp, Homo sapiens
gggagcctcgcccctccagtgt

SEQ ID NO: 4271886 - DNA, 23 bp, Homo sapiens
gggagcctcgcccctccagtgtt

SEQ ID NO: 4271887 - DNA, 12 bp, Homo sapiens
gggagctgaggg

SEQ ID NO: 4271888 - DNA, 17 bp, Homo sapiens
gggagctgaggggcagg

SEQ ID NO: 4271889 - DNA, 18 bp, Homo sapiens
gggagctgaggggcaggg

SEQ ID NO: 4271890 - DNA, 15 bp, Homo sapiens
gggaggagactcagg

SEQ ID NO: 4271891 - DNA, 10 bp, Homo sapiens
gggaggaggg

SEQ ID NO: 4271892 - DNA, 21 bp, Homo sapiens
gggaggagggggcccggctgg

SEQ ID NO: 4271893 - DNA, 14 bp, Homo sapiens
gggaggcgcgagcc

SEQ ID NO: 4271894 - DNA, 16 bp, Homo sapiens
gggaggggagagaagg

SEQ ID NO: 4271895 - DNA, 15 bp, Homo sapiens
gggagtgggagagga

SEQ ID NO: 4271896 - DNA, 13 bp, Homo sapiens
gggatccagagag

SEQ ID NO: 4271897 - DNA, 17 bp, Homo sapiens
gggatgggcacaggctg

SEQ ID NO: 4271898 - DNA, 16 bp, Homo sapiens
gggattcaaatgcatg

SEQ ID NO: 4271899 - DNA, 17 bp, Homo sapiens
gggattcaaatgcatga

SEQ ID NO: 4271900 - DNA, 18 bp, Homo sapiens
gggatttcaagggactgg

SEQ ID NO: 4271901 - DNA, 13 bp, Homo sapiens
gggcacagccaga

SEQ ID NO: 4271902 - DNA, 14 bp, Homo sapiens
gggcacagccagaa

SEQ ID NO: 4271903 - DNA, 19 bp, Homo sapiens
gggcacaggctgccccacc

SEQ ID NO: 4271904 - DNA, 22 bp, Homo sapiens
gggcagaaggaggaagggactg

SEQ ID NO: 4271905 - DNA, 23 bp, Homo sapiens
gggcagaaggaggaagggactgg

SEQ ID NO: 4271906 - DNA, 23 bp, Homo sapiens
gggcagaggggagaggaagcaca

SEQ ID NO: 4271907 - DNA, 13 bp, Homo sapiens
gggcagcccagag

SEQ ID NO: 4271908 - DNA, 12 bp, Homo sapiens
gggcagcccctc

SEQ ID NO: 4271909 - DNA, 14 bp, Homo sapiens
gggcagcccctccc

SEQ ID NO: 4271910 - DNA, 20 bp, Homo sapiens
gggcagcctgtgggagaagg

SEQ ID NO: 4271911 - DNA, 18 bp, Homo sapiens
gggcagctgccagagaag

SEQ ID NO: 4271912 - DNA, 14 bp, Homo sapiens
gggcaggagcctag

SEQ ID NO: 4271913 - DNA, 21 bp, Homo sapiens
gggcaggagcctagaggagga

SEQ ID NO: 4271914 - DNA, 15 bp, Homo sapiens
gggcaggcagagctc

SEQ ID NO: 4271915 - DNA, 14 bp, Homo sapiens
gggcatctccagga

SEQ ID NO: 4271916 - DNA, 14 bp, Homo sapiens
gggcatctggccct

SEQ ID NO: 4271917 - DNA, 17 bp, Homo sapiens
gggcatctggccctgct

SEQ ID NO: 4271918 - DNA, 21 bp, Homo sapiens
gggcatctggccctgctgccc

SEQ ID NO: 4271919 - DNA, 17 bp, Homo sapiens
gggcatggacagggcca

SEQ ID NO: 4271920 - DNA, 15 bp, Homo sapiens
gggcatggccaggtg

SEQ ID NO: 4271921 - DNA, 17 bp, Homo sapiens
gggcatggccaggtggc

SEQ ID NO: 4271922 - DNA, 20 bp, Homo sapiens
gggcatggccaggtggccac

SEQ ID NO: 4271923 - DNA, 16 bp, Homo sapiens
gggcatgtccccagtg

SEQ ID NO: 4271924 - DNA, 23 bp, Homo sapiens
gggcatgtccccagtgtggactc

SEQ ID NO: 4271925 - DNA, 15 bp, Homo sapiens
gggccaacaccaggg

SEQ ID NO: 4271926 - DNA, 16 bp, Homo sapiens
gggccaacaccaggga

SEQ ID NO: 4271927 - DNA, 23 bp, Homo sapiens
gggccaagccagggttccagaca

SEQ ID NO: 4271928 - DNA, 13 bp, Homo sapiens
gggccaaggactg

SEQ ID NO: 4271929 - DNA, 13 bp, Homo sapiens
gggccactggcat

SEQ ID NO: 4271930 - DNA, 23 bp, Homo sapiens
gggccactggcatctctggagtg

SEQ ID NO: 4271931 - DNA, 12 bp, Homo sapiens
gggccagcccct

SEQ ID NO: 4271932 - DNA, 15 bp, Homo sapiens
gggccagcccctccc

SEQ ID NO: 4271933 - DNA, 11 bp, Homo sapiens
gggccaggaga

SEQ ID NO: 4271934 - DNA, 12 bp, Homo sapiens
gggccaggagaa

SEQ ID NO: 4271935 - DNA, 13 bp, Homo sapiens
gggccagggttgc

SEQ ID NO: 4271936 - DNA, 18 bp, Homo sapiens
gggccatgaactttgtcc

SEQ ID NO: 4271937 - DNA, 12 bp, Homo sapiens
gggcccagaggg

SEQ ID NO: 4271938 - DNA, 15 bp, Homo sapiens
gggccccagggaact

SEQ ID NO: 4271939 - DNA, 16 bp, Homo sapiens
gggccccagggaacta

SEQ ID NO: 4271940 - DNA, 14 bp, Homo sapiens
gggcccggctgggc

SEQ ID NO: 4271941 - DNA, 23 bp, Homo sapiens
gggccctaggcatactctccagg

SEQ ID NO: 4271942 - DNA, 10 bp, Homo sapiens
gggccctgct

SEQ ID NO: 4271943 - DNA, 11 bp, Homo sapiens
gggccctgctc

SEQ ID NO: 4271944 - DNA, 18 bp, Homo sapiens
gggccctgctcaggcctc

SEQ ID NO: 4271945 - DNA, 18 bp, Homo sapiens
gggccctggttcccccag

SEQ ID NO: 4271946 - DNA, 22 bp, Homo sapiens
gggccctggttcccccaggacc

SEQ ID NO: 4271947 - DNA, 21 bp, Homo sapiens
gggcccttcccaacctcccct

SEQ ID NO: 4271948 - DNA, 20 bp, Homo sapiens
gggccgcttcgccatgtgct

SEQ ID NO: 4271949 - DNA, 16 bp, Homo sapiens
gggcgctgagggcagg

SEQ ID NO: 4271950 - DNA, 21 bp, Homo sapiens
gggcggtccagaggaggtgcc

SEQ ID NO: 4271951 - DNA, 22 bp, Homo sapiens
gggcggtccagaggaggtgccc

SEQ ID NO: 4271952 - DNA, 10 bp, Homo sapiens
gggctcacac

SEQ ID NO: 4271953 - DNA, 18 bp, Homo sapiens
gggctcacaccagccctg

SEQ ID NO: 4271954 - DNA, 12 bp, Homo sapiens
gggctccagagt

SEQ ID NO: 4271955 - DNA, 13 bp, Homo sapiens
gggctctgcgtcc

SEQ ID NO: 4271956 - DNA, 21 bp, Homo sapiens
gggctgccgtgcacggggcca

SEQ ID NO: 4271957 - DNA, 13 bp, Homo sapiens
gggctggattggc

SEQ ID NO: 4271958 - DNA, 14 bp, Homo sapiens
gggctggattggca

SEQ ID NO: 4271959 - DNA, 16 bp, Homo sapiens
gggctggcatggggag

SEQ ID NO: 4271960 - DNA, 15 bp, Homo sapiens
gggctggccagctgt

SEQ ID NO: 4271961 - DNA, 15 bp, Homo sapiens
gggctggctgccttc

SEQ ID NO: 4271962 - DNA, 17 bp, Homo sapiens
gggctggcttctccctg

SEQ ID NO: 4271963 - DNA, 19 bp, Homo sapiens
gggctggtttggtggccag

SEQ ID NO: 4271964 - DNA, 16 bp, Homo sapiens
gggcttggaagggcgc

SEQ ID NO: 4271965 - DNA, 19 bp, Homo sapiens
gggcttggggtagagagga

SEQ ID NO: 4271966 - DNA, 15 bp, Homo sapiens
ggggacttggatagg

SEQ ID NO: 4271967 - DNA, 21 bp, Homo sapiens
ggggagagaaggtggtctgca

SEQ ID NO: 4271968 - DNA, 13 bp, Homo sapiens
ggggagctggtgg

SEQ ID NO: 4271969 - DNA, 18 bp, Homo sapiens
ggggaggaaactcacctg

SEQ ID NO: 4271970 - DNA, 21 bp, Homo sapiens
ggggaggccaagtgcaggctg

SEQ ID NO: 4271971 - DNA, 18 bp, Homo sapiens
ggggaggccgaggcaggg

SEQ ID NO: 4271972 - DNA, 13 bp, Homo sapiens
ggggagggagaga

SEQ ID NO: 4271973 - DNA, 19 bp, Homo sapiens
ggggatttcaagggactgg

SEQ ID NO: 4271974 - DNA, 13 bp, Homo sapiens
ggggcaagagctc

SEQ ID NO: 4271975 - DNA, 19 bp, Homo sapiens
ggggcaagagctcaggaga

SEQ ID NO: 4271976 - DNA, 13 bp, Homo sapiens
ggggcacagccag

SEQ ID NO: 4271977 - DNA, 16 bp, Homo sapiens
ggggcagaaggaggaa

SEQ ID NO: 4271978 - DNA, 14 bp, Homo sapiens
ggggcagctgccag

SEQ ID NO: 4271979 - DNA, 12 bp, Homo sapiens
ggggcaggaagt

SEQ ID NO: 4271980 - DNA, 21 bp, Homo sapiens
ggggcaggcctttttgagcca

SEQ ID NO: 4271981 - DNA, 18 bp, Homo sapiens
ggggcatggacagggcca

SEQ ID NO: 4271982 - DNA, 20 bp, Homo sapiens
ggggcatggacagggccagg

SEQ ID NO: 4271983 - DNA, 22 bp, Homo sapiens
ggggcatggacagggccagggt

SEQ ID NO: 4271984 - DNA, 14 bp, Homo sapiens
ggggccatgaggcc

SEQ ID NO: 4271985 - DNA, 22 bp, Homo sapiens
ggggcccctttttactcccctt

SEQ ID NO: 4271986 - DNA, 21 bp, Homo sapiens
ggggcccgcctggcagaactg

SEQ ID NO: 4271987 - DNA, 23 bp, Homo sapiens
ggggcccgcctggcagaactgag

SEQ ID NO: 4271988 - DNA, 18 bp, Homo sapiens
ggggccgggctggcttct

SEQ ID NO: 4271989 - DNA, 22 bp, Homo sapiens
ggggcctagtggcttcagcccc

SEQ ID NO: 4271990 - DNA, 16 bp, Homo sapiens
ggggctagactgggct

SEQ ID NO: 4271991 - DNA, 21 bp, Homo sapiens
ggggctgcatcctcagcccca

SEQ ID NO: 4271992 - DNA, 16 bp, Homo sapiens
ggggctggccagctgt

SEQ ID NO: 4271993 - DNA, 13 bp, Homo sapiens
ggggctgggcaga

SEQ ID NO: 4271994 - DNA, 14 bp, Homo sapiens
ggggctgggcagag

SEQ ID NO: 4271995 - DNA, 13 bp, Homo sapiens
ggggcttggaagg

SEQ ID NO: 4271996 - DNA, 21 bp, Homo sapiens
ggggcttggggtagagaggac

SEQ ID NO: 4271997 - DNA, 14 bp, Homo sapiens
gggggaggccgagg

SEQ ID NO: 4271998 - DNA, 15 bp, Homo sapiens
gggggccatgagctc

SEQ ID NO: 4271999 - DNA, 22 bp, Homo sapiens
ggggtctccacctcaggggaga

SEQ ID NO: 4272000 - DNA, 14 bp, Homo sapiens
ggggtctgggaggc

SEQ ID NO: 4272001 - DNA, 17 bp, Homo sapiens
ggggtctgggaggcagg

SEQ ID NO: 4272002 - DNA, 14 bp, Homo sapiens
ggggtgagccccgc

SEQ ID NO: 4272003 - DNA, 14 bp, Homo sapiens
ggggtgggcctctg

SEQ ID NO: 4272004 - DNA, 19 bp, Homo sapiens
ggggtggggcttggaaggg

SEQ ID NO: 4272005 - DNA, 22 bp, Homo sapiens
ggggtgggggagaatggctctg

SEQ ID NO: 4272006 - DNA, 18 bp, Homo sapiens
ggggtggttggaggcctg

SEQ ID NO: 4272007 - DNA, 13 bp, Homo sapiens
ggggttggctggg

SEQ ID NO: 4272008 - DNA, 17 bp, Homo sapiens
ggggtttccacacaggc

SEQ ID NO: 4272009 - DNA, 15 bp, Homo sapiens
gggtagggggcctga

SEQ ID NO: 4272010 - DNA, 20 bp, Homo sapiens
gggtcagcaggggggttggg

SEQ ID NO: 4272011 - DNA, 14 bp, Homo sapiens
gggtctccacctca

SEQ ID NO: 4272012 - DNA, 17 bp, Homo sapiens
gggtctgggaggcaggt

SEQ ID NO: 4272013 - DNA, 15 bp, Homo sapiens
gggtgagggtgacag

SEQ ID NO: 4272014 - DNA, 21 bp, Homo sapiens
gggtgccaaccacctctggcc

SEQ ID NO: 4272015 - DNA, 12 bp, Homo sapiens
gggtgccatggt

SEQ ID NO: 4272016 - DNA, 21 bp, Homo sapiens
gggtgctgcttccctctgcct

SEQ ID NO: 4272017 - DNA, 23 bp, Homo sapiens
gggtgctgcttccctctgcctgt

SEQ ID NO: 4272018 - DNA, 17 bp, Homo sapiens
gggtggccggccctgcc

SEQ ID NO: 4272019 - DNA, 14 bp, Homo sapiens
gggtggggcttgga

SEQ ID NO: 4272020 - DNA, 24 bp, Homo sapiens
gggtgggggcctgctgtgggtcag

SEQ ID NO: 4272021 - DNA, 17 bp, Homo sapiens
gggtggtcttcaagcct

SEQ ID NO: 4272022 - DNA, 21 bp, Homo sapiens
gggtggtcttcaagcctggcc

SEQ ID NO: 4272023 - DNA, 22 bp, Homo sapiens
gggtggtcttcaagcctggccc

SEQ ID NO: 4272024 - DNA, 23 bp, Homo sapiens
gggtgtatttattttcctcccca

SEQ ID NO: 4272025 - DNA, 14 bp, Homo sapiens
gggtgtgagcaggg

SEQ ID NO: 4272026 - DNA, 12 bp, Homo sapiens
gggtgtgctcca

SEQ ID NO: 4272027 - DNA, 21 bp, Homo sapiens
gggtgtgctccaggcttcctg

SEQ ID NO: 4272028 - DNA, 14 bp, Homo sapiens
gggtgtggcttgga

SEQ ID NO: 4272029 - DNA, 18 bp, Homo sapiens
gggtgtgggtcagggagg

SEQ ID NO: 4272030 - DNA, 21 bp, Homo sapiens
gggttagacaagcctggagga

SEQ ID NO: 4272031 - DNA, 20 bp, Homo sapiens
gggttccagacagagtggat

SEQ ID NO: 4272032 - DNA, 21 bp, Homo sapiens
gggttcccactggctcctcca

SEQ ID NO: 4272033 - DNA, 23 bp, Homo sapiens
gggttggccagagggcccctcac

SEQ ID NO: 4272034 - DNA, 20 bp, Homo sapiens
gggttggctgggcccagaag

SEQ ID NO: 4272035 - DNA, 16 bp, Homo sapiens
gggtttccacacaggc

SEQ ID NO: 4272036 - DNA, 17 bp, Homo sapiens
gggtttccacacaggcc

SEQ ID NO: 4272037 - DNA, 20 bp, Homo sapiens
gggtttggcgggccaaggac

SEQ ID NO: 4272038 - DNA, 19 bp, Homo sapiens
ggtaacatagatgcctggg

SEQ ID NO: 4272039 - DNA, 22 bp, Homo sapiens
ggtaacatagatgcctgggcct

SEQ ID NO: 4272040 - DNA, 15 bp, Homo sapiens
ggtaagattgttatt

SEQ ID NO: 4272041 - DNA, 22 bp, Homo sapiens
ggtaagttggctcacatcatgt

SEQ ID NO: 4272042 - DNA, 21 bp, Homo sapiens
ggtacttctgtgttgtgattc

SEQ ID NO: 4272043 - DNA, 13 bp, Homo sapiens
ggtagggggcctg

SEQ ID NO: 4272044 - DNA, 19 bp, Homo sapiens
ggtagtagaatctcagcac

SEQ ID NO: 4272045 - DNA, 14 bp, Homo sapiens
ggtatccagaggtg

SEQ ID NO: 4272046 - DNA, 18 bp, Homo sapiens
ggtattttcgtgcatttg

SEQ ID NO: 4272047 - DNA, 18 bp, Homo sapiens
ggtcaataattgtggaga

SEQ ID NO: 4272048 - DNA, 24 bp, Homo sapiens
ggtcaccttcctgggcagcccaga

SEQ ID NO: 4272049 - DNA, 22 bp, Homo sapiens
ggtcagcggcctggggacggag

SEQ ID NO: 4272050 - DNA, 14 bp, Homo sapiens
ggtcagggaggggt

SEQ ID NO: 4272051 - DNA, 19 bp, Homo sapiens
ggtcagtgaggcccaggga

SEQ ID NO: 4272052 - DNA, 19 bp, Homo sapiens
ggtcatcctgggcatgtcc

SEQ ID NO: 4272053 - DNA, 20 bp, Homo sapiens
ggtccacattctgctgcccc

SEQ ID NO: 4272054 - DNA, 21 bp, Homo sapiens
ggtcccagacatgctgcccac

SEQ ID NO: 4272055 - DNA, 16 bp, Homo sapiens
ggtctcatgcctgaga

SEQ ID NO: 4272056 - DNA, 13 bp, Homo sapiens
ggtctccacccct

SEQ ID NO: 4272057 - DNA, 18 bp, Homo sapiens
ggtctccacccctcaagc

SEQ ID NO: 4272058 - DNA, 15 bp, Homo sapiens
ggtctccacctcagg

SEQ ID NO: 4272059 - DNA, 17 bp, Homo sapiens
ggtctccacctcagggg

SEQ ID NO: 4272060 - DNA, 15 bp, Homo sapiens
ggtctctaggcctga

SEQ ID NO: 4272061 - DNA, 16 bp, Homo sapiens
ggtctgctcctgtggc

SEQ ID NO: 4272062 - DNA, 20 bp, Homo sapiens
ggtctgctcctgtggcggtg

SEQ ID NO: 4272063 - DNA, 23 bp, Homo sapiens
ggtctggctttggaaagacctgt

SEQ ID NO: 4272064 - DNA, 16 bp, Homo sapiens
ggtctgtgggactggc

SEQ ID NO: 4272065 - DNA, 17 bp, Homo sapiens
ggtcttcaagcctggcc

SEQ ID NO: 4272066 - DNA, 13 bp, Homo sapiens
ggtcttggagagg

SEQ ID NO: 4272067 - DNA, 14 bp, Homo sapiens
ggtcttggagagga

SEQ ID NO: 4272068 - DNA, 20 bp, Homo sapiens
ggtcttggagaggaggtgtg

SEQ ID NO: 4272069 - DNA, 13 bp, Homo sapiens
ggtgacagaggga

SEQ ID NO: 4272070 - DNA, 14 bp, Homo sapiens
ggtgacagagggac

SEQ ID NO: 4272071 - DNA, 16 bp, Homo sapiens
ggtgacagagggacag

SEQ ID NO: 4272072 - DNA, 21 bp, Homo sapiens
ggtgacagagggacagtgggc

SEQ ID NO: 4272073 - DNA, 12 bp, Homo sapiens
ggtgataagtgg

SEQ ID NO: 4272074 - DNA, 16 bp, Homo sapiens
ggtgataagtggaaaa

SEQ ID NO: 4272075 - DNA, 18 bp, Homo sapiens
ggtgataagtggaaaaaa

SEQ ID NO: 4272076 - DNA, 17 bp, Homo sapiens
ggtgcagtggcaaagga

SEQ ID NO: 4272077 - DNA, 18 bp, Homo sapiens
ggtgcagtggcaaaggat

SEQ ID NO: 4272078 - DNA, 22 bp, Homo sapiens
ggtgccatggtgttggaggggc

SEQ ID NO: 4272079 - DNA, 20 bp, Homo sapiens
ggtgcccaccagctggctct

SEQ ID NO: 4272080 - DNA, 16 bp, Homo sapiens
ggtgcccgggcagggg

SEQ ID NO: 4272081 - DNA, 15 bp, Homo sapiens
ggtgccctggcccag

SEQ ID NO: 4272082 - DNA, 13 bp, Homo sapiens
ggtgcctgtgacc

SEQ ID NO: 4272083 - DNA, 15 bp, Homo sapiens
ggtggaacaggagga

SEQ ID NO: 4272084 - DNA, 21 bp, Homo sapiens
ggtggaggctaagcctggaca

SEQ ID NO: 4272085 - DNA, 23 bp, Homo sapiens
ggtggccaagcctgccccggcca

SEQ ID NO: 4272086 - DNA, 16 bp, Homo sapiens
ggtggcccgacagcct

SEQ ID NO: 4272087 - DNA, 18 bp, Homo sapiens
ggtggcccgacagcctgg

SEQ ID NO: 4272088 - DNA, 20 bp, Homo sapiens
ggtggcccgacagcctggca

SEQ ID NO: 4272089 - DNA, 18 bp, Homo sapiens
ggtggccggccctgcccc

SEQ ID NO: 4272090 - DNA, 16 bp, Homo sapiens
ggtggccgggggtggg

SEQ ID NO: 4272091 - DNA, 13 bp, Homo sapiens
ggtgggctccaga

SEQ ID NO: 4272092 - DNA, 14 bp, Homo sapiens
ggtgggctccagag

SEQ ID NO: 4272093 - DNA, 18 bp, Homo sapiens
ggtgggctccagagtagg

SEQ ID NO: 4272094 - DNA, 17 bp, Homo sapiens
ggtggggcgggaaagcc

SEQ ID NO: 4272095 - DNA, 22 bp, Homo sapiens
ggtggggcttggaagggcgctg

SEQ ID NO: 4272096 - DNA, 14 bp, Homo sapiens
ggtgggggcctgct

SEQ ID NO: 4272097 - DNA, 21 bp, Homo sapiens
ggtgggggcctgctgtgggtc

SEQ ID NO: 4272098 - DNA, 18 bp, Homo sapiens
ggtggtcttcaagcctgg

SEQ ID NO: 4272099 - DNA, 14 bp, Homo sapiens
ggtggtcttggaga

SEQ ID NO: 4272100 - DNA, 16 bp, Homo sapiens
ggtggttggaggcctg

SEQ ID NO: 4272101 - DNA, 17 bp, Homo sapiens
ggtggttggaggcctgg

SEQ ID NO: 4272102 - DNA, 17 bp, Homo sapiens
ggtggtttcagaaaggg

SEQ ID NO: 4272103 - DNA, 20 bp, Homo sapiens
ggtgtagggaacggcctgag

SEQ ID NO: 4272104 - DNA, 17 bp, Homo sapiens
ggtgtatttattttcct

SEQ ID NO: 4272105 - DNA, 18 bp, Homo sapiens
ggtgtcacagaggcagtg

SEQ ID NO: 4272106 - DNA, 13 bp, Homo sapiens
ggtgtccctgcct

SEQ ID NO: 4272107 - DNA, 17 bp, Homo sapiens
ggtgtccctgcctggcc

SEQ ID NO: 4272108 - DNA, 19 bp, Homo sapiens
ggtgtgaatgctgtacctt

SEQ ID NO: 4272109 - DNA, 17 bp, Homo sapiens
ggtgtgctccaggcttc

SEQ ID NO: 4272110 - DNA, 13 bp, Homo sapiens
ggtgtgggctccc

SEQ ID NO: 4272111 - DNA, 14 bp, Homo sapiens
ggtgtgggctccca

SEQ ID NO: 4272112 - DNA, 21 bp, Homo sapiens
ggtgtgggctcccacgccctc

SEQ ID NO: 4272113 - DNA, 14 bp, Homo sapiens
ggtgttctggcctc

SEQ ID NO: 4272114 - DNA, 15 bp, Homo sapiens
ggtgttctggcctct

SEQ ID NO: 4272115 - DNA, 16 bp, Homo sapiens
ggtgttttcagaaaga

SEQ ID NO: 4272116 - DNA, 17 bp, Homo sapiens
ggttaagccatatgaca

SEQ ID NO: 4272117 - DNA, 16 bp, Homo sapiens
ggttcatgcctggggt

SEQ ID NO: 4272118 - DNA, 17 bp, Homo sapiens
ggttccagacagagtgg

SEQ ID NO: 4272119 - DNA, 13 bp, Homo sapiens
ggttccagacagg

SEQ ID NO: 4272120 - DNA, 16 bp, Homo sapiens
ggttcccactggctcc

SEQ ID NO: 4272121 - DNA, 18 bp, Homo sapiens
ggatgtcttgagatgtat

SEQ ID NO: 4272122 - DNA, 15 bp, Homo sapiens
ggattataatcagaa

SEQ ID NO: 4272123 - DNA, 11 bp, Homo sapiens
ggattcaaatg

SEQ ID NO: 4272124 - DNA, 20 bp, Homo sapiens
ggattcagtttctaaaattg

SEQ ID NO: 4272125 - DNA, 22 bp, Homo sapiens
ggattcccgtggctttgtgctt

SEQ ID NO: 4272126 - DNA, 22 bp, Homo sapiens
ggattggcaggtgtgggctccc

SEQ ID NO: 4272127 - DNA, 15 bp, Homo sapiens
ggattggtaccagag

SEQ ID NO: 4272128 - DNA, 18 bp, Homo sapiens
ggattgtccacaaatgtc

SEQ ID NO: 4272129 - DNA, 13 bp, Homo sapiens
ggattttgtggct

SEQ ID NO: 4272130 - DNA, 11 bp, Homo sapiens
ggatttttcat

SEQ ID NO: 4272131 - DNA, 16 bp, Homo sapiens
ggcaaatatcttgaaa

SEQ ID NO: 4272132 - DNA, 17 bp, Homo sapiens
ggcaaatgtccaagcat

SEQ ID NO: 4272133 - DNA, 20 bp, Homo sapiens
ggcaaccccctcggagcctg

SEQ ID NO: 4272134 - DNA, 21 bp, Homo sapiens
ggcaaccccctcggagcctgt

SEQ ID NO: 4272135 - DNA, 16 bp, Homo sapiens
ggcacagggcagtggg

SEQ ID NO: 4272136 - DNA, 14 bp, Homo sapiens
ggcacctggggagt

SEQ ID NO: 4272137 - DNA, 22 bp, Homo sapiens
ggcacttcgtggatgacctcct

SEQ ID NO: 4272138 - DNA, 14 bp, Homo sapiens
ggcagaactgagct

SEQ ID NO: 4272139 - DNA, 21 bp, Homo sapiens
ggcagaactgagctcctctgg

SEQ ID NO: 4272140 - DNA, 21 bp, Homo sapiens
ggcagagattgggggggcttg

SEQ ID NO: 4272141 - DNA, 13 bp, Homo sapiens
ggcagaggggaga

SEQ ID NO: 4272142 - DNA, 17 bp, Homo sapiens
ggcagcaacaggaccag

SEQ ID NO: 4272143 - DNA, 22 bp, Homo sapiens
ggcagcaacaggaccaggagcc

SEQ ID NO: 4272144 - DNA, 17 bp, Homo sapiens
ggcagccaccctgccat

SEQ ID NO: 4272145 - DNA, 16 bp, Homo sapiens
ggcagcccagagagac

SEQ ID NO: 4272146 - DNA, 20 bp, Homo sapiens
ggcagcccagagagaccctg

SEQ ID NO: 4272147 - DNA, 12 bp, Homo sapiens
ggcagcccctcc

SEQ ID NO: 4272148 - DNA, 21 bp, Homo sapiens
ggcagccgtgccttcagctct

SEQ ID NO: 4272149 - DNA, 15 bp, Homo sapiens
ggcagcctgtgggag

SEQ ID NO: 4272150 - DNA, 18 bp, Homo sapiens
ggcagcctgtgggtcctt

SEQ ID NO: 4272151 - DNA, 22 bp, Homo sapiens
ggcagctgcagttagcacagag

SEQ ID NO: 4272152 - DNA, 11 bp, Homo sapiens
ggcagctgcca

SEQ ID NO: 4272153 - DNA, 12 bp, Homo sapiens
ggcagctggctc

SEQ ID NO: 4272154 - DNA, 16 bp, Homo sapiens
ggcagctggctctgaa

SEQ ID NO: 4272155 - DNA, 17 bp, Homo sapiens
ggcagctggctctgaat

SEQ ID NO: 4272156 - DNA, 20 bp, Homo sapiens
ggcaggaaccatggacctgc

SEQ ID NO: 4272157 - DNA, 21 bp, Homo sapiens
ggcaggaaccatggacctgca

SEQ ID NO: 4272158 - DNA, 21 bp, Homo sapiens
ggcaggaagtcaggagccagc

SEQ ID NO: 4272159 - DNA, 14 bp, Homo sapiens
ggcaggcagagctc

SEQ ID NO: 4272160 - DNA, 19 bp, Homo sapiens
ggcaggcccctttggacct

SEQ ID NO: 4272161 - DNA, 20 bp, Homo sapiens
ggcaggcctttttgagccaa

SEQ ID NO: 4272162 - DNA, 22 bp, Homo sapiens
ggcagggagggaaacccgggga

SEQ ID NO: 4272163 - DNA, 16 bp, Homo sapiens
ggcaggggctgcatcc

SEQ ID NO: 4272164 - DNA, 13 bp, Homo sapiens
ggcagggttctag

SEQ ID NO: 4272165 - DNA, 20 bp, Homo sapiens
ggcaggtcccgagccccctg

SEQ ID NO: 4272166 - DNA, 21 bp, Homo sapiens
ggcaggtcccgagccccctgt

SEQ ID NO: 4272167 - DNA, 15 bp, Homo sapiens
ggcaggtgtgggctc

SEQ ID NO: 4272168 - DNA, 13 bp, Homo sapiens
ggcagtggcccag

SEQ ID NO: 4272169 - DNA, 23 bp, Homo sapiens
ggcagtggcccagggaatcaggg

SEQ ID NO: 4272170 - DNA, 15 bp, Homo sapiens
ggcatactctccagg

SEQ ID NO: 4272171 - DNA, 15 bp, Homo sapiens
ggcatccacttcaca

SEQ ID NO: 4272172 - DNA, 19 bp, Homo sapiens
ggcatccccagccccctgg

SEQ ID NO: 4272173 - DNA, 16 bp, Homo sapiens
ggcatctccaggaagg

SEQ ID NO: 4272174 - DNA, 16 bp, Homo sapiens
ggcatctctggagtgt

SEQ ID NO: 4272175 - DNA, 17 bp, Homo sapiens
ggcatctggccctgctg

SEQ ID NO: 4272176 - DNA, 20 bp, Homo sapiens
ggcatgaccctggagcccgg

SEQ ID NO: 4272177 - DNA, 15 bp, Homo sapiens
ggcatgccgagtgcc

SEQ ID NO: 4272178 - DNA, 18 bp, Homo sapiens
ggcatgccgagtgcccca

SEQ ID NO: 4272179 - DNA, 16 bp, Homo sapiens
ggcatggacagggcca

SEQ ID NO: 4272180 - DNA, 18 bp, Homo sapiens
ggcatggacagggccagg

SEQ ID NO: 4272181 - DNA, 14 bp, Homo sapiens
ggcatgtccccagt

SEQ ID NO: 4272182 - DNA, 24 bp, Homo sapiens
ggcattagctaaaaccttccatgt

SEQ ID NO: 4272183 - DNA, 14 bp, Homo sapiens
ggcattgtttccac

SEQ ID NO: 4272184 - DNA, 18 bp, Homo sapiens
ggccaacaccagggatgg

SEQ ID NO: 4272185 - DNA, 22 bp, Homo sapiens
ggccaagccagggttccagaca

SEQ ID NO: 4272186 - DNA, 15 bp, Homo sapiens
ggccaagcctgcccc

SEQ ID NO: 4272187 - DNA, 17 bp, Homo sapiens
ggccaaggactgccgac

SEQ ID NO: 4272188 - DNA, 14 bp, Homo sapiens
ggccacgggggagg

SEQ ID NO: 4272189 - DNA, 18 bp, Homo sapiens
ggccactctgtttgctca

SEQ ID NO: 4272190 - DNA, 13 bp, Homo sapiens
ggccactgcagtc

SEQ ID NO: 4272191 - DNA, 14 bp, Homo sapiens
ggccactggcatct

SEQ ID NO: 4272192 - DNA, 17 bp, Homo sapiens
ggccactttgcagacct

SEQ ID NO: 4272193 - DNA, 19 bp, Homo sapiens
ggccactttgcagacctgg

SEQ ID NO: 4272194 - DNA, 13 bp, Homo sapiens
ggccagaggaagg

SEQ ID NO: 4272195 - DNA, 22 bp, Homo sapiens
ggccagaggaagggaggcctga

SEQ ID NO: 4272196 - DNA, 22 bp, Homo sapiens
ggccagcatccatgcggccggc

SEQ ID NO: 4272197 - DNA, 14 bp, Homo sapiens
ggccagcccagatg

SEQ ID NO: 4272198 - DNA, 20 bp, Homo sapiens
ggccagcccagatggctccc

SEQ ID NO: 4272199 - DNA, 18 bp, Homo sapiens
ggccagcccctcccacca

SEQ ID NO: 4272200 - DNA, 21 bp, Homo sapiens
ggccagcccctcccaccacag

SEQ ID NO: 4272201 - DNA, 23 bp, Homo sapiens
ggccagcccctcccaccacagca

SEQ ID NO: 4272202 - DNA, 13 bp, Homo sapiens
ggccagctcctta

SEQ ID NO: 4272203 - DNA, 15 bp, Homo sapiens
ggccagggctctggc

SEQ ID NO: 4272204 - DNA, 22 bp, Homo sapiens
ggccagggttgcggtcgcggct

SEQ ID NO: 4272205 - DNA, 17 bp, Homo sapiens
ggccatgaactttgtcc

SEQ ID NO: 4272206 - DNA, 21 bp, Homo sapiens
ggccatgagctccagaccccc

SEQ ID NO: 4272207 - DNA, 20 bp, Homo sapiens
ggccatggaagctggcagga

SEQ ID NO: 4272208 - DNA, 21 bp, Homo sapiens
ggcccaccagagcctccctca

SEQ ID NO: 4272209 - DNA, 18 bp, Homo sapiens
ggcccagcagcggcccag

SEQ ID NO: 4272210 - DNA, 13 bp, Homo sapiens
ggcccagcctggc

SEQ ID NO: 4272211 - DNA, 19 bp, Homo sapiens
ggcccagcctgtggcctca

SEQ ID NO: 4272212 - DNA, 22 bp, Homo sapiens
ggcccagcctgtggcctcagca

SEQ ID NO: 4272213 - DNA, 23 bp, Homo sapiens
ggcccagcctgtggcctcagcat

SEQ ID NO: 4272214 - DNA, 21 bp, Homo sapiens
ggcccagggaatcagggagca

SEQ ID NO: 4272215 - DNA, 19 bp, Homo sapiens
ggcccagtgagagtgaggc

SEQ ID NO: 4272216 - DNA, 22 bp, Homo sapiens
ggcccatgccctccgtcctggc

SEQ ID NO: 4272217 - DNA, 16 bp, Homo sapiens
ggccccaaaaccacag

SEQ ID NO: 4272218 - DNA, 23 bp, Homo sapiens
ggccccacccaccctctggtcct

SEQ ID NO: 4272219 - DNA, 14 bp, Homo sapiens
ggccccagagactc

SEQ ID NO: 4272220 - DNA, 11 bp, Homo sapiens
ggccccaggct

SEQ ID NO: 4272221 - DNA, 12 bp, Homo sapiens
ggccccaggctg

SEQ ID NO: 4272222 - DNA, 13 bp, Homo sapiens
ggccccaggctgg

SEQ ID NO: 4272223 - DNA, 14 bp, Homo sapiens
ggccccaggctgga

SEQ ID NO: 4272224 - DNA, 15 bp, Homo sapiens
ggccccaggctggat

SEQ ID NO: 4272225 - DNA, 15 bp, Homo sapiens
ggccccagggaacta

SEQ ID NO: 4272226 - DNA, 15 bp, Homo sapiens
ggcccccagagcgcc

SEQ ID NO: 4272227 - DNA, 14 bp, Homo sapiens
ggcccccgccctct

SEQ ID NO: 4272228 - DNA, 17 bp, Homo sapiens
ggcccccgccctctgcc

SEQ ID NO: 4272229 - DNA, 18 bp, Homo sapiens
ggcccccgccctctgccc

SEQ ID NO: 4272230 - DNA, 23 bp, Homo sapiens
ggcccctgaagtgaccccagctc

SEQ ID NO: 4272231 - DNA, 14 bp, Homo sapiens
ggccccttgctgct

SEQ ID NO: 4272232 - DNA, 19 bp, Homo sapiens
ggccccttgctgctggctc

SEQ ID NO: 4272233 - DNA, 18 bp, Homo sapiens
ggcccgagggtcccaagg

SEQ ID NO: 4272234 - DNA, 15 bp, Homo sapiens
ggcccgcctggcaga

SEQ ID NO: 4272235 - DNA, 19 bp, Homo sapiens
ggcccgcctggcagaactg

SEQ ID NO: 4272236 - DNA, 15 bp, Homo sapiens
ggcccggctgggccc

SEQ ID NO: 4272237 - DNA, 22 bp, Homo sapiens
ggcccgggaggaggatccgggc

SEQ ID NO: 4272238 - DNA, 12 bp, Homo sapiens
ggccctaggcat

SEQ ID NO: 4272239 - DNA, 16 bp, Homo sapiens
ggccctccgcggggga

SEQ ID NO: 4272240 - DNA, 10 bp, Homo sapiens
ggccctgccc

SEQ ID NO: 4272241 - DNA, 12 bp, Homo sapiens
ggccctgcccca

SEQ ID NO: 4272242 - DNA, 17 bp, Homo sapiens
ggccctgccccacacag

SEQ ID NO: 4272243 - DNA, 12 bp, Homo sapiens
ggccctgccccc

SEQ ID NO: 4272244 - DNA, 23 bp, Homo sapiens
ggccctgccccccacattctggc

SEQ ID NO: 4272245 - DNA, 16 bp, Homo sapiens
ggccctgctcaggcct

SEQ ID NO: 4272246 - DNA, 17 bp, Homo sapiens
ggccctgctcaggcctc

SEQ ID NO: 4272247 - DNA, 13 bp, Homo sapiens
ggccctgctgccc

SEQ ID NO: 4272248 - DNA, 17 bp, Homo sapiens
ggccctgctgcccccta

SEQ ID NO: 4272249 - DNA, 19 bp, Homo sapiens
ggccctgctgccccctacc

SEQ ID NO: 4272250 - DNA, 13 bp, Homo sapiens
ggccctggctctg

SEQ ID NO: 4272251 - DNA, 17 bp, Homo sapiens
ggccctgttgtgggggt

SEQ ID NO: 4272252 - DNA, 13 bp, Homo sapiens
ggcccttcctctc

SEQ ID NO: 4272253 - DNA, 15 bp, Homo sapiens
ggcccttcctctcca

SEQ ID NO: 4272254 - DNA, 17 bp, Homo sapiens
ggcccttcctctccact

SEQ ID NO: 4272255 - DNA, 20 bp, Homo sapiens
ggaatcgaggaaccagagcc

SEQ ID NO: 4272256 - DNA, 19 bp, Homo sapiens
ggaatgactataaacatta

SEQ ID NO: 4272257 - DNA, 15 bp, Homo sapiens
ggacaagcccaggac

SEQ ID NO: 4272258 - DNA, 23 bp, Homo sapiens
ggacacagaggacagcttcccca

SEQ ID NO: 4272259 - DNA, 23 bp, Homo sapiens
ggacacagaggacggcttcccca

SEQ ID NO: 4272260 - DNA, 22 bp, Homo sapiens
ggacacagtcagggcggggctg

SEQ ID NO: 4272261 - DNA, 23 bp, Homo sapiens
ggacaccatcccctcctagcaca

SEQ ID NO: 4272262 - DNA, 14 bp, Homo sapiens
ggacacggcctctg

SEQ ID NO: 4272263 - DNA, 16 bp, Homo sapiens
ggacacggcctctggg

SEQ ID NO: 4272264 - DNA, 18 bp, Homo sapiens
ggacacggcctctgggga

SEQ ID NO: 4272265 - DNA, 15 bp, Homo sapiens
ggacactgcctttgc

SEQ ID NO: 4272266 - DNA, 20 bp, Homo sapiens
ggacactgcctttgctgcct

SEQ ID NO: 4272267 - DNA, 21 bp, Homo sapiens
ggacactgcctttgctgcctt

SEQ ID NO: 4272268 - DNA, 18 bp, Homo sapiens
ggacagatcaatggcgca

SEQ ID NO: 4272269 - DNA, 16 bp, Homo sapiens
ggacaggaacacccag

SEQ ID NO: 4272270 - DNA, 17 bp, Homo sapiens
ggacaggaacacccagc

SEQ ID NO: 4272271 - DNA, 20 bp, Homo sapiens
ggacaggaacacccagcccc

SEQ ID NO: 4272272 - DNA, 21 bp, Homo sapiens
ggacaggaacacccagcccca

SEQ ID NO: 4272273 - DNA, 15 bp, Homo sapiens
ggacagggcatggcc

SEQ ID NO: 4272274 - DNA, 15 bp, Homo sapiens
ggacagggccagggt

SEQ ID NO: 4272275 - DNA, 18 bp, Homo sapiens
ggacagggccagggttgc

SEQ ID NO: 4272276 - DNA, 22 bp, Homo sapiens
ggacaggtggaggcgagccaga

SEQ ID NO: 4272277 - DNA, 14 bp, Homo sapiens
ggacagtctggagg

SEQ ID NO: 4272278 - DNA, 15 bp, Homo sapiens
ggacagtctggaggt

SEQ ID NO: 4272279 - DNA, 18 bp, Homo sapiens
ggacagtctggaggtccc

SEQ ID NO: 4272280 - DNA, 12 bp, Homo sapiens
ggaccaggagcc

SEQ ID NO: 4272281 - DNA, 15 bp, Homo sapiens
ggaccaggagccagg

SEQ ID NO: 4272282 - DNA, 17 bp, Homo sapiens
ggacccagcaggggcag

SEQ ID NO: 4272283 - DNA, 17 bp, Homo sapiens
ggaccccatctgctgag

SEQ ID NO: 4272284 - DNA, 23 bp, Homo sapiens
ggaccctgagggtttccaccttg

SEQ ID NO: 4272285 - DNA, 11 bp, Homo sapiens
ggaccctgggt

SEQ ID NO: 4272286 - DNA, 21 bp, Homo sapiens
ggacctgcagttggcctcagc

SEQ ID NO: 4272287 - DNA, 23 bp, Homo sapiens
ggacctgcagttggcctcagcag

SEQ ID NO: 4272288 - DNA, 21 bp, Homo sapiens
ggacgccccccggcctgatgg

SEQ ID NO: 4272289 - DNA, 16 bp, Homo sapiens
ggacgtgggctccagg

SEQ ID NO: 4272290 - DNA, 22 bp, Homo sapiens
ggactcgggctaagtccagctc

SEQ ID NO: 4272291 - DNA, 19 bp, Homo sapiens
ggactctgtggggccacac

SEQ ID NO: 4272292 - DNA, 20 bp, Homo sapiens
ggactgcatgcaagctcagg

SEQ ID NO: 4272293 - DNA, 17 bp, Homo sapiens
ggactggaggctgggtg

SEQ ID NO: 4272294 - DNA, 18 bp, Homo sapiens
ggactggcccacccctct

SEQ ID NO: 4272295 - DNA, 19 bp, Homo sapiens
ggactgggaagggggcagg

SEQ ID NO: 4272296 - DNA, 23 bp, Homo sapiens
ggacttcaaaatcagtgatggga

SEQ ID NO: 4272297 - DNA, 22 bp, Homo sapiens
ggacttcctgctacagtagctg

SEQ ID NO: 4272298 - DNA, 21 bp, Homo sapiens
ggactttccaccccctccctg

SEQ ID NO: 4272299 - DNA, 18 bp, Homo sapiens
ggacttttgttcatggga

SEQ ID NO: 4272300 - DNA, 14 bp, Homo sapiens
ggagaaaagccaga

SEQ ID NO: 4272301 - DNA, 20 bp, Homo sapiens
ggagaacttgaacaaagtct

SEQ ID NO: 4272302 - DNA, 18 bp, Homo sapiens
ggagaaggagaggctctg

SEQ ID NO: 4272303 - DNA, 18 bp, Homo sapiens
ggagaaggcctgcccccc

SEQ ID NO: 4272304 - DNA, 23 bp, Homo sapiens
ggagaagggttagacaagcctgg

SEQ ID NO: 4272305 - DNA, 16 bp, Homo sapiens
ggagaccaggactctg

SEQ ID NO: 4272306 - DNA, 19 bp, Homo sapiens
ggagaccctgggagagtga

SEQ ID NO: 4272307 - DNA, 13 bp, Homo sapiens
ggagactgaccca

SEQ ID NO: 4272308 - DNA, 16 bp, Homo sapiens
ggagactgacccattc

SEQ ID NO: 4272309 - DNA, 14 bp, Homo sapiens
ggagactgagcttg

SEQ ID NO: 4272310 - DNA, 17 bp, Homo sapiens
ggagagaaggtggtctg

SEQ ID NO: 4272311 - DNA, 18 bp, Homo sapiens
ggagagaatgagagagtg

SEQ ID NO: 4272312 - DNA, 20 bp, Homo sapiens
ggagaggaagccacgtgctg

SEQ ID NO: 4272313 - DNA, 21 bp, Homo sapiens
ggagagtgaggtcatcccggg

SEQ ID NO: 4272314 - DNA, 14 bp, Homo sapiens
ggagatccgccctg

SEQ ID NO: 4272315 - DNA, 23 bp, Homo sapiens
ggagatccgccctgggctctggg

SEQ ID NO: 4272316 - DNA, 20 bp, Homo sapiens
ggagatggggagggcgcttt

SEQ ID NO: 4272317 - DNA, 14 bp, Homo sapiens
ggagattgctctgg

SEQ ID NO: 4272318 - DNA, 16 bp, Homo sapiens
ggagcactggaggcct

SEQ ID NO: 4272319 - DNA, 23 bp, Homo sapiens
ggagcagcacgccaaccccagca

SEQ ID NO: 4272320 - DNA, 19 bp, Homo sapiens
ggagcaggaagcaaggcca

SEQ ID NO: 4272321 - DNA, 22 bp, Homo sapiens
ggagcagtgggccctggctctg

SEQ ID NO: 4272322 - DNA, 14 bp, Homo sapiens
ggagcatacccagt

SEQ ID NO: 4272323 - DNA, 12 bp, Homo sapiens
ggagccagcagg

SEQ ID NO: 4272324 - DNA, 16 bp, Homo sapiens
ggagccaggtgtcctg

SEQ ID NO: 4272325 - DNA, 22 bp, Homo sapiens
ggagcctcgcccctccagtgtt

SEQ ID NO: 4272326 - DNA, 12 bp, Homo sapiens
ggagcctgtgtt

SEQ ID NO: 4272327 - DNA, 20 bp, Homo sapiens
ggagcctgtgttagtgtctg

SEQ ID NO: 4272328 - DNA, 16 bp, Homo sapiens
ggagcgggacctgtgg

SEQ ID NO: 4272329 - DNA, 12 bp, Homo sapiens
ggagctgagggg

SEQ ID NO: 4272330 - DNA, 17 bp, Homo sapiens
ggagctgaggggcaggg

SEQ ID NO: 4272331 - DNA, 17 bp, Homo sapiens
ggagctggcgtctgtct

SEQ ID NO: 4272332 - DNA, 18 bp, Homo sapiens
ggagcttctccagccacc

SEQ ID NO: 4272333 - DNA, 16 bp, Homo sapiens
ggaggaaaaaggctgg

SEQ ID NO: 4272334 - DNA, 22 bp, Homo sapiens
ggaggaaaaaggctggtggaca

SEQ ID NO: 4272335 - DNA, 14 bp, Homo sapiens
ggaggaactggtcc

SEQ ID NO: 4272336 - DNA, 22 bp, Homo sapiens
ggaggaaggagcctatggcatc

SEQ ID NO: 4272337 - DNA, 18 bp, Homo sapiens
ggaggaagggactggtcc

SEQ ID NO: 4272338 - DNA, 11 bp, Homo sapiens
ggaggacagaa

SEQ ID NO: 4272339 - DNA, 15 bp, Homo sapiens
ggaggagacagtcag

SEQ ID NO: 4272340 - DNA, 23 bp, Homo sapiens
ggaggagacagtcaggaagcctc

SEQ ID NO: 4272341 - DNA, 16 bp, Homo sapiens
ggaggagactcaggcc

SEQ ID NO: 4272342 - DNA, 19 bp, Homo sapiens
ggaggcaggtcccgagccc

SEQ ID NO: 4272343 - DNA, 17 bp, Homo sapiens
ggaggcagtggcttgga

SEQ ID NO: 4272344 - DNA, 14 bp, Homo sapiens
ggaggccgaggcag

SEQ ID NO: 4272345 - DNA, 16 bp, Homo sapiens
ggaggccgaggcaggg

SEQ ID NO: 4272346 - DNA, 15 bp, Homo sapiens
ggaggcctgaggggc

SEQ ID NO: 4272347 - DNA, 16 bp, Homo sapiens
ggaggcctgaggggca

SEQ ID NO: 4272348 - DNA, 15 bp, Homo sapiens
ggaggcctggtctgg

SEQ ID NO: 4272349 - DNA, 12 bp, Homo sapiens
ggaggcgcgagc

SEQ ID NO: 4272350 - DNA, 17 bp, Homo sapiens
ggagggaaacccgggga

SEQ ID NO: 4272351 - DNA, 13 bp, Homo sapiens
ggagggcgctttt

SEQ ID NO: 4272352 - DNA, 13 bp, Homo sapiens
ggaggggcctggc

SEQ ID NO: 4272353 - DNA, 16 bp, Homo sapiens
ggaggtcccagacatg

SEQ ID NO: 4272354 - DNA, 17 bp, Homo sapiens
ggaggtgtggagtggag

SEQ ID NO: 4272355 - DNA, 19 bp, Homo sapiens
ggagtcagggagccctggg

SEQ ID NO: 4272356 - DNA, 15 bp, Homo sapiens
ggagtccagacctgg

SEQ ID NO: 4272357 - DNA, 22 bp, Homo sapiens
ggagtccagacctgggccctgg

SEQ ID NO: 4272358 - DNA, 17 bp, Homo sapiens
ggagtcctgttctcaga

SEQ ID NO: 4272359 - DNA, 13 bp, Homo sapiens
ggagtcgagctgg

SEQ ID NO: 4272360 - DNA, 18 bp, Homo sapiens
ggagtctgaaggagagga

SEQ ID NO: 4272361 - DNA, 20 bp, Homo sapiens
ggagtctgaaggagaggagt

SEQ ID NO: 4272362 - DNA, 12 bp, Homo sapiens
ggagtgcagtgg

SEQ ID NO: 4272363 - DNA, 21 bp, Homo sapiens
ggagtggaggggtcagcaggg

SEQ ID NO: 4272364 - DNA, 13 bp, Homo sapiens
ggagtgggagagg

SEQ ID NO: 4272365 - DNA, 24 bp, Homo sapiens
ggagtgggagaggaagccacgtgc

SEQ ID NO: 4272366 - DNA, 17 bp, Homo sapiens
ggagtggtaacaagagg

SEQ ID NO: 4272367 - DNA, 15 bp, Homo sapiens
ggagtgtgtgggggt

SEQ ID NO: 4272368 - DNA, 21 bp, Homo sapiens
ggagtgtgtgggggtctggga

SEQ ID NO: 4272369 - DNA, 13 bp, Homo sapiens
ggagttgggctgg

SEQ ID NO: 4272370 - DNA, 14 bp, Homo sapiens
ggagttgggctggt

SEQ ID NO: 4272371 - DNA, 15 bp, Homo sapiens
ggatacgtgtcaatg

SEQ ID NO: 4272372 - DNA, 20 bp, Homo sapiens
ggatcaaggggttcccactg

SEQ ID NO: 4272373 - DNA, 18 bp, Homo sapiens
ggatccagatagcctagg

SEQ ID NO: 4272374 - DNA, 23 bp, Homo sapiens
ggatccagatagcctagggtgag

SEQ ID NO: 4272375 - DNA, 13 bp, Homo sapiens
ggatctccaggcc

SEQ ID NO: 4272376 - DNA, 14 bp, Homo sapiens
ggatctccaggccc

SEQ ID NO: 4272377 - DNA, 16 bp, Homo sapiens
ggatctccaggcccag

SEQ ID NO: 4272378 - DNA, 19 bp, Homo sapiens
ggatctccaggcccagcct

SEQ ID NO: 4272379 - DNA, 17 bp, Homo sapiens
ggatctcttaagacagc

SEQ ID NO: 4272380 - DNA, 18 bp, Homo sapiens
ggatctgctccatgcaga

SEQ ID NO: 4272381 - DNA, 14 bp, Homo sapiens
ggatgaactagcca

SEQ ID NO: 4272382 - DNA, 16 bp, Homo sapiens
ggatgctgggttctgg

SEQ ID NO: 4272383 - DNA, 20 bp, Homo sapiens
ggatgctgggttctggggct

SEQ ID NO: 4272384 - DNA, 21 bp, Homo sapiens
ggatgcttgcctagggcctgg

SEQ ID NO: 4272385 - DNA, 23 bp, Homo sapiens
ggatggcgtgtcccctgcctgtg

SEQ ID NO: 4272386 - DNA, 14 bp, Homo sapiens
ggatgggcacaggc

SEQ ID NO: 4272387 - DNA, 23 bp, Homo sapiens
ggatggtactagggggaagtgac

SEQ ID NO: 4272388 - DNA, 18 bp, Homo sapiens
gctggcaggagacactgg

SEQ ID NO: 4272389 - DNA, 11 bp, Homo sapiens
gctggcccctc

SEQ ID NO: 4272390 - DNA, 12 bp, Homo sapiens
gctggcccctca

SEQ ID NO: 4272391 - DNA, 23 bp, Homo sapiens
gctggcccctcacctgggcacct

SEQ ID NO: 4272392 - DNA, 13 bp, Homo sapiens
gctggcctcttcc

SEQ ID NO: 4272393 - DNA, 16 bp, Homo sapiens
gctggctcccagggcc

SEQ ID NO: 4272394 - DNA, 18 bp, Homo sapiens
gctggctctgcagcacat

SEQ ID NO: 4272395 - DNA, 14 bp, Homo sapiens
gctggctgccttag

SEQ ID NO: 4272396 - DNA, 20 bp, Homo sapiens
gctggctgccttagaacctt

SEQ ID NO: 4272397 - DNA, 16 bp, Homo sapiens
gctggcttctccctgg

SEQ ID NO: 4272398 - DNA, 19 bp, Homo sapiens
gctggcttctccctggact

SEQ ID NO: 4272399 - DNA, 12 bp, Homo sapiens
gctgggaccctc

SEQ ID NO: 4272400 - DNA, 16 bp, Homo sapiens
gctgggagaaaagcca

SEQ ID NO: 4272401 - DNA, 10 bp, Homo sapiens
gctgggagag

SEQ ID NO: 4272402 - DNA, 12 bp, Homo sapiens
gctgggagagcc

SEQ ID NO: 4272403 - DNA, 16 bp, Homo sapiens
gctgggagagccaagg

SEQ ID NO: 4272404 - DNA, 19 bp, Homo sapiens
gctgggagcctcgcccctc

SEQ ID NO: 4272405 - DNA, 14 bp, Homo sapiens
gctgggcccagaag

SEQ ID NO: 4272406 - DNA, 13 bp, Homo sapiens
gctggggagggag

SEQ ID NO: 4272407 - DNA, 22 bp, Homo sapiens
gctggggcttttgtgccaggag

SEQ ID NO: 4272408 - DNA, 23 bp, Homo sapiens
gctgggggccatgagctccagac

SEQ ID NO: 4272409 - DNA, 14 bp, Homo sapiens
gctgggtcccgggt

SEQ ID NO: 4272410 - DNA, 21 bp, Homo sapiens
gctgggtggccggccctgccc

SEQ ID NO: 4272411 - DNA, 23 bp, Homo sapiens
gctggtcacccccacccccgggt

SEQ ID NO: 4272412 - DNA, 17 bp, Homo sapiens
gctggtcatcctgggca

SEQ ID NO: 4272413 - DNA, 19 bp, Homo sapiens
gctggtctctaggcctgaa

SEQ ID NO: 4272414 - DNA, 22 bp, Homo sapiens
gctggtgcccaccagctggctc

SEQ ID NO: 4272415 - DNA, 15 bp, Homo sapiens
gctggtgcccaccct

SEQ ID NO: 4272416 - DNA, 18 bp, Homo sapiens
gctggtggacagacccag

SEQ ID NO: 4272417 - DNA, 22 bp, Homo sapiens
gctggtggacagacccagggtg

SEQ ID NO: 4272418 - DNA, 19 bp, Homo sapiens
gctgtaagacggccttgga

SEQ ID NO: 4272419 - DNA, 16 bp, Homo sapiens
gctgtacactgcacga

SEQ ID NO: 4272420 - DNA, 17 bp, Homo sapiens
gctgtatacaaacaggt

SEQ ID NO: 4272421 - DNA, 14 bp, Homo sapiens
gctgtatctgtgct

SEQ ID NO: 4272422 - DNA, 19 bp, Homo sapiens
gctgtattttcttttatat

SEQ ID NO: 4272423 - DNA, 14 bp, Homo sapiens
gctgtctccagacc

SEQ ID NO: 4272424 - DNA, 13 bp, Homo sapiens
gctgtgccagctg

SEQ ID NO: 4272425 - DNA, 14 bp, Homo sapiens
gctgtgccagctgc

SEQ ID NO: 4272426 - DNA, 17 bp, Homo sapiens
gctgtgccagctgcttc

SEQ ID NO: 4272427 - DNA, 13 bp, Homo sapiens
gctgtgctggtct

SEQ ID NO: 4272428 - DNA, 14 bp, Homo sapiens
gctgtgctggtctc

SEQ ID NO: 4272429 - DNA, 18 bp, Homo sapiens
gctgtgctggtctctagg

SEQ ID NO: 4272430 - DNA, 20 bp, Homo sapiens
gctgtgctggtctctaggcc

SEQ ID NO: 4272431 - DNA, 22 bp, Homo sapiens
gctgtgctggtctctaggcctg

SEQ ID NO: 4272432 - DNA, 14 bp, Homo sapiens
gctgtggcccctcc

SEQ ID NO: 4272433 - DNA, 18 bp, Homo sapiens
gctgtgggagtgattttg

SEQ ID NO: 4272434 - DNA, 19 bp, Homo sapiens
gctgtgggtcagtgtgcca

SEQ ID NO: 4272435 - DNA, 22 bp, Homo sapiens
gctgttgtctgccgtgagagcc

SEQ ID NO: 4272436 - DNA, 19 bp, Homo sapiens
gctgttttatgtcatactc

SEQ ID NO: 4272437 - DNA, 22 bp, Homo sapiens
gcttaaaaaagaaagattttat

SEQ ID NO: 4272438 - DNA, 13 bp, Homo sapiens
gcttaattccaat

SEQ ID NO: 4272439 - DNA, 21 bp, Homo sapiens
gcttagctgaaacctaaggca

SEQ ID NO: 4272440 - DNA, 19 bp, Homo sapiens
gcttcaatctacgatgtta

SEQ ID NO: 4272441 - DNA, 17 bp, Homo sapiens
gcttcagcccctggggt

SEQ ID NO: 4272442 - DNA, 13 bp, Homo sapiens
gcttcaggtgagc

SEQ ID NO: 4272443 - DNA, 15 bp, Homo sapiens
gcttcaggtgagcca

SEQ ID NO: 4272444 - DNA, 21 bp, Homo sapiens
gcttccagttggactgtggcc

SEQ ID NO: 4272445 - DNA, 21 bp, Homo sapiens
gcttccatggtggtttcagaa

SEQ ID NO: 4272446 - DNA, 11 bp, Homo sapiens
gcttcccagga

SEQ ID NO: 4272447 - DNA, 14 bp, Homo sapiens
gcttcccaggaccc

SEQ ID NO: 4272448 - DNA, 20 bp, Homo sapiens
gcttcccaggaccctgggtc

SEQ ID NO: 4272449 - DNA, 20 bp, Homo sapiens
gcttccccatcgccttctgg

SEQ ID NO: 4272450 - DNA, 14 bp, Homo sapiens
gcttccccattgcc

SEQ ID NO: 4272451 - DNA, 17 bp, Homo sapiens
gcttcccgctcagccct

SEQ ID NO: 4272452 - DNA, 20 bp, Homo sapiens
gcttccctctgcctgtccct

SEQ ID NO: 4272453 - DNA, 23 bp, Homo sapiens
gcttccctctgcctgtccctctc

SEQ ID NO: 4272454 - DNA, 16 bp, Homo sapiens
gcttccctctgctcca

SEQ ID NO: 4272455 - DNA, 15 bp, Homo sapiens
gcttccggctgagct

SEQ ID NO: 4272456 - DNA, 16 bp, Homo sapiens
gcttccggctgagctg

SEQ ID NO: 4272457 - DNA, 12 bp, Homo sapiens
gcttcctgccct

SEQ ID NO: 4272458 - DNA, 17 bp, Homo sapiens
gcttcctgccctagcag

SEQ ID NO: 4272459 - DNA, 19 bp, Homo sapiens
gcttcgccatgtgctgtgc

SEQ ID NO: 4272460 - DNA, 21 bp, Homo sapiens
gcttcgccatgtgctgtgcac

SEQ ID NO: 4272461 - DNA, 12 bp, Homo sapiens
gcttctccagcc

SEQ ID NO: 4272462 - DNA, 21 bp, Homo sapiens
gcttctccagccaccaaggct

SEQ ID NO: 4272463 - DNA, 13 bp, Homo sapiens
gcttctgcccacc

SEQ ID NO: 4272464 - DNA, 15 bp, Homo sapiens
gcttctgcccacccc

SEQ ID NO: 4272465 - DNA, 20 bp, Homo sapiens
gcttctgcccaccccgcctc

SEQ ID NO: 4272466 - DNA, 21 bp, Homo sapiens
gcttctgcccaccccgcctct

SEQ ID NO: 4272467 - DNA, 22 bp, Homo sapiens
gcttctgcccaccccgcctctg

SEQ ID NO: 4272468 - DNA, 23 bp, Homo sapiens
gcttctgcccaccccgcctctgg

SEQ ID NO: 4272469 - DNA, 18 bp, Homo sapiens
gcttgaagattcaggctt

SEQ ID NO: 4272470 - DNA, 20 bp, Homo sapiens
gcttgaagattcaggcttgc

SEQ ID NO: 4272471 - DNA, 21 bp, Homo sapiens
gcttgattctaaaggggacag

SEQ ID NO: 4272472 - DNA, 21 bp, Homo sapiens
gcttggaacatttgggagact

SEQ ID NO: 4272473 - DNA, 16 bp, Homo sapiens
gcttggagcagaggtg

SEQ ID NO: 4272474 - DNA, 13 bp, Homo sapiens
gcttggccagaag

SEQ ID NO: 4272475 - DNA, 19 bp, Homo sapiens
gcttgggaccgccagatgg

SEQ ID NO: 4272476 - DNA, 15 bp, Homo sapiens
gcttgtcagagctgg

SEQ ID NO: 4272477 - DNA, 18 bp, Homo sapiens
gcttgtcagagctgggag

SEQ ID NO: 4272478 - DNA, 13 bp, Homo sapiens
gcttgtcctgctc

SEQ ID NO: 4272479 - DNA, 14 bp, Homo sapiens
gcttgtcctgctca

SEQ ID NO: 4272480 - DNA, 15 bp, Homo sapiens
gcttgttcagtcact

SEQ ID NO: 4272481 - DNA, 17 bp, Homo sapiens
gctttatgaagttaaca

SEQ ID NO: 4272482 - DNA, 16 bp, Homo sapiens
gctttccaacacacaa

SEQ ID NO: 4272483 - DNA, 18 bp, Homo sapiens
gctttgctggagtcctgt

SEQ ID NO: 4272484 - DNA, 22 bp, Homo sapiens
gctttggaaagacctgtgaggg

SEQ ID NO: 4272485 - DNA, 21 bp, Homo sapiens
gctttggctcgggacttcaaa

SEQ ID NO: 4272486 - DNA, 15 bp, Homo sapiens
gctttgggctgccct

SEQ ID NO: 4272487 - DNA, 16 bp, Homo sapiens
gctttgggctgccctg

SEQ ID NO: 4272488 - DNA, 13 bp, Homo sapiens
gcttttcactgct

SEQ ID NO: 4272489 - DNA, 23 bp, Homo sapiens
gcttttcactgctggctgcctta

SEQ ID NO: 4272490 - DNA, 17 bp, Homo sapiens
gcttttctgcaattcaa

SEQ ID NO: 4272491 - DNA, 15 bp, Homo sapiens
ggaaaaaatatttta

SEQ ID NO: 4272492 - DNA, 22 bp, Homo sapiens
ggaaaaccaagccgtggcttcc

SEQ ID NO: 4272493 - DNA, 13 bp, Homo sapiens
ggaaaagggcagg

SEQ ID NO: 4272494 - DNA, 21 bp, Homo sapiens
ggaaacccggggaactggttt

SEQ ID NO: 4272495 - DNA, 18 bp, Homo sapiens
ggaaaccttcacccagca

SEQ ID NO: 4272496 - DNA, 21 bp, Homo sapiens
ggaaactcacctgctggcccc

SEQ ID NO: 4272497 - DNA, 20 bp, Homo sapiens
ggaaagggtgctgcttccct

SEQ ID NO: 4272498 - DNA, 23 bp, Homo sapiens
ggaaataggcccaaccaccagat

SEQ ID NO: 4272499 - DNA, 13 bp, Homo sapiens
ggaaatcctgtta

SEQ ID NO: 4272500 - DNA, 14 bp, Homo sapiens
ggaaatgctgattt

SEQ ID NO: 4272501 - DNA, 20 bp, Homo sapiens
ggaacagagtatatatgtac

SEQ ID NO: 4272502 - DNA, 17 bp, Homo sapiens
ggaacaggaggaactgg

SEQ ID NO: 4272503 - DNA, 23 bp, Homo sapiens
ggaacaggaggaactggtccagg

SEQ ID NO: 4272504 - DNA, 21 bp, Homo sapiens
ggaacctcgaagctgttctct

SEQ ID NO: 4272505 - DNA, 13 bp, Homo sapiens
ggaagagagaaag

SEQ ID NO: 4272506 - DNA, 18 bp, Homo sapiens
ggaagaggccgctgcagg

SEQ ID NO: 4272507 - DNA, 17 bp, Homo sapiens
ggaagcaaggccagccc

SEQ ID NO: 4272508 - DNA, 18 bp, Homo sapiens
ggaagcaccagcctcagt

SEQ ID NO: 4272509 - DNA, 14 bp, Homo sapiens
ggaagcagagcctg

SEQ ID NO: 4272510 - DNA, 17 bp, Homo sapiens
ggaagcctcctgctgag

SEQ ID NO: 4272511 - DNA, 22 bp, Homo sapiens
ggaagctggcaggagacactgg

SEQ ID NO: 4272512 - DNA, 16 bp, Homo sapiens
ggaagggactaggagc

SEQ ID NO: 4272513 - DNA, 20 bp, Homo sapiens
ggaaggtctcatgcctgaga

SEQ ID NO: 4272514 - DNA, 18 bp, Homo sapiens
ggaagtcaggagccagca

SEQ ID NO: 4272515 - DNA, 21 bp, Homo sapiens
ggaagtcaggagccagcaggg

SEQ ID NO: 4272516 - DNA, 18 bp, Homo sapiens
ggaagtccctgagaagcc

SEQ ID NO: 4272517 - DNA, 17 bp, Homo sapiens
ggaagtgacaaggcccc

SEQ ID NO: 4272518 - DNA, 22 bp, Homo sapiens
ggaagtgacaaggccccagaga

SEQ ID NO: 4272519 - DNA, 17 bp, Homo sapiens
ggaagtggcctgagaag

SEQ ID NO: 4272520 - DNA, 16 bp, Homo sapiens
ggaagtgtgctgaggt

SEQ ID NO: 4272521 - DNA, 15 bp, Homo sapiens
ggaatcagggagcac

SEQ ID NO: 4272522 - DNA, 15 bp, Homo sapiens
gctatgtctgtgatg

SEQ ID NO: 4272523 - DNA, 12 bp, Homo sapiens
gctattaagaaa

SEQ ID NO: 4272524 - DNA, 12 bp, Homo sapiens
gctattaatatt

SEQ ID NO: 4272525 - DNA, 13 bp, Homo sapiens
gctattcccaggc

SEQ ID NO: 4272526 - DNA, 17 bp, Homo sapiens
gctattcccaggcaggg

SEQ ID NO: 4272527 - DNA, 22 bp, Homo sapiens
gctcaacctacagtggagggag

SEQ ID NO: 4272528 - DNA, 15 bp, Homo sapiens
gctcacaccagccct

SEQ ID NO: 4272529 - DNA, 16 bp, Homo sapiens
gctcacaccagccctg

SEQ ID NO: 4272530 - DNA, 22 bp, Homo sapiens
gctcacagaacccttggagcca

SEQ ID NO: 4272531 - DNA, 11 bp, Homo sapiens
gctcacagcca

SEQ ID NO: 4272532 - DNA, 15 bp, Homo sapiens
gctcacagccaccac

SEQ ID NO: 4272533 - DNA, 21 bp, Homo sapiens
gctcacagccaccacctggat

SEQ ID NO: 4272534 - DNA, 13 bp, Homo sapiens
gctcacccaggac

SEQ ID NO: 4272535 - DNA, 18 bp, Homo sapiens
gctcacccaggacctctg

SEQ ID NO: 4272536 - DNA, 20 bp, Homo sapiens
gctcacccaggacctctggg

SEQ ID NO: 4272537 - DNA, 23 bp, Homo sapiens
gctcagatgctggtcatcctggg

SEQ ID NO: 4272538 - DNA, 16 bp, Homo sapiens
gctcagcccacccccc

SEQ ID NO: 4272539 - DNA, 17 bp, Homo sapiens
gctcagcccacccccct

SEQ ID NO: 4272540 - DNA, 12 bp, Homo sapiens
gctcagccctcc

SEQ ID NO: 4272541 - DNA, 17 bp, Homo sapiens
gctcagccctccctgcc

SEQ ID NO: 4272542 - DNA, 21 bp, Homo sapiens
gctccacagaaaccctgtttt

SEQ ID NO: 4272543 - DNA, 21 bp, Homo sapiens
gctccacgggggcctagtggc

SEQ ID NO: 4272544 - DNA, 15 bp, Homo sapiens
gctccagacccccag

SEQ ID NO: 4272545 - DNA, 14 bp, Homo sapiens
gctccagccaaccc

SEQ ID NO: 4272546 - DNA, 21 bp, Homo sapiens
gctccaggcttcctgccctag

SEQ ID NO: 4272547 - DNA, 23 bp, Homo sapiens
gctccaggcttcctgccctagca

SEQ ID NO: 4272548 - DNA, 12 bp, Homo sapiens
gctccagggact

SEQ ID NO: 4272549 - DNA, 17 bp, Homo sapiens
gctccagtctgctgccc

SEQ ID NO: 4272550 - DNA, 18 bp, Homo sapiens
gctccagtctgctgccct

SEQ ID NO: 4272551 - DNA, 14 bp, Homo sapiens
gctccagtgttttc

SEQ ID NO: 4272552 - DNA, 19 bp, Homo sapiens
gctccagtgttttcttgtg

SEQ ID NO: 4272553 - DNA, 20 bp, Homo sapiens
gctccagtgttttcttgtgt

SEQ ID NO: 4272554 - DNA, 14 bp, Homo sapiens
gctccatcttattt

SEQ ID NO: 4272555 - DNA, 19 bp, Homo sapiens
gctccatgcagatctagcc

SEQ ID NO: 4272556 - DNA, 23 bp, Homo sapiens
gctccatgcagatctagccaggc

SEQ ID NO: 4272557 - DNA, 20 bp, Homo sapiens
gctcccacaggcccttcctc

SEQ ID NO: 4272558 - DNA, 21 bp, Homo sapiens
gctcccacaggcccttcctct

SEQ ID NO: 4272559 - DNA, 15 bp, Homo sapiens
gctcccacgccctcc

SEQ ID NO: 4272560 - DNA, 15 bp, Homo sapiens
gctcccactgcccct

SEQ ID NO: 4272561 - DNA, 18 bp, Homo sapiens
gctcccactgcccctgca

SEQ ID NO: 4272562 - DNA, 22 bp, Homo sapiens
gctcccaggacgcagggagacc

SEQ ID NO: 4272563 - DNA, 14 bp, Homo sapiens
gctcccagggccat

SEQ ID NO: 4272564 - DNA, 14 bp, Homo sapiens
gctcccagggtcct

SEQ ID NO: 4272565 - DNA, 23 bp, Homo sapiens
gctcccagggtcctgggggctgc

SEQ ID NO: 4272566 - DNA, 21 bp, Homo sapiens
gctcccatctccctcccattt

SEQ ID NO: 4272567 - DNA, 14 bp, Homo sapiens
gctccccagcccag

SEQ ID NO: 4272568 - DNA, 18 bp, Homo sapiens
gctcccccatcctcccct

SEQ ID NO: 4272569 - DNA, 13 bp, Homo sapiens
gctccctgggctg

SEQ ID NO: 4272570 - DNA, 14 bp, Homo sapiens
gctccctgggctgg

SEQ ID NO: 4272571 - DNA, 15 bp, Homo sapiens
gctccctgggctggc

SEQ ID NO: 4272572 - DNA, 16 bp, Homo sapiens
gctcctctgcctgtgc

SEQ ID NO: 4272573 - DNA, 15 bp, Homo sapiens
gctcctctgccttgg

SEQ ID NO: 4272574 - DNA, 22 bp, Homo sapiens
gctcctgtggcggtgcagtggc

SEQ ID NO: 4272575 - DNA, 13 bp, Homo sapiens
gctcgttccccca

SEQ ID NO: 4272576 - DNA, 18 bp, Homo sapiens
gctctagacaaccctgca

SEQ ID NO: 4272577 - DNA, 15 bp, Homo sapiens
gctctcctgggccag

SEQ ID NO: 4272578 - DNA, 16 bp, Homo sapiens
gctctcctgggccagg

SEQ ID NO: 4272579 - DNA, 22 bp, Homo sapiens
gctctcctgggccagggtctcg

SEQ ID NO: 4272580 - DNA, 16 bp, Homo sapiens
gctctgaaagctgctt

SEQ ID NO: 4272581 - DNA, 17 bp, Homo sapiens
gctctgaaagctgcttc

SEQ ID NO: 4272582 - DNA, 18 bp, Homo sapiens
gctctgaatgtagccagc

SEQ ID NO: 4272583 - DNA, 20 bp, Homo sapiens
gctctgaatgtagccagccc

SEQ ID NO: 4272584 - DNA, 21 bp, Homo sapiens
gctctgaatgtagccagccca

SEQ ID NO: 4272585 - DNA, 23 bp, Homo sapiens
gctctgaggcaaccccctcggag

SEQ ID NO: 4272586 - DNA, 19 bp, Homo sapiens
gctctgaggctgccccagg

SEQ ID NO: 4272587 - DNA, 14 bp, Homo sapiens
gctctgccatcagc

SEQ ID NO: 4272588 - DNA, 23 bp, Homo sapiens
gctctggcaggtggccagggctc

SEQ ID NO: 4272589 - DNA, 19 bp, Homo sapiens
gctctgtcttggtaggttt

SEQ ID NO: 4272590 - DNA, 17 bp, Homo sapiens
gctcttctcctttcaca

SEQ ID NO: 4272591 - DNA, 19 bp, Homo sapiens
gctgaaaaattgtagagtg

SEQ ID NO: 4272592 - DNA, 18 bp, Homo sapiens
gctgaatgtatgtaaata

SEQ ID NO: 4272593 - DNA, 22 bp, Homo sapiens
gctgacaaccaccgctccccag

SEQ ID NO: 4272594 - DNA, 19 bp, Homo sapiens
gctgacagcactaaacttg

SEQ ID NO: 4272595 - DNA, 22 bp, Homo sapiens
gctgaccagaagtggcaggagg

SEQ ID NO: 4272596 - DNA, 14 bp, Homo sapiens
gctgagctgtgcca

SEQ ID NO: 4272597 - DNA, 23 bp, Homo sapiens
gctgagctgtgccagctgcttct

SEQ ID NO: 4272598 - DNA, 14 bp, Homo sapiens
gctgaggggcaggg

SEQ ID NO: 4272599 - DNA, 12 bp, Homo sapiens
gctgaggtgggc

SEQ ID NO: 4272600 - DNA, 15 bp, Homo sapiens
gctgaggtgggcctt

SEQ ID NO: 4272601 - DNA, 15 bp, Homo sapiens
gctgagtggtccaca

SEQ ID NO: 4272602 - DNA, 12 bp, Homo sapiens
gctgcaccaacc

SEQ ID NO: 4272603 - DNA, 14 bp, Homo sapiens
gctgcacctgcagg

SEQ ID NO: 4272604 - DNA, 17 bp, Homo sapiens
gctgcacctgcagggag

SEQ ID NO: 4272605 - DNA, 18 bp, Homo sapiens
gctgcacctgcagggagc

SEQ ID NO: 4272606 - DNA, 20 bp, Homo sapiens
gctgcacctgcagggagcag

SEQ ID NO: 4272607 - DNA, 14 bp, Homo sapiens
gctgcactgccctc

SEQ ID NO: 4272608 - DNA, 22 bp, Homo sapiens
gctgcaggaatcaaaaattgaa

SEQ ID NO: 4272609 - DNA, 15 bp, Homo sapiens
gctgcatcctcagcc

SEQ ID NO: 4272610 - DNA, 16 bp, Homo sapiens
gctgcatcctcagccc

SEQ ID NO: 4272611 - DNA, 20 bp, Homo sapiens
gctgcatcctcagccccagg

SEQ ID NO: 4272612 - DNA, 22 bp, Homo sapiens
gctgcatcctcagccccagggc

SEQ ID NO: 4272613 - DNA, 23 bp, Homo sapiens
gctgcatcctcagccccagggcc

SEQ ID NO: 4272614 - DNA, 15 bp, Homo sapiens
gctgccacacttcag

SEQ ID NO: 4272615 - DNA, 21 bp, Homo sapiens
gctgccacacttcaggctctt

SEQ ID NO: 4272616 - DNA, 17 bp, Homo sapiens
gctgcccaccccctgct

SEQ ID NO: 4272617 - DNA, 15 bp, Homo sapiens
gctgccccacccctc

SEQ ID NO: 4272618 - DNA, 21 bp, Homo sapiens
gctgcccccagaccccatcca

SEQ ID NO: 4272619 - DNA, 17 bp, Homo sapiens
gctgcccgtgaggaggg

SEQ ID NO: 4272620 - DNA, 21 bp, Homo sapiens
gctgcccgtgaggagggggag

SEQ ID NO: 4272621 - DNA, 23 bp, Homo sapiens
gctgcccgtgaggagggggagaa

SEQ ID NO: 4272622 - DNA, 21 bp, Homo sapiens
gctgccctccatcccgacatg

SEQ ID NO: 4272623 - DNA, 15 bp, Homo sapiens
gctgccctgcaaacc

SEQ ID NO: 4272624 - DNA, 12 bp, Homo sapiens
gctgccctggtg

SEQ ID NO: 4272625 - DNA, 13 bp, Homo sapiens
gctgccctggtgc

SEQ ID NO: 4272626 - DNA, 17 bp, Homo sapiens
gctgccctggtgctgcc

SEQ ID NO: 4272627 - DNA, 22 bp, Homo sapiens
gctgcctaaatccactctgcag

SEQ ID NO: 4272628 - DNA, 15 bp, Homo sapiens
gctgcctccccaacc

SEQ ID NO: 4272629 - DNA, 23 bp, Homo sapiens
gctgcctccccaaccctgcccct

SEQ ID NO: 4272630 - DNA, 19 bp, Homo sapiens
gctgcctctgaaaatattt

SEQ ID NO: 4272631 - DNA, 13 bp, Homo sapiens
gctgcctgcctcc

SEQ ID NO: 4272632 - DNA, 22 bp, Homo sapiens
gctgcctgcctccggccctgcc

SEQ ID NO: 4272633 - DNA, 15 bp, Homo sapiens
gctgccttagaacct

SEQ ID NO: 4272634 - DNA, 17 bp, Homo sapiens
gctgccttctgtctctt

SEQ ID NO: 4272635 - DNA, 19 bp, Homo sapiens
gctgccttctgtctcttgc

SEQ ID NO: 4272636 - DNA, 20 bp, Homo sapiens
gctgccttctgtctcttgca

SEQ ID NO: 4272637 - DNA, 14 bp, Homo sapiens
gctgcgctgccctg

SEQ ID NO: 4272638 - DNA, 15 bp, Homo sapiens
gctgcgctgccctgc

SEQ ID NO: 4272639 - DNA, 19 bp, Homo sapiens
gctgcgctgtgctggtctc

SEQ ID NO: 4272640 - DNA, 14 bp, Homo sapiens
gctgctcctcgcag

SEQ ID NO: 4272641 - DNA, 16 bp, Homo sapiens
gctgctgcactgccct

SEQ ID NO: 4272642 - DNA, 23 bp, Homo sapiens
gctgctgcagtcagcacagagag

SEQ ID NO: 4272643 - DNA, 18 bp, Homo sapiens
gctgctggctcccatctc

SEQ ID NO: 4272644 - DNA, 20 bp, Homo sapiens
gctgctggctcccatctccc

SEQ ID NO: 4272645 - DNA, 20 bp, Homo sapiens
gctgctggtcacccccaccc

SEQ ID NO: 4272646 - DNA, 15 bp, Homo sapiens
gctgcttccctctgc

SEQ ID NO: 4272647 - DNA, 20 bp, Homo sapiens
gctgcttccctctgcctgtc

SEQ ID NO: 4272648 - DNA, 12 bp, Homo sapiens
gctgcttctgcc

SEQ ID NO: 4272649 - DNA, 13 bp, Homo sapiens
gctgctttccaac

SEQ ID NO: 4272650 - DNA, 13 bp, Homo sapiens
gctggagagtaga

SEQ ID NO: 4272651 - DNA, 19 bp, Homo sapiens
gctggagtcctgttctcag

SEQ ID NO: 4272652 - DNA, 20 bp, Homo sapiens
gctggagtgcagtggtgcga

SEQ ID NO: 4272653 - DNA, 14 bp, Homo sapiens
gctggatgctgggt

SEQ ID NO: 4272654 - DNA, 22 bp, Homo sapiens
gctggattggcaggtgtgggct

SEQ ID NO: 4272655 - DNA, 17 bp, Homo sapiens
gctggcaccgccttctc

SEQ ID NO: 4272656 - DNA, 21 bp, Homo sapiens
gaacaggaggaactggtccag

SEQ ID NO: 4272657 - DNA, 13 bp, Homo sapiens
gaacattcatgtg

SEQ ID NO: 4272658 - DNA, 23 bp, Homo sapiens
gaaccagagccatggactctaca

SEQ ID NO: 4272659 - DNA, 19 bp, Homo sapiens
gaaccagtcttttgaaaga

SEQ ID NO: 4272660 - DNA, 13 bp, Homo sapiens
gaacccccctccc

SEQ ID NO: 4272661 - DNA, 14 bp, Homo sapiens
gaacctctgattta

SEQ ID NO: 4272662 - DNA, 18 bp, Homo sapiens
gaacgatccttcaaagtc

SEQ ID NO: 4272663 - DNA, 14 bp, Homo sapiens
gaactcagccttaa

SEQ ID NO: 4272664 - DNA, 21 bp, Homo sapiens
gaactcagccttaagaaagct

SEQ ID NO: 4272665 - DNA, 15 bp, Homo sapiens
gaactccttgatttt

SEQ ID NO: 4272666 - DNA, 19 bp, Homo sapiens
gaactgagctcctctgggc

SEQ ID NO: 4272667 - DNA, 18 bp, Homo sapiens
gaactggtccaggccagg

SEQ ID NO: 4272668 - DNA, 17 bp, Homo sapiens
gaactgtcccacaaaat

SEQ ID NO: 4272669 - DNA, 23 bp, Homo sapiens
gaactgtcttagtcataccatcc

SEQ ID NO: 4272670 - DNA, 20 bp, Homo sapiens
gaactgttgtttgatgtgta

SEQ ID NO: 4272671 - DNA, 19 bp, Homo sapiens
gaacttgaacaaagtctct

SEQ ID NO: 4272672 - DNA, 21 bp, Homo sapiens
gaacttgatgttcctgggatg

SEQ ID NO: 4272673 - DNA, 20 bp, Homo sapiens
gaagaaaagtgggccagtgt

SEQ ID NO: 4272674 - DNA, 12 bp, Homo sapiens
gaagaaagcctg

SEQ ID NO: 4272675 - DNA, 17 bp, Homo sapiens
gaagaaagtctatgctt

SEQ ID NO: 4272676 - DNA, 14 bp, Homo sapiens
gaagaagctcctga

SEQ ID NO: 4272677 - DNA, 14 bp, Homo sapiens
gaagaagggaaatt

SEQ ID NO: 4272678 - DNA, 14 bp, Homo sapiens
gaagaattggcaga

SEQ ID NO: 4272679 - DNA, 14 bp, Homo sapiens
gaagaatttgaaga

SEQ ID NO: 4272680 - DNA, 24 bp, Homo sapiens
gaagacacgtgtttttgtatcttt

SEQ ID NO: 4272681 - DNA, 16 bp, Homo sapiens
gaagaccttctgaaga

SEQ ID NO: 4272682 - DNA, 19 bp, Homo sapiens
gaagagagatatatctgaa

SEQ ID NO: 4272683 - DNA, 18 bp, Homo sapiens
gaagagcgctcctctgcc

SEQ ID NO: 4272684 - DNA, 16 bp, Homo sapiens
gaagagctagagaaat

SEQ ID NO: 4272685 - DNA, 17 bp, Homo sapiens
gaagaggccgctgcagg

SEQ ID NO: 4272686 - DNA, 19 bp, Homo sapiens
gaagagggagaaggagagg

SEQ ID NO: 4272687 - DNA, 23 bp, Homo sapiens
gaagatcctccttccaggcccca

SEQ ID NO: 4272688 - DNA, 18 bp, Homo sapiens
gaagcaaacacacagact

SEQ ID NO: 4272689 - DNA, 14 bp, Homo sapiens
gaagcaaataaata

SEQ ID NO: 4272690 - DNA, 15 bp, Homo sapiens
gaagcaaataaatat

SEQ ID NO: 4272691 - DNA, 15 bp, Homo sapiens
gaagcaaggccagcc

SEQ ID NO: 4272692 - DNA, 19 bp, Homo sapiens
gaagcacaagaagtgggag

SEQ ID NO: 4272693 - DNA, 17 bp, Homo sapiens
gaagcaccagcctcagt

SEQ ID NO: 4272694 - DNA, 16 bp, Homo sapiens
gaagcagagcctgggg

SEQ ID NO: 4272695 - DNA, 20 bp, Homo sapiens
gaagcagcatcaacctagga

SEQ ID NO: 4272696 - DNA, 19 bp, Homo sapiens
gaagcaggttgcttcaaga

SEQ ID NO: 4272697 - DNA, 21 bp, Homo sapiens
gaagccacgtgctggagagta

SEQ ID NO: 4272698 - DNA, 13 bp, Homo sapiens
gaagcctccacct

SEQ ID NO: 4272699 - DNA, 17 bp, Homo sapiens
gaagcctccacctgcag

SEQ ID NO: 4272700 - DNA, 19 bp, Homo sapiens
gaagcctccacctgcagcc

SEQ ID NO: 4272701 - DNA, 15 bp, Homo sapiens
gaagctcagcccacc

SEQ ID NO: 4272702 - DNA, 18 bp, Homo sapiens
gaagctcagcccaccccc

SEQ ID NO: 4272703 - DNA, 15 bp, Homo sapiens
gaagctggcaggaga

SEQ ID NO: 4272704 - DNA, 15 bp, Homo sapiens
gaaggaagagcaagc

SEQ ID NO: 4272705 - DNA, 18 bp, Homo sapiens
gaaggaatggtgcttggc

SEQ ID NO: 4272706 - DNA, 17 bp, Homo sapiens
gaaggagaggagtgcgc

SEQ ID NO: 4272707 - DNA, 12 bp, Homo sapiens
gaaggagaggct

SEQ ID NO: 4272708 - DNA, 21 bp, Homo sapiens
gaaggaggaagggactggtcc

SEQ ID NO: 4272709 - DNA, 13 bp, Homo sapiens
gaaggatgaacag

SEQ ID NO: 4272710 - DNA, 19 bp, Homo sapiens
gaaggattttaaatgctgt

SEQ ID NO: 4272711 - DNA, 17 bp, Homo sapiens
gaaggcctgcccccctt

SEQ ID NO: 4272712 - DNA, 14 bp, Homo sapiens
gaagggactggtcc

SEQ ID NO: 4272713 - DNA, 13 bp, Homo sapiens
gaagggaggcctg

SEQ ID NO: 4272714 - DNA, 15 bp, Homo sapiens
gaagggaggcctgag

SEQ ID NO: 4272715 - DNA, 18 bp, Homo sapiens
gaagggaggcctgagggg

SEQ ID NO: 4272716 - DNA, 19 bp, Homo sapiens
gaagggcgctgagggcagg

SEQ ID NO: 4272717 - DNA, 20 bp, Homo sapiens
gaagggcgctgagggcaggg

SEQ ID NO: 4272718 - DNA, 14 bp, Homo sapiens
gaagggggccatga

SEQ ID NO: 4272719 - DNA, 20 bp, Homo sapiens
gaagggttagacaagcctgg

SEQ ID NO: 4272720 - DNA, 21 bp, Homo sapiens
gaagggttagacaagcctgga

SEQ ID NO: 4272721 - DNA, 22 bp, Homo sapiens
gaagggttagacaagcctggag

SEQ ID NO: 4272722 - DNA, 23 bp, Homo sapiens
gaagggttagacaagcctggagg

SEQ ID NO: 4272723 - DNA, 15 bp, Homo sapiens
gaaggtcggaggctt

SEQ ID NO: 4272724 - DNA, 20 bp, Homo sapiens
gaaggttggaactgctgcca

SEQ ID NO: 4272725 - DNA, 15 bp, Homo sapiens
gaaggttgtgatgaa

SEQ ID NO: 4272726 - DNA, 22 bp, Homo sapiens
gaagtaagttctgaaaactgtt

SEQ ID NO: 4272727 - DNA, 17 bp, Homo sapiens
gaagtcaggagccagca

SEQ ID NO: 4272728 - DNA, 18 bp, Homo sapiens
gaagtcaggagccagcag

SEQ ID NO: 4272729 - DNA, 17 bp, Homo sapiens
gaagtccagtgaccctg

SEQ ID NO: 4272730 - DNA, 16 bp, Homo sapiens
gaagtcttccatcagc

SEQ ID NO: 4272731 - DNA, 19 bp, Homo sapiens
gaagtcttccatcagcagt

SEQ ID NO: 4272732 - DNA, 22 bp, Homo sapiens
gaagtcttccatcagcagtgat

SEQ ID NO: 4272733 - DNA, 16 bp, Homo sapiens
gaagtgaatacatggt

SEQ ID NO: 4272734 - DNA, 18 bp, Homo sapiens
gaagtgacaaggccccag

SEQ ID NO: 4272735 - DNA, 13 bp, Homo sapiens
gaagtgaccccag

SEQ ID NO: 4272736 - DNA, 15 bp, Homo sapiens
gaagtgaccccagct

SEQ ID NO: 4272737 - DNA, 20 bp, Homo sapiens
gaagtgataacactggagtg

SEQ ID NO: 4272738 - DNA, 13 bp, Homo sapiens
gaagtgcccctgc

SEQ ID NO: 4272739 - DNA, 18 bp, Homo sapiens
gaagtgcccctgctgcct

SEQ ID NO: 4272740 - DNA, 13 bp, Homo sapiens
gaagtggcaggag

SEQ ID NO: 4272741 - DNA, 15 bp, Homo sapiens
gaagtggcctgagaa

SEQ ID NO: 4272742 - DNA, 19 bp, Homo sapiens
gaagtgggattcaggaatg

SEQ ID NO: 4272743 - DNA, 22 bp, Homo sapiens
gaagtgggattcaggaatgggc

SEQ ID NO: 4272744 - DNA, 20 bp, Homo sapiens
gaagtgtgctgaggtgggcc

SEQ ID NO: 4272745 - DNA, 12 bp, Homo sapiens
gaagttgttagt

SEQ ID NO: 4272746 - DNA, 18 bp, Homo sapiens
gaataaataaagaagaaa

SEQ ID NO: 4272747 - DNA, 13 bp, Homo sapiens
gaataagttttat

SEQ ID NO: 4272748 - DNA, 21 bp, Homo sapiens
gaatacagtaagctgctctat

SEQ ID NO: 4272749 - DNA, 13 bp, Homo sapiens
gaatactgtattg

SEQ ID NO: 4272750 - DNA, 17 bp, Homo sapiens
gaatataaatgtgtgta

SEQ ID NO: 4272751 - DNA, 18 bp, Homo sapiens
gaatcaaatctgagcctt

SEQ ID NO: 4272752 - DNA, 19 bp, Homo sapiens
gaatcaacagtgaacagct

SEQ ID NO: 4272753 - DNA, 16 bp, Homo sapiens
gaatcaagtctgtgaa

SEQ ID NO: 4272754 - DNA, 16 bp, Homo sapiens
gcccgcccacctgggc

SEQ ID NO: 4272755 - DNA, 18 bp, Homo sapiens
gcccgctgcgctgccctg

SEQ ID NO: 4272756 - DNA, 19 bp, Homo sapiens
gcccgctgcgctgccctgc

SEQ ID NO: 4272757 - DNA, 17 bp, Homo sapiens
gcccggcagtgcacccc

SEQ ID NO: 4272758 - DNA, 12 bp, Homo sapiens
gcccggctgggc

SEQ ID NO: 4272759 - DNA, 22 bp, Homo sapiens
gcccgggagatccgccctgggc

SEQ ID NO: 4272760 - DNA, 21 bp, Homo sapiens
gcccgggaggaggatccgggc

SEQ ID NO: 4272761 - DNA, 14 bp, Homo sapiens
gcccgtgaggaggg

SEQ ID NO: 4272762 - DNA, 17 bp, Homo sapiens
gcccgtgtggccccttc

SEQ ID NO: 4272763 - DNA, 17 bp, Homo sapiens
gccctagcagtttgcct

SEQ ID NO: 4272764 - DNA, 20 bp, Homo sapiens
gccctagcagtttgcctctg

SEQ ID NO: 4272765 - DNA, 23 bp, Homo sapiens
gccctagcagtttgcctctgcac

SEQ ID NO: 4272766 - DNA, 21 bp, Homo sapiens
gccctaggcatactctccagg

SEQ ID NO: 4272767 - DNA, 16 bp, Homo sapiens
gccctcaggcttgggg

SEQ ID NO: 4272768 - DNA, 16 bp, Homo sapiens
gccctccccctgccag

SEQ ID NO: 4272769 - DNA, 12 bp, Homo sapiens
gccctccctccc

SEQ ID NO: 4272770 - DNA, 15 bp, Homo sapiens
gccctccctgcccct

SEQ ID NO: 4272771 - DNA, 21 bp, Homo sapiens
gccctccctgcccctcccttc

SEQ ID NO: 4272772 - DNA, 15 bp, Homo sapiens
gccctccgcccttcc

SEQ ID NO: 4272773 - DNA, 18 bp, Homo sapiens
gccctccgcccttccctg

SEQ ID NO: 4272774 - DNA, 17 bp, Homo sapiens
gccctccgtcctggcag

SEQ ID NO: 4272775 - DNA, 21 bp, Homo sapiens
gccctccgtcctggcagggca

SEQ ID NO: 4272776 - DNA, 13 bp, Homo sapiens
gccctcctccctc

SEQ ID NO: 4272777 - DNA, 12 bp, Homo sapiens
gccctcctctgg

SEQ ID NO: 4272778 - DNA, 16 bp, Homo sapiens
gccctcctctggtcac

SEQ ID NO: 4272779 - DNA, 17 bp, Homo sapiens
gccctcgtctccctggc

SEQ ID NO: 4272780 - DNA, 20 bp, Homo sapiens
gccctctcttaatgccacgg

SEQ ID NO: 4272781 - DNA, 13 bp, Homo sapiens
gccctctgccact

SEQ ID NO: 4272782 - DNA, 15 bp, Homo sapiens
gccctctgcccccag

SEQ ID NO: 4272783 - DNA, 21 bp, Homo sapiens
gccctgacatgctaacctctc

SEQ ID NO: 4272784 - DNA, 11 bp, Homo sapiens
gccctgagggg

SEQ ID NO: 4272785 - DNA, 12 bp, Homo sapiens
gccctgaggggc

SEQ ID NO: 4272786 - DNA, 16 bp, Homo sapiens
gccctgaggggcctgc

SEQ ID NO: 4272787 - DNA, 21 bp, Homo sapiens
gccctgaggggcctgccactc

SEQ ID NO: 4272788 - DNA, 15 bp, Homo sapiens
gccctgcattttcat

SEQ ID NO: 4272789 - DNA, 16 bp, Homo sapiens
gccctgccccacacag

SEQ ID NO: 4272790 - DNA, 11 bp, Homo sapiens
gccctgccccc

SEQ ID NO: 4272791 - DNA, 12 bp, Homo sapiens
gccctgcccccc

SEQ ID NO: 4272792 - DNA, 20 bp, Homo sapiens
gccctgcccttcagcatcct

SEQ ID NO: 4272793 - DNA, 16 bp, Homo sapiens
gccctgctcaggcctc

SEQ ID NO: 4272794 - DNA, 20 bp, Homo sapiens
gccctgctttgggctgccct

SEQ ID NO: 4272795 - DNA, 15 bp, Homo sapiens
gccctggctcccaca

SEQ ID NO: 4272796 - DNA, 16 bp, Homo sapiens
gccctggctctgtcac

SEQ ID NO: 4272797 - DNA, 14 bp, Homo sapiens
gccctgggctctgg

SEQ ID NO: 4272798 - DNA, 17 bp, Homo sapiens
gccctgggctctgggtt

SEQ ID NO: 4272799 - DNA, 21 bp, Homo sapiens
gccctggggtttccacacagg

SEQ ID NO: 4272800 - DNA, 16 bp, Homo sapiens
gccctggtgctgccac

SEQ ID NO: 4272801 - DNA, 21 bp, Homo sapiens
gccctggtgctgccacacttc

SEQ ID NO: 4272802 - DNA, 21 bp, Homo sapiens
gccctggtggccaagcctgcc

SEQ ID NO: 4272803 - DNA, 23 bp, Homo sapiens
gccctggtggccaagcctgcccc

SEQ ID NO: 4272804 - DNA, 21 bp, Homo sapiens
gccctggttcccccaggaccc

SEQ ID NO: 4272805 - DNA, 19 bp, Homo sapiens
gccctggttctccatcccc

SEQ ID NO: 4272806 - DNA, 20 bp, Homo sapiens
gccctggttctccatcccca

SEQ ID NO: 4272807 - DNA, 16 bp, Homo sapiens
gccctgtggaagggac

SEQ ID NO: 4272808 - DNA, 23 bp, Homo sapiens
gccctgtggaagggactaggagc

SEQ ID NO: 4272809 - DNA, 23 bp, Homo sapiens
gccctgttgtgggggtgtcacag

SEQ ID NO: 4272810 - DNA, 18 bp, Homo sapiens
gcccttcccaacctcccc

SEQ ID NO: 4272811 - DNA, 21 bp, Homo sapiens
gcccttcctctccactgcctt

SEQ ID NO: 4272812 - DNA, 18 bp, Homo sapiens
gccctttcacccctcttc

SEQ ID NO: 4272813 - DNA, 17 bp, Homo sapiens
gccgagctctcctgggc

SEQ ID NO: 4272814 - DNA, 15 bp, Homo sapiens
gccgagtgccccaga

SEQ ID NO: 4272815 - DNA, 14 bp, Homo sapiens
gccgctgcagggtg

SEQ ID NO: 4272816 - DNA, 16 bp, Homo sapiens
gccgctgcagggtggc

SEQ ID NO: 4272817 - DNA, 19 bp, Homo sapiens
gccgctgcagggtggcatc

SEQ ID NO: 4272818 - DNA, 19 bp, Homo sapiens
gccgctgcagtcagcacag

SEQ ID NO: 4272819 - DNA, 13 bp, Homo sapiens
gccgctgggagag

SEQ ID NO: 4272820 - DNA, 14 bp, Homo sapiens
gccgctgggagagc

SEQ ID NO: 4272821 - DNA, 15 bp, Homo sapiens
gccgctgggagagcc

SEQ ID NO: 4272822 - DNA, 12 bp, Homo sapiens
gccgctggtgcc

SEQ ID NO: 4272823 - DNA, 16 bp, Homo sapiens
gccgctgtgtccccgc

SEQ ID NO: 4272824 - DNA, 14 bp, Homo sapiens
gccggggagctgag

SEQ ID NO: 4272825 - DNA, 21 bp, Homo sapiens
gccgggggtgggggcctgctg

SEQ ID NO: 4272826 - DNA, 21 bp, Homo sapiens
gccgtagactcacggctgcac

SEQ ID NO: 4272827 - DNA, 20 bp, Homo sapiens
gccgtcttcactcgcccccg

SEQ ID NO: 4272828 - DNA, 11 bp, Homo sapiens
gccgtgagagc

SEQ ID NO: 4272829 - DNA, 16 bp, Homo sapiens
gccgtgcacggggcca

SEQ ID NO: 4272830 - DNA, 17 bp, Homo sapiens
gccgtgcacggggccag

SEQ ID NO: 4272831 - DNA, 20 bp, Homo sapiens
gccgtgcacggggccagcat

SEQ ID NO: 4272832 - DNA, 15 bp, Homo sapiens
gccgtgcagggccag

SEQ ID NO: 4272833 - DNA, 20 bp, Homo sapiens
gccgtggagtcgagctggcc

SEQ ID NO: 4272834 - DNA, 11 bp, Homo sapiens
gccgtggcttc

SEQ ID NO: 4272835 - DNA, 12 bp, Homo sapiens
gccgtggcttcc

SEQ ID NO: 4272836 - DNA, 15 bp, Homo sapiens
gccgtggcttcccgc

SEQ ID NO: 4272837 - DNA, 15 bp, Homo sapiens
gccgtgtctgtggcc

SEQ ID NO: 4272838 - DNA, 19 bp, Homo sapiens
gccgtgtctgtggccctct

SEQ ID NO: 4272839 - DNA, 15 bp, Homo sapiens
gccgttgcctctctg

SEQ ID NO: 4272840 - DNA, 16 bp, Homo sapiens
gcctacaaatcagtaa

SEQ ID NO: 4272841 - DNA, 18 bp, Homo sapiens
gcctacccaccccttccc

SEQ ID NO: 4272842 - DNA, 22 bp, Homo sapiens
gcctacccaccccttcccgccc

SEQ ID NO: 4272843 - DNA, 22 bp, Homo sapiens
gcctagaggaggaaaaaggctg

SEQ ID NO: 4272844 - DNA, 22 bp, Homo sapiens
gcctaggagctggggagggaga

SEQ ID NO: 4272845 - DNA, 15 bp, Homo sapiens
gcctaggccagctcc

SEQ ID NO: 4272846 - DNA, 17 bp, Homo sapiens
gcctagggcctggtcca

SEQ ID NO: 4272847 - DNA, 17 bp, Homo sapiens
gcctagggtgagggtga

SEQ ID NO: 4272848 - DNA, 17 bp, Homo sapiens
gcctatgccacctgcag

SEQ ID NO: 4272849 - DNA, 18 bp, Homo sapiens
gcctatgccacctgcagc

SEQ ID NO: 4272850 - DNA, 19 bp, Homo sapiens
gcctatgccacctgcagcg

SEQ ID NO: 4272851 - DNA, 20 bp, Homo sapiens
gcctatggaaagggtgtggc

SEQ ID NO: 4272852 - DNA, 13 bp, Homo sapiens
gcctattgtaata

SEQ ID NO: 4272853 - DNA, 18 bp, Homo sapiens
gcctcaaccctccctcag

SEQ ID NO: 4272854 - DNA, 15 bp, Homo sapiens
gcctcacctggcttc

SEQ ID NO: 4272855 - DNA, 19 bp, Homo sapiens
gcctcacctggcttcccag

SEQ ID NO: 4272856 - DNA, 21 bp, Homo sapiens
gcctcacctggcttcccagga

SEQ ID NO: 4272857 - DNA, 19 bp, Homo sapiens
gcctcagaggccccttgct

SEQ ID NO: 4272858 - DNA, 21 bp, Homo sapiens
gcctcagcagaaggccttgcc

SEQ ID NO: 4272859 - DNA, 18 bp, Homo sapiens
gcctcaggcctggccctt

SEQ ID NO: 4272860 - DNA, 17 bp, Homo sapiens
gcctcaggctttttcca

SEQ ID NO: 4272861 - DNA, 18 bp, Homo sapiens
gcctcaggctttttccat

SEQ ID NO: 4272862 - DNA, 21 bp, Homo sapiens
gcctcagtccctccctcctgg

SEQ ID NO: 4272863 - DNA, 23 bp, Homo sapiens
gcctcagtccctccctcctggct

SEQ ID NO: 4272864 - DNA, 15 bp, Homo sapiens
gcctcagtgcagccc

SEQ ID NO: 4272865 - DNA, 21 bp, Homo sapiens
gcctcagtgcagccccctcct

SEQ ID NO: 4272866 - DNA, 21 bp, Homo sapiens
gcctcagtggactttccaccc

SEQ ID NO: 4272867 - DNA, 22 bp, Homo sapiens
gcctcagtggactttccacccc

SEQ ID NO: 4272868 - DNA, 22 bp, Homo sapiens
gcctcatcctcctggacccagc

SEQ ID NO: 4272869 - DNA, 13 bp, Homo sapiens
gcctcatgggagt

SEQ ID NO: 4272870 - DNA, 17 bp, Homo sapiens
gcctccacctgcagccc

SEQ ID NO: 4272871 - DNA, 22 bp, Homo sapiens
gcctccacctgcagccccaggc

SEQ ID NO: 4272872 - DNA, 12 bp, Homo sapiens
gcctcccagcca

SEQ ID NO: 4272873 - DNA, 17 bp, Homo sapiens
gcctccccaaccctgcc

SEQ ID NO: 4272874 - DNA, 20 bp, Homo sapiens
gcctccccaaccctgcccct

SEQ ID NO: 4272875 - DNA, 21 bp, Homo sapiens
gcctccccaaccctgcccctg

SEQ ID NO: 4272876 - DNA, 22 bp, Homo sapiens
gcctccccaaccctgcccctgc

SEQ ID NO: 4272877 - DNA, 22 bp, Homo sapiens
gcctcccgaacacgcacagaag

SEQ ID NO: 4272878 - DNA, 18 bp, Homo sapiens
gcctccctcagccacgcc

SEQ ID NO: 4272879 - DNA, 20 bp, Homo sapiens
gcctccggccctgccccaca

SEQ ID NO: 4272880 - DNA, 21 bp, Homo sapiens
gcctcgcccctccagtgttgc

SEQ ID NO: 4272881 - DNA, 14 bp, Homo sapiens
gcctctcactctgg

SEQ ID NO: 4272882 - DNA, 17 bp, Homo sapiens
gcctctcactctggcag

SEQ ID NO: 4272883 - DNA, 15 bp, Homo sapiens
gcctctctcagccca

SEQ ID NO: 4272884 - DNA, 18 bp, Homo sapiens
gcctctctcagcccaggt

SEQ ID NO: 4272885 - DNA, 15 bp, Homo sapiens
gcctctctgccagcc

SEQ ID NO: 4272886 - DNA, 12 bp, Homo sapiens
gcctctgaactg

SEQ ID NO: 4272887 - DNA, 18 bp, Homo sapiens
gcctctgaactgctgctg

SEQ ID NO: 4272888 - DNA, 19 bp, Homo sapiens
gcctctgaactgctgctgg

SEQ ID NO: 4272889 - DNA, 20 bp, Homo sapiens
gcctctgcacgtgcacacac

SEQ ID NO: 4272890 - DNA, 23 bp, Homo sapiens
gcctctgcacgtgcacacacctg

SEQ ID NO: 4272891 - DNA, 15 bp, Homo sapiens
gcctctggcctggga

SEQ ID NO: 4272892 - DNA, 17 bp, Homo sapiens
gcctctgggctcacacc

SEQ ID NO: 4272893 - DNA, 23 bp, Homo sapiens
gcctctggggagaccgagtgtgg

SEQ ID NO: 4272894 - DNA, 23 bp, Homo sapiens
gcctctggtttggggcgaggcag

SEQ ID NO: 4272895 - DNA, 22 bp, Homo sapiens
gcctcttcctccctccctgcag

SEQ ID NO: 4272896 - DNA, 23 bp, Homo sapiens
gcctcttcctccctccctgcagg

SEQ ID NO: 4272897 - DNA, 15 bp, Homo sapiens
gcctcttcgggaaga

SEQ ID NO: 4272898 - DNA, 18 bp, Homo sapiens
gcctgaagttggagtgag

SEQ ID NO: 4272899 - DNA, 15 bp, Homo sapiens
gcctgagagcagaat

SEQ ID NO: 4272900 - DNA, 12 bp, Homo sapiens
gcctgaggggca

SEQ ID NO: 4272901 - DNA, 15 bp, Homo sapiens
gcctgagttgagggg

SEQ ID NO: 4272902 - DNA, 13 bp, Homo sapiens
gcctgcccacccg

SEQ ID NO: 4272903 - DNA, 14 bp, Homo sapiens
gcctgcccacccgt

SEQ ID NO: 4272904 - DNA, 12 bp, Homo sapiens
gcctgcccccct

SEQ ID NO: 4272905 - DNA, 14 bp, Homo sapiens
gcctgccccccttc

SEQ ID NO: 4272906 - DNA, 18 bp, Homo sapiens
gcctgcctccggccctgc

SEQ ID NO: 4272907 - DNA, 19 bp, Homo sapiens
gcctgcgatggtgctgcac

SEQ ID NO: 4272908 - DNA, 19 bp, Homo sapiens
gcctgcgtggcctggggct

SEQ ID NO: 4272909 - DNA, 17 bp, Homo sapiens
gcctgctatccagccgc

SEQ ID NO: 4272910 - DNA, 17 bp, Homo sapiens
gcctggacacagtcagg

SEQ ID NO: 4272911 - DNA, 18 bp, Homo sapiens
gcctggacacagtcaggg

SEQ ID NO: 4272912 - DNA, 18 bp, Homo sapiens
gcctggcacagggcagtg

SEQ ID NO: 4272913 - DNA, 18 bp, Homo sapiens
gcctggcagaactgagct

SEQ ID NO: 4272914 - DNA, 21 bp, Homo sapiens
gcctggcagccgtgccttcag

SEQ ID NO: 4272915 - DNA, 16 bp, Homo sapiens
gcctggcccagccagc

SEQ ID NO: 4272916 - DNA, 17 bp, Homo sapiens
gcctggcccagccagca

SEQ ID NO: 4272917 - DNA, 16 bp, Homo sapiens
gcctggcccagtgaga

SEQ ID NO: 4272918 - DNA, 18 bp, Homo sapiens
gcctggcccagtgagagt

SEQ ID NO: 4272919 - DNA, 16 bp, Homo sapiens
gcctggccccaaatgt

SEQ ID NO: 4272920 - DNA, 14 bp, Homo sapiens
gcctgggccactgg

SEQ ID NO: 4272921 - DNA, 19 bp, Homo sapiens
gcctgggccactggcatct

SEQ ID NO: 4272922 - DNA, 13 bp, Homo sapiens
gcctggggacgga

SEQ ID NO: 4272923 - DNA, 16 bp, Homo sapiens
gcctggggtggaggct

SEQ ID NO: 4272924 - DNA, 20 bp, Homo sapiens
gcctggggtggaggctaagc

SEQ ID NO: 4272925 - DNA, 17 bp, Homo sapiens
gcctggtctggagcccc

SEQ ID NO: 4272926 - DNA, 21 bp, Homo sapiens
gcctgtccacctgtgctgctg

SEQ ID NO: 4272927 - DNA, 14 bp, Homo sapiens
gcctgtccctctca

SEQ ID NO: 4272928 - DNA, 19 bp, Homo sapiens
gcctgtgaccggggtcctg

SEQ ID NO: 4272929 - DNA, 23 bp, Homo sapiens
gcctgtgaccggggtcctgaggc

SEQ ID NO: 4272930 - DNA, 13 bp, Homo sapiens
gcctgtgcccgct

SEQ ID NO: 4272931 - DNA, 18 bp, Homo sapiens
gcctgtgcccgctgcgct

SEQ ID NO: 4272932 - DNA, 19 bp, Homo sapiens
gcctgtgcccgctgcgctg

SEQ ID NO: 4272933 - DNA, 21 bp, Homo sapiens
gcctgtgcccgctgcgctgcc

SEQ ID NO: 4272934 - DNA, 22 bp, Homo sapiens
gcctgtgcccgctgcgctgccc

SEQ ID NO: 4272935 - DNA, 13 bp, Homo sapiens
gcctgtggcctca

SEQ ID NO: 4272936 - DNA, 24 bp, Homo sapiens
gcctgtgttagtgtctgtccatct

SEQ ID NO: 4272937 - DNA, 16 bp, Homo sapiens
gccttaagtcttactg

SEQ ID NO: 4272938 - DNA, 19 bp, Homo sapiens
gccttccacgctgtctcca

SEQ ID NO: 4272939 - DNA, 22 bp, Homo sapiens
gccttccacgctgtctccagac

SEQ ID NO: 4272940 - DNA, 15 bp, Homo sapiens
gccttccatgggcat

SEQ ID NO: 4272941 - DNA, 18 bp, Homo sapiens
gccttcccctcagccaca

SEQ ID NO: 4272942 - DNA, 23 bp, Homo sapiens
gccttcgatacaccgggcctgga

SEQ ID NO: 4272943 - DNA, 15 bp, Homo sapiens
gccttctacctgcag

SEQ ID NO: 4272944 - DNA, 14 bp, Homo sapiens
gccttctcccctcc

SEQ ID NO: 4272945 - DNA, 17 bp, Homo sapiens
gccttctgatgaaatgt

SEQ ID NO: 4272946 - DNA, 23 bp, Homo sapiens
gccttctggggagggacacagag

SEQ ID NO: 4272947 - DNA, 16 bp, Homo sapiens
gccttctgtctcttgc

SEQ ID NO: 4272948 - DNA, 21 bp, Homo sapiens
gccttgagtgacatgcggctg

SEQ ID NO: 4272949 - DNA, 16 bp, Homo sapiens
gccttggttcctccag

SEQ ID NO: 4272950 - DNA, 16 bp, Homo sapiens
gcctttgctgccttct

SEQ ID NO: 4272951 - DNA, 11 bp, Homo sapiens
gcctttgtaac

SEQ ID NO: 4272952 - DNA, 22 bp, Homo sapiens
gcctttgtaaccacaactttca

SEQ ID NO: 4272953 - DNA, 16 bp, Homo sapiens
gccttttagttcctgt

SEQ ID NO: 4272954 - DNA, 17 bp, Homo sapiens
gccttttagttcctgtg

SEQ ID NO: 4272955 - DNA, 20 bp, Homo sapiens
gccttttagttcctgtgcac

SEQ ID NO: 4272956 - DNA, 20 bp, Homo sapiens
gcctttttgagccaatccca

SEQ ID NO: 4272957 - DNA, 20 bp, Homo sapiens
gcgacggctcctccccgatc

SEQ ID NO: 4272958 - DNA, 16 bp, Homo sapiens
gcgagaacacaagcca

SEQ ID NO: 4272959 - DNA, 15 bp, Homo sapiens
gcgagcctgcttgct

SEQ ID NO: 4272960 - DNA, 22 bp, Homo sapiens
gcgaggacgtgaagcctcccga

SEQ ID NO: 4272961 - DNA, 14 bp, Homo sapiens
gcgaggggagggtg

SEQ ID NO: 4272962 - DNA, 12 bp, Homo sapiens
gcgagtctggag

SEQ ID NO: 4272963 - DNA, 10 bp, Homo sapiens
gcgatgtgtt

SEQ ID NO: 4272964 - DNA, 12 bp, Homo sapiens
gcgcacacacac

SEQ ID NO: 4272965 - DNA, 14 bp, Homo sapiens
gcgccctccctccc

SEQ ID NO: 4272966 - DNA, 18 bp, Homo sapiens
gcgccctccctccctcca

SEQ ID NO: 4272967 - DNA, 20 bp, Homo sapiens
gcgccctccctccctccaca

SEQ ID NO: 4272968 - DNA, 14 bp, Homo sapiens
gcgccttcctgggt

SEQ ID NO: 4272969 - DNA, 18 bp, Homo sapiens
gcgccttcctgggttggc

SEQ ID NO: 4272970 - DNA, 17 bp, Homo sapiens
gcgccttctacctgcag

SEQ ID NO: 4272971 - DNA, 18 bp, Homo sapiens
gcgccttctacctgcagg

SEQ ID NO: 4272972 - DNA, 19 bp, Homo sapiens
gcgccttctacctgcagga

SEQ ID NO: 4272973 - DNA, 20 bp, Homo sapiens
gcgccttctacctgcaggac

SEQ ID NO: 4272974 - DNA, 23 bp, Homo sapiens
gcgctagagcattctggggtggg

SEQ ID NO: 4272975 - DNA, 16 bp, Homo sapiens
gcgctcctctgccttg

SEQ ID NO: 4272976 - DNA, 18 bp, Homo sapiens
gcgctctgcatgctcctc

SEQ ID NO: 4272977 - DNA, 23 bp, Homo sapiens
gcgctgacaaccaccgctcccca

SEQ ID NO: 4272978 - DNA, 21 bp, Homo sapiens
gcgctgtgctggtctctaggc

SEQ ID NO: 4272979 - DNA, 14 bp, Homo sapiens
gcggagcttctcca

SEQ ID NO: 4272980 - DNA, 18 bp, Homo sapiens
gcggagcttctccagcca

SEQ ID NO: 4272981 - DNA, 15 bp, Homo sapiens
gcggccgcctgtcct

SEQ ID NO: 4272982 - DNA, 19 bp, Homo sapiens
gcggcctggggacggagca

SEQ ID NO: 4272983 - DNA, 19 bp, Homo sapiens
gcgggcagtgacgtgagtg

SEQ ID NO: 4272984 - DNA, 15 bp, Homo sapiens
gcgggccaaggactg

SEQ ID NO: 4272985 - DNA, 11 bp, Homo sapiens
gcgggccagga

SEQ ID NO: 4272986 - DNA, 18 bp, Homo sapiens
gcgggtaaaaagagaagg

SEQ ID NO: 4272987 - DNA, 14 bp, Homo sapiens
gcggtatccagagg

SEQ ID NO: 4272988 - DNA, 23 bp, Homo sapiens
gcggtcaataattgtggagagga

SEQ ID NO: 4272989 - DNA, 12 bp, Homo sapiens
gcgtaggagaga

SEQ ID NO: 4272990 - DNA, 13 bp, Homo sapiens
gcgtagggccagg

SEQ ID NO: 4272991 - DNA, 17 bp, Homo sapiens
gcgtagggccagggctc

SEQ ID NO: 4272992 - DNA, 23 bp, Homo sapiens
gcgtctgagcggccgcctgtcct

SEQ ID NO: 4272993 - DNA, 24 bp, Homo sapiens
gcgtgacttcagactctctcctct

SEQ ID NO: 4272994 - DNA, 21 bp, Homo sapiens
gcgtgcaggggcggtccagag

SEQ ID NO: 4272995 - DNA, 16 bp, Homo sapiens
gcgtgggatccagaga

SEQ ID NO: 4272996 - DNA, 19 bp, Homo sapiens
gctaaatgcctaataaaca

SEQ ID NO: 4272997 - DNA, 15 bp, Homo sapiens
gctaacactggcccc

SEQ ID NO: 4272998 - DNA, 16 bp, Homo sapiens
gctaacactggcccct

SEQ ID NO: 4272999 - DNA, 18 bp, Homo sapiens
gctaaccagttctctttg

SEQ ID NO: 4273000 - DNA, 16 bp, Homo sapiens
gctaagcctgatgatg

SEQ ID NO: 4273001 - DNA, 14 bp, Homo sapiens
gctaaggcttccgg

SEQ ID NO: 4273002 - DNA, 15 bp, Homo sapiens
gctaagtccagctct

SEQ ID NO: 4273003 - DNA, 14 bp, Homo sapiens
gctaatcagcattc

SEQ ID NO: 4273004 - DNA, 13 bp, Homo sapiens
gctaatgtaatca

SEQ ID NO: 4273005 - DNA, 15 bp, Homo sapiens
gctaatgtaatcatt

SEQ ID NO: 4273006 - DNA, 20 bp, Homo sapiens
gctaatgtaatcatttatct

SEQ ID NO: 4273007 - DNA, 14 bp, Homo sapiens
gctaattaaaaagt

SEQ ID NO: 4273008 - DNA, 18 bp, Homo sapiens
gctacagtagctgtgggg

SEQ ID NO: 4273009 - DNA, 23 bp, Homo sapiens
gctacggttccctgcctaggagc

SEQ ID NO: 4273010 - DNA, 17 bp, Homo sapiens
gctagactgggctggct

SEQ ID NO: 4273011 - DNA, 17 bp, Homo sapiens
gctaggtgggccagccc

SEQ ID NO: 4273012 - DNA, 19 bp, Homo sapiens
gctaggtgggccagcccct

SEQ ID NO: 4273013 - DNA, 18 bp, Homo sapiens
gctagtgatacactgtat

SEQ ID NO: 4273014 - DNA, 23 bp, Homo sapiens
gctagtgatacactgtatctaaa

SEQ ID NO: 4273015 - DNA, 18 bp, Homo sapiens
gctataacaactctattt

SEQ ID NO: 4273016 - DNA, 23 bp, Homo sapiens
gctatagttactgtcctgttgat

SEQ ID NO: 4273017 - DNA, 21 bp, Homo sapiens
gctatgaagagctagagaaat

SEQ ID NO: 4273018 - DNA, 21 bp, Homo sapiens
gctatgccactaggccctggt

SEQ ID NO: 4273019 - DNA, 24 bp, Homo sapiens
gctatgccactaggccctggtctg

SEQ ID NO: 4273020 - DNA, 14 bp, Homo sapiens
gctatgtctgtgat

SEQ ID NO: 4273021 - DNA, 14 bp, Homo sapiens
cttgtgaaacacag

SEQ ID NO: 4273022 - DNA, 19 bp, Homo sapiens
cttgtgaaacacagctgtt

SEQ ID NO: 4273023 - DNA, 19 bp, Homo sapiens
cttgtgcctcttgggagac

SEQ ID NO: 4273024 - DNA, 17 bp, Homo sapiens
cttgtgtatgtgactcc

SEQ ID NO: 4273025 - DNA, 15 bp, Homo sapiens
cttgtgtgagtgtga

SEQ ID NO: 4273026 - DNA, 15 bp, Homo sapiens
cttgtgttgttttct

SEQ ID NO: 4273027 - DNA, 13 bp, Homo sapiens
cttgtgtttgtat

SEQ ID NO: 4273028 - DNA, 18 bp, Homo sapiens
cttgttatggtagaaaaa

SEQ ID NO: 4273029 - DNA, 14 bp, Homo sapiens
cttgttcagtcact

SEQ ID NO: 4273030 - DNA, 22 bp, Homo sapiens
cttgttcagtcacttgtttgtg

SEQ ID NO: 4273031 - DNA, 12 bp, Homo sapiens
cttgttcttcct

SEQ ID NO: 4273032 - DNA, 13 bp, Homo sapiens
cttgttcttcctc

SEQ ID NO: 4273033 - DNA, 23 bp, Homo sapiens
cttgtttctatactgtttgtaat

SEQ ID NO: 4273034 - DNA, 21 bp, Homo sapiens
cttgtttgcctttaggcagga

SEQ ID NO: 4273035 - DNA, 14 bp, Homo sapiens
cttgtttgttctag

SEQ ID NO: 4273036 - DNA, 21 bp, Homo sapiens
ctttacagttctggaggagga

SEQ ID NO: 4273037 - DNA, 22 bp, Homo sapiens
ctttagaaataaaccttaatat

SEQ ID NO: 4273038 - DNA, 23 bp, Homo sapiens
ctttagaaataaaccttaatatt

SEQ ID NO: 4273039 - DNA, 14 bp, Homo sapiens
ctttaggcaggaag

SEQ ID NO: 4273040 - DNA, 21 bp, Homo sapiens
ctttatcttgggaccaaaact

SEQ ID NO: 4273041 - DNA, 23 bp, Homo sapiens
ctttatggcagacattgtgctag

SEQ ID NO: 4273042 - DNA, 15 bp, Homo sapiens
ctttattgtctgtaa

SEQ ID NO: 4273043 - DNA, 13 bp, Homo sapiens
ctttatttaaaat

SEQ ID NO: 4273044 - DNA, 16 bp, Homo sapiens
ctttcaagatctaaat

SEQ ID NO: 4273045 - DNA, 14 bp, Homo sapiens
ctttcacaaccttc

SEQ ID NO: 4273046 - DNA, 18 bp, Homo sapiens
ctttcacccctcttccca

SEQ ID NO: 4273047 - DNA, 20 bp, Homo sapiens
ctttcactataatgtgaaat

SEQ ID NO: 4273048 - DNA, 13 bp, Homo sapiens
ctttcactgaagt

SEQ ID NO: 4273049 - DNA, 19 bp, Homo sapiens
ctttcagtttgtccacaca

SEQ ID NO: 4273050 - DNA, 20 bp, Homo sapiens
ctttcagtttgtccacacaa

SEQ ID NO: 4273051 - DNA, 17 bp, Homo sapiens
ctttcatgatttgcaac

SEQ ID NO: 4273052 - DNA, 12 bp, Homo sapiens
ctttcatttctt

SEQ ID NO: 4273053 - DNA, 16 bp, Homo sapiens
ctttccaccccctccc

SEQ ID NO: 4273054 - DNA, 13 bp, Homo sapiens
ctttccagaacta

SEQ ID NO: 4273055 - DNA, 14 bp, Homo sapiens
ctttcccaaaccct

SEQ ID NO: 4273056 - DNA, 23 bp, Homo sapiens
ctttcccgatgcgtggctcccag

SEQ ID NO: 4273057 - DNA, 15 bp, Homo sapiens
ctttccctgcatccc

SEQ ID NO: 4273058 - DNA, 13 bp, Homo sapiens
ctttcctgatgtt

SEQ ID NO: 4273059 - DNA, 16 bp, Homo sapiens
ctttcctgatgttgat

SEQ ID NO: 4273060 - DNA, 23 bp, Homo sapiens
ctttcctttcatcctcagcaagt

SEQ ID NO: 4273061 - DNA, 13 bp, Homo sapiens
ctttctatgtaga

SEQ ID NO: 4273062 - DNA, 19 bp, Homo sapiens
ctttctatgtagaactgtt

SEQ ID NO: 4273063 - DNA, 14 bp, Homo sapiens
ctttctccaaagtt

SEQ ID NO: 4273064 - DNA, 19 bp, Homo sapiens
ctttctgacaataaataat

SEQ ID NO: 4273065 - DNA, 21 bp, Homo sapiens
ctttctgacaataaataatat

SEQ ID NO: 4273066 - DNA, 17 bp, Homo sapiens
ctttgacctcaacctgt

SEQ ID NO: 4273067 - DNA, 18 bp, Homo sapiens
ctttgacctcaacctgtg

SEQ ID NO: 4273068 - DNA, 20 bp, Homo sapiens
ctttgcattgtctgtctgca

SEQ ID NO: 4273069 - DNA, 12 bp, Homo sapiens
ctttgctgcctt

SEQ ID NO: 4273070 - DNA, 17 bp, Homo sapiens
ctttgctgccttctgtc

SEQ ID NO: 4273071 - DNA, 18 bp, Homo sapiens
ctttgctgccttctgtct

SEQ ID NO: 4273072 - DNA, 20 bp, Homo sapiens
ctttgctgccttctgtctct

SEQ ID NO: 4273073 - DNA, 15 bp, Homo sapiens
ctttgcttgtcctgc

SEQ ID NO: 4273074 - DNA, 15 bp, Homo sapiens
ctttggacctgcagt

SEQ ID NO: 4273075 - DNA, 19 bp, Homo sapiens
ctttggacctgcagttggc

SEQ ID NO: 4273076 - DNA, 16 bp, Homo sapiens
ctttggcttaattcca

SEQ ID NO: 4273077 - DNA, 20 bp, Homo sapiens
ctttgggctgccctggtgct

SEQ ID NO: 4273078 - DNA, 20 bp, Homo sapiens
ctttggtaatgtgtcaaaga

SEQ ID NO: 4273079 - DNA, 16 bp, Homo sapiens
ctttggtttctgtctg

SEQ ID NO: 4273080 - DNA, 16 bp, Homo sapiens
cttttaacttcacctt

SEQ ID NO: 4273081 - DNA, 16 bp, Homo sapiens
cttttaatgatactgt

SEQ ID NO: 4273082 - DNA, 18 bp, Homo sapiens
cttttattcattagctgt

SEQ ID NO: 4273083 - DNA, 16 bp, Homo sapiens
cttttcaaacacacac

SEQ ID NO: 4273084 - DNA, 18 bp, Homo sapiens
cttttcagcttgtttcta

SEQ ID NO: 4273085 - DNA, 19 bp, Homo sapiens
cttttcagcttgtttctat

SEQ ID NO: 4273086 - DNA, 16 bp, Homo sapiens
cttttcatatcatttc

SEQ ID NO: 4273087 - DNA, 16 bp, Homo sapiens
cttttccattctgggt

SEQ ID NO: 4273088 - DNA, 18 bp, Homo sapiens
cttttccattctgggtgt

SEQ ID NO: 4273089 - DNA, 16 bp, Homo sapiens
cttttctagcaactgt

SEQ ID NO: 4273090 - DNA, 11 bp, Homo sapiens
cttttctgctg

SEQ ID NO: 4273091 - DNA, 20 bp, Homo sapiens
cttttggcccccgagctggg

SEQ ID NO: 4273092 - DNA, 13 bp, Homo sapiens
cttttgtcctgca

SEQ ID NO: 4273093 - DNA, 21 bp, Homo sapiens
cttttgtcctgcatcatcttg

SEQ ID NO: 4273094 - DNA, 16 bp, Homo sapiens
cttttgtgccaggagt

SEQ ID NO: 4273095 - DNA, 21 bp, Homo sapiens
ctttttaaaaagttgcacatt

SEQ ID NO: 4273096 - DNA, 19 bp, Homo sapiens
ctttttactccccttgagc

SEQ ID NO: 4273097 - DNA, 16 bp, Homo sapiens
ctttttcttttttgag

SEQ ID NO: 4273098 - DNA, 19 bp, Homo sapiens
ctttttcttttttgagtgt

SEQ ID NO: 4273099 - DNA, 21 bp, Homo sapiens
cttttttcttccccctccatg

SEQ ID NO: 4273100 - DNA, 16 bp, Homo sapiens
cttttttgagtgtgca

SEQ ID NO: 4273101 - DNA, 15 bp, Homo sapiens
gaaaaaagagaaaaa

SEQ ID NO: 4273102 - DNA, 15 bp, Homo sapiens
gaaaaaccaatgatt

SEQ ID NO: 4273103 - DNA, 16 bp, Homo sapiens
gaaaaattgtagagtg

SEQ ID NO: 4273104 - DNA, 15 bp, Homo sapiens
gaaaaatttcacgat

SEQ ID NO: 4273105 - DNA, 23 bp, Homo sapiens
gaaaacatctcatcatgtctatt

SEQ ID NO: 4273106 - DNA, 18 bp, Homo sapiens
gaaaaccaagccgtggct

SEQ ID NO: 4273107 - DNA, 19 bp, Homo sapiens
gaaaaccaagccgtggctt

SEQ ID NO: 4273108 - DNA, 12 bp, Homo sapiens
gaaaagaagaaa

SEQ ID NO: 4273109 - DNA, 19 bp, Homo sapiens
gaaaagaagaaagtctatg

SEQ ID NO: 4273110 - DNA, 18 bp, Homo sapiens
gaaaagatgttgtgtctt

SEQ ID NO: 4273111 - DNA, 12 bp, Homo sapiens
gaaaagccagat

SEQ ID NO: 4273112 - DNA, 16 bp, Homo sapiens
gaaaagggcaggagcc

SEQ ID NO: 4273113 - DNA, 18 bp, Homo sapiens
gaaaagggcaggagccta

SEQ ID NO: 4273114 - DNA, 19 bp, Homo sapiens
gaaaagggcaggagcctag

SEQ ID NO: 4273115 - DNA, 20 bp, Homo sapiens
gaaaatagtaaatgctttgt

SEQ ID NO: 4273116 - DNA, 17 bp, Homo sapiens
gaaacaaatttttttct

SEQ ID NO: 4273117 - DNA, 18 bp, Homo sapiens
gaaacaacactcagtcct

SEQ ID NO: 4273118 - DNA, 18 bp, Homo sapiens
gaaacacagaactcagcc

SEQ ID NO: 4273119 - DNA, 21 bp, Homo sapiens
gaaacacagaactcagcctta

SEQ ID NO: 4273120 - DNA, 19 bp, Homo sapiens
gaaacacgtttagaaatga

SEQ ID NO: 4273121 - DNA, 22 bp, Homo sapiens
gaaacagcttgatgctgtttct

SEQ ID NO: 4273122 - DNA, 20 bp, Homo sapiens
gaaactatgcacctataaat

SEQ ID NO: 4273123 - DNA, 16 bp, Homo sapiens
gaaactgacttgctgt

SEQ ID NO: 4273124 - DNA, 21 bp, Homo sapiens
ctgtctgagccctgccctcac

SEQ ID NO: 4273125 - DNA, 11 bp, Homo sapiens
ctgtctgattc

SEQ ID NO: 4273126 - DNA, 17 bp, Homo sapiens
ctgtctgattctatgcc

SEQ ID NO: 4273127 - DNA, 20 bp, Homo sapiens
ctgtctgcgccgctgtgctg

SEQ ID NO: 4273128 - DNA, 12 bp, Homo sapiens
ctgtctgtggct

SEQ ID NO: 4273129 - DNA, 22 bp, Homo sapiens
ctgtctgtgtgaggctccctcc

SEQ ID NO: 4273130 - DNA, 14 bp, Homo sapiens
ctgtcttcaagggc

SEQ ID NO: 4273131 - DNA, 18 bp, Homo sapiens
ctgtgaaagtctcctgta

SEQ ID NO: 4273132 - DNA, 23 bp, Homo sapiens
ctgtgaactgccaggcagctgca

SEQ ID NO: 4273133 - DNA, 19 bp, Homo sapiens
ctgtgaacttgatgttcct

SEQ ID NO: 4273134 - DNA, 17 bp, Homo sapiens
ctgtgaataaagccaca

SEQ ID NO: 4273135 - DNA, 18 bp, Homo sapiens
ctgtgaatcaaaacaaat

SEQ ID NO: 4273136 - DNA, 16 bp, Homo sapiens
ctgtgacacagctgag

SEQ ID NO: 4273137 - DNA, 22 bp, Homo sapiens
ctgtgaccggggtcctgaggct

SEQ ID NO: 4273138 - DNA, 13 bp, Homo sapiens
ctgtgacctgtgg

SEQ ID NO: 4273139 - DNA, 15 bp, Homo sapiens
ctgtgacctgtgggg

SEQ ID NO: 4273140 - DNA, 16 bp, Homo sapiens
ctgtgacctgtgggga

SEQ ID NO: 4273141 - DNA, 20 bp, Homo sapiens
ctgtgatcgtgtgttgccat

SEQ ID NO: 4273142 - DNA, 23 bp, Homo sapiens
ctgtgatgtcagtagtgcctgtg

SEQ ID NO: 4273143 - DNA, 19 bp, Homo sapiens
ctgtgattaattattgaaa

SEQ ID NO: 4273144 - DNA, 12 bp, Homo sapiens
ctgtgcacagcc

SEQ ID NO: 4273145 - DNA, 17 bp, Homo sapiens
ctgtgcacccgtgccac

SEQ ID NO: 4273146 - DNA, 21 bp, Homo sapiens
ctgtgcagccggggagctgag

SEQ ID NO: 4273147 - DNA, 22 bp, Homo sapiens
ctgtgcagccggggagctgagg

SEQ ID NO: 4273148 - DNA, 18 bp, Homo sapiens
ctgtgccagctgcttctg

SEQ ID NO: 4273149 - DNA, 20 bp, Homo sapiens
ctgtgcgagaacacaagcca

SEQ ID NO: 4273150 - DNA, 16 bp, Homo sapiens
ctgtgcgttttagagt

SEQ ID NO: 4273151 - DNA, 15 bp, Homo sapiens
ctgtgctaagttgtc

SEQ ID NO: 4273152 - DNA, 13 bp, Homo sapiens
ctgtgctgctgca

SEQ ID NO: 4273153 - DNA, 17 bp, Homo sapiens
ctgtgctggtctctagg

SEQ ID NO: 4273154 - DNA, 16 bp, Homo sapiens
ctgtgctgttgtctgc

SEQ ID NO: 4273155 - DNA, 22 bp, Homo sapiens
ctgtggagcccgcacccccacc

SEQ ID NO: 4273156 - DNA, 23 bp, Homo sapiens
ctgtggagcccgcacccccaccc

SEQ ID NO: 4273157 - DNA, 16 bp, Homo sapiens
ctgtggattctatatt

SEQ ID NO: 4273158 - DNA, 17 bp, Homo sapiens
ctgtggattctatattt

SEQ ID NO: 4273159 - DNA, 14 bp, Homo sapiens
ctgtggcccctcct

SEQ ID NO: 4273160 - DNA, 19 bp, Homo sapiens
ctgtggcccctccttctcc

SEQ ID NO: 4273161 - DNA, 23 bp, Homo sapiens
ctgtggcccctccttctcccctc

SEQ ID NO: 4273162 - DNA, 15 bp, Homo sapiens
ctgtggccctctctt

SEQ ID NO: 4273163 - DNA, 12 bp, Homo sapiens
ctgtggcctcag

SEQ ID NO: 4273164 - DNA, 13 bp, Homo sapiens
ctgtggcctcagc

SEQ ID NO: 4273165 - DNA, 14 bp, Homo sapiens
ctgtggcctcagca

SEQ ID NO: 4273166 - DNA, 15 bp, Homo sapiens
ctgtggcctcagcat

SEQ ID NO: 4273167 - DNA, 14 bp, Homo sapiens
ctgtggcctcagga

SEQ ID NO: 4273168 - DNA, 15 bp, Homo sapiens
ctgtggcctcaggag

SEQ ID NO: 4273169 - DNA, 21 bp, Homo sapiens
ctgtgggactggcccacccct

SEQ ID NO: 4273170 - DNA, 17 bp, Homo sapiens
ctgtgggcagctggctc

SEQ ID NO: 4273171 - DNA, 20 bp, Homo sapiens
ctgtgggcagctggctctga

SEQ ID NO: 4273172 - DNA, 14 bp, Homo sapiens
ctgtggggagctgg

SEQ ID NO: 4273173 - DNA, 15 bp, Homo sapiens
ctgtggggagctggt

SEQ ID NO: 4273174 - DNA, 22 bp, Homo sapiens
ctgtggggagctggtgggggca

SEQ ID NO: 4273175 - DNA, 20 bp, Homo sapiens
ctgtggggatttctcccagc

SEQ ID NO: 4273176 - DNA, 15 bp, Homo sapiens
ctgtgggtagtatga

SEQ ID NO: 4273177 - DNA, 22 bp, Homo sapiens
ctgtggtcttcaaattgtcttt

SEQ ID NO: 4273178 - DNA, 16 bp, Homo sapiens
ctgtgtaatctctgat

SEQ ID NO: 4273179 - DNA, 21 bp, Homo sapiens
ctgtgtccccgcgggcagtga

SEQ ID NO: 4273180 - DNA, 19 bp, Homo sapiens
ctgtgtccctctctctgga

SEQ ID NO: 4273181 - DNA, 20 bp, Homo sapiens
ctgtgtccctctctctggaa

SEQ ID NO: 4273182 - DNA, 19 bp, Homo sapiens
ctgtgttagtgtctgtcca

SEQ ID NO: 4273183 - DNA, 21 bp, Homo sapiens
ctgttaaggcatccacttcac

SEQ ID NO: 4273184 - DNA, 23 bp, Homo sapiens
ctgttcatttccaccaagggtat

SEQ ID NO: 4273185 - DNA, 12 bp, Homo sapiens
ctgttccctgct

SEQ ID NO: 4273186 - DNA, 18 bp, Homo sapiens
ctgttccctgctgggtgg

SEQ ID NO: 4273187 - DNA, 22 bp, Homo sapiens
ctgttctcagagctccacagaa

SEQ ID NO: 4273188 - DNA, 14 bp, Homo sapiens
ctgttctctgcttt

SEQ ID NO: 4273189 - DNA, 13 bp, Homo sapiens
ctgttctgtgtct

SEQ ID NO: 4273190 - DNA, 13 bp, Homo sapiens
ctgttgattaatt

SEQ ID NO: 4273191 - DNA, 19 bp, Homo sapiens
ctgttgattaatttctgcc

SEQ ID NO: 4273192 - DNA, 21 bp, Homo sapiens
ctgttgattaatttctgccat

SEQ ID NO: 4273193 - DNA, 22 bp, Homo sapiens
ctgttgtctgccgtgagagccc

SEQ ID NO: 4273194 - DNA, 23 bp, Homo sapiens
ctgttgtctgccgtgagagccca

SEQ ID NO: 4273195 - DNA, 17 bp, Homo sapiens
ctgtttaccctccctgt

SEQ ID NO: 4273196 - DNA, 22 bp, Homo sapiens
ctgtttaccctccctgtcccct

SEQ ID NO: 4273197 - DNA, 16 bp, Homo sapiens
ctgtttatggtatttt

SEQ ID NO: 4273198 - DNA, 19 bp, Homo sapiens
ctgtttgctcacccaggac

SEQ ID NO: 4273199 - DNA, 21 bp, Homo sapiens
ctgtttgctcacccaggacct

SEQ ID NO: 4273200 - DNA, 15 bp, Homo sapiens
ctgttttatgtcata

SEQ ID NO: 4273201 - DNA, 19 bp, Homo sapiens
ctgttttatgtcatactct

SEQ ID NO: 4273202 - DNA, 20 bp, Homo sapiens
ctgttttattgagttctgaa

SEQ ID NO: 4273203 - DNA, 14 bp, Homo sapiens
ctgtttttgtagtg

SEQ ID NO: 4273204 - DNA, 17 bp, Homo sapiens
cttaaaaaaaaaaatga

SEQ ID NO: 4273205 - DNA, 21 bp, Homo sapiens
cttaaaaaagaaagattttat

SEQ ID NO: 4273206 - DNA, 21 bp, Homo sapiens
cttaaaagctatcttcatgta

SEQ ID NO: 4273207 - DNA, 16 bp, Homo sapiens
cttaaaataatgattt

SEQ ID NO: 4273208 - DNA, 18 bp, Homo sapiens
cttaaaattagcatctgg

SEQ ID NO: 4273209 - DNA, 14 bp, Homo sapiens
cttaaacagggcat

SEQ ID NO: 4273210 - DNA, 22 bp, Homo sapiens
cttaaacagggcatctccagga

SEQ ID NO: 4273211 - DNA, 15 bp, Homo sapiens
cttaacctgcttttg

SEQ ID NO: 4273212 - DNA, 12 bp, Homo sapiens
cttaatatttct

SEQ ID NO: 4273213 - DNA, 20 bp, Homo sapiens
cttaatgttctgaataattt

SEQ ID NO: 4273214 - DNA, 13 bp, Homo sapiens
cttacacacaaaa

SEQ ID NO: 4273215 - DNA, 18 bp, Homo sapiens
cttacatgcattactgca

SEQ ID NO: 4273216 - DNA, 20 bp, Homo sapiens
cttacattagcagtttgctt

SEQ ID NO: 4273217 - DNA, 21 bp, Homo sapiens
cttacattagcagtttgcttt

SEQ ID NO: 4273218 - DNA, 18 bp, Homo sapiens
cttaccccgtccctttcc

SEQ ID NO: 4273219 - DNA, 21 bp, Homo sapiens
cttactaaacattttgttatt

SEQ ID NO: 4273220 - DNA, 15 bp, Homo sapiens
cttactgattaactc

SEQ ID NO: 4273221 - DNA, 16 bp, Homo sapiens
cttagaaattgcattt

SEQ ID NO: 4273222 - DNA, 12 bp, Homo sapiens
cttagaatgggg

SEQ ID NO: 4273223 - DNA, 19 bp, Homo sapiens
cttagctgaacaatgaatg

SEQ ID NO: 4273224 - DNA, 13 bp, Homo sapiens
cttagcttttctg

SEQ ID NO: 4273225 - DNA, 13 bp, Homo sapiens
cttagtatctcat

SEQ ID NO: 4273226 - DNA, 22 bp, Homo sapiens
cttagtatctcatcaacaaaga

SEQ ID NO: 4273227 - DNA, 13 bp, Homo sapiens
cttagtcatacca

SEQ ID NO: 4273228 - DNA, 22 bp, Homo sapiens
cttagtttcagctgaccagaag

SEQ ID NO: 4273229 - DNA, 14 bp, Homo sapiens
cttatattgttcac

SEQ ID NO: 4273230 - DNA, 16 bp, Homo sapiens
cttatattgttcactt

SEQ ID NO: 4273231 - DNA, 14 bp, Homo sapiens
cttatgctgctgtg

SEQ ID NO: 4273232 - DNA, 16 bp, Homo sapiens
cttatgctgctgtgaa

SEQ ID NO: 4273233 - DNA, 16 bp, Homo sapiens
cttattcaaagagaaa

SEQ ID NO: 4273234 - DNA, 17 bp, Homo sapiens
cttattcaaagagaaaa

SEQ ID NO: 4273235 - DNA, 13 bp, Homo sapiens
cttatttatatat

SEQ ID NO: 4273236 - DNA, 15 bp, Homo sapiens
cttatttatatatga

SEQ ID NO: 4273237 - DNA, 14 bp, Homo sapiens
cttattttagacaa

SEQ ID NO: 4273238 - DNA, 11 bp, Homo sapiens
cttattttctg

SEQ ID NO: 4273239 - DNA, 17 bp, Homo sapiens
cttcaaccttgagacag

SEQ ID NO: 4273240 - DNA, 21 bp, Homo sapiens
cttcaagctcaccctgctcct

SEQ ID NO: 4273241 - DNA, 13 bp, Homo sapiens
cttcaccaagctt

SEQ ID NO: 4273242 - DNA, 14 bp, Homo sapiens
cttcaccaggaaga

SEQ ID NO: 4273243 - DNA, 11 bp, Homo sapiens
cttcaccttaa

SEQ ID NO: 4273244 - DNA, 15 bp, Homo sapiens
cttcacttctgacca

SEQ ID NO: 4273245 - DNA, 12 bp, Homo sapiens
cttcagactctc

SEQ ID NO: 4273246 - DNA, 10 bp, Homo sapiens
cttccagatg

SEQ ID NO: 4273247 - DNA, 16 bp, Homo sapiens
cttccaggccccaggc

SEQ ID NO: 4273248 - DNA, 24 bp, Homo sapiens
cttccaggccccaggctggatgct

SEQ ID NO: 4273249 - DNA, 15 bp, Homo sapiens
cttccatcagcagtg

SEQ ID NO: 4273250 - DNA, 17 bp, Homo sapiens
cttccatcagcagtgat

SEQ ID NO: 4273251 - DNA, 20 bp, Homo sapiens
cttccatcagcagtgattga

SEQ ID NO: 4273252 - DNA, 21 bp, Homo sapiens
cttccatggtggtttcagaaa

SEQ ID NO: 4273253 - DNA, 22 bp, Homo sapiens
cttccatggtggtttcagaaag

SEQ ID NO: 4273254 - DNA, 15 bp, Homo sapiens
cttccattcccagac

SEQ ID NO: 4273255 - DNA, 13 bp, Homo sapiens
cttcccaccaact

SEQ ID NO: 4273256 - DNA, 19 bp, Homo sapiens
cttcccacggccactgcag

SEQ ID NO: 4273257 - DNA, 21 bp, Homo sapiens
cttcccacggccactgcagtc

SEQ ID NO: 4273258 - DNA, 17 bp, Homo sapiens
cttcccaggaccctggg

SEQ ID NO: 4273259 - DNA, 18 bp, Homo sapiens
cttcccaggaccctgggt

SEQ ID NO: 4273260 - DNA, 19 bp, Homo sapiens
cttcccaggaccctgggtc

SEQ ID NO: 4273261 - DNA, 14 bp, Homo sapiens
cttcccatttgtaa

SEQ ID NO: 4273262 - DNA, 23 bp, Homo sapiens
cttccccaacgaaaagcacatcc

SEQ ID NO: 4273263 - DNA, 11 bp, Homo sapiens
cttccccactg

SEQ ID NO: 4273264 - DNA, 14 bp, Homo sapiens
cttccccactgcct

SEQ ID NO: 4273265 - DNA, 19 bp, Homo sapiens
cttccccatcgccttctgg

SEQ ID NO: 4273266 - DNA, 19 bp, Homo sapiens
cttccccattgccttctgg

SEQ ID NO: 4273267 - DNA, 20 bp, Homo sapiens
cttcccccttcccctgcgcc

SEQ ID NO: 4273268 - DNA, 19 bp, Homo sapiens
cttcccctgcgccctccct

SEQ ID NO: 4273269 - DNA, 22 bp, Homo sapiens
cttcccctgcgccctccctccc

SEQ ID NO: 4273270 - DNA, 15 bp, Homo sapiens
cttcccgctcagccc

SEQ ID NO: 4273271 - DNA, 18 bp, Homo sapiens
cttcccgctcagccctcc

SEQ ID NO: 4273272 - DNA, 23 bp, Homo sapiens
cttcccgctcagccctccctgcc

SEQ ID NO: 4273273 - DNA, 13 bp, Homo sapiens
cttccctccacct

SEQ ID NO: 4273274 - DNA, 19 bp, Homo sapiens
cttccctccacctgcttgt

SEQ ID NO: 4273275 - DNA, 15 bp, Homo sapiens
cttccctctgcctgt

SEQ ID NO: 4273276 - DNA, 19 bp, Homo sapiens
cttccctctgcctgtccct

SEQ ID NO: 4273277 - DNA, 15 bp, Homo sapiens
cttccctctgctcca

SEQ ID NO: 4273278 - DNA, 15 bp, Homo sapiens
cttccgctctgaggc

SEQ ID NO: 4273279 - DNA, 20 bp, Homo sapiens
cttccggctgagctgtgcca

SEQ ID NO: 4273280 - DNA, 17 bp, Homo sapiens
cttcctccctccctgca

SEQ ID NO: 4273281 - DNA, 19 bp, Homo sapiens
cttcctccctccctgcagg

SEQ ID NO: 4273282 - DNA, 20 bp, Homo sapiens
cttcctccctccctgcaggg

SEQ ID NO: 4273283 - DNA, 15 bp, Homo sapiens
cttcctctccactgc

SEQ ID NO: 4273284 - DNA, 16 bp, Homo sapiens
cttcctctccactgcc

SEQ ID NO: 4273285 - DNA, 19 bp, Homo sapiens
cttcctctccactgccttc

SEQ ID NO: 4273286 - DNA, 12 bp, Homo sapiens
cttcctgcccta

SEQ ID NO: 4273287 - DNA, 19 bp, Homo sapiens
cttcctgctacagtagctg

SEQ ID NO: 4273288 - DNA, 22 bp, Homo sapiens
cttcctggattttctttctatg

SEQ ID NO: 4273289 - DNA, 20 bp, Homo sapiens
cttcctgggcagcccagaga

SEQ ID NO: 4273290 - DNA, 19 bp, Homo sapiens
cttcctgggttggccagag

SEQ ID NO: 4273291 - DNA, 13 bp, Homo sapiens
cttccttcatttc

SEQ ID NO: 4273292 - DNA, 16 bp, Homo sapiens
cttccttcatttcctc

SEQ ID NO: 4273293 - DNA, 19 bp, Homo sapiens
cttccttttgtatcctcca

SEQ ID NO: 4273294 - DNA, 13 bp, Homo sapiens
cttcgactgtgac

SEQ ID NO: 4273295 - DNA, 16 bp, Homo sapiens
cttcgctattcccagg

SEQ ID NO: 4273296 - DNA, 13 bp, Homo sapiens
cttcgtggagctc

SEQ ID NO: 4273297 - DNA, 18 bp, Homo sapiens
cttcgtggagctctaact

SEQ ID NO: 4273298 - DNA, 20 bp, Homo sapiens
cttctaatccatgtgctgct

SEQ ID NO: 4273299 - DNA, 15 bp, Homo sapiens
cttctacctgcagga

SEQ ID NO: 4273300 - DNA, 21 bp, Homo sapiens
cttctcaaatgctactcagta

SEQ ID NO: 4273301 - DNA, 20 bp, Homo sapiens
cttctccagccaccaaggct

SEQ ID NO: 4273302 - DNA, 21 bp, Homo sapiens
cttctccagccaccaaggctg

SEQ ID NO: 4273303 - DNA, 13 bp, Homo sapiens
cttctccccaatc

SEQ ID NO: 4273304 - DNA, 22 bp, Homo sapiens
cttctcccctccagacccctac

SEQ ID NO: 4273305 - DNA, 21 bp, Homo sapiens
cttctccctggactctgtggg

SEQ ID NO: 4273306 - DNA, 14 bp, Homo sapiens
cttctcctttcaca

SEQ ID NO: 4273307 - DNA, 17 bp, Homo sapiens
cttctcctttcacaacc

SEQ ID NO: 4273308 - DNA, 20 bp, Homo sapiens
cttctcctttcacaaccttc

SEQ ID NO: 4273309 - DNA, 15 bp, Homo sapiens
cttctctcagcctcc

SEQ ID NO: 4273310 - DNA, 21 bp, Homo sapiens
cttctcttacgctctctgtct

SEQ ID NO: 4273311 - DNA, 17 bp, Homo sapiens
cttctgaccacacttcc

SEQ ID NO: 4273312 - DNA, 18 bp, Homo sapiens
cttctgaccacacttcct

SEQ ID NO: 4273313 - DNA, 16 bp, Homo sapiens
cttctgcccaccccgc

SEQ ID NO: 4273314 - DNA, 16 bp, Homo sapiens
cttctggccgctgcag

SEQ ID NO: 4273315 - DNA, 18 bp, Homo sapiens
cttctggctgctgcagtc

SEQ ID NO: 4273316 - DNA, 15 bp, Homo sapiens
cttctggggagggac

SEQ ID NO: 4273317 - DNA, 21 bp, Homo sapiens
cttctggggagggacacagag

SEQ ID NO: 4273318 - DNA, 22 bp, Homo sapiens
cttctggggagggacacagagg

SEQ ID NO: 4273319 - DNA, 12 bp, Homo sapiens
cttctgtctctt

SEQ ID NO: 4273320 - DNA, 15 bp, Homo sapiens
cttctgtctcttgca

SEQ ID NO: 4273321 - DNA, 16 bp, Homo sapiens
cttctgtctcttgcat

SEQ ID NO: 4273322 - DNA, 13 bp, Homo sapiens
cttctgtctgtaa

SEQ ID NO: 4273323 - DNA, 22 bp, Homo sapiens
cttctgtggctcacagaaccct

SEQ ID NO: 4273324 - DNA, 12 bp, Homo sapiens
cttcttctgtaa

SEQ ID NO: 4273325 - DNA, 17 bp, Homo sapiens
cttcttctgtaatattt

SEQ ID NO: 4273326 - DNA, 18 bp, Homo sapiens
cttcttctgtaatattta

SEQ ID NO: 4273327 - DNA, 22 bp, Homo sapiens
cttcttctgtaatatttacaat

SEQ ID NO: 4273328 - DNA, 17 bp, Homo sapiens
cttctttactaacactg

SEQ ID NO: 4273329 - DNA, 24 bp, Homo sapiens
cttgaaattatatctgtggtcttc

SEQ ID NO: 4273330 - DNA, 16 bp, Homo sapiens
cttgaacattaatcca

SEQ ID NO: 4273331 - DNA, 17 bp, Homo sapiens
cttgaagattcaggctt

SEQ ID NO: 4273332 - DNA, 18 bp, Homo sapiens
cttgaagattcaggcttg

SEQ ID NO: 4273333 - DNA, 15 bp, Homo sapiens
cttgaatagtattgt

SEQ ID NO: 4273334 - DNA, 18 bp, Homo sapiens
cttgaatagtattgtgtt

SEQ ID NO: 4273335 - DNA, 23 bp, Homo sapiens
cttgaatggaaggtccgagtctt

SEQ ID NO: 4273336 - DNA, 18 bp, Homo sapiens
cttgagagcgctggcctc

SEQ ID NO: 4273337 - DNA, 22 bp, Homo sapiens
cttgagatgtattatgcaaagt

SEQ ID NO: 4273338 - DNA, 18 bp, Homo sapiens
cttgagcaaggcaagaag

SEQ ID NO: 4273339 - DNA, 21 bp, Homo sapiens
cttgagcaaggcaagaagtgg

SEQ ID NO: 4273340 - DNA, 22 bp, Homo sapiens
cttgagcaaggcaagaagtggg

SEQ ID NO: 4273341 - DNA, 15 bp, Homo sapiens
cttgagcccactcct

SEQ ID NO: 4273342 - DNA, 16 bp, Homo sapiens
cttgagtgggccccct

SEQ ID NO: 4273343 - DNA, 23 bp, Homo sapiens
cttgatgttgcttagtcacttat

SEQ ID NO: 4273344 - DNA, 21 bp, Homo sapiens
cttgattttagccttctctgt

SEQ ID NO: 4273345 - DNA, 14 bp, Homo sapiens
cttgcaacacacag

SEQ ID NO: 4273346 - DNA, 17 bp, Homo sapiens
cttgcataagcctcagg

SEQ ID NO: 4273347 - DNA, 18 bp, Homo sapiens
cttgcataagcctcaggc

SEQ ID NO: 4273348 - DNA, 17 bp, Homo sapiens
cttgcattaaaagactg

SEQ ID NO: 4273349 - DNA, 13 bp, Homo sapiens
cttgccccccacc

SEQ ID NO: 4273350 - DNA, 15 bp, Homo sapiens
cttgccccccacccc

SEQ ID NO: 4273351 - DNA, 17 bp, Homo sapiens
cttgccgctgggagagc

SEQ ID NO: 4273352 - DNA, 18 bp, Homo sapiens
cttgccgctgggagagcc

SEQ ID NO: 4273353 - DNA, 18 bp, Homo sapiens
cttgcctagggcctggtc

SEQ ID NO: 4273354 - DNA, 20 bp, Homo sapiens
cttgcctagggcctggtcca

SEQ ID NO: 4273355 - DNA, 20 bp, Homo sapiens
cttgctcaataaaggtcata

SEQ ID NO: 4273356 - DNA, 16 bp, Homo sapiens
cttgctgcactcttgc

SEQ ID NO: 4273357 - DNA, 12 bp, Homo sapiens
cttgctgctggc

SEQ ID NO: 4273358 - DNA, 23 bp, Homo sapiens
cttgctttcacaaatatagttga

SEQ ID NO: 4273359 - DNA, 14 bp, Homo sapiens
cttggacggggaca

SEQ ID NO: 4273360 - DNA, 23 bp, Homo sapiens
cttggacggggacacggcctctg

SEQ ID NO: 4273361 - DNA, 12 bp, Homo sapiens
cttggagaggag

SEQ ID NO: 4273362 - DNA, 20 bp, Homo sapiens
ctggcttctccctggactct

SEQ ID NO: 4273363 - DNA, 21 bp, Homo sapiens
ctggcttctccctggactctg

SEQ ID NO: 4273364 - DNA, 16 bp, Homo sapiens
ctggcttttcactgct

SEQ ID NO: 4273365 - DNA, 16 bp, Homo sapiens
ctgggaaaagggcagg

SEQ ID NO: 4273366 - DNA, 18 bp, Homo sapiens
ctgggagaaaagccagat

SEQ ID NO: 4273367 - DNA, 19 bp, Homo sapiens
ctgggagaaaagccagatg

SEQ ID NO: 4273368 - DNA, 13 bp, Homo sapiens
ctgggagagtgag

SEQ ID NO: 4273369 - DNA, 21 bp, Homo sapiens
ctgggagatgctgggaccctc

SEQ ID NO: 4273370 - DNA, 15 bp, Homo sapiens
ctgggagcctcgccc

SEQ ID NO: 4273371 - DNA, 13 bp, Homo sapiens
ctgggaggcaggt

SEQ ID NO: 4273372 - DNA, 19 bp, Homo sapiens
ctgggcacctggggagtgg

SEQ ID NO: 4273373 - DNA, 15 bp, Homo sapiens
ctgggcagaggggag

SEQ ID NO: 4273374 - DNA, 23 bp, Homo sapiens
ctgggcagaggggagaggaagca

SEQ ID NO: 4273375 - DNA, 13 bp, Homo sapiens
ctgggcagcccag

SEQ ID NO: 4273376 - DNA, 15 bp, Homo sapiens
ctgggcatccccagc

SEQ ID NO: 4273377 - DNA, 21 bp, Homo sapiens
ctgggcatccccagccccctg

SEQ ID NO: 4273378 - DNA, 16 bp, Homo sapiens
ctgggcatctggccct

SEQ ID NO: 4273379 - DNA, 23 bp, Homo sapiens
ctgggccactggcatctctggag

SEQ ID NO: 4273380 - DNA, 14 bp, Homo sapiens
ctgggcccagaagg

SEQ ID NO: 4273381 - DNA, 23 bp, Homo sapiens
ctgggcccagaaggttgtgatga

SEQ ID NO: 4273382 - DNA, 20 bp, Homo sapiens
ctgggcccgagggtcccaag

SEQ ID NO: 4273383 - DNA, 21 bp, Homo sapiens
ctgggctcacaccagccctgg

SEQ ID NO: 4273384 - DNA, 14 bp, Homo sapiens
ctgggctggcatgg

SEQ ID NO: 4273385 - DNA, 18 bp, Homo sapiens
ctgggctggcatggggag

SEQ ID NO: 4273386 - DNA, 14 bp, Homo sapiens
ctggggacggagca

SEQ ID NO: 4273387 - DNA, 15 bp, Homo sapiens
ctggggacggagcac

SEQ ID NO: 4273388 - DNA, 17 bp, Homo sapiens
ctggggacggagcactg

SEQ ID NO: 4273389 - DNA, 15 bp, Homo sapiens
ctggggagggacaca

SEQ ID NO: 4273390 - DNA, 19 bp, Homo sapiens
ctggggagggacacagagg

SEQ ID NO: 4273391 - DNA, 16 bp, Homo sapiens
ctggggaggggctccg

SEQ ID NO: 4273392 - DNA, 16 bp, Homo sapiens
ctggggcggtcaataa

SEQ ID NO: 4273393 - DNA, 16 bp, Homo sapiens
ctggggctgagagtgg

SEQ ID NO: 4273394 - DNA, 19 bp, Homo sapiens
ctggggctgagagtggggc

SEQ ID NO: 4273395 - DNA, 22 bp, Homo sapiens
ctggggcttttgtgccaggagt

SEQ ID NO: 4273396 - DNA, 22 bp, Homo sapiens
ctgggggccatgagctccagac

SEQ ID NO: 4273397 - DNA, 19 bp, Homo sapiens
ctggggggggcaagagctc

SEQ ID NO: 4273398 - DNA, 18 bp, Homo sapiens
ctggggtggaggctaagc

SEQ ID NO: 4273399 - DNA, 13 bp, Homo sapiens
ctggggtggggct

SEQ ID NO: 4273400 - DNA, 15 bp, Homo sapiens
ctggggtggggcttg

SEQ ID NO: 4273401 - DNA, 18 bp, Homo sapiens
ctggggtggggcttggaa

SEQ ID NO: 4273402 - DNA, 23 bp, Homo sapiens
ctggggtgggtgtgagcagggtg

SEQ ID NO: 4273403 - DNA, 21 bp, Homo sapiens
ctggggtggttggaggcctgg

SEQ ID NO: 4273404 - DNA, 17 bp, Homo sapiens
ctgggtcaccttcctgg

SEQ ID NO: 4273405 - DNA, 18 bp, Homo sapiens
ctgggtcaccttcctggg

SEQ ID NO: 4273406 - DNA, 16 bp, Homo sapiens
ctgggtcagcttgaat

SEQ ID NO: 4273407 - DNA, 18 bp, Homo sapiens
ctgggtggccggccctgc

SEQ ID NO: 4273408 - DNA, 13 bp, Homo sapiens
ctgggtgtgctcc

SEQ ID NO: 4273409 - DNA, 16 bp, Homo sapiens
ctgggtgtgctccagg

SEQ ID NO: 4273410 - DNA, 18 bp, Homo sapiens
ctgggtgtgctccaggct

SEQ ID NO: 4273411 - DNA, 17 bp, Homo sapiens
ctgggtttgggcagtgg

SEQ ID NO: 4273412 - DNA, 19 bp, Homo sapiens
ctgggtttgggcagtggag

SEQ ID NO: 4273413 - DNA, 17 bp, Homo sapiens
ctggtaagattgttatt

SEQ ID NO: 4273414 - DNA, 20 bp, Homo sapiens
ctggtaagattgttattaaa

SEQ ID NO: 4273415 - DNA, 22 bp, Homo sapiens
ctggtaagattgttattaaatg

SEQ ID NO: 4273416 - DNA, 23 bp, Homo sapiens
ctggtaagattgttattaaatgt

SEQ ID NO: 4273417 - DNA, 13 bp, Homo sapiens
ctggtattaaatg

SEQ ID NO: 4273418 - DNA, 19 bp, Homo sapiens
ctggtattaaatgccaagg

SEQ ID NO: 4273419 - DNA, 14 bp, Homo sapiens
ctggtcatcctggg

SEQ ID NO: 4273420 - DNA, 17 bp, Homo sapiens
ctggtccaggcatgggt

SEQ ID NO: 4273421 - DNA, 16 bp, Homo sapiens
ctggtccatgatggag

SEQ ID NO: 4273422 - DNA, 17 bp, Homo sapiens
ctggtccttctgacccc

SEQ ID NO: 4273423 - DNA, 19 bp, Homo sapiens
ctggtccttctgaccccac

SEQ ID NO: 4273424 - DNA, 16 bp, Homo sapiens
ctggtctctaggcctg

SEQ ID NO: 4273425 - DNA, 14 bp, Homo sapiens
ctggtctctccttg

SEQ ID NO: 4273426 - DNA, 12 bp, Homo sapiens
ctggtctggagc

SEQ ID NO: 4273427 - DNA, 20 bp, Homo sapiens
ctggtctggagcccctatcc

SEQ ID NO: 4273428 - DNA, 12 bp, Homo sapiens
ctggtctggctt

SEQ ID NO: 4273429 - DNA, 23 bp, Homo sapiens
ctggtgaaagagtaaaaccaaag

SEQ ID NO: 4273430 - DNA, 22 bp, Homo sapiens
ctggtgcatttaaaatggactt

SEQ ID NO: 4273431 - DNA, 14 bp, Homo sapiens
ctggtgccctggcc

SEQ ID NO: 4273432 - DNA, 17 bp, Homo sapiens
ctggtgccctggcccag

SEQ ID NO: 4273433 - DNA, 15 bp, Homo sapiens
ctggtgcgttcctaa

SEQ ID NO: 4273434 - DNA, 22 bp, Homo sapiens
ctggtgctgccacacttcaggc

SEQ ID NO: 4273435 - DNA, 18 bp, Homo sapiens
ctggtggccaagcctgcc

SEQ ID NO: 4273436 - DNA, 22 bp, Homo sapiens
ctggtggcccgacagcctggca

SEQ ID NO: 4273437 - DNA, 13 bp, Homo sapiens
ctggtgtctagtt

SEQ ID NO: 4273438 - DNA, 15 bp, Homo sapiens
ctggttcccccagga

SEQ ID NO: 4273439 - DNA, 17 bp, Homo sapiens
ctggttcccccaggacc

SEQ ID NO: 4273440 - DNA, 19 bp, Homo sapiens
ctggttcccccaggaccct

SEQ ID NO: 4273441 - DNA, 18 bp, Homo sapiens
ctggttctccatccccat

SEQ ID NO: 4273442 - DNA, 20 bp, Homo sapiens
ctggttctccatccccatgt

SEQ ID NO: 4273443 - DNA, 19 bp, Homo sapiens
ctggttggtgttcttccca

SEQ ID NO: 4273444 - DNA, 17 bp, Homo sapiens
ctggtttggggcgaggc

SEQ ID NO: 4273445 - DNA, 21 bp, Homo sapiens
ctggtttggtggccaggctgg

SEQ ID NO: 4273446 - DNA, 18 bp, Homo sapiens
ctggtttttctgttccct

SEQ ID NO: 4273447 - DNA, 15 bp, Homo sapiens
ctgtaaatatgtcac

SEQ ID NO: 4273448 - DNA, 13 bp, Homo sapiens
ctgtaatatttac

SEQ ID NO: 4273449 - DNA, 21 bp, Homo sapiens
ctgtaatatttacaatgtatt

SEQ ID NO: 4273450 - DNA, 16 bp, Homo sapiens
ctgtacaaagggaagc

SEQ ID NO: 4273451 - DNA, 15 bp, Homo sapiens
ctgtacctttctgac

SEQ ID NO: 4273452 - DNA, 18 bp, Homo sapiens
ctgtacgtctggtgttct

SEQ ID NO: 4273453 - DNA, 21 bp, Homo sapiens
ctgtagaaaggttgattctca

SEQ ID NO: 4273454 - DNA, 15 bp, Homo sapiens
ctgtagacatctgtc

SEQ ID NO: 4273455 - DNA, 14 bp, Homo sapiens
ctgtagtaattgtt

SEQ ID NO: 4273456 - DNA, 15 bp, Homo sapiens
ctgtatatttgtatg

SEQ ID NO: 4273457 - DNA, 16 bp, Homo sapiens
ctgtatatttgtatga

SEQ ID NO: 4273458 - DNA, 19 bp, Homo sapiens
ctgtatatttgtatgatat

SEQ ID NO: 4273459 - DNA, 20 bp, Homo sapiens
ctgtatctaaaaaataactg

SEQ ID NO: 4273460 - DNA, 15 bp, Homo sapiens
ctgtatgtcattaaa

SEQ ID NO: 4273461 - DNA, 12 bp, Homo sapiens
ctgtatttccaa

SEQ ID NO: 4273462 - DNA, 15 bp, Homo sapiens
ctgtattttctttta

SEQ ID NO: 4273463 - DNA, 22 bp, Homo sapiens
ctgtattttcttttatatctgt

SEQ ID NO: 4273464 - DNA, 17 bp, Homo sapiens
ctgtcactaaatggcag

SEQ ID NO: 4273465 - DNA, 20 bp, Homo sapiens
ctgtcagagaatatgaccta

SEQ ID NO: 4273466 - DNA, 15 bp, Homo sapiens
ctgtccaatctgcaa

SEQ ID NO: 4273467 - DNA, 19 bp, Homo sapiens
ctgtccacctgtgctgctg

SEQ ID NO: 4273468 - DNA, 18 bp, Homo sapiens
ctgtccagagagagaagt

SEQ ID NO: 4273469 - DNA, 18 bp, Homo sapiens
ctgtccatctgtctgtcc

SEQ ID NO: 4273470 - DNA, 21 bp, Homo sapiens
ctgtcccggagctcaggccct

SEQ ID NO: 4273471 - DNA, 11 bp, Homo sapiens
ctgtccctgtc

SEQ ID NO: 4273472 - DNA, 16 bp, Homo sapiens
ctgtccctgtccctgc

SEQ ID NO: 4273473 - DNA, 15 bp, Homo sapiens
ctgtcctacccgccc

SEQ ID NO: 4273474 - DNA, 17 bp, Homo sapiens
ctgtccttagactcctt

SEQ ID NO: 4273475 - DNA, 20 bp, Homo sapiens
ctgtccttcccacggccact

SEQ ID NO: 4273476 - DNA, 23 bp, Homo sapiens
ctgtccttcccacggccactgca

SEQ ID NO: 4273477 - DNA, 14 bp, Homo sapiens
ctgtctaagaataa

SEQ ID NO: 4273478 - DNA, 20 bp, Homo sapiens
ctgtctaagaataatgacgt

SEQ ID NO: 4273479 - DNA, 19 bp, Homo sapiens
ctgtctcaagagggcactg

SEQ ID NO: 4273480 - DNA, 21 bp, Homo sapiens
ctgtctcaagagggcactggt

SEQ ID NO: 4273481 - DNA, 22 bp, Homo sapiens
ctgtctcaagagggcactggtg

SEQ ID NO: 4273482 - DNA, 17 bp, Homo sapiens
ctgtctctcatgaacct

SEQ ID NO: 4273483 - DNA, 19 bp, Homo sapiens
ctgtctgaaaccagaagac

SEQ ID NO: 4273484 - DNA, 22 bp, Homo sapiens
ctgtctgaaaccagaagactgg

SEQ ID NO: 4273485 - DNA, 17 bp, Homo sapiens
ctgtctgagccctgccc

SEQ ID NO: 4273486 - DNA, 18 bp, Homo sapiens
ctgtctgagccctgccct

SEQ ID NO: 4273487 - DNA, 19 bp, Homo sapiens
ctgtctgagccctgccctc

SEQ ID NO: 4273488 - DNA, 18 bp, Homo sapiens
ctagagaaattcttgtta

SEQ ID NO: 4273489 - DNA, 19 bp, Homo sapiens
ctagagatattttgtaaaa

SEQ ID NO: 4273490 - DNA, 21 bp, Homo sapiens
ctagatctcctgtaattttgt

SEQ ID NO: 4273491 - DNA, 17 bp, Homo sapiens
ctagcaagaagattcta

SEQ ID NO: 4273492 - DNA, 22 bp, Homo sapiens
ctagcaagaagattctaaaaca

SEQ ID NO: 4273493 - DNA, 20 bp, Homo sapiens
ctagcacaaggagtgcccgc

SEQ ID NO: 4273494 - DNA, 18 bp, Homo sapiens
ctagcagtttgcctctgc

SEQ ID NO: 4273495 - DNA, 20 bp, Homo sapiens
ctagcagtttgcctctgcac

SEQ ID NO: 4273496 - DNA, 21 bp, Homo sapiens
ctagcagtttgcctctgcacg

SEQ ID NO: 4273497 - DNA, 23 bp, Homo sapiens
ctagccaggcctcccgcatgctg

SEQ ID NO: 4273498 - DNA, 17 bp, Homo sapiens
ctagccatatattttct

SEQ ID NO: 4273499 - DNA, 21 bp, Homo sapiens
ctagctatgctgtatctgtgc

SEQ ID NO: 4273500 - DNA, 13 bp, Homo sapiens
ctaggagcactgt

SEQ ID NO: 4273501 - DNA, 11 bp, Homo sapiens
ctaggagctgg

SEQ ID NO: 4273502 - DNA, 19 bp, Homo sapiens
ctaggagctggggagggag

SEQ ID NO: 4273503 - DNA, 13 bp, Homo sapiens
ctaggccagctcc

SEQ ID NO: 4273504 - DNA, 14 bp, Homo sapiens
ctaggccagctcct

SEQ ID NO: 4273505 - DNA, 16 bp, Homo sapiens
ctaggccagctcctta

SEQ ID NO: 4273506 - DNA, 18 bp, Homo sapiens
ctagggtcctcaggcagt

SEQ ID NO: 4273507 - DNA, 14 bp, Homo sapiens
ctaggtctccaccc

SEQ ID NO: 4273508 - DNA, 16 bp, Homo sapiens
ctaggtctccacccct

SEQ ID NO: 4273509 - DNA, 19 bp, Homo sapiens
ctaggtgctggcatgtctg

SEQ ID NO: 4273510 - DNA, 13 bp, Homo sapiens
ctaggtgggccag

SEQ ID NO: 4273511 - DNA, 15 bp, Homo sapiens
ctaggtgggccagcc

SEQ ID NO: 4273512 - DNA, 21 bp, Homo sapiens
ctaggtgggccagcccctccc

SEQ ID NO: 4273513 - DNA, 23 bp, Homo sapiens
ctagtattccagacctgaagaat

SEQ ID NO: 4273514 - DNA, 18 bp, Homo sapiens
ctagtcacatatcaagtc

SEQ ID NO: 4273515 - DNA, 18 bp, Homo sapiens
ctagtcctattctattgc

SEQ ID NO: 4273516 - DNA, 17 bp, Homo sapiens
ctagtctctgatttgca

SEQ ID NO: 4273517 - DNA, 21 bp, Homo sapiens
ctagtgatacactgtatctaa

SEQ ID NO: 4273518 - DNA, 19 bp, Homo sapiens
ctagtggcttcagcccctg

SEQ ID NO: 4273519 - DNA, 20 bp, Homo sapiens
ctagtttgcatacttcctgg

SEQ ID NO: 4273520 - DNA, 18 bp, Homo sapiens
ctatatatacatgtatag

SEQ ID NO: 4273521 - DNA, 19 bp, Homo sapiens
ctatatatacatgtatagt

SEQ ID NO: 4273522 - DNA, 20 bp, Homo sapiens
ctatattgctgaatgcaaga

SEQ ID NO: 4273523 - DNA, 17 bp, Homo sapiens
ctatcacctcccctcct

SEQ ID NO: 4273524 - DNA, 19 bp, Homo sapiens
ctatcacctcccctccttg

SEQ ID NO: 4273525 - DNA, 18 bp, Homo sapiens
ctatcagagaagcagcat

SEQ ID NO: 4273526 - DNA, 20 bp, Homo sapiens
ctatcagagaagcagcatca

SEQ ID NO: 4273527 - DNA, 13 bp, Homo sapiens
ctatccagccgca

SEQ ID NO: 4273528 - DNA, 14 bp, Homo sapiens
ctatcctgcaccct

SEQ ID NO: 4273529 - DNA, 18 bp, Homo sapiens
ctatcctgcaccctctgc

SEQ ID NO: 4273530 - DNA, 17 bp, Homo sapiens
ctatctggtattaaatg

SEQ ID NO: 4273531 - DNA, 21 bp, Homo sapiens
ctatctggtattaaatgccaa

SEQ ID NO: 4273532 - DNA, 14 bp, Homo sapiens
ctatcttcatgtaa

SEQ ID NO: 4273533 - DNA, 20 bp, Homo sapiens
ctatcttcatgtaaattgac

SEQ ID NO: 4273534 - DNA, 17 bp, Homo sapiens
ctatgcacctataaata

SEQ ID NO: 4273535 - DNA, 18 bp, Homo sapiens
ctatgcacctataaatac

SEQ ID NO: 4273536 - DNA, 13 bp, Homo sapiens
ctatgccacctgc

SEQ ID NO: 4273537 - DNA, 17 bp, Homo sapiens
ctatgccactaggccct

SEQ ID NO: 4273538 - DNA, 20 bp, Homo sapiens
ctatgccactaggccctggt

SEQ ID NO: 4273539 - DNA, 21 bp, Homo sapiens
ctatgccactaggccctggtc

SEQ ID NO: 4273540 - DNA, 23 bp, Homo sapiens
ctatgccactaggccctggtctg

SEQ ID NO: 4273541 - DNA, 14 bp, Homo sapiens
ctatgcctgtattt

SEQ ID NO: 4273542 - DNA, 18 bp, Homo sapiens
ctatgcctgtatttccaa

SEQ ID NO: 4273543 - DNA, 16 bp, Homo sapiens
ctatgcgtaaatcaac

SEQ ID NO: 4273544 - DNA, 15 bp, Homo sapiens
ctatgctgtatctgt

SEQ ID NO: 4273545 - DNA, 14 bp, Homo sapiens
ctatgtagaactgt

SEQ ID NO: 4273546 - DNA, 16 bp, Homo sapiens
ctatgtcatttcattt

SEQ ID NO: 4273547 - DNA, 22 bp, Homo sapiens
ctatgtccatgaaaaacagcag

SEQ ID NO: 4273548 - DNA, 17 bp, Homo sapiens
ctatgtgtcatgatttc

SEQ ID NO: 4273549 - DNA, 14 bp, Homo sapiens
ctatgtgtgtgctt

SEQ ID NO: 4273550 - DNA, 21 bp, Homo sapiens
ctattaacaattaattgtctt

SEQ ID NO: 4273551 - DNA, 13 bp, Homo sapiens
ctattaagaaact

SEQ ID NO: 4273552 - DNA, 11 bp, Homo sapiens
ctattaatatt

SEQ ID NO: 4273553 - DNA, 13 bp, Homo sapiens
ctattaatatttg

SEQ ID NO: 4273554 - DNA, 17 bp, Homo sapiens
ctattatccccatttct

SEQ ID NO: 4273555 - DNA, 18 bp, Homo sapiens
ctattcccaggcagggag

SEQ ID NO: 4273556 - DNA, 20 bp, Homo sapiens
ctattgtaatatagaaaaaa

SEQ ID NO: 4273557 - DNA, 13 bp, Homo sapiens
ctatttaaaaaat

SEQ ID NO: 4273558 - DNA, 18 bp, Homo sapiens
ctatttagcatgacaagc

SEQ ID NO: 4273559 - DNA, 18 bp, Homo sapiens
ctatttcaacttcaggaa

SEQ ID NO: 4273560 - DNA, 12 bp, Homo sapiens
ctatttctatct

SEQ ID NO: 4273561 - DNA, 14 bp, Homo sapiens
ctatttctatctgc

SEQ ID NO: 4273562 - DNA, 17 bp, Homo sapiens
ctatttttttgttgctg

SEQ ID NO: 4273563 - DNA, 19 bp, Homo sapiens
ctcaaccctccctcagccc

SEQ ID NO: 4273564 - DNA, 22 bp, Homo sapiens
ctcaaccctccctcagcccctc

SEQ ID NO: 4273565 - DNA, 20 bp, Homo sapiens
ctcaacctacagtggaggga

SEQ ID NO: 4273566 - DNA, 13 bp, Homo sapiens
ctcaacctgtgat

SEQ ID NO: 4273567 - DNA, 19 bp, Homo sapiens
ctcaagagggcactggtgg

SEQ ID NO: 4273568 - DNA, 21 bp, Homo sapiens
ctcaagagggcactggtggcc

SEQ ID NO: 4273569 - DNA, 15 bp, Homo sapiens
ctcaagccaggagac

SEQ ID NO: 4273570 - DNA, 19 bp, Homo sapiens
ctcaagccaggagaccctg

SEQ ID NO: 4273571 - DNA, 17 bp, Homo sapiens
ctcaagctgcatctaga

SEQ ID NO: 4273572 - DNA, 19 bp, Homo sapiens
ctcaagtcggtgggcctgc

SEQ ID NO: 4273573 - DNA, 13 bp, Homo sapiens
ctcacaactgttt

SEQ ID NO: 4273574 - DNA, 20 bp, Homo sapiens
ctcacaactgtttttgaaga

SEQ ID NO: 4273575 - DNA, 16 bp, Homo sapiens
ctcacaccagccctgg

SEQ ID NO: 4273576 - DNA, 17 bp, Homo sapiens
ctcacaccagccctggt

SEQ ID NO: 4273577 - DNA, 16 bp, Homo sapiens
ctcacagccaccacct

SEQ ID NO: 4273578 - DNA, 13 bp, Homo sapiens
ctcacatcatgta

SEQ ID NO: 4273579 - DNA, 21 bp, Homo sapiens
ctcaccaaaatatagttaatt

SEQ ID NO: 4273580 - DNA, 14 bp, Homo sapiens
ctcacccagcctgg

SEQ ID NO: 4273581 - DNA, 17 bp, Homo sapiens
ctcacccaggacctctg

SEQ ID NO: 4273582 - DNA, 18 bp, Homo sapiens
ctcacccaggacctctgg

SEQ ID NO: 4273583 - DNA, 16 bp, Homo sapiens
ctcaccctgctcctac

SEQ ID NO: 4273584 - DNA, 17 bp, Homo sapiens
ctcacctgaattcgaga

SEQ ID NO: 4273585 - DNA, 16 bp, Homo sapiens
ctcacctgctggcccc

SEQ ID NO: 4273586 - DNA, 19 bp, Homo sapiens
ctcacctgctggcccctca

SEQ ID NO: 4273587 - DNA, 18 bp, Homo sapiens
ctcacctggcttcccagg

SEQ ID NO: 4273588 - DNA, 20 bp, Homo sapiens
ctcacctggcttcccaggac

SEQ ID NO: 4273589 - DNA, 21 bp, Homo sapiens
ctcacctggcttcccaggacc

SEQ ID NO: 4273590 - DNA, 20 bp, Homo sapiens
ctcacctgggcacctgggga

SEQ ID NO: 4273591 - DNA, 22 bp, Homo sapiens
ctcaccttgcaacacacagaca

SEQ ID NO: 4273592 - DNA, 21 bp, Homo sapiens
ctcacggctgcacctgcaggg

SEQ ID NO: 4273593 - DNA, 15 bp, Homo sapiens
ctcactagaatattc

SEQ ID NO: 4273594 - DNA, 14 bp, Homo sapiens
ctcactccactccc

SEQ ID NO: 4273595 - DNA, 15 bp, Homo sapiens
ctcactccactcccc

SEQ ID NO: 4273596 - DNA, 17 bp, Homo sapiens
ctcactccactcccctc

SEQ ID NO: 4273597 - DNA, 19 bp, Homo sapiens
ctcactcctacctggtaat

SEQ ID NO: 4273598 - DNA, 19 bp, Homo sapiens
ctcactctggcagcctcag

SEQ ID NO: 4273599 - DNA, 12 bp, Homo sapiens
ctcactgccctc

SEQ ID NO: 4273600 - DNA, 20 bp, Homo sapiens
ctcactggctggactggagg

SEQ ID NO: 4273601 - DNA, 18 bp, Homo sapiens
ctcactggtgcatttaaa

SEQ ID NO: 4273602 - DNA, 21 bp, Homo sapiens
ctcactggtgcatttaaaatg

SEQ ID NO: 4273603 - DNA, 15 bp, Homo sapiens
ctcacttcaagctca

SEQ ID NO: 4273604 - DNA, 20 bp, Homo sapiens
ctcacttcaagctcaccctg

SEQ ID NO: 4273605 - DNA, 14 bp, Homo sapiens
ctcacttttctcca

SEQ ID NO: 4273606 - DNA, 19 bp, Homo sapiens
ctcagaagtttcttcttta

SEQ ID NO: 4273607 - DNA, 17 bp, Homo sapiens
ctcagagggtccctagg

SEQ ID NO: 4273608 - DNA, 22 bp, Homo sapiens
ctcagatgctggtcatcctggg

SEQ ID NO: 4273609 - DNA, 14 bp, Homo sapiens
ctcagcaagtgctg

SEQ ID NO: 4273610 - DNA, 20 bp, Homo sapiens
ctcagcacagcctcacccct

SEQ ID NO: 4273611 - DNA, 14 bp, Homo sapiens
ctcagcagaaggcc

SEQ ID NO: 4273612 - DNA, 17 bp, Homo sapiens
ctcagcagaaggccttg

SEQ ID NO: 4273613 - DNA, 13 bp, Homo sapiens
ctcagccacgcct

SEQ ID NO: 4273614 - DNA, 22 bp, Homo sapiens
ctcagccacgcctctctcagcc

SEQ ID NO: 4273615 - DNA, 16 bp, Homo sapiens
ctcagccactcccagg

SEQ ID NO: 4273616 - DNA, 19 bp, Homo sapiens
ctcagcccacatagtgatg

SEQ ID NO: 4273617 - DNA, 23 bp, Homo sapiens
ctcagccccagggccctgctcag

SEQ ID NO: 4273618 - DNA, 14 bp, Homo sapiens
ctcagccctccctg

SEQ ID NO: 4273619 - DNA, 20 bp, Homo sapiens
ctcagccctccctgcccctc

SEQ ID NO: 4273620 - DNA, 15 bp, Homo sapiens
ctcagcctccactcc

SEQ ID NO: 4273621 - DNA, 18 bp, Homo sapiens
ctcagcctccactccctg

SEQ ID NO: 4273622 - DNA, 14 bp, Homo sapiens
cccagggccctgct

SEQ ID NO: 4273623 - DNA, 16 bp, Homo sapiens
cccagggccctgctca

SEQ ID NO: 4273624 - DNA, 21 bp, Homo sapiens
cccaggggcactgtgttctca

SEQ ID NO: 4273625 - DNA, 15 bp, Homo sapiens
cccaggggcctttgc

SEQ ID NO: 4273626 - DNA, 18 bp, Homo sapiens
cccagggttcccccagcc

SEQ ID NO: 4273627 - DNA, 12 bp, Homo sapiens
cccaggtctcct

SEQ ID NO: 4273628 - DNA, 16 bp, Homo sapiens
cccaggtctcctgggc

SEQ ID NO: 4273629 - DNA, 14 bp, Homo sapiens
cccaggtgttgtcc

SEQ ID NO: 4273630 - DNA, 16 bp, Homo sapiens
cccaggtgttgtccgt

SEQ ID NO: 4273631 - DNA, 23 bp, Homo sapiens
cccaggtgttgtccgtgtctgtt

SEQ ID NO: 4273632 - DNA, 14 bp, Homo sapiens
cccagtccccggga

SEQ ID NO: 4273633 - DNA, 15 bp, Homo sapiens
cccagtgtccccagg

SEQ ID NO: 4273634 - DNA, 14 bp, Homo sapiens
cccagtgtggactc

SEQ ID NO: 4273635 - DNA, 20 bp, Homo sapiens
cccagtgtggactctggact

SEQ ID NO: 4273636 - DNA, 11 bp, Homo sapiens
cccatatcatg

SEQ ID NO: 4273637 - DNA, 12 bp, Homo sapiens
cccatccagcgt

SEQ ID NO: 4273638 - DNA, 19 bp, Homo sapiens
cccatccctttctaagcag

SEQ ID NO: 4273639 - DNA, 16 bp, Homo sapiens
cccatcgccttctggg

SEQ ID NO: 4273640 - DNA, 12 bp, Homo sapiens
cccatctcactt

SEQ ID NO: 4273641 - DNA, 15 bp, Homo sapiens
cccatgcatggcctc

SEQ ID NO: 4273642 - DNA, 13 bp, Homo sapiens
cccatgccctccc

SEQ ID NO: 4273643 - DNA, 21 bp, Homo sapiens
cccatgccctccgtcctggca

SEQ ID NO: 4273644 - DNA, 18 bp, Homo sapiens
cccatttgtaatgtatct

SEQ ID NO: 4273645 - DNA, 15 bp, Homo sapiens
ccccaaaaccacagc

SEQ ID NO: 4273646 - DNA, 16 bp, Homo sapiens
ccccaaaaccacagcc

SEQ ID NO: 4273647 - DNA, 23 bp, Homo sapiens
ccccaaaaccacagccctgtcag

SEQ ID NO: 4273648 - DNA, 18 bp, Homo sapiens
ccccaaactgtagtaatt

SEQ ID NO: 4273649 - DNA, 18 bp, Homo sapiens
ccccaaatgttctttcct

SEQ ID NO: 4273650 - DNA, 15 bp, Homo sapiens
ccccaaccctgcccc

SEQ ID NO: 4273651 - DNA, 23 bp, Homo sapiens
ccccaaccctgcccctgccccgt

SEQ ID NO: 4273652 - DNA, 12 bp, Homo sapiens
ccccaaggaaga

SEQ ID NO: 4273653 - DNA, 17 bp, Homo sapiens
ccccaaggaagaacaaa

SEQ ID NO: 4273654 - DNA, 15 bp, Homo sapiens
ccccacacaggcctg

SEQ ID NO: 4273655 - DNA, 21 bp, Homo sapiens
ccccacacaggcctggcccag

SEQ ID NO: 4273656 - DNA, 21 bp, Homo sapiens
aggcctgaactaggtgctggc

SEQ ID NO: 4273657 - DNA, 22 bp, Homo sapiens
aggcctgccccccttcccaccc

SEQ ID NO: 4273658 - DNA, 13 bp, Homo sapiens
aggcctggagttg

SEQ ID NO: 4273659 - DNA, 10 bp, Homo sapiens
aggcctggcc

SEQ ID NO: 4273660 - DNA, 12 bp, Homo sapiens
aggcctggccca

SEQ ID NO: 4273661 - DNA, 16 bp, Homo sapiens
aggcctggcccagcca

SEQ ID NO: 4273662 - DNA, 18 bp, Homo sapiens
aggcctggcccagccagc

SEQ ID NO: 4273663 - DNA, 20 bp, Homo sapiens
aggcctggcccagccagcag

SEQ ID NO: 4273664 - DNA, 15 bp, Homo sapiens
aggcctggtctggag

SEQ ID NO: 4273665 - DNA, 21 bp, Homo sapiens
aggcctggtctggagccccta

SEQ ID NO: 4273666 - DNA, 24 bp, Homo sapiens
aggcctggtctggagcccctatcc

SEQ ID NO: 4273667 - DNA, 15 bp, Homo sapiens
aggcctggtgccctg

SEQ ID NO: 4273668 - DNA, 18 bp, Homo sapiens
aggcctggtgccctggcc

SEQ ID NO: 4273669 - DNA, 22 bp, Homo sapiens
aggcctggtgccctggcccagc

SEQ ID NO: 4273670 - DNA, 12 bp, Homo sapiens
aggccttgcctt

SEQ ID NO: 4273671 - DNA, 14 bp, Homo sapiens
aggccttgccttgt

SEQ ID NO: 4273672 - DNA, 16 bp, Homo sapiens
aggcctttttgagcca

SEQ ID NO: 4273673 - DNA, 22 bp, Homo sapiens
aggcgagccagattaggcctgg

SEQ ID NO: 4273674 - DNA, 23 bp, Homo sapiens
aggcgagccagattaggcctgga

SEQ ID NO: 4273675 - DNA, 14 bp, Homo sapiens
aggcgccccttccc

SEQ ID NO: 4273676 - DNA, 15 bp, Homo sapiens
aggcgccttcctggg

SEQ ID NO: 4273677 - DNA, 17 bp, Homo sapiens
aggcggtatccagaggt

SEQ ID NO: 4273678 - DNA, 16 bp, Homo sapiens
aggcgtagggccaggg

SEQ ID NO: 4273679 - DNA, 18 bp, Homo sapiens
aggcgtagggccagggct

SEQ ID NO: 4273680 - DNA, 22 bp, Homo sapiens
aggcgtagggccagggctctgg

SEQ ID NO: 4273681 - DNA, 16 bp, Homo sapiens
aggcgtcttgtatttt

SEQ ID NO: 4273682 - DNA, 13 bp, Homo sapiens
aggcgtgcagggg

SEQ ID NO: 4273683 - DNA, 17 bp, Homo sapiens
aggctcccactgcccct

SEQ ID NO: 4273684 - DNA, 20 bp, Homo sapiens
aggctccctccctccctgct

SEQ ID NO: 4273685 - DNA, 23 bp, Homo sapiens
aggctctaattctctaggaaagt

SEQ ID NO: 4273686 - DNA, 20 bp, Homo sapiens
aggctctgaaagctgcttct

SEQ ID NO: 4273687 - DNA, 17 bp, Homo sapiens
aggctctgttccacata

SEQ ID NO: 4273688 - DNA, 13 bp, Homo sapiens
aggctcttctcct

SEQ ID NO: 4273689 - DNA, 21 bp, Homo sapiens
aggctgccccacccctccatg

SEQ ID NO: 4273690 - DNA, 12 bp, Homo sapiens
aggctggagctg

SEQ ID NO: 4273691 - DNA, 14 bp, Homo sapiens
aggctggagctggc

SEQ ID NO: 4273692 - DNA, 14 bp, Homo sapiens
aggctggatgctgg

SEQ ID NO: 4273693 - DNA, 21 bp, Homo sapiens
aggctggggcttttgtgccag

SEQ ID NO: 4273694 - DNA, 20 bp, Homo sapiens
aggctgggtggccggccctg

SEQ ID NO: 4273695 - DNA, 19 bp, Homo sapiens
aggctggtggacagaccca

SEQ ID NO: 4273696 - DNA, 20 bp, Homo sapiens
aggctgtattttcttttata

SEQ ID NO: 4273697 - DNA, 23 bp, Homo sapiens
aggctgtattttcttttatatct

SEQ ID NO: 4273698 - DNA, 17 bp, Homo sapiens
aggcttccggctgagct

SEQ ID NO: 4273699 - DNA, 18 bp, Homo sapiens
aggcttccggctgagctg

SEQ ID NO: 4273700 - DNA, 23 bp, Homo sapiens
aggcttccggctgagctgtgcca

SEQ ID NO: 4273701 - DNA, 14 bp, Homo sapiens
aggcttcctgccct

SEQ ID NO: 4273702 - DNA, 14 bp, Homo sapiens
aggcttccttcatt

SEQ ID NO: 4273703 - DNA, 16 bp, Homo sapiens
aggcttccttcatttc

SEQ ID NO: 4273704 - DNA, 12 bp, Homo sapiens
aggcttctccac

SEQ ID NO: 4273705 - DNA, 21 bp, Homo sapiens
aggcttgcattaaaagactgt

SEQ ID NO: 4273706 - DNA, 22 bp, Homo sapiens
aggcttgggaccgccagatggg

SEQ ID NO: 4273707 - DNA, 15 bp, Homo sapiens
aggcttgtcagagct

SEQ ID NO: 4273708 - DNA, 16 bp, Homo sapiens
aggcttgtcagagctg

SEQ ID NO: 4273709 - DNA, 13 bp, Homo sapiens
aggctttttccat

SEQ ID NO: 4273710 - DNA, 20 bp, Homo sapiens
agggaaaacataatatcttg

SEQ ID NO: 4273711 - DNA, 21 bp, Homo sapiens
agggaaacccggggaactggt

SEQ ID NO: 4273712 - DNA, 12 bp, Homo sapiens
agggaaaccttt

SEQ ID NO: 4273713 - DNA, 16 bp, Homo sapiens
agggaaatccaactcc

SEQ ID NO: 4273714 - DNA, 13 bp, Homo sapiens
agggaaatgctgt

SEQ ID NO: 4273715 - DNA, 15 bp, Homo sapiens
agggaaatgctgttg

SEQ ID NO: 4273716 - DNA, 19 bp, Homo sapiens
agggaaatgctgttggtga

SEQ ID NO: 4273717 - DNA, 18 bp, Homo sapiens
agggaacagacctcggct

SEQ ID NO: 4273718 - DNA, 12 bp, Homo sapiens
agggaagaaatc

SEQ ID NO: 4273719 - DNA, 14 bp, Homo sapiens
agggaatgaatcca

SEQ ID NO: 4273720 - DNA, 18 bp, Homo sapiens
agggaattgaggtctgct

SEQ ID NO: 4273721 - DNA, 21 bp, Homo sapiens
agggacagccaaaagtaagtg

SEQ ID NO: 4273722 - DNA, 21 bp, Homo sapiens
agggacagcgggtaaaaagag

SEQ ID NO: 4273723 - DNA, 15 bp, Homo sapiens
agggacagtgggcta

SEQ ID NO: 4273724 - DNA, 21 bp, Homo sapiens
agggaccaaggacccctcacc

SEQ ID NO: 4273725 - DNA, 17 bp, Homo sapiens
agggactaggagcactg

SEQ ID NO: 4273726 - DNA, 17 bp, Homo sapiens
agggactggtccaggca

SEQ ID NO: 4273727 - DNA, 20 bp, Homo sapiens
agggactggtccaggcatgg

SEQ ID NO: 4273728 - DNA, 15 bp, Homo sapiens
agggagaaggagagg

SEQ ID NO: 4273729 - DNA, 22 bp, Homo sapiens
agggagactgacccattcacat

SEQ ID NO: 4273730 - DNA, 19 bp, Homo sapiens
agggagcactggaggcctc

SEQ ID NO: 4273731 - DNA, 22 bp, Homo sapiens
agggaggaatcgaggaaccaga

SEQ ID NO: 4273732 - DNA, 18 bp, Homo sapiens
agggaggcctgaggggca

SEQ ID NO: 4273733 - DNA, 14 bp, Homo sapiens
agggcactggtggc

SEQ ID NO: 4273734 - DNA, 15 bp, Homo sapiens
agggcaggagcctag

SEQ ID NO: 4273735 - DNA, 17 bp, Homo sapiens
agggcaggagcctagag

SEQ ID NO: 4273736 - DNA, 18 bp, Homo sapiens
agggcaggagcctagagg

SEQ ID NO: 4273737 - DNA, 22 bp, Homo sapiens
agggcaggagcctagaggagga

SEQ ID NO: 4273738 - DNA, 15 bp, Homo sapiens
agggcaggcagagct

SEQ ID NO: 4273739 - DNA, 17 bp, Homo sapiens
agggcaggcagagctca

SEQ ID NO: 4273740 - DNA, 19 bp, Homo sapiens
agggcagggttctagaagg

SEQ ID NO: 4273741 - DNA, 20 bp, Homo sapiens
agggcagggttctagaaggg

SEQ ID NO: 4273742 - DNA, 13 bp, Homo sapiens
agggcatctccag

SEQ ID NO: 4273743 - DNA, 14 bp, Homo sapiens
agggcatctccagg

SEQ ID NO: 4273744 - DNA, 16 bp, Homo sapiens
agggcatctccaggaa

SEQ ID NO: 4273745 - DNA, 16 bp, Homo sapiens
agggccagggctctgg

SEQ ID NO: 4273746 - DNA, 17 bp, Homo sapiens
agggccagggctctggc

SEQ ID NO: 4273747 - DNA, 24 bp, Homo sapiens
agggccagtcatggctgtcccctg

SEQ ID NO: 4273748 - DNA, 17 bp, Homo sapiens
agggcccccacaggagc

SEQ ID NO: 4273749 - DNA, 20 bp, Homo sapiens
agggcccctcactggctgga

SEQ ID NO: 4273750 - DNA, 13 bp, Homo sapiens
agggcccctgaag

SEQ ID NO: 4273751 - DNA, 23 bp, Homo sapiens
agggcccctgaagtgaccccagc

SEQ ID NO: 4273752 - DNA, 11 bp, Homo sapiens
agggccctgct

SEQ ID NO: 4273753 - DNA, 15 bp, Homo sapiens
agggccctgctcagg

SEQ ID NO: 4273754 - DNA, 15 bp, Homo sapiens
agggcgggccaggag

SEQ ID NO: 4273755 - DNA, 14 bp, Homo sapiens
agggcggggctggc

SEQ ID NO: 4273756 - DNA, 21 bp, Homo sapiens
agggcggggctggccagctgt

SEQ ID NO: 4273757 - DNA, 22 bp, Homo sapiens
agggctctggcaggtggccagg

SEQ ID NO: 4273758 - DNA, 19 bp, Homo sapiens
agggctggattggcaggtg

SEQ ID NO: 4273759 - DNA, 23 bp, Homo sapiens
aggggaaaccttcacccagcacc

SEQ ID NO: 4273760 - DNA, 22 bp, Homo sapiens
aggggaagtgtgctgaggtggg

SEQ ID NO: 4273761 - DNA, 15 bp, Homo sapiens
aggggacagatcttg

SEQ ID NO: 4273762 - DNA, 12 bp, Homo sapiens
aggggactgcat

SEQ ID NO: 4273763 - DNA, 16 bp, Homo sapiens
aggggactgcatgcaa

SEQ ID NO: 4273764 - DNA, 19 bp, Homo sapiens
aggggactgcatgcaagct

SEQ ID NO: 4273765 - DNA, 23 bp, Homo sapiens
aggggagacttaggccagaggtg

SEQ ID NO: 4273766 - DNA, 13 bp, Homo sapiens
aggggagagaagg

SEQ ID NO: 4273767 - DNA, 23 bp, Homo sapiens
catcaatacttttgtgtattctg

SEQ ID NO: 4273768 - DNA, 14 bp, Homo sapiens
catcagaagtggta

SEQ ID NO: 4273769 - DNA, 14 bp, Homo sapiens
catcagcaagacaa

SEQ ID NO: 4273770 - DNA, 23 bp, Homo sapiens
catcagcagtgattgaagtatct

SEQ ID NO: 4273771 - DNA, 12 bp, Homo sapiens
catcagcccctg

SEQ ID NO: 4273772 - DNA, 18 bp, Homo sapiens
catcagcccctgctgctc

SEQ ID NO: 4273773 - DNA, 23 bp, Homo sapiens
ccacatagtgatggttcccctgt

SEQ ID NO: 4273774 - DNA, 22 bp, Homo sapiens
ccacatccaacatttcctcagg

SEQ ID NO: 4273775 - DNA, 16 bp, Homo sapiens
ccacatccattccaga

SEQ ID NO: 4273776 - DNA, 18 bp, Homo sapiens
ccacatccattccagagc

SEQ ID NO: 4273777 - DNA, 19 bp, Homo sapiens
cccggcccccctctcgggc

SEQ ID NO: 4273778 - DNA, 17 bp, Homo sapiens
cccggctctgaggctgc

SEQ ID NO: 4273779 - DNA, 14 bp, Homo sapiens
cccgggaggaggat

SEQ ID NO: 4273780 - DNA, 20 bp, Homo sapiens
cccggggcatggacagggcc

SEQ ID NO: 4273781 - DNA, 20 bp, Homo sapiens
cccgggtttggcgggccaag

SEQ ID NO: 4273782 - DNA, 18 bp, Homo sapiens
cccggtgcccaagaatag

SEQ ID NO: 4273783 - DNA, 20 bp, Homo sapiens
cccgtgccacgcgctctgca

SEQ ID NO: 4273784 - DNA, 18 bp, Homo sapiens
cccgtgtggccccttcac

SEQ ID NO: 4273785 - DNA, 17 bp, Homo sapiens
cccgtttccaagcctgg

SEQ ID NO: 4273786 - DNA, 22 bp, Homo sapiens
ccctacccggctcgttccccca

SEQ ID NO: 4273787 - DNA, 20 bp, Homo sapiens
ccctagcagtttgcctctgc

SEQ ID NO: 4273788 - DNA, 16 bp, Homo sapiens
ccctaggtctccaccc

SEQ ID NO: 4273789 - DNA, 21 bp, Homo sapiens
ccctaggtctccacccctcaa

SEQ ID NO: 4273790 - DNA, 19 bp, Homo sapiens
ccctaggtgggtcaactcc

SEQ ID NO: 4273791 - DNA, 24 bp, Homo sapiens
ccctaggtgggtcaactccaaggc

SEQ ID NO: 4273792 - DNA, 13 bp, Homo sapiens
ccctagttctttg

SEQ ID NO: 4273793 - DNA, 18 bp, Homo sapiens
ccctatcctgcaccctct

SEQ ID NO: 4273794 - DNA, 20 bp, Homo sapiens
ccctatcctgcaccctctgc

SEQ ID NO: 4273795 - DNA, 23 bp, Homo sapiens
ccctcacctgggcacctggggag

SEQ ID NO: 4273796 - DNA, 18 bp, Homo sapiens
ccctcaccttgcaacaca

SEQ ID NO: 4273797 - DNA, 14 bp, Homo sapiens
ccctcactccactc

SEQ ID NO: 4273798 - DNA, 22 bp, Homo sapiens
ccctcactccactcccctcatc

SEQ ID NO: 4273799 - DNA, 12 bp, Homo sapiens
ccctcactggct

SEQ ID NO: 4273800 - DNA, 14 bp, Homo sapiens
ccctcactggctgg

SEQ ID NO: 4273801 - DNA, 16 bp, Homo sapiens
ccctcactggctggac

SEQ ID NO: 4273802 - DNA, 22 bp, Homo sapiens
ccctcactggctggactggagg

SEQ ID NO: 4273803 - DNA, 13 bp, Homo sapiens
ccctcagagccac

SEQ ID NO: 4273804 - DNA, 16 bp, Homo sapiens
ccctcagccacgcctc

SEQ ID NO: 4273805 - DNA, 22 bp, Homo sapiens
ccctcagccacgcctctctcag

SEQ ID NO: 4273806 - DNA, 12 bp, Homo sapiens
ccctcagcccct

SEQ ID NO: 4273807 - DNA, 17 bp, Homo sapiens
ccctcagcccctcttgc

SEQ ID NO: 4273808 - DNA, 13 bp, Homo sapiens
ccctcaggcttgg

SEQ ID NO: 4273809 - DNA, 18 bp, Homo sapiens
ccctcatcacacgtcaca

SEQ ID NO: 4273810 - DNA, 13 bp, Homo sapiens
ccctcatccacta

SEQ ID NO: 4273811 - DNA, 17 bp, Homo sapiens
ccctccacacctccacc

SEQ ID NO: 4273812 - DNA, 18 bp, Homo sapiens
ccctccacacctccaccc

SEQ ID NO: 4273813 - DNA, 12 bp, Homo sapiens
ccctccactcct

SEQ ID NO: 4273814 - DNA, 14 bp, Homo sapiens
ccctccactcctcc

SEQ ID NO: 4273815 - DNA, 11 bp, Homo sapiens
ccctccagacc

SEQ ID NO: 4273816 - DNA, 19 bp, Homo sapiens
ccctccagacccctaccct

SEQ ID NO: 4273817 - DNA, 22 bp, Homo sapiens
ccctccagacccctaccctttc

SEQ ID NO: 4273818 - DNA, 21 bp, Homo sapiens
ccctccatgtagaagagggag

SEQ ID NO: 4273819 - DNA, 22 bp, Homo sapiens
ccctccatgtagaagagggaga

SEQ ID NO: 4273820 - DNA, 14 bp, Homo sapiens
ccctccccaaggaa

SEQ ID NO: 4273821 - DNA, 23 bp, Homo sapiens
ccctccccatggtgcagtgaaga

SEQ ID NO: 4273822 - DNA, 19 bp, Homo sapiens
ccctcccccggggtctcca

SEQ ID NO: 4273823 - DNA, 20 bp, Homo sapiens
ccctcccccggggtctccac

SEQ ID NO: 4273824 - DNA, 22 bp, Homo sapiens
ccctcccccggggtctccacct

SEQ ID NO: 4273825 - DNA, 13 bp, Homo sapiens
ccctccctcagcc

SEQ ID NO: 4273826 - DNA, 11 bp, Homo sapiens
ccctccctccc

SEQ ID NO: 4273827 - DNA, 17 bp, Homo sapiens
ccctccctggcctgttc

SEQ ID NO: 4273828 - DNA, 20 bp, Homo sapiens
ccctcctatcacctcccctc

SEQ ID NO: 4273829 - DNA, 18 bp, Homo sapiens
ccctcctgaaacttacac

SEQ ID NO: 4273830 - DNA, 14 bp, Homo sapiens
ccctcctggctcac

SEQ ID NO: 4273831 - DNA, 19 bp, Homo sapiens
ccctcctggctcacagcca

SEQ ID NO: 4273832 - DNA, 22 bp, Homo sapiens
ccctcctggctcacagccacca

SEQ ID NO: 4273833 - DNA, 15 bp, Homo sapiens
ccctcggagcctgtg

SEQ ID NO: 4273834 - DNA, 17 bp, Homo sapiens
ccctcggagcctgtgtt

SEQ ID NO: 4273835 - DNA, 17 bp, Homo sapiens
ccctcggggcaggaagt

SEQ ID NO: 4273836 - DNA, 17 bp, Homo sapiens
ccctcgtctccctggcc

SEQ ID NO: 4273837 - DNA, 15 bp, Homo sapiens
ccctctatttagcat

SEQ ID NO: 4273838 - DNA, 16 bp, Homo sapiens
ccctctcaggcatgcc

SEQ ID NO: 4273839 - DNA, 21 bp, Homo sapiens
ccctctcaggcatgcctgtgt

SEQ ID NO: 4273840 - DNA, 13 bp, Homo sapiens
ccctctccccgga

SEQ ID NO: 4273841 - DNA, 19 bp, Homo sapiens
ccctctcgggctctctcac

SEQ ID NO: 4273842 - DNA, 14 bp, Homo sapiens
ccctctctgtccaa

SEQ ID NO: 4273843 - DNA, 22 bp, Homo sapiens
ccctctcttaatgccacggcag

SEQ ID NO: 4273844 - DNA, 20 bp, Homo sapiens
ccctctgagtgaagtccagt

SEQ ID NO: 4273845 - DNA, 18 bp, Homo sapiens
ccctctgcccccagctgc

SEQ ID NO: 4273846 - DNA, 19 bp, Homo sapiens
ccctctgctatgtctgtga

SEQ ID NO: 4273847 - DNA, 13 bp, Homo sapiens
ccctcttccccct

SEQ ID NO: 4273848 - DNA, 14 bp, Homo sapiens
ccctcttccccctt

SEQ ID NO: 4273849 - DNA, 17 bp, Homo sapiens
ccctcttcccccttccc

SEQ ID NO: 4273850 - DNA, 20 bp, Homo sapiens
ccctgaagtgaccccagctc

SEQ ID NO: 4273851 - DNA, 22 bp, Homo sapiens
ccctgaagtgaccccagctcca

SEQ ID NO: 4273852 - DNA, 23 bp, Homo sapiens
ccctgaagtgaccccagctccag

SEQ ID NO: 4273853 - DNA, 16 bp, Homo sapiens
ccctgagaagcctcat

SEQ ID NO: 4273854 - DNA, 16 bp, Homo sapiens
ccctgagggcccttcc

SEQ ID NO: 4273855 - DNA, 18 bp, Homo sapiens
ccctgaggggcctgccac

SEQ ID NO: 4273856 - DNA, 22 bp, Homo sapiens
ccctgagggtttccaccttggc

SEQ ID NO: 4273857 - DNA, 14 bp, Homo sapiens
ccctgcaagtggac

SEQ ID NO: 4273858 - DNA, 13 bp, Homo sapiens
ccctgcacacacc

SEQ ID NO: 4273859 - DNA, 15 bp, Homo sapiens
ccctgcacacacctg

SEQ ID NO: 4273860 - DNA, 22 bp, Homo sapiens
ccctgcaggcggtatccagagg

SEQ ID NO: 4273861 - DNA, 18 bp, Homo sapiens
ccctgccaactttccaga

SEQ ID NO: 4273862 - DNA, 19 bp, Homo sapiens
ccggctgggcccgagggtc

SEQ ID NO: 4273863 - DNA, 17 bp, Homo sapiens
ccgggagatccgccctg

SEQ ID NO: 4273864 - DNA, 14 bp, Homo sapiens
ccggggagctgagg

SEQ ID NO: 4273865 - DNA, 18 bp, Homo sapiens
ccggggagctgaggggca

SEQ ID NO: 4273866 - DNA, 18 bp, Homo sapiens
ccggggcagctgccagag

SEQ ID NO: 4273867 - DNA, 21 bp, Homo sapiens
ccgggtgccccccatgccctc

SEQ ID NO: 4273868 - DNA, 22 bp, Homo sapiens
ccgggtgccccccatgccctcc

SEQ ID NO: 4273869 - DNA, 15 bp, Homo sapiens
ccgggtgcctgtgac

SEQ ID NO: 4273870 - DNA, 16 bp, Homo sapiens
ccgggtgcctgtgacc

SEQ ID NO: 4273871 - DNA, 19 bp, Homo sapiens
ccgtagactcacggctgca

SEQ ID NO: 4273872 - DNA, 14 bp, Homo sapiens
ccgtcatgctccca

SEQ ID NO: 4273873 - DNA, 16 bp, Homo sapiens
ccgtcctggcagggca

SEQ ID NO: 4273874 - DNA, 18 bp, Homo sapiens
ccgtcctggcagggcagg

SEQ ID NO: 4273875 - DNA, 18 bp, Homo sapiens
ccgtgcacggggccagca

SEQ ID NO: 4273876 - DNA, 17 bp, Homo sapiens
ccgtgccttcagctcta

SEQ ID NO: 4273877 - DNA, 11 bp, Homo sapiens
ccgtggcttcc

SEQ ID NO: 4273878 - DNA, 21 bp, Homo sapiens
ccgtggcttcccgctcagccc

SEQ ID NO: 4273879 - DNA, 21 bp, Homo sapiens
ccgtggtgaggttgtgctgcc

SEQ ID NO: 4273880 - DNA, 18 bp, Homo sapiens
ccgtgtctgtggccctct

SEQ ID NO: 4273881 - DNA, 18 bp, Homo sapiens
ccgtgtgctccagtgttt

SEQ ID NO: 4273882 - DNA, 13 bp, Homo sapiens
ccgtgtggcccct

SEQ ID NO: 4273883 - DNA, 14 bp, Homo sapiens
ccgtgtggcccctt

SEQ ID NO: 4273884 - DNA, 17 bp, Homo sapiens
ccgttgcctctctgcca

SEQ ID NO: 4273885 - DNA, 23 bp, Homo sapiens
ccgttgtgtgggtttactctgtg

SEQ ID NO: 4273886 - DNA, 13 bp, Homo sapiens
ccgtttccaagcc

SEQ ID NO: 4273887 - DNA, 14 bp, Homo sapiens
cctacaaatcagta

SEQ ID NO: 4273888 - DNA, 15 bp, Homo sapiens
cctacagtggaggga

SEQ ID NO: 4273889 - DNA, 17 bp, Homo sapiens
cctacccgcccgcgtcc

SEQ ID NO: 4273890 - DNA, 22 bp, Homo sapiens
cctagcacaaggagtgcccgcc

SEQ ID NO: 4273891 - DNA, 21 bp, Homo sapiens
cctagcagtttgcctctgcac

SEQ ID NO: 4273892 - DNA, 21 bp, Homo sapiens
cctaggagcagtgggccctgg

SEQ ID NO: 4273893 - DNA, 22 bp, Homo sapiens
cctaggagcagtgggccctggc

SEQ ID NO: 4273894 - DNA, 23 bp, Homo sapiens
cctaggagcagtgggccctggct

SEQ ID NO: 4273895 - DNA, 14 bp, Homo sapiens
cctaggagctgggg

SEQ ID NO: 4273896 - DNA, 17 bp, Homo sapiens
cctaggcatactctcca

SEQ ID NO: 4273897 - DNA, 15 bp, Homo sapiens
cctaggtctccaccc

SEQ ID NO: 4273898 - DNA, 21 bp, Homo sapiens
cctaggtctccacccctcaag

SEQ ID NO: 4273899 - DNA, 19 bp, Homo sapiens
cctagtggcttcagcccct

SEQ ID NO: 4273900 - DNA, 22 bp, Homo sapiens
cctagtggcttcagcccctggg

SEQ ID NO: 4273901 - DNA, 17 bp, Homo sapiens
cctatcacctcccctcc

SEQ ID NO: 4273902 - DNA, 18 bp, Homo sapiens
cctatcacctcccctcct

SEQ ID NO: 4273903 - DNA, 20 bp, Homo sapiens
cctatcagagaagcagcatc

SEQ ID NO: 4273904 - DNA, 15 bp, Homo sapiens
cctatcatcagttag

SEQ ID NO: 4273905 - DNA, 17 bp, Homo sapiens
cctatcctgcaccctct

SEQ ID NO: 4273906 - DNA, 18 bp, Homo sapiens
cctatgccacctgcagcg

SEQ ID NO: 4273907 - DNA, 18 bp, Homo sapiens
cctatgtcatttcatttc

SEQ ID NO: 4273908 - DNA, 22 bp, Homo sapiens
cctattctattgcagttataga

SEQ ID NO: 4273909 - DNA, 20 bp, Homo sapiens
cctcaaaaagatttccccat

SEQ ID NO: 4273910 - DNA, 22 bp, Homo sapiens
cctcaacaaagaagaaccatct

SEQ ID NO: 4273911 - DNA, 16 bp, Homo sapiens
cctcaaccctccctca

SEQ ID NO: 4273912 - DNA, 19 bp, Homo sapiens
cctcaaccctccctcagcc

SEQ ID NO: 4273913 - DNA, 15 bp, Homo sapiens
cctcaagccaggaga

SEQ ID NO: 4273914 - DNA, 16 bp, Homo sapiens
cctcaagccaggagac

SEQ ID NO: 4273915 - DNA, 23 bp, Homo sapiens
cctcaagccaggagaccctgtct

SEQ ID NO: 4273916 - DNA, 15 bp, Homo sapiens
cctcacctggcttcc

SEQ ID NO: 4273917 - DNA, 13 bp, Homo sapiens
cctgcgcaggccc

SEQ ID NO: 4273918 - DNA, 15 bp, Homo sapiens
cctgcgccctccctc

SEQ ID NO: 4273919 - DNA, 23 bp, Homo sapiens
cctgcgccctccctccctccaca

SEQ ID NO: 4273920 - DNA, 21 bp, Homo sapiens
cctgcgccctgacatgctaac

SEQ ID NO: 4273921 - DNA, 15 bp, Homo sapiens
cctgcgtggcctggg

SEQ ID NO: 4273922 - DNA, 16 bp, Homo sapiens
cctgcgtggcctgggg

SEQ ID NO: 4273923 - DNA, 12 bp, Homo sapiens
cctgctcaggcc

SEQ ID NO: 4273924 - DNA, 19 bp, Homo sapiens
cctgctcaggcctcacctg

SEQ ID NO: 4273925 - DNA, 22 bp, Homo sapiens
cctgctcaggcctcacctggct

SEQ ID NO: 4273926 - DNA, 16 bp, Homo sapiens
cctgctccctgctccc

SEQ ID NO: 4273927 - DNA, 23 bp, Homo sapiens
cctgctgagtggtccacattctg

SEQ ID NO: 4273928 - DNA, 19 bp, Homo sapiens
cctgctgcctccccaaccc

SEQ ID NO: 4273929 - DNA, 16 bp, Homo sapiens
cctgctgtgggtcagt

SEQ ID NO: 4273930 - DNA, 23 bp, Homo sapiens
cctgctttgggctgccctggtgc

SEQ ID NO: 4273931 - DNA, 13 bp, Homo sapiens
cctggaaagccct

SEQ ID NO: 4273932 - DNA, 16 bp, Homo sapiens
cctggacacagtcagg

SEQ ID NO: 4273933 - DNA, 17 bp, Homo sapiens
cctggacacagtcaggg

SEQ ID NO: 4273934 - DNA, 18 bp, Homo sapiens
cctggacccagcaggggc

SEQ ID NO: 4273935 - DNA, 19 bp, Homo sapiens
cctggacgcatgcagggcc

SEQ ID NO: 4273936 - DNA, 13 bp, Homo sapiens
cctggagaactag

SEQ ID NO: 4273937 - DNA, 15 bp, Homo sapiens
cctggagcccggcag

SEQ ID NO: 4273938 - DNA, 21 bp, Homo sapiens
cctggaggacaaaacagcggg

SEQ ID NO: 4273939 - DNA, 22 bp, Homo sapiens
cctggaggacaaaacagcggga

SEQ ID NO: 4273940 - DNA, 13 bp, Homo sapiens
cctggatcccttt

SEQ ID NO: 4273941 - DNA, 19 bp, Homo sapiens
cctggatggatctgctcca

SEQ ID NO: 4273942 - DNA, 20 bp, Homo sapiens
cctggattttctttctatgt

SEQ ID NO: 4273943 - DNA, 21 bp, Homo sapiens
cctggattttctttctatgta

SEQ ID NO: 4273944 - DNA, 17 bp, Homo sapiens
cctggcacagggcagtg

SEQ ID NO: 4273945 - DNA, 17 bp, Homo sapiens
cctggcagaactgagct

SEQ ID NO: 4273946 - DNA, 20 bp, Homo sapiens
cctggcagaactgagctcct

SEQ ID NO: 4273947 - DNA, 12 bp, Homo sapiens
cctggcagccgt

SEQ ID NO: 4273948 - DNA, 13 bp, Homo sapiens
cctggcagggcag

SEQ ID NO: 4273949 - DNA, 14 bp, Homo sapiens
cctggcccagcctg

SEQ ID NO: 4273950 - DNA, 16 bp, Homo sapiens
cctggcccagtgagag

SEQ ID NO: 4273951 - DNA, 20 bp, Homo sapiens
cctggcccctcccacatccc

SEQ ID NO: 4273952 - DNA, 21 bp, Homo sapiens
cctggccctttcacccctctt

SEQ ID NO: 4273953 - DNA, 22 bp, Homo sapiens
cctggccctttcacccctcttc

SEQ ID NO: 4273954 - DNA, 11 bp, Homo sapiens
cctggcctgtt

SEQ ID NO: 4273955 - DNA, 19 bp, Homo sapiens
cctggcctgttctgttttg

SEQ ID NO: 4273956 - DNA, 14 bp, Homo sapiens
cctggctcacagcc

SEQ ID NO: 4273957 - DNA, 17 bp, Homo sapiens
cctggctcacagccacc

SEQ ID NO: 4273958 - DNA, 18 bp, Homo sapiens
cctggctcacagccacca

SEQ ID NO: 4273959 - DNA, 20 bp, Homo sapiens
cctggctcacagccaccacc

SEQ ID NO: 4273960 - DNA, 23 bp, Homo sapiens
cctggctcacagccaccacctgg

SEQ ID NO: 4273961 - DNA, 12 bp, Homo sapiens
cctggctcagcc

SEQ ID NO: 4273962 - DNA, 17 bp, Homo sapiens
cctggctcccacaggcc

SEQ ID NO: 4273963 - DNA, 16 bp, Homo sapiens
cctggctcccagggtc

SEQ ID NO: 4273964 - DNA, 15 bp, Homo sapiens
cctggcttcccagga

SEQ ID NO: 4273965 - DNA, 18 bp, Homo sapiens
cctggcttttcactgctg

SEQ ID NO: 4273966 - DNA, 19 bp, Homo sapiens
cctgggaaaagggcaggag

SEQ ID NO: 4273967 - DNA, 14 bp, Homo sapiens
cctgggagagtgag

SEQ ID NO: 4273968 - DNA, 22 bp, Homo sapiens
cctgggagagtgaggtcatccc

SEQ ID NO: 4273969 - DNA, 15 bp, Homo sapiens
cctgggagatgctgg

SEQ ID NO: 4273970 - DNA, 13 bp, Homo sapiens
cctgggcagccca

SEQ ID NO: 4273971 - DNA, 14 bp, Homo sapiens
cctgggcagcccag

SEQ ID NO: 4273972 - DNA, 19 bp, Homo sapiens
cctgggcagcccagagaga

SEQ ID NO: 4273973 - DNA, 20 bp, Homo sapiens
cctgggcatccccagccccc

SEQ ID NO: 4273974 - DNA, 14 bp, Homo sapiens
cctgggcatctggc

SEQ ID NO: 4273975 - DNA, 21 bp, Homo sapiens
cctgggcatctggccctgctg

SEQ ID NO: 4273976 - DNA, 14 bp, Homo sapiens
cctgggcatgtccc

SEQ ID NO: 4273977 - DNA, 18 bp, Homo sapiens
cctgggcatgtccccagt

SEQ ID NO: 4273978 - DNA, 19 bp, Homo sapiens
cctgggccactggcatctc

SEQ ID NO: 4273979 - DNA, 14 bp, Homo sapiens
cctgggccctaggc

SEQ ID NO: 4273980 - DNA, 18 bp, Homo sapiens
cctgggccctaggcatac

SEQ ID NO: 4273981 - DNA, 16 bp, Homo sapiens
cctgggcctgatggtg

SEQ ID NO: 4273982 - DNA, 15 bp, Homo sapiens
cctggggacggagca

SEQ ID NO: 4273983 - DNA, 18 bp, Homo sapiens
cctggggacggagcactg

SEQ ID NO: 4273984 - DNA, 18 bp, Homo sapiens
cctggggatgtggctgga

SEQ ID NO: 4273985 - DNA, 16 bp, Homo sapiens
cctgggggctgctgca

SEQ ID NO: 4273986 - DNA, 19 bp, Homo sapiens
cctgggggctgctgcactg

SEQ ID NO: 4273987 - DNA, 23 bp, Homo sapiens
cctgggggctgctgcactgccct

SEQ ID NO: 4273988 - DNA, 19 bp, Homo sapiens
cctggggggcacagccaga

SEQ ID NO: 4273989 - DNA, 20 bp, Homo sapiens
cctggggggcacagccagaa

SEQ ID NO: 4273990 - DNA, 19 bp, Homo sapiens
cctggggtggttggaggcc

SEQ ID NO: 4273991 - DNA, 21 bp, Homo sapiens
cctggggtggttggaggcctg

SEQ ID NO: 4273992 - DNA, 22 bp, Homo sapiens
cctggggtggttggaggcctgg

SEQ ID NO: 4273993 - DNA, 14 bp, Homo sapiens
cctgggtgtgctcc

SEQ ID NO: 4273994 - DNA, 22 bp, Homo sapiens
cctgggtgtgctccaggcttcc

SEQ ID NO: 4273995 - DNA, 20 bp, Homo sapiens
cctgggttggccagagggcc

SEQ ID NO: 4273996 - DNA, 17 bp, Homo sapiens
cctggtcctgcactgtc

SEQ ID NO: 4273997 - DNA, 21 bp, Homo sapiens
cctggtctggagcccctatcc

SEQ ID NO: 4273998 - DNA, 17 bp, Homo sapiens
cctggtgccctggccca

SEQ ID NO: 4273999 - DNA, 19 bp, Homo sapiens
cctggtggccaagcctgcc

SEQ ID NO: 4274000 - DNA, 17 bp, Homo sapiens
cctggtgtccctgcctg

SEQ ID NO: 4274001 - DNA, 14 bp, Homo sapiens
cctggtgtctagtt

SEQ ID NO: 4274002 - DNA, 15 bp, Homo sapiens
cctggttcccccagg

SEQ ID NO: 4274003 - DNA, 16 bp, Homo sapiens
cctggttcccccagga

SEQ ID NO: 4274004 - DNA, 23 bp, Homo sapiens
cctgtattgtctgacttctcagg

SEQ ID NO: 4274005 - DNA, 19 bp, Homo sapiens
cctgtcagtgcagcccgtg

SEQ ID NO: 4274006 - DNA, 19 bp, Homo sapiens
cctgtccacctgtgctgct

SEQ ID NO: 4274007 - DNA, 15 bp, Homo sapiens
cctgtccctctcagg

SEQ ID NO: 4274008 - DNA, 23 bp, Homo sapiens
cctgtccctgccccgccccccag

SEQ ID NO: 4274009 - DNA, 10 bp, Homo sapiens
cctgtccttc

SEQ ID NO: 4274010 - DNA, 18 bp, Homo sapiens
cctgtccttcccacggcc

SEQ ID NO: 4274011 - DNA, 14 bp, Homo sapiens
cctgtctttgctgt

SEQ ID NO: 4274012 - DNA, 18 bp, Homo sapiens
cctgtctttgctgtttat

SEQ ID NO: 4274013 - DNA, 19 bp, Homo sapiens
cctgtgaccggggtcctga

SEQ ID NO: 4274014 - DNA, 14 bp, Homo sapiens
cctgtgagatgtgt

SEQ ID NO: 4274015 - DNA, 20 bp, Homo sapiens
cctgtgatcgtgtgttgcca

SEQ ID NO: 4274016 - DNA, 15 bp, Homo sapiens
cctgtggagcccgca

SEQ ID NO: 4274017 - DNA, 17 bp, Homo sapiens
cctgtggagcccgcacc

SEQ ID NO: 4274018 - DNA, 18 bp, Homo sapiens
cctgtggagcccgcaccc

SEQ ID NO: 4274019 - DNA, 16 bp, Homo sapiens
cctgtggcctcagcat

SEQ ID NO: 4274020 - DNA, 17 bp, Homo sapiens
cctgtggcctcagcatc

SEQ ID NO: 4274021 - DNA, 17 bp, Homo sapiens
cctgtggcggtgcagtg

SEQ ID NO: 4274022 - DNA, 21 bp, Homo sapiens
cctgtggcggtgcagtggcaa

SEQ ID NO: 4274023 - DNA, 20 bp, Homo sapiens
cctgtggggatttctcccag

SEQ ID NO: 4274024 - DNA, 22 bp, Homo sapiens
cctgtggggatttctcccagct

SEQ ID NO: 4274025 - DNA, 18 bp, Homo sapiens
cctgtggtgaggtcctgt

SEQ ID NO: 4274026 - DNA, 16 bp, Homo sapiens
cctgttctcagagctc

SEQ ID NO: 4274027 - DNA, 23 bp, Homo sapiens
cctgttctcagagctccacagaa

SEQ ID NO: 4274028 - DNA, 13 bp, Homo sapiens
cctgttctgtgtc

SEQ ID NO: 4274029 - DNA, 14 bp, Homo sapiens
cctgttctgtgtct

SEQ ID NO: 4274030 - DNA, 18 bp, Homo sapiens
cctgttctgtgtctgctg

SEQ ID NO: 4274031 - DNA, 20 bp, Homo sapiens
cctgttctgtgtctgctgta

SEQ ID NO: 4274032 - DNA, 22 bp, Homo sapiens
cctgttgattaatttctgccat

SEQ ID NO: 4274033 - DNA, 23 bp, Homo sapiens
cctgttgattaatttctgccatt

SEQ ID NO: 4274034 - DNA, 23 bp, Homo sapiens
cctgttttattgagttctgaagg

SEQ ID NO: 4274035 - DNA, 15 bp, Homo sapiens
ccttaatatttcttc

SEQ ID NO: 4274036 - DNA, 19 bp, Homo sapiens
ccttaatatttcttcaaat

SEQ ID NO: 4274037 - DNA, 16 bp, Homo sapiens
ccttagaacctttctt

SEQ ID NO: 4274038 - DNA, 18 bp, Homo sapiens
ccttagaacctttcttac

SEQ ID NO: 4274039 - DNA, 22 bp, Homo sapiens
ccttcaaagtctcaatgaaata

SEQ ID NO: 4274040 - DNA, 14 bp, Homo sapiens
ccttcaaccattcc

SEQ ID NO: 4274041 - DNA, 14 bp, Homo sapiens
ccttcacccagcac

SEQ ID NO: 4274042 - DNA, 18 bp, Homo sapiens
ccttcactccctgtcata

SEQ ID NO: 4274043 - DNA, 20 bp, Homo sapiens
ccttcacttctgaccacact

SEQ ID NO: 4274044 - DNA, 22 bp, Homo sapiens
ccttcacttctgaccacacttc

SEQ ID NO: 4274045 - DNA, 16 bp, Homo sapiens
ccttcagtaaacacca

SEQ ID NO: 4274046 - DNA, 14 bp, Homo sapiens
ccttcataaattat

SEQ ID NO: 4274047 - DNA, 17 bp, Homo sapiens
ccttccacacttccacc

SEQ ID NO: 4274048 - DNA, 19 bp, Homo sapiens
ccttccacgctgtctccag

SEQ ID NO: 4274049 - DNA, 20 bp, Homo sapiens
ccttccacgctgtctccaga

SEQ ID NO: 4274050 - DNA, 13 bp, Homo sapiens
ccttccaggcccc

SEQ ID NO: 4274051 - DNA, 16 bp, Homo sapiens
ccttccaggccccagg

SEQ ID NO: 4274052 - DNA, 20 bp, Homo sapiens
ccttccaggcgtagggccag

SEQ ID NO: 4274053 - DNA, 15 bp, Homo sapiens
ccttcccaacctccc

SEQ ID NO: 4274054 - DNA, 15 bp, Homo sapiens
ccttcccacccctat

SEQ ID NO: 4274055 - DNA, 19 bp, Homo sapiens
ccttcccacggccactgca

SEQ ID NO: 4274056 - DNA, 12 bp, Homo sapiens
ccttccccactc

SEQ ID NO: 4274057 - DNA, 20 bp, Homo sapiens
ccttccccactgcctgccca

SEQ ID NO: 4274058 - DNA, 17 bp, Homo sapiens
ccttccctgacactgtc

SEQ ID NO: 4274059 - DNA, 15 bp, Homo sapiens
ccttcctctccactg

SEQ ID NO: 4274060 - DNA, 16 bp, Homo sapiens
ccttcctctccactgc

SEQ ID NO: 4274061 - DNA, 21 bp, Homo sapiens
ccttcctctccactgccttcg

SEQ ID NO: 4274062 - DNA, 12 bp, Homo sapiens
ccttcctgggtt

SEQ ID NO: 4274063 - DNA, 15 bp, Homo sapiens
ccttcctgttctgtg

SEQ ID NO: 4274064 - DNA, 22 bp, Homo sapiens
ccttcctgttctgtgtctgctg

SEQ ID NO: 4274065 - DNA, 20 bp, Homo sapiens
ccttcgatacaccgggcctg

SEQ ID NO: 4274066 - DNA, 22 bp, Homo sapiens
ccttctaatccatgtgctgctg

SEQ ID NO: 4274067 - DNA, 14 bp, Homo sapiens
ccttctacctgcag

SEQ ID NO: 4274068 - DNA, 16 bp, Homo sapiens
ccttctacctgcagga

SEQ ID NO: 4274069 - DNA, 14 bp, Homo sapiens
ccttctcccacact

SEQ ID NO: 4274070 - DNA, 12 bp, Homo sapiens
ccttctcccctc

SEQ ID NO: 4274071 - DNA, 15 bp, Homo sapiens
ccttctcccctccag

SEQ ID NO: 4274072 - DNA, 18 bp, Homo sapiens
ccttctcccctccagacc

SEQ ID NO: 4274073 - DNA, 20 bp, Homo sapiens
ccttctcccctccagacccc

SEQ ID NO: 4274074 - DNA, 21 bp, Homo sapiens
ccttctcccctccagacccct

SEQ ID NO: 4274075 - DNA, 22 bp, Homo sapiens
ccttctcccctccagaccccta

SEQ ID NO: 4274076 - DNA, 18 bp, Homo sapiens
ccttctctgttcatttcc

SEQ ID NO: 4274077 - DNA, 15 bp, Homo sapiens
ccttctgatgaaatg

SEQ ID NO: 4274078 - DNA, 22 bp, Homo sapiens
ccttctgcggagcttctccagc

SEQ ID NO: 4274079 - DNA, 23 bp, Homo sapiens
ccttctgcggagcttctccagcc

SEQ ID NO: 4274080 - DNA, 20 bp, Homo sapiens
ccttctggccgctgcagtca

SEQ ID NO: 4274081 - DNA, 18 bp, Homo sapiens
ccttctggctgctgcagt

SEQ ID NO: 4274082 - DNA, 20 bp, Homo sapiens
ccttctggctgctgcagtca

SEQ ID NO: 4274083 - DNA, 13 bp, Homo sapiens
ccttcttccattc

SEQ ID NO: 4274084 - DNA, 16 bp, Homo sapiens
ccttcttccattccca

SEQ ID NO: 4274085 - DNA, 14 bp, Homo sapiens
ccttgagacagctt

SEQ ID NO: 4274086 - DNA, 22 bp, Homo sapiens
ccttgaggacctccacctggga

SEQ ID NO: 4274087 - DNA, 22 bp, Homo sapiens
ccttgatgtcttgagagcgctg

SEQ ID NO: 4274088 - DNA, 21 bp, Homo sapiens
ccttgattttagccttctctg

SEQ ID NO: 4274089 - DNA, 22 bp, Homo sapiens
ccttgattttagccttctctgt

SEQ ID NO: 4274090 - DNA, 16 bp, Homo sapiens
ccttgcaacacacaga

SEQ ID NO: 4274091 - DNA, 18 bp, Homo sapiens
ccttgccgctgggagagc

SEQ ID NO: 4274092 - DNA, 23 bp, Homo sapiens
ccttgccgctgggagagccaagg

SEQ ID NO: 4274093 - DNA, 15 bp, Homo sapiens
ccttgcctcctgtgt

SEQ ID NO: 4274094 - DNA, 13 bp, Homo sapiens
ccttgctgctggc

SEQ ID NO: 4274095 - DNA, 21 bp, Homo sapiens
ccttggacggggacacggcct

SEQ ID NO: 4274096 - DNA, 21 bp, Homo sapiens
ccttggcccagcagcggccca

SEQ ID NO: 4274097 - DNA, 22 bp, Homo sapiens
ccttggcccagcagcggcccag

SEQ ID NO: 4274098 - DNA, 13 bp, Homo sapiens
ccttggcccctct

SEQ ID NO: 4274099 - DNA, 15 bp, Homo sapiens
ccttggcccctctct

SEQ ID NO: 4274100 - DNA, 19 bp, Homo sapiens
ccttgggatgggcacaggc

SEQ ID NO: 4274101 - DNA, 13 bp, Homo sapiens
ccttggttcctcc

SEQ ID NO: 4274102 - DNA, 17 bp, Homo sapiens
ccttggttcctccagca

SEQ ID NO: 4274103 - DNA, 19 bp, Homo sapiens
ccttgtagacgcacctgct

SEQ ID NO: 4274104 - DNA, 21 bp, Homo sapiens
ccttgtagacgcacctgctga

SEQ ID NO: 4274105 - DNA, 23 bp, Homo sapiens
ccttgtgtatgtgactccatatc

SEQ ID NO: 4274106 - DNA, 23 bp, Homo sapiens
ccttgtgtgagtgtgacgggggt

SEQ ID NO: 4274107 - DNA, 22 bp, Homo sapiens
ccttgtttgcctttaggcagga

SEQ ID NO: 4274108 - DNA, 14 bp, Homo sapiens
cctttaggcaggaa

SEQ ID NO: 4274109 - DNA, 20 bp, Homo sapiens
cctttatcatgtgtttctgt

SEQ ID NO: 4274110 - DNA, 18 bp, Homo sapiens
cctttcatcctcagcaag

SEQ ID NO: 4274111 - DNA, 19 bp, Homo sapiens
cctttcatcctcagcaagt

SEQ ID NO: 4274112 - DNA, 14 bp, Homo sapiens
cctttccctgcatc

SEQ ID NO: 4274113 - DNA, 18 bp, Homo sapiens
cctttccctgcatccctt

SEQ ID NO: 4274114 - DNA, 18 bp, Homo sapiens
cctttccgtgccgggagc

SEQ ID NO: 4274115 - DNA, 19 bp, Homo sapiens
cctttctaagcaggaaggt

SEQ ID NO: 4274116 - DNA, 22 bp, Homo sapiens
cctccctcctggctcacagcca

SEQ ID NO: 4274117 - DNA, 14 bp, Homo sapiens
cctccctgcagggt

SEQ ID NO: 4274118 - DNA, 21 bp, Homo sapiens
cctccctgcccctcccttcaa

SEQ ID NO: 4274119 - DNA, 14 bp, Homo sapiens
cctccctgctgcca

SEQ ID NO: 4274120 - DNA, 14 bp, Homo sapiens
cctccctggcctgt

SEQ ID NO: 4274121 - DNA, 15 bp, Homo sapiens
cctccctggcctgtt

SEQ ID NO: 4274122 - DNA, 21 bp, Homo sapiens
cctccgcgggggacaggaaca

SEQ ID NO: 4274123 - DNA, 14 bp, Homo sapiens
cctccggccctgcc

SEQ ID NO: 4274124 - DNA, 19 bp, Homo sapiens
cctccggccctgccccaca

SEQ ID NO: 4274125 - DNA, 21 bp, Homo sapiens
cctcctccagttctgatgagg

SEQ ID NO: 4274126 - DNA, 14 bp, Homo sapiens
cctcctgctgagtg

SEQ ID NO: 4274127 - DNA, 19 bp, Homo sapiens
cctcctggacccagcaggg

SEQ ID NO: 4274128 - DNA, 21 bp, Homo sapiens
cctcctggacccagcaggggc

SEQ ID NO: 4274129 - DNA, 16 bp, Homo sapiens
cctcctggctcacagc

SEQ ID NO: 4274130 - DNA, 17 bp, Homo sapiens
cctcctggctcacagcc

SEQ ID NO: 4274131 - DNA, 20 bp, Homo sapiens
cctcctggctcacagccacc

SEQ ID NO: 4274132 - DNA, 16 bp, Homo sapiens
cctccttagaaaagac

SEQ ID NO: 4274133 - DNA, 14 bp, Homo sapiens
cctccttccaggcc

SEQ ID NO: 4274134 - DNA, 19 bp, Homo sapiens
cctccttccaggccccagg

SEQ ID NO: 4274135 - DNA, 17 bp, Homo sapiens
cctccttctcccctcca

SEQ ID NO: 4274136 - DNA, 19 bp, Homo sapiens
cctccttgccgctgggaga

SEQ ID NO: 4274137 - DNA, 20 bp, Homo sapiens
cctccttgccgctgggagag

SEQ ID NO: 4274138 - DNA, 14 bp, Homo sapiens
cctccttgcctcct

SEQ ID NO: 4274139 - DNA, 20 bp, Homo sapiens
cctccttgcctcctgtgtaa

SEQ ID NO: 4274140 - DNA, 18 bp, Homo sapiens
cctcgcttcataggcaga

SEQ ID NO: 4274141 - DNA, 12 bp, Homo sapiens
cctcggagcctg

SEQ ID NO: 4274142 - DNA, 13 bp, Homo sapiens
cctcggagcctgt

SEQ ID NO: 4274143 - DNA, 18 bp, Homo sapiens
cctcggccagagctccca

SEQ ID NO: 4274144 - DNA, 20 bp, Homo sapiens
cctcggccagagctcccagg

SEQ ID NO: 4274145 - DNA, 13 bp, Homo sapiens
cctcggctgtgtg

SEQ ID NO: 4274146 - DNA, 18 bp, Homo sapiens
cctcgtctccctggccac

SEQ ID NO: 4274147 - DNA, 19 bp, Homo sapiens
cctcgtctccctggccacc

SEQ ID NO: 4274148 - DNA, 18 bp, Homo sapiens
cctcgtctttgcttgtcc

SEQ ID NO: 4274149 - DNA, 20 bp, Homo sapiens
cctctcaggcatgcctgtgt

SEQ ID NO: 4274150 - DNA, 19 bp, Homo sapiens
cctctccactgccttcgat

SEQ ID NO: 4274151 - DNA, 21 bp, Homo sapiens
cctctccccggacaagcccag

SEQ ID NO: 4274152 - DNA, 23 bp, Homo sapiens
cctctccccggacaagcccagga

SEQ ID NO: 4274153 - DNA, 14 bp, Homo sapiens
cctctcctgcatcc

SEQ ID NO: 4274154 - DNA, 16 bp, Homo sapiens
cctctctcagcccagg

SEQ ID NO: 4274155 - DNA, 13 bp, Homo sapiens
cctctctgccagc

SEQ ID NO: 4274156 - DNA, 14 bp, Homo sapiens
cctctctgccagcc

SEQ ID NO: 4274157 - DNA, 15 bp, Homo sapiens
cctctctgccagccg

SEQ ID NO: 4274158 - DNA, 21 bp, Homo sapiens
cctctctggccactctgctct

SEQ ID NO: 4274159 - DNA, 21 bp, Homo sapiens
cctctctgtttaccctccctg

SEQ ID NO: 4274160 - DNA, 19 bp, Homo sapiens
cctctcttaatgccacggc

SEQ ID NO: 4274161 - DNA, 18 bp, Homo sapiens
cctctgaactgctgctgg

SEQ ID NO: 4274162 - DNA, 18 bp, Homo sapiens
cctctgagtgaagtccag

SEQ ID NO: 4274163 - DNA, 20 bp, Homo sapiens
cctctgcaagattctgtggg

SEQ ID NO: 4274164 - DNA, 17 bp, Homo sapiens
cctctgcacgtgcacac

SEQ ID NO: 4274165 - DNA, 17 bp, Homo sapiens
cctctgccactgacagg

SEQ ID NO: 4274166 - DNA, 19 bp, Homo sapiens
cctctgcctgtccctctca

SEQ ID NO: 4274167 - DNA, 17 bp, Homo sapiens
cctctgcctgtgcccgc

SEQ ID NO: 4274168 - DNA, 16 bp, Homo sapiens
cctctgggcaggacct

SEQ ID NO: 4274169 - DNA, 17 bp, Homo sapiens
cctctgggctcacacca

SEQ ID NO: 4274170 - DNA, 16 bp, Homo sapiens
cctctggtctgggtgc

SEQ ID NO: 4274171 - DNA, 16 bp, Homo sapiens
cctctggtttggggcg

SEQ ID NO: 4274172 - DNA, 18 bp, Homo sapiens
cctctggtttggggcgag

SEQ ID NO: 4274173 - DNA, 21 bp, Homo sapiens
cctctggtttggggcgaggca

SEQ ID NO: 4274174 - DNA, 22 bp, Homo sapiens
cctcttcccaccaactctctct

SEQ ID NO: 4274175 - DNA, 12 bp, Homo sapiens
cctcttccccct

SEQ ID NO: 4274176 - DNA, 14 bp, Homo sapiens
cctcttcccccttc

SEQ ID NO: 4274177 - DNA, 15 bp, Homo sapiens
cctcttcccccttcc

SEQ ID NO: 4274178 - DNA, 15 bp, Homo sapiens
cggctgggcccgagg

SEQ ID NO: 4274179 - DNA, 20 bp, Homo sapiens
cgggaaagccagtgactcca

SEQ ID NO: 4274180 - DNA, 20 bp, Homo sapiens
cgggaaaggccggtgggaag

SEQ ID NO: 4274181 - DNA, 14 bp, Homo sapiens
cgggacctgtggct

SEQ ID NO: 4274182 - DNA, 19 bp, Homo sapiens
cgggagatccgccctgggc

SEQ ID NO: 4274183 - DNA, 21 bp, Homo sapiens
cgggagatccgccctgggctc

SEQ ID NO: 4274184 - DNA, 14 bp, Homo sapiens
cgggagcctgcgtg

SEQ ID NO: 4274185 - DNA, 21 bp, Homo sapiens
cgggcacccccggacgccccc

SEQ ID NO: 4274186 - DNA, 12 bp, Homo sapiens
cgggccaaggac

SEQ ID NO: 4274187 - DNA, 17 bp, Homo sapiens
cgggctaagtccagctc

SEQ ID NO: 4274188 - DNA, 19 bp, Homo sapiens
cgggctaagtccagctctc

SEQ ID NO: 4274189 - DNA, 14 bp, Homo sapiens
cggggcagctgcca

SEQ ID NO: 4274190 - DNA, 13 bp, Homo sapiens
cggggcaggaagt

SEQ ID NO: 4274191 - DNA, 17 bp, Homo sapiens
cggggcaggaagtccct

SEQ ID NO: 4274192 - DNA, 22 bp, Homo sapiens
cggggccagcatccatgcggcc

SEQ ID NO: 4274193 - DNA, 14 bp, Homo sapiens
cggggccaggatgg

SEQ ID NO: 4274194 - DNA, 11 bp, Homo sapiens
cggggccatgg

SEQ ID NO: 4274195 - DNA, 13 bp, Homo sapiens
cgggggacaggaa

SEQ ID NO: 4274196 - DNA, 18 bp, Homo sapiens
cgggggaggccgaggcag

SEQ ID NO: 4274197 - DNA, 19 bp, Homo sapiens
cgggggaggccgaggcagg

SEQ ID NO: 4274198 - DNA, 17 bp, Homo sapiens
cggggtcctgaggctgg

SEQ ID NO: 4274199 - DNA, 11 bp, Homo sapiens
cgggtctgtgg

SEQ ID NO: 4274200 - DNA, 15 bp, Homo sapiens
cgggtgcctgtgacc

SEQ ID NO: 4274201 - DNA, 22 bp, Homo sapiens
cgggtgcctgtgaccggggtcc

SEQ ID NO: 4274202 - DNA, 19 bp, Homo sapiens
cgggtttggcgggccaagg

SEQ ID NO: 4274203 - DNA, 23 bp, Homo sapiens
cgggtttggcgggccaaggactg

SEQ ID NO: 4274204 - DNA, 13 bp, Homo sapiens
cggtgagactctg

SEQ ID NO: 4274205 - DNA, 16 bp, Homo sapiens
cggtgagactctgagg

SEQ ID NO: 4274206 - DNA, 23 bp, Homo sapiens
cggtgcagtggcaaaggatccag

SEQ ID NO: 4274207 - DNA, 21 bp, Homo sapiens
cggtgggagccgtcagcctgt

SEQ ID NO: 4274208 - DNA, 21 bp, Homo sapiens
cggtgtagggaacggcctgag

SEQ ID NO: 4274209 - DNA, 17 bp, Homo sapiens
cggttgtaggactaaat

SEQ ID NO: 4274210 - DNA, 15 bp, Homo sapiens
cgtatgttatacaac

SEQ ID NO: 4274211 - DNA, 21 bp, Homo sapiens
cgtcacagcagtacttgctca

SEQ ID NO: 4274212 - DNA, 18 bp, Homo sapiens
cgtcaccatctcaggcca

SEQ ID NO: 4274213 - DNA, 16 bp, Homo sapiens
cgtccacggctctagg

SEQ ID NO: 4274214 - DNA, 15 bp, Homo sapiens
cgtccctctccccgg

SEQ ID NO: 4274215 - DNA, 20 bp, Homo sapiens
cgtccctgagggcccttccc

SEQ ID NO: 4274216 - DNA, 23 bp, Homo sapiens
cgtccctgagggcccttcccaac

SEQ ID NO: 4274217 - DNA, 15 bp, Homo sapiens
cgtcctggcagggca

SEQ ID NO: 4274218 - DNA, 20 bp, Homo sapiens
cgtctccctggccacccttg

SEQ ID NO: 4274219 - DNA, 22 bp, Homo sapiens
cgtctgagcggccgcctgtcct

SEQ ID NO: 4274220 - DNA, 14 bp, Homo sapiens
cgtctggtgttctc

SEQ ID NO: 4274221 - DNA, 15 bp, Homo sapiens
cgtcttgtattttct

SEQ ID NO: 4274222 - DNA, 19 bp, Homo sapiens
cgtgacttcagactctctc

SEQ ID NO: 4274223 - DNA, 22 bp, Homo sapiens
cgtgacttcagactctctcctc

SEQ ID NO: 4274224 - DNA, 19 bp, Homo sapiens
cgtgagagcccaatcactg

SEQ ID NO: 4274225 - DNA, 12 bp, Homo sapiens
cgtgaggagggg

SEQ ID NO: 4274226 - DNA, 13 bp, Homo sapiens
cgtgaggaggggg

SEQ ID NO: 4274227 - DNA, 12 bp, Homo sapiens
cgtgcacacacc

SEQ ID NO: 4274228 - DNA, 18 bp, Homo sapiens
cgtgcacacacctgcaca

SEQ ID NO: 4274229 - DNA, 17 bp, Homo sapiens
cgtgccaaatcctgggc

SEQ ID NO: 4274230 - DNA, 21 bp, Homo sapiens
accagatgacacataaatctg

SEQ ID NO: 4274231 - DNA, 15 bp, Homo sapiens
accagcagcacaatt

SEQ ID NO: 4274232 - DNA, 12 bp, Homo sapiens
accagccctggt

SEQ ID NO: 4274233 - DNA, 15 bp, Homo sapiens
accagcctcagtgca

SEQ ID NO: 4274234 - DNA, 13 bp, Homo sapiens
accagctggctct

SEQ ID NO: 4274235 - DNA, 14 bp, Homo sapiens
accagctggctctg

SEQ ID NO: 4274236 - DNA, 22 bp, Homo sapiens
accaggaaattctgtttatgtt

SEQ ID NO: 4274237 - DNA, 15 bp, Homo sapiens
accaggaagaaggcc

SEQ ID NO: 4274238 - DNA, 14 bp, Homo sapiens
accaggaaggaaga

SEQ ID NO: 4274239 - DNA, 16 bp, Homo sapiens
accaggaaggaagagc

SEQ ID NO: 4274240 - DNA, 20 bp, Homo sapiens
accaggaaggaagagcaagc

SEQ ID NO: 4274241 - DNA, 22 bp, Homo sapiens
accaggactctgccttccaggc

SEQ ID NO: 4274242 - DNA, 22 bp, Homo sapiens
accagggggaagcaccagcctc

SEQ ID NO: 4274243 - DNA, 14 bp, Homo sapiens
accagggtttagtt

SEQ ID NO: 4274244 - DNA, 15 bp, Homo sapiens
accagtcttttgaaa

SEQ ID NO: 4274245 - DNA, 13 bp, Homo sapiens
accatagaactgt

SEQ ID NO: 4274246 - DNA, 15 bp, Homo sapiens
accatagcttaagaa

SEQ ID NO: 4274247 - DNA, 19 bp, Homo sapiens
accatagcttaagaagtat

SEQ ID NO: 4274248 - DNA, 18 bp, Homo sapiens
accatatgattgaaaaga

SEQ ID NO: 4274249 - DNA, 19 bp, Homo sapiens
accatatgattgaaaagaa

SEQ ID NO: 4274250 - DNA, 21 bp, Homo sapiens
accatccatccctggtgaaag

SEQ ID NO: 4274251 - DNA, 18 bp, Homo sapiens
accatcccctcctagcac

SEQ ID NO: 4274252 - DNA, 13 bp, Homo sapiens
accatctcaggcc

SEQ ID NO: 4274253 - DNA, 15 bp, Homo sapiens
accatctcaggccac

SEQ ID NO: 4274254 - DNA, 16 bp, Homo sapiens
accatctcaggccacc

SEQ ID NO: 4274255 - DNA, 21 bp, Homo sapiens
accatctcaggccacctgccc

SEQ ID NO: 4274256 - DNA, 17 bp, Homo sapiens
accatgaagaacataaa

SEQ ID NO: 4274257 - DNA, 17 bp, Homo sapiens
accatgaagatgccatt

SEQ ID NO: 4274258 - DNA, 18 bp, Homo sapiens
acctgcacaccgtccctc

SEQ ID NO: 4274259 - DNA, 21 bp, Homo sapiens
acctgcacaccgtccctctcc

SEQ ID NO: 4274260 - DNA, 13 bp, Homo sapiens
acctgcagcccca

SEQ ID NO: 4274261 - DNA, 18 bp, Homo sapiens
acctgcagccccaggcct

SEQ ID NO: 4274262 - DNA, 19 bp, Homo sapiens
acctgcagccccaggcctc

SEQ ID NO: 4274263 - DNA, 18 bp, Homo sapiens
acctgcaggactcgggct

SEQ ID NO: 4274264 - DNA, 15 bp, Homo sapiens
acctgcagttggcct

SEQ ID NO: 4274265 - DNA, 20 bp, Homo sapiens
acctgcagttggcctcagca

SEQ ID NO: 4274266 - DNA, 22 bp, Homo sapiens
acctgcagttggcctcagcaga

SEQ ID NO: 4274267 - DNA, 18 bp, Homo sapiens
acctgcccccactcagca

SEQ ID NO: 4274268 - DNA, 15 bp, Homo sapiens
acctgcccccgctct

SEQ ID NO: 4274269 - DNA, 17 bp, Homo sapiens
acctgcccccttctccc

SEQ ID NO: 4274270 - DNA, 19 bp, Homo sapiens
acctgcccccttctcccac

SEQ ID NO: 4274271 - DNA, 23 bp, Homo sapiens
acctgcccccttctcccacactg

SEQ ID NO: 4274272 - DNA, 23 bp, Homo sapiens
acctgctgcccgtgaggaggggg

SEQ ID NO: 4274273 - DNA, 14 bp, Homo sapiens
acctgctggcccct

SEQ ID NO: 4274274 - DNA, 15 bp, Homo sapiens
acctgctggcccctc

SEQ ID NO: 4274275 - DNA, 16 bp, Homo sapiens
acctgctggcccctca

SEQ ID NO: 4274276 - DNA, 19 bp, Homo sapiens
acctgctggcccctcacct

SEQ ID NO: 4274277 - DNA, 21 bp, Homo sapiens
acctgcttgtgttgggcccca

SEQ ID NO: 4274278 - DNA, 15 bp, Homo sapiens
acctggatggatctg

SEQ ID NO: 4274279 - DNA, 21 bp, Homo sapiens
actccagacccctggcttttc

SEQ ID NO: 4274280 - DNA, 13 bp, Homo sapiens
actccaggagagg

SEQ ID NO: 4274281 - DNA, 14 bp, Homo sapiens
actccaggagagga

SEQ ID NO: 4274282 - DNA, 19 bp, Homo sapiens
actccagggttaaagaaag

SEQ ID NO: 4274283 - DNA, 23 bp, Homo sapiens
actccatatcccgggagcagttg

SEQ ID NO: 4274284 - DNA, 14 bp, Homo sapiens
actcccaggggcct

SEQ ID NO: 4274285 - DNA, 17 bp, Homo sapiens
actccccttgagctgag

SEQ ID NO: 4274286 - DNA, 14 bp, Homo sapiens
actcctacctggta

SEQ ID NO: 4274287 - DNA, 14 bp, Homo sapiens
actccttctcccca

SEQ ID NO: 4274288 - DNA, 23 bp, Homo sapiens
actccttgattttagccttctct

SEQ ID NO: 4274289 - DNA, 20 bp, Homo sapiens
actcgggctaagtccagctc

SEQ ID NO: 4274290 - DNA, 21 bp, Homo sapiens
actcgggctaagtccagctct

SEQ ID NO: 4274291 - DNA, 22 bp, Homo sapiens
actctattttttactacataat

SEQ ID NO: 4274292 - DNA, 14 bp, Homo sapiens
actctcctgaggag

SEQ ID NO: 4274293 - DNA, 15 bp, Homo sapiens
actctctcctctctc

SEQ ID NO: 4274294 - DNA, 18 bp, Homo sapiens
aaagaggcgtcttgtatt

SEQ ID NO: 4274295 - DNA, 21 bp, Homo sapiens
aaagatggtaatcttttctga

SEQ ID NO: 4274296 - DNA, 15 bp, Homo sapiens
aaagattaacaacac

SEQ ID NO: 4274297 - DNA, 17 bp, Homo sapiens
aaagattttatgtgctt

SEQ ID NO: 4274298 - DNA, 23 bp, Homo sapiens
aaagattttatgtgcttgaagat

SEQ ID NO: 4274299 - DNA, 12 bp, Homo sapiens
aaagcacatcca

SEQ ID NO: 4274300 - DNA, 17 bp, Homo sapiens
aaagcatattgactttt

SEQ ID NO: 4274301 - DNA, 20 bp, Homo sapiens
aaagcatctattcccaaaga

SEQ ID NO: 4274302 - DNA, 18 bp, Homo sapiens
aaagccacataaccagcg

SEQ ID NO: 4274303 - DNA, 14 bp, Homo sapiens
aaaggaaacctttt

SEQ ID NO: 4274304 - DNA, 22 bp, Homo sapiens
aaaggactgttttttcctgagc

SEQ ID NO: 4274305 - DNA, 21 bp, Homo sapiens
aaaggatccagatagcctagg

SEQ ID NO: 4274306 - DNA, 20 bp, Homo sapiens
aaaggcccaaaccaggggga

SEQ ID NO: 4274307 - DNA, 17 bp, Homo sapiens
aaaggctggtggacaga

SEQ ID NO: 4274308 - DNA, 19 bp, Homo sapiens
aaagggcagcccctcccca

SEQ ID NO: 4274309 - DNA, 11 bp, Homo sapiens
aaagggcagga

SEQ ID NO: 4274310 - DNA, 16 bp, Homo sapiens
aaaggtcatattggaa

SEQ ID NO: 4274311 - DNA, 12 bp, Homo sapiens
aaagtagtactt

SEQ ID NO: 4274312 - DNA, 17 bp, Homo sapiens
aaagtatctctactttc

SEQ ID NO: 4274313 - DNA, 21 bp, Homo sapiens
aaagtatctctactttcctga

SEQ ID NO: 4274314 - DNA, 23 bp, Homo sapiens
aaagtcacagccgtttgaatata

SEQ ID NO: 4274315 - DNA, 14 bp, Homo sapiens
aaagtcagatgttt

SEQ ID NO: 4274316 - DNA, 18 bp, Homo sapiens
aaagtctcaatgaaatag

SEQ ID NO: 4274317 - DNA, 14 bp, Homo sapiens
aaagtctcctgtat

SEQ ID NO: 4274318 - DNA, 17 bp, Homo sapiens
aaagtctcctgtatcat

SEQ ID NO: 4274319 - DNA, 17 bp, Homo sapiens
aaagtctgtctgcactg

SEQ ID NO: 4274320 - DNA, 19 bp, Homo sapiens
aaagtgagaaaactgtgac

SEQ ID NO: 4274321 - DNA, 14 bp, Homo sapiens
aaagtgcactgtgt

SEQ ID NO: 4274322 - DNA, 15 bp, Homo sapiens
aaagtgcactgtgtc

SEQ ID NO: 4274323 - DNA, 21 bp, Homo sapiens
aaagtgctttgctggagtcct

SEQ ID NO: 4274324 - DNA, 23 bp, Homo sapiens
aaagtgctttgctggagtcctgt

SEQ ID NO: 4274325 - DNA, 16 bp, Homo sapiens
aaagtgtaaaatagaa

SEQ ID NO: 4274326 - DNA, 17 bp, Homo sapiens
aaagtgtaaaatagaat

SEQ ID NO: 4274327 - DNA, 16 bp, Homo sapiens
aaagttaatcttcatg

SEQ ID NO: 4274328 - DNA, 20 bp, Homo sapiens
aaagttagggcatttttctt

SEQ ID NO: 4274329 - DNA, 22 bp, Homo sapiens
aaagttagggcatttttcttgg

SEQ ID NO: 4274330 - DNA, 12 bp, Homo sapiens
aaagttttcaga

SEQ ID NO: 4274331 - DNA, 18 bp, Homo sapiens
aaataaaacttgagccca

SEQ ID NO: 4274332 - DNA, 14 bp, Homo sapiens
aaataaaccttaat

SEQ ID NO: 4274333 - DNA, 16 bp, Homo sapiens
aaataaataatctcat

SEQ ID NO: 4274334 - DNA, 19 bp, Homo sapiens
aaataaataatctcatccc

SEQ ID NO: 4274335 - DNA, 14 bp, Homo sapiens
aaataacatattct

SEQ ID NO: 4274336 - DNA, 20 bp, Homo sapiens
aaataacatattcttgcttt

SEQ ID NO: 4274337 - DNA, 16 bp, Homo sapiens
aaataaccaaaaaatg

SEQ ID NO: 4274338 - DNA, 12 bp, Homo sapiens
aaataactgtgc

SEQ ID NO: 4274339 - DNA, 13 bp, Homo sapiens
aaataatgattta

SEQ ID NO: 4274340 - DNA, 21 bp, Homo sapiens
aaatacatgcctttccagtgc

SEQ ID NO: 4274341 - DNA, 13 bp, Homo sapiens
aaatacattccag

SEQ ID NO: 4274342 - DNA, 15 bp, Homo sapiens
aaatagtgttctttt

SEQ ID NO: 4274343 - DNA, 21 bp, Homo sapiens
aaatagtgttctttttaaaaa

SEQ ID NO: 4274344 - DNA, 18 bp, Homo sapiens
aaatagtttcaaatgagt

SEQ ID NO: 4274345 - DNA, 21 bp, Homo sapiens
aaatagtttcaaatgagttta

SEQ ID NO: 4274346 - DNA, 13 bp, Homo sapiens
aaatagttttcta

SEQ ID NO: 4274347 - DNA, 19 bp, Homo sapiens
aaatagttttctaaatgtt

SEQ ID NO: 4274348 - DNA, 21 bp, Homo sapiens
aaatagttttctaaatgtttc

SEQ ID NO: 4274349 - DNA, 16 bp, Homo sapiens
aaatatatatttatca

SEQ ID NO: 4274350 - DNA, 15 bp, Homo sapiens
aaatatctgtgaaat

SEQ ID NO: 4274351 - DNA, 21 bp, Homo sapiens
aaatatctgtgaaatatcatc

SEQ ID NO: 4274352 - DNA, 15 bp, Homo sapiens
aaatatcttgaaagg

SEQ ID NO: 4274353 - DNA, 13 bp, Homo sapiens
aaatatttctaag

SEQ ID NO: 4274354 - DNA, 16 bp, Homo sapiens
aaatatttgcttattt

SEQ ID NO: 4274355 - DNA, 22 bp, Homo sapiens
aaatcaacttgtcacaaagtga

SEQ ID NO: 4274356 - DNA, 16 bp, Homo sapiens
aaatcagaatctttaa

SEQ ID NO: 4274357 - DNA, 14 bp, Homo sapiens
aaatcagtcttgga

SEQ ID NO: 4274358 - DNA, 22 bp, Homo sapiens
aaatcatatttacctgtgaatc

SEQ ID NO: 4274359 - DNA, 11 bp, Homo sapiens
aaatcatcaaa

SEQ ID NO: 4274360 - DNA, 17 bp, Homo sapiens
aaatcatcaaagtgttt

SEQ ID NO: 4274361 - DNA, 21 bp, Homo sapiens
aaatccattttctaaactgtt

SEQ ID NO: 4274362 - DNA, 12 bp, Homo sapiens
aaatctgagcct

SEQ ID NO: 4274363 - DNA, 11 bp, Homo sapiens
aaatgaagaaa

SEQ ID NO: 4274364 - DNA, 14 bp, Homo sapiens
aaatgaatagtaca

SEQ ID NO: 4274365 - DNA, 14 bp, Homo sapiens
aaatgattccaaat

SEQ ID NO: 4274366 - DNA, 15 bp, Homo sapiens
aaatgattccaaata

SEQ ID NO: 4274367 - DNA, 17 bp, Homo sapiens
aaatgcaaagcacacct

SEQ ID NO: 4274368 - DNA, 16 bp, Homo sapiens
aaatgcatgatattgt

SEQ ID NO: 4274369 - DNA, 14 bp, Homo sapiens
aaatgctaatgtaa

SEQ ID NO: 4274370 - DNA, 21 bp, Homo sapiens
aaatgctgatttaaacttctt

SEQ ID NO: 4274371 - DNA, 13 bp, Homo sapiens
aaatgctgtatgt

SEQ ID NO: 4274372 - DNA, 15 bp, Homo sapiens
aaatggaacattaac

SEQ ID NO: 4274373 - DNA, 13 bp, Homo sapiens
aaatgtaactgtc

SEQ ID NO: 4274374 - DNA, 21 bp, Homo sapiens
aaatgtagcttcagtcattaa

SEQ ID NO: 4274375 - DNA, 13 bp, Homo sapiens
aaatgtattatgt

SEQ ID NO: 4274376 - DNA, 23 bp, Homo sapiens
aaatgtattatgtcctgtgagat

SEQ ID NO: 4274377 - DNA, 13 bp, Homo sapiens
aaatgtcctcaga

SEQ ID NO: 4274378 - DNA, 23 bp, Homo sapiens
aaatgttaacaatgcctattgta

SEQ ID NO: 4274379 - DNA, 16 bp, Homo sapiens
aaatgtttctttttct

SEQ ID NO: 4274380 - DNA, 20 bp, Homo sapiens
aaattacagaagaagctcct

SEQ ID NO: 4274381 - DNA, 13 bp, Homo sapiens
aaattagtgagat

SEQ ID NO: 4274382 - DNA, 15 bp, Homo sapiens
aaattagtgagattt

SEQ ID NO: 4274383 - DNA, 17 bp, Homo sapiens
aaattatttctaaaaca

SEQ ID NO: 4274384 - DNA, 21 bp, Homo sapiens
aaattatttctaaaacattaa

SEQ ID NO: 4274385 - DNA, 14 bp, Homo sapiens
aaattcaacaaatg

SEQ ID NO: 4274386 - DNA, 16 bp, Homo sapiens
aaattcaacaaatgat

SEQ ID NO: 4274387 - DNA, 20 bp, Homo sapiens
aaattcaacacttattttct

SEQ ID NO: 4274388 - DNA, 13 bp, Homo sapiens
aaattcacactgt

SEQ ID NO: 4274389 - DNA, 14 bp, Homo sapiens
aaattctagattac

SEQ ID NO: 4274390 - DNA, 16 bp, Homo sapiens
aaattgatgggtgggc

SEQ ID NO: 4274391 - DNA, 18 bp, Homo sapiens
aaattgcatttcctgaca

SEQ ID NO: 4274392 - DNA, 15 bp, Homo sapiens
aaattggtgataagt

SEQ ID NO: 4274393 - DNA, 19 bp, Homo sapiens
aaattggtgataagtggaa

SEQ ID NO: 4274394 - DNA, 14 bp, Homo sapiens
aaatttaatatact

SEQ ID NO: 4274395 - DNA, 21 bp, Homo sapiens
aaatttattcttatcttagga

SEQ ID NO: 4274396 - DNA, 17 bp, Homo sapiens
aaatttcacgattcatt

SEQ ID NO: 4274397 - DNA, 21 bp, Homo sapiens
aaatttcacgattcatttttg

SEQ ID NO: 4274398 - DNA, 13 bp, Homo sapiens
aacaaagaaatat

SEQ ID NO: 4274399 - DNA, 12 bp, Homo sapiens
aacaaattaaaa

SEQ ID NO: 4274400 - DNA, 21 bp, Homo sapiens
aacaactccaggaaaactgtt

SEQ ID NO: 4274401 - DNA, 15 bp, Homo sapiens
aacaagaggagcagg

SEQ ID NO: 4274402 - DNA, 14 bp, Homo sapiens
aacaagatttccct

SEQ ID NO: 4274403 - DNA, 22 bp, Homo sapiens
aacaagccaaacattcttattt

SEQ ID NO: 4274404 - DNA, 19 bp, Homo sapiens
aacaataaaagtgtccatt

SEQ ID NO: 4274405 - DNA, 17 bp, Homo sapiens
aacaatgcctattgtaa

SEQ ID NO: 4274406 - DNA, 15 bp, Homo sapiens
aacaattaattgtct

SEQ ID NO: 4274407 - DNA, 20 bp, Homo sapiens
aacacaagccacgcctgcga

SEQ ID NO: 4274408 - DNA, 12 bp, Homo sapiens
aacacaatcaaa

SEQ ID NO: 4274409 - DNA, 11 bp, Homo sapiens
aacacagctgt

SEQ ID NO: 4274410 - DNA, 12 bp, Homo sapiens
aacacatttcgt

SEQ ID NO: 4274411 - DNA, 15 bp, Homo sapiens
aacacctaagtgact

SEQ ID NO: 4274412 - DNA, 13 bp, Homo sapiens
aacacgtttagaa

SEQ ID NO: 4274413 - DNA, 12 bp, Homo sapiens
aacactggcccc

SEQ ID NO: 4274414 - DNA, 17 bp, Homo sapiens
aacacttattttctgaa

SEQ ID NO: 4274415 - DNA, 15 bp, Homo sapiens
aacagagtatatatg

SEQ ID NO: 4274416 - DNA, 17 bp, Homo sapiens
aacagagtatatatgta

SEQ ID NO: 4274417 - DNA, 16 bp, Homo sapiens
aacagatgtttgtttt

SEQ ID NO: 4274418 - DNA, 23 bp, Homo sapiens
aacagctaggttaataggaggac

SEQ ID NO: 4274419 - DNA, 14 bp, Homo sapiens
aacaggaccaggag

SEQ ID NO: 4274420 - DNA, 18 bp, Homo sapiens
aacaggaccaggagccag

SEQ ID NO: 4274421 - DNA, 21 bp, Homo sapiens
aacaggcgttctcagcctccg

SEQ ID NO: 4274422 - DNA, 14 bp, Homo sapiens
aacagtaatcagtt

SEQ ID NO: 4274423 - DNA, 14 bp, Homo sapiens
aacagtgtttccag

SEQ ID NO: 4274424 - DNA, 15 bp, Homo sapiens
aacagtgtttccagt

SEQ ID NO: 4274425 - DNA, 22 bp, Homo sapiens
aacagttctcccttcaactgta

SEQ ID NO: 4274426 - DNA, 15 bp, Homo sapiens
aacagttgcacagca

SEQ ID NO: 4274427 - DNA, 16 bp, Homo sapiens
aacataatatcttgaa

SEQ ID NO: 4274428 - DNA, 22 bp, Homo sapiens
aacataatatcttgaagaatat

SEQ ID NO: 4274429 - DNA, 18 bp, Homo sapiens
agccgagctctcctgggc

SEQ ID NO: 4274430 - DNA, 23 bp, Homo sapiens
agccggactttcggagttggggg

SEQ ID NO: 4274431 - DNA, 15 bp, Homo sapiens
agccggggagctgag

SEQ ID NO: 4274432 - DNA, 23 bp, Homo sapiens
agccggggagctgaggggcaggg

SEQ ID NO: 4274433 - DNA, 16 bp, Homo sapiens
agccgtgccttcagct

SEQ ID NO: 4274434 - DNA, 13 bp, Homo sapiens
agccgtggcttcc

SEQ ID NO: 4274435 - DNA, 20 bp, Homo sapiens
agcctaggggtcagggacca

SEQ ID NO: 4274436 - DNA, 17 bp, Homo sapiens
agcctagggtgagggtg

SEQ ID NO: 4274437 - DNA, 11 bp, Homo sapiens
agcctatggca

SEQ ID NO: 4274438 - DNA, 14 bp, Homo sapiens
agcctcaaatgcag

SEQ ID NO: 4274439 - DNA, 14 bp, Homo sapiens
agcctcacccctgc

SEQ ID NO: 4274440 - DNA, 11 bp, Homo sapiens
agcctcacctt

SEQ ID NO: 4274441 - DNA, 13 bp, Homo sapiens
agcctcagccact

SEQ ID NO: 4274442 - DNA, 14 bp, Homo sapiens
agcctcaggcctgg

SEQ ID NO: 4274443 - DNA, 16 bp, Homo sapiens
agcctccacctgcagc

SEQ ID NO: 4274444 - DNA, 19 bp, Homo sapiens
agcctccacctgcagcccc

SEQ ID NO: 4274445 - DNA, 18 bp, Homo sapiens
agcctccactccctgtct

SEQ ID NO: 4274446 - DNA, 21 bp, Homo sapiens
agcctccactccctgtctgaa

SEQ ID NO: 4274447 - DNA, 21 bp, Homo sapiens
agcctccctcagccacgcctc

SEQ ID NO: 4274448 - DNA, 14 bp, Homo sapiens
agcctcctgctgag

SEQ ID NO: 4274449 - DNA, 15 bp, Homo sapiens
agcctcgcccctcca

SEQ ID NO: 4274450 - DNA, 21 bp, Homo sapiens
agcctgcgtggcctggggctg

SEQ ID NO: 4274451 - DNA, 18 bp, Homo sapiens
agcctggacacagtcagg

SEQ ID NO: 4274452 - DNA, 18 bp, Homo sapiens
agcctggcacagggcagt

SEQ ID NO: 4274453 - DNA, 20 bp, Homo sapiens
agcctggcacagggcagtgg

SEQ ID NO: 4274454 - DNA, 17 bp, Homo sapiens
agcctggcccagtgaga

SEQ ID NO: 4274455 - DNA, 13 bp, Homo sapiens
agcctgggccact

SEQ ID NO: 4274456 - DNA, 19 bp, Homo sapiens
agcctgggccactggcatc

SEQ ID NO: 4274457 - DNA, 22 bp, Homo sapiens
agcctgggccactggcatctct

SEQ ID NO: 4274458 - DNA, 21 bp, Homo sapiens
agcctggggtgggtgtgagca

SEQ ID NO: 4274459 - DNA, 17 bp, Homo sapiens
agcctgtgaactgccag

SEQ ID NO: 4274460 - DNA, 16 bp, Homo sapiens
agcctgtggcctcagc

SEQ ID NO: 4274461 - DNA, 17 bp, Homo sapiens
agcctgtggcctcagca

SEQ ID NO: 4274462 - DNA, 13 bp, Homo sapiens
agcctgtgggaga

SEQ ID NO: 4274463 - DNA, 15 bp, Homo sapiens
agcctgtgggtcctt

SEQ ID NO: 4274464 - DNA, 17 bp, Homo sapiens
agccttaagtcttactg

SEQ ID NO: 4274465 - DNA, 22 bp, Homo sapiens
agccttaagtcttactgttttg

SEQ ID NO: 4274466 - DNA, 18 bp, Homo sapiens
agccttagtttcagctga

SEQ ID NO: 4274467 - DNA, 23 bp, Homo sapiens
agccttggggattcttccatctg

SEQ ID NO: 4274468 - DNA, 17 bp, Homo sapiens
agccttttattaacata

SEQ ID NO: 4274469 - DNA, 19 bp, Homo sapiens
agccttttattaacatata

SEQ ID NO: 4274470 - DNA, 21 bp, Homo sapiens
agcgaggcagaatggtgggct

SEQ ID NO: 4274471 - DNA, 20 bp, Homo sapiens
agcgcacctcgccgtgtctt

SEQ ID NO: 4274472 - DNA, 15 bp, Homo sapiens
agcgcccctccctag

SEQ ID NO: 4274473 - DNA, 17 bp, Homo sapiens
agcgctcctctgccttg

SEQ ID NO: 4274474 - DNA, 16 bp, Homo sapiens
agcgctggcctcttcc

SEQ ID NO: 4274475 - DNA, 16 bp, Homo sapiens
agcggccgcctgtcct

SEQ ID NO: 4274476 - DNA, 12 bp, Homo sapiens
agcggcctgggg

SEQ ID NO: 4274477 - DNA, 22 bp, Homo sapiens
agcggcttccccattgccttct

SEQ ID NO: 4274478 - DNA, 16 bp, Homo sapiens
agcgggtaaaaagaga

SEQ ID NO: 4274479 - DNA, 17 bp, Homo sapiens
agcgggtaaaaagagaa

SEQ ID NO: 4274480 - DNA, 21 bp, Homo sapiens
agcgtgtcctatccccggacc

SEQ ID NO: 4274481 - DNA, 18 bp, Homo sapiens
agctaaattacaattgtc

SEQ ID NO: 4274482 - DNA, 17 bp, Homo sapiens
agctaacactggcccct

SEQ ID NO: 4274483 - DNA, 16 bp, Homo sapiens
agctaatcagcattct

SEQ ID NO: 4274484 - DNA, 21 bp, Homo sapiens
agctaatcagcattctcactc

SEQ ID NO: 4274485 - DNA, 18 bp, Homo sapiens
agctataaaatgaataca

SEQ ID NO: 4274486 - DNA, 17 bp, Homo sapiens
agctataacaactctat

SEQ ID NO: 4274487 - DNA, 19 bp, Homo sapiens
agctataacaactctattt

SEQ ID NO: 4274488 - DNA, 16 bp, Homo sapiens
agctatatatgaataa

SEQ ID NO: 4274489 - DNA, 21 bp, Homo sapiens
agctatgaagagctagagaaa

SEQ ID NO: 4274490 - DNA, 15 bp, Homo sapiens
agctatgagagatgt

SEQ ID NO: 4274491 - DNA, 22 bp, Homo sapiens
agctatgctgtatctgtgcttt

SEQ ID NO: 4274492 - DNA, 16 bp, Homo sapiens
agctcaccctgctcct

SEQ ID NO: 4274493 - DNA, 17 bp, Homo sapiens
agctcacttcaagctca

SEQ ID NO: 4274494 - DNA, 14 bp, Homo sapiens
agctcagcacagcc

SEQ ID NO: 4274495 - DNA, 11 bp, Homo sapiens
agctcagccca

SEQ ID NO: 4274496 - DNA, 14 bp, Homo sapiens
agctcagcccaccc

SEQ ID NO: 4274497 - DNA, 14 bp, Homo sapiens
agctcaggagaagg

SEQ ID NO: 4274498 - DNA, 16 bp, Homo sapiens
agctcaggccctggtg

SEQ ID NO: 4274499 - DNA, 14 bp, Homo sapiens
agctcagggctgga

SEQ ID NO: 4274500 - DNA, 21 bp, Homo sapiens
agctcagggctggattggcag

SEQ ID NO: 4274501 - DNA, 22 bp, Homo sapiens
agctcagggctggattggcagg

SEQ ID NO: 4274502 - DNA, 23 bp, Homo sapiens
agctcagggctggattggcaggt

SEQ ID NO: 4274503 - DNA, 23 bp, Homo sapiens
agctcagggtgctccctcctcag

SEQ ID NO: 4274504 - DNA, 17 bp, Homo sapiens
agctcatcttcactgca

SEQ ID NO: 4274505 - DNA, 16 bp, Homo sapiens
agctccagacccccag

SEQ ID NO: 4274506 - DNA, 17 bp, Homo sapiens
agctccagacccccagc

SEQ ID NO: 4274507 - DNA, 21 bp, Homo sapiens
agctcccaggacgcagggaga

SEQ ID NO: 4274508 - DNA, 19 bp, Homo sapiens
agctcctgaatccctttca

SEQ ID NO: 4274509 - DNA, 13 bp, Homo sapiens
agctcgtgtgctt

SEQ ID NO: 4274510 - DNA, 17 bp, Homo sapiens
agctcgtgtgcttagaa

SEQ ID NO: 4274511 - DNA, 17 bp, Homo sapiens
agctctagacaaccctg

SEQ ID NO: 4274512 - DNA, 21 bp, Homo sapiens
agctctcccctgcgcaggccc

SEQ ID NO: 4274513 - DNA, 14 bp, Homo sapiens
agctctcctgggcc

SEQ ID NO: 4274514 - DNA, 18 bp, Homo sapiens
agctctcctgggccaggg

SEQ ID NO: 4274515 - DNA, 13 bp, Homo sapiens
agctcttcatgtt

SEQ ID NO: 4274516 - DNA, 16 bp, Homo sapiens
agctcttcatgtttca

SEQ ID NO: 4274517 - DNA, 16 bp, Homo sapiens
agctcttggcaggagt

SEQ ID NO: 4274518 - DNA, 21 bp, Homo sapiens
agctgaccagaagtggcagga

SEQ ID NO: 4274519 - DNA, 22 bp, Homo sapiens
agctgaccagaagtggcaggag

SEQ ID NO: 4274520 - DNA, 14 bp, Homo sapiens
agctgagctggcct

SEQ ID NO: 4274521 - DNA, 10 bp, Homo sapiens
agctgagggg

SEQ ID NO: 4274522 - DNA, 16 bp, Homo sapiens
agctgaggggcagggc

SEQ ID NO: 4274523 - DNA, 16 bp, Homo sapiens
agctgcaggaatcaaa

SEQ ID NO: 4274524 - DNA, 13 bp, Homo sapiens
agctgcttctgcc

SEQ ID NO: 4274525 - DNA, 15 bp, Homo sapiens
agctgcttctgccca

SEQ ID NO: 4274526 - DNA, 15 bp, Homo sapiens
agctggcaggagaca

SEQ ID NO: 4274527 - DNA, 15 bp, Homo sapiens
agctggcaggagggt

SEQ ID NO: 4274528 - DNA, 22 bp, Homo sapiens
agctggccgtggagtcgagctg

SEQ ID NO: 4274529 - DNA, 13 bp, Homo sapiens
agctggctctgca

SEQ ID NO: 4274530 - DNA, 18 bp, Homo sapiens
agctgtacaaagggaagc

SEQ ID NO: 4274531 - DNA, 11 bp, Homo sapiens
agctgtgccag

SEQ ID NO: 4274532 - DNA, 17 bp, Homo sapiens
agctgtgccagctgctt

SEQ ID NO: 4274533 - DNA, 20 bp, Homo sapiens
agctgtgccagctgcttctg

SEQ ID NO: 4274534 - DNA, 16 bp, Homo sapiens
agctgtggggagctgg

SEQ ID NO: 4274535 - DNA, 17 bp, Homo sapiens
agctgttctaatggatt

SEQ ID NO: 4274536 - DNA, 14 bp, Homo sapiens
agctgttctctgct

SEQ ID NO: 4274537 - DNA, 12 bp, Homo sapiens
agcttcaaaaca

SEQ ID NO: 4274538 - DNA, 13 bp, Homo sapiens
agcttcaaaacag

SEQ ID NO: 4274539 - DNA, 14 bp, Homo sapiens
agcttcaaaacaga

SEQ ID NO: 4274540 - DNA, 16 bp, Homo sapiens
agcttcaaaacagaac

SEQ ID NO: 4274541 - DNA, 11 bp, Homo sapiens
agcttccagat

SEQ ID NO: 4274542 - DNA, 14 bp, Homo sapiens
agcttctccagcca

SEQ ID NO: 4274543 - DNA, 13 bp, Homo sapiens
agcttgaatgtcc

SEQ ID NO: 4274544 - DNA, 23 bp, Homo sapiens
agcttgaatgtccccattctata

SEQ ID NO: 4274545 - DNA, 17 bp, Homo sapiens
agcttgatgctgtttct

SEQ ID NO: 4274546 - DNA, 19 bp, Homo sapiens
agcttgtttctatactgtt

SEQ ID NO: 4274547 - DNA, 12 bp, Homo sapiens
agctttcctggg

SEQ ID NO: 4274548 - DNA, 15 bp, Homo sapiens
agctttcctgggtct

SEQ ID NO: 4274549 - DNA, 22 bp, Homo sapiens
agctttgtcactgtttcactac

SEQ ID NO: 4274550 - DNA, 23 bp, Homo sapiens
aggaaaaaggctggtggacagac

SEQ ID NO: 4274551 - DNA, 19 bp, Homo sapiens
aggaaaaccaagccgtggc

SEQ ID NO: 4274552 - DNA, 20 bp, Homo sapiens
aggaaaaccaagccgtggct

SEQ ID NO: 4274553 - DNA, 21 bp, Homo sapiens
agttagggcatttttcttgga

SEQ ID NO: 4274554 - DNA, 12 bp, Homo sapiens
agttattaatag

SEQ ID NO: 4274555 - DNA, 16 bp, Homo sapiens
agttcaatcaaacttt

SEQ ID NO: 4274556 - DNA, 15 bp, Homo sapiens
agttcagcaaaactg

SEQ ID NO: 4274557 - DNA, 23 bp, Homo sapiens
agttcccaagaaaggaaaccttt

SEQ ID NO: 4274558 - DNA, 14 bp, Homo sapiens
agttctatttctat

SEQ ID NO: 4274559 - DNA, 23 bp, Homo sapiens
agttctatttctatctgcaaata

SEQ ID NO: 4274560 - DNA, 13 bp, Homo sapiens
agttctcacattt

SEQ ID NO: 4274561 - DNA, 13 bp, Homo sapiens
agttctgaaaact

SEQ ID NO: 4274562 - DNA, 20 bp, Homo sapiens
agttctgaaggttggaactg

SEQ ID NO: 4274563 - DNA, 13 bp, Homo sapiens
agttctggaggag

SEQ ID NO: 4274564 - DNA, 15 bp, Homo sapiens
agttctggaggagga

SEQ ID NO: 4274565 - DNA, 22 bp, Homo sapiens
agttgaggggcttccctctgct

SEQ ID NO: 4274566 - DNA, 14 bp, Homo sapiens
agttgatgaccaat

SEQ ID NO: 4274567 - DNA, 15 bp, Homo sapiens
agttgcaaagcattt

SEQ ID NO: 4274568 - DNA, 15 bp, Homo sapiens
agttgcacagcatct

SEQ ID NO: 4274569 - DNA, 16 bp, Homo sapiens
agttgcacagcatctc

SEQ ID NO: 4274570 - DNA, 14 bp, Homo sapiens
agttgctgtttact

SEQ ID NO: 4274571 - DNA, 20 bp, Homo sapiens
agttggcctcagcagaaggc

SEQ ID NO: 4274572 - DNA, 21 bp, Homo sapiens
agttgtaacattctatttcaa

SEQ ID NO: 4274573 - DNA, 16 bp, Homo sapiens
agtttaaaaaaataac

SEQ ID NO: 4274574 - DNA, 14 bp, Homo sapiens
agtttaccaatcaa

SEQ ID NO: 4274575 - DNA, 20 bp, Homo sapiens
agtttaccaatcaacagcat

SEQ ID NO: 4274576 - DNA, 22 bp, Homo sapiens
agtttcaagtatccttgttgac

SEQ ID NO: 4274577 - DNA, 17 bp, Homo sapiens
agtttgcaatcttatgt

SEQ ID NO: 4274578 - DNA, 15 bp, Homo sapiens
agtttgcctctgcac

SEQ ID NO: 4274579 - DNA, 16 bp, Homo sapiens
agtttgctaatgtttc

SEQ ID NO: 4274580 - DNA, 20 bp, Homo sapiens
agtttgctgtatacaaacag

SEQ ID NO: 4274581 - DNA, 21 bp, Homo sapiens
agtttgctgtatacaaacagg

SEQ ID NO: 4274582 - DNA, 15 bp, Homo sapiens
agtttgtgcaagaca

SEQ ID NO: 4274583 - DNA, 13 bp, Homo sapiens
agtttgttttctt

SEQ ID NO: 4274584 - DNA, 18 bp, Homo sapiens
agtttgttttctttttct

SEQ ID NO: 4274585 - DNA, 18 bp, Homo sapiens
ataaaaattctagattac

SEQ ID NO: 4274586 - DNA, 14 bp, Homo sapiens
ataaaacagtgttt

SEQ ID NO: 4274587 - DNA, 19 bp, Homo sapiens
ataaaacagtgtttccagt

SEQ ID NO: 4274588 - DNA, 16 bp, Homo sapiens
ataaacaacttaatgt

SEQ ID NO: 4274589 - DNA, 18 bp, Homo sapiens
ataaaccttaatatttct

SEQ ID NO: 4274590 - DNA, 19 bp, Homo sapiens
ataaactcagtcaaatgta

SEQ ID NO: 4274591 - DNA, 22 bp, Homo sapiens
ataaataaagaagaaaataacc

SEQ ID NO: 4274592 - DNA, 21 bp, Homo sapiens
ataaatactaaatatgaaatt

SEQ ID NO: 4274593 - DNA, 16 bp, Homo sapiens
ataaatatctatttat

SEQ ID NO: 4274594 - DNA, 22 bp, Homo sapiens
ataaatatctatttatctgtct

SEQ ID NO: 4274595 - DNA, 22 bp, Homo sapiens
ataaatctgtctgattctatgc

SEQ ID NO: 4274596 - DNA, 18 bp, Homo sapiens
ataaatcttccaaagttt

SEQ ID NO: 4274597 - DNA, 14 bp, Homo sapiens
ataaatgtgtgtat

SEQ ID NO: 4274598 - DNA, 20 bp, Homo sapiens
ataaatgtgtgtatgtgtgt

SEQ ID NO: 4274599 - DNA, 14 bp, Homo sapiens
ataaattatttcta

SEQ ID NO: 4274600 - DNA, 13 bp, Homo sapiens
ataacaactctat

SEQ ID NO: 4274601 - DNA, 15 bp, Homo sapiens
ataacaactctattt

SEQ ID NO: 4274602 - DNA, 22 bp, Homo sapiens
ataacaagccaaacattcttat

SEQ ID NO: 4274603 - DNA, 17 bp, Homo sapiens
ataacaatgtatgtgaa

SEQ ID NO: 4274604 - DNA, 20 bp, Homo sapiens
ataacatattcttgctttca

SEQ ID NO: 4274605 - DNA, 16 bp, Homo sapiens
ataacatctctttcat

SEQ ID NO: 4274606 - DNA, 20 bp, Homo sapiens
ataacatctgaaaagaaatg

SEQ ID NO: 4274607 - DNA, 20 bp, Homo sapiens
ataaccaaaaaatgtgagct

SEQ ID NO: 4274608 - DNA, 12 bp, Homo sapiens
ataaccagcggg

SEQ ID NO: 4274609 - DNA, 20 bp, Homo sapiens
ataactaagcaagtatattt

SEQ ID NO: 4274610 - DNA, 14 bp, Homo sapiens
ataagaagcaaata

SEQ ID NO: 4274611 - DNA, 16 bp, Homo sapiens
ataagcctcaggcctg

SEQ ID NO: 4274612 - DNA, 22 bp, Homo sapiens
ataagcctcaggcctggccctt

SEQ ID NO: 4274613 - DNA, 23 bp, Homo sapiens
ataagcctcaggcctggcccttt

SEQ ID NO: 4274614 - DNA, 22 bp, Homo sapiens
ataagtggaaaaaagagaaaaa

SEQ ID NO: 4274615 - DNA, 13 bp, Homo sapiens
ataataaaaatca

SEQ ID NO: 4274616 - DNA, 21 bp, Homo sapiens
ataataactagatctcctgta

SEQ ID NO: 4274617 - DNA, 21 bp, Homo sapiens
ataatacttaaaaatatgtga

SEQ ID NO: 4274618 - DNA, 17 bp, Homo sapiens
ataatactttgtataca

SEQ ID NO: 4274619 - DNA, 16 bp, Homo sapiens
ataatctcttcttata

SEQ ID NO: 4274620 - DNA, 23 bp, Homo sapiens
ataatgtttccctcaagaacaaa

SEQ ID NO: 4274621 - DNA, 21 bp, Homo sapiens
ataattagatccattaattta

SEQ ID NO: 4274622 - DNA, 22 bp, Homo sapiens
ataattagatccattaatttaa

SEQ ID NO: 4274623 - DNA, 15 bp, Homo sapiens
ataattatgtttacc

SEQ ID NO: 4274624 - DNA, 16 bp, Homo sapiens
ataattgcaagggaag

SEQ ID NO: 4274625 - DNA, 15 bp, Homo sapiens
ataattgtggagagg

SEQ ID NO: 4274626 - DNA, 16 bp, Homo sapiens
ataattgtggagagga

SEQ ID NO: 4274627 - DNA, 18 bp, Homo sapiens
ataatttcttactaaaca

SEQ ID NO: 4274628 - DNA, 19 bp, Homo sapiens
ataattttttagttaaaat

SEQ ID NO: 4274629 - DNA, 20 bp, Homo sapiens
ataattttttagttaaaatc

SEQ ID NO: 4274630 - DNA, 11 bp, Homo sapiens
atacaaacagg

SEQ ID NO: 4274631 - DNA, 19 bp, Homo sapiens
atacaaccttcatttaaaa

SEQ ID NO: 4274632 - DNA, 14 bp, Homo sapiens
atacagaatgaatc

SEQ ID NO: 4274633 - DNA, 15 bp, Homo sapiens
atacagtttttgtaa

SEQ ID NO: 4274634 - DNA, 18 bp, Homo sapiens
atacatcacgttaaagta

SEQ ID NO: 4274635 - DNA, 16 bp, Homo sapiens
atacatgatgatttca

SEQ ID NO: 4274636 - DNA, 19 bp, Homo sapiens
atacatgatgatttcagaa

SEQ ID NO: 4274637 - DNA, 18 bp, Homo sapiens
atacatggtttaaagtca

SEQ ID NO: 4274638 - DNA, 15 bp, Homo sapiens
atacatgtatagtga

SEQ ID NO: 4274639 - DNA, 16 bp, Homo sapiens
atacattaaaataact

SEQ ID NO: 4274640 - DNA, 14 bp, Homo sapiens
ataccccctgcccc

SEQ ID NO: 4274641 - DNA, 20 bp, Homo sapiens
ataccccctgccccagagaa

SEQ ID NO: 4274642 - DNA, 21 bp, Homo sapiens
ataccccctgccccagagaag

SEQ ID NO: 4274643 - DNA, 16 bp, Homo sapiens
ataccctaggtctcca

SEQ ID NO: 4274644 - DNA, 19 bp, Homo sapiens
ataccctaggtctccaccc

SEQ ID NO: 4274645 - DNA, 20 bp, Homo sapiens
ataccctaggtctccacccc

SEQ ID NO: 4274646 - DNA, 21 bp, Homo sapiens
ataccctaggtctccacccct

SEQ ID NO: 4274647 - DNA, 18 bp, Homo sapiens
atacctctctctatatat

SEQ ID NO: 4274648 - DNA, 15 bp, Homo sapiens
atactcaccaaaata

SEQ ID NO: 4274649 - DNA, 17 bp, Homo sapiens
atactcaccaaaatata

SEQ ID NO: 4274650 - DNA, 13 bp, Homo sapiens
atactcattagaa

SEQ ID NO: 4274651 - DNA, 13 bp, Homo sapiens
atactctccagga

SEQ ID NO: 4274652 - DNA, 21 bp, Homo sapiens
atactctgtgtaatctctgat

SEQ ID NO: 4274653 - DNA, 23 bp, Homo sapiens
atactctgtgtaatctctgatta

SEQ ID NO: 4274654 - DNA, 16 bp, Homo sapiens
atactgtctaagaata

SEQ ID NO: 4274655 - DNA, 13 bp, Homo sapiens
atactgtgtgtga

SEQ ID NO: 4274656 - DNA, 21 bp, Homo sapiens
atactgtgtgtgagtgtgaat

SEQ ID NO: 4274657 - DNA, 18 bp, Homo sapiens
atactgtttgtaatatac

SEQ ID NO: 4274658 - DNA, 14 bp, Homo sapiens
atacttggtcctta

SEQ ID NO: 4274659 - DNA, 17 bp, Homo sapiens
atacttggtccttaaaa

SEQ ID NO: 4274660 - DNA, 18 bp, Homo sapiens
atactttgcattgtctgt

SEQ ID NO: 4274661 - DNA, 13 bp, Homo sapiens
atacttttgtgta

SEQ ID NO: 4274662 - DNA, 18 bp, Homo sapiens
atacttttgtgtattctg

SEQ ID NO: 4274663 - DNA, 20 bp, Homo sapiens
atacttttgtgtattctgtg

SEQ ID NO: 4274664 - DNA, 17 bp, Homo sapiens
atagaaaaaaacattct

SEQ ID NO: 4274665 - DNA, 21 bp, Homo sapiens
atagaactgtcccacaaaata

SEQ ID NO: 4274666 - DNA, 17 bp, Homo sapiens
atagatcacggcatgtt

SEQ ID NO: 4274667 - DNA, 14 bp, Homo sapiens
atagatgcctgggc

SEQ ID NO: 4274668 - DNA, 15 bp, Homo sapiens
atagatgcctgggcc

SEQ ID NO: 4274669 - DNA, 23 bp, Homo sapiens
atagcctagggtgagggtgacag

SEQ ID NO: 4274670 - DNA, 12 bp, Homo sapiens
atagcgtgtgta

SEQ ID NO: 4274671 - DNA, 15 bp, Homo sapiens
ataggagcttccaga

SEQ ID NO: 4274672 - DNA, 16 bp, Homo sapiens
ataggagcttccagat

SEQ ID NO: 4274673 - DNA, 23 bp, Homo sapiens
ataggtatttcttccagtgatgt

SEQ ID NO: 4274674 - DNA, 12 bp, Homo sapiens
ataggtttctaa

SEQ ID NO: 4274675 - DNA, 16 bp, Homo sapiens
atagtagcagagtcat

SEQ ID NO: 4274676 - DNA, 20 bp, Homo sapiens
atagtatgcactatatacat

SEQ ID NO: 4274677 - DNA, 15 bp, Homo sapiens
atagtggctttcatt

SEQ ID NO: 4274678 - DNA, 21 bp, Homo sapiens
atagtgtgttgtgctttcaag

SEQ ID NO: 4274679 - DNA, 20 bp, Homo sapiens
atagttaattgtggctttat

SEQ ID NO: 4274680 - DNA, 21 bp, Homo sapiens
atagttaattgtggctttatg

SEQ ID NO: 4274681 - DNA, 20 bp, Homo sapiens
atagttctatttctatctgc

SEQ ID NO: 4274682 - DNA, 14 bp, Homo sapiens
atagttgatatgta

SEQ ID NO: 4274683 - DNA, 20 bp, Homo sapiens
atagttgatatgtaacagtt

SEQ ID NO: 4274684 - DNA, 16 bp, Homo sapiens
atagtttgaattcatg

SEQ ID NO: 4274685 - DNA, 22 bp, Homo sapiens
atagtttgttttctttttctgt

SEQ ID NO: 4274686 - DNA, 15 bp, Homo sapiens
atagttttctaaatg

SEQ ID NO: 4274687 - DNA, 16 bp, Homo sapiens
atagttttctaaatgt

SEQ ID NO: 4274688 - DNA, 17 bp, Homo sapiens
atagttttctaaatgtt

SEQ ID NO: 4274689 - DNA, 21 bp, Homo sapiens
atagttttctaaatgtttctt

SEQ ID NO: 4274690 - DNA, 14 bp, Homo sapiens
atataactttagaa

SEQ ID NO: 4274691 - DNA, 19 bp, Homo sapiens
atataataaatatatattt

SEQ ID NO: 4274692 - DNA, 23 bp, Homo sapiens
atataataaatatatatttatca

SEQ ID NO: 4274693 - DNA, 14 bp, Homo sapiens
atatacatgtatag

SEQ ID NO: 4274694 - DNA, 13 bp, Homo sapiens
atatactcattag

SEQ ID NO: 4274695 - DNA, 12 bp, Homo sapiens
atatactgcata

SEQ ID NO: 4274696 - DNA, 23 bp, Homo sapiens
atatagttgaacaagatttccct

SEQ ID NO: 4274697 - DNA, 16 bp, Homo sapiens
atatagtttgttttct

SEQ ID NO: 4274698 - DNA, 23 bp, Homo sapiens
atatagtttgttttctttttctg

SEQ ID NO: 4274699 - DNA, 12 bp, Homo sapiens
atatatacatgt

SEQ ID NO: 4274700 - DNA, 13 bp, Homo sapiens
atatatacatgta

SEQ ID NO: 4274701 - DNA, 19 bp, Homo sapiens
atatatacccccccatgca

SEQ ID NO: 4274702 - DNA, 12 bp, Homo sapiens
atatatctgaaa

SEQ ID NO: 4274703 - DNA, 19 bp, Homo sapiens
atatatgaaaactaagttc

SEQ ID NO: 4274704 - DNA, 14 bp, Homo sapiens
atatcctatactgg

SEQ ID NO: 4274705 - DNA, 22 bp, Homo sapiens
atatctctatttaattttgaca

SEQ ID NO: 4274706 - DNA, 16 bp, Homo sapiens
atatcttgaagaatat

SEQ ID NO: 4274707 - DNA, 13 bp, Homo sapiens
atatctttcagtt

SEQ ID NO: 4274708 - DNA, 19 bp, Homo sapiens
atatgacaatttcaaaatg

SEQ ID NO: 4274709 - DNA, 21 bp, Homo sapiens
atatgacaatttcaaaatgca

SEQ ID NO: 4274710 - DNA, 18 bp, Homo sapiens
atatggggggccaacacc

SEQ ID NO: 4274711 - DNA, 14 bp, Homo sapiens
atatgtaacagttg

SEQ ID NO: 4274712 - DNA, 13 bp, Homo sapiens
atatgtaacatgt

SEQ ID NO: 4274713 - DNA, 15 bp, Homo sapiens
atatgtaacatgtct

SEQ ID NO: 4274714 - DNA, 23 bp, Homo sapiens
atattaaaaagccaagtgtcctg

SEQ ID NO: 4274715 - DNA, 17 bp, Homo sapiens
atattagagtgccctta

SEQ ID NO: 4274716 - DNA, 12 bp, Homo sapiens
atattataagat

SEQ ID NO: 4274717 - DNA, 23 bp, Homo sapiens
atattatttgctaattaaaaagt

SEQ ID NO: 4274718 - DNA, 17 bp, Homo sapiens
atattcattctttataa

SEQ ID NO: 4274719 - DNA, 20 bp, Homo sapiens
atattccaggtttaagtaga

SEQ ID NO: 4274720 - DNA, 23 bp, Homo sapiens
atattcttgctttcacaaatata

SEQ ID NO: 4274721 - DNA, 14 bp, Homo sapiens
atattgagcaatat

SEQ ID NO: 4274722 - DNA, 22 bp, Homo sapiens
atctgctgcctctgaaaatatt

SEQ ID NO: 4274723 - DNA, 15 bp, Homo sapiens
atctggtattaaatg

SEQ ID NO: 4274724 - DNA, 18 bp, Homo sapiens
atctggtattaaatgcca

SEQ ID NO: 4274725 - DNA, 16 bp, Homo sapiens
atctgtaaatttaact

SEQ ID NO: 4274726 - DNA, 17 bp, Homo sapiens
atctgtaaatttaactg

SEQ ID NO: 4274727 - DNA, 18 bp, Homo sapiens
atctgtctgattctatgc

SEQ ID NO: 4274728 - DNA, 14 bp, Homo sapiens
atctgtctgtccta

SEQ ID NO: 4274729 - DNA, 16 bp, Homo sapiens
atctgtttgcttctaa

SEQ ID NO: 4274730 - DNA, 20 bp, Homo sapiens
atcttaaaagctatcttcat

SEQ ID NO: 4274731 - DNA, 12 bp, Homo sapiens
atcttgaagaat

SEQ ID NO: 4274732 - DNA, 17 bp, Homo sapiens
atcttgagcaaggcaag

SEQ ID NO: 4274733 - DNA, 16 bp, Homo sapiens
atctttactggaaatg

SEQ ID NO: 4274734 - DNA, 15 bp, Homo sapiens
atctttgctcccagt

SEQ ID NO: 4274735 - DNA, 19 bp, Homo sapiens
atgaaaaccaccctatcat

SEQ ID NO: 4274736 - DNA, 22 bp, Homo sapiens
atgaaataaattggtgataagt

SEQ ID NO: 4274737 - DNA, 17 bp, Homo sapiens
atgaaataccaactatg

SEQ ID NO: 4274738 - DNA, 22 bp, Homo sapiens
atgaaataggagggaaaccttt

SEQ ID NO: 4274739 - DNA, 15 bp, Homo sapiens
atgaaatatatgtga

SEQ ID NO: 4274740 - DNA, 22 bp, Homo sapiens
atgaaatatttgcttatttata

SEQ ID NO: 4274741 - DNA, 13 bp, Homo sapiens
atgaacactggct

SEQ ID NO: 4274742 - DNA, 12 bp, Homo sapiens
atgaactagcca

SEQ ID NO: 4274743 - DNA, 13 bp, Homo sapiens
atgaactagccat

SEQ ID NO: 4274744 - DNA, 19 bp, Homo sapiens
atgaagaaaagtgggccag

SEQ ID NO: 4274745 - DNA, 13 bp, Homo sapiens
atgaagaagaaaa

SEQ ID NO: 4274746 - DNA, 17 bp, Homo sapiens
atgaagcaaacacacag

SEQ ID NO: 4274747 - DNA, 16 bp, Homo sapiens
atgaataattatgttt

SEQ ID NO: 4274748 - DNA, 23 bp, Homo sapiens
atgaataattgaggttaggaacc

SEQ ID NO: 4274749 - DNA, 15 bp, Homo sapiens
atgacaatttcaaaa

SEQ ID NO: 4274750 - DNA, 17 bp, Homo sapiens
atgacaatttcaaaatg

SEQ ID NO: 4274751 - DNA, 23 bp, Homo sapiens
atgacccggcccccgccctctgc

SEQ ID NO: 4274752 - DNA, 11 bp, Homo sapiens
atgaccctgga

SEQ ID NO: 4274753 - DNA, 13 bp, Homo sapiens
atgacctaaatcc

SEQ ID NO: 4274754 - DNA, 23 bp, Homo sapiens
atgacctaaatccattttctaaa

SEQ ID NO: 4274755 - DNA, 17 bp, Homo sapiens
atgacgtattgtgaaat

SEQ ID NO: 4274756 - DNA, 16 bp, Homo sapiens
atgactataaacatta

SEQ ID NO: 4274757 - DNA, 23 bp, Homo sapiens
atgactataaacattaaaagaag

SEQ ID NO: 4274758 - DNA, 14 bp, Homo sapiens
atgactctttattg

SEQ ID NO: 4274759 - DNA, 16 bp, Homo sapiens
atgagatactttgcat

SEQ ID NO: 4274760 - DNA, 13 bp, Homo sapiens
atgagccagctct

SEQ ID NO: 4274761 - DNA, 17 bp, Homo sapiens
atgagctccagaccccc

SEQ ID NO: 4274762 - DNA, 20 bp, Homo sapiens
atgagctccagacccccagc

SEQ ID NO: 4274763 - DNA, 20 bp, Homo sapiens
atgaggcacgcctgccttct

SEQ ID NO: 4274764 - DNA, 15 bp, Homo sapiens
atgaggggactgcat

SEQ ID NO: 4274765 - DNA, 16 bp, Homo sapiens
atgagtcccagtggga

SEQ ID NO: 4274766 - DNA, 16 bp, Homo sapiens
atgagttcaaatactt

SEQ ID NO: 4274767 - DNA, 18 bp, Homo sapiens
atgagttcaaatactttt

SEQ ID NO: 4274768 - DNA, 15 bp, Homo sapiens
atgatactgtctaag

SEQ ID NO: 4274769 - DNA, 18 bp, Homo sapiens
atgatataataaatatat

SEQ ID NO: 4274770 - DNA, 20 bp, Homo sapiens
atgatattcaatcttaacaa

SEQ ID NO: 4274771 - DNA, 17 bp, Homo sapiens
atgatattgctgaagaa

SEQ ID NO: 4274772 - DNA, 18 bp, Homo sapiens
atgatattgtatgtacct

SEQ ID NO: 4274773 - DNA, 13 bp, Homo sapiens
atgatcttccaaa

SEQ ID NO: 4274774 - DNA, 17 bp, Homo sapiens
atgatggatgagaaaaa

SEQ ID NO: 4274775 - DNA, 15 bp, Homo sapiens
atgattcataacaat

SEQ ID NO: 4274776 - DNA, 11 bp, Homo sapiens
atgattccaaa

SEQ ID NO: 4274777 - DNA, 12 bp, Homo sapiens
atgattccaaat

SEQ ID NO: 4274778 - DNA, 21 bp, Homo sapiens
atgattccaagggcccagagg

SEQ ID NO: 4274779 - DNA, 23 bp, Homo sapiens
atgattcgcccaaagccagacag

SEQ ID NO: 4274780 - DNA, 13 bp, Homo sapiens
atgattctcctct

SEQ ID NO: 4274781 - DNA, 16 bp, Homo sapiens
atgattctcctctccc

SEQ ID NO: 4274782 - DNA, 12 bp, Homo sapiens
atgatttgcaac

SEQ ID NO: 4274783 - DNA, 16 bp, Homo sapiens
atgatttgcaacttta

SEQ ID NO: 4274784 - DNA, 12 bp, Homo sapiens
atgatttttaac

SEQ ID NO: 4274785 - DNA, 20 bp, Homo sapiens
atgattttttacaaattatg

SEQ ID NO: 4274786 - DNA, 22 bp, Homo sapiens
atgcaaagtaccaactgagcca

SEQ ID NO: 4274787 - DNA, 21 bp, Homo sapiens
atgcacatttgtcactgaata

SEQ ID NO: 4274788 - DNA, 16 bp, Homo sapiens
atgcagatctagccag

SEQ ID NO: 4274789 - DNA, 17 bp, Homo sapiens
atgcagatctagccagg

SEQ ID NO: 4274790 - DNA, 17 bp, Homo sapiens
atgcagcttcaggtgag

SEQ ID NO: 4274791 - DNA, 17 bp, Homo sapiens
atgcaggcagcctgcag

SEQ ID NO: 4274792 - DNA, 21 bp, Homo sapiens
atgcagggcccccacaggagc

SEQ ID NO: 4274793 - DNA, 23 bp, Homo sapiens
atgcagtgtagattttatagtgt

SEQ ID NO: 4274794 - DNA, 20 bp, Homo sapiens
atgcatgatattgtatgtac

SEQ ID NO: 4274795 - DNA, 21 bp, Homo sapiens
atgcatgatattgtatgtacc

SEQ ID NO: 4274796 - DNA, 22 bp, Homo sapiens
atgcatgatattgtatgtacct

SEQ ID NO: 4274797 - DNA, 15 bp, Homo sapiens
atgcatggcctccca

SEQ ID NO: 4274798 - DNA, 17 bp, Homo sapiens
atgcatggcctcccagc

SEQ ID NO: 4274799 - DNA, 20 bp, Homo sapiens
atgcatggcctcccagccac

SEQ ID NO: 4274800 - DNA, 15 bp, Homo sapiens
atgccacctgcagcg

SEQ ID NO: 4274801 - DNA, 15 bp, Homo sapiens
atgccacggcagcca

SEQ ID NO: 4274802 - DNA, 18 bp, Homo sapiens
atgccacggcagccaccc

SEQ ID NO: 4274803 - DNA, 20 bp, Homo sapiens
atgccacggcagccaccctg

SEQ ID NO: 4274804 - DNA, 21 bp, Homo sapiens
atgccacggcagccaccctgc

SEQ ID NO: 4274805 - DNA, 15 bp, Homo sapiens
atgccactaggccct

SEQ ID NO: 4274806 - DNA, 16 bp, Homo sapiens
atgccccactctgctg

SEQ ID NO: 4274807 - DNA, 18 bp, Homo sapiens
atgccccactctgctgag

SEQ ID NO: 4274808 - DNA, 16 bp, Homo sapiens
atgccgctgtgtcccc

SEQ ID NO: 4274809 - DNA, 12 bp, Homo sapiens
atgcctgggcct

SEQ ID NO: 4274810 - DNA, 15 bp, Homo sapiens
atgcctgggcctgat

SEQ ID NO: 4274811 - DNA, 19 bp, Homo sapiens
atgcctgtatttccaacaa

SEQ ID NO: 4274812 - DNA, 21 bp, Homo sapiens
atgccttcataaattatttct

SEQ ID NO: 4274813 - DNA, 22 bp, Homo sapiens
atgcctttctagtcctattcta

SEQ ID NO: 4274814 - DNA, 17 bp, Homo sapiens
atgcctttttggttttg

SEQ ID NO: 4274815 - DNA, 18 bp, Homo sapiens
atgcgctcttcaccagga

SEQ ID NO: 4274816 - DNA, 20 bp, Homo sapiens
atgcgctcttcaccaggaag

SEQ ID NO: 4274817 - DNA, 21 bp, Homo sapiens
atgcgctcttcaccaggaaga

SEQ ID NO: 4274818 - DNA, 15 bp, Homo sapiens
atgcggccggcctgg

SEQ ID NO: 4274819 - DNA, 23 bp, Homo sapiens
atgctaatgtaatcatttatctt

SEQ ID NO: 4274820 - DNA, 16 bp, Homo sapiens
atgctagcacaatatt

SEQ ID NO: 4274821 - DNA, 21 bp, Homo sapiens
atgctatctcgctagccatat

SEQ ID NO: 4274822 - DNA, 12 bp, Homo sapiens
atgctccagcca

SEQ ID NO: 4274823 - DNA, 20 bp, Homo sapiens
atgctccagccaacccctgt

SEQ ID NO: 4274824 - DNA, 21 bp, Homo sapiens
atgctccagccaacccctgtg

SEQ ID NO: 4274825 - DNA, 22 bp, Homo sapiens
atgctcccaaatgcagcttcag

SEQ ID NO: 4274826 - DNA, 15 bp, Homo sapiens
atgctcccccatcct

SEQ ID NO: 4274827 - DNA, 20 bp, Homo sapiens
atgctcccccatcctcccct

SEQ ID NO: 4274828 - DNA, 22 bp, Homo sapiens
atgctcccccatcctccccttc

SEQ ID NO: 4274829 - DNA, 23 bp, Homo sapiens
atgctcccccatcctccccttcc

SEQ ID NO: 4274830 - DNA, 14 bp, Homo sapiens
atgctcctctgcct

SEQ ID NO: 4274831 - DNA, 19 bp, Homo sapiens
atgctcctctgcctgtgcc

SEQ ID NO: 4274832 - DNA, 21 bp, Homo sapiens
atgctcctctgcctgtgcccg

SEQ ID NO: 4274833 - DNA, 22 bp, Homo sapiens
atgctgagtatgttaagctctt

SEQ ID NO: 4274834 - DNA, 12 bp, Homo sapiens
atgctgcctgcc

SEQ ID NO: 4274835 - DNA, 21 bp, Homo sapiens
atgctgcctgcctccggccct

SEQ ID NO: 4274836 - DNA, 22 bp, Homo sapiens
atgctgcctgcctccggccctg

SEQ ID NO: 4274837 - DNA, 23 bp, Homo sapiens
atgctgcctgcctccggccctgc

SEQ ID NO: 4274838 - DNA, 14 bp, Homo sapiens
atgctgctgtgaat

SEQ ID NO: 4274839 - DNA, 16 bp, Homo sapiens
atgctgctgtgaattt

SEQ ID NO: 4274840 - DNA, 19 bp, Homo sapiens
atgctgctgtgaatttttt

SEQ ID NO: 4274841 - DNA, 21 bp, Homo sapiens
atgctgggttctggggctgag

SEQ ID NO: 4274842 - DNA, 22 bp, Homo sapiens
atgctgggttctggggctgaga

SEQ ID NO: 4274843 - DNA, 20 bp, Homo sapiens
atgctggtcatcctgggcat

SEQ ID NO: 4274844 - DNA, 14 bp, Homo sapiens
atgctgtatctgtg

SEQ ID NO: 4274845 - DNA, 19 bp, Homo sapiens
atgctgtatgtcattaaag

SEQ ID NO: 4274846 - DNA, 16 bp, Homo sapiens
atgctttgtgtgattg

SEQ ID NO: 4274847 - DNA, 14 bp, Homo sapiens
atggaagagagaaa

SEQ ID NO: 4274848 - DNA, 23 bp, Homo sapiens
atggaagcctccacctgcagccc

SEQ ID NO: 4274849 - DNA, 19 bp, Homo sapiens
atggaagggccttctccac

SEQ ID NO: 4274850 - DNA, 13 bp, Homo sapiens
atggacagggcca

SEQ ID NO: 4274851 - DNA, 14 bp, Homo sapiens
atggacagggccag

SEQ ID NO: 4274852 - DNA, 15 bp, Homo sapiens
atggacagggccagg

SEQ ID NO: 4274853 - DNA, 17 bp, Homo sapiens
atggacagggccagggt

SEQ ID NO: 4274854 - DNA, 14 bp, Homo sapiens
atggacctgcactt

SEQ ID NO: 4274855 - DNA, 16 bp, Homo sapiens
atggactctacactgt

SEQ ID NO: 4274856 - DNA, 15 bp, Homo sapiens
caggtgtcctgactg

SEQ ID NO: 4274857 - DNA, 20 bp, Homo sapiens
caggtgtcctgactgtccta

SEQ ID NO: 4274858 - DNA, 22 bp, Homo sapiens
caggttgtctgaagtcactgca

SEQ ID NO: 4274859 - DNA, 13 bp, Homo sapiens
cagtaaacaccat

SEQ ID NO: 4274860 - DNA, 14 bp, Homo sapiens
cagtaactcatctg

SEQ ID NO: 4274861 - DNA, 19 bp, Homo sapiens
cagtaagctgctctattgt

SEQ ID NO: 4274862 - DNA, 18 bp, Homo sapiens
cagtaatgtcataaagtg

SEQ ID NO: 4274863 - DNA, 14 bp, Homo sapiens
cagtacttgctcaa

SEQ ID NO: 4274864 - DNA, 19 bp, Homo sapiens
cagtacttgctcaataaag

SEQ ID NO: 4274865 - DNA, 20 bp, Homo sapiens
cagtagaaggtcggaggctt

SEQ ID NO: 4274866 - DNA, 19 bp, Homo sapiens
cagtagctgtggggagctg

SEQ ID NO: 4274867 - DNA, 17 bp, Homo sapiens
cagtagtgcctgtgatc

SEQ ID NO: 4274868 - DNA, 14 bp, Homo sapiens
cagtatattttatt

SEQ ID NO: 4274869 - DNA, 16 bp, Homo sapiens
cagtatattttatttc

SEQ ID NO: 4274870 - DNA, 17 bp, Homo sapiens
cagtatattttatttca

SEQ ID NO: 4274871 - DNA, 24 bp, Homo sapiens
cagtatccgcgagcctgcttgctg

SEQ ID NO: 4274872 - DNA, 15 bp, Homo sapiens
cagtcagcacagaga

SEQ ID NO: 4274873 - DNA, 16 bp, Homo sapiens
cagtcagcacagagag

SEQ ID NO: 4274874 - DNA, 13 bp, Homo sapiens
cagtcagggcggg

SEQ ID NO: 4274875 - DNA, 15 bp, Homo sapiens
ctccctgtctgaaac

SEQ ID NO: 4274876 - DNA, 18 bp, Homo sapiens
ctcccttcaaccattccc

SEQ ID NO: 4274877 - DNA, 19 bp, Homo sapiens
ctcccttcaaccattcccc

SEQ ID NO: 4274878 - DNA, 23 bp, Homo sapiens
ctcccttcaaccattccccatgg

SEQ ID NO: 4274879 - DNA, 19 bp, Homo sapiens
ctccctttatcatgtgttt

SEQ ID NO: 4274880 - DNA, 20 bp, Homo sapiens
ctccgcccttccctgacact

SEQ ID NO: 4274881 - DNA, 20 bp, Homo sapiens
ctccgcgggggacaggaaca

SEQ ID NO: 4274882 - DNA, 16 bp, Homo sapiens
ctccggatgacacaaa

SEQ ID NO: 4274883 - DNA, 21 bp, Homo sapiens
ctcctagcacaaggagtgccc

SEQ ID NO: 4274884 - DNA, 17 bp, Homo sapiens
ctcctccagcaagacct

SEQ ID NO: 4274885 - DNA, 14 bp, Homo sapiens
ctcctcccggtgcc

SEQ ID NO: 4274886 - DNA, 11 bp, Homo sapiens
ctcctccctcc

SEQ ID NO: 4274887 - DNA, 20 bp, Homo sapiens
ctcctccctccgctaaggct

SEQ ID NO: 4274888 - DNA, 13 bp, Homo sapiens
ctcctcggccaga

SEQ ID NO: 4274889 - DNA, 17 bp, Homo sapiens
ctcctcggccagagctc

SEQ ID NO: 4274890 - DNA, 21 bp, Homo sapiens
ctcctcggccagagctcccag

SEQ ID NO: 4274891 - DNA, 23 bp, Homo sapiens
ctcctcggccagagctcccagga

SEQ ID NO: 4274892 - DNA, 19 bp, Homo sapiens
ctcctctctctccctccac

SEQ ID NO: 4274893 - DNA, 12 bp, Homo sapiens
ctcctctgcctg

SEQ ID NO: 4274894 - DNA, 18 bp, Homo sapiens
ctcctctgcctgtgcccg

SEQ ID NO: 4274895 - DNA, 22 bp, Homo sapiens
ctcctctgcctgtgcccgctgc

SEQ ID NO: 4274896 - DNA, 13 bp, Homo sapiens
ctcctctgccttg

SEQ ID NO: 4274897 - DNA, 14 bp, Homo sapiens
ctcctctgccttgg

SEQ ID NO: 4274898 - DNA, 17 bp, Homo sapiens
ctcctgcatccctccac

SEQ ID NO: 4274899 - DNA, 19 bp, Homo sapiens
ctcctgcatccctccaccc

SEQ ID NO: 4274900 - DNA, 14 bp, Homo sapiens
ctcctgccctcgtc

SEQ ID NO: 4274901 - DNA, 22 bp, Homo sapiens
ctcctgccctcgtctccctggc

SEQ ID NO: 4274902 - DNA, 21 bp, Homo sapiens
ctcctgctgaccttctgcggc

SEQ ID NO: 4274903 - DNA, 13 bp, Homo sapiens
ctcctgctgagtg

SEQ ID NO: 4274904 - DNA, 14 bp, Homo sapiens
ctcctgctgagtgg

SEQ ID NO: 4274905 - DNA, 20 bp, Homo sapiens
ctcctggacccagcaggggc

SEQ ID NO: 4274906 - DNA, 14 bp, Homo sapiens
ctcctggctcacag

SEQ ID NO: 4274907 - DNA, 15 bp, Homo sapiens
ctcctggctcacagc

SEQ ID NO: 4274908 - DNA, 21 bp, Homo sapiens
ctcctggctcacagccaccac

SEQ ID NO: 4274909 - DNA, 15 bp, Homo sapiens
ctcctgggcatctgg

SEQ ID NO: 4274910 - DNA, 21 bp, Homo sapiens
ctcctgggcatctggccctgc

SEQ ID NO: 4274911 - DNA, 15 bp, Homo sapiens
ctcctgggccagggt

SEQ ID NO: 4274912 - DNA, 12 bp, Homo sapiens
cctcttgccccc

SEQ ID NO: 4274913 - DNA, 14 bp, Homo sapiens
cctcttgggagacg

SEQ ID NO: 4274914 - DNA, 17 bp, Homo sapiens
cctctttcctctctggc

SEQ ID NO: 4274915 - DNA, 15 bp, Homo sapiens
cctgaaatgtttcca

SEQ ID NO: 4274916 - DNA, 22 bp, Homo sapiens
cctgaactaggtgctggcatgt

SEQ ID NO: 4274917 - DNA, 17 bp, Homo sapiens
cctgaagtgaccccagc

SEQ ID NO: 4274918 - DNA, 23 bp, Homo sapiens
cctgaagtgaccccagctccagg

SEQ ID NO: 4274919 - DNA, 19 bp, Homo sapiens
cctgacactgtctgctgcc

SEQ ID NO: 4274920 - DNA, 20 bp, Homo sapiens
cctgacactgtctgctgccc

SEQ ID NO: 4274921 - DNA, 18 bp, Homo sapiens
cctgagcttggccagaag

SEQ ID NO: 4274922 - DNA, 17 bp, Homo sapiens
cctgaggagcagcccac

SEQ ID NO: 4274923 - DNA, 22 bp, Homo sapiens
cctgaggagcagcccacctgct

SEQ ID NO: 4274924 - DNA, 15 bp, Homo sapiens
cctgagggcccttcc

SEQ ID NO: 4274925 - DNA, 9 bp, Homo sapiens
cctgagggg

SEQ ID NO: 4274926 - DNA, 11 bp, Homo sapiens
cctgaggggca

SEQ ID NO: 4274927 - DNA, 17 bp, Homo sapiens
cctgaggggcctgccac

SEQ ID NO: 4274928 - DNA, 16 bp, Homo sapiens
cctgatggccaggcct

SEQ ID NO: 4274929 - DNA, 23 bp, Homo sapiens
cctgatggccaggcctcagggac

SEQ ID NO: 4274930 - DNA, 17 bp, Homo sapiens
cctgcaagtggacgtgg

SEQ ID NO: 4274931 - DNA, 20 bp, Homo sapiens
cctgcacacacctgcacacc

SEQ ID NO: 4274932 - DNA, 15 bp, Homo sapiens
cctgcacacccctgc

SEQ ID NO: 4274933 - DNA, 20 bp, Homo sapiens
cctgcacacccctgcacaca

SEQ ID NO: 4274934 - DNA, 22 bp, Homo sapiens
cctgcagaccacactctgcctg

SEQ ID NO: 4274935 - DNA, 14 bp, Homo sapiens
cctgcagcagagcc

SEQ ID NO: 4274936 - DNA, 18 bp, Homo sapiens
cctgcagccccaggcctc

SEQ ID NO: 4274937 - DNA, 22 bp, Homo sapiens
cctgcaggcggtatccagaggt

SEQ ID NO: 4274938 - DNA, 14 bp, Homo sapiens
cctgcagggagcag

SEQ ID NO: 4274939 - DNA, 19 bp, Homo sapiens
cctgcagggagcagcacgc

SEQ ID NO: 4274940 - DNA, 14 bp, Homo sapiens
cctgcagggtaggg

SEQ ID NO: 4274941 - DNA, 18 bp, Homo sapiens
cctgcagttggcctcagc

SEQ ID NO: 4274942 - DNA, 14 bp, Homo sapiens
cctgcatcatcttg

SEQ ID NO: 4274943 - DNA, 17 bp, Homo sapiens
cctgcatccctccaccc

SEQ ID NO: 4274944 - DNA, 16 bp, Homo sapiens
cctgcatcccttggcc

SEQ ID NO: 4274945 - DNA, 19 bp, Homo sapiens
cctgcatcccttggcccct

SEQ ID NO: 4274946 - DNA, 16 bp, Homo sapiens
cctgccaactttccag

SEQ ID NO: 4274947 - DNA, 17 bp, Homo sapiens
cctgccactctcctgag

SEQ ID NO: 4274948 - DNA, 12 bp, Homo sapiens
cctgccagaggc

SEQ ID NO: 4274949 - DNA, 15 bp, Homo sapiens
cctgccagaggcctg

SEQ ID NO: 4274950 - DNA, 18 bp, Homo sapiens
cctgccatggaggcgcct

SEQ ID NO: 4274951 - DNA, 14 bp, Homo sapiens
cctgccccacacag

SEQ ID NO: 4274952 - DNA, 17 bp, Homo sapiens
cctgccccacacaggcc

SEQ ID NO: 4274953 - DNA, 11 bp, Homo sapiens
cctgccccaga

SEQ ID NO: 4274954 - DNA, 12 bp, Homo sapiens
cctgccccagag

SEQ ID NO: 4274955 - DNA, 13 bp, Homo sapiens
cctgccccagaga

SEQ ID NO: 4274956 - DNA, 16 bp, Homo sapiens
cctgccccagagaagc

SEQ ID NO: 4274957 - DNA, 23 bp, Homo sapiens
cctgccccagagaagcctcagtc

SEQ ID NO: 4274958 - DNA, 19 bp, Homo sapiens
cctgccccatcccatccct

SEQ ID NO: 4274959 - DNA, 21 bp, Homo sapiens
cctgccccccacattctggct

SEQ ID NO: 4274960 - DNA, 22 bp, Homo sapiens
cctgccccccacattctggctc

SEQ ID NO: 4274961 - DNA, 20 bp, Homo sapiens
cctgccccccttcccacccc

SEQ ID NO: 4274962 - DNA, 22 bp, Homo sapiens
cctgccccccttcccaccccta

SEQ ID NO: 4274963 - DNA, 17 bp, Homo sapiens
cctgcccccgctctgcc

SEQ ID NO: 4274964 - DNA, 18 bp, Homo sapiens
cctgcccccttctcccac

SEQ ID NO: 4274965 - DNA, 18 bp, Homo sapiens
cctgccccgccccccaga

SEQ ID NO: 4274966 - DNA, 21 bp, Homo sapiens
cctgccccgccccccagagcc

SEQ ID NO: 4274967 - DNA, 23 bp, Homo sapiens
cctgccccgccccccagagccag

SEQ ID NO: 4274968 - DNA, 17 bp, Homo sapiens
cctgcccctgccccgtc

SEQ ID NO: 4274969 - DNA, 13 bp, Homo sapiens
cctgccctcactc

SEQ ID NO: 4274970 - DNA, 16 bp, Homo sapiens
cctgcccttcagcatc

SEQ ID NO: 4274971 - DNA, 15 bp, Homo sapiens
cctgcctaggagctg

SEQ ID NO: 4274972 - DNA, 17 bp, Homo sapiens
cctgcctccggccctgc

SEQ ID NO: 4274973 - DNA, 20 bp, Homo sapiens
cctgcctctgaactgctgct

SEQ ID NO: 4274974 - DNA, 12 bp, Homo sapiens
cctgcctggccc

SEQ ID NO: 4274975 - DNA, 20 bp, Homo sapiens
cctgcctggccctcctctgg

SEQ ID NO: 4274976 - DNA, 14 bp, Homo sapiens
cctgccttcatgga

SEQ ID NO: 4274977 - DNA, 20 bp, Homo sapiens
cctgccttttagttcctgtg

SEQ ID NO: 4274978 - DNA, 22 bp, Homo sapiens
cctgccttttagttcctgtgca

SEQ ID NO: 4274979 - DNA, 19 bp, Homo sapiens
cgtgccacgcgctctgcat

SEQ ID NO: 4274980 - DNA, 21 bp, Homo sapiens
cgtgccacgcgctctgcatgc

SEQ ID NO: 4274981 - DNA, 22 bp, Homo sapiens
cgtgccacgcgctctgcatgct

SEQ ID NO: 4274982 - DNA, 21 bp, Homo sapiens
cgtggaaagggtgctgcttcc

SEQ ID NO: 4274983 - DNA, 20 bp, Homo sapiens
cgtggagccacaggcagacg

SEQ ID NO: 4274984 - DNA, 18 bp, Homo sapiens
cgtggaggaatgctcccc

SEQ ID NO: 4274985 - DNA, 21 bp, Homo sapiens
cgtggagtcgagctggccgac

SEQ ID NO: 4274986 - DNA, 16 bp, Homo sapiens
cgtggcatcttaaaag

SEQ ID NO: 4274987 - DNA, 19 bp, Homo sapiens
cgtggcttcccgctcagcc

SEQ ID NO: 4274988 - DNA, 21 bp, Homo sapiens
cgtggcttcccgctcagccct

SEQ ID NO: 4274989 - DNA, 16 bp, Homo sapiens
cgtggctttgtgctta

SEQ ID NO: 4274990 - DNA, 18 bp, Homo sapiens
cgtgggatccagagagaa

SEQ ID NO: 4274991 - DNA, 21 bp, Homo sapiens
cgtgggatccagagagaagca

SEQ ID NO: 4274992 - DNA, 13 bp, Homo sapiens
cgtgggctccagg

SEQ ID NO: 4274993 - DNA, 22 bp, Homo sapiens
cgtggtatgtgaattgaagtca

SEQ ID NO: 4274994 - DNA, 15 bp, Homo sapiens
cgtgtcaatgtgtgc

SEQ ID NO: 4274995 - DNA, 14 bp, Homo sapiens
cgtgtcctatcccc

SEQ ID NO: 4274996 - DNA, 17 bp, Homo sapiens
cgtgtctgtggccctct

SEQ ID NO: 4274997 - DNA, 19 bp, Homo sapiens
cgtgtgctccagtgttttc

SEQ ID NO: 4274998 - DNA, 16 bp, Homo sapiens
cgttatctcattgcaa

SEQ ID NO: 4274999 - DNA, 22 bp, Homo sapiens
cgttatctcattgcaaaaatat

SEQ ID NO: 4275000 - DNA, 19 bp, Homo sapiens
cgttcaacttttcctttga

SEQ ID NO: 4275001 - DNA, 17 bp, Homo sapiens
cgttgttgtccctgcag

SEQ ID NO: 4275002 - DNA, 18 bp, Homo sapiens
ctaaaaagtcagatgttt

SEQ ID NO: 4275003 - DNA, 17 bp, Homo sapiens
ctaaaatactcaccaaa

SEQ ID NO: 4275004 - DNA, 22 bp, Homo sapiens
ctaaaatactcaccaaaatata

SEQ ID NO: 4275005 - DNA, 15 bp, Homo sapiens
ctaaaattcaacaaa

SEQ ID NO: 4275006 - DNA, 22 bp, Homo sapiens
ctaaaattctagtctctgattt

SEQ ID NO: 4275007 - DNA, 17 bp, Homo sapiens
ctaaactgttttcatgt

SEQ ID NO: 4275008 - DNA, 21 bp, Homo sapiens
ctaaaggggacagatcttgag

SEQ ID NO: 4275009 - DNA, 22 bp, Homo sapiens
ctaaatccattttctaaactgt

SEQ ID NO: 4275010 - DNA, 14 bp, Homo sapiens
ctaaatgcaaagca

SEQ ID NO: 4275011 - DNA, 18 bp, Homo sapiens
ctaaatgcctaataaaca

SEQ ID NO: 4275012 - DNA, 13 bp, Homo sapiens
ctaaatgttcatg

SEQ ID NO: 4275013 - DNA, 19 bp, Homo sapiens
ctaaattacaattgtcatt

SEQ ID NO: 4275014 - DNA, 16 bp, Homo sapiens
ctaacactggccccta

SEQ ID NO: 4275015 - DNA, 17 bp, Homo sapiens
ctaacattattactttt

SEQ ID NO: 4275016 - DNA, 18 bp, Homo sapiens
ctaactgattcagggccc

SEQ ID NO: 4275017 - DNA, 13 bp, Homo sapiens
ctaacttttgtgt

SEQ ID NO: 4275018 - DNA, 17 bp, Homo sapiens
ctaacttttgtgtgaaa

SEQ ID NO: 4275019 - DNA, 17 bp, Homo sapiens
ctaagaacccatggaaa

SEQ ID NO: 4275020 - DNA, 13 bp, Homo sapiens
ctaagaataaata

SEQ ID NO: 4275021 - DNA, 16 bp, Homo sapiens
ctaagaataaataaag

SEQ ID NO: 4275022 - DNA, 22 bp, Homo sapiens
ctaagaataaataaagaagaaa

SEQ ID NO: 4275023 - DNA, 14 bp, Homo sapiens
ctaagattgtacat

SEQ ID NO: 4275024 - DNA, 23 bp, Homo sapiens
ctaagcaggaaggtctcatgcct

SEQ ID NO: 4275025 - DNA, 12 bp, Homo sapiens
ctaagcctggac

SEQ ID NO: 4275026 - DNA, 20 bp, Homo sapiens
ctaagcctggacacagtcag

SEQ ID NO: 4275027 - DNA, 22 bp, Homo sapiens
ctaagcctggacacagtcaggg

SEQ ID NO: 4275028 - DNA, 18 bp, Homo sapiens
ctaagctgttggaagggg

SEQ ID NO: 4275029 - DNA, 10 bp, Homo sapiens
ctaagtgact

SEQ ID NO: 4275030 - DNA, 17 bp, Homo sapiens
ctaatcagcattctcac

SEQ ID NO: 4275031 - DNA, 16 bp, Homo sapiens
ctaattaaaaagttaa

SEQ ID NO: 4275032 - DNA, 15 bp, Homo sapiens
ctaattaatttcagt

SEQ ID NO: 4275033 - DNA, 17 bp, Homo sapiens
ctaattaatttcagtaa

SEQ ID NO: 4275034 - DNA, 20 bp, Homo sapiens
ctacactgtgaacttgggga

SEQ ID NO: 4275035 - DNA, 18 bp, Homo sapiens
ctacagccaaattgcaga

SEQ ID NO: 4275036 - DNA, 18 bp, Homo sapiens
ctacagctaatcagcatt

SEQ ID NO: 4275037 - DNA, 20 bp, Homo sapiens
ctacagtagctgtggggagc

SEQ ID NO: 4275038 - DNA, 23 bp, Homo sapiens
ctacagtagctgtggggagctgg

SEQ ID NO: 4275039 - DNA, 19 bp, Homo sapiens
ctacataactaatacagct

SEQ ID NO: 4275040 - DNA, 22 bp, Homo sapiens
ctacataattaaattttaatgt

SEQ ID NO: 4275041 - DNA, 16 bp, Homo sapiens
ctaccacttatttcta

SEQ ID NO: 4275042 - DNA, 20 bp, Homo sapiens
ctaccccaggacgcatgcag

SEQ ID NO: 4275043 - DNA, 22 bp, Homo sapiens
ctacccggctcgttcccccagg

SEQ ID NO: 4275044 - DNA, 23 bp, Homo sapiens
ctacccggctcgttcccccaggg

SEQ ID NO: 4275045 - DNA, 22 bp, Homo sapiens
ctaccgagtctcttctccactg

SEQ ID NO: 4275046 - DNA, 11 bp, Homo sapiens
ctacctgcagg

SEQ ID NO: 4275047 - DNA, 14 bp, Homo sapiens
ctacgcagaagaga

SEQ ID NO: 4275048 - DNA, 22 bp, Homo sapiens
ctacggttccctgcctaggagc

SEQ ID NO: 4275049 - DNA, 13 bp, Homo sapiens
ctactaagaataa

SEQ ID NO: 4275050 - DNA, 21 bp, Homo sapiens
ctactaagaataaataaagaa

SEQ ID NO: 4275051 - DNA, 16 bp, Homo sapiens
ctactgattgaatgtt

SEQ ID NO: 4275052 - DNA, 18 bp, Homo sapiens
ctactttcctgatgttga

SEQ ID NO: 4275053 - DNA, 21 bp, Homo sapiens
ctactttggtttctgtctgta

SEQ ID NO: 4275054 - DNA, 22 bp, Homo sapiens
ctagaaggatgaacagttctcc

SEQ ID NO: 4275055 - DNA, 13 bp, Homo sapiens
ctagacaaccctg

SEQ ID NO: 4275056 - DNA, 16 bp, Homo sapiens
ctagacaaccctgcaa

SEQ ID NO: 4275057 - DNA, 20 bp, Homo sapiens
ctagactgggctggctgcct

SEQ ID NO: 4275058 - DNA, 21 bp, Homo sapiens
ctagactgggctggctgcctt

SEQ ID NO: 4275059 - DNA, 22 bp, Homo sapiens
ctagactgggctggctgccttc

SEQ ID NO: 4275060 - DNA, 21 bp, Homo sapiens
ctctggcactccagaacaaac

SEQ ID NO: 4275061 - DNA, 20 bp, Homo sapiens
ctctggcaggtggccagggc

SEQ ID NO: 4275062 - DNA, 14 bp, Homo sapiens
ctctggccctgttg

SEQ ID NO: 4275063 - DNA, 18 bp, Homo sapiens
ctctggcctgggaaaagg

SEQ ID NO: 4275064 - DNA, 20 bp, Homo sapiens
ctctggccttggttcctcca

SEQ ID NO: 4275065 - DNA, 22 bp, Homo sapiens
ctctggccttggttcctccagc

SEQ ID NO: 4275066 - DNA, 15 bp, Homo sapiens
ctctgggcaggacct

SEQ ID NO: 4275067 - DNA, 22 bp, Homo sapiens
ctctgggctcacaccagccctg

SEQ ID NO: 4275068 - DNA, 23 bp, Homo sapiens
ctctgggctcacaccagccctgg

SEQ ID NO: 4275069 - DNA, 15 bp, Homo sapiens
ctctggggcttgcta

SEQ ID NO: 4275070 - DNA, 14 bp, Homo sapiens
ctctggtccttctg

SEQ ID NO: 4275071 - DNA, 22 bp, Homo sapiens
ctctggtttggggcgaggcaga

SEQ ID NO: 4275072 - DNA, 19 bp, Homo sapiens
ctctgtcactaaatggcag

SEQ ID NO: 4275073 - DNA, 21 bp, Homo sapiens
ctctgtctggctgtacgtctg

SEQ ID NO: 4275074 - DNA, 19 bp, Homo sapiens
ctctgtgctaagttgtctt
